United States Patent 11,446,398 (REGULATED BIOCIRCUIT SYSTEMS) - sequence listing, part 22

SEQ ID NO: 99564 - protein, 592 aa, Homo sapiens
  Payload ID: 19851
  Gene Name: zinc finger protein 280D
  Uniprot ID: Q6N043
  ENSP ID: ENSP00000453636
MGDNPFQPKSNSKMAELFMECEEEELEPWQKKVKEVEDDDDDEPIFVGEISSSKPAISNILNRVNPSSYSRGLKNGALSRGITAAFKPTSQHYTNPTSNPVPASPINFHPESRSSDSSVIVQPFSKPGYITNSSRVVSNKSSELLFDLTQDTGLSHYQGGPTLSMAGMSESSFLSKRPSTSEVNNVNPKKPKPSESVSGANSSAVLPSVKSPSVTSSQAMLAKGTNTSSNQSKNGTPFPRACPKCNIHFNLLDPLKNHMKYCCPDMINNFLGLAKTEFSSTVNKNTTIDSEKGKLIMLVNDFYYGKHEGDVQEEQKTHTTFKCFSCLKILKNNIRFMNHMKHHLELEKQSSESWENHTTCQHCYRQFPTPFQLQCHIESTHTPHEFSTICKICELSFETEHVLLQHMKDNHKPGEMPYVCQVCNYRSSSFSDVETHFRTSHENTKNLLCPFCLKVIKIATPYMHHYMKHQKKGIHRCTKCRLQFLTCKEKMDHKTQHHRTFIKPKQLEGLPPGTKVTIRASVGPLQSGASPTPSISASASTLQLSPPRTKNITAKNPAKSNTSKPNTVKSNASKPNTSIVGAFTNALSVVPK

SEQ ID NO: 99565 - protein, 158 aa, Homo sapiens
  Payload ID: 19851
  Gene Name: zinc finger protein 280D
  Uniprot ID: Q6N043
  ENSP ID: ENSP00000453706
MGDNPFQPKSNSKMAELFMECEEEELEPWQKKVKEVEDDDDDEPIFVGEISSSKPAISNILNRVNPSSYSRGLKNGALSRGITAAFKPTSQHYTNPTSNPVPASPINFHPESRSSDSSVIVQPFSKPVSVSKTIRPAQGSIGCCLSISTVPSYNSGLS

SEQ ID NO: 99566 - protein, 80 aa, Homo sapiens
  Payload ID: 19851
  Gene Name: zinc finger protein 280D
  ENSP ID: ENSP00000453912
MGDNPFQPKSNSKMAELFMECEEEELEPWQKKVKEVEDDDDDEPIFVGEISSSKPAISNILNRVNPSSYSRGLKNGALSR

SEQ ID NO: 99567 - protein, 966 aa, Homo sapiens
  Payload ID: 19851
  Gene Name: zinc finger protein 280D
  Uniprot ID: Q6N043
  ENSP ID: ENSP00000454111
MAELFMECEEEELEPWQKKVKEVEDDDDDEPIFVGEISSSKPAISNILNRVNPSSYSRGLKNGALSRGITAAFKPTSQHYTNPTSNPVPASPINFHPESRSSDSSVIVQPFSKPGYITNSSRVVSNKSSELLFDLTQDTGLSHYQGGPTLSMAGMSESSFLSKRPSTSEVNNVNPKKPKPSESVSGANSSAVLPSVKSPSVTSSQAMLAKGTNTSSNQSKNGTPFPRACPKCNIHFNLLDPLKNHMKYCCPDMINNFLGLAKTEFSSTVNKNTTIDSEKGKLIMLVNDFYYGKHEGDVQEEQKTHTTFKCFSCLKILKNNIRFMNHMKHHLELEKQSSESWENHTTCQHCYRQFPTPFQLQCHIESTHTPHEFSTICKICELSFETEHVLLQHMKDNHKPGEMPYVCQVCNYRSSSFSDVETHFRTSHENTKNLLCPFCLKVIKIATPYMHHYMKHQKKGIHRCTKCRLQFLTCKEKMDHKTQHHRTFIKPKQLEGLPPGTKVTIRASVGPLQSGASPTPSISASASTLQLSPPRTKNITAKNPAKSNTSKPNTVKSNASKPNTSKPNGSKSKYKPKISNMQKKQSTLASSNKKSKVNTALRNLRYRRGIHKCIECCSEIKDFANHFPTYVHCSFCRYNTSCSKAYVNHMMSFHSNRPSKRFCIFKKHSENLRGITLVCLNCDFLSDVSGLDNMATHLSQHKTHTCQVVMQKVSVCIPTSEHLSELKKEAPAKEQEPVSKEIARPNMAERETETSNSESKQDKAASSKEKNGCNANSFEGSSTTKSEESITVSDKENETCLADQETGSKNIVSCDSNIGADKVEKKKQIQHVCQEMELKMCQSSENIILSDQIKDHNSSEARFSSKNIKDLRLASDNVSIDQFLRKRHEPESVSSDVSEQGSIHLEPLTPSEVLEYEATEILQKGSGDPSAKTDEVVSDQTDDIPGGNNPSTTEATVDLEDEKERS

SEQ ID NO: 99568 - protein, 421 aa, Homo sapiens
  Payload ID: 19851
  Gene Name: zinc finger protein 280D
  Uniprot ID: Q6N043
  ENSP ID: ENSP00000454173
MLVNDFYYGKHEGDVQEEQKTHTTFKCFSCLKILKNNIRFMNHMKHHLELEKQSSESWENHTTCQHCYRQFPTPFQLQCHIESTHTPHEFSTICKICELSFETEHVLLQHMKDNHKPGEMPYVCQVCNYRSSSFSDVETHFRTSHENTKNLLCPFCLKVIKIATPYMHHYMKHQKKGIHRCTKCRLQFLTCKEKMDHKTQHHRTFIKPKQLEGLPPGTKVTIRASVGPLQSGASPTPSISASASTLQLSPPRTKNITAKNPAKSNTSKPNTVKSNASKPNTSKPNGSKSKYKPKISNMQKKQSTLASSNKKSKVNTALRNLRYRRGIHKCIECCSEIKDFANHFPTYVHCSFCRYNTSCSKAYVNHMMSFHSNRPSKRFCIFKKHSENLRCVGGQIECDLPKLHKLVVEPRLTLGLLTPNF

SEQ ID NO: 99569 - protein, 895 aa, Homo sapiens
  Payload ID: 19852
  Gene Name: zinc finger protein 281
  Uniprot ID: Q9Y2X9
  ENSP ID: ENSP00000294740
MKIGSGFLSGGGGTGSSGGSGSGGGGSGGGGGGGSSGRRAEMEPTFPQGMVMFNHRLPPVTSFTRPAGSAAPPPQCVLSSSTSAAPAAEPPPPPAPDMTFKKEPAASAAAFPSQRTSWGFLQSLVSIKQEKPADPEEQQSHHHHHHHHYGGLFAGAEERSPGLGGGEGGSHGVIQDLSILHQHVQQQPAQHHRDVLLSSSSRTDDHHGTEEPKQDTNVKKAKRPKPESQGIKAKRKPSASSKPSLVGDGEGAILSPSQKPHICDHCSAAFRSSYHLRRHVLIHTGERPFQCSQCSMGFIQKYLLQRHEKIHSREKPFGCDQCSMKFIQKYHMERHKRTHSGEKPYKCDTCQQYFSRTDRLLKHRRTCGEVIVKGATSAEPGSSNHTNMGNLAVLSQGNTSSSRRKTKSKSIAIENKEQKTGKTNESQISNNINMQSYSVEMPTVSSSGGIIGTGIDELQKRVPKLIFKKGSRKNTDKNYLNFVSPLPDIVGQKSLSGKPSGSLGIVSNNSVETIGLLQSTSGKQGQISSNYDDAMQFSKKRRYLPTASSNSAFSINVGHMVSQQSVIQSAGVSVLDNEAPLSLIDSSALNAEIKSCHDKSGIPDEVLQSILDQYSNKSESQKEDPFNIAEPRVDLHTSGEHSELVQEENLSPGTQTPSNDKASMLQEYSKYLQQAFEKSTNASFTLGHGFQFVSLSSPLHNHTLFPEKQIYTTSPLECGFGQSVTSVLPSSLPKPPFGMLFGSQPGLYLSALDATHQQLTPSQELDDLIDSQKNLETSSAFQSSSQKLTSQKEQKNLESSTGFQIPSQELASQIDPQKDIEPRTTYQIENFAQAFGSQFKSGSRVPMTFITNSNGEVDHRVRTSVSDFSGYTNMMSDVSEPCSTRVKTPTSQSYR

SEQ ID NO: 99570 - protein, 859 aa, Homo sapiens
  Payload ID: 19852
  Gene Name: zinc finger protein 281
  Uniprot ID: Q9Y2X9
  ENSP ID: ENSP00000356321
MKIGSGFLSGGGGTGSSGGSGSGGGGSGGGGGGGSSGRRAEMEPTFPQAPAAEPPPPPAPDMTFKKEPAASAAAFPSQRTSWGFLQSLVSIKQEKPADPEEQQSHHHHHHHHYGGLFAGAEERSPGLGGGEGGSHGVIQDLSILHQHVQQQPAQHHRDVLLSSSSRTDDHHGTEEPKQDTNVKKAKRPKPESQGIKAKRKPSASSKPSLVGDGEGAILSPSQKPHICDHCSAAFRSSYHLRRHVLIHTGERPFQCSQCSMGFIQKYLLQRHEKIHSREKPFGCDQCSMKFIQKYHMERHKRTHSGEKPYKCDTCQQYFSRTDRLLKHRRTCGEVIVKGATSAEPGSSNHTNMGNLAVLSQGNTSSSRRKTKSKSIAIENKEQKTGKTNESQISNNINMQSYSVEMPTVSSSGGIIGTGIDELQKRVPKLIFKKGSRKNTDKNYLNFVSPLPDIVGQKSLSGKPSGSLGIVSNNSVETIGLLQSTSGKQGQISSNYDDAMQFSKKRRYLPTASSNSAFSINVGHMVSQQSVIQSAGVSVLDNEAPLSLIDSSALNAEIKSCHDKSGIPDEVLQSILDQYSNKSESQKEDPFNIAEPRVDLHTSGEHSELVQEENLSPGTQTPSNDKASMLQEYSKYLQQAFEKSTNASFTLGHGFQFVSLSSPLHNHTLFPEKQIYTTSPLECGFGQSVTSVLPSSLPKPPFGMLFGSQPGLYLSALDATHQQLTPSQELDDLIDSQKNLETSSAFQSSSQKLTSQKEQKNLESSTGFQIPSQELASQIDPQKDIEPRTTYQIENFAQAFGSQFKSGSRVPMTFITNSNGEVDHRVRTSVSDFSGYTNMMSDVSEPCSTRVKTPTSQSYR

SEQ ID NO: 99571 - protein, 895 aa, Homo sapiens; identical to SEQ ID NO: 99569
  Payload ID: 19852
  Gene Name: zinc finger protein 281
  Uniprot ID: Q9Y2X9
  ENSP ID: ENSP00000356322

SEQ ID NO: 99572 - protein, 463 aa, Homo sapiens
  Payload ID: 19853
  Gene Name: zinc finger protein 282
  Uniprot ID: Q9UDV7
  ENSP ID: ENSP00000418840
MQFVSTRPQPQQLGIQGLGLDSGSWSWAQALPPEEVCHQEPALRGEMAEGMPPMQAQEWDMDARRPMPFQFPPFPDRAPVFPDRMMREPQLPTAEISLWTVVAAIQAVERKVDAQASQLLNLEGRTGTAEKKLADCEKTAVEFGNHMESKWAVLGTLLQEYGLLQRRLENLENLLRNRNFWVLRLPPGSKGEAPKVPVTFVDIAVYFSEDEWKNLDEWQKELYNNLVKENYKTLMSLDAEGSVPKPDAPVQAEPREEPCVWEQRHPEEREIPMDPEAGAEPLVPAQDASSQVKREDTLCVRGQRGLEERAIPTESITDSPISAQDLLSRIKQEEHQCVWDQQDLADRDIPTDPNSESLISAHDILSWIKQEEQPYPWGPRDSMDGELGLDSGPSDSLLMVKNPPPAPPQPQPQPQPPQPQLQSQPQPQSLPPIAVAENPGGPPSRGLLDDGFQPHQGAALRVR

SEQ ID NO: 99573 - protein, 671 aa, Homo sapiens
  Payload ID: 19853
  Gene Name: zinc finger protein 282
  Uniprot ID: Q9UDV7
  ENSP ID: ENSP00000477841
MQFVSTRPQPQQLGIQGLGLDSGSWSWAQALPPEEVCHQEPALRGEMAEGMPPMQAQEWDMDARRPMPFQFPPFPDRAPVFPDRMMREPQLPTAEISLWTVVAAIQAVERKVDAQASQLLNLEGRTGTAEKKLADCEKTAVEFGNHMESKWAVLGTLLQEYGLLQRRLENLENLLRNRNFWVLRLPPGSKGEAPKVPVTFVDIAVYFSEDEWKNLDEWQKELYNNLVKENYKTLMSLDAEGSVPKPDAPVQAEPREEPCVWEQRHPEEREIPMDPEAGAEPLVPAQDASSQVKREDTLCVRGQRGLEERAIPTESITDSPISAQDLLSRIKQEEHQCVWDQQDLADRDIPTDPNSESLISAHDILSWIKQEEQPYPWGPRDSMDGELGLDSGPSDSLLMVKNPPPAPPQPQPQPQPPQPQLQSQPQPQSLPPIAVAENPGGPPSRGLLDDGFQVLPGERGSGEAPPGGDRSTGGGGGDGGGGGGGAEAGTGAGGGCGSCCPGGLRRSLLLHGARSKPYSCPECGKSFGVRKSLIIHHRSHTKERPYECAECEKSFNCHSGLIRHQMTHRGERPYKCSECEKTYSRKEHLQNHQRLHTGERPFQCALCGKSFIRKQNLLKHQRIHTGERPYTCGECGKSFRYKESLKDHLRVHSGGPGPGAPRQLPPPPERD

SEQ ID NO: 99574 - protein, 679 aa, Homo sapiens
  Payload ID: 19854
  Gene Name: zinc finger protein 283
  Uniprot ID: Q8N7M2
  ENSP ID: ENSP00000327314
MESRSVAQAGVQWCDLGSLQAPPPGFTLFSCLSLLSSWDYSSGFSGFCASPIEESHGALISSCNSRTMTDGLVTFRDVAIDFSQEEWECLDPAQRDLYVDVMLENYSNLVSLDLESKTYETKKIFSENDIFEINFSQWEMKDKSKTLGLEASIFRNNWKCKSIFEGLKGHQEGYFSQMIISYEKIPSYRKSKSLTPHQRIHNTEKSYVCKECGKACSHGSKLVQHERTHTAEKHFECKECGKNYLSAYQLNVHQRFHTGEKPYECKECGKTFSWGSSLVKHERIHTGEKPYECKECGKAFSRGYHLTQHQKIHTGVKSYKCKECGKAFFWGSSLAKHEIIHTGEKPYKCKECGKAFSRGYQLTQHQKIHTGKKPYECKICGKAFCWGYQLTRHQIFHTGEKPYECKECGKAFNCGSSLIQHERIHTGEKPYECKECGKAFSRGYHLSQHQKIHTGEKPFECKECGKAFSWGSSLVKHERVHTGEKSHECKECGKTFCSGYQLTRHQVFHTGEKPYECKECGKAFNCGSSLVQHERIHTGEKPYECKECGKAFSRGYHLTQHQKIHTGEKPFKCKECGKAFSWGSSLVKHERVHTNEKSYECKDCGKAFGSGYQLSVHQRFHTGEKLYQRKEFGKTFTCGSKLVHERTHSNDKPYKYNECGEAFLWTTYSNEKIDTDETL

SEQ ID NO: 99575 - protein, 79 aa, Homo sapiens
  Payload ID: 19854
  Gene Name: zinc finger protein 283
  ENSP ID: ENSP00000465054
MCLITLNNSYRMFESCSGFSGFCASPIEESHGALISSCNSRTMTDGLVTFRDVAIDFSQEEWECLDPAQRDFRDEVSPC

SEQ ID NO: 99576 - protein, 45 aa, Homo sapiens
  Payload ID: 19854
  Gene Name: zinc finger protein 283
  ENSP ID: ENSP00000465942
MTDGLVTFRDVAIDFSQEEWECLDPAQRDLYVDVMLENYSNLVSL

SEQ ID NO: 99577 - protein, 94 aa, Homo sapiens [sequence omitted]

SEQ ID NO: 99578 - protein, 107 aa, Homo sapiens
  Payload ID: 19854
  Gene Name: zinc finger protein 283
  ENSP ID: ENSP00000468508
MESRSVAQAGVQWCDLGSLQAPPPGFTLFSCLSLLSSWDYSSGFSGFCASPIEESHGALISSCNSRTMTDGLVTFRDVAIDFSQEEWECLDPAQRDFFLHWKLQGYL

SEQ ID NO: 99579 - protein, 540 aa, Homo sapiens
  Payload ID: 19854
  Gene Name: zinc finger protein 283
  ENSP ID: ENSP00000468708
MKDKSKTLGLEASIFRNNWKCKSIFEGLKGHQEGYFSQMIISYEKIPSYRKSKSLTPHQRIHNTEKSYVCKECGKACSHGSKLVQHERTHTAEKHFECKECGKNYLSAYQLNVHQRFHTGEKPYECKECGKTFSWGSSLVKHERIHTGEKPYECKECGKAFSRGYHLTQHQKIHTGVKSYKCKECGKAFFWGSSLAKHEIIHTGEKPYKCKECGKAFSRGYQLTQHQKIHTGKKPYECKICGKAFCWGYQLTRHQIFHTGEKPYECKECGKAFNCGSSLIQHERIHTGEKPYECKECGKAFSRGYHLSQHQKIHTGEKPFECKECGKAFSWGSSLVKHERVHTGEKSHECKECGKTFCSGYQLTRHQVFHTGEKPYECKECGKAFNCGSSLVQHERIHTGEKPYECKECGKAFSRGYHLTQHQKIHTGEKPFKCKECGKAFSWGSSLVKHERVHTNEKSYECKDCGKAFGSGYQLSVHQRFHTGEKLYQRKEFGKTFTCGSKLVHERTHSNDKPYKYNECGEAFLWTTYSNEKIDTDETL

SEQ ID NO: 99580 - protein, 679 aa, Homo sapiens; identical to SEQ ID NO: 99574
  Payload ID: 19854
  Gene Name: zinc finger protein 283
  Uniprot ID: Q8N7M2
  ENSP ID: ENSP00000484852

SEQ ID NO: 99581 - protein, 593 aa, Homo sapiens
  Payload ID: 19855
  Gene Name: zinc finger protein 284
  Uniprot ID: Q2VY69
  ENSP ID: ENSP00000411032
MTMFKEAVTFKDVAVVFTEEELGLLDVSQRKLYRDVMLENFRNLLSVGHQLSHRDTFHFQREEKFWIMETATQREGNSGGKIQTELESVPETGPHEEWSCQQIWEQTASELTRPQDSISSSQFSTQGDVPSQVDAGLSIIHIGETPSEHGKCKKFFSDVSILDLHQQLHSGKISHTCNEYRKRFCYSSALCLHQKVHMGEKRYKCDVCSKAFSQNSQLQTHQRIHTGEKPFKCEQCGKSFSRRSGMYVHCKLHTGEKPHICEECGKAFIHNSQLREHQRIHTGEKPFKCYICGKSFHSRSNLNRHSMVHMQEKSFRCDTCSNSFGQRSALNSHCMDHTKEKLYKCEECGRSFTCRQDLCKHQMDHTGDKPYNCNVCGKGFRWSSCLSRHQRVHNGETTFKCDGCGKRFYMNSQGHSHQRAYREEELYKCQKCGKGYISKFNLDLHQRVHTGERPYNCKECGKSFRWASGILRHKRLHTGEKPFKCEECGKRFTENSKLRFHQRIHTGEKPYKCEECGKGFRWASTHLTHQRLHSREKLFQCEDCGKSSEHSSCLQDQQSDHSGEKTSKCEDCGKRYERRLNLDMILSLFLNDI

SEQ ID NO: 99582 - protein, 590 aa, Homo sapiens
  Payload ID: 19856
  Gene Name: zinc finger protein 285
  Uniprot ID: Q96NJ3
  ENSP ID: ENSP00000439431
MIKFQERVTFKDVAVVFTKEELALLDKAQINLYQDVMLENFRNLMLVRDGIKNNILNLQAKGLSYLSQEVLHCWQIWKQRIRDLTVSQDYIVNLQEECSPHLEDVSLSEEWAGISLQISENENYVVNAIIKNQDITAWQSLTQVLTPESWRKANIMTEPQNSQGRYKGIYMEEKLYRRAQHDDSLSWTSCDHHESQECKGEDPGRHPSCGKNLGMKSTVEKRNAAHVLPQPFPCNNCGVAFADDTDPHVHHSTHLGEKSYKCDQYGKNFSQSQDLIVHCKTHSGKTPYEFHEWPMGCKQSSDLPRYQKVSSGDKPYKCKECGKGFRRSSSLHNHHRVHTGEMPYKCDECGKGFGFRSLLCIHQGVHTGKKPYKCEECGKGFDQSSNLLVHQRVHTGEKPYKCSECGKCFSSSSVLQVHWRFHTGEKPYRCGECGKGFSQCTHLHIHQRVHTGEKPYKCNVCGKDFAYSSVLHTHQRVHTGEKPYKCEVCGKCFSYSSYFHLHQRDHIREKPYKCDECGKGFSRNSDLNVHLRVHTGERPYKCKACGKGFSRNSYLLAHQRVHIDETQYTHCERGKDLLTHQRLHEQRETL

SEQ ID NO: 99583 - protein, 597 aa, Homo sapiens
  Payload ID: 19856
  Gene Name: zinc finger protein 285
  ENSP ID: ENSP00000464788
MIKFQIQGIHVQERVTFKDVAVVFTKEELALLDKAQINLYQDVMLENFRNLMLVRDGIKNNILNLQAKGLSYLSQEVLHCWQIWKQRIRDLTVSQDYIVNLQEECSPHLEDVSLSEEWAGISLQISENENYVVNAIIKNQDITAWQSLTQVLTPESWRKANIMTEPQNSQGRYKGIYMEEKLYRRAQHDDSLSWTSCDHHESQECKGEDPGRHPSCGKNLGMKSTVEKRNAAHVLPQPFPCNNCGVAFADDTDPHVHHSTHLGEKSYKCDQYGKNFSQSQDLIVHCKTHSGKTPYEFHEWPMGCKQSSDLPRYQKVSSGDKPYKCKECGKGFRRSSSLHNHHRVHTGEMPYKCDECGKGFGFRSLLCIHQGVHTGKKPYKCEECGKGFDQSSNLLVHQRVHTGEKPYKCSECGKCFSSSSVLQVHWRFHTGEKPYRCGECGKGFSQCTHLHIHQRVHTGEKPYKCNVCGKDFAYSSVLHTHQRVHTGEKPYKCEVCGKCFSYSSYFHLHQRDHIREKPYKCDECGKGFSRNSDLNVHLRVHTGERPYKCKACGKGFSRNSYLLAHQRVHIDETQYTHCERGKDLLTHQRLHEQRETL

SEQ ID NO: 99584 - protein, 56 aa, Homo sapiens
  Payload ID: 19856
  Gene Name: zinc finger protein 285
  ENSP ID: ENSP00000467795
MIKFQIQGIHVQERVTFKDVAVVFTKEELALLDKAQINLYQDVMLENFRNLMLVSE

SEQ ID NO: 99585 - protein, 39 aa, Homo sapiens
  Payload ID: 19856
  Gene Name: zinc finger protein 285
  ENSP ID: ENSP00000468399
MTEPQNSQGRYKGIYMEEKLYRRAQHDDSLSWTSCDHHE

SEQ ID NO: 99586 - protein, 590 aa, Homo sapiens; identical to SEQ ID NO: 99582
  Payload ID: 19856
  Gene Name: zinc finger protein 285
  Uniprot ID: Q96NJ3
  ENSP ID: ENSP00000483662

SEQ ID NO: 99587 - protein, 141 aa, Homo sapiens
  Payload ID: 19857
  Gene Name: zinc finger protein 286A
  ENSP ID: ENSP00000379230
METDLAEMPEKGALSSQDSPHFQEKSTEEGEVAALRLTARSQETVTFKDVAMDFTPEEWGKLDPAQRDVMLENYRNLVSLWLPVSKPESYNLENGKEPLKLERKAPKSSYSAVAVIILFLIPYVHLESWFREITGRRISRS

SEQ ID NO: 99588 - protein, 116 aa, Homo sapiens
  Payload ID: 19857
  Gene Name: zinc finger protein 286A
  ENSP ID: ENSP00000379231
METDLAEMPEKGALSSQDSPHFQEKSTEEGEVAALRLTARSQETVTFKDVAMDFTPEEWGKLDPAQRDVMLENYRNLVSLWLPVSKPESYNLENGKEPLKLERKAPKSSYSELPFC

SEQ ID NO: 99589 - protein, 521 aa, Homo sapiens; identical to SEQ ID NO: 87095
  Payload ID: 19857
  Gene Name: zinc finger protein 286A
  Uniprot ID: Q9HBT8
  ENSP ID: ENSP00000397163

SEQ ID NO: 99590 - protein, 60 aa, Homo sapiens
  Payload ID: 19857
  Gene Name: zinc finger protein 286A
  ENSP ID: ENSP00000461939
METDLAEMPEKGALSSQDSPHFQEKSTEEGEVAALRLTARSQNCLFVEHRKRRKFAFPMS

SEQ ID NO: 99591 - protein, 106 aa, Homo sapiens
  Payload ID: 19857
  Gene Name: zinc finger protein 286A
  ENSP ID: ENSP00000461982
MGALSSQDSPHFQEKSTEEGEVAALRLTARSQETVTFKDVAMDFTPEEWGKLDPAQRDVMLENYRNLVSLWLPVSKPESYNLENGKEPLKLERKAPKSSYSELPFC

SEQ ID NO: 99592 - protein, 60 aa, Homo sapiens
  Payload ID: 19857
  Gene Name: zinc finger protein 286A
  ENSP ID: ENSP00000462182
METDLAEMPEKGALSSQDSPHFQEKSTEEGEVAALRLTARSQGFQFPNLRATTWRMEKNH

SEQ ID NO: 99593 - protein, 171 aa, Homo sapiens
  Payload ID: 19857
  Gene Name: zinc finger protein 286A
  ENSP ID: ENSP00000462509
MGEPRREGRKWDHEARGASNSSGQGDLNWGEEQNLQNKEEVVIMETDLAEMPEKGALSSQDSPHFQEKSTEEGEVAALRLTARSQETVTFKDVAMDFTPEEWGKLDPAQRDVMLENYRNLVSLWLPVSKPESYNLENGKEPLKLERKAPKSSYSDMETRPQSKDSTSVQDF

SEQ ID NO: 99594 - protein, 116 aa, Homo sapiens; identical to SEQ ID NO: 99588
  Payload ID: 19857
  Gene Name: zinc finger protein 286A
  ENSP ID: ENSP00000462679

SEQ ID NO: 99595 - protein, 50 aa, Homo sapiens
  Payload ID: 19857
  Gene Name: zinc finger protein 286A
  ENSP ID: ENSP00000463915
MGALSSQDSPHFQEKSTEEGEVAALRLTARSQGFQFPNLRATTWRMEKNH

SEQ ID NO: 99596 - protein, 521 aa, Homo sapiens; identical to SEQ ID NO: 87095
  Payload ID: 19857
  Gene Name: zinc finger protein 286A
  Uniprot ID: Q9HBT8
  ENSP ID: ENSP00000464063

SEQ ID NO: 99597 - protein, 521 aa, Homo sapiens; identical to SEQ ID NO: 87095
  Payload ID: 19857
  Gene Name: zinc finger protein 286A
  Uniprot ID: Q9HBT8
  ENSP ID: ENSP00000464218

SEQ ID NO: 99598 - protein, 511 aa, Homo sapiens; identical to SEQ ID NO: 87092
  Payload ID: 19857
  Gene Name: zinc finger protein 286A
  Uniprot ID: Q9HBT8
  ENSP ID: ENSP00000466154

SEQ ID NO: 99599 - protein, 92 aa, Homo sapiens
  Payload ID: 19857
  Gene Name: zinc finger protein 286A
  ENSP ID: ENSP00000467116
EGEVAALRLTARSQETVTFKDVAMDFTPEEWGKLDPAQRDVMLENYRNLVSLWLPVSKPESYNLENGKEPLKLERKAPKSSYSGEPDRWESS

SEQ ID NO: 99600 - protein, 119 aa, Homo sapiens
  Payload ID: 19857
  Gene Name: zinc finger protein 286A
  ENSP ID: ENSP00000467718
METRPQSKDSTSVQDFSKAESCKVAIIDRLTRNSVYDSNLEAALECENWLENQQGNQERHLREMFTHMNSLSEETDHKHDVYWKSFNQKSVLITEDRVPKGSYAFHTLEKSLKQKSNLM

SEQ ID NO: 99601 - protein, 65 aa, Homo sapiens
  Payload ID: 19858
  Gene Name: zinc finger protein 286B
  ENSP ID: ENSP00000460210
METDLAEMPEKGVLSSQDSPHFQEKSTEEGEVAALRLTARSQNCLFVEHRKRRKFAFPMSFRRGD

SEQ ID NO: 99602 - protein, 112 aa, Homo sapiens
  Payload ID: 19858
  Gene Name: zinc finger protein 286B
  ENSP ID: ENSP00000460736
METDLAEMPEKGGENCGRVELVAWKDEIPAPEGKTVGSGEVALGWLSPLSWGWMGFLSETEELGMGAPPFPWQLGTQWTLQSYPQNFCLPRILPISKRRAQKREKWLLCASR

SEQ ID NO: 99603 - protein, 522 aa, Homo sapiens
  Payload ID: 19858
  Gene Name: zinc finger protein 286B
  Uniprot ID: P0CG31
  ENSP ID: ENSP00000461413
METDLAEMPEKGVLSSQDSPHFQEKSTEEGEVAALRLTARSQAAAAAAAPGSRSLRGVHVPPPLHPAPAREEIKSTCSLKACFSLSLTLTYYRTAFLLSTENEGNLHFQCPSDVETRPQSKDSTSVQDFSKAESCKVAIIDRLTRNSVYDSNLEAALECENWLEKQQGNQERHLREMFTHMNSLSEETDHEHDVYWKSFNQKSVLITEDRVPKGSYAFHTLEKSLKQKSNLMKKQRTYKEKKPHKCNDCGELFTCHSVHIQHQRVHTGEKPYTCNECGKSFSHRANLTKHQRTHTRILFECRECKKTFTESSSLATHQRIHVGERPYECNECGKGFNRSTHLVQHQLIHTGVRPYECNECDKAFIHSSALIKHQRTHTGEKPYKCQECGKAFSHCSSLTKHQRVHTGEKPYECSECGKTFSQSTHLVQHQRIHTGEKPYECSECGKTFSQSSNFAKHQRIHIGKKPYKCSECGKAFIHSSALIQHQRTHTGEKPFRCNECGKSFKCSSSLIRHQRVHTEEQP

SEQ ID NO: 99604 - protein, 129 aa, Homo sapiens
  Payload ID: 19858
  Gene Name: zinc finger protein 286B
  ENSP ID: ENSP00000462368
METDLAEMPEKGVLSSQDSPHFQEKSTEEGEVAALRLTARSQAAAAAAAPGSRSLRGVHVPPPLHPAPAREESARTPAAAGRAAKMAEAPASPAPLSPLEVELDPEFEPQSRPRSCTWPLQRPELQASP

SEQ ID NO: 99605 - protein, 106 aa, Homo sapiens
  Payload ID: 19858
  Gene Name: zinc finger protein 286B
  ENSP ID: ENSP00000463300
METDLAEMPEKGVLSSQDSPHFQEKSTEEGEVAALRLTARSQAAAAAAAPGSRSLRGVHVPPPLHPAPAREESARTPAAAGRAAKMAEAPASPAPLSPLEVELDPE

SEQ ID NO: 99606 - protein, 761 aa, Homo sapiens
  Payload ID: 19859
  Gene Name: zinc finger protein 287
  Uniprot ID: Q9HBT7
  ENSP ID: ENSP00000379168
MLASSKRMNSSSRSQILLRWKSDKAQSGPYNVEKEILTSRFLRDTETCRQNFRNFPYPDLAGPRKALSQLRELCLKWLRPEIHSKEQILELLVLEQFLTILPGEVRTWVKSQYPESSEEAVTLVEDLTQILEEEAPQNSTLSQDTPEEDPRGKHAFQTGWLNDLVTKESMTFKDVAVDITQEDWELMRPVQKELYKTVTLQNYWNMVSLGLTVYRPTVIPILEEPWMVIKEILEGPSPEWETKAQACTPVEDMSKLTKEETHTIKLEDSYDYDDRLERRGKGGFWKIHTDERGFSLKSVLSQEYDPTEECLSKYDIYRNNFEKHSNLIVQFDTQLDNKTSVYNEGRATFNHVSYGIVHRKILPGEKPYKCNVCGKKFRKYPSLLKHQSTHAKEKSYECEECGKEFRHISSLIAHQRMHTGEKPYECHQCGKAFSQRAHLTIHQRIHTGEKPYKCDDCGKDFSQRAHLTIHQRTHTGEKPYKCLECGKTFSHSSSLINHQRVHTGEKPYICNECGKTFSQSTHLLQHQKIHTGKKPYKCNECWKVFSQSTYLIRHQRIHSGEKCYKCNECGKAFAHSSTLIQHQTTHTGEKSYICNICGKAFSQSANLTQHHRTHTGEKPYKCSVCGKAFSQSVHLTQHQRIHNGEKPFKCNICGKAYRQGANLTQHQRIHTGEKPYKCNECGKAFIYSSSLNQHQRTHTGERPYKCNECDKDFSQRTCLIQHQRIHTGEKPYACRICGKTFTQSTNLIQHQRVHTGAKHRN

SEQ ID NO: 99607 - protein, 761 aa, Homo sapiens; identical to SEQ ID NO: 99606
  Payload ID: 19859
  Gene Name: zinc finger protein 287
  Uniprot ID: Q9HBT7
  ENSP ID: ENSP00000379169

SEQ ID NO: 99608 - protein, 57 aa, Homo sapiens
  Payload ID: 19859
  Gene Name: zinc finger protein 287
  ENSP ID: ENSP00000406051
MLASSKRMNSSSRSQILLRWKSDKAQSGPYNVEKEILTSRFLRDTETCRQNFRNFPY

SEQ ID NO: 99609 - protein, 2718 aa, Homo sapiens
  Payload ID: 19860
  Gene Name: zinc finger protein 292
  ENSP ID: ENSP00000342847
MADEEAEQERLSCGEGGCVAELQRLGERLQELELQLRESRVPAVEAATDYCQQLCQTLLEYAEKWKTSEDPLPLLEVYTVAIQSYVKARPYLTSECENVALVLERLALSCVELLLCLPVELSDKQWEQFQTLVQVAHEKLMENGSCELHFLATLAQETGVWKNPVLCTILSQEPLDKDKAFEGPILLDMRIKHLIKTNQLSQATALAKLCSDHPEIGIKGSFKQTYLVCLCTSSPNGKLIEEISEVDCKDALEMICNLESEGDEKSALVLCTAFLSRQLQQGDMYCAWELTLFWSKLQQRVEPSIQVYLERCRQLSLLTKTVYHIFFLIKVINSETEGAGLATCIELCVKALRLESTENTEVKISICKTISCLLPDDLEVKRACQLSEFLIEPTVDAYYAVEMLYNQPDQKYDEENLPIPNSLRCELLLVLKTQWPFDPEFWDWKTLKRQCLALMGEEASIVSSIDELNDSEVYEKVVDYQEESKETSMNGLSGGVGANSGLLKDIGDEKQKKREIKQLRERGFISARFRNWQAYMQYCVLCDKEFLGHRIVRHAQKHYKDGIYSCPICAKNFNSKETFVPHVTLHVKQSSKERLAAMKPLRRLGRPPKITTTNENQKTNTVAKQEQRPIKKNSLYSTDFIVFNDNDGSDDENDDKDKSYEPEVIPVQKPVPVNEFNCPVTFCKKGFKYFKNLIAHVKGHKDNEDAKRFLEMQSKKVICQYCRRHFVSVTHLNDHLQMHCGSKPYICIQMKCKAGFNSYAELLTHRKEHQVFRAKCMFPKCGRIFSEAYLLYDHEAQHYNTYTCKFTGCGKVYRSQGELEKHLDDHSTPPEKVLPPEAQLNSSGDSIQPSEVNQNTAENIEKERSMLPSENNIENSLLADRSDAWDKSKAESAVTKQDQISASELRQANGPLSNGLENPATTPLLQSSEVAVSIKVSLNQGIEDNFGKQENSTVEGSGEALVTDLHTPVEDTCNDLCHPGFQERKEQDCFNDAHVTQNSLVNSETLKIGDLTPQNLERQVNNLMTFSVQNQAAFQNNLPTSKFECGDNVKTSSNLYNLPLKTLESIAFVPPQSDLSNSLGTPSVPPKAPVQKFSCQVEGCTRTYNSSQSIGKHMKTAHPDQYAAFKMQRKSKKGQKANNLNTPNNGKFVYFLPSPVNSSNPFFTSQTKANGNPACSAQLQHVSPPIFPAHLASVSTPLLSSMESVINPNITSQDKNEQGGMLCSQMENLPSTALPAQMEDLTKTVLPLNIDSGSDPFLPLPAESSSMSLFPSPADSGTNSVFSQLENNTNHYSSQIEGNTNSSFLKGGNGENAVFPSQVNVANNFSSTNAQQSAPEKVKKDRGRGPNGKERKPKHNKRAKWPAIIRDGKFICSRCYRAFTNPRSLGGHLSKRSYCKPLDGAEIAQELLQSNGQPSLLASMILSTNAVNLQQPQQSTFNPEACFKDPSFLQLLAENRSPAFLPNTFPRSGVTNFNTSVSQEGSEIIKQALETAGIPSTFEGAEMLSHVSTGCVSDASQVNATVMPNPTVPPLLHTVCHPNTLLTNQNRTSNSKTSSIEECSSLPVFPTNDLLLKTVENGLCSSSFPNSGGPSQNFTSNSSRVSVISGPQNTRSSHLNKKGNSASKRRKKVAPPLIAPNASQNLVTSDLTTMGLIAKSVEIPTTNLHSNVIPTCEPQSLVENLTQKLNNVNNQLFMTDVKENFKTSLESHTVLAPLTLKTENGDSQMMALNSCTTSINSDLQISEDNVIQNFEKTLEIIKTAMNSQILEVKSGSQGAGETSQNAQINYNIQLPSVNTVQNNKLPDSSPFSSFISVMPTKSNIPQSEVSHKEDQIQEILEGLQKLKLENDLSTPASQCVLINTSVTLTPTPVKSTADITVIQPVSEMINIQFNDKVNKPFVCQNQGCNYSAMTKDALFKHYGKIHQYTPEMILEIKKNQLKFAPFKCVVPTCTKTFTRNSNLRAHCQLVHHFTTEEMVKLKIKRPYGRKSQSENVPASRSTQVKKQLAMTEENKKESQPALELRAETQNTHSNVAVIPEKQLVEKKSPDKTESSLQVITVTSEQCNTNALTNTQTKGRKIRRHKKEKEEKKRKKPVSQSLEFPTRYSPYRPYRCVHQGCFAAFTIQQNLILHYQAVHKSDLPAFSAEVEEESEAGKESEETETKQTLKEFRCQVSDCSRIFQAITGLIQHYMKLHEMTPEEIESMTASVDVGKFPCDQLECKSSFTTYLNYVVHLEADHGIGLRASKTEEDGVYKCDCEGCDRIYATRSNLLRHIFNKHNDKHKAHLIRPRRLTPGQENMSSKANQEKSKSKHRGTKHSRCGKEGIKMPKTKRKKKNNLENKNAKIVQIEENKPYSLKRGKHVYSIKARNDALSECTSRFVTQYPCMIKGCTSVVTSESNIIRHYKCHKLSKAFTSQHRNLLIVFKRCCNSQVKETSEQEGAKNDVKDSDTCVSESNDNSRTTATVSQKEVEKNEKDEMDELTELFITKLINEDSTSVETQANTSSNVSNDFQEDNLCQSERQKASNLKRVNKEKNVSQNKKRKVEKAEPASAAELSSVRKEEETAVAIQTIEEHPASFDWSSFKPMGFEVSFLKFLEESAVKQKKNTDKDHPNTGNKKGSHSNSRKNIDKTAVTSGNHVCPCKESETFVQFANPSQLQCSDNVKIVLDKNLKDCTELVLKQLQEMKPTVSLKKLEVHSNDPDMSVMKDISIGKATGRGQY

SEQ ID NO: 99610 - protein, 2723 aa, Homo sapiens
  Payload ID: 19860
  Gene Name: zinc finger protein 292
  Uniprot ID: O60281
  ENSP ID: ENSP00000358590
MADEEAEQERLSCGEGGCVAELQRLGERLQELELQLRESRVPAVEAATDYCQQLCQTLLEYAEKWKTSEDPLPLLEVYTVAIQSYVKARPYLTSECENVALVLERLALSCVELLLCLPVELSDKQWEQFQTLVQVAHEKLMENGSCELHFLATLAQETGVWKNPVLCTILSQEPLDKDKVNEFLAFEGPILLDMRIKHLIKTNQLSQATALAKLCSDHPEIGIKGSFKQTYLVCLCTSSPNGKLIEEISEVDCKDALEMICNLESEGDEKSALVLCTAFLSRQLQQGDMYCAWELTLFWSKLQQRVEPSIQVYLERCRQLSLLTKTVYHIFFLIKVINSETEGAGLATCIELCVKALRLESTENTEVKISICKTISCLLPDDLEVKRACQLSEFLIEPTVDAYYAVEMLYNQPDQKYDEENLPIPNSLRCELLLVLKTQWPFDPEFWDWKTLKRQCLALMGEEASIVSSIDELNDSEVYEKVVDYQEESKETSMNGLSGGVGANSGLLKDIGDEKQKKREIKQLRERGFISARFRNWQAYMQYCVLCDKEFLGHRIVRHAQKHYKDGIYSCPICAKNFNSKETFVPHVTLHVKQSSKERLAAMKPLRRLGRPPKITTTNENQKTNTVAKQEQRPIKKNSLYSTDFIVFNDNDGSDDENDDKDKSYEPEVIPVQKPVPVNEFNCPVTFCKKGFKYFKNLIAHVKGHKDNEDAKRFLEMQSKKVICQYCRRHFVSVTHLNDHLQMHCGSKPYICIQMKCKAGFNSYAELLTHRKEHQVFRAKCMFPKCGRIFSEAYLLYDHEAQHYNTYTCKFTGCGKVYRSQGELEKHLDDHSTPPEKVLPPEAQLNSSGDSIQPSEVNQNTAENIEKERSMLPSENNIENSLLADRSDAWDKSKAESAVTKQDQISASELRQANGPLSNGLENPATTPLLQSSEVAVSIKVSLNQGIEDNFGKQENSTVEGSGEALVTDLHTPVEDTCNDLCHPGFQERKEQDCFNDAHVTQNSLVNSETLKIGDLTPQNLERQVNNLMTFSVQNQAAFQNNLPTSKFECGDNVKTSSNLYNLPLKTLESIAFVPPQSDLSNSLGTPSVPPKAPVQKFSCQVEGCTRTYNSSQSIGKHMKTAHPDQYAAFKMQRKSKKGQKANNLNTPNNGKFVYFLPSPVNSSNPFFTSQTKANGNPACSAQLQHVSPPIFPAHLASVSTPLLSSMESVINPNITSQDKNEQGGMLCSQMENLPSTALPAQMEDLTKTVLPLNIDSGSDPFLPLPAESSSMSLFPSPADSGTNSVFSQLENNTNHYSSQIEGNTNSSFLKGGNGENAVFPSQVNVANNFSSTNAQQSAPEKVKKDRGRGPNGKERKPKHNKRAKWPAIIRDGKFICSRCYRAFTNPRSLGGHLSKRSYCKPLDGAEIAQELLQSNGQPSLLASMILSTNAVNLQQPQQSTFNPEACFKDPSFLQLLAENRSPAFLPNTFPRSGVTNFNTSVSQEGSEIIKQALETAGIPSTFEGAEMLSHVSTGCVSDASQVNATVMPNPTVPPLLHTVCHPNTLLTNQNRTSNSKTSSIEECSSLPVFPTNDLLLKTVENGLCSSSFPNSGGPSQNFTSNSSRVSVISGPQNTRSSHLNKKGNSASKRRKKVAPPLIAPNASQNLVTSDLTTMGLIAKSVEIPTTNLHSNVIPTCEPQSLVENLTQKLNNVNNQLFMTDVKENFKTSLESHTVLAPLTLKTENGDSQMMALNSCTTSINSDLQISEDNVIQNFEKTLEIIKTAMNSQILEVKSGSQGAGETSQNAQINYNIQLPSVNTVQNNKLPDSSPFSSFISVMPTKSNIPQSEVSHKEDQIQEILEGLQKLKLENDLSTPASQCVLINTSVTLTPTPVKSTADITVIQPVSEMINIQFNDKVNKPFVCQNQGCNYSAMTKDALFKHYGKIHQYTPEMILEIKKNQLKFAPFKCVVPTCTKTFTRNSNLRAHCQLVHHFTTEEMVKLKIKRPYGRKSQSENVPASRSTQVKKQLAMTEENKKESQPALELRAETQNTHSNVAVIPEKQLVEKKSPDKTESSLQVITVTSEQCNTNALTNTQTKGRKIRRHKKEKEEKKRKKPVSQSLEFPTRYSPYRPYRCVHQGCFAAFTIQQNLILHYQAVHKSDLPAFSAEVEEESEAGKESEETETKQTLKEFRCQVSDCSRIFQAITGLIQHYMKLHEMTPEEIESMTASVDVGKFPCDQLECKSSFTTYLNYVVHLEADHGIGLRASKTEEDGVYKCDCEGCDRIYATRSNLLRHIFNKHNDKHKAHLIRPRRLTPGQENMSSKANQEKSKSKHRGTKHSRCGKEGIKMPKTKRKKKNNLENKNAKIVQIEENKPYSLKRGKHVYSIKARNDALSECTSRFVTQYPCMIKGCTSVVTSESNIIRHYKCHKLSKAFTSQHRNLLIVFKRCCNSQVKETSEQEGAKNDVKDSDTCVSESNDNSRTTATVSQKEVEKNEKDEMDELTELFITKLINEDSTSVETQANTSSNVSNDFQEDNLCQSERQKASNLKRVNKEKNVSQNKKRKVEKAEPASAAELSSVRKEEETAVAIQTIEEHPASFDWSSFKPMGFEVSFLKFLEESAVKQKKNTDKDHPNTGNKKGSHSNSRKNIDKTAVTSGNHVCPCKESETFVQFANPSQLQCSDNVKIVLDKNLKDCTELVLKQLQEMKPTVSLKKLEVHSNDPDMSVMKDISIGKATGRGQY

SEQ ID NO: 99611 - protein, 132 aa, Homo sapiens
  Payload ID: 19860
  Gene Name: zinc finger protein 292
  ENSP ID: ENSP00000428073
  MOD_RES (1)..(1): Any amino acid
XEISEVDCKDALEMICNLESEGDEKSALVLCTAFLSRQLQQGDMYCAWELTLFWSKLQQRVEPSIQVYLERCRQLSLLTKTVYHIFFLIKVINSERWGLTILPRFISNSWAQVILRALAFQSGGITGMSHHT

SEQ ID NO: 99612 - protein, 256 aa, Homo sapiens
  Payload ID: 19860
  Gene Name: zinc finger protein 292
  ENSP ID: ENSP00000428857
VELRRRRLRRGAAAPGRAAPGAGATAAGEPGTGRGSGHRLLSAAVPDTPRICREMENFRRSFTFIGEVEEESEAGKESEETETKQTLKEFRCQVSDCSRIFQAITGLIQHYMKLHEMTPEEIESMTASVDVGKFPCDQLECKSSFTTYLNYVVHLEADHGIGLRASKTEEDGVYKCDCEGCDRIYATRSNLLRHIFNKHNDKHKAHLIRPRRLTPGQENMSSKANQEKSKSKHRGTKHSRCGKEGIKMPKTKRKKK

SEQ ID NO: 99613 - protein, 87 aa, Homo sapiens
  Payload ID: 19860
  Gene Name: zinc finger protein 292
  ENSP ID: ENSP00000428925
MADEEAEQERLSCGEGGCVAELQRLGERLQELELQLRESRVPAVEAATDYCQQLCQISEVDCKDALEMICNLESEGDEKSALVLCTA

SEQ ID NO: 99614 - protein, 66 aa, Homo sapiens
  Payload ID: 19860
  Gene Name: zinc finger protein 292
  ENSP ID: ENSP00000430569
MADEEAEQERLSCGEGGCVAELQRLGERLQELELQLRESRVPAVEAATDYCQQLCQGLTVTQAGMQ

SEQ ID NO: 99615 - protein, 475 aa, Homo sapiens
  Payload ID: 19861
  Gene Name: zinc finger protein 296
  Uniprot ID: Q8WUU4
  ENSP ID: ENSP00000302770
MSRRKAGSAPRRVEPAPAANPDDEMEMQDLVIELKPEPDAQPQQAPRLGPFSPKEVSSAGRFGGEPHHSPGPMPAGAALLALGPRNPWTLWTPLTPNYPDRQPWTDKHPDLLTCGRCLQTFPLEAITAFMDHKKLGCQLFRGPSRGQGSEREELKALSCLRCGKQFTVAWKLLRHAQWDHGLSIYQTESEAPEAPLLGLAEVAAAVSAVVGPAAEAKSPRASGSGLTRRSPTCPVCKKTLSSFSNLKVHMRSHTGERPYACDQCPYACAQSSKLNRHKKTHRQVPPQSPLMADTSQEQASAAPPEPAVHAAAPTSTLPCSGGEGAGAAATAGVQEPGAPGSGAQAGPGGDTWGAITTEQRTDPANSQKASPKKMPKSGGKSRGPGGSCEFCGKHFTNSSNLTVHRRSHTGERPYTCEFCNYACAQSSKLNRHRRMHGMTPGSTRFECPHCHVPFGLRATLDKHLRQKHPEAAGEA

SEQ ID NO: 99616 - protein, 451 aa, Homo sapiens
  Payload ID: 19861
  Gene Name: zinc finger protein 296
  ENSP ID: ENSP00000479435
MEMQDLVIELKPEPDAQPQQAPRLGPFSPKEVSSAGRFGGEPHHSPGPMPAGAALLALGPRNPWTLWTPLTPNYPDRQPWTDKHPDLLTCGRCLQTFPLEAITAFMDHKKLGCQLFRGPSRGQGSEREELKALSCLRCGKQFTVAWKLLRHAQWDHGLSIYQTESEAPEAPLLGLAEVAAAVSAVVGPAAEAKSPRASGSGLTRRSPTCPVCKKTLSSFSNLKVHMRSHTGERPYACDQCPYACAQSSKLNRHKKTHRQVPPQSPLMADTSQEQASAAPPEPAVHAAAPTSTLPCSGGEGAGAAATAGVQEPGAPGSGAQAGPGGDTWGAITTEQRTDPANSQKASPKKMPKSGGKSRGPGGSCEFCGKHFTNSSNLTVHRRSHTGERPYTCEFCNYACAQSSKLNRHRRMHGMTPGSTRFECPHCHVPFGLRATLDKHLRQKHPEAAGEA

SEQ ID NO: 99617 - protein, 20 aa, Homo sapiens
  Payload ID: 19862
  Gene Name: zinc finger protein 3
  ENSP ID: ENSP00000292393
MLAAALLKAKSQELVTFEDV

SEQ ID NO: 99618 - protein, 446 aa, Homo sapiens
  Payload ID: 19862
  Gene Name: zinc finger protein 3
  Uniprot ID: P17036
  ENSP ID: ENSP00000299667
METQADLVSQEPQALLDSALPSKVPAFSDKDSLGDEMLAAALLKAKSQELVTFEDVAVYFIRKEWKRLEPAQRDLYRDVMLENYGNVFSLDRETRTENDQEISEDTRSHGVLLGRFQKDISQGLKFKEAYEREVSLKRPLGNSPGERLNRKMPDFGQVTVEEKLTPRGERSEKYNDFGNSFTVNSNLISHQRLPVGDRPHKCDECSKSFNRTSDLIQHQRIHTGEKPYECNECGKAFSQSSHLIQHQRIHTGEKPYECSDCGKTFSCSSALILHRRIHTGEKPYECNECGKTFSWSSTLTHHQRIHTGEKPYACNECGKAFSRSSTLIHHQRIHTGEKPYECNECGKAFSQSSHLYQHQRIHTGEKPYECMECGGKFTYSSGLIQHQRIHTGENPYECSECGKAFRYSSALVRHQRIHTGEKPLNGIGMSKSSLRVTTELNIREST

SEQ ID NO: 99619 - protein, 446 aa, Homo sapiens; identical to SEQ ID NO: 99618
  Payload ID: 19862
  Gene Name: zinc finger protein 3
  Uniprot ID: P17036
  ENSP ID: ENSP00000306372

SEQ ID NO: 99620 - protein, 184 aa, Homo sapiens
  Payload ID: 19862
  Gene Name: zinc finger protein 3
  ENSP ID: ENSP00000388042
METQADLVSQEPQALLDSALPSKVPAFSDKDSLGDEMLAAALLKAKSQELVTFEDVAVYFIRKEWKRLEPAQRDLYRDVMLENYGNVFSLDRETRTENDQEISEDTRSHGVLLGRFQKDISQGLKFKEAYEREVSLKRPLGNSPGERLNRKMPDFGQVTVEEKLTPRGERSEKYNDFGNSFTVN

SEQ ID NO: 99621 - protein, 98 aa, Homo sapiens
  Payload ID: 19862
  Gene Name: zinc finger protein 3
  ENSP ID: ENSP00000394113
MLAAALLKAKSQELVTFEDVAVYFIRKEWKRLEPAQRDLYRDVMLENYGNVFSLDRETRTENDQEISEDTRSHGVLLGRFQKDISQGLKFKEAYEREV

SEQ ID NO: 99622 - protein, 131 aa, Homo sapiens
  Payload ID: 19862
  Gene Name: zinc finger protein 3
  Uniprot ID: P17036
  ENSP ID: ENSP00000399951
METQADLVSQEPQALLDSALPSKVPAFSDKDSLGDEMLAAALLKAKSQELVTFEDVAVYFIRKEWKRLEPAQRDLYRDVMLENYGNVFSLDWIHVCLTTQKVMLAWLTGTLSVAKGLCSSELASVEPPDTF

SEQ ID NO: 99623 - protein, 184 aa, Homo sapiens; identical to SEQ ID NO: 99620
  Payload ID: 19862
  Gene Name: zinc finger protein 3
  ENSP ID: ENSP00000405970

SEQ ID NO: 99624 - protein, 446 aa, Homo sapiens; identical to SEQ ID NO: 99618
  Payload ID: 19862
  Gene Name: zinc finger protein 3
  Uniprot ID: P17036
  ENSP ID: ENSP00000415358

SEQ ID NO: 99625 - protein, 148 aa, Homo sapiens
  Payload ID: 19862
  Gene Name: zinc finger protein 3
  ENSP ID: ENSP00000416088
MLAAALLKAKSQELVTFEDVAVYFIRKEWKRLEPAQRDLYRDVMLENYGNVFSLDRETRTENDQEISEDTRSHGVLLGRFQKDISQGLKFKEAYEREVSLKRPLGNSPGERLNRKMPDFGQVTVEEKLTPRGERSEKYNDFGNSFTVN

SEQ ID NO: 99626 - protein, 104 aa, Homo sapiens
  Payload ID: 19862
  Gene Name: zinc finger protein 3
  ENSP ID: ENSP00000416686
METQADLVSQEPQALLDSALPSKVPAFSDKDSLGDEMLAAALLKAKSQELVTFEDVAVYFIRKEWKRLEPAQRDLYRDVMLENYGNVFSLDRETRTENDQEISE

SEQ ID NO: 99627 - protein, 624 aa, Homo sapiens
  Payload ID: 19863
  Gene Name: zinc finger protein 30
  Uniprot ID: P17039
  ENSP ID: ENSP00000303889
MAHKYVGLQYHGSVTFEDVAIAFSQQEWESLDSSQRGLYRDVMLENYRNLVSMAGHSRSKPHVIALLEQWKEPEVTVRKDGRRWCTDLQLEDDTIGCKEMPTSENCPSFALHQKISRQKPRECQEYGKTLCQDSKPVQHERIHSSEKPNRCKECGKNFSNGHQLTIHQRLHVGEKPYKYEKCGKAFISGSAFVKHGRIHTGEKPLKCKQCGKTISGSYQLTVHKSIHTGKKPYECGECGKAFLVYGKLTRHQSTHTGEKPFGCEECGKAFSTFSYLVQHQRIHTSEKPYECKECGKAFSTSSPLAKHQRIHTGEKPYECKECGKSFTVYGQLTRHQSIHTGEKPFECKECGKAFRLSSFLHAHQRIHAEIKPYGCKECGRTFSRASYLVQHGRLHTGEKPYECKECGKAFSTGSYLVQHQRIHTGEKPYECKECGKAFISRHQLTVHQRVHTGEKPYECKECGKAFRVHVHLTQHRKIHTDVKPYECKECGKTFSRASYLVQHSRIHTGKKPYECKECGKAFSSGSYLVQHQRIHTGEKPYECNKCGKAFTVYGQLIGHQSVHTGEKPFECKECGKAFRLNSFLTEHQRVHTGEKPFKCKKCGKTFRYSSALKVHLRKHMSVIP

SEQ ID NO: 99628 - protein, 624 aa, Homo sapiens; identical to SEQ ID NO: 99627
  Payload ID: 19863
  Gene Name: zinc finger protein 30
  Uniprot ID: P17039
  ENSP ID: ENSP00000403441

SEQ ID NO: 99629 - protein, 623 aa, Homo sapiens
  Payload ID: 19863
  Gene Name: zinc finger protein 30
  Uniprot ID: P17039
  ENSP ID: ENSP00000469954
MAHKYVGLQYHGSVTFEDVAIAFSQQEWESLDSSQRGLYRDVMLENYRNLVSMGHSRSKPHVIALLEQWKEPEVTVRKDGRRWCTDLQLEDDTIGCKEMPTSENCPSFALHQKISRQKPRECQEYGKTLCQDSKPVQHERIHSSEKPNRCKECGKNFSNGHQLTIHQRLHVGEKPYKYEKCGKAFISGSAFVKHGRIHTGEKPLKCKQCGKTISGSYQLTVHKSIHTGKKPYECGECGKAFLVYGKLTRHQSTHTGEKPFGCEECGKAFSTFSYLVQHQRIHTSEKPYECKECGKAFSTSSPLAKHQRIHTGEKPYECKECGKSFTVYGQLTRHQSIHTGEKPFECKECGKAFRLSSFLHAHQRIHAEIKPYGCKECGRTFSRASYLVQHGRLHTGEKPYECKECGKAFSTGSYLVQHQRIHTGEKPYECKECGKAFISRHQLTVHQRVHTGEKPYECKECGKAFRVHVHLTQHRKIHTDVKPYECKECGKTFSRASYLVQHSRIHTGKKPYECKECGKAFSSGSYLVQHQRIHTGEKPYECNKCGKAFTVYGQLIGHQSVHTGEKPFECKECGKAFRLNSFLTEHQRVHTGEKPFKCKKCGKTFRYSSALKVHLRKHMSVIP

SEQ ID NO: 99630 - protein, 86 aa, Homo sapiens
  Payload ID: 19863
  Gene Name: zinc finger protein 30
  Uniprot ID: P17039
  ENSP ID: ENSP00000470094
MAHKYVGLQYHGSVTFEDVAIAFSQQEWESLDSSQRGLYRDVMLENYRNLVSMGHSRSKPHVIALLEQWKEPEVTVRKDGRRWCTG

SEQ ID NO: 99631 - protein, 86 aa, Homo sapiens
  Payload ID: 19863
  Gene Name: zinc finger protein 30
  ENSP ID: ENSP00000476813
MAHKYVGLQYHGSVTFEDVAIAFSQQEWESLDSSQRGLYRDVMLENYRNLVSMAGHSRSKPHVIALLEQWKEPEVTVRKDGRRWCT

SEQ ID NO: 99632 - protein, 604 aa, Homo sapiens
  Payload ID: 19864
  Gene Name: zinc finger protein 300
  Uniprot ID: Q96RE9
  ENSP ID: ENSP00000274599
MMKSQGLVSFKDVAVDFTQEEWQQLDPSQRTLYRDVMLENYSHLVSMGYPVSKPDVISKLEQGEEPWIIKGDISNWIYPDEYQADGRQDRKSNLHNSQSCILGTVSFHHKILKGVTRDGSLCSILKVCQGDGQLQRFLENQDKLFRQVTFVNSKTVTEASGHKYNPLGKIFQECIETDISIQRFHKYDAFKKNLKPNIDLPSCYKSNSRKKPDQSFGGGKSSSQSEPNSNLEKIHNGVIPFDDNQCGNVFRNTQSLIQYQNVETKEKSCVCVTCGKAFAKKSQLIVHQRIHTGKKPYDCGACGKAFSEKFHLVVHQRTHTGEKPYDCSECGKAFSQKSSLIIHQRVHTGEKPYECSECGKAFSQKSPLIIHQRIHTGEKPYECRECGKAFSQKSQLIIHHRAHTGEKPYECTECGKAFCEKSHLIIHKRIHTGEKPYKCAQCEEAFSRKTELITHQLVHTGEKPYECTECGKTFSRKSQLIIHQRTHTGEKPYKCSECGKAFCQKSHLIGHQRIHTGEKPYICTECGKAFSQKSHLPGHQRIHTGEKPYICAECGKAFSQKSDLVLHQRIHTGERPYQCAICGKAFIQKSQLTVHQRIHTVVKS

SEQ ID NO: 99633 - protein, 604 aa, Homo sapiens [sequence omitted]

SEQ ID NO: 99634 - protein, 568 aa, Homo sapiens
  Payload ID: 19864
  Gene Name: zinc finger protein 300
  Uniprot ID: Q96RE9
  ENSP ID: ENSP00000392593
MLENYSHLVSMGYPVSKPDVISKLEQGEEPWIIKGDISNWIYPDEYQADGRQDRKSNLHNSQSCILGTVSFHHKILKGVTRDGSLCSILKVCQGDGQLQRFLENQDKLFRQVTFVNSKTVTEASGHKYNPLGKIFQECIETDISIQRFHKYDAFKKNLKPNIDLPSCYKSNSRKKPDQSFGGGKSSSQSEPNSNLEKIHNGVIPFDDNQCGNVFRNTQSLIQYQNVETKEKSCVCVTCGKAFAKKSQLIVHQRIHTGKKPYDCGACGKAFSEKFHLVVHQRTHTGEKPYDCSECGKAFSQKSSLIIHQRVHTGEKPYECSECGKAFSQKSPLIIHQRIHTGEKPYECRECGKAFSQKSQLIIHHRAHTGEKPYECTECGKAFCEKSHLIIHKRIHTGEKPYKCAQCEEAFSRKTELITHQLVHTGEKPYECTECGKTFSRKSQLIIHQRTHTGEKPYKCSECGKAFCQKSHLIGHQRIHTGEKPYICTECGKAFSQKSHLPGHQRIHTGEKPYICAECGKAFSQKSDLVLHQRIHTGERPYQCAICGKAFIQKSQLTVHQRIHTVVKS

SEQ ID NO: 99635 - protein, 620 aa, Homo sapiens
  Payload ID: 19864
  Gene Name: zinc finger protein 300
  Uniprot ID: Q96RE9
  ENSP ID: ENSP00000397178
MVPAETSSSGLLEEQKMMKSQGLVSFKDVAVDFTQEEWQQLDPSQRTLYRDVMLENYSHLVSMGYPVSKPDVISKLEQGEEPWIIKGDISNWIYPDEYQADGRQDRKSNLHNSQSCILGTVSFHHKILKGVTRDGSLCSILKVCQGDGQLQRFLENQDKLFRQVTFVNSKTVTEASGHKYNPLGKIFQECIETDISIQRFHKYDAFKKNLKPNIDLPSCYKSNSRKKPDQSFGGGKSSSQSEPNSNLEKIHNGVIPFDDNQCGNVFRNTQSLIQYQNVETKEKSCVCVTCGKAFAKKSQLIVHQRIHTGKKPYDCGACGKAFSEKFHLVVHQRTHTGEKPYDCSECGKAFSQKSSLIIHQRVHTGEKPYECSECGKAFSQKSPLIIHQRIHTGEKPYECRECGKAFSQKSQLIIHHRAHTGEKPYECTECGKAFCEKSHLIIHKRIHTGEKPYKCAQCEEAFSRKTELITHQLVHTGEKPYECTECGKTFSRKSQLIIHQRTHTGEKPYKCSECGKAFCQKSHLIGHQRIHTGEKPYICTECGKAFSQKSHLPGHQRIHTGEKPYICAECGKAFSQKSDLVLHQRIHTGERPYQCAICGKAFIQKSQLTVHQRIHTVVKS

SEQ ID NO: 99636 - protein, 90 aa, Homo sapiens
  Payload ID: 19864
  Gene Name: zinc finger protein 300
  ENSP ID: ENSP00000414195
MMKSQGLVSFKDVAVDFTQEEWQQLDPSQRTLYRDVMLENYSHLVSMGYPVSKPDVISKLEQGEEPWIIKGDISNWIYPDEYQADGRQGK

SEQ ID NO: 99637 - protein, 399 aa, Homo sapiens
  Payload ID: 19865
  Gene Name: zinc finger protein 302
  Uniprot ID: Q9NR11
  ENSP ID: ENSP00000391067
MSQVTFSDVAIDFSHEEWACLDSAQRDLYKDVMVQNYENLVSVGLSVTKPYVIMLLEDGKEPWMMEKKLSKDWESRWENKELSTKKDIYDEDSPQPVTMEKVVKQSYEFSNSNKNLEYTECDTFRSTFHSKSTLSEPQNNSAEGNSHKYDILKKNLSKKSVIKSERINGGKKLLNSNKSGAAFNQSKSLTLPQTCNREKIYTCSECGKAFGKQSILSRHWRIHTGEKPYECRECGKTFSHGSSLTRHQISHSGEKPYKCIECGKAFSHGSSLTNHQSTHTGEKPYECMNCGKSFSRVSLLIQHLRIHTQEKRYECRICGKAFIHSSSLIHHQKSHTGEKPYECRECGKAFCCSSHLTQHQRIHSMKKKYECNKCLKVFSSFSFLVQHQSIHTEEKPFEV

SEQ ID NO: 99638 - protein, 443 aa, Homo sapiens
  Payload ID: 19865
  Gene Name: zinc finger protein 302
  ENSP ID: ENSP00000396379
MSQRQYPECYLAPNGCLVSNCGVNKMSNEELVGQNHGMEGEACTGGDVTFSDVAIDFSHEEWACLDSAQRDLYKDVMVQNYENLVSVGLSVTKPYVIMLLEDGKEPWMMEKKLSKDWESRWENKELSTKKDIYDEDSPQPVTMEKVVKQSYEFSNSNKNLEYTECDTFRSTFHSKSTLSEPQNNSAEGNSHKYDILKKNLSKKSVIKSERINGGKKLLNSNKSGAAFNQSKSLTLPQTCNREKIYTCSECGKAFGKQSILSRHWRIHTGEKPYECRECGKTFSHGSSLTRHQISHSGEKPYKCIECGKAFSHGSSLTNHQSTHTGEKPYECMNCGKSFSRVSLLIQHLRIHTQEKRYECRICGKAFIHSSSLIHHQKSHTGEKPYECRECGKAFCCSSHLTQHQRIHSMKKKYECNKCLKVFSSFSFLVQHQSIHTEEKPFEV

SEQ ID NO: 99639 - protein, 399 aa, Homo sapiens; identical to SEQ ID NO: 99637
  Payload ID: 19865
  Gene Name: zinc finger protein 302
  Uniprot ID: Q9NR11
  ENSP ID: ENSP00000405219

SEQ ID NO: 99640 - protein, 399 aa, Homo sapiens; identical to SEQ ID NO: 99637
  Payload ID: 19865
  Gene Name: zinc finger protein 302
  Uniprot ID: Q9NR11
  ENSP ID: ENSP00000421028

SEQ ID NO: 99641 - protein, 132 aa, Homo sapiens
  Payload ID: 19865
  Gene Name: zinc finger protein 302
  ENSP ID: ENSP00000421201
MSQVTFSDVAIDFSHEEWACLDSAQRDLYKDVMVQNYENLVSVAGLSVTKPYVIMLLEDGKEPWMMEKKLSKAYPFPLSHSVPASVNFGFSALFEHCSEVTEIFELSELCVFWVLHFLSNSPNSTVEAFFKK

SEQ ID NO: 99642 - protein, 142 aa, Homo sapiens
  Payload ID: 19865
  Gene Name: zinc finger protein 302
  ENSP ID: ENSP00000421696
MSQVTFSDVAIDFSHEEWACLDSAQRDLYKDVMVQNYENLVSVGLSVTKPYVIMLLEDGKEPWMMEKKLSKDWESRWENKELSTKKDIYDEDSPQPVTMEKVVKQSYEFSNSNKNLEYTECDTFRSTFHSKSTLSEPQNNSA

SEQ ID NO: 99643 - protein, 131 aa, Homo sapiens
  Payload ID: 19865
  Gene Name: zinc finger protein 302
  ENSP ID: ENSP00000423235
MSQVTFSDVAIDFSHEEWACLDSAQRDLYKDVMVQNYENLVSVGLSVTKPYVIMLLEDGKEPWMMEKKLSKAYPFPLSHSVPASVNFGFSALFEHCSEVTEIFELSELCVFWVLHFLSNSPNSTVEAFFKK

SEQ ID NO: 99644 - protein, 120 aa, Homo sapiens
  Payload ID: 19865
  Gene Name: zinc finger protein 302
  ENSP ID: ENSP00000423460
MSQVTFSDVAIDFSHEEWACLDSAQRDLYKDVMVQNYENLVSVGLSVTKPYVIMLLEDGKEPWMMEKKLSKAYPFPLSHSVPASVNFGFSALFEHCSEVTEIFELSELCVFWVLHFLSNS

SEQ ID NO: 99645 - protein, 132 aa, Homo sapiens; identical to SEQ ID NO: 99641
  Payload ID: 19865
  Gene Name: zinc finger protein 302
  ENSP ID: ENSP00000424292

SEQ ID NO: 99646 - protein, 28 aa, Homo sapiens
  Payload ID: 19865
  Gene Name: zinc finger protein 302
  ENSP ID: ENSP00000477197
MSQIGNQDGKTRNYQQRRIFMMKIHPNQ

SEQ ID NO: 99647 - protein, 400 aa, Homo sapiens
  Payload ID: 19865
  Gene Name: zinc finger protein 302
  ENSP ID: ENSP00000481754
MSQVTFSDVAIDFSHEEWACLDSAQRDLYKDVMVQNYENLVSVAGLSVTKPYVIMLLEDGKEPWMMEKKLSKDWESRWENKELSTKKDIYDEDSPQPVTMEKVVKQSYEFSNSNKNLEYTECDTFRSTFHSKSTLSEPQNNSAEGNSHKYDILKKNLSKKSVIKSERINGGKKLLNSNKSGAAFNQSKSLTLPQTCNREKIYTCSECGKAFGKQSILSRHWRIHTGEKPYECRECGKTFSHGSSLTRHQISHSGEKPYKCIECGKAFSHGSSLTNHQSTHTGEKPYECMNCGKSFSRVSLLIQHLRIHTQEKRYECRICGKAFIHSSSLIHHQKSHTGEKPYECRECGKAFCCSSHLTQHQRIHSMKKKYECNKCLKVFSSFSFLVQHQSIHTEEKPFEV

SEQ ID NO: 99648 - protein, 478 aa, Homo sapiens
  Payload ID: 19865
  Gene Name: zinc finger protein 302
  ENSP ID: ENSP00000486577
MSQVTFSDVAIDFSHEEWACLDSAQRDLYKDVMVQNYENLVSVAGLSVTKPYVIMLLEDGKEPWMMEKKLSKAYPFPLSHSVPASVNFGFSALFEHCSEVTEIFELSELCVFWVLHFLSNSPNSTVEAFFKKKKKKKKKKKRQCFAFLIYFRLGIKMGKQGIINKEGYLEDSPQPVTMEKVVKQSYEFSNSNKNLEYTECDTFRSTFHSKSTLSEPQNNSAEGNSHKYDILKKNLSKKSVIKSERINGGKKLLNSNKSGAAFNQSKSLTLPQTCNREKIYTCSECGKAFGKQSILSRHWRIHTGEKPYECRECGKTFSHGSSLTRHQISHSGEKPYKCIECGKAFSHGSSLTNHQSTHTGEKPYECMNCGKSFSRVSLLIQHLRIHTQEKRYECRICGKAFIHSSSLIHHQKSHTGEKPYECRECGKAFCCSSHLTQHQRIHSMKKKYECNKCLKVFSSFSFLVQHQSIHTEEKPFEV

SEQ ID NO: 99649 - protein, 659 aa, Homo sapiens
  Payload ID: 19866
  Gene Name: zinc finger protein 304
  Uniprot ID: Q9HCX3
  ENSP ID: ENSP00000282286
MAAAVLMDRVQSCVTFEDVFVYFSREEWELLEEAQRFLYRDVMLENFALVATLGFWCEAEHEAPSEQSVSVEGVSQVRTAESGLFQKAHPCEMCDPLLKDILHLAEHQGSHLTQKLCTRGLCRRRFSFSANFYQHQKQHNGENCFRGDDGGASFVKSCTVHMLGRSFTCREEGMDLPDSSGLFQHQTTYNRVSPCRRTECMESFPHSSSLRQHQGDYDGQMLFSCGDEGKAFLDTFTLLDSQMTHAEVRPFRCLPCGNVFKEKSALINHRKIHSGEISHVCKECGKAFIHLHHLKMHQKFHTGKRHYTCSECGKAFSRKDTLVQHQRVHTGERSYDCSECGKAYSRSSHLVQHQRIHTGERPYKCNKCGKAFSRKDTLVQHQRFHTGERPYECSECGKFFSQSSHLIEHWRIHTGARPYECIECGKFFSHNSSLIKHRRVHTGARSYVCSKCGKAFGCKDTLVQHQIIHTGARPYECSECGKAFSRKDTLVQHQKIHTGERPYECGECGKFFSHSSNLIVHQRIHTGAKPYECNECGKCFSHNSSLILHQRVHTGARPYVCSECGKAYISSSHLVQHKKVHTGARPYECSECGKFFSRNSGLILHQRVHTGEKPYVCSECGKAYSRSSHLVRHQKAHTGERAHECNSFGGPLAASLKLV

SEQ ID NO: 99650 - protein, 659 aa, Homo sapiens; identical to SEQ ID NO: 99649
  Payload ID: 19866
  Gene Name: zinc finger protein 304
  Uniprot ID: Q9HCX3
  ENSP ID: ENSP00000375586

SEQ ID NO: 99651 - protein, 706 aa, Homo sapiens
  Payload ID: 19866
  Gene Name: zinc finger protein 304
  ENSP ID: ENSP00000401642
MAAAVLMDRVQSCVTFEDVFVYFSREEWELLEEAQRFLYRDVMLENFALVATLAFIFPVPCSCAVGGGRKPWVPDRADITAATVKETYRGHGPAEWELEEGFWCEAEHEAPSEQSVSVEGVSQVRTAESGLFQKAHPCEMCDPLLKDILHLAEHQGSHLTQKLCTRGLCRRRFSFSANFYQHQKQHNGENCFRGDDGGASFVKSCTVHMLGRSFTCREEGMDLPDSSGLFQHQTTYNRVSPCRRTECMESFPHSSSLRQHQGDYDGQMLFSCGDEGKAFLDTFTLLDSQMTHAEVRPFRCLPCGNVFKEKSALINHRKIHSGEISHVCKECGKAFIHLHHLKMHQKFHTGKRHYTCSECGKAFSRKDTLVQHQRVHTGERSYDCSECGKAYSRSSHLVQHQRIHTGERPYKCNKCGKAFSRKDTLVQHQRFHTGERPYECSECGKFFSQSSHLIEHWRIHTGARPYECIECGKFFSHNSSLIKHRRVHTGARSYVCSKCGKAFGCKDTLVQHQIIHTGARPYECSECGKAFSRKDTLVQHQKIHTGERPYECGECGKFFSHSSNLIVHQRIHTGAKPYECNECGKCFSHNSSLILHQRVHTGARPYVCSECGKAYISSSHLVQHKKVHTGARPYECSECGKFFSRNSGLILHQRVHTGEKPYVCSECGKAYSRSSHLVRHQKAHTGERAHECNSFGGPLAASLKLV

SEQ ID NO: 99652 - protein, 617 aa, Homo sapiens
  Payload ID: 19866
  Gene Name: zinc finger protein 304
  ENSP ID: ENSP00000470319
MLENFALVATLGFWCEAEHEAPSEQSVSVEGVSQVRTAESGLFQKAHPCEMCDPLLKDILHLAEHQGSHLTQKLCTRGLCRRRFSFSANFYQHQKQHNGENCFRGDDGGASFVKSCTVHMLGRSFTCREEGMDLPDSSGLFQHQTTYNRVSPCRRTECMESFPHSSSLRQHQGDYDGQMLFSCGDEGKAFLDTFTLLDSQMTHAEVRPFRCLPCGNVFKEKSALINHRKIHSGEISHVCKECGKAFIHLHHLKMHQKFHTGKRHYTCSECGKAFSRKDTLVQHQRVHTGERSYDCSECGKAYSRSSHLVQHQRIHTGERPYKCNKCGKAFSRKDTLVQHQRFHTGERPYECSECGKFFSQSSHLIEHWRIHTGARPYECIECGKFFSHNSSLIKHRRVHTGARSYVCSKCGKAFGCKDTLVQHQIIHTGARPYECSECGKAFSRKDTLVQHQKIHTGERPYECGECGKFFSHSSNLIVHQRIHTGAKPYECNECGKCFSHNSSLILHQRVHTGARPYVCSECGKAYISSSHLVQHKKVHTGARPYECSECGKFFSRNSGLILHQRVHTGEKPYVCSECGKAYSRSSHLVRHQKAHTGERAHECNSFGGPLAASLKLV

SEQ ID NO: 99653 - protein, 666 aa, Homo sapiens
  Payload ID: 19867
  Gene Name: zinc finger protein 311
  Uniprot ID: Q5JNZ3
  ENSP ID: ENSP00000366384
MQEVVLLDESSGPPSQLLWTRQDTQLPQESALLPAPYPAFTKDGSQGNLPQADITLMSQAQESVTFEDVAVNFTNREWQCLTYAQRHLYKDVMLENYGNMVSLGFPFPKPPLISHLEREVDPCVQDPQDRESLSCSYPVSADKMWPENEKASSQQEIFENGEAYWMKFNSLLKVDSRDPKVREVCVQDVKLENQWETSIREKLREEKEGSEEVTCKKGKNQKVLSKNLNPNSKHSQCNKVLIAQKLHECARCGKNFSWHSDLILHEQIHSGEKPHVCNECGKAFKTRNQLSMHRIIHTGEKPFNCTQCGKAFNSRSALCRHKKTHSGEKPHECRDCGKAFKTRNRLCMHQLIHTGEKPYKCNCCGKAFQFKHSLTIHGRIHTGEKPYECEECGKAFSGSSDLTKHIRIHTGERPYECSKCGRAFSRSSDLSKHKRIHTREKHYGCPQCGKDFSIKAELTKHRRIHTEEKRYRCEECGKAFRHNCKRRAHEREHTGEKPYQCRDCGKTFQDKHCLTIHQRIHTGEKPYKCLECGKAFSGKSNLTNHRRIHTGEKPHKCEVCGMAFHHSSVLRQHKRIHTGEKPYTCSECGTSFRQGSALIGHKRVHTGEKPYECEECGKAFRVSSNLTGHKKRKHQVWSTHELDGSRKSLSPVTVSQTSVVSILTSA

SEQ ID NO: 99654 - protein, 666 aa, Homo sapiens; identical to SEQ ID NO: 99653
  Payload ID: 19867
  Gene Name: zinc finger protein 311
  Uniprot ID: Q5JNZ3
  ENSP ID: ENSP00000373151

SEQ ID NO: 99655 - protein, 666 aa, Homo sapiens
  Payload ID: 19867
  Gene Name: zinc finger protein 311
  Uniprot ID: Q5JNZ3
  ENSP ID: ENSP00000398440
MQEVVLLDESSGPPSQLLWTRQDTQLPQESALLPAPYPAFTKDGSQGNLPQADITLMSQAQESVTFEDVAVNFTNREWQCLTYAQRHLYKDVMLENYGNMVSLGFPFPKPPLISHLEREVDPCVQDPQDRESLSCSYPVSADKMWPENEKASSQQEIFENGEAYWMKFNSLLKVDSRDPKVREVCVQDVKLENQWETSIREKLREEKEGSEEVTCKKGKNQKVLSKNLNPNSKHSQCNKVLIAQKLHECARCGKNFSWHSDLILHEQIHSGEKPHVCNECGKAFKTRNQLSMHRIIHTGEKPFNCTQCGKAFNSRSALCRHKKTHSGEKPHECRDCGKAFKTRNRLCMHQLIHTGEKPYKCNCCGKAFQFKHSLTIHGRIHTGEKPYECEECGKAFSGSSDLTKHIRIHTGERPYECSKCGRAFSRSSDLSKHKRIHTREKHYGCPQCGKDFSIKAELTKHRRIHTEEKRYRCEECGKAFRHNCKRRAHEREHTGEKPYQCRDCGKTFQDQHCLTIHQRIHTGEKPYKCLECGKAFSGKSNLTNHRRIHTGEKPHKCEVCGMAFHHSSVLRQHKRIHTGEKPYTCSECGTSFRQGSALIGHKRVHTGEKPYECEECGKAFRVSSNLTGHKKRKHQVWSTHELDGSRKSLSPVTVSQTSVVSILTSA

SEQ ID NO: 99656 - protein, 666 aa, Homo sapiens; identical to SEQ ID NO: 99653
  Payload ID: 19867
  Gene Name: zinc finger protein 311
  Uniprot ID: Q5JNZ3
  ENSP ID: ENSP00000398983

SEQ ID NO: 99657 - protein, 666 aa, Homo sapiens; identical to SEQ ID NO: 99653
  Payload ID: 19867
  Gene Name: zinc finger protein 311
  Uniprot ID: Q5JNZ3
  ENSP ID: ENSP00000399157

SEQ ID NO: 99658 - protein, 666 aa, Homo sapiens; identical to SEQ ID NO: 99653
  Payload ID: 19867
  Gene Name: zinc finger protein 311
  Uniprot ID: Q5JNZ3
  ENSP ID: ENSP00000405154

SEQ ID NO: 99659 - protein, 666 aa, Homo sapiens; identical to SEQ ID NO: 99653
  Payload ID: 19867
  Gene Name: zinc finger protein 311
  Uniprot ID: Q5JNZ3
  ENSP ID: ENSP00000415772

SEQ ID NO: 99660 - protein, 1004 aa, Homo sapiens
  Payload ID: 19868
  Gene Name: zinc finger protein 316
  Uniprot ID: A6NFI3
  ENSP ID: ENSP00000477706
MAALHTTPDSPAAQLERAEDGSECDPDQEEEEEEEEKGEEVQEVEEEEEEIVVEEEEEGVAEVVQDAQVEAVAEVEVEADVEEEDVKEVLAEEECPALGTQERLSRGGDAKSPVLQEKGLQASRAPATPRDEDLEEEEEEEEDEDEDDLLTAGCQELVTFEDVAVYFSLEEWERLEADQRGLYQEVMQENYGILVSLGYPIPKPDLIFRLEQGEEPWVPDSPRPEEGDIVTGVYTGAWFWTDDIEDHEEEDDEDFLAEVAEEENEPPGLWSAAYGVGDVPGTWGPDDSDSAQTPEGWGPDPGGLGVLADGSEAKPFLPGREPGANLLSPWAFPAAVAPPAGRPETTCDVCGKVFPHRSRLAKHQRYHAAVKPFGCEECGKGFVYRSHLAIHQRTHTGEKPFPCPDCGKRFVYKSHLVTHRRIHTGERPYRCAFCGAGFGRRSYLVTHQRTHTGERPYPCSHCGRSFSQSSALARHQAVHTADRPHCCPDCGQAFRLRADFQRHRRGGGCAEAGGDGPRREPGETAAAAGPEDTDPGPEGSEVGEADGEAEAAAEEREEAAVAAPTPSGKVDPAPERRFLELGNGLGEGEGPSSHPLGFHFPVHPKSWLHPDSFPILGLPDFRERLPVDGRPLPAPLGGPLSLVEGTGLACDPFGGGGAAGGGGGLRAFGPAIGGLLAEPAPAALAEEESPWICSDCGKTFGRRAALAKHQRYHAGERPHRCADCGKSFVYGSHLARHRRTHTGERPFPCPECGARFARGSHLAAHVRGHTGEKPFVCGVCGAGFSRRAHLTAHGRAHTGERPYACGECGRRFGQSAALTRHQWAHAEEKPHRCPDCGKGFGHSSDFKRHRRTHTGEKPFRCADCGRGFAQRSNLAKHRRGHTGERPFPCPECGKRFSQRSVLVTHQRTHTGERPYACANCGRRFSQSSHLLTHMKTHRGATAAPGSGSAPAPAPKPEAAAKGPSSAGPGERGSALLEFAGGTSFGSEHQAAFAGPSGAYREGVL

SEQ ID NO: 99661 - protein, 40 aa, Homo sapiens
  Payload ID: 19868
  Gene Name: zinc finger protein 316
  ENSP ID: ENSP00000482395
MQENYGILVSLGYPIPKPDLIFRLEQGEEPWVPDSPRPEE

SEQ ID NO: 99662 - protein, 595 aa, Homo sapiens
  Payload ID: 19869
  Gene Name: zinc finger protein 317
  Uniprot ID: Q96PQ6
  ENSP ID: ENSP00000247956
MAALSPTFATSTQDSTCLQDSEFPVSSKDHSCPQNLDLFVCSGLEPHTPSVGSQESVTFQDVAVDFTEKEWPLLDSSQRKLYKDVMLENYSNLTSLGYQVGKPSLISHLEQEEEPRTEERGAHQGACADWETPSKTKWSLLMEDIFGKETPSGVTMERAGLGEKSTEYAHLFEVFGMDPHLTQPMGRHAGKRPYHRRDYGVAFKGRPHLTQHMSMYDGRKMHECHQCQKAFTTSASLTRHRRIHTGEKPYECSDCGKAFNDPSALRSHARTHLKEKPFDCSQCGNAFRTLSALKIHMRVHTGERPYKCDQCGKAYGRSCHLIAHKRTHTGERPYECHDCGKAFQHPSHLKEHVRNHTGEKPYACTQCGKAFRWKSNFNLHKKNHMVEKTYECKECGKSFGDLVSRRKHMRIHIVKKPVECRQCGKTFRNQSILKTHMNSHTGEKPYGCDLCGKAFSASSNLTAHRKIHTQERRYECAACGKVFGDYLSRRRHMSVHLVKKRVECRQCGKAFRNQSTLKTHMRSHTGEKPYECDHCGKAFSIGSNLNVHRRIHTGEKPYECLVCGKAFSDHSSLRSHVKTHRGEKLFVSSVWKRLQ

SEQ ID NO: 99663 - protein, 563 aa, Homo sapiens
  Payload ID: 19869
  Gene Name: zinc finger protein 317
  Uniprot ID: Q96PQ6
  ENSP ID: ENSP00000353554
MAALSPTFATSTQDSTCLQDSEFPVSSKDHSCPQNLDLFVCSGLEPHTPSVGSQESVTFQDVAVDFTEKEWPLLDSSQRKLYKDVMLENYSNLTSLDWETPSKTKWSLLMEDIFGKETPSGVTMERAGLGEKSTEYAHLFEVFGMDPHLTQPMGRHAGKRPYHRRDYGVAFKGRPHLTQHMSMYDGRKMHECHQCQKAFTTSASLTRHRRIHTGEKPYECSDCGKAFNDPSALRSHARTHLKEKPFDCSQCGNAFRTLSALKIHMRVHTGERPYKCDQCGKAYGRSCHLIAHKRTHTGERPYECHDCGKAFQHPSHLKEHVRNHTGEKPYACTQCGKAFRWKSNFNLHKKNHMVEKTYECKECGKSFGDLVSRRKHMRIHIVKKPVECRQCGKTFRNQSILKTHMNSHTGEKPYGCDLCGKAFSASSNLTAHRKIHTQERRYECAACGKVFGDYLSRRRHMSVHLVKKRVECRQCGKAFRNQSTLKTHMRSHTGEKPYECDHCGKAFSIGSNLNVHRRIHTGEKPYECLVCGKAFSDHSSLRSHVKTHRGEKLFVSSVWKRLQ

SEQ ID NO: 99664 - protein, 106 aa, Homo sapiens
  Payload ID: 19869
  Gene Name: zinc finger protein 317
  ENSP ID: ENSP00000465780
MAALSPTFATSTQDSTCLQDSEFPVSSKDHSCPQNLDLFVCSGLEPHTPSVGSQESVTFQDVAVDFTEKEWPLLDSSQRKLYKDVMLENYSNLTSLEILAPPFCCS

SEQ ID NO: 99665 - protein, 44 aa, Homo sapiens
  Payload ID: 19869
  Gene Name: zinc finger protein 317
  ENSP ID: ENSP00000468213
ADWETPSKTKWSLLMEDIFGKETPSGVTMVFLQLVPSMSHSPGH

SEQ ID NO: 99666 - protein, 2279 aa, Homo sapiens
  Payload ID: 19870
  Gene Name: zinc finger protein 318
  Uniprot ID: Q5VUA4
  ENSP ID: ENSP00000354964
MYRSSARSSVSSHRPKDDGGGGPRSGRSSGSSSGPARRSSPPPPPSGSSSRTPARRPRSPSGHRGRRASPSPPRGRRVSPSPPRARRGSPSPPRGRRLFPPGPAGFRGSSRGESRADYARDGRGDHPGDSGSRRRSPGLCSDSLEKSLRITVGNDHFCVSTPERRRLSDRLGSPVDNLEDMDRDDLTDDSVFTRSSQCSRGLERYISQEEGPLSPFLGQLDEDYRTKETFLHRSDYSPHISCHDELLRGTERNREKLKGYSIRSEERSREAKRPRYDDTVKINSMGGDHPSFTSGTRNYRQRRRSPSPRFLDPEFRELDLARRKREEEEERSRSLSQELVGVDGGGTGCSIPGLSGVLTASEPGYSLHRPEEVSVMPKKSILKKRIEVDIMEPSMQLESFSSSTSSSQDHPLYSGHPSLPLSGAIAAFASEIENKGTMVETALKEPQGNLYQWGPLPGIPKDNSPLREKFGSFLCHKDNLDLKAEGPERHTDFLLPHERASQDGSGFSRILSMLADSTSTQEKRRRSFPDIEDEEKFLYGDEEEDLKAESVPKPLGSSESEVMRQKASSLPSSAPAVKLESLEETNPEYAKIHDLLKTIGLDIGVAEISQLAARTQERLHGKKPSLRSSADRRSSVDRYFSADHCSSVDHRFSADRCSSVDHCFSADRRSSDPHRLESREAHHSNTHSPEVSHPHPPSPVDPYLLTKNSPPFLKSDHPVGHISGPEVVGSGFQSSVAVRCMLPSAPSAPIRLPHTAALSQFHMPRASQFAAARIPPNYQGPAIPPASFDAYRHYMAYAASRWPMYPTSQPSNHPVPEPHRIMPITKQATRSRPNLRVIPTVTPDKPKQKESLRGSIPAAQVPVQVSIPSLIRYNPEKISDEKNRASQKQKVIEEREKLKNDREARQKKMYYLRTELERLHKQQGEMLRKKRREKDGHKDPLLVEVSRLQDNIMKDIAELRQEAEEAEKKQSELDKVAQILGINIFDKSQKSLSDSREPTEKPGKAEKSKSPEKVSSFSNSSSNKESKVNNEKFRTKSPKPAESPQSATKQLDQPTAAYEYYDAGNHWCKDCNTICGTMFDFFTHMHNKKHTQTLDPYNRPWASKTQSEAKQDAIKRTDKITVPAKGSEFLVPISGFYCQLCEEFLGDPISGEQHVKGHQHNEKYKKYVDENPLYEERRNLDRQAGLAVVLETERRRQSELKRKLSEKPKEEKKEKKAKAVKEVKEDDKVSEKLEDQLSEGRNSPEKAENKRNTGIKLQLKEEVKKESPTSSSFGKFSWKKPEKEEEKSSLVTPSISKEEILESSKDKEDGKTEAGKAKPIKIKLSGKTVVAHTSPWMPVVTTSTQTKIRPNLPIPSTVLRKSCSATMSKPAPLNTFLSIKSSGTTAKPLPVVKESSADLLLPPDIISKAFGGEEVILKGSPEEKVVLAEKSEPSHLPEQILPPPPPPPPPPPPPPPVIPHPAAPSAAQANAILAPVKSNPVVSQTLSPGFVGPNILNPVLPVAIMASAQPAAIPSDETAPGVSESDRDQTLFSVLVRPPPPLSSVFSEQAKKLEKRNSCLATANAKDLYDIFYSSGGKGAPETKGAPETKLSGGPLANGENSNLSRTKSSDTSSTSPLNSSASQEELHQDEGLVAAPIVSNSEKPIAKTLVALGKWSVVEHVGPKSTGSTYGFLQPLTRLCQSRPYETITPKTDTLAIWTSSSFQSDTSRDISPEKSELDLGEPGPPGVEPPPQLLDIQCKESQKLVEIHLRESVNQDKESQELRKSEDCRESEIETNTELKERVKELSEGIVDEGVSTSIGPHSIDDSNLNHGNRYMWEGEVKQPNLLMIDKEAEQSNKLMTGSETPSKVVIKLSPQACSFTKAKLDSFLSEARSLLNPQDTPVKISAPELLLHSPARSAMCLTGSPQEQGVSVVSEEGLENSAPESASRTSRYRSLKLKRERSKDFQVKKIYELAVWDENKKRPETWESPEKPKTEALELQDVHPELTVTIESKALEDFEATDLKVEELTALGNLGDMPVDFCTTRVSPAHRSPTVLCQKVCEENSVSPIGCNSSDPADFEPIPSFSGFPLDSPKTLVLDFETEGERNSPNPRSVRIPSPNILKTGLTENVDRGLGGLEGTHQALDLLAGGMMPEEVKESSQLDKQESLGLELKTINSAGLGPSPCLPDLVDFVTRTSGVQKDKLCSPLSEPGDPSKCSSLELGPLQLEISNASTTEVAILQVDDDSGDPLNLVKAPVSRSPPREQVIEDNMVPQGMPEQETTVGAIQDHTESSVHN

SEQ ID NO: 99667 - protein, 79 aa, Homo sapiens
  Payload ID: 19870
  Gene Name: zinc finger protein 318
  ENSP ID: ENSP00000475511
  MOD_RES (1)..(1): Any amino acid
XPAESPQSATKQLDQPTAAYEYYDAGNHWCKDCNTICGTMFDFFTHMHNKKHTQGQFQKSSDFQKEGLQQTFLPPERQG

SEQ ID NO: 99668 - protein, 1117 aa, Homo sapiens
  Payload ID: 19870
  Gene Name: zinc finger protein 318
  Uniprot ID: Q5VUA4
  ENSP ID: ENSP00000475748
MYRSSARSSVSSHRPKDDGGGGPRSGRSSGSSSGPARRSSPPPPPSGSSSRTPARRPRSPSGHRGRRASPSPPRGRRVSPSPPRARRGSPSPPRGRRLFPPGPAGFRGSSRGESRADYARDGRGDHPGDSGSRRRSPGLCSDSLEKSLRITVGNDHFCVSTPERRRLSDRLGSPVDNLEDMDRDDLTDDSVFTRSSQCSRGLERYISQEEGPLSPFLGQLDEDYRTKETFLHRSDYSPHISCHDELLRGTERNREKLKGYSIRSEERSREAKRPRYDDTVKINSMGGDHPSFTSGTRNYRQRRRSPSPRFLDPEFRELDLARRKREEEEERSRSLSQELVGVDGGGTGCSIPGLSGVLTASEPGYSLHRPEEVSVMPKKSILKKRIEVDIMEPSMQLESFSSSTSSSQDHPLYSGHPSLPLSGAIAAFASEIENKGTMVETALKEPQGNLYQWGPLPGIPKDNSPLREKFGSFLCHKDNLDLKAEGPERHTDFLLPHERASQDGSGFSRILSMLADSTSTQEKRRRSFPDIEDEEKFLYGDEEEDLKAESVPKPLGSSESEVMRQKASSLPSSAPAVKLESLEETNPEYAKIHDLLKTIGLDIGVAEISQLAARTQERLHGKKPSLRSSADRRSSVDRYFSADHCSSVDHRFSADRCSSVDHCFSADRRSSDPHRLESREAHHSNTHSPEVSHPHPPSPVDPYLLTKNSPPFLKSDHPVGHISGPEVVGSGFQSSVAVRCMLPSAPSAPIRLPHTAALSQFHMPRASQFAAARIPPNYQGPAIPPASFDAYRHYMAYAASRWPMYPTSQPSNHPVPEPHRIMPITKQATRSRPNLRVIPTVTPDKPKQKESLRGSIPAAQVPVQVSIPSLIRYNPEKISDEKNRASQKQKVIEEREKLKNDREARQKKMYYLRTELERLHKQQGEMLRKKRREKDGHKDPLLVEVSRLQDNIMKDIAELRQEAEEAEKKQSELDKVAQILGINIFDKSQKSLSDSREPTEKPGKAEKSKSPEKVSSFSNSSSNKESKVNNEKFRTKSPKPAESPQSATKQLDQPTAAYEYYDAGNHWCKDCNTICGTMFDFFTHMHNKKHTQGQFQKSSDFQKEGLQQTFLPPERQG

SEQ ID NO: 99669 - protein, 582 aa, Homo sapiens
  Payload ID: 19871
  Gene Name: zinc finger protein 319
  Uniprot ID: Q9P2F9
  ENSP ID: ENSP00000299237
MSESWQQPPQTQPQQPQPPQPQHHAEPPPALAEHTLPPGTAENPLGCAVYGILLQPDPGLQPPQHAPLQAAGEPGPKCGVCGHDLAHLSSPHEHQCLAGHDRSFQCTQCLKIFHQATDLLEHQCVQAEQKPFVCGVCKMGFSLLTSLAQHHSSHSGLVKCSICEKTYKPAEAAEPATTAAPSLPAAPAPSTVTPAEQADKPYSCPICQKPFKHLSELSRHERIHTGEKPYKCTLCDKSFSQSSHLVHHKRTHSSERPYKCAVCEKTFKHRSHLVRHMYAHSGEHHLFRCNVCELHFKESSELLQHPCTPSGERPFRCGECQKAFKRPSDLRQHERTHSAERPFKCDLCPMGFKQQYALMRHRRTHKTEEPFKCGLCEKGFGQPSHLLYHQHVHTLETLFKCPVCQKGFDQSAELLRHKCLPGAAERPFKCPVCNKAYKRASALQKHQLAHCAAAEKPLRCTLCERRFFSSSEFVQHRCDPAREKPLKCPDCEKRFKYASDLQRHRRVHTGEKPYKCPNCDKAFKQREHLNKHQGVHAREQQFKCVWCGERFLDVALLQEHSAQHSAAAAAAEGAYQVAACLP

SEQ ID NO: 99670 - protein, 69 aa, Homo sapiens
  Payload ID: 19871
  Gene Name: zinc finger protein 319
  ENSP ID: ENSP00000457048
MSESWQQPPQTQPQQPQPPQPQHHAEPPPALAEHTLPPGTAENPLGCAVYGILLQPDPGLQPPQHAPLQ

SEQ ID NO: 99671 - protein, 273 aa, Homo sapiens
  Payload ID: 19872
  Gene Name: zinc finger protein 32
  Uniprot ID: P17041
  ENSP ID: ENSP00000363556
MFGFPTATLLDCHGRYAQNVAFFNVMTEAHHKYDHSEATGSSSWDIQNSFRREKLEQKSPDSKTLQEDSPGVRQRVYECQECGKSFRQKGSLTLHERIHTGQKPFECTHCGKSFRAKGNLVTHQRIHTGEKPYQCKECGKSFSQRGSLAVHERLHTGQKPYECAICQRSFRNQSNLAVHRRVHSGEKPYRCDQCGKAFSQKGSLIVHIRVHTGLKPYACTQCRKSFHTRGNCILHGKIHTGETPYLCGQCGKSFTQRGSLAVHQRSCSQRLTL

SEQ ID NO: 99672 - protein, 273 aa, Homo sapiens; identical to SEQ ID NO: 99671
  Payload ID: 19872
  Gene Name: zinc finger protein 32
  Uniprot ID: P17041
  ENSP ID: ENSP00000379143

SEQ ID NO: 99673 - protein, 509 aa, Homo sapiens
  Payload ID: 19873
  Gene Name: zinc finger protein 320
  Uniprot ID: A2RRD8
  ENSP ID: ENSP00000375660
MALSQGLLTFRDVAIEFSQEEWKCLDPAQRTLYRDVMLENYRNLVSLDISSKCMMNTLSSTGQGNTEVIHTGTLQRQASYHIGAFCSQEIEKDIHDFVFQWQEDETNDHEAPMTEIKKLTSSTDRYDQRHAGNKPIKGQLESRFHLHLRRHRRIHTGEKPYKCEECEKVFSCKSHLEIHRIIHTGEKPYKCKVCDKAFKHDSHLAKHTRIHRGDKHYTCNECGKVFDQKATLACHHRSHTGEKPYKCNECGKTFSQTSHLVYHHRLHTGEKPYKCNECGKTFARNSVLVIHKAVHTAEKPYKCNECGKVFKQRATLAGHRRVHTGEKPYRCEECDKVFSRKSHLERHRRIHTGEKPYKCKVCDKAFRSDSRLAEHQRVHTGERPYTCNECGKVFSTKAYLACHQKLHTGEKLYECEECDKVYIRKSHLERHRRIHTGEKPHKCGDCGKAFNSPSHLIRHQRIHTGQKSYKCHQCGKVFSLRSLLAEHQKIPFGDNCFKCNEYSKPSSIN

SEQ ID NO: 99674 - protein, 155 aa, Homo sapiens
  Payload ID: 19873
  Gene Name: zinc finger protein 320
  ENSP ID: ENSP00000468995
MALSQGLLTFRDVAIEFSQEEWKCLDPAQRTLYRDVMLENYRNLVSLGQGNTEVIHTGTLQRQASYHIGAFCSQEIEKDIHDFVFQWQEDETNDHEAPMTEIKKLTSSTDRYDQRHAGNKPIKGQLESRFHLHLRRHRRIHTGEKPYKCEECEKV

SEQ ID NO: 99675 - protein, 86 aa, Homo sapiens
  Payload ID: 19873
  Gene Name: zinc finger protein 320
  ENSP ID: ENSP00000470403
MALSQGLLTFRDVAIEFSQEEWKCLDPAQRTLYRDVMLENYRNLVSLDISSKCMMNTLSSTGQGNTEVIHTGTLQRQASYHIGAFC

SEQ ID NO: 99676 - protein, 25 aa, Homo sapiens
  Payload ID: 19873
  Gene Name: zinc finger protein 320
  ENSP ID: ENSP00000471548
MALSQGLLTFRDVAIEFSQEEWKCL

SEQ ID NO: 99677 - protein, 57 aa, Homo sapiens
  Payload ID: 19873
  Gene Name: zinc finger protein 320
  ENSP ID: ENSP00000471938
MALSQGLLTFRDVAIEFSQEEWKCLDPAQRTLYRDVMLENYRNLVSLDISSKCMMNT

SEQ ID NO: 99678 - protein, 123 aa, Homo sapiens
  Payload ID: 19873
  Gene Name: zinc finger protein 320
  ENSP ID: ENSP00000472651
MALSQGLLTFRDVAIEFSQEEWKCLDPAQRTLYRDVMLENYRNLVSLDISSKCMMNTLSSTGQGNTEVIHTGTLQRQASYHIGAFCSQEIEKDIHDFVFQWQEDETNDHEAPMTEIKKLTSST

SEQ ID NO: 99679 - protein, 117 aa, Homo sapiens
  Payload ID: 19873
  Gene Name: zinc finger protein 320
  ENSP ID: ENSP00000472908
MALSQGLLTFRDVAIEFSQEEWKCLDPAQRTLYRDVMLENYRNLVSLGLISRDLCYLRKTPRRQRKGARDGSSSGILDFQRCGYRVLFAGVETPGPCTERFIQGCDVGELQEPGVCG

SEQ ID NO: 99680 - protein, 509 aa, Homo sapiens; identical to SEQ ID NO: 99673
  Payload ID: 19873
  Gene Name: zinc finger protein 320
  Uniprot ID: A2RRD8
  ENSP ID: ENSP00000473091

SEQ ID NO: 99681 - protein, 402 aa, Homo sapiens
  Payload ID: 19874
  Gene Name: zinc finger protein 322
  Uniprot ID: Q6U7Q0
  ENSP ID: ENSP00000418897
MYTSEEKCNQRTQKRKIYNVCPRKGKKIFIHMHEIIQIDGHIYQCLECKQNFCENLALIMCERTHTGEKPYKCDMCEKTFVQSSDLTSHQRIHNYEKPYKCSKCEKSFWHHLALSGHQRTHAGKKFYTCDICGKNFGQSSDLLVHQRSHTGEKPYLCSECDKCFSRSTNLIRHRRTHTGEKPFKCLECEKAFSGKSDLISHQRTHTGERPYKCNKCEKSYRHRSAFIVHKRVHTGEKPYKCGACEKCFGQKSDLIVHQRVHTGEKPYKCLECMRSFTRSANLIRHQATHTHTFKCLEYEKSFNCSSDLIVHQRIHMEEKPHQWSACESGFLLGMDFVAQQKMRTQTEELHYKYTVCDKSFHQSSALLQHQTVHIGEKPFVCNVSEKGLELSPPHASEASQMS

SEQ ID NO: 99682 - protein, 402 aa, Homo sapiens; identical to SEQ ID NO: 99681
  Payload ID: 19874
  Gene Name: zinc finger protein 322
  Uniprot ID: Q6U7Q0
  ENSP ID: ENSP00000419728

SEQ ID NO: 99683 - protein, 26 aa, Homo sapiens
  Payload ID: 19874
  Gene Name: zinc finger protein 322
  ENSP ID: ENSP00000420301
MYTSEEKCNQRTQKRKIYNVCPRKGK

SEQ ID NO: 99684 - protein, 402 aa, Homo sapiens; identical to SEQ ID NO: 99681
  Payload ID: 19874
  Gene Name: zinc finger protein 322
  Uniprot ID: Q6U7Q0
  ENSP ID: ENSP00000478899

SEQ ID NO: 99685 - protein, 402 aa, Homo sapiens; identical to SEQ ID NO: 99681
  Payload ID: 19874
  Gene Name: zinc finger protein 322
  Uniprot ID: Q6U7Q0
  ENSP ID: ENSP00000482607

SEQ ID NO: 99686 - protein, 402 aa, Homo sapiens; identical to SEQ ID NO: 99681
  Payload ID: 19874
  Gene Name: zinc finger protein 322
  Uniprot ID: Q6U7Q0
  ENSP ID: ENSP00000483223

SEQ ID NO: 99687 - protein, 553 aa, Homo sapiens
  Payload ID: 19875
  Gene Name: zinc finger protein 324
  Uniprot ID: O75467
  ENSP ID: ENSP00000196482
MAFEDVAVYFSQEEWGLLDTAQRALYRRVMLDNFALVASLGLSTSRPRVVIQLERGEEPWVPSGTDTTLSRTTYRRRNPGSWSLTEDRDVSGEWPRAFPDTPPGMTTSVFPVAGACHSVKSLQRQRGASPSRERKPTGVSVIYWERLLLGSGSGQASVSLRLTSPLRPPEGVRLREKTLTEHALLGRQPRTPERQKPCAQEVPGRTFGSAQDLEAAGGRGHHRMGAVWQEPHRLLGGQEPSTWDELGEALHAGEKSFECRACSKVFVKSSDLLKHLRTHTGERPYECAQCGKAFSQTSHLTQHQRIHSGETPYACPVCGKAFRHSSSLVRHQRIHTAEKSFRCSECGKAFSHGSNLSQHRKIHAGGRPYACAQCGRRFCRNSHLIQHERTHTGEKPFVCALCGAAFSQGSSLFKHQRVHTGEKPFACPQCGRAFSHSSNLTQHQLLHTGERPFRCVDCGKAFAKGAVLLSHRRIHTGEKPFVCTQCGRAFRERPALFHHQRIHTGEKTVRRSRASLHPQARSVAGASSEGAPAKETEPTPASGPAAVSQPAEV

SEQ ID NO: 99688 - protein, 286 aa, Homo sapiens [sequence omitted]

SEQ ID NO: 99689 - protein, 553 aa, Homo sapiens; identical to SEQ ID NO: 99687
  Payload ID: 19875
  Gene Name: zinc finger protein 324
  Uniprot ID: O75467
  ENSP ID: ENSP00000444812

SEQ ID NO: 99690 - protein, 412 aa, Homo sapiens
  Payload ID: 19875
  Gene Name: zinc finger protein 324
  ENSP ID: ENSP00000471778
  MOD_RES (1)..(1): Any amino acid
XYWERLLLGSGSGQASVSLRLTSPLRPPEGVRLREKTLTEHALLGRQPRTPERQKPCAQEVPGRTFGSAQDLEAAGGRGHHRMGAVWQEPHRLLGGQEPSTWDELGEALHAGEKSFECRACSKVFVKSSDLLKHLRTHTGERPYECAQCGKAFSQTSHLTQHQRIHSGETPYACPVCGKAFRHSSSLVRHQRIHTAEKSFRCSECGKAFSHGSNLSQHRKIHAGGRPYACAQCGRRFCRNSHLIQHERTHTGEKPFVCALCGAAFSQGSSLFKHQRVHTGEKPFACPQCGRAFSHSSNLTQHQLLHTGERPFRCVDCGKAFAKGAVLLSHRRIHTGEKPFVCTQCGRAFRERPALFHHQRIHTGEKTVRRSRASLHPQARSVAGASSEGAPAKETEPTPASGPAAVSQPAEV

SEQ ID NO: 99691 - protein, 544 aa, Homo sapiens
  Payload ID: 19876
  Gene Name: zinc finger protein 324B
  Uniprot ID: Q6AW86
  ENSP ID: ENSP00000337473
MTFEDVAVYFSQEEWGLLDTAQRALYRHVMLENFTLVTSLGLSTSRPRVVIQLERGEEPWVPSGKDMTLARNTYGRLNSGSWSLTEDRDVSGEWPRAFPDTPPGMTTSVFPVADACHSVKSLQRQPGASPSQERKPTGVSVIYWERLLLGSRSDQASISLRLTSPLRPPKSSRPREKTFTEYRVPGRQPRTPERQKPCAQEVPGRAFGNASDLKAASGGRDRRMGAAWQEPHRLLGGQEPSTWDELGEALHAGEKSFECRACSKVFVKSSDLLKHLRTHTGERPYECTQCGKAFSQTSHLTQHQRIHSGETPYACPVCGKAFRHSSSLVRHQRIHTAEKSFRCSECGKAFSHGSNLSQHRKIHAGGRPYACAQCGRRFCRNSHLIQHERTHTGEKPFVCALCGAAFSQGSSLFLHQRVHTGEKPFACAQCGRSFSRSSNLTQHQLLHTGERPFRCVDCGKGFAKGAVLLSHRRIHTGEKPFVCTQCGRAFRERPALLHHQRIHTTEKTNAAAPDCTPGPGFLQGHHRKVRRGGKPSPVLKPAKV

SEQ ID NO: 99692 - protein, 544 aa, Homo sapiens; identical to SEQ ID NO: 99691
  Payload ID: 19876
  Gene Name: zinc finger protein 324B
  Uniprot ID: Q6AW86
  ENSP ID: ENSP00000438930

SEQ ID NO: 99693 - protein, 130 aa, Homo sapiens
  Payload ID: 19876
  Gene Name: zinc finger protein 324B
  ENSP ID: ENSP00000471086
MTFEDVAVYFSQEEWGLLDTAQRALYRHVMLENFTLVTSLGLSTSRPRVVIQLERGEEPWVPSGKDMTLARNTYGRLNSGEWELRWGELRTNLWPSPCPCFSDSGNTSSSPASYLTPFSSIISLSWRLLP

SEQ ID NO: 99694 - protein, 79 aa, Homo sapiens
  Payload ID: 19876
  Gene Name: zinc finger protein 324B
  ENSP ID: ENSP00000471122
MTFEDVAVYFSQEEWGLLDTAQRALYRHVMLENFTLVTSLGLSTSRPRVVIQLERGEEPWVPSGKDMTLARNTYGRLNS

SEQ ID NO: 99695 - protein, 138 aa, Homo sapiens
  Payload ID: 19876
  Gene Name: zinc finger protein 324B
  ENSP ID: ENSP00000472178
MTFEDVAVYFSQEEWGLLDTAQRALYRHVMLENFTLVTSLGLSTSRPRVVIQLERGEEPWVPSGKDMTLARNTYGRLNSGSWSLTEDRDVSGEWPRAFPDTPPGMTTSVFPVADACHSVKSLQRQPGASPSQERKPTG

SEQ ID NO: 99696 - protein, 147 aa, Homo sapiens
  Payload ID: 19876
  Gene Name: zinc finger protein 324B
  ENSP ID: ENSP00000473115
MTFEDVAVYFSQEEWGLLDTAQRALYRHVMLENFTLVTSLGLSTSRPRVVIQLERGEEPWVPSGKDMTLARNTYGRLNSGSWSLTEDRDVSGEWPRAFPDTPPGMTTSVFPVADACHSVKSLQRQPGASPSQERKPTGVSVIYWERL

SEQ ID NO: 99697 - protein, 582 aa, Homo sapiens
  Payload ID: 19877
  Gene Name: zinc finger protein 326
  Uniprot ID: Q5BKZ1
  ENSP ID: ENSP00000340796
MDFEDDYTHSACRNTYQGFNGMDRDYGPGSYGGMDRDYGHGSYGGQRSMDSYLNQSYGMDNHSGGGGGSRFGPYESYDSRSSLGGRDLYRSGYGFNEPEQSRFGGSYGGRFESSYRNSLDSFGGRNQGGSSWEAPYSRSKLRPGFMEDRGRENYSSYSSFSSPHMKPAPVGSRGRGTPAYPESTFGSRNYDAFGGPSTGRGRGRGHMGDFGSIHRPGIVVDYQNKSTNVTVAAARGIKRKMMQPFNKPSGTFIKKPKLAKPMEKISLSKSPTKTDPKNEEEEKRRIEARREKQRRRREKNSEKYGDGYRMAFTCSFCKFRTFEEKDIELHLESSSHQETLDHIQKQTKFDKVVMEFLHECMVNKFKKTSIRKQQTNNQTEVVKIIEKDVMEGVTVDDHMMKVETVHCSACSVYIPALHSSVQQHLKSPDHIKGKQAYKEQIKRESVLTATSILNNPIVKARYERFVKGENPFEIQDHSQDQQIEGDEEDEEKIDEPIEEEEDEDEEEEAEEVGEVEEVEEVEEVREGGIEGEGNIQGVGEGGEVGVVGEVEGVGEVEEVEELEEETAKEEPADFPVEQPEEN

SEQ ID NO: 99698 - protein, 70 aa, Homo sapiens
  Payload ID: 19877
  Gene Name: zinc finger protein 326
  Uniprot ID: Q5BKZ1
  ENSP ID: ENSP00000355318
MDFEDDYTHSACRNTYQGFNGMDRDYGPGSYGGMDRDYGHGSYGGQRSMDSYLNQSYGMDNHSGGGGGSR

SEQ ID NO: 99699 - protein, 493 aa, Homo sapiens
  Payload ID: 19877
  Gene Name: zinc finger protein 326
  ENSP ID: ENSP00000359476
MDFEDDYTHSACRNTYQGFNGMDRDYGPGSYGGMDRDYGHGSYGGQRSMDSYLNQSYGMDNHSGGGGGSSFSSPHMKPAPVGSRGRGTPAYPESTFGSRNYDAFGGPSTGRGRGRGHMGDFGSIHRPGIVVDYQNKSTNVTVAAARGIKRKMMQPFNKPSGTFIKKPKLAKPMEKISLSKSPTKTDPKNEEEEKRRIEARREKQRRRREKNSEKYGDGYRMAFTCSFCKFRTFEEKDIELHLESSSHQETLDHIQKQTKFDKVVMEFLHECMVNKFKKTSIRKQQTNNQTEVVKIIEKDVMEGVTVDDHMMKVETVHCSACSVYIPALHSSVQQHLKSPDHIKGKQAYKEQIKRESVLTATSILNNPIVKARYERFVKGENPFEIQDHSQDQQIEGDEEDEEKIDEPIEEEEDEDEEEEAEEVGEVEEVEEVEEVREGGIEGEGNIQGVGEGGEVGVVGEVEGVGEVEEVEELEEETAKEEPADFPVEQPEEN

SEQ ID NO: 99700 - protein, 53 aa, Homo sapiens
  Payload ID: 19877
  Gene Name: zinc finger protein 326
  ENSP ID: ENSP00000378084
MDFEDDYTHSACRNTYQGFNGMDRDYGPGSYGGLTFKDIYLKILLLSASKAYG

SEQ ID NO: 99701 - protein, 541 aa, Homo sapiens
  Payload ID: 19878
  Gene Name: zinc finger protein 329
  Uniprot ID: Q86UD4
  ENSP ID: ENSP00000350773
MRLKMTTRNFPEREVPCDVEVERFTREVPCLSSLGDGWDCENQEGHLRQSALTLEKPGTQEAICEYPGFGEHLIASSDLPPSQRVLATNGFHAPDSNVSGLDCDPALPSYPKSYADKRTGDSDACGKGFNHSMEVIHGRNPVREKPYKYPESVKSFNHFTSLGHQKIMKRGKKSYEGKNFENIFTLSSSLNENQRNLPGEKQYRCTECGKCFKRNSSLVLHHRTHTGEKPYTCNECGKSFSKNYNLIVHQRIHTGEKPYECSKCGKAFSDGSALTQHQRIHTGEKPYECLECGKTFNRNSSLILHQRTHTGEKPYRCNECGKPFTDISHLTVHLRIHTGEKPYECSKCGKAFRDGSYLTQHERTHTGEKPFECAECGKSFNRNSHLIVHQKIHSGEKPYECKECGKTFIESAYLIRHQRIHTGEKPYGCNQCQKLFRNIAGLIRHQRTHTGEKPYECNQCGKAFRDSSCLTKHQRIHTKETPYQCPECGKSFKQNSHLAVHQRLHSREGPSRCPQCGKMFQKSSSLVRHQRAHLGEQPMET

SEQ ID NO: 99702 - protein, 541 aa, Homo sapiens; identical to SEQ ID NO: 99701
  Payload ID: 19878
  Gene Name: zinc finger protein 329
  Uniprot ID: Q86UD4
  ENSP ID: ENSP00000439527

SEQ ID NO: 99703 - protein, 541 aa, Homo sapiens; identical to SEQ ID NO: 99701
  Payload ID: 19878
  Gene Name: zinc finger protein 329
  Uniprot ID: Q86UD4
  ENSP ID: ENSP00000470008

SEQ ID NO: 99704 - protein, 541 aa, Homo sapiens; identical to SEQ ID NO: 99701
  Payload ID: 19878
  Gene Name: zinc finger protein 329
  Uniprot ID: Q86UD4
  ENSP ID: ENSP00000470323

SEQ ID NO: 99705 - protein, 42 aa, Homo sapiens
  Payload ID: 19878
  Gene Name: zinc finger protein 329
  ENSP ID: ENSP00000471614
MRLKMTTRNFPEREVPCDVEVERFTREVPCLSSLGDGWDCEN

SEQ ID NO: 99706 - protein, 320 aa, Homo sapiens
  Payload ID: 19879
  Gene Name: zinc finger protein 330
  Uniprot ID: Q9Y3S2
  ENSP ID: ENSP00000262990
MPKKKTGARKKAENRREREKQLRASRSTIDLAKHPCNASMECDKCQRRQKNRAFCYFCNSVQKLPICAQCGKTKCMMKSSDCVIKHAGVYSTGLAMVGAICDFCEAWVCHGRKCLSTHACACPLTDAECVECERGVWDHGGRIFSCSFCHNFLCEDDQFEHQASCQVLEAETFKCVSCNRLGQHSCLRCKACFCDDHTRSKVFKQEKGKQPPCPKCGHETQETKDLSMSTRSLKFGRQTGGEEGDGASGYDAYWKNLSSDKYGDTSYHDEEEDEYEAEDDEEEEDEGRKDSDTESSDLFTNLNLGRTYASGYAHYEEQEN

SEQ ID NO: 99707 - protein, 153 aa, Homo sapiens
  Payload ID: 19879
  Gene Name: zinc finger protein 330
  ENSP ID: ENSP00000422251
MPKKKTGARKKAENRREREKQLRASRSTIDLAKHPCNASMECDKCQRRQKNRAFCYFCNSVQKLPICAQCGKTKCMMKSSDCVIKHAGVYSTGLAMVGAICDFCEAWVCHGRKCLSTHACACPLTDAECVECERGVWDHGGRIFSCSFCHNFL

SEQ ID NO: 99708 - protein, 35 aa, Homo sapiens
  Payload ID: 19879
  Gene Name: zinc finger protein 330
  ENSP ID: ENSP00000422574
MPKKKTGARKKAENRREREKQLRASRSTIDLAKHP

SEQ ID NO: 99709 - protein, 229 aa, Homo sapiens
  Payload ID: 19879
  Gene Name: zinc finger protein 330
  ENSP ID: ENSP00000422599
MPKKKTGARKKAENRREREKQLRASRSTIDLAKHPCNASMECDKCQRRQKNRAFCYFCNSVQKLPICAQCGKTKCMMKSSDCVIKHAGVYSTGLAMVGAICDFCEAWVCHGRKCLSTHACACPLTDAECVECERGVWDHGGRIFSCSFCHNFLCEDDQFEHQASCQVLEAETFKCVSCNRLGQHSCLRCKACFCDDHTRSKVFKQEKGKQPPCPKCGHETQETKDLSMS

SEQ ID NO: 99710 - protein, 139 aa, Homo sapiens
  Payload ID: 19879
  Gene Name: zinc finger protein 330
  ENSP ID: ENSP00000422966
MPKKKTGARKKAENRREREKQLRASRSTIDLAKHPCNASMECDKCQRRQKNRAFCYFCNSVQKLPICAQCGKTKCMMKSSDCVIKHAGVYSTGLAMVGAICDFCEAWVCHGRKCLSTHACACPLTDAECVECERGVWDH

SEQ ID NO: 99711 - protein, 41 aa, Homo sapiens
  Payload ID: 19879
  Gene Name: zinc finger protein 330
  ENSP ID: ENSP00000423217
MPKKKTGARKKAENRREREKQLRASRSTIDLAKHPCNASMD

SEQ ID NO: 99712 - protein, 77 aa, Homo sapiens
  Payload ID: 19879
  Gene Name: zinc finger protein 330
  ENSP ID: ENSP00000427201
MPKKKTGARKKAENRREREKQLRASRSTIDLAKHPCNASMECDKCQRENKVHDEVFRLCHKACWCIQYWPCNGGCNM

SEQ ID NO: 99713 - protein, 463 aa, Homo sapiens
  Payload ID: 19880
  Gene Name: zinc finger protein 331
  Uniprot ID: Q9NQX6
  ENSP ID: ENSP00000253144
MAQGLVTFADVAIDFSQEEWACLNSAQRDLYWDVMLENYSNLVSLDLESAYENKSLPTEKNIHEIRASKRNSDRRSKSLGRNWICEGTLERPQRSRGRYVNQMIINYVKRPATREGTPPRTHQRHHKENSFECKDCGKAFSRGYQLSQHQKIHTGEKPYECKECKKAFRWGNQLTQHQKIHTGEKPYECKDCGKAFRWGSSLVIHKRIHTGEKPYECKDCGKAFRRGDELTQHQRFHTGEKDYECKDCGKTFSRVYKLIQHKRIHSGEKPYECKDCGKAFICGSSLIQHKRIHTGEKPYECQECGKAFTRVNYLTQHQKIHTGEKPHECKECGKAFRWGSSLVKHERIHTGEKPYKCTECGKAFNCGYHLTQHERIHTGETPYKCKECGKAFIYGSSLVKHERIHTGVKPYGCTECGKSFSHGHQLTQHQKTHSGAKSYECKECGKACNHLNHLREHQRIHNS

SEQ ID NO: 99714 - protein, 463 aa, Homo sapiens; identical to SEQ ID NO: 99713
  Payload ID: 19880
  Gene Name: zinc finger protein 331
  Uniprot ID: Q9NQX6
  ENSP ID: ENSP00000393336

SEQ ID NO: 99715 - protein, 463 aa, Homo sapiens; identical to SEQ ID NO: 99713
  Payload ID: 19880
  Gene Name: zinc finger protein 331
  Uniprot ID: Q9NQX6
  ENSP ID: ENSP00000393817

SEQ ID NO: 99716 - protein, 463 aa, Homo sapiens; identical to SEQ ID NO: 99713
  Payload ID: 19880
  Gene Name: zinc finger protein 331
  Uniprot ID: Q9NQX6
  ENSP ID: ENSP00000421014

SEQ ID NO: 99717 - protein, 463 aa, Homo sapiens; identical to SEQ ID NO: 99713
  Payload ID: 19880
  Gene Name: zinc finger protein 331
  Uniprot ID: Q9NQX6
  ENSP ID: ENSP00000421728

SEQ ID NO: 99718 - protein, 166 aa, Homo sapiens
  Payload ID: 19880
  Gene Name: zinc finger protein 331
  ENSP ID: ENSP00000422471
MAQGLVTFADVAIDFSQEEWACLNSAQRDLYWDVMLENYSNLVSLDLESAYENKSLPTEKNIHEIRASKRNSDRRSKSLGRNWICEGTLERPQRSRGRYVNQMIINYVKRPATREGTPPRTHQRHHKENSFECKDCGKAFSRGYQLSQHQKIHTGEKPYECKECKK

SEQ ID NO: 99719 - protein, 85 aa, Homo sapiens
  Payload ID: 19880
  Gene Name: zinc finger protein 331
  ENSP ID: ENSP00000422586
MAQGLVTFADVAIDFSQEEWACLNSAQRDLYWDVMLENYSNLVSLDLESAYENKSLPTEKNIHEIRASKRNSDRRSKSLGRNWIC

SEQ ID NO: 99720 - protein, 463 aa, Homo sapiens; identical to SEQ ID NO: 99713
  Payload ID: 19880
  Gene Name: zinc finger protein 331
  Uniprot ID: Q9NQX6
  ENSP ID: ENSP00000423156

SEQ ID NO: 99721 - protein, 86 aa, Homo sapiens
  Payload ID: 19880
  Gene Name: zinc finger protein 331
  ENSP ID: ENSP00000423263
MAQGLVTFADVAIDFSQEEWACLNSAQRDLYWDVMLENYSNLVSLDLESAYENKSLPTEKNIHEIRASKRNSDRRSKSLGRNWICE

SEQ ID NO: 99722 - protein, 63 aa, Homo sapiens
  Payload ID: 19880
  Gene Name: zinc finger protein 331
  ENSP ID: ENSP00000423675
MAQGLVTFADVAIDFSQEEWACLNSAQRDLYWDVMLENYSNLVSLDLESAYENKSLPTEKNIH

SEQ ID NO: 99723 - protein, 99 aa, Homo sapiens
  Payload ID: 19880
  Gene Name: zinc finger protein 331
  ENSP ID: ENSP00000424835
MAQGLVTFADVAIDFSQEEWACLNSAQRDLYWDVMLENYSNLVSLDLESAYENKSLPTEKNIHEIRASKRNSDRRSKSLGRNWICEGTLERPQRSRGRY

SEQ ID NO: 99724 - protein, 64 aa, Homo sapiens
  Payload ID: 19880
  Gene Name: zinc finger protein 331
  ENSP ID: ENSP00000424929
MAQGLVTFADVAIDFSQEEWACLNSAQRDLYWDVMLENYSNLVSLDLESAYENKSLPTEKNIHE

SEQ ID NO: 99725 - protein, 66 aa, Homo sapiens
  Payload ID: 19880
  Gene Name: zinc finger protein 331
  ENSP ID: ENSP00000425517
MAQGLVTFADVAIDFSQEEWACLNSAQRDLYWDVMLENYSNLVSLDLESAYENKSLPTEKNIHEIR

SEQ ID NO: 99726 - protein, 105 aa, Homo sapiens
  Payload ID: 19880
  Gene Name: zinc finger protein 331
  ENSP ID: ENSP00000426127
MAQGLVTFADVAIDFSQEEWACLNSAQRDLYWDVMLENYSNLVSLDLESAYENKSLPTEKNIHEIRASKRNSDRRSKSLGRNWICEGTLERPQRSRGRYVNQMII

SEQ ID NO: 99727 - protein, 47 aa, Homo sapiens
  Payload ID: 19880
  Gene Name: zinc finger protein 331
  ENSP ID: ENSP00000426155
MAQGLVTFADVAIDFSQEEWACLNSAQRDLYWDVMLENYSNLVSLDL

SEQ ID NO: 99728 - protein, 98 aa, Homo sapiens
  Payload ID: 19880
  Gene Name: zinc finger protein 331
  ENSP ID: ENSP00000426458
MAQGLVTFADVAIDFSQEEWACLNSAQRDLYWDVMLENYSNLVSLDLESAYENKSLPTEKNIHEIRASKRNSDRRSKSLGRNWICEGTLERPQRSRGR

SEQ ID NO: 99729 - protein, 463 aa, Homo sapiens; identical to SEQ ID NO: 99713
  Payload ID: 19880
  Gene Name: zinc finger protein 331
  Uniprot ID: Q9NQX6
  ENSP ID: ENSP00000427439

SEQ ID NO: 99730 - protein, 177 aa, Homo sapiens
  Payload ID: 19880
  Gene Name: zinc finger protein 331
  ENSP ID: ENSP00000427532
MAQGLVTFADVAIDFSQEEWACLNSAQRDLYWDVMLENYSNLVSLDLESAYENKSLPTEKNIHEIRASKRNSDRRSKSLGRNWICEGTLERPQRSRGRYVNQMIINYVKRPATREGTPPRTHQRHHKENSFECKDCGKAFSRGYQLSQHQKIHTGEKPYECKECKKAFRWGNQLTQH

SEQ ID NO: 99731 - protein, 665 aa, Homo sapiens
  Payload ID: 19881
  Gene Name: zinc finger protein 333
  Uniprot ID: Q96JL9
  ENSP ID: ENSP00000292530
MESVTFEDVAVEFIQEWALLDSARRSLCKYRMLDQCRTLASRGTPPCKPSCVSQLGQRAEPKATERGILRATGVAWESQLKPEELPSMQDLLEEASSRDMQMGPGLFLRMQLVPSIEERETPLTREDRPALQEPPWSLGCTGLKAAMQIQRVVIPVPTLGHRNPWVARDSAVPARDPAWLQEDKVEEEAMAPGLPTACSQEPVTFADVAVVFTPEEWVFLDSTQRSLYRDVMLENYRNLASVADQLCKPNALSYLEERGEQWTTDRGVLSDTCAEPQCQPQEAIPSQDTFTEILSIDVKGEQPQPGEKLYKYNELEKPFNSIEPLFQYQRIHAGEASCECQEIRNSFFQSAHLIVPEKIRSGDKSYACNKCEKSFRYSSDLIRHEKTHTAEKCFDCQECGQAFKYSSNLRRHMRTHTGEKPFECSQCGKTFTRNFNLILHQRNHTGEKPYECKDCGKAFNQPSSLRSHVRTHTGEKPFECSQCGKAFREHSSLKTHLRTHTREKPYECNQCGKPFRTSTHLNVHKRIHTGEKLYECATCGQVLSRLSTLKSHMRTHTGEKPYVCQECGRAFSEPSSLRKHARTHSGKKPYACQECGRAFGQSSHLIVHVRTHSAGRPYQCNQCEKAFRHSSSLTVHKRTHVGRETIRNGSLPLSMSHPYCGPLAN

SEQ ID NO: 99732 - protein, 303 aa, Homo sapiens
  Payload ID: 19881
  Gene Name: zinc finger protein 333
  Uniprot ID: Q96JL9
  ENSP ID: ENSP00000438130
MESVTFEDVAVEFIQEWALLDSARRSLCKYRMLDQCRTLASRGTPPCKPSCVSQLGQRAEPKATERGILRATGVAWESQLKPEELPSMQDLLEEASSRDMQMGPGLFLRMQLVPSIEERETPLTREDRPALQEPPWSLGCTGLKAAMQIQRVVIPVPTLGHRNPWVARDSAVPARDPAWLQEDKVEEEAMAPGLPTACSQEPVTFADVAVVFTPEEWVFLDSTQRSLYRDVMLENYRNLASVADQLCKPNALSYLEERGEQWTTDRGVLSDTCAEPQCQPQEAIPSQDTFTEILSIDVKGPPN

SEQ ID NO: 99733 - protein, 195 aa, Homo sapiens
  Payload ID: 19881
  Gene Name: zinc finger protein 333
  ENSP ID: ENSP00000471420
MESVTFEDVAVEFIQEWALLDSARRSLCKYRMLDQCRTLASRGTPPCKPSCVSQLGQRAEPKATERGILRATGVAWESQLKPEELPSMQDLLEEASSRDMQMGPGLFLRMQLVPSIEERETPLTREDRPALQEPPWSLGCTGLKAAMQIQRVVIPVPTLGHRNPWVARDSGQKEDAWCRARSGVDLKAGGKEVSF

SEQ ID NO: 99734 - protein, 106 aa, Homo sapiens
  Payload ID: 19881
  Gene Name: zinc finger protein 333
  ENSP ID: ENSP00000471574
MESVTFEDVAVEFIQEWALLDSARRSLCKYRMLDQCRTLASRGTPPCKPSCVSQLGQRAEPKATERGILRATGVAWESQLKPEELPSMQDLLEEASSRDMQMVDPM

SEQ ID NO: 99735 - protein, 166 aa, Homo sapiens
  Payload ID: 19881
  Gene Name: zinc finger protein 333
  ENSP ID: ENSP00000472026
MESVTFEDVAVEFIQEWALLDSARRSLCKYRMLDQCRTLASRGAGAVPEDAAGALHRREGDTIDSRGPASSPGAALVSGMHGTEGRYADSEGGDTSAYSGPPQPMGGQGFWEQFLDLSLVLLFSIFLRVTPLLSSDGEMGTRKQSQRKHRPLLRGAHGQLGGQSSK

SEQ ID NO: 99736 - protein, 680 aa, Homo sapiens
  Payload ID: 19882
  Gene Name: zinc finger protein 334
  Uniprot ID: Q9HCZ1
  ENSP ID: ENSP00000255129
MKMKKFQIPVSFQDLTVNFTQEEWQQLDPAQRLLYRDVMLENYSNLVSVGYHVSKPDVIFKLEQGEEPWIVEEFSNQNYPDIDDALEKNKEIQDKHLTQTVFFSNKTLITERENVFGKTLNLGMNSVPSRKMPYKCNPGGNSLKTNSEVIVAKKSKENRKIPDGYSGFGKHEKSHLGMKKYRYNPMRKASNQNENLILHQNIQILKQPFDYNKCGKTFFKRAILITQKGRQTERKPNECNECRKTFSKRSTLIVHQRIHTGEKPYVCSDCRKTFRVKTSLTRHRRIHTGERPYECSECRKTFIDKSALIVHQKIHGGEKSYECNECGKTFFRKSALAEHFRSHTGEKPYECKECGNAFSKKSYLVVHQRTHRGEKPNECKECGKTFFCQSALTAHQRIHTGEKPYECSECEKTFFCQSALNVHRRSHTGEKPYECSQCGKFLCTKSALIAHQITHRGKKSYECNECGKFFCHKSTLTIHQRTHTGEKHGVFNKCGRISIVKSNCSQCKRMNTKENLYECSEHGHAVSKNSHLIVHQRTIWERPYECNECGRTYCRKSALTHHQRTHTGQRPYECNECGKTFCQKFSFVEHQRTHTGEKPYECNECGKSFCHKSAFRVHRRIHTGEKPYECNQCGKTYRRLWTLTEHQKIHTGEKPYECNKCEKTFRHKSNFLLHQKSHKE

SEQ ID NO: 99737 - protein, 642 aa, Homo sapiens
  Payload ID: 19882
  Gene Name: zinc finger protein 334
  ENSP ID: ENSP00000402582
MLENYSNLVSVGYHVSKPDVIFKLEQGEEPWIVEEFSNQNYPDIDDALEKNKEIQDKHLTQTVFFSNKTLITERENVFGKTLNLGMNSVPSRKMPYKCNPGGNSLKTNSEVIVAKKSKENRKIPDGYSGFGKHEKSHLGMKKYRYNPMRKASNQNENLILHQNIQILKQPFDYNKCGKTFFKRAILITQKGRQTERKPNECNECRKTFSKRSTLIVHQRIHTGEKPYVCSDCRKTFRVKTSLTRHRRIHTGERPYECSECRKTFIDKSALIVHQKIHGGEKSYECNECGKTFFRKSALAEHFRSHTGEKPYECKECGNAFSKKSYLVVHQRTHRGEKPNECKECGKTFFCQSALTAHQRIHTGEKPYECSECEKTFFCQSALNVHRRSHTGEKPYECSQCGKFLCTKSALIAHQITHRGKKSYECNECGKFFCHKSTLTIHQRTHTGEKHGVFNKCGRISIVKSNCSQCKRMNTKENLYECSEHGHAVSKNSHLIVHQRTIWERPYECNECGRTYCRKSALTHHQRTHTGQRPYECNECGKTFCQKFSFVEHQRTHTGEKPYECNECGKSFCHKSAFRVHRRIHTGEKPYECNQCGKTYRRLWTLTEHQKIHTGEKPYECNKCEKTFRHKSNFLLHQKSHKE

SEQ ID NO: 99738 - protein, 173 aa, Homo sapiens
  Payload ID: 19882
  Gene Name: zinc finger protein 334
  ENSP ID: ENSP00000473164
MLENYSNLVSVGYHVSKPDVIFKLEQGEEPWIVEEFSNQNYPDIDDALEKNKEIQDKHLTQTVFFSNKTLITERENVFGKTLNLGMNSVPSRKMPYKCNPGGNSLKTNSEVIVAKKSKENRKIPDGYSGFGKHEKSHLGMKKYRYNPMRKASNQNENLILHQNIQILKQPFDY

SEQ ID NO: 99739 - protein, 703 aa, Homo sapiens
  Payload ID: 19882
  Gene Name: zinc finger protein 334
  ENSP ID: ENSP00000473194
MCVFLHLLSYIKDTSFIPGPDCELHPRGMAATGPCSEAPVQGCDAGELQQLGLCGVSDVQRSWSKFCNFPLTGYHVSKPDVIFKLEQGEEPWIVEEFSNQNYPDIDDALEKNKEIQDKHLTQTVFFSNKTLITERENVFGKTLNLGMNSVPSRKMPYKCNPGGNSLKTNSEVIVAKKSKENRKIPDGYSGFGKHEKSHLGMKKYRYNPMRKASNQNENLILHQNIQILKQPFDYNKCGKTFFKRAILITQKGRQTERKPNECNECRKTFSKRSTLIVHQRIHTGEKPYVCSDCRKTFRVKTSLTRHRRIHTGERPYECSECRKTFIDKSALIVHQKIHGGEKSYECNECGKTFFRKSALAEHFRSHTGEKPYECKECGNAFSKKSYLVVHQRTHRGEKPNECKECGKTFFCQSALTAHQRIHTGEKPYECSECEKTFFCQSALNVHRRSHTGEKPYECSQCGKFLCTKSALIAHQITHRGKKSYECNECGKFFCHKSTLTIHQRTHTGEKHGVFNKCGRISIVKSNCSQCKRMNTKENLYECSEHGHAVSKNSHLIVHQRTIWERPYECNECGRTYCRKSALTHHQRTHTGQRPYECNECGKTFCQKFSFVEHQRTHTGEKPYECNECGKSFCHKSAFRVHRRIHTGEKPYECNQCGKTYRRLWTLTEHQKIHTGEKPYECNKCEKTFRHKSNFLLHQKSHKE

SEQ ID NO: 99740 - protein, 679 aa, Homo sapiens
  Payload ID: 19882
  Gene Name: zinc finger protein 334
  ENSP ID: ENSP00000484362
MENEKEIPVSFQDLTVNFTQEEWQQLDPAQRLLYRDVMLENYSNLVSVGYHVSKPDVIFKLEQGEEPWIVEEFSNQNYPDIDDALEKNKEIQDKHLTQTVFFSNKTLITERENVFGKTLNLGMNSVPSRKMPYKCNPGGNSLKTNSEVIVAKKSKENRKIPDGYSGFGKHEKSHLGMKKYRYNPMRKASNQNENLILHQNIQILKQPFDYNKCGKTFFKRAILITQKGRQTERKPNECNECRKTFSKRSTLIVHQRIHTGEKPYVCSDCRKTFRVKTSLTRHRRIHTGERPYECSECRKTFIDKSALIVHQKIHGGEKSYECNECGKTFFRKSALAEHFRSHTGEKPYECKECGNAFSKKSYLVVHQRTHRGEKPNECKECGKTFFCQSALTAHQRIHTGEKPYECSECEKTFFCQSALNVHRRSHTGEKPYECSQCGKFLCTKSALIAHQITHRGKKSYECNECGKFFCHKSTLTIHQRTHTGEKHGVFNKCGRISIVKSNCSQCKRMNTKENLYECSEHGHAVSKNSHLIVHQRTIWERPYECNECGRTYCRKSALTHHQRTHTGQRPYECNECGKTFCQKFSFVEHQRTHTGEKPYECNECGKSFCHKSAFRVHRRIHTGEKPYECNQCGKTYRRLWTLTEHQKIHTGEKPYECNKCEKTFRHKSNFLLHQKSHKE

SEQ ID NO: 99741 - protein, 679 aa, Homo sapiens; identical to SEQ ID NO: 99740
  Payload ID: 19882
  Gene Name: zinc finger protein 334
  ENSP ID: ENSP00000485779

SEQ ID NO: 99742 - protein, 1342 aa, Homo sapiens
  Payload ID: 19883
  Gene Name: zinc finger protein 335
  Uniprot ID: Q9H4Z2
  ENSP ID: ENSP00000325326
MEENEVESSSDAAPGPGRPEEPSESGLGVGTSEAVSADSSDAAAAPGQAEADDSGVGQSSDRGSRSQEEVSESSSSADPLPNSYLPDSSSVSHGPVAGVTGGPPALVHSSALPDPNMLVSDCTASSSDLGSAIDKIIESTIGPDLIQNCITVTSAEDGGAETTRYLILQGPDDGAPMTSPMSSSTLAHSLAAIEALADGPTSTSTCLEAQGGPSSPVQLPPASGAEEPDLQSLEAMMEVVVVQQFKCKMCQYRSSTKATLLRHMRERHFRPVAAAAAAAGKKGRLRKWSTSTKSQEEEGPEEEDDDDIVDAGAIDDLEEDSDYNPAEDEPRGRQLRLQRPTPSTPRPRRRPGRPRKLPRLEISDLPDGVEGEPLVSSQSGQSPPEPQDPEAPSSSGPGHLVAMGKVSRTPVEAGVSQSDAENAAPSCPDEHDTLPRRRGRPSRRFLGKKYRKYYYKSPKPLLRPFLCRICGSRFLSHEDLRFHVNSHEAGDPQLFKCLQCSYRSRRWSSLKEHMFNHVGSKPYKCDECSYTSVYRKDVIRHAAVHSRDRKKRPDPTPKLSSFPCPVCGRVYPMQKRLTQHMKTHSTEKPHMCDKCGKSFKKRYTFKMHLLTHIQAVANRRFKCEFCEFVCEDKKALLNHQLSHVSDKPFKCSFCPYRTFREDFLLSHVAVKHTGAKPFACEYCHFSTRHKKNLRLHVRCRHASSFEEWGRRHPEEPPSRRRPFFSLQQIEELKQQHSAAPGPPPSSPGPPEIPPEATTFQSSEAPSLLCSDTLGGATIIYQQGAEESTAMATQTALDLLLNMSAQRELGGTALQVAVVKSEDVEAGLASPGGQPSPEGATPQVVTLHVAEPGGGAAAESQLGPPDLPQITLAPGPFGGTGYSVITAPPMEEGTSAPGTPYSEEPAGEAAQAVVVSDTLKEAGTHYIMATDGTQLHHIELTADGSISFPSPDALASGAKWPLLQCGGLPRDGPEPPSPAKTHCVGDSQSSASSPPATSKALGLAVPPSPPSAATAASKKFSCKICAEAFPGRAEMESHKRAHAGPGAFKCPDCPFSARQWPEVRAHMAQHSSLRPHQCSQCSFASKNKKDLRRHMLTHTKEKPFACHLCGQRFNRNGHLKFHIQRLHSPDGRKSGTPTARAPTQTPTQTIILNSDDETLATLHTALQSSHGVLGPERLQQALSQEHIIVAQEQTVTNQEEAAYIQEITTADGQTVQHLVTSDNQVQYIISQDGVQHLLPQEYVVVPEGHHIQVQEGQITHIQYEQGAPFLQESQIQYVPVSPGQQLVTQAQLEAAAHSAVTAVADAAMAQAQGLFGTDETVPEHIQQLQHQGIEYDVITLADD

SEQ ID NO: 99743 - protein, 751 aa, Homo sapiens
  Payload ID: 19884
  Gene Name: zinc finger protein 337
  Uniprot ID: Q9Y3M9
  ENSP ID: ENSP00000252979
MGPQGARRQAFLAFGDVTVDFTQKEWRLLSPAQRALYREVTLENYSHLVSLGILHSKPELIRRLEQGEVPWGEERRRRPGPCAGIYAEHVLRPKNLGLAHQRQQQLQFSDQSFQSDTAEGQEKEKSTKPMAFSSPPLRHAVSSRRRNSVVEIESSQGQRENPTEIDKVLKGIENSRWGAFKCAERGQDFSRKMMVIIHKKAHSRQKLFTCRECHQGFRDESALLLHQNTHTGEKSYVCSVCGRGFSLKANLLRHQRTHSGEKPFLCKVCGRGYTSKSYLTVHERTHTGEKPYECQECGRRFNDKSSYNKHLKAHSGEKPFVCKECGRGYTNKSYFVVHKRIHSGEKPYRCQECGRGFSNKSHLITHQRTHSGEKPFACRQCKQSFSVKGSLLRHQRTHSGEKPFVCKDCERSFSQKSTLVYHQRTHSGEKPFVCRECGQGFIQKSTLVKHQITHSEEKPFVCKDCGRGFIQKSTFTLHQRTHSEEKPYGCRECGRRFRDKSSYNKHLRAHLGEKRFFCRDCGRGFTLKPNLTIHQRTHSGEKPFMCKQCEKSFSLKANLLRHQWTHSGERPFNCKDCGRGFILKSTLLFHQKTHSGEKPFICSECGQGFIWKSNLVKHQLAHSGKQPFVCKECGRGFNWKGNLLTHQRTHSGEKPFVCNVCGQGFSWKRSLTRHHWRIHSKEKPFVCQECKRGYTSKSDLTVHERIHTGERPYECQECGRKFSNKSYYSKHLKRHLREKRFCTGSVGEASS

SEQ ID NO: 99744 - protein, 751 aa, Homo sapiens; identical to SEQ ID NO: 99743
  Payload ID: 19884
  Gene Name: zinc finger protein 337
  Uniprot ID: Q9Y3M9
  ENSP ID: ENSP00000365619

SEQ ID NO: 99745 - protein, 829 aa, Homo sapiens
  Payload ID: 19885
  Gene Name: zinc finger protein 33A
  ENSP ID: ENSP00000304268
MCPRGYPEQSNWMSSPLYSTEVEQKSQESVSFKDVTVGFTQEEWQHLDPSQRALYRDVMLENYSNLVSVGYCVHKPEVIFRLQQGEEPWKQEEEFPSQSFPEVWTADHLKERSQENQSKHLWEVVFINNEMLTKEQGDVIGIPFNVDVSSFPSRKMFCQCDSCGMSFNTVSELVISKINYLGKKSDEFNACGKLLLNIKHDETHTQEKNEVLKNRNTLSHHEETLQHEKIQTLEHNFEYSICQETLLEKAVFNTQKRENAEENNCDYNEFGRTLCDSSSLLFHQISPSRDNHYEFSDCEKFLCVKSTLSKPHGVSMKHYDCGESGNNFRRKLCLSHLQKGDKGEKHFECNECGKAFWEKSHLTRHQRVHTGQKPFQCNECEKAFWDKSNLTKHQRSHTGEKPFECNECGKAFSHKSALTLHQRTHTGEKPYQCNACGKTFCQKSDLTKHQRTHTGLKPYECYECGKSFRVTSHLKVHQRTHTGEKPFECLECGKSFSEKSNLTQHQRIHIGDKSYECNACGKTFYHKSLLTRHQIIHTGWKPYECYECGKTFCLKSDLTVHQRTHTGQKPFACPECGKFFSHKSTLSQHYRTHTGEKPYECHECGKIFYNKSYLTKHNRTHTGEKPYECNECGKAFYQKSQLTQHQRIHIGEKPYKCNECGKAFCHKSALIVHQRTHTQEKPYKCNECGKSFCVKSGLIFHERKHTGEKPYECNECGKFFRHKSSLTVHHRAHTGEKSCQCNECGKIFYRKSELAQHQRSHTGEKPYECNTCRKTFSQKSNLIVHQRRHIGENLMNEMDIRNFQPQVSLHNASEYSHCGESPDDILNVQ

SEQ ID NO: 99746 - protein, 699 aa, Homo sapiens
  Payload ID: 19885
  Gene Name: zinc finger protein 33A
  ENSP ID: ENSP00000363747
MLTKEQGDVIGIPFNVDVSSFPSRKMFCQCDSCGMSFNTVSELVISKINYLGKKSDEFNACGKLLLNIKHDETHTQEKNEVLKNRNTLSHHEETLQHEKIQTLEHNFEYSICQETLLEKAVFNTQKRENAEENNCDYNEFGRTLCDSSSLLFHQISPSRDNHYEFSDCEKFLCVKSTLSKPHGVSMKHYDCGESGNNFRRKLCLSHLQKGDKGEKHFECNECGKAFWEKSHLTRHQRVHTGQKPFQCNECEKAFWDKSNLTKHQRSHTGEKPFECNECGKAFSHKSALTLHQRTHTGEKPYQCNACGKTFCQKSDLTKHQRTHTGLKPYECYECGKSFRVTSHLKVHQRTHTGEKPFECLECGKSFSEKSNLTQHQRIHIGDKSYECNACGKTFYHKSLLTRHQIIHTGWKPYECYECGKTFCLKSDLTVHQRTHTGQKPFACPECGKFFSHKSTLSQHYRTHTGEKPYECHECGKIFYNKSYLTKHNRTHTGEKPYECNECGKAFYQKSQLTQHQRIHIGEKPYKCNECGKAFCHKSALIVHQRTHTQEKPYKCNECGKSFCVKSGLIFHERKHTGEKPYECNECGKFFRHKSSLTVHHRAHTGEKSCQCNECGKIFYRKSELAQHQRSHTGEKPYECNTCRKTFSQKSNLIVHQRRHIGENLMNEMDIRNFQPQVSLHNASEYSHCGESPDDILNVQ

SEQ ID NO: 99747 - protein, 810 aa, Homo sapiens
  Payload ID: 19885
  Gene Name: zinc finger protein 33A
  Uniprot ID: Q06730
  ENSP ID: ENSP00000387713
MNKVEQKSQESVSFKDVTVGFTQEEWQHLDPSQRALYRDVMLENYSNLVSVGYCVHKPEVIFRLQQGEEPWKQEEEFPSQSFPVWTADHLKERSQENQSKHLWEVVFINNEMLTKEQGDVIGIPFNVDVSSFPSRKMFCQCDSCGMSFNTVSELVISKINYLGKKSDEFNACGKLLLNIKHDETHTQEKNEVLKNRNTLSHHEETLQHEKIQTLEHNFEYSICQETLLEKAVFNTQKRENAEENNCDYNEFGRTLCDSSSLLFHQISPSRDNHYEFSDCEKFLCVKSTLSKPHGVSMKHYDCGESGNNFRRKLCLSHLQKGDKGEKHFECNECGKAFWEKSHLTRHQRVHTGQKPFQCNECEKAFWDKSNLTKHQRSHTGEKPFECNECGKAFSHKSALTLHQRTHTGEKPYQCNACGKTFCQKSDLTKHQRTHTGLKPYECYECGKSFRVTSHLKVHQRTHTGEKPFECLECGKSFSEKSNLTQHQRIHIGDKSYECNACGKTFYHKSLLTRHQIIHTGWKPYECYECGKTFCLKSDLTVHQRTHTGQKPFACPECGKFFSHKSTLSQHYRTHTGEKPYECHECGKIFYNKSYLTKHNRTHTGEKPYECNECGKAFYQKSQLTQHQRIHIGEKPYKCNECGKAFCHKSALIVHQRTHTQEKPYKCNECGKSFCVKSGLIFHERKHTGEKPYECNECGKFFRHKSSLTVHHRAHTGEKSCQCNECGKIFYRKSELAQHQRSHTGEKPYECNTCRKTFSQKSNLIVHQRRHIGENLMNEMDIRNFQPQVSLHNASEYSHCGESPDDILNVQ

SEQ ID NO: 99748 - protein, 811 aa, Homo sapiens
  Payload ID: 19885
  Gene Name: zinc finger protein 33A
  Uniprot ID: Q06730
  ENSP ID: ENSP00000402467
MNKVEQKSQESVSFKDVTVGFTQEEWQHLDPSQRALYRDVMLENYSNLVSVGYCVHKPEVIFRLQQGEEPWKQEEEFPSQSFPEVWTADHLKERSQENQSKHLWEVVFINNEMLTKEQGDVIGIPFNVDVSSFPSRKMFCQCDSCGMSFNTVSELVISKINYLGKKSDEFNACGKLLLNIKHDETHTQEKNEVLKNRNTLSHHEETLQHEKIQTLEHNFEYSICQETLLEKAVFNTQKRENAEENNCDYNEFGRTLCDSSSLLFHQISPSRDNHYEFSDCEKFLCVKSTLSKPHGVSMKHYDCGESGNNFRRKLCLSHLQKGDKGEKHFECNECGKAFWEKSHLTRHQRVHTGQKPFQCNECEKAFWDKSNLTKHQRSHTGEKPFECNECGKAFSHKSALTLHQRTHTGEKPYQCNACGKTFCQKSDLTKHQRTHTGLKPYECYECGKSFRVTSHLKVHQRTHTGEKPFECLECGKSFSEKSNLTQHQRIHIGDKSYECNACGKTFYHKSLLTRHQIIHTGWKPYECYECGKTFCLKSDLTVHQRTHTGQKPFACPECGKFFSHKSTLSQHYRTHTGEKPYECHECGKIFYNKSYLTKHNRTHTGEKPYECNECGKAFYQKSQLTQHQRIHIGEKPYKCNECGKAFCHKSALIVHQRTHTQEKPYKCNECGKSFCVKSGLIFHERKHTGEKPYECNECGKFFRHKSSLTVHHRAHTGEKSCQCNECGKIFYRKSELAQHQRSHTGEKPYECNTCRKTFSQKSNLIVHQRRHIGENLMNEMDIRNFQPQVSLHNASEYSHCGESPDDILNVQ

SEQ ID NO: 99749 - protein, 138 aa, Homo sapiens
  Payload ID: 19885
  Gene Name: zinc finger protein 33A
  ENSP ID: ENSP00000437022
MNKVEQKSQESVSFKDVTVGFTQEEWQHLDPSQRALYRDVMLENYSNLVSVGYCVHKPEVIFRLQQGEEPWKQEEEFPSQSFPEVWTADHLKERSQENQSKHLWEVVFINNEMLTKEQGDVIGIPFNVDAPEMLMPLD

SEQ ID NO: 99750 - protein, 817 aa, Homo sapiens
  Payload ID: 19885
  Gene Name: zinc finger protein 33A
  Uniprot ID: Q06730
  ENSP ID: ENSP00000485869
MANATRRGSGVEQKSQESVSFKDVTVGFTQEEWQHLDPSQRALYRDVMLENYSNLVSVGYCVHKPEVIFRLQQGEEPWKQEEEFPSQSFPVWTADHLKERSQENQSKHLWEVVFINNEMLTKEQGDVIGIPFNVDVSSFPSRKMFCQCDSCGMSFNTVSELVISKINYLGKKSDEFNACGKLLLNIKHDETHTQEKNEVLKNRNTLSHHEETLQHEKIQTLEHNFEYSICQETLLEKAVFNTQKRENAEENNCDYNEFGRTLCDSSSLLFHQISPSRDNHYEFSDCEKFLCVKSTLSKPHGVSMKHYDCGESGNNFRRKLCLSHLQKGDKGEKHFECNECGKAFWEKSHLTRHQRVHTGQKPFQCNECEKAFWDKSNLTKHQRSHTGEKPFECNECGKAFSHKSALTLHQRTHTGEKPYQCNACGKTFCQKSDLTKHQRTHTGLKPYECYECGKSFRVTSHLKVHQRTHTGEKPFECLECGKSFSEKSNLTQHQRIHIGDKSYECNACGKTFYHKSLLTRHQIIHTGWKPYECYECGKTFCLKSDLTVHQRTHTGQKPFACPECGKFFSHKSTLSQHYRTHTGEKPYECHECGKIFYNKSYLTKHNRTHTGEKPYECNECGKAFYQKSQLTQHQRIHIGEKPYKCNECGKAFCHKSALIVHQRTHTQEKPYKCNECGKSFCVKSGLIFHERKHTGEKPYECNECGKFFRHKSSLTVHHRAHTGEKSCQCNECGKIFYRKSELAQHQRSHTGEKPYECNTCRKTFSQKSNLIVHQRRHIGENLMNEMDIRNFQPQVSLHNASEYSHCGESPDDILNVQ

SEQ ID NO: 99751 - protein, 778 aa, Homo sapiens
  Payload ID: 19886
  Gene Name: zinc finger protein 33B
  Uniprot ID: Q06732
  ENSP ID: ENSP00000352444
MNKVDQKFQGSVSFKDVTVGFTQEEWQHLDPSQRALYRDVMLENYSNLVSVGYCAHKPEVIFRLEQGEEPWRLEEEFPSQSFPEVWTADHLKERSQENQSKHLWEVVFINNEMLTKEQGNVIGIPFNMDVSSFPSRKMFCQYDSRGMSFNTVSELVISKINYLGKKSDEFNACGKLLLNIKHDETHTREKNEVLKNRNTLSHRENTLQHEKIQTLDHNFEYSICQETLLEKAVFNTRKRENAEENNCDYNEFGRTFCDSSSLLFHQIPPSKDSHYEFSDCEKFLCVKSTLSKHDGVPVKHYDCGESGNNFRRKLCLSQLQKGDKGEKHFECNECGKAFWEKSHLTRHQRVHTGEKHFQCNQCGKTFWEKSNLTKHQRSHTGEKPFECNECGKAFSHKSALTLHQRTHTGEKPYQCNACGKTFYQKSDLTKHQRTHTGQKPYECYECGKSFCMNSHLTVHQRTHTGEKPFECLECGKSFCQKSHLTQHQRTHIGDKPYECNACGKTFYHKSVLTRHQIIHTGLKPYECYECGKTFCLKSDLTIHQRTHTGEKPFACPECGKFFSHKSTLSQHYRTHTGEKPYECHECGKIFYNKSYLTKHNRTHTGEKPYECNECGKTFCQKSQLTQHQRIHIGEKPYECNECGKAFCHKSALIVHQRTHTQEKPYKCNECGKSFCVKSGLILHERKHTGEKPYECNECGKSFSHKSSLTVHHRAHTGEKSCQCNECGKIFYRKSDLAKHQRSHTGEKPYECNTCRKTFSQKSNLIVHQRTHIGEKPYE

SEQ ID NO: 99752 - protein, 90 aa, Homo sapiens
  Payload ID: 19886
  Gene Name: zinc finger protein 33B
  ENSP ID: ENSP00000479296
MANATRRESEVDQKFQGSVSFKDVTVGFTQEEWQHLDPSQRALYRDVMLENYSNLVSVGYCAHKPEVIFRLEQGEEPWRLEEEFPSQSFP

SEQ ID NO: 99753 - protein, 93 aa, Homo sapiens
  Payload ID: 19886
  Gene Name: zinc finger protein 33B
  ENSP ID: ENSP00000480979
HLDPSQRALYRDVMLENYSNLVSVGYCAHKPEVIFRLEQGEEPWRLEEEFPSQSFPEVWTADHLKERSQENQSKHLWEVVFINNEMLTKEQGP

SEQ ID NO: 99754 - protein, 778 aa, Homo sapiens
  Payload ID: 19886
  Gene Name: zinc finger protein 33B
  ENSP ID: ENSP00000481265
MSAVDQKFQGSVSFKDVTVGFTQEEWQHLDPSQRALYRDVMLENYSNLVSVGYCAHKPEVIFRLEQGEEPWRLEEEFPSQSFPEVWTADHLKERSQENQSKHLWEVVFINNEMLTKEQGNVIGIPFNMDVSSFPSRKMFCQYDSRGMSFNTVSELVISKINYLGKKSDEFNACGKLLLNIKHDETHTREKNEVLKNRNTLSHRENTLQHEKIQTLDHNFEYSICQETLLEKAVFNTRKRENAEENNCDYNEFGRTFCDSSSLLFHQIPPSKDSHYEFSDCEKFLCVKSTLSKHDGVPVKHYDCGESGNNFRRKLCLSQLQKGDKGEKHFECNECGKAFWEKSHLTRHQRVHTGEKHFQCNQCGKTFWEKSNLTKHQRSHTGEKPFECNECGKAFSHKSALTLHQRTHTGEKPYQCNACGKTFYQKSDLTKHQRTHTGQKPYECYECGKSFCMNSHLTVHQRTHTGEKPFECLECGKSFCQKSHLTQHQRTHIGDKPYECNACGKTFYHKSVLTRHQIIHTGLKPYECYECGKTFCLKSDLTIHQRTHTGEKPFACPECGKFFSHKSTLSQHYRTHTGEKPYECHECGKIFYNKSYLTKHNRTHTGEKPYECNECGKTFCQKSQLTQHQRIHIGEKPYECNECGKAFCHKSALIVHQRTHTQEKPYKCNECGKSFCVKSGLILHERKHTGEKPYECNECGKSFSHKSSLTVHHRAHTGEKSCQCNECGKIFYRKSDLAKHQRSHTGEKPYECNTCRKTFSQKSNLIVHQRTHIGEKPYE

SEQ ID NO: 99755 - protein, 36 aa, Homo sapiens
  Payload ID: 19886
  Gene Name: zinc finger protein 33B
  ENSP ID: ENSP00000484085
SQENQSKHLWEVVFINNEMLTKEQDVISLRREWYVP

SEQ ID NO: 99756 - protein, 560 aa, Homo sapiens
  Payload ID: 19887
  Gene Name: zinc finger protein 34
  Uniprot ID: Q8IZ26
  ENSP ID: ENSP00000341528
MLLLLSDQLLLTALRKPNPQAMAALFLSAPPQAEVTFEDVAVYLSREEWGRLGPAQRGLYRDVMLETYGNLVSLGVGPAGPKPGVISQLERGDEPWVLDVQGTSGKEHLRVNSPALGTRTEYKELTSQETFGEEDPQGSEPVEACDHISKSEGSLEKLVEQRGPRAVTLTNGESSRESGGNLRLLSRPVPDQRPHKCDICEQSFEQRSYLNNHKRVHRSKKTNTVRNSGEIFSANLVVKEDQKIPTGKKLHYCSYCGKTFRYSANLVKHQRLHTEEKPYKCDECGKAFSQSCEFINHRRMHSGEIPYRCDECGKTFTRRPNLMKHQRIHTGEKPYKCGECGKHFSAYSSLIYHQRIHTGEKPYKCNDCGKAFSDGSILIRHRRTHTGEKPFECKECGKGFTQSSNLIQHQRIHTGEKPYKCNECEKAFIQKTKLVEHQRSHTGEKPYECNDCGKVFSQSTHLIQHQRIHTGEKPYKCSECGKAFHNSSRLIHHQRLHHGEKPYRCSDCKKAFSQSTYLIQHRRIHTGEKPYKCSECGKAFRHSSNMCQHQRIHLREDFSM

SEQ ID NO: 99757 - protein, 539 aa, Homo sapiens
  Payload ID: 19887
  Gene Name: zinc finger protein 34
  ENSP ID: ENSP00000396894
MAALFLSAPPQAEVTFEDVAVYLSREEWGRLGPAQRGLYRDVMLETYGNLVSLGVGPAGPKPGVISQLERGDEPWVLDVQGTSGKEHLRVNSPALGTRTEYKELTSQETFGEEDPQGSEPVEACDHISKSEGSLEKLVEQRGPRAVTLTNGESSRESGGNLRLLSRPVPDQRPHKCDICEQSFEQRSYLNNHKRVHRSKKTNTVRNSGEIFSANLVVKEDQKIPTGKKLHYCSYCGKTFRYSANLVKHQRLHTEEKPYKCDECGKAFSQSCEFINHRRMHSGEIPYRCDECGKTFTRRPNLMKHQRIHTGEKPYKCGECGKHFSAYSSLIYHQRIHTGEKPYKCNDCGKAFSDGSILIRHRRTHTGEKPFECKECGKGFTQSSNLIQHQRIHTGEKPYKCNECEKAFIQKTKLVEHQRSHTGEKPYECNDCGKVFSQSTHLIQHQRIHTGEKPYKCSECGKAFHNSSRLIHHQRLHHGEKPYRCSDCKKAFSQSTYLIQHRRIHTGEKPYKCSECGKAFRHSSNMCQHQRIHLREDFSM

SEQ ID NO: 99758 - protein, 264 aa, Homo sapiens
  Payload ID: 19887
  Gene Name: zinc finger protein 34
  ENSP ID: ENSP00000434049
MAALFLSAPPQAEVTFEDVAVYLSREEWGRLGPAQRGLYRDVMLETYGNLVSLALGTRTEYKELTSQETFGEEDPQGSEPVEACDHISKSEGSLEKLVEQRGPRAVTLTNGESSRESGGNLRLLSRPVPDQRPHKCDICEQSFEQRSYLNNHKRVHRSKKTNTVRNSGEIFSANLVVKEDQKIPTGKKLHYCSYCGKTFRYSANLVKHQRLHTEEKPYKCDECGKAFSQSCEFINHRRMHSGEIPYRCDECGKTFTRRPNLMKH

SEQ ID NO: 99759 - protein, 158 aa, Homo sapiens
  Payload ID: 19887
  Gene Name: zinc finger protein 34
  ENSP ID: ENSP00000437056
MLLLLSDQLLLTALRKPNPQAMAALFLSAPPQAEVTFEDVAVYLSREEWGRLGPAQRGLYRDVMLETYGNLVSLALGTRTEYKELTSQETFGEEDPQGSEPVEACDHISKSEGSLEKLVEQRGPRAVTLTNGESSRESGGNLRLLSRPVPDQRPHKCD

SEQ ID NO: 99760 - protein, 847 aa, Homo sapiens
  Payload ID: 19888
  Gene Name: zinc finger protein 341
  Uniprot ID: Q9BYN7
  ENSP ID: ENSP00000344308
MAQAIFEALEGMDNQTVLAVQSLLDGQGAVPDPTGQSVNAPPAIQPLDDEDVFLCGKCKKQFNSLPAFMTHKREQCQGNAPALATVSLATNSIYPPSAAPTAVQQAPTPANRQISTYITVPPSPLIQTLVQGNILVSDDVLMSAMSAFTSLDQPMPQGPPPVQSSLNMHSVPSYLTQPPPPPPPPPPLPPPPPPQPPPPPPQSLGPPGRPNPGGNGVVEVYSAAAPLAGSGTVEIQALGMQPYPPLEVPNQCVEPPVYPTPTVYSPGKQGFKPKGPNPAAPMTSATGGTVATFDSPATLKTRRAKAAGKPKAQKLKCSYCDKSFTKNFDLQQHIRSHTGEKPFQCIACGRAFAQKSNVKKHMQTHKVWPPGHSGGTVSRNSVTVQVMALNPSRQEDEESTGLGQPLPGAPQPQALSTAGEEEGDKPESKQVVLIDSSYLCQFCPSKFSTYFQLKSHMTQHKNEQVYKCVVKSCAQTFPKLDTFLEHIKSHQEELSYRCHLCGKDFPSLYDLGVHQYSHSLLPQHSPKKDNAVYKCVKCVNKYSTPEALEHHLQTATHNFPCPHCQKVFPCERYLRRHLPTHGSGGRFKCQVCKKFFRREHYLKLHAHIHSGEKPYKCSVCESAFNRKDKLKRHMLIHEPFKKYKCPFSTHTGCSKEFNRPDKLKAHILSHSGMKLHKCALCSKSFSRRAHLAEHQRAHTGNYKFRCAGCAKGFSRHKYLKDHRCRLGPQKDKDLQTRRPPQRRAAPRSCGSGGRKVLTPLPDPLGLEELKDTGAGLVPEAVPGKPPFAEPDAVLSIVVGGAVGAETELVVPGHAEGLGSNLALAELQAGAEGPCAMLAVPVYIQASE

SEQ ID NO: 99761 - protein, 854 aa, Homo sapiens
  Payload ID: 19888
  Gene Name: zinc finger protein 341
  Uniprot ID: Q9BYN7
  ENSP ID: ENSP00000364346
MAQAIFEALEGMDNQTVLAVQSLLDGQGAVPDPTGQSVNAPPAIQPLDDEDVFLCGKCKKQFNSLPAFMTHKREQCQGNAPALATVSLATNSIYPPSAAPTAVQQAPTPANRQISTYITVPPSPLIQTLVQGNILVSDDVLMSAMSAFTSLDQPMPQGPPPVQSSLNMHSVPSYLTQPPPPPPPPPPLPPPPPPQPPPPPPQSLGPPGRPNPGGNGVVEVYSAAAPLAGSGTVEIQALGMQPYPPLEVPNQCVEPPVYPTPTVYSPGKQGFKPKGPNPAAPMTSATGGTVATFDSPATLKTRRAKGARGLPEAAGKPKAQKLKCSYCDKSFTKNFDLQQHIRSHTGEKPFQCIACGRAFAQKSNVKKHMQTHKVWPPGHSGGTVSRNSVTVQVMALNPSRQEDEESTGLGQPLPGAPQPQALSTAGEEEGDKPESKQVVLIDSSYLCQFCPSKFSTYFQLKSHMTQHKNEQVYKCVVKSCAQTFPKLDTFLEHIKSHQEELSYRCHLCGKDFPSLYDLGVHQYSHSLLPQHSPKKDNAVYKCVKCVNKYSTPEALEHHLQTATHNFPCPHCQKVFPCERYLRRHLPTHGSGGRFKCQVCKKFFRREHYLKLHAHIHSGEKPYKCSVCESAFNRKDKLKRHMLIHEPFKKYKCPFSTHTGCSKEFNRPDKLKAHILSHSGMKLHKCALCSKSFSRRAHLAEHQRAHTGNYKFRCAGCAKGFSRHKYLKDHRCRLGPQKDKDLQTRRPPQRRAAPRSCGSGGRKVLTPLPDPLGLEELKDTGAGLVPEAVPGKPPFAEPDAVLSIVVGGAVGAETELVVPGHAEGLGSNLALAELQAGAEGPCAMLAVPVYIQASE

SEQ ID NO: 99762 - protein, 604 aa, Homo sapiens
  Payload ID: 19888
  Gene Name: zinc finger protein 341
  ENSP ID: ENSP00000432933
MAQAIFEALEGMDNQTVLAVQSLLDGQGAVPDPTGQSVNAPPAIQPLDDEDVFLCGKCKKQFNSLPAFMTHKREQCQGNAPALATVSLATNSIYPPSAAPTAVQQAPTPANRQISTYITVPPSPLIQTLVQGNILVSDDVLMSAMSAFTSLDQPMPQGPPPVQSSLNMHSVPSYLTQPPPPPPPPPPLPPPPPPQPPPPPPQSLGPPGRPNPGGNGVVEVYSAAAPLAGSGTVEIQALGMQPYPPLEVPNQCVEPPVYPTPTVYSPGKQGFKPKGPNPAAPMTSATGGTVATFDSPATLKTRRAKGARGLPEAAGKPKAQKLKCSYCDKSFTKNFDLQQHIRSHTGEKPFQCIACGRAFAQKSNVKKHMQTHKVWPPGHSGGTVSRNSVTVQVMALNPSRQEDEESTGLGQPLPGAPQPQALSTAGEEEGDKPESKQVVLIDSSYLCQFCPSKFSTYFQLKSHMTQHKNEQVYKCVVKSCAQTFPKLDTFLEHIKSHQEELSYRCHLCGKDFPSLYDLGVHQYSHSLLPQHSPKKDNAVYKCFLVNATCGVICPPTAAGAGSSAKCARSSSGGSIISNCMLTSTRVRSPTNAQCASLRSTARTN

SEQ ID NO: 99763 - protein, 72 aa, Homo sapiens
  Payload ID: 19888
  Gene Name: zinc finger protein 341
  ENSP ID: ENSP00000434423
MAQAIFEALEGMDNQTVLAVQSLLDGQGAVPDPTGQSVNAPPAIQPLDLHIHHSAPVPTDPDPGAGEHLGER

SEQ ID NO: 99764 - protein, 599 aa, Homo sapiens
  Payload ID: 19889
  Gene Name: zinc finger protein 343
  Uniprot ID: Q6P1L6
  ENSP ID: ENSP00000278772
MMLPYPSALGDQYWEEILLPKNGENVETMKKLTQNHKAKGLPSNDTDCPQKKEGKAQIVVPVTFRDVTVIFTEAEWKRLSPEQRNLYKEVMLENYRNLLSLAEPKPEIYTCSSCLLAFSCQQFLSQHVLQIFLGLCAENHFHPGNSSPGHWKQQGQQYSHVSCWFENAEGQERGGGSKPWSARTEERETSRAFPSPLQRQSASPRKGNMVVETEPSSAQRPNPVQLDKGLKELETLRFGAINCREYEPDHNLESNFITNPRTLLGKKPYICSDCGRSFKDRSTLIRHHRIHSMEKPYVCSECGRGFSQKSNLSRHQRTHSEEKPYLCRECGQSFRSKSILNRHQWTHSEEKPYVCSECGRGFSEKSSFIRHQRTHSGEKPYVCLECGRSFCDKSTLRKHQRIHSGEKPYVCRECGRGFSQNSDLIKHQRTHLDEKPYVCRECGRGFCDKSTLIIHERTHSGEKPYVCGECGRGFSRKSLLLVHQRTHSGEKHYVCRECRRGFSQKSNLIRHQRTHSNEKPYICRECGRGFCDKSTLIVHERTHSGEKPYVCSECGRGFSRKSLLLVHQRTHSGEKHYVCRECGRGFSHKSNLIRHQRTH

SEQ ID NO: 99765 - protein, 118 aa, Homo sapiens
  Payload ID: 19889
  Gene Name: zinc finger protein 343
  Uniprot ID: Q6P1L6
  ENSP ID: ENSP00000351188
MMLPYPSALGDQYWEEILLPKNGENVETMKKLTQNHKAKGLPSNDTDCPQKKEGKAQIVVPVTFRDVTVIFTEAEWKRLSPEQRNLYKEVMLENYRNLLSLGQEIETILANIVKSHLY

SEQ ID NO: 99766 - protein, 118 aa, Homo sapiens; identical to SEQ ID NO: 99765
  Payload ID: 19889
  Gene Name: zinc finger protein 343
  Uniprot ID: Q6P1L6
  ENSP ID: ENSP00000370652

SEQ ID NO: 99767 - protein, 144 aa, Homo sapiens
  Payload ID: 19889
  Gene Name: zinc finger protein 343
  ENSP ID: ENSP00000399682
MMLPYPSALGDQYWEEILLPKNGENVETMKKLTQNHKAKGLPSNDTDCPQKKEGKAQIVVPVTFRDVTVIFTEAEWKRLSPEQRNLYKEVMLENYRNLLSLAEPKPEIYTCSSCLLAFSCQQFLSQHVLQIFLGLCAENHFHPG

SEQ ID NO: 99768 - protein, 101 aa, Homo sapiens
  Payload ID: 19889
  Gene Name: zinc finger protein 343
  ENSP ID: ENSP00000416488
MMLPYPSALGDQYWEEILLPKNGENVETMKKLTQNHKAKGLPSNDTDCPQKKEGKAQIVVPVTFRDVTVIFTEAEWKRLSPEQRNLYKEVMLENYRNLLSL

SEQ ID NO: 99769 - protein, 640 aa, Homo sapiens
  Payload ID: 19889
  Gene Name: zinc finger protein 343
  ENSP ID: ENSP00000482819
MMLPYPSALGDQYWEEILLPKNGENVETMKKLTQNHKAKGLPSNDTDCPQKKEGKAQIVVPVTFRDVTVIFTEAEWKRLSPEQRNLYKEVMLENYRNLLSLDGVSLLLPRLECNRAISAHHNLCLPGSSNSPATASRVVGITAEPKPEIYTCSSCLLAFSCQQFLSQHVLQIFLGLCAENHFHPGNSSPGHWKQQGQQYSHVSCWFENAEGQERGGGSKPWSARTEERETSRAFPSPLQRQSASPRKGNMVVETEPSSAQRPNPVQLDKGLKELETLRFGAINCREYEPDHNLESNFITNPRTLLGKKPYICSDCGRSFKDRSTLIRHHRIHSMEKPYVCSECGRGFSQKSNLSRHQRTHSEEKPYLCRECGQSFRSKSILNRHQWTHSEEKPYVCSECGRGFSEKSSFIRHQRTHSGEKPYVCLECGRSFCDKSTLRKHQRIHSGEKPYVCRECGRGFSQNSDLIKHQRTHLDEKPYVCRECGRGFCDKSTLIIHERTHSGEKPYVCGECGRGFSRKSLLLVHQRTHSGEKHYVCRECRRGFSQKSNLIRHQRTHSNEKPYICRECGRGFCDKSTLIVHERTHSGEKPYVCSECGRGFSRKSLLLVHQRTHSGEKHYVCRECGRGFSHKSNLIRHQRTH

SEQ ID NO: 99770 - protein, 509 aa, Homo sapiens
  Payload ID: 19889
  Gene Name: zinc finger protein 343
  Uniprot ID: Q6P1L6
  ENSP ID: ENSP00000483851
MLENYRNLLSLAEPKPEIYTCSSCLLAFSCQQFLSQHVLQIFLGLCAENHFHPGNSSPGHWKQQGQQYSHVSCWFENAEGQERGGGSKPWSARTEERETSRAFPSPLQRQSASPRKGNMVVETEPSSAQRPNPVQLDKGLKELETLRFGAINCREYEPDHNLESNFITNPRTLLGKKPYICSDCGRSFKDRSTLIRHHRIHSMEKPYVCSECGRGFSQKSNLSRHQRTHSEEKPYLCRECGQSFRSKSILNRHQWTHSEEKPYVCSECGRGFSEKSSFIRHQRTHSGEKPYVCLECGRSFCDKSTLRKHQRIHSGEKPYVCRECGRGFSQNSDLIKHQRTHLDEKPYVCRECGRGFCDKSTLIIHERTHSGEKPYVCGECGRGFSRKSLLLVHQRTHSGEKHYVCRECRRGFSQKSNLIRHQRTHSNEKPYICRECGRGFCDKSTLIVHERTHSGEKPYVCSECGRGFSRKSLLLVHQRTHSGEKHYVCRECGRGFSHKSNLIRHQRTH

SEQ ID NO: 99771 - protein, 113 aa, Homo sapiens
  Payload ID: 19890
  Gene Name: zinc finger protein 345
  ENSP ID: ENSP00000331120
MENLTKHSIECSSFRGDWECKNQFERKQGSQEGHFSEMIFTPEDMPTFSIQHQRIHTDEKLLECKECGKDFSFVSVLVRHQRIHTGEKPYECKECGKAFGSGANLAYHQRIHT

SEQ ID NO: 99772 - protein, 488 aa, Homo sapiens
  Payload ID: 19890
  Gene Name: zinc finger protein 345
  Uniprot ID: Q14585
  ENSP ID: ENSP00000431202
MENLTKHSIECSSFRGDWECKNQFERKQGSQEGHFSEMIFTPEDMPTFSIQHQRIHTDEKLLECKECGKDFSFVSVLVRHQRIHTGEKPYECKECGKAFGSGANLAYHQRIHTGEKPFECKECGKAFGSGSNLTHHQRIHTGEKPYECKECGKAFSFGSGLIRHQIIHSGEKPYECKECGKSFSFESALIRHHRIHTGEKPYECIDCGKAFGSGSNLTQHRRIHTGEKPYECKACGMAFSSGSALTRHQRIHTGEKPYICNECGKAFSFGSALTRHQRIHTGEKPYVCKECGKAFNSGSDLTQHQRIHTGEKPYECKECEKAFRSGSKLIQHQRMHTGEKPYECKECGKTFSSGSDLTQHHRIHTGEKPYECKECGKAFGSGSKLIQHQLIHTGERPYECKECGKSFSSGSALNRHQRIHTGEKPYECKECGKAFYSGSSLTQHQRIHTGEKLYECKNCGKAYGRDSEFQQHKKSHNGKKLCELETIN

SEQ ID NO: 99773 - protein, 488 aa, Homo sapiens; identical to SEQ ID NO: 99772
  Payload ID: 19890
  Gene Name: zinc finger protein 345
  Uniprot ID: Q14585
  ENSP ID: ENSP00000431216

SEQ ID NO: 99774 - protein, 74 aa, Homo sapiens
  Payload ID: 19890
  Gene Name: zinc finger protein 345
  ENSP ID: ENSP00000431289
MENLTKHSIECSSFRGDWECKNQFERKQGSQEGHFSEMIFTPEDMPTFSIQHQRIHTDEKLLECKECGKDFSFV

SEQ ID NO: 99775 - protein, 488 aa, Homo sapiens; identical to SEQ ID NO: 99772
  Payload ID: 19890
  Gene Name: zinc finger protein 345
  Uniprot ID: Q14585
  ENSP ID: ENSP00000465431

SEQ ID NO: 99776 - protein, 184 aa, Homo sapiens
  Payload ID: 19890
  Gene Name: zinc finger protein 345
  ENSP ID: ENSP00000465851
MENLTKHSIECSSFRGDWECKNQFERKQGSQEGHFSEMIFTPEDMPTFSIQHQRIHTDEKLLECKECGKDFSFVSVLVRHQRIHTGEKPYECKECGKAFGSGANLAYHQRIHTGEKPFECKECGKAFGSGSNLTHHQRIHTGEKPYECKECGKAFSFGSGLIRHQIIHSGEKPYECKECGKSFS

SEQ ID NO: 99777 - protein, 94 aa, Homo sapiens
  Payload ID: 19890
  Gene Name: zinc finger protein 345
  ENSP ID: ENSP00000466374
MENLTKHSIECSSFRGDWECKNQFERKQGSQEGHFSEMIFTPEDMPTFSIQHQRIHTDEKLLECKECGKDFSFVSVLVRHQRIHTGEKPYECKE

SEQ ID NO: 99778 - protein, 75 aa, Homo sapiens
  Payload ID: 19890
  Gene Name: zinc finger protein 345
  ENSP ID: ENSP00000467611
MENLTKHSIECSSFRDPPQALPETQLCVSSSYSLWSSDCKAISMPRQGLSWRAMEEDRPAGCRFCSRACTMREIF

SEQ ID NO: 99779 - protein, 53 aa, Homo sapiens
  Payload ID: 19890
  Gene Name: zinc finger protein 345
  ENSP ID: ENSP00000468757
MENLTKHSIECSSFRDPPQALPETQLCVSSSYSLWSSDCKAISMPRQGLSWRA

SEQ ID NO: 99780 - protein, 488 aa, Homo sapiens; identical to SEQ ID NO: 99772
  Payload ID: 19890
  Gene Name: zinc finger protein 345
  Uniprot ID: Q14585
  ENSP ID: ENSP00000477522

SEQ ID NO: 99781 - protein, 488 aa, Homo sapiens; identical to SEQ ID NO: 99772
  Payload ID: 19890
  Gene Name: zinc finger protein 345
  Uniprot ID: Q14585
  ENSP ID: ENSP00000482400

SEQ ID NO: 99782 - protein, 294 aa, Homo sapiens
  Payload ID: 19891
  Gene Name: zinc finger protein 346
  Uniprot ID: Q9UL40
  ENSP ID: ENSP00000350869
MEYPAPATVQAADGGAAGPYSSSELLEGQEPDGVRFDRERARRLWEAVSGAQPVGREEVEHMIQKNQCLFTNTQCKVCCALLISESQKLAHYQSKKHANKVKRYLAIHGMETLKGETKKLDSDQKSSRSKDKNQCCPICNMTFSSPVVAQSHYLGKTHAKNLKLKQQSTKVEALHQNREMIDPDKFCSLCHATFNDPVMAQQHYVGKKHRKQETKLKLMARYGRLADPAVTDFPAGKGYPCKTCKIVLNSIEQYQAHVSGFKHKNQSPKTVASSLGQIPMQRQPIQKDSTTLED

SEQ ID NO: 99783 - protein, 118 aa, Homo sapiens
  Payload ID: 19891
  Gene Name: zinc finger protein 346
  ENSP ID: ENSP00000421089
MEYPAPATVQAADGGAAGPYSSSELLEGQEPDGVRFDRERARRLWEAVSGAQPVGREEAGKGYPCKTCKIVLNSIEQYQAHVSGFKHKNQSPKTVASSLGQIPMQRQPIQKDSTTLED

SEQ ID NO: 99784 - protein, 262 aa, Homo sapiens
  Payload ID: 19891
  Gene Name: zinc finger protein 346
  Uniprot ID: Q9UL40
  ENSP ID: ENSP00000421212
MEYPAPATVQAADGGAAGPYSSSELLEGQEPDGVRFDRERARRLWEAVSGAQPVGREEVEHMIQKNQCLFTNTQCKVCCALLISESQKLAHYQSSRSKDKNQCCPICNMTFSSPVVAQSHYLGKTHAKNLKLKQQSTKVEALHQNREMIDPDKFCSLCHATFNDPVMAQQHYVGKKHRKQETKLKLMARYGRLADPAVTDFPAGKGYPCKTCKIVLNSIEQYQAHVSGFKHKNQSPKTVASSLGQIPMQRQPIQKDSTTLED

SEQ ID NO: 99785 - protein, 131 aa, Homo sapiens
  Payload ID: 19891
  Gene Name: zinc finger protein 346
  ENSP ID: ENSP00000421388
MEYPAPATVQAADGGAAGPYSSSELLEGQEPDGVRFDRERARRLWEAVSGAQPVGREEVEHMIQKNQCLFTNTQCKVCCALLISESQKLAHYQSKKHANKVKRYLAIHGMETLKGETKKLDSDQPCTRIER

SEQ ID NO: 99786 - protein, 196 aa, Homo sapiens
  Payload ID: 19891
  Gene Name: zinc finger protein 346
  ENSP ID: ENSP00000423515
MEYPAPATVQAADGGAAGPYSSSELLEGQEPDGVRFDRERARRLWEAVSGAQPVGREEALSKRLTNPFLVASTLALHQNREMIDPDKFCSLCHATFNDPVMAQQHYVGKKHRKQETKLKLMARYGRLADPAVTDFPAGKGYPCKTCKIVLNSIEQYQAHVSGFKHKNQSPKTVASSLGQIPMQRQPIQKDSTTLED

SEQ ID NO: 99787 - protein, 135 aa, Homo sapiens
  Payload ID: 19891
  Gene Name: zinc finger protein 346
  ENSP ID: ENSP00000423690
MEYPAPATVQAADGGAAGPYSSSELLEGQEPDGVRFDRERARRLWEAVSGAQPVGREEVEHMIQKNQCLFTNTQCKVCCALLISESQKLAHYQSKKHANKVKRYLAIHGMETLKGETKKLDSDQLERATPAKHVR

SEQ ID NO: 99788 - protein, 319 aa, Homo sapiens
  Payload ID: 19891
  Gene Name: zinc finger protein 346
  Uniprot ID: Q9UL40
  ENSP ID: ENSP00000424495
MEYPAPATVQAADGGAAGPYSSSELLEGQEPDGVRFDRERARRLWEAVSGAQPVGREEAQFFPHSRTVIPILVLSETYSLCHPVEHMIQKNQCLFTNTQCKVCCALLISESQKLAHYQSKKHANKVKRYLAIHGMETLKGETKKLDSDQKSSRSKDKNQCCPICNMTFSSPVVAQSHYLGKTHAKNLKLKQQSTKVEALHQNREMIDPDKFCSLCHATFNDPVMAQQHYVGKKHRKQETKLKLMARYGRLADPAVTDFPAGKGYPCKTCKIVLNSIEQYQAHVSGFKHKNQSPKTVASSLGQIPMQRQPIQKDSTTLED

SEQ ID NO: 99789 - protein, 310 aa, Homo sapiens
  Payload ID: 19891
  Gene Name: zinc finger protein 346
  ENSP ID: ENSP00000425725
MEYPAPATVQAADGGAAGPYSSSELLEGQEPDGVRFDRERARRLWEAVSGAQPVGREEVEHMIQKNQCLFTNTQCKVCCALLISESQKLAHYQSKKHANKVKRYLAIHGMETLKGETKKLDSDQKSSRSKDKNQCCPICNMTFSSPVVAQSHYLGKTHAKNLKLKQQSTKVEALSKRLTNPFLVASTLALHQNREMIDPDKFCSLCHATFNDPVMAQQHYVGKKHRKQETKLKLMARYGRLADPAVTDFPAGKGYPCKTCKIVLNSIEQYQAHVSGFKHKNQSPKTVASSLGQIPMQRQPIQKDSTTLED

SEQ ID NO: 99790 - protein, 839 aa, Homo sapiens
  Payload ID: 19892
  Gene Name: zinc finger protein 347
  Uniprot ID: Q96SE7
  ENSP ID: ENSP00000334146
MALTQGQVTFRDVAIEFSQEEWTCLDPAQRTLYRDVMLENYRNLASLGISCFDLSIISMLEQGKEPFTLESQVQIAGNPDGWEWIKAVITALSSEFVMKDLLHKGKSNTGEVFQTVMLERQESQDIEGCSFREVQKNTHGLEYQCRDAEGNYKGVLLTQEGNLTHGRDEHDKRDARNKLIKNQLGLSLQSHLPELQLFQYEGKIYECNQVEKSFNNNSSVSPPQQMPYNVKTHISKKYLKDFISSLLLTQGQKANNWGSPYKSNGCGMVFPQNSHLASHQRSHTKEKPYKCYECGKAFRTRSNLTTHQVIHTGEKRYKCNECGKVFSRNSQLSQHQKIHTGEKPYKCNECGKVFTQNSHLVRHRGIHTGEKPYKCNECGKAFRARSSLAIHQATHSGEKPYKCNECGKVFTQNSHLTNHWRIHTGEKPYKCNECGKAFGVRSSLAIHLVIHTGEKPYKCHECGKVFRRNSHLARHQLIHTGEKPYKCNECGKAFRAHSNLTTHQVIHTGEKPYKCNECGKVFTQNSHLANHQRIHTGVKPYMCNECGKAFSVYSSLTTHQVIHTGEKPYKCNECGKVFTQNSHLARHRGIHTGEKPYKCNECGKVFRHNSYLSRHQRIHTGEKPYKYNEYGKAFSEHSNLTTHQVIHTGEKPYKCNECGKVFTQNSHLARHRRVHTGGKPYQCNECGKAFSQTSKLARHQRVHTGEKPYECNQCGKAFSVRSSLTTHQAIHTGKKPYKCNECGKVFTQNSHLARHRGIHTGEKPYKCNECGKAFSQTSKLARHQRIHTGEKPYECGKPFSICSSLTTHQTIHTGGKPYKCNVWKVLKSEFKPCKPSQNS

SEQ ID NO: 99791 - protein, 840 aa, Homo sapiens
  Payload ID: 19892
  Gene Name: zinc finger protein 347
  Uniprot ID: Q96SE7
  ENSP ID: ENSP00000405218
MALTQGQVTFRDVAIEFSQEEWTCLDPAQRTLYRDVMLENYRNLASLAGISCFDLSIISMLEQGKEPFTLESQVQIAGNPDGWEWIKAVITALSSEFVMKDLLHKGKSNTGEVFQTVMLERQESQDIEGCSFREVQKNTHGLEYQCRDAEGNYKGVLLTQEGNLTHGRDEHDKRDARNKLIKNQLGLSLQSHLPELQLFQYEGKIYECNQVEKSFNNNSSVSPPQQMPYNVKTHISKKYLKDFISSLLLTQGQKANNWGSPYKSNGCGMVFPQNSHLASHQRSHTKEKPYKCYECGKAFRTRSNLTTHQVIHTGEKRYKCNECGKVFSRNSQLSQHQKIHTGEKPYKCNECGKVFTQNSHLVRHRGIHTGEKPYKCNECGKAFRARSSLAIHQATHSGEKPYKCNECGKVFTQNSHLTNHWRIHTGEKPYKCNECGKAFGVRSSLAIHLVIHTGEKPYKCHECGKVFRRNSHLARHQLIHTGEKPYKCNECGKAFRAHSNLTTHQVIHTGEKPYKCNECGKVFTQNSHLANHQRIHTGVKPYMCNECGKAFSVYSSLTTHQVIHTGEKPYKCNECGKVFTQNSHLARHRGIHTGEKPYKCNECGKVFRHNSYLSRHQRIHTGEKPYKYNEYGKAFSEHSNLTTHQVIHTGEKPYKCNECGKVFTQNSHLARHRRVHTGGKPYQCNECGKAFSQTSKLARHQRVHTGEKPYECNQCGKAFSVRSSLTTHQAIHTGKKPYKCNECGKVFTQNSHLARHRGIHTGEKPYKCNECGKAFSQTSKLARHQRIHTGEKPYECGKPFSICSSLTTHQTIHTGGKPYKCNVWKVLKSEFKPCKPSQNS

SEQ ID NO: 99792 - protein, 125 aa, Homo sapiens
  Payload ID: 19892
  Gene Name: zinc finger protein 347
  ENSP ID: ENSP00000469338
MLEQGKEPFTLESQVQIAGNPDGWEWIKAVITALSSEFVMKDLLHKGKSNTGEVFQTVMLERQESQDIEGCSFREVQKNTHGLEYQCRDAEGNYKGVLLTQEGNLTHGRDEHDKRDARNKLIKNQ

SEQ ID NO: 99793 - protein, 102 aa, Homo sapiens
  Payload ID: 19892
  Gene Name: zinc finger protein 347
  ENSP ID: ENSP00000470499
MLENYRNLASLGISCFDLSIISMLEQGKEPFTLESQVQIAGNPDGWEWIKAVITALSSEFVMKDLLHKGKSNTGEVFQTVMLERQESQDIEGCSFREVQKNT

SEQ ID NO: 99794 - protein, 34 aa, Homo sapiens
  Payload ID: 19892
  Gene Name: zinc finger protein 347
  ENSP ID: ENSP00000470590
MLEQGKEPFTLESQVQIAGNPDGWEWIKAVITAS

SEQ ID NO: 99795 - protein, 840 aa, Homo sapiens; identical to SEQ ID NO: 99791
  Payload ID: 19892
  Gene Name: zinc finger protein 347
  Uniprot ID: Q96SE7
  ENSP ID: ENSP00000471712

SEQ ID NO: 99796 - protein, 34 aa, Homo sapiens
  Payload ID: 19892
  Gene Name: zinc finger protein 347
  ENSP ID: ENSP00000471825
MALTQGQVTFRDVAIEFSQEEWTCLDPAQRTLYR

SEQ ID NO: 99797 - protein, 103 aa, Homo sapiens
  Payload ID: 19893
  Gene Name: zinc finger protein 35
  ENSP ID: ENSP00000296092
MTAELREAMALAPWGPVKVKKEEEEEENFPGQASSQQVHSENIKVWAPVQGLQTGLDGSEEEEKVLKPRTYSYWFQKLRYVRKLKNPSSYQKESRKLILKDLS

SEQ ID NO: 99798 - protein, 527 aa, Homo sapiens
  Payload ID: 19893
  Gene Name: zinc finger protein 35
  Uniprot ID: P13682
  ENSP ID: ENSP00000379368
MTAELREAMALAPWGPVKVKKEEEEEENFPGQASSQQVHSENIKVWAPVQGLQTGLDGSEEEEKGQNISWDMAVVLKATQEAPAASTLGSYSLPGTLAKSEILETHGTMNFLGAETKNLQLLVPKTEICEEAEKPLIISERIQKADPQGPELGEACEKGNMLKRQRIKREKKDFRQVIVNDCHLPESFKEEENQKCKKSGGKYSLNSGAVKNPKTQLGQKPFTCSVCGKGFSQSANLVVHQRIHTGEKPFECHECGKAFIQSANLVVHQRIHTGQKPYVCSKCGKAFTQSSNLTVHQKIHSLEKTFKCNECEKAFSYSSQLARHQKVHITEKCYECNECGKTFTRSSNLIVHQRIHTGEKPFACNDCGKAFTQSANLIVHQRSHTGEKPYECKECGKAFSCFSHLIVHQRIHTAEKPYDCSECGKAFSQLSCLIVHQRIHSGDLPYVCNECGKAFTCSSYLLIHQRIHNGEKPYTCNECGKAFRQRSSLTVHQRTHTGEKPYECEKCGAAFISNSHLMRHHRTHLVE

SEQ ID NO: 99799 - protein, 103 aa, Homo sapiens; identical to SEQ ID NO: 99797
  Payload ID: 19893
  Gene Name: zinc finger protein 35
  ENSP ID: ENSP00000391573

SEQ ID NO: 99800 - protein, 103 aa, Homo sapiens; identical to SEQ ID NO: 99797
  Payload ID: 19893
  Gene Name: zinc finger protein 35
  ENSP ID: ENSP00000401311

SEQ ID NO: 99801 - protein, 112 aa, Homo sapiens
  Payload ID: 19893
  Gene Name: zinc finger protein 35
  ENSP ID: ENSP00000404336
MTAELREAMALAPWGPVKVKKEEEEEENFPGQASSQQVHSENIKVWAPVQGLQTGLDGSEEEEKGQNISWDMAVVLKATQEAPAASTLGSYSLPGTLAKSEILETHGTMNFL

SEQ ID NO: 99802 - protein, 134 aa, Homo sapiens
  Payload ID: 19893
  Gene Name: zinc finger protein 35
  ENSP ID: ENSP00000404354
MTAELREAMALAPWGPVKVKKEEEEEENFPGQASSQQVHSENIKVWAPVQGLQTGLDGSEEEEKGQNISWDMAVVLKATQEAPAASTLGSYSLPGTLAKSEILETHGTMNFLGAETKNLQLLVPKTEICEEAEK

SEQ ID NO: 99803 - protein, 103 aa, Homo sapiens; identical to SEQ ID NO: 99797
  Payload ID: 19893
  Gene Name: zinc finger protein 35
  ENSP ID: ENSP00000485695

SEQ ID NO: 99804 - protein, 527 aa, Homo sapiens; identical to SEQ ID NO: 99798
  Payload ID: 19893
  Gene Name: zinc finger protein 35
  Uniprot ID: P13682
  ENSP ID: ENSP00000486354

SEQ ID NO: 99805 - protein, 103 aa, Homo sapiens; identical to SEQ ID NO: 99797
  Payload ID: 19893
  Gene Name: zinc finger protein 35
  ENSP ID: ENSP00000486615

SEQ ID NO: 99806 - protein, 134 aa, Homo sapiens; identical to SEQ ID NO: 99802
  Payload ID: 19893
  Gene Name: zinc finger protein 35
  ENSP ID: ENSP00000486794

SEQ ID NO: 99807 - protein, 112 aa, Homo sapiens; identical to SEQ ID NO: 99801
  Payload ID: 19893
  Gene Name: zinc finger protein 35
  ENSP ID: ENSP00000487042

SEQ ID NO: 99808 - protein, 103 aa, Homo sapiens; identical to SEQ ID NO: 99797
  Payload ID: 19893
  Gene Name: zinc finger protein 35
  ENSP ID: ENSP00000487287

SEQ ID NO: 99809 - protein, 532 aa, Homo sapiens
  Payload ID: 19894
  Gene Name: zinc finger protein 350
  Uniprot ID: Q9GZX5
  ENSP ID: ENSP00000243644
MIQAQESITLEDVAVDFTWEEWQLLGAAQKDLYRDVMLENYSNLVAVGYQASKPDALFKLEQGEQLWTIEDGIHSGACSDIWKVDHVLERLQSESLVNRRKPCHEHDAFENIVHCSKSQFLLGQNHDIFDLRGKSLKSNLTLVNQSKGYEIKNSVEFTGNGDSFLHANHERLHTAIKFPASQKLISTKSQFISPKHQKTRKLEKHHVCSECGKAFIKKSWLTDHQVMHTGEKPHRCSLCEKAFSRKFMLTEHQRTHTGEKPYECPECGKAFLKKSRLNIHQKTHTGEKPYICSECGKGFIQKGNLIVHQRIHTGEKPYICNECGKGFIQKTCLIAHQRFHTGKTPFVCSECGKSCSQKSGLIKHQRIHTGEKPFECSECGKAFSTKQKLIVHQRTHTGERPYGCNECGKAFAYMSCLVKHKRIHTREKQEAAKVENPPAERHSSLHTSDVMQEKNSANGATTQVPSVAPQTSLNISGLLANRNVVLVGQPVVRCAASGDNRGFAQDRNLVNAVNVVVPSVINYVLFYVTENP

SEQ ID NO: 99810 - protein, 67 aa, Homo sapiens
  Payload ID: 19894
  Gene Name: zinc finger protein 350
  ENSP ID: ENSP00000469594
MIQAQESITLEDVAVDFTWEEWQLLGAAQKDLYRDVMLENYSNLVAVGYQASKPDALFKLEQGEQLW

SEQ ID NO: 99811 - protein, 62 aa, Homo sapiens
  Payload ID: 19894
  Gene Name: zinc finger protein 350
  ENSP ID: ENSP00000470066
MIQAQESITLEDVAVDFTWEEWQLLGAAQKDLYRDVMLENYSNLVAVGYQASKPDALFKLEQ

SEQ ID NO: 99812 - protein, 163 aa, Homo sapiens
  Payload ID: 19894
  Gene Name: zinc finger protein 350
  ENSP ID: ENSP00000470930
MLENYSNLVAVGYQASKPDALFKLEQGEQLWTIEDGIHSGACSDIWKVDHVLERLQSESLVNRRKPCHEHDAFENIVHCSKSQFLLGQNHDIFDLRGKSLKSNLTLVNQSKGYEIKNSVEFTGNGDSFLHANHERLHTAIKFPASQKLISTKSQFISPKHQKT

SEQ ID NO: 99813 - protein, 52 aa, Homo sapiens
  Payload ID: 19894
  Gene Name: zinc finger protein 350
  ENSP ID: ENSP00000472104
MIQAQESITLEDVAVDFTWEEWQLLGAAQKDLYRDVMLENYSNLVAVGYQAS

SEQ ID NO: 99814 - protein, 605 aa, Homo sapiens
  Payload ID: 19895
  Gene Name: zinc finger protein 354A
  Uniprot ID: O60765
  ENSP ID: ENSP00000337122
MAAGQREARPQVSLTFEDVAVLFTRDEWRKLAPSQRNLYRDVMLENYRNLVSLGLPFTKPKVISLLQQGEDPWEVEKDGSGVSSLGSKSSHKTTKSTQTQDSSFQGLILKRSNRNVPWDLKLEKPYIYEGRLEKKQDKKGSFQIVSATHKKIPTIERSHKNTELSQNFSPKSVLIRQQILPREKTPPKCEIQGNSLKQNSQLLNQPKITADKRYKCSLCEKTFINTSSLRKHEKNHSGEKLFKCKECSKAFSQSSALIQHQITHTGEKPYICKECGKAFTLSTSLYKHLRTHTVEKSYRCKECGKSFSRRSGLFIHQKIHAEENPCKYNPGRKASSCSTSLSGCQRIHSRKKSYLCNECGNTFKSSSSLRYHQRIHTGEKPFKCSECGRAFSQSASLIQHERIHTGEKPYRCNECGKGFTSISRLNRHRIIHTGEKFYNCNECGKALSSHSTLIIHERIHTGEKPCKCKVCGKAFRQSSALIQHQRMHTGERPYKCNECGKTFRCNSSLSNHQRIHTGEKPYRCEECGISFGQSSALIQHRRIHTGEKPFKCNTCGKTFRQSSSRIAHQRIHTGEKPYECNTCGKLFNHRSSLTNHYKIHIEEDP

SEQ ID NO: 99815 - protein, 66 aa, Homo sapiens
  Payload ID: 19895
  Gene Name: zinc finger protein 354A
  ENSP ID: ENSP00000428752
MAAGQREARPQVSLTFEDVAVLFTRDEWRKLAPSQRNLYRDVMLENYRNLVSLGPYINRQWSEFGP

SEQ ID NO: 99816 - protein, 135 aa, Homo sapiens
  Payload ID: 19895
  Gene Name: zinc finger protein 354A
  ENSP ID: ENSP00000429675
MAAGQREARPQVSLTFEDVAVLFTRDEWRKLAPSQRNLYRDVMLENYRNLVSLGLPFTKPKVISLLQQGEDPWEVEKDGSGVSSLGSKSSHKTTKSTQTQDSSFQGLILKRSNRNVPWDLKLEKPYIYEGRLEKK

SEQ ID NO: 99817 - protein, 612 aa, Homo sapiens
  Payload ID: 19896
  Gene Name: zinc finger protein 354B
  Uniprot ID: Q96LW1
  ENSP ID: ENSP00000327143
MAAGQREARPQVSLTFEDVAVLFTWDEWRKLAPSQRNLYRDVMLENYRNLVSLGLSFTKPKVISLLQQGEDPWEVEKDSSGVSSLGCKSTPKMTKSTQTQDSFQEQIRKRLKRDEPWNFISERSCIYEEKLKKQQDKNENLQIISVAHTKILTVDRSHKNVEFGQNFYLKSVFIKQQRFAKEKTPSKCEIQRNSFKQNSNLLNQSKIKTAEKRYKCSTCEKAFIHNSSLRKHQKNHTGEKLFKCKECLKAFSQSSALIQHQRTHTGEKPYICKECGKAFSHSASLCKHLRTHTVEKCYRCKECGKSFSRRSGLFIHQKIHAQENPHKYNPGRKASSYSTSLSGSQKIHLRKKSYLCNECGNTFKSSSSLRYHQRIHTGEKPFKCSECGRAFSQSASLIQHERIHTGEKPYRCNECGKGFTSISRLNRHRIIHTGEKLYNCNECGKALSSHSTLIIHERIHTGEKPCKCKVCGKAFRQSSALIQHQRMHTGERPYKCNECDKTFRCNSSLSNHQRIHTGEKPYRCLECGMSFGQSAALIQHQRIHTGEKPFKCNTCGKTFRQSSSLIAHQRIHTGEKPYECNACGKLFSQRSSLTNHYKIHIEEDSLKADLHV

SEQ ID NO: 99818 - protein, 134 aa, Homo sapiens
  Payload ID: 19896
  Gene Name: zinc finger protein 354B
  ENSP ID: ENSP00000429827
MAAGQREARPQVSLTFEDVAVLFTWDEWRKLAPSQRNLYRDVMLENYRNLVSLGLSFTKPKVISLLQQGEDPWEVEKDSSGVSSLGCKSTPKMTKSTQTQDSFQEQIRKRLKRDEPWNFISERSCIYEEKLKKQ

SEQ ID NO: 99819 - protein, 554 aa, Homo sapiens [sequence omitted]

SEQ ID NO: 99820 - protein, 568 aa, Homo sapiens
  Payload ID: 19898
  Gene Name: zinc finger protein 358
  Uniprot ID: Q9NW07
  ENSP ID: ENSP00000377873
MRRSVLVRNPGHKGLRPVYEELDSDSEDLDPNPEDLDPVSEDPEPDPEDLNTVPEDVDPSYEDLEPVSEDLDPDAEAPGSEPQDPDPMSSSFDLDPDVIGPVPLILDPNSDTLSPGDPKVDPISSGLTATPQVLATSPAVLPAPASPPRPFSCPDCGRAFRRSSGLSQHRRTHSGEKPYRCPDCGKSFSHGATLAQHRGIHTGARPYQCAACGKAFGWRSTLLKHRSSHSGEKPHHCPVCGKAFGHGSLLAQHLRTHGGPRPHKCPVCAKGFGQGSALLKHLRTHTGERPYPCPQCGKAFGQSSALLQHQRTHTAERPYRCPHCGKAFGQSSNLQHHLRIHTGERPYACPHCSKAFGQSSALLQHLHVHSGERPYRCQLCGKAFGQASSLTKHKRVHEGAAAAAAAAAAAAAAAAAGLGLGPGLSPASMMRPGQVSLLGPDAVSVLGSGLGLSPGTSSGRNPDPGSGPGTLPDPSSKPLPGSRSTPSPTPVESSDPKAGHDAGPDLVPSPDLDPVPSPDPDPVPSPDPNPVSCPDPCSPTRGTVSPALPTGESPEWVQEQGALLGPDG

SEQ ID NO: 99821 - protein, 568 aa, Homo sapiens; identical to SEQ ID NO: 99820
  Payload ID: 19898
  Gene Name: zinc finger protein 358
  Uniprot ID: Q9NW07
  ENSP ID: ENSP00000472305

SEQ ID NO: 99822 - protein, 169 aa, Homo sapiens
  Payload ID: 19898
  Gene Name: zinc finger protein 358
  ENSP ID: ENSP00000472777
MRRSVLVRNPGHKGLRPVYEELDSDSEDLDPNPEDLDPVSEDPEPDPEDLNTVPEDVDPSYEDLEPVSEDLDPDAEAPGSEPQDPDPMSSSFDLDPDVIGPVPLILDPNSDTLSPGDPKVDPISSGLTATPQVLATSPAVLPAPASPPRPFSCPDCGRAFRRSSGLSQH

SEQ ID NO: 99823 - protein, 420 aa, Homo sapiens
  Payload ID: 19899
  Gene Name: zinc finger protein 362
  Uniprot ID: Q5T0B9
  ENSP ID: ENSP00000362527
MSRSSPSGKGHSRMAEPRFNNPYFWPPPPTMPSQLDNLVLINKIKEQLMAEKIRPPHLPPTSASSQQPLLVPPAPAESSQAVMSLPKLQQVPGLHPQAVPQPDVALHARPATSTVTGLGLSTRTPSVSTSESSAGAGTGTGTSTPSTPTTTSQSRLIASSPTLISGITSPPLLDSIKTIQGHGLLGPPKSERGRKKIKAENPGGPPVLVVPYPILASGETAKEGKTYRCKVCPLTFFTKSEMQIHSKSHTEAKPHKCPHCSKSFANASYLAQHLRIHLGVKPYHCSYCDKSFRQLSHLQQHTRIHTGDRPYKCPHPGCEKAFTQLSNLQSHQRQHNKDKPYKCPNCYRAYSDSASLQIHLSAHAIKHAKAYCCSMCGRAYTSETYLMKHMSKHTVVEHLVSHHSPQRTESPGIPVRISLI

SEQ ID NO: 99824 - protein, 200 aa, Homo sapiens
  Payload ID: 19899
  Gene Name: zinc finger protein 362
  ENSP ID: ENSP00000438354
MAEPRFNNPYFWPPPPTMPSQLDNLVLINKIKEQLMAEKIRPPHLPPTSASSQQPLLVPPAPAESSQAVMSLPKLQQVPGLHPQAVPQPDVALHARPATSTVTGLGLSTRTPSVSTSESSAGAGTGTGTSTPSTPTTTSQSRLIASSPTLISGITSPPLLDSIKTIQGHGLLGPPKSERGRKKIKAENPGGPPVLVVPYP

SEQ ID NO: 99825 - protein, 420 aa, Homo sapiens; identical to SEQ ID NO: 99823
  Payload ID: 19899
  Gene Name: zinc finger protein 362
  Uniprot ID: Q5T0B9
  ENSP ID: ENSP00000446335

SEQ ID NO: 99826 - protein, 65 aa, Homo sapiens
  Payload ID: 19900
  Gene Name: zinc finger protein 365
  ENSP ID: ENSP00000345300
MSALGQITITVSRCWNTERNQTDKNPCLHGAYLQLRETVKNKDLAKFGCYFPFVEGLFITMRRTS

SEQ ID NO: 99827 - protein, 65 aa, Homo sapiens; identical to SEQ ID NO: 99826
  Payload ID: 19900
  Gene Name: zinc finger protein 365
  ENSP ID: ENSP00000362889

SEQ ID NO: 99828 - protein, 68 aa, Homo sapiens
  Payload ID: 19900
  Gene Name: zinc finger protein 365
  ENSP ID: ENSP00000378670
MSALGQITITVSRESVSTSQSRNISLLTLGQLQNCVIGKLTIIDLLTEHLLGVRHGVICFPWGLPSSS

SEQ ID NO: 99829 - protein, 216 aa, Homo sapiens
  Payload ID: 19900
  Gene Name: zinc finger protein 365
  Uniprot ID: Q70YC4
  ENSP ID: ENSP00000378672
MSALGQITITVSRCWNTERNQTDKNPCLHGAYLQLRETVKNKSTHLKKPLMKQAPPWKDHLTFQPLHPAERKTQVWRWQSGNSSDLETTSSASPWPTGSNRDVVLNTLAESCCGLSELITAPPYAGVSIQGFSQIWVLFPFCGGTFHHNEKDVLGLQDFERESVSTSQSRNISLLTLGQLQNCVIGKLTIIDLLTEHLLGVRHGVICFPWGLPSSS

SEQ ID NO: 99830 - protein, 407 aa, Homo sapiens
  Payload ID: 19900
  Gene Name: zinc finger protein 365
  Uniprot ID: Q70YC5
  ENSP ID: ENSP00000378674
MQQKAFEESRYPWQESFENVAVCLPLRCPRCGDHTRFRSLSSLRAHLEFSHSYEERTLLTKCSLFPSLKDTDLVTSSELLKPGKLQSSGNVVKQKPSYVNLYSISHEHSKDRKPFEVVAERPVSYVQTYTAMDLHADSLDGTRSGPGLPTSDTKASFEAHVREKFNRMVEAVDRTIEKRIDKLTKELAQKTAELLEVRAAFVQLTQKKQEVQRRERALNRQVDVAVEMIAVLRQRLTESEEELLRKEEEVVTFNHFLEAAAEKEVQGKARLQDFIENLLQRVELAEKQLEYYQSQQASGFVRDLSGHVLTDISSNRKPKCLSRGHPHSVCNHPDLKAHFHPKGRNHLKKAKDDRASMQPAKAIHEQAESSRDLCRPPKKGELLGFGRKGNIRPKMAKKKPTAIVNII

SEQ ID NO: 99831 - protein, 333 aa, Homo sapiens
  Payload ID: 19900
  Gene Name: zinc finger protein 365
  Uniprot ID: Q70YC5
  ENSP ID: ENSP00000378675
MQQKAFEESRYPWQESFENVAVCLPLRCPRCGDHTRFRSLSSLRAHLEFSHSYEERTLLTKCSLFPSLKDTDLVTSSELLKPGKLQSSGNVVKQKPSYVNLYSISHEHSKDRKPFEVVAERPVSYVQTYTAMDLHADSLDGTRSGPGLPTSDTKASFEAHVREKFNRMVEAVDRTIEKRIDKLTKELAQKTAELLEVRAAFVQLTQKKQEVQRRERALNRQVDVAVEMIAVLRQRLTESEEELLRKEEEVVTFNHFLEAAAEKEVQGKARLQDFIENLLQRVELAEKQLEYYQSQQASGFVRDLSGHVSWKGAGEARLVCQNDLELEESAIVE

SEQ ID NO: 99832 - protein, 462 aa, Homo sapiens
  Payload ID: 19900
  Gene Name: zinc finger protein 365
  Uniprot ID: Q70YC5
  ENSP ID: ENSP00000387091
MQQKAFEESRYPWQESFENVAVCLPLRCPRCGDHTRFRSLSSLRAHLEFSHSYEERTLLTKCSLFPSLKDTDLVTSSELLKPGKLQSSGNVVKQKPSYVNLYSISHEHSKDRKPFEVVAERPVSYVQTYTAMDLHADSLDGTRSGPGLPTSDTKASFEAHVREKFNRMVEAVDRTIEKRIDKLTKELAQKTAELLEVRAAFVQLTQKKQEVQRRERALNRQVDVAVEMIAVLRQRLTESEEELLRKEEEVVTFNHFLEAAAEKEVQGKARLQDFIENLLQRVELAEKQLEYYQSQQASGFVRDLSGHVSWKGAGEARLVCQNDLELEIFGHINHHLSGLKDSHCLVFLQAPPVPWIILASFLWILGNPWTSSTATAGFSQIWVLFPFCGGTFHHNEKDVLGLQDFERESVSTSQSRNISLLTLGQLQNCVIGKLTIIDLLTEHLLGVRHGVICFPWGLPSSS

SEQ ID NO: 99833 - protein, 53 aa, Homo sapiens
  Payload ID: 19900
  Gene Name: zinc finger protein 365
  ENSP ID: ENSP00000392791
MQQKAFEESRYPWQESFENVAVCLPLRCPRCGDHTRFRSLSSLRAHLEFSHSY

SEQ ID NO: 99834 - protein, 216 aa, Homo sapiens; identical to SEQ ID NO: 99829
  Payload ID: 19900
  Gene Name: zinc finger protein 365
  Uniprot ID: Q70YC4
  ENSP ID: ENSP00000481372

SEQ ID NO: 99835 - protein, 744 aa, Homo sapiens
  Payload ID: 19901
  Gene Name: zinc finger protein 366
  Uniprot ID: Q8N895
  ENSP ID: ENSP00000313158
MQKEMKMIKDEDVHFDLAVKKTPSFPHCLQPVASRGKAPQRHPFPEALRGPFSQFRYEPPPGDLDGFPGVFEGAGSRKRKSMPTKMPYNHPAEEVTLALHSEENKNHGLPNLPLLFPQPPRPKYDSQMIDLCNVGFQFYRSLEHFGGKPVKQEPIKPSAVWPQPTPTPFLPTPYPYYPKVHPGLMFPFFVPSSSPFPFSRHTFLPKQPPEPLLPRKAEPQESEETKQKVERVDVNVQIDDSYYVDVGGSQKRWQCPTCEKSYTSKYNLVTHILGHSGIKPHACTHCGKLFKQLSHLHTHMLTHQGTRPHKCQVCHKAFTQTSHLKRHMMQHSEVKPHNCRVCGRGFAYPSELKAHEAKHASGRENICVECGLDFPTLAQLKRHLTTHRGPIQYNCSECDKTFQYPSQLQNHMMKHKDIRPYICSECGMEFVQPHHLKQHSLTHKGVKEHKCGICGREFTLLANMKRHVLIHTNIRAYQCHLCYKSFVQKQTLKAHMIVHSDVKPFKCKLCGKEFNRMHNLMGHMHLHSDSKPFKCLYCPSKFTLKGNLTRHMKVKHGVMERGLHSQGLGRGRIALAQTAGVLRSLEQEEPFDLSQKRRAKVPVFQSDGESAQGSHCHEEEEEDNCYEVEPYSPGLAPQSQQLCTPEDLSTKSEHAPEVLEEACKEEKEDASKGEWEKRSKGDLGAEGGQERDCAGRDECLSLRAFQSTRRGPSFSDYLYFKHRDESLKELLERKMEKQAVLLGI

SEQ ID NO: 99836 - protein, 64 aa, Homo sapiens
  Payload ID: 19901
  Gene Name: zinc finger protein 366
  ENSP ID: ENSP00000391333
MQKEMKMIKDEDVHFDLAVKKTPSFPHCLQPVASRGKAPQRHPFPEALRGPFSQFRYEPPPGDL

SEQ ID NO: 99837 - protein, 65 aa, Homo sapiens
  Payload ID: 19901
  Gene Name: zinc finger protein 366
  ENSP ID: ENSP00000423241
MQKEMKMIKDEDVHFDLAVKKTPSFPHCLQPVASRGKAPQRHPFPEALRGPFSQFRPRAPSMTLR

SEQ ID NO: 99838 - protein, 350 aa, Homo sapiens
  Payload ID: 19902
  Gene Name: zinc finger protein 367
  Uniprot ID: Q7RTV3
  ENSP ID: ENSP00000364405
MIRGFEAPMAENPPPPPPPVIFCHDSPKRVLVSVIRTTPIKPTCGGGGEPEPPPPLIPTSPGFSDFMVYPWRWGENAHNVTLSPGAAGAAASAALPAAAAAEHSGLRGRGAPPPAASASAAASGGEDEEEASSPDSGHLKDGIRRGRPRADTVRDLINEGEHSSSRIRCNICNRVFPREKSLQAHKRTHTGERPYLCDYPDCGKAFVQSGQLKTHQRLHTGEKPFVCSENGCLSRFTHANRHCPKHPYARLKREEPTDTLSKHQAADNKAAAEWLARYWEMREQRTPTLKGKLVQKADQEQQDPLEYLQSDEEDDEKRGAQRRLQEQRERLHGALALIELANLTGAPLRQ

SEQ ID NO: 99839 - protein, 561 aa, Homo sapiens
  Payload ID: 19903
  Gene Name: zinc finger protein 37A
  Uniprot ID: P17032
  ENSP ID: ENSP00000329141
MITSQGSVSFRDVTVGFTQEEWQHLDPAQRTLYRDVMLENYSHLVSVGYCIPKPEVILKLEKGEEPWILEEKFPSQSHLELINTSRNYSIMKFNEFNKGGKCFCDEKHEIIHSEEEPSEYNKNGNSFWLNEDLIWHQKIKNWEQSFEYNECGKAFPENSLFLVHKRGYTGQKTCKYTEHGKTCDMSFFITHQQTHPRENHYGNECGENIFEESILLEHQSVYPFSQKLNLTPIQRTHSINNIIEYNECGTFFSEKLVLHLQQRTHTGEKPYECHECGKTFTQKSAHTRHQRTHTGGKPYECHECGKTFYKNSDLIKHQRIHTGERPYGCHECGKSFSEKSTLTQHQRTHTGEKPYECHECGKTFSFKSVLTVHQKTHTGEKPYECYACGKAFLRKSDLIKHQRIHTGEKPYECNECGKSFSEKSTLTKHLRTHTGEKPYECIQCGKFFCYYSGFTEHLRRHTGEKPFGCNECGKTFRQKSALIVHQRTHIRQKPYGCNQCGKSFCVKSKLIAHHRTHTGEKPYECNVCGKSFYVKSKLTVHQRIHLGRNPINVVNEGNYSG

SEQ ID NO: 99840 - protein, 561 aa, Homo sapiens; identical to SEQ ID NO: 99839
  Payload ID: 19903
  Gene Name: zinc finger protein 37A
  Uniprot ID: P17032
  ENSP ID: ENSP00000354377

SEQ ID NO: 99841 - protein, 550 aa, Homo sapiens
  Payload ID: 19904
  Gene Name: zinc finger protein 382
  Uniprot ID: Q96SR6
  ENSP ID: ENSP00000292928
MPLQGSVSFKDVTVDFTQEEWQQLDPAQKALYRDVMLENYCHFVSVGFHMAKPDMIRKLEQGEELWTQRIFPSYSYLEEDGKTEDVLVKFKEYQDRHSRPLIFINHKKLIKERSNIYGKTFTLGKNRISKTILCEYKPDGKVLKNISELVIRNISPIKEKFGDSTGWEKSLLNTKHEKIHPAVNLHKQTERVLSGKQELIQHQKVQAPEQPFDHNECEKSFLMKGMLFTHTRAHRGERTFEYNKDGIAFIEKSSLSVHPSNLMEKKPSAYNKYGKFLCRKPVFIMPQRPQTEEKPFHCPYCGNNFRRKSYLIEHQRIHTGEKPYVCNQCGKAFRQKTALTLHEKTHIEGKPFICIDCGKSFRQKATLTRHHKTHTGEKAYECPQCGSAFRKKSYLIDHQRTHTGEKPYQCNECGKAFIQKTTLTVHQRTHTGEKPYICNECGKSFCQKTTLTLHQRIHTGEKPYICNECGKSFRQKAILTVHHRIHTGEKSNGCPQCGKAFSRKSNLIRHQKTHTGEKPYECKQCGKFFSCKSNLIVHQKTHKVETTGIQ

SEQ ID NO: 99842 - protein, 501 aa, Homo sapiens
  Payload ID: 19904
  Gene Name: zinc finger protein 382
  ENSP ID: ENSP00000389722
MAKPDMIRKLEQGEELWTQRIFPSYSYLEEDGKTEDVLVKFKEYQDRHSRPLIFINHKKLIKERSNIYGKTFTLGKNRISKTILCEYKPDGKVLKNISELVIRNISPIKEKFGDSTGWEKSLLNTKHEKIHPAVNLHKQTERVLSGKQELIQHQKVQAPEQPFDHNECEKSFLMKGMLFTHTRAHRGERTFEYNKDGIAFIEKSSLSVHPSNLMEKKPSAYNKYGKFLCRKPVFIMPQRPQTEEKPFHCPYCGNNFRRKSYLIEHQRIHTGEKPYVCNQCGKAFRQKTALTLHEKTHIEGKPFICIDCGKSFRQKATLTRHHKTHTGEKAYECPQCGSAFRKKSYLIDHQRTHTGEKPYQCNECGKAFIQKTTLTVHQRTHTGEKPYICNECGKSFCQKTTLTLHQRIHTGEKPYICNECGKSFRQKAILTVHHRIHTGEKSNGCPQCGKAFSRKSNLIRHQKTHTGEKPYECKQCGKFFSCKSNLIVHQKTHKVETTGIQ

SEQ ID NO: 99843 - protein, 549 aa, Homo sapiens
  Payload ID: 19904
  Gene Name: zinc finger protein 382
  Uniprot ID: Q96SR6
  ENSP ID: ENSP00000407593
MSQGSVSFKDVTVDFTQEEWQQLDPAQKALYRDVMLENYCHFVSVGFHMAKPDMIRKLEQGEELWTQRIFPSYSYLEEDGKTEDVLVKFKEYQDRHSRPLIFINHKKLIKERSNIYGKTFTLGKNRISKTILCEYKPDGKVLKNISELVIRNISPIKEKFGDSTGWEKSLLNTKHEKIHPAVNLHKQTERVLSGKQELIQHQKVQAPEQPFDHNECEKSFLMKGMLFTHTRAHRGERTFEYNKDGIAFIEKSSLSVHPSNLMEKKPSAYNKYGKFLCRKPVFIMPQRPQTEEKPFHCPYCGNNFRRKSYLIEHQRIHTGEKPYVCNQCGKAFRQKTALTLHEKTHIEGKPFICIDCGKSFRQKATLTRHHKTHTGEKAYECPQCGSAFRKKSYLIDHQRTHTGEKPYQCNECGKAFIQKTTLTVHQRTHTGEKPYICNECGKSFCQKTTLTLHQRIHTGEKPYICNECGKSFRQKAILTVHHRIHTGEKSNGCPQCGKAFSRKSNLIRHQKTHTGEKPYECKQCGKFFSCKSNLIVHQKTHKVETTGIQ

SEQ ID NO: 99844 - protein, 549 aa, Homo sapiens
  Payload ID: 19904
  Gene Name: zinc finger protein 382
  Uniprot ID: Q96SR6
  ENSP ID: ENSP00000410113
MPLQGSVSFKDVTVDFTQEEWQQLDPAQKALYRDVMLENYCHFVSVGFHMAKPDMIRKLEQGEELWTQRIFPSYSYLEDGKTEDVLVKFKEYQDRHSRPLIFINHKKLIKERSNIYGKTFTLGKNRISKTILCEYKPDGKVLKNISELVIRNISPIKEKFGDSTGWEKSLLNTKHEKIHPAVNLHKQTERVLSGKQELIQHQKVQAPEQPFDHNECEKSFLMKGMLFTHTRAHRGERTFEYNKDGIAFIEKSSLSVHPSNLMEKKPSAYNKYGKFLCRKPVFIMPQRPQTEEKPFHCPYCGNNFRRKSYLIEHQRIHTGEKPYVCNQCGKAFRQKTALTLHEKTHIEGKPFICIDCGKSFRQKATLTRHHKTHTGEKAYECPQCGSAFRKKSYLIDHQRTHTGEKPYQCNECGKAFIQKTTLTVHQRTHTGEKPYICNECGKSFCQKTTLTLHQRIHTGEKPYICNECGKSFRQKAILTVHHRIHTGEKSNGCPQCGKAFSRKSNLIRHQKTHTGEKPYECKQCGKFFSCKSNLIVHQKTHKVETTGIQ

SEQ ID NO: 99845 - protein, 184 aa, Homo sapiens
  Payload ID: 19904
  Gene Name: zinc finger protein 382
  ENSP ID: ENSP00000465485
MAKPDMIRKLEQGEELWTQRIFPSYSYLEEDGKTEDVLVKFKEYQDRHSRPLIFINHKKLIKERSNIYGKTFTLGKNRISKTILCEYKPDGKVLKNISELVIRNISPIKEKFGDSTGWEKSLLNTKHEKIHPAVNLHKQTERVLSGKQELIQHQKVQAPEQPFDHNECEKSFLMKGMLFTHTRA

SEQ ID NO: 99846 - protein, 25 aa, Homo sapiens
  Payload ID: 19904
  Gene Name: zinc finger protein 382
  ENSP ID: ENSP00000467675
MSQGSVSFKDVTVDFTQEEWQQLDP

SEQ ID NO: 99847 - protein, 475 aa, Homo sapiens
  Payload ID: 19905
  Gene Name: zinc finger protein 383
  Uniprot ID: Q8NA42
  ENSP ID: ENSP00000340132
MAEGSVMFSDVSIDFSQEEWDCLDPVQRDLYRDVMLENYGNLVSMGLYTPKPQVISLLEQGKEPWMVGRELTRGLCSDLESMCETKLLSLKKEVYEIELCQREIMGLTKHGLEYSSFGDVLEYRSHLAKQLGYPNGHFSQEIFTPEYMPTFIQQTFLTLHQIINNEDRPYECKKCGKAFSQNSQFIQHQRIHIGEKSYECKECGKFFSCGSHVTRHLKIHTGEKPFECKECGKAFSCSSYLSQHQRIHTGKKPYECKECGKAFSYCSNLIDHQRIHTGEKPYECKVCGKAFTKSSQLFQHARIHTGEKPYECKECGKAFTQSSKLVQHQRIHTGEKPYECKECGKAFSSGSALTNHQRIHTGEKPYDCKECGKAFTQSSQLRQHQRIHAGEKPFECLECGKAFTQNSQLFQHQRIHTDEKPYECNECGKAFNKCSNLTRHLRIHTGEKPYNCKECGKAFSSGSDLIRHQGIHTNK

SEQ ID NO: 99848 - protein, 475 aa, Homo sapiens; identical to SEQ ID NO: 99847
  Payload ID: 19905
  Gene Name: zinc finger protein 383
  Uniprot ID: Q8NA42
  ENSP ID: ENSP00000464871

SEQ ID NO: 99849 - protein, 114 aa, Homo sapiens
  Payload ID: 19905
  Gene Name: zinc finger protein 383
  ENSP ID: ENSP00000465246
MAEGSVMFSDVSIDFSQEEWDCLDPVQRDLYRDVMLENYGNLVSMGLYTPKPQVISLLEQGKEPWMVGRELTRGLCSDLESMCETKLLSLKKEVYEIELCQREIMGLTKHGLEY

SEQ ID NO: 99850 - protein, 475 aa, Homo sapiens; identical to SEQ ID NO: 99847
  Payload ID: 19905
  Gene Name: zinc finger protein 383
  Uniprot ID: Q8NA42
  ENSP ID: ENSP00000466101

SEQ ID NO: 99851 - protein, 81 aa, Homo sapiens
  Payload ID: 19905
  Gene Name: zinc finger protein 383
  ENSP ID: ENSP00000466246
MAEGSVMFSDVSIDFSQEEWDCLDPVQRDLYRDVMLENYGNLVSMGKGICTSDSQFSSGMSPSSTVNFSAAFQDFTLLSLK

SEQ ID NO: 99852 - protein, 516 aa, Homo sapiens
  Payload ID: 19906
  Gene Name: zinc finger protein 384
  Uniprot ID: Q8TF68
  ENSP ID: ENSP00000321650
MEESHFNSNPYFWPSIPTVSGQIENTMFINKMKDQLLPEKGCGLAPPHYPTLLTVPASVSLPSGISMDTESKSDQLTPHSQASVTQNITVVPVPSTGLMTAGVSCSQRWRREGSQSRGPGLVITSPSGSLVTTASSAQTFPISAPMIVSALPPGSQALQVVPDLSKKVASTLTEEGGGGGGGGGSVAPKPPRGRKKKRMLESGLPEMNDPYVLSPEDDDDHQKDGKTYRCRMCSLTFYSKSEMQIHSKSHTETKPHKCPHCSKTFANSSYLAQHIRIHSGAKPYSCNFCEKSFRQLSHLQQHTRIHTGDRPYKCAHPGCEKAFTQLSNLQSHRRQHNKDKPFKCHNCHRAYTDAASLEVHLSTHTVKHAKVYTCTICSRAYTSETYLMKHMRKHNPPDLQQQVQAAAAAAAVAQAQAQAQAQAQAQAQAQAQAQASQASQQQQQQQQQQQQQQQQPPPHFQSPGAAPQGGGGGDSNPNPPPQCSFDLTPYKTAEHHKDICLTVTTSTIQVEHLASS

SEQ ID NO: 99853 - protein, 461 aa, Homo sapiens
  Payload ID: 19906
  Gene Name: zinc finger protein 384
  Uniprot ID: Q8TF68
  ENSP ID: ENSP00000348018
MEESHFNSNPYFWPSIPTVSGQIENTMFINKMKDQLLPEKGCGLAPPHYPTLLTVPASVSLPSGISMDTESKSDQLTPHSQASVTQNITVVPVPSTGLMTAALQVVPDLSKKVASTLTEEGGGGGGGGGSVAPKPPRGRKKKRMLESGLPEMNDPYVLSPEDDDDHQKDGKTYRCRMCSLTFYSKSEMQIHSKSHTETKPHKCPHCSKTFANSSYLAQHIRIHSGAKPYSCNFCEKSFRQLSHLQQHTRIHTGDRPYKCAHPGCEKAFTQLSNLQSHRRQHNKDKPFKCHNCHRAYTDAASLEVHLSTHTVKHAKVYTCTICSRAYTSETYLMKHMRKHNPPDLQQQVQAAAAAAAVAQAQAQAQAQAQAQAQAQAQAQASQASQQQQQQQQQQQQQQQQPPPHFQSPGAAPQGGGGGDSNPNPPPQCSFDLTPYKTAEHHKDICLTVTTSTIQVEHLASS

SEQ ID NO: 99854 - protein, 577 aa, Homo sapiens
  Payload ID: 19906
  Gene Name: zinc finger protein 384
  Uniprot ID: Q8TF68
  ENSP ID: ENSP00000354592
MEESHFNSNPYFWPSIPTVSGQIENTMFINKMKDQLLPEKGCGLAPPHYPTLLTVPASVSLPSGISMDTESKSDQLTPHSQASVTQNITVVPVPSTGLMTAGVSCSQRWRREGSQSRGPGLVITSPSGSLVTTASSAQTFPISAPMIVSALPPGSQALQVVPDLSKKVASTLTEEGGGGGGGGGSVAPKPPRGRKKKRMLESGLPEMNDPYVLSPEDDDDHQKDGKTYRCRMCSLTFYSKSEMQIHSKSHTETKPHKCPHCSKTFANSSYLAQHIRIHSGAKPYSCNFCEKSFRQLSHLQQHTRIHSKMHTETIKPHKCPHCSKTFANTSYLAQHLRIHSGAKPYNCSYCQKAFRQLSHLQQHTRIHTGDRPYKCAHPGCEKAFTQLSNLQSHRRQHNKDKPFKCHNCHRAYTDAASLEVHLSTHTVKHAKVYTCTICSRAYTSETYLMKHMRKHNPPDLQQQVQAAAAAAAVAQAQAQAQAQAQAQAQAQAQAQASQASQQQQQQQQQQQQQQQQPPPHFQSPGAAPQGGGGGDSNPNPPPQCSFDLTPYKTAEHHKDICLTVTTSTIQVEHLASS

SEQ ID NO: 99855 - protein, 577 aa, Homo sapiens; identical to SEQ ID NO: 99854
  Payload ID: 19906
  Gene Name: zinc finger protein 384
  Uniprot ID: Q8TF68
  ENSP ID: ENSP00000380019

SEQ ID NO: 99856 - protein, 377 aa, Homo sapiens
  Payload ID: 19906
  Gene Name: zinc finger protein 384
  ENSP ID: ENSP00000399572
MEESHFNSNPYFWPSIPTVSGQIENTMFINKMKDQLLPEKGCGLAPPHYPTLLTVPASVSLPSGISMDTESKSDQLTPHSQASVTQNITVVPVPSTGLMTAGVSCSQRWRREGSQSRGPGLVITSPSGSLVTTASSAQTFPISAPMIVSALPPGSQALQVVPDLSKKVASTLTEEGGGGGGGGGSVAPKPPRGRKKKRMLESGLPEMNDPYVLSPEDDDDHQKDGKTYRSEGNCGTGNGQSLGLMDSVPGSTTNLLCDPGCRMCSLTFYSKSEMQIHSKSHTETKPHKCPHCSKTFANSSYLAQHIRIHSGAKPYSCNFCEKSFRQLSHLQQHTRIHSKMHTETIKPHKCPHCSKTFANTSYLAQHLRIHSGAKPYN

SEQ ID NO: 99857 - protein, 277 aa, Homo sapiens
  Payload ID: 19906
  Gene Name: zinc finger protein 384
  ENSP ID: ENSP00000412911
MEESHFNSNPYFWPSIPTVSGQIENTMFINKMKDQLLPEKGCGLAPPHYPTLLTVPASVSLPSGISMDTESKSDQLTPHSQASVTQNITVVPVPSTGLMTAGPGLVITSPSGSLVTTASSAQTFPISAPMIVSALPPGSQALQVVPDLSKKVASTLTEEGGGGGGGGGSVAPKPPRGRKKKRMLESGLPEMNDPYVLSPEDDDDHQKDGKTYRCRMCSLTFYSKSEMQIHSKSHTETKPHKCPHCSKTFANSSYLAQHIRIHSGAKPYSCNFCEKSF

SEQ ID NO: 99858 - protein, 168 aa, Homo sapiens
  Payload ID: 19906
  Gene Name: zinc finger protein 384
  ENSP ID: ENSP00000437488
MEESHFNSNPYFWPSIPTVSGQIENTMFINKMKDQLLPEKGCGLAPPHYPTLLTVPASVSLPSGISMDTESKSDQLTPHSQASVTQNITVVPVPSTGLMTAGPGLVITSPSGSLVTTASSAQTFPISAPMIVSALPPGSQALQVVPDLSKKVASTLTEEGGGGGGGGG

SEQ ID NO: 99859 - protein, 116 aa, Homo sapiens
  Payload ID: 19906
  Gene Name: zinc finger protein 384
  ENSP ID: ENSP00000438047
MEESHFNSNPYFWPSIPTVSGQIENTMFINKMKDQLLPEKGCGLAPPHYPTLLTVPASVSLPSGISMDTESKSDQLTPHSQASVTQNITVVPVPSTGLMTAGVSCSQRWRREGSQS

SEQ ID NO: 99860 - protein, 118 aa, Homo sapiens
  Payload ID: 19906
  Gene Name: zinc finger protein 384
  ENSP ID: ENSP00000438555
MEESHFNSNPYFWPSIPTVSGQIENTMFINKMKDQLLPEKGCGLAPPHYPTLLTVPASVSLPSGISMDTESKSDQLTPHSQASVTQNITVVPVPSTGLMTAGVSCSQRWRREGSQSRG

SEQ ID NO: 99861 - protein, 204 aa, Homo sapiens
  Payload ID: 19906
  Gene Name: zinc finger protein 384
  ENSP ID: ENSP00000439736
MEESHFNSNPYFWPSIPTVSGQIENTMFINKMKDQLLPEKGCGLAPPHYPTLLTVPASVSLPSGISMDTESKSDQLTPHSQASVTQNITVVPVPSTGLMTAGVSCSQRWRREGSQSRGPGLVITSPSGSLVTTASSAQTFPISAPMIVSALPPGSQALQVVPDLSKKVASTLTEEGGGGGGGGGSVAPKPPRGRKKKRMLESGL

SEQ ID NO: 99862 - protein, 127 aa, Homo sapiens
  Payload ID: 19906
  Gene Name: zinc finger protein 384
  ENSP ID: ENSP00000441408
MEESHFNSNPYFWPSIPTVSGQIENTMFINKMKDQLLPEKGCGLAPPHYPTLLTVPASVSLPSGISMDTESKSDQLTPHSQASVTQNITVVPVPSTGLMTAGVSCSQRWRREGSQSRGPGLVITSPS

SEQ ID NO: 99863 - protein, 159 aa, Homo sapiens
  Payload ID: 19906
  Gene Name: zinc finger protein 384
  ENSP ID: ENSP00000473311
  MOD_RES (1)..(1): Any amino acid
XFKCHNCHRAYTDAASLEVHLSTHTVKHAKVYTCTICSRAYTSQQVQAAAAAAAVAQAQAQAQAQAQAQAQAQAQAQASQASQQQQQQQQQQQQQQQQPPPHFQSPGAAPQGGGGGDSNPNPPPQCSFDLTPYKTAEHHKDICLTVTTSTIQVEHLASS

SEQ ID NO: 99864 - protein, 305 aa, Homo sapiens
  Payload ID: 19907
  Gene Name: zinc finger protein 385A
  Uniprot ID: Q96PM9
  ENSP ID: ENSP00000293385
MILGSLSRAGPLPLLRQPPIMQPPLDLKQILPFPLEPAPTLGLFSNYSTMDPVQKAVLSHTFGGPLLKTKRPVISCNICQIRFNSQSQAEAHYKGNRHARRVKGIEAAKTRGREPGVREPGDPAPPGSTPTNGDGVAPRPGTKHKTILEARSGLGPIKAYPRLGPPTPGEPEAPAQDRTFHCEICNVKVNSEVQLKQHISSRRHRDGVAGKPNPLLSRHKKSRGAGELAGTLTFSKELPKSLAGGLLPSPLAVAAVMAAAAGSPLSLRPAPAAPLLQGPPITHPLLHPAPGPIRTAHGPILFSPY

SEQ ID NO: 99865 - protein, 386 aa, Homo sapiens
  Payload ID: 19907
  Gene Name: zinc finger protein 385A
  Uniprot ID: Q96PM9
  ENSP ID: ENSP00000338927
MILGSLSRAGPLPLLRQPPIMQPPLDLKQILPFPLEPAPTLGLFSNYSTMDPVQKAVLSHTFGGPLLKTKRPVISCNICQIRFNSQSQAEAHYKGNRHARRVKGIEAAKTRGREPGVREPGDPAPPGSTPTNGDGVAPRPVSMENGLGPAPGSPEKQPGSPSPPSIPETGQGVTKGEGGTPAPASLPGGSKEEEEKAKRLLYCALCKVAVNSLSQLEAHNKGTKHKTILEARSGLGPIKAYPRLGPPTPGEPEAPAQDRTFHCEICNVKVNSEVQLKQHISSRRHRDGVAGKPNPLLSRHKKSRGAGELAGTLTFSKELPKSLAGGLLPSPLAVAAVMAAAAGSPLSLRPAPAAPLLQGPPITHPLLHPAPGPIRTAHGPILFSPY

SEQ ID NO: 99866 - protein, 366 aa, Homo sapiens
  Payload ID: 19907
  Gene Name: zinc finger protein 385A
  Uniprot ID: Q96PM9
  ENSP ID: ENSP00000377849
MQPPLDLKQILPFPLEPAPTLGLFSNYSTMDPVQKAVLSHTFGGPLLKTKRPVISCNICQIRFNSQSQAEAHYKGNRHARRVKGIEAAKTRGREPGVREPGDPAPPGSTPTNGDGVAPRPVSMENGLGPAPGSPEKQPGSPSPPSIPETGQGVTKGEGGTPAPASLPGGSKEEEEKAKRLLYCALCKVAVNSLSQLEAHNKGTKHKTILEARSGLGPIKAYPRLGPPTPGEPEAPAQDRTFHCEICNVKVNSEVQLKQHISSRRHRDGVAGKPNPLLSRHKKSRGAGELAGTLTFSKELPKSLAGGLLPSPLAVAAVMAAAAGSPLSLRPAPAAPLLQGPPITHPLLHPAPGPIRTAHGPILFSPY

SEQ ID NO: 99867 - protein, 366 aa, Homo sapiens; identical to SEQ ID NO: 99866
  Payload ID: 19907
  Gene Name: zinc finger protein 385A
  Uniprot ID: Q96PM9
  ENSP ID: ENSP00000446913

SEQ ID NO: 99868 - protein, 285 aa, Homo sapiens
  Payload ID: 19907
  Gene Name: zinc finger protein 385A
  Uniprot ID: Q96PM9
  ENSP ID: ENSP00000447162
MQPPLDLKQILPFPLEPAPTLGLFSNYSTMDPVQKAVLSHTFGGPLLKTKRPVISCNICQIRFNSQSQAEAHYKGNRHARRVKGIEAAKTRGREPGVREPGDPAPPGSTPTNGDGVAPRPGTKHKTILEARSGLGPIKAYPRLGPPTPGEPEAPAQDRTFHCEICNVKVNSEVQLKQHISSRRHRDGVAGKPNPLLSRHKKSRGAGELAGTLTFSKELPKSLAGGLLPSPLAVAAVMAAAAGSPLSLRPAPAAPLLQGPPITHPLLHPAPGPIRTAHGPILFSPY

SEQ ID NO: 99869 - protein, 164 aa, Homo sapiens
  Payload ID: 19907
  Gene Name: zinc finger protein 385A
  ENSP ID: ENSP00000448264
MQPPLDLKQILPFPLEPAPTLGLFSNYSTMDPVQKAVLSHTFGGPLLKTKRPVISCNICQIRFNSQSQAEAHYKGNRHARRVKGIEAAKTRGREPGVREPGDPAPPGSTPTNGDGVAPRPVSMENGLGPAPGSPEKQPGSPSPPSIPETGQGVTKGEGGTPAPA

SEQ ID NO: 99870 - protein, 231 aa, Homo sapiens
  Payload ID: 19907
  Gene Name: zinc finger protein 385A
  ENSP ID: ENSP00000448466
MQPPLDLKQILPFPLEPAPTLGLFSNYSTMDPVQKAVLSHTFGGPLLKTKRPVISCNICQIRFNSQSQAEAHYKGNRHARRVKGIEAAKTRGREPGVREPGDPAPPGSTPTNGDGVAPRPVSMENGLGPAPGSPEKQPGSPSPPSIPETGQGVTKGEGGTPAPASLPGGSKEEEEKAKRLLYCALCKVAVNSLSQLEAHNKGTKHKTILEARSGLGPIKAYPRLGPPTPGE

SEQ ID NO: 99871 - protein, 253 aa, Homo sapiens
  Payload ID: 19907
  Gene Name: zinc finger protein 385A
  ENSP ID: ENSP00000448567
PTLGLFSNYSTMDPVQKAVLSHTFGGPLLKTKRPVISCNICQIRFNSQSQAEAHYKGNRHARRVKGIEAAKTRGREPGVREPGDPAPPGSTPTNGDGVAPRPESHSVAQARVQWHNLSSLQPPPPRFKRFSCLSLLSSWDYRHLPPHPVSMENGLGPAPGSPEKQPGSPSPPSIPETGQGVTKGEGGTPAPASLPGGSKEEEEKAKRLLYCALCKVAVNSLSQLEAHNKGTKHKTILEARSGLGPIKAYPRLG

SEQ ID NO: 99872 - protein, 94 aa, Homo sapiens
  Payload ID: 19907
  Gene Name: zinc finger protein 385A
  ENSP ID: ENSP00000448754
MQPPLDLKQILPFPLEPAPTLGLFSNYSTSQAEAHYKGNRHARRVKGIEAAKTRGREPGVREPGDPAPPGSTPTNGDGVAPRPVSMENGLGPAP

SEQ ID NO: 99873 - protein, 366 aa, Homo sapiens; identical to SEQ ID NO: 99866
  Payload ID: 19907
  Gene Name: zinc finger protein 385A
  Uniprot ID: Q96PM9
  ENSP ID: ENSP00000449161

SEQ ID NO: 99874 - protein, 145 aa, Homo sapiens
  Payload ID: 19907
  Gene Name: zinc finger protein 385A
  ENSP ID: ENSP00000449462
MQPPLDLKQILPFPLEPAPTLGLFSNYSTMDPVQKAVLSHTFGGPLLKTKRPVISCNICQIRFNSQSQAEAHYKGNRHARRVKGIEAAKTRGREPGVREPGDPAPPGSTPTNGDGVAPRPVSMENGLGPAPGSPEKQPGSPSPPS

SEQ ID NO: 99875 - protein, 178 aa, Homo sapiens
  Payload ID: 19907
  Gene Name: zinc finger protein 385A
  ENSP ID: ENSP00000450149
MILGSLSRAGPLPLLRQPPIMQPPLDLKQILPFPLEPAPTLGLFSNYSTSQAEAHYKGNRHARRVKGIEAAKTRGREPGVREPGDPAPPGSTPTNGDGVAPRPVSMENGLGPAPGSPEKQPGSPSPPSIPETGQGVTKGEGGTPAPASLPGGSKEEEEKAKRLLYCALCKVAVNSLSQ

SEQ ID NO: 99876 - protein, 113 aa, Homo sapiens
  Payload ID: 19907
  Gene Name: zinc finger protein 385A
  ENSP ID: ENSP00000450373
EPAPTLGLFSNYSTMDPVQKAVLSHTFGGPLLKTKRPVISCNICQIRFNSQSQAEAHYKGNRHARRVKGIEAAKTRGREPGVREPGDPAPPGSTPTNGDGVAPRPAFRRLVRV

SEQ ID NO: 99877 - protein, 369 aa, Homo sapiens
  Payload ID: 19908
  Gene Name: zinc finger protein 385B
  Uniprot ID: Q569K4
  ENSP ID: ENSP00000338225
MMQPSLDIKPFMSFPVDSSSAVGLFPNFNTMDPVQKAVINHTFGVSIPPKKKQVISCNVCQLRFNSDSQAEAHYKGSKHAKKVKALDATKNKPKMVPSKDSAKANPSCSITPITGNNSDKSEDKGKLKASSSSQPSSSESGSFLLKSGTTPLPPGAATSPSKSTNGAPGTVVESEEEKAKKLLYCSLCKVAVNSLSQLEAHNTGSKHKTMVEARNGAGPIKSYPRPGSRLKMQNGSKGSGLQNKTFHCEICDVHVNSEIQLKQHISSRRHKDRVAGKPLKPKYSPYNKLQRSPSILAAKLAFQKDMMKPLAPAFLSSPLAAAAAVSSALSLPPRPSASLFQAPAIPPALLRPGHGPIRATPASILFAPY

SEQ ID NO: 99878 - protein, 395 aa, Homo sapiens
  Payload ID: 19908
  Gene Name: zinc finger protein 385B
  Uniprot ID: Q569K4
  ENSP ID: ENSP00000386379
MWSGLPSRGSTCHTTTLPALVRTPTLMMQPSLDIKPFMSFPVDSSSAVGLFPNFNTMDPVQKAVINHTFGVSIPPKKKQVISCNVCQLRFNSDSQAEAHYKGSKHAKKVKALDATKNKPKMVPSKDSAKANPSCSITPITGNNSDKSEDKGKLKASSSSQPSSSESGSFLLKSGTTPLPPGAATSPSKSTNGAPGTVVESEEEKAKKLLYCSLCKVAVNSLSQLEAHNTGSKHKTMVEARNGAGPIKSYPRPGSRLKMQNGSKGSGLQNKTFHCEICDVHVNSEIQLKQHISSRRHKDRVAGKPLKPKYSPYNKLQRSPSILAAKLAFQKDMMKPLAPAFLSSPLAAAAAVSSALSLPPRPSASLFQAPAIPPALLRPGHGPIRATPASILFAPY

SEQ ID NO: 99879 - protein, 369 aa, Homo sapiens; identical to SEQ ID NO: 99877
  Payload ID: 19908
  Gene Name: zinc finger protein 385B
  Uniprot ID: Q569K4
  ENSP ID: ENSP00000386507

SEQ ID NO: 99880 - protein, 471 aa, Homo sapiens
  Payload ID: 19908
  Gene Name: zinc finger protein 385B
  Uniprot ID: Q569K4
  ENSP ID: ENSP00000386845
MNMANFLRGFEEKGIKNDRPEDQLSKEKKKILFSFCEVCNIQLNSAAQAQVHSNGKSHRKRVKQLSDGQPPPPAQASPSSNSSTGSTCHTTTLPALVRTPTLMMQPSLDIKPFMSFPVDSSSAVGLFPNFNTMDPVQKAVINHTFGVSIPPKKKQVISCNVCQLRFNSDSQAEAHYKGSKHAKKVKALDATKNKPKMVPSKDSAKANPSCSITPITGNNSDKSEDKGKLKASSSSQPSSSESGSFLLKSGTTPLPPGAATSPSKSTNGAPGTVVESEEEKAKKLLYCSLCKVAVNSLSQLEAHNTGSKHKTMVEARNGAGPIKSYPRPGSRLKMQNGSKGSGLQNKTFHCEICDVHVNSEIQLKQHISSRRHKDRVAGKPLKPKYSPYNKLQRSPSILAAKLAFQKDMMKPLAPAFLSSPLAAAAAVSSALSLPPRPSASLFQAPAIPPALLRPGHGPIRATPASILFAPY

SEQ ID NO: 99881 - protein, 263 aa, Homo sapiens
  Payload ID: 19908
  Gene Name: zinc finger protein 385B
  ENSP ID: ENSP00000394038
MMQPSLDIKPFMSFPVDSSSAVGLFPNFNTMDPVQKAVINHTFGVSIPPKKKQVISCNVCQLRFNSDSQAEAHYKGSKHAKKVKALDATKNKPKMVPSKDSAKANPSCSITPITGNNSDKSEDKGKLKASSSSQPSSSESGSFLLKSGTTPLPPGAATSPSKSTNGAPGTVVESEEEKAKKLLYCSLCKVAVNSLSQLEAHNTGSKHKTMVEARNGAGPIKSYPRPGSRLKMQNGSKGSGLQNKTFHCEICDVHVNSEIQLKQ

SEQ ID NO: 99882 - protein, 138 aa, Homo sapiens
  Payload ID: 19908
  Gene Name: zinc finger protein 385B
  ENSP ID: ENSP00000399198
MLGSTCHTTTLPALVRTPTLMMQPSLDIKPFMSFPVDSSSAVGLFPNFNTKRRGLFETNKFCQMDPVQKAVINHTFGVSIPPKKKQVISCNVCQLRFNSDSQAEAHYKGSKHAKKVKALDATKNKPKMVPSKDSAKAN

SEQ ID NO: 99883 - protein, 31 aa, Homo sapiens
  Payload ID: 19908
  Gene Name: zinc finger protein 385B
  ENSP ID: ENSP00000400232
MNMANFLRGFEEKGIKNDRPEDQLSKEKKKI

SEQ ID NO: 99884 - protein, 75 aa, Homo sapiens
  Payload ID: 19908
  Gene Name: zinc finger protein 385B
  ENSP ID: ENSP00000409978
MNMANFLRGFEEKGIKNDRPEDQLSKEKKKILFSFCEVCNIQLNSAAQAQVHSNGKSHRKRVKQLSDGQPPPPAQ

SEQ ID NO: 99885 - protein, 459 aa, Homo sapiens
  Payload ID: 19909
  Gene Name: zinc finger protein 385C
  ENSP ID: ENSP00000411514
MKRPLSPPPPAEKETPISGAAECLPRPPEPPKPKRERKRPSYTLCDVCNIQLNSAAQAQVHCGGRAHQRRLRQLSLGKSPSGPAGPASGAPSPLLASLPLPTRPLQPPLDFKHLLAFHFNGAAPLSLFPNFSTMDPVQKAVISHTFGVPSPLKKKLFISCNICHLRFNSANQAEAHYKGHKHARKLKAVEAAKSKQRPHTQAQDGAVVSPIPTLASGAPGEPQSKAVPAAPPLGPPLQPPPTPDPTCREPAHSELLDAASSSSSSSCPPCSPEPGREAPGPEPAAAAVGSSMSGEGRSEKGHLYCPTCKVTVNSASQLQAHNTGAKHRWMMEGQRGAPRRSRGRPVSRGGAGHKAKRVTGGRGGRQGPSPAFHCALCQLQVNSETQLKQHMSSRRHKDRLAGKTPKPSSQHSKLQKHAALASKLALQKQLTKTLAARFLPSPLPTAATAICALPGPLAL

SEQ ID NO: 99886 - protein, 424 aa, Homo sapiens
  Payload ID: 19909
  Gene Name: zinc finger protein 385C
  ENSP ID: ENSP00000480744
MGLAAGPASGAPSPLLASLPLPTRPLQPPLDFKHLLAFHFNGAAPLSLFPNFSTMDPVQKAVISHTFGVPSPLKKKLFISCNICHLRFNSANQAEAHYKGHKHARKLKAVEAAKSKQRPHTQAQDGAVVSPIPTLASGAPGEPQSKVPAAPPLGPPLQPPPTPDPTCREPAHSELLDAASSSSSSSCPPCSPEPGREAPGPEPAAAAVGSSMSGEGRSEKGHLYCPTCKVTVNSASQLQAHNTGAKHRWMMEGQRGAPRRSRGRPVSRGGAGHKAKRVTGGRGGRQGPSPAFHCALCQLQVNSETQLKQHMSSRRHKDRLAGKTPKPSSQHSKLQKHAALAVSILKSKLALQKQLTKTLAARFLPSPLPTAATAICALPGPLALRPAPTAATTLFPAPILGPALFRTPAGAVRPATGPIVLAPY

SEQ ID NO: 99887 - protein, 395 aa, Homo sapiens
  Payload ID: 19910
  Gene Name: zinc finger protein 385D
  Uniprot ID: Q9H6B1
  ENSP ID: ENSP00000281523
MRNIMYFGGTCQSPALPALVRPPAPPLQPSLDIKPFLPFPLDTAAAVNLFPNFNAMDPIQKAVINHTFGVPLPHRRKQIISCNICQLRFNSDSQAAAHYKGTKHAKKLKALEAMKNKQKSVTAKDSAKTTFTSITTNTINTSSDKTDGTAGTPAISTTTTVEIRKSSVMTTEITSKVEKSPTTATGNSSCPSTETEEEKAKRLLYCSLCKVAVNSASQLEAHNSGTKHKTMLEARNGSGTIKAFPRAGVKGKGPVNKGNTGLQNKTFHCEICDVHVNSETQLKQHISSRRHKDRAAGKPPKPKYSPYNKLQKTAHPLGVKLVFSKEPSKPLAPRILPNPLAAAAAAAAVAVSSPFSLRTAPAATLFQTSALPPALLRPAPGPIRTAHTPVLFAPY

SEQ ID NO: 99888 - protein, 103 aa, Homo sapiens
  Payload ID: 19910
  Gene Name: zinc finger protein 385D
  ENSP ID: ENSP00000388232
MRNIMYFGGTCQSPALPALVRPPAPPLQPSLDIKPFLPFPLDTAAAVNLFPNFNAMDPIQKAVINHTFGVPLPHRRKQIISCNICQLRFNSDMAQAKELDWPH

SEQ ID NO: 99889 - protein, 358 aa, Homo sapiens
  Payload ID: 19911
  Gene Name: zinc finger protein 391
  Uniprot ID: Q9UJN7
  ENSP ID: ENSP00000244576
MESLRGNTAQGPTNEEDYKNEGQLSRQTKCPAQKKSSFENTVVRKVSVTLKEIFTGEEGPESSEFSLSPNLDAQQKIPKGHGSPISRKNSKDNSDLIKHQRLFSQRKPCKCNECEKAFSYQSDLLVHSRIHGGEKPFECNKCGKSFSRSTHLIEHQRTHTGEKPYECNECGKAFSRSTHLSLHQRIHTGEKPYECSECGKAFSRSTNLSQHQRTHTQERPYKCNECGKAFGDRSTIIQHQRIHTGENPYECSKCGKAFSWISSLTEHQRTHTGENPYECSECGKVFSRSSSLTEHQRIHSGEKPHECRVCGKGFSRSSSLIIHQRTHTGEKPYKCNDCGKAFCQSSTLIRHQHLHTKE

SEQ ID NO: 99890 - protein, 133 aa, Homo sapiens
  Payload ID: 19911
  Gene Name: zinc finger protein 391
  ENSP ID: ENSP00000419498
MESLRGNTAQGPTNEEDYKNEGQLSRQTKCPAQKKSSFENTVVRKVSVTLKEIFTGEEGPESSEFSLSPNLDAQQKIPKGHGSPISRKNSKDNSDLIKHQRLFSQRKPCKCNECEKAFSYQSDLLVHSRIHGG

SEQ ID NO: 99891 - protein, 561 aa, Homo sapiens
  Payload ID: 19912
  Gene Name: zinc finger protein 394
  Uniprot ID: Q53GI3
  ENSP ID: ENSP00000337363
MNSSLTAQRRGSDAELGPWVMAARSKDAAPSQRDGLLPVKVEEDSPGSWEPNYPAASPDPETSRLHFRQLRYQEVAGPEEALSRLRELCRRWLRPELLSKEQILELLVLEQFLTILPEELQAWVREHCPESGEEAVAVVRALQRALDGTSSQGMVTFEDTAVSLTWEEWERLDPARRDFCRESAQKDSGSTVPPSLESRVENKELIPMQQILEEAEPQGQLQEAFQGKRPLFSKCGSTHEDRVEKQSGDPLPLKLENSPEAEGLNSISDVNKNGSIEGEDSKNNELQNSARCSNLVLCQHIPKAERPTDSEEHGNKCKQSFHMVTWHVLKPHKSDSGDSFHHSSLFETQRQLHEERPYKCGNCGKSFKQRSDLFRHQRIHTGEKPYGCQECGKSFSQSAALTKHQRTHTGEKPYTCLKCGERFRQNSHLNRHQSTHSRDKHFKCEECGETCHISNLFRHQRLHKGERPYKCEECEKSFKQRSDLFKHHRIHTGEKPYGCSVCGKRFNQSATLIKHQRIHTGEKPYKCLECGERFRQSTHLIRHQRIHQNKVLSAGRGGSRL

SEQ ID NO: 99892 - protein, 162 aa, Homo sapiens
  Payload ID: 19912
  Gene Name: zinc finger protein 394
  Uniprot ID: Q53GI3
  ENSP ID: ENSP00000409565
MNSSLTAQRRGSDAELGPWVMAARSKDAAPSQRDGLLPVKVEEDSPGSWEPNYPAASPDPETSRLHFRQLRYQEVAGPEEALSRLRELCRRWLRPELLSKEQILELLVLEQFLTILPEELQAWVREHCPESGEEAVAVVRALQRALDGTSSQVWKAEWRTKS

SEQ ID NO: 99893 - protein, 513 aa, Homo sapiens
  Payload ID: 19913
  Gene Name: zinc finger protein 395
  Uniprot ID: Q9H8N7
  ENSP ID: ENSP00000340494
MASVLSRRLGKRSLLGARVLGPSASEGPSAAPPSEPLLEGAAPQPFTTSDDTPCQEQPKEVLKAPSTSGLQQVAFQPGQKVYVWYGGQECTGLVEQHSWMEGQVTVWLLEQKLQVCCRVEEVWLAELQGPCPQAPPLEPGAQALAYRPVSRNIDVPKRKSDAVEMDEMMAAMVLTSLSCSPVVQSPPGTEANFSASRAACDPWKESGDISDSGSSTTSGHWSGSSGVSTPSPPHPQASPKYLGDAFGSPQTDHGFETDPDPFLLDEPAPRKRKNSVKVMYKCLWPNCGKVLRSIVGIKRHVKALHLGDTVDSDQFKREEDFYYTEVQLKEESAAAAAAAAAGTPVPGTPTSEPAPTPSMTGLPLSALPPPLHKAQSSGPEHPGPESSLPSGALSKSAPGSFWHIQADHAYQALPSFQIPVSPHIYTSVSWAAAPSAACSLSPVRSRSLSFSEPQQPAPAMKSHLIVTSPPRAQSGARKARGEAKKCRKVYGIEHRDQWCTACRWKKACQRFLD

SEQ ID NO: 99894 - protein, 30 aa, Homo sapiens
  Payload ID: 19913
  Gene Name: zinc finger protein 395
  ENSP ID: ENSP00000427719
LPSGALSKSAPGSFWHIQADHAYQESPRGG

SEQ ID NO: 99895 - protein, 124 aa, Homo sapiens
  Payload ID: 19913
  Gene Name: zinc finger protein 395
  ENSP ID: ENSP00000427812
MASVLSRRLGKRSLLGARVLGPSASEGPSAAPPSEPLLEGAAPQPFTTSDDTPCQEQPKEVLKAPSTSGLQQVAFQPGQKVYVWYGGQECTGLVEQHSWMEGQVTVWLLEQKLQVCCRVEEVWL

SEQ ID NO: 99896 - protein, 187 aa, Homo sapiens
  Payload ID: 19913
  Gene Name: zinc finger protein 395
  ENSP ID: ENSP00000427934
MASVLSRRLGKRSLLGARVLGPSASEGPSAAPPSEPLLEGAAPQPFTTSDDTPCQEQPKEVLKAPSTSGLQQVAFQPGQKVYVWYGGQECTGLVEQHSWMEGQVTVWLLEQKLQVCCRVEEVWLAELQGPCPQAPPLEPGAQALAYRPVSRNIDVPKRKSDAVEMDEMMAAMVLTSLSCSPVVQSPP

SEQ ID NO: 99897 - protein, 513 aa, Homo sapiens; identical to SEQ ID NO: 99893
  Payload ID: 19913
  Gene Name: zinc finger protein 395
  Uniprot ID: Q9H8N7
  ENSP ID: ENSP00000428452

SEQ ID NO: 99898 - protein, 513 aa, Homo sapiens; identical to SEQ ID NO: 99893
  Payload ID: 19913
  Gene Name: zinc finger protein 395
  Uniprot ID: Q9H8N7
  ENSP ID: ENSP00000429640

SEQ ID NO: 99899 - protein, 47 aa, Homo sapiens
  Payload ID: 19913
  Gene Name: zinc finger protein 395
  ENSP ID: ENSP00000429649
MASVLSRRLGKRSLLGARVLGPSASEGPSAAPPSEPLLEGAAPQPFT

SEQ ID NO: 99900 - protein, 102 aa, Homo sapiens
  Payload ID: 19913
  Gene Name: zinc finger protein 395
  ENSP ID: ENSP00000429823
MASVLSRRLGKRSLLGARVLGPSASEGPSAAPPSEPLLEGAAPQPFTTSDDTPCQEQPKEVLKAPSTSGLQQVAFQPGQKVYVWYGGQECTGLVEQHSWMEG

SEQ ID NO: 99901 - protein, 156 aa, Homo sapiens
  Payload ID: 19913
  Gene Name: zinc finger protein 395
  ENSP ID: ENSP00000430203
MASVLSRRLGKRSLLGARVLGPSASEGPSAAPPSEPLLEGAAPQPFTTSDDTPCQEQPKEVLKAPSTSGLQQVAFQPGQKVYVWYGGQECTGLVEQHSWMEGQVTVWLLEQKLQVCCRVEEVWLAELQGPCPQAPPLEPGAQALAYRPVSRNIDVP

SEQ ID NO: 99902 - protein, 333 aa, Homo sapiens
  Payload ID: 19914
  Gene Name: zinc finger protein 396
  Uniprot ID: Q96N95
  ENSP ID: ENSP00000302310
MSAKLGKSSSLLTQTSEECNGILTEKMEEEEQTCDPDSSLHWSSSYSPETFRQQFRQFGYQDSPGPHEALSRLWELCHLWLRPEVHTKEQILELLVLEQFLAILPKELQAWVQKHHPENGEETVTMLEDVERELDGPKQIFFGRRKDMIAEKLAPSEITEELPSSQLMPVKKQLQGASWELQSLRPHDEDIKTTNVKSASRQKTSLGIELHCNVSNILHMNGSQSSTYRGTYEQDGRFEKRQGNPSWKKQQKCDECGKIFSQSSALILHQRIHSGKKPYACDECAKAFSRSAILIQHRRTHTDSKYEHAIAEAQKNMYFKTRLKCPRSLSGGR

SEQ ID NO: 99903 - protein, 39 aa, Homo sapiens
  Payload ID: 19914
  Gene Name: zinc finger protein 396
  ENSP ID: ENSP00000465440
MSAKLGKSSSLLTQTSEECNGILTEKMEEEEQTCDPDSS

SEQ ID NO: 99904 - protein, 335 aa, Homo sapiens
  Payload ID: 19914
  Gene Name: zinc finger protein 396
  Uniprot ID: Q96N95
  ENSP ID: ENSP00000466500
MSAKLGKSSSLLTQTSEECNGILTEKMEEEEQTCDPDSSLHWSSSYSPETFRQQFRQFGYQDSPGPHEALSRLWELCHLWLRPEVHTKEQILELLVLEQFLAILPKELQAWVQKHHPENGEETVTMLEDVERELDGPKQIFFGRRKDMIAEKLAPSEITEELPSSQLMPVKKQLQGASWELQSLRPHDEDIKTTNVKSASRQKTSLGIELHCNVSNILHMNGSQSSTYRGTYEQDGRFEKRQGNPSWKKQQKCDECGKIFSQSSALILHQRIHSGKKPYACDECAKAFSRSAILIQHRRTHTGEKPYKCHDCGKAFSQSSNLFRHRKRHIRKKVP

SEQ ID NO: 99905 - protein, 210 aa, Homo sapiens
  Payload ID: 19914
  Gene Name: zinc finger protein 396
  Uniprot ID: Q96N95
  ENSP ID: ENSP00000467275
MSAKLGKSSSLLTQTSEECNGILTEKMEEEEQTCDPDSSLHWSSSYSPETFRQQFRQFGYQDSPGPHEALSRLWELCHLWLRPEVHTKEQILELLVLEQFLAILPKELQAWVQKHHPENGEETVTMLEDVERELDGPKQIFFGRRKDMIAEKLAPSEITEELPSSQLMPVKKQLQGASWELQSLRPHGEGAGFSSCWKVWGPSAHHTHLS

SEQ ID NO: 99906 - protein, 131 aa, Homo sapiens
  Payload ID: 19914
  Gene Name: zinc finger protein 396
  ENSP ID: ENSP00000468381
MSAKLGKSSSLLTQTSEECNGILTEKMEEEEQTCDPDSSLHWSSSYSPETFRQQFRQFGYQDSPGPHEALSRLWELCHLWLRPEVHTKEQILELLVLEQFLAILPKELQAWVQKHHPENGEETVTMLEDVE

SEQ ID NO: 99907 - protein, 275 aa, Homo sapiens
  Payload ID: 19915
  Gene Name: zinc finger protein 397
  Uniprot ID: Q8NF99
  ENSP ID: ENSP00000261333
MAVESGVISTLIPQDPPEQELILVKVEDNFSWDEKFKQNGSTQSCQELFRQQFRKFCYQETPGPREALSRLQELCYQWLMPELHTKEQILELLVLEQFLSILPEELQIWVQQHNPESGEEAVTLLEDLEREFDDPGQQVPASPQGPAVPWKDLTCLRASQESTDIHLQPLKTQLKSWKPCLSPKSDCENSETATKEGISEEKSQGLPQEPSFRGIKLSRPPKASSAIRWECVSPGSFPGDIIAAEATHSTISCFAINTLPATILPSKNVNRKYFS

SEQ ID NO: 99908 - protein, 534 aa, Homo sapiens
  Payload ID: 19915
  Gene Name: zinc finger protein 397
  Uniprot ID: Q8NF99
  ENSP ID: ENSP00000331577
MAVESGVISTLIPQDPPEQELILVKVEDNFSWDEKFKQNGSTQSCQELFRQQFRKFCYQETPGPREALSRLQELCYQWLMPELHTKEQILELLVLEQFLSILPEELQIWVQQHNPESGEEAVTLLEDLEREFDDPGQQVPASPQGPAVPWKDLTCLRASQESTDIHLQPLKTQLKSWKPCLSPKSDCENSETATKEGISEEKSQGLPQEPSFRGISEHESNLVWKQGSATGEKLRSPSQGGSFSQVIFTNKSLGKRDLYDEAERCLILTTDSIMCQKVPPEERPYRCDVCGHSFKQHSSLTQHQRIHTGEKPYKCNQCGKAFSLRSYLIIHQRIHSGEKAYECSECGKAFNQSSALIRHRKIHTGEKACKCNECGKAFSQSSYLIIHQRIHTGEKPYECNECGKTFSQSSKLIRHQRIHTGERPYECNECGKAFRQSSELITHQRIHSGEKPYECSECGKAFSLSSNLIRHQRIHSGEEPYQCNECGKTFKRSSALVQHQRIHSGDEAYICNECGKAFRHRSVLMRHQRVHTIK

SEQ ID NO: 99909 - protein, 245 aa, Homo sapiens
  Payload ID: 19915
  Gene Name: zinc finger protein 397
  ENSP ID: ENSP00000347850
MAVESGVISTLIPQDPPEQELILVKVEDNFSWDEKFKQNGSTQSCQELFRQQFRKFCYQETPGPREALSRLQELCYQWLMPELHTKEQILELLVLEQFLSILPEELQIWVQQHNPESGEEAVTLLEDLEREFDDPGQQVPASPQGPAVPWKDLTCLRASQESTDIHLQPLKTQLKSWKPCLSPKSELSRPPKASSAIRWECVSPGSFPGDIIAAEATHSTISCFAINTLPATILPSKNVNRKYFS

SEQ ID NO: 99910 - protein, 201 aa, Homo sapiens
  Payload ID: 19915
  Gene Name: zinc finger protein 397
  ENSP ID: ENSP00000464808
  MOD_RES (1)..(1): Any amino acid
XAVESGVISTLIPQDPPEQELILVKVEDNFSWDEKFKQNGSTQSCQELFRQQFRKFCYQETPGPREALSRLQELCYQWLMPELHTKEQILELLVLEQFLSILPEELQIWVQQHNPESGEEAVTLLEDLEREFDDPGQQVGTEKSDVGKGIYSLEHVMVPASPQGPAVPWKDLTCLRASQESTDIHLQPLKTQLKSWKPCLS

SEQ ID NO: 99911 - protein, 207 aa, Homo sapiens
  Payload ID: 19915
  Gene Name: zinc finger protein 397
  Uniprot ID: Q8NF99
  ENSP ID: ENSP00000466317
MAVESGVISTLIPQDPPEQELILVKVEDNFSWDEKFKQNGSTQSCQELFRQQFRKFCYQETPGPREALSRLQELCYQWLMPELHTKEQILELLVLEQFLSILPEELQIWVQQHNPESGEEAVTLLEDLEREFDDPGQQVPASPQGPAVPWKDLTCLRASQESTDIHLQPLKTQLKSWKPCLSPKSGEEWEIIWKLLTLRPLFLRMQN

SEQ ID NO: 99912 - protein, 207 aa, Homo sapiens; identical to SEQ ID NO: 99911
  Payload ID: 19915
  Gene Name: zinc finger protein 397
  Uniprot ID: Q8NF99
  ENSP ID: ENSP00000466760

SEQ ID NO: 99913 - protein, 188 aa, Homo sapiens
  Payload ID: 19915
  Gene Name: zinc finger protein 397
  ENSP ID: ENSP00000468413
MAVESGVISTLIPQDPPEQELILVKVEDNFSWDEKFKQNGSTQSCQELFRQQFRKFCYQETPGPREALSRLQELCYQWLMPELHTKEQILELLVLEQFLSILPEELQIWVQQHNPESGEEAVTLLEDLEREFDDPGQQVPASPQGPAVPWKDLTCLRASQESTDIHLQPLKTQLKSWKPCLSPKSDFS

SEQ ID NO: 99914 - protein, 138 aa, Homo sapiens
  Payload ID: 19915
  Gene Name: zinc finger protein 397
  ENSP ID: ENSP00000472393
MAVESGVISTLIPQDPPEQELILVKVEDNFSWDEKFKQNGSTQSCQELFRQQFRKFCYQETPGPREALSRLQELCYQWLMPELHTKEQILELLVLEQFLSILPEELQIWVQQHNPESGEEAVTLLEDLEREFDDPGQQ

SEQ ID NO: 99915 - protein, 471 aa, Homo sapiens
  Payload ID: 19916
  Gene Name: zinc finger protein 398
  Uniprot ID: Q8TD17
  ENSP ID: ENSP00000389972
MKGNYESLISMDYAINQPDVLSQIQPEGEHNTEDQAGPEESEIPTDPSEEPGISTSDILSWIKQEEEPQVGAPPESKESDVYKSTYADEELVIKAEGLARSSLCPEVPVPFSSPPAAAKDAFSDVAFKSQQSTSMTPFGRPATDLPEASEGQVTFTQLGSYPLPPPVGEQVFSCHHCGKNLSQDMLLTHQCSHATEHPLPCAQCPKHFTPQADLSSTSQDHASETPPTCPHCARTFTHPSRLTYHLRVHNSTERPFPCPDCPKRFADQARLTSHRRAHASERPFRCAQCGRSFSLKISLLLHQRGHAQERPFSCPQCGIDFNGHSALIRHQMIHTGERPYPCTDCSKSFMRKEHLLNHRRLHTGERPFSCPHCGKSFIRKHHLMKHQRIHTGERPYPCSYCGRSFRYKQTLKDHLRSGHNGGCGGDSDPSGQPPNPPGPLITGLETSGLGVNTEGLETNQWYGEGSGGGVL

SEQ ID NO: 99916 - protein, 471 aa, Homo sapiens; identical to SEQ ID NO: 99915
  Payload ID: 19916
  Gene Name: zinc finger protein 398
  Uniprot ID: Q8TD17
  ENSP ID: ENSP00000418564

SEQ ID NO: 99917 - protein, 471 aa, Homo sapiens; identical to SEQ ID NO: 99915
  Payload ID: 19916
  Gene Name: zinc finger protein 398
  Uniprot ID: Q8TD17
  ENSP ID: ENSP00000419391

SEQ ID NO: 99918 - protein, 642 aa, Homo sapiens
  Payload ID: 19916
  Gene Name: zinc finger protein 398
  Uniprot ID: Q8TD17
  ENSP ID: ENSP00000420418
MAEAAPAPTSEWDSECLTSLQPLPLPTPPAANEAHLQTAAISLWTVVAAVQAIERKVEIHSRRLLHLEGRTGTAEKKLASCEKTVTELGNQLEGKWAVLGTLLQEYGLLQRRLENLENLLRNRNFWILRLPPGIKGDIPKVPVAFDDVSIYFSTPEWEKLEEWQKELYKNIMKGNYESLISMDYAINQPDVLSQIQPEGEHNTEDQAGPEESEIPTDPSEEPGISTSDILSWIKQEEEPQVGAPPESKESDVYKSTYADEELVIKAEGLARSSLCPEVPVPFSSPPAAAKDAFSDVAFKSQQSTSMTPFGRPATDLPEASEGQVTFTQLGSYPLPPPVGEQVFSCHHCGKNLSQDMLLTHQCSHATEHPLPCAQCPKHFTPQADLSSTSQDHASETPPTCPHCARTFTHPSRLTYHLRVHNSTERPFPCPDCPKRFADQARLTSHRRAHASERPFRCAQCGRSFSLKISLLLHQRGHAQERPFSCPQCGIDFNGHSALIRHQMIHTGERPYPCTDCSKSFMRKEHLLNHRRLHTGERPFSCPHCGKSFIRKHHLMKHQRIHTGERPYPCSYCGRSFRYKQTLKDHLRSGHNGGCGGDSDPSGQPPNPPGPLITGLETSGLGVNTEGLETNQWYGEGSGGGVL

SEQ ID NO: 99919 - protein, 551 aa, Homo sapiens
  Payload ID: 19917
  Gene Name: zinc finger protein 404
  ENSP ID: ENSP00000319479
FQVPLTFSDVAIDFSQEEWEYLNSDQRDLYRDVMLENYTNLVSLDFNFTTESNKLSSEKRNYEVNAYHQETWKRNKTFNLMRFIFRTDPQYTIEFGRQQRPKVGCFSQMIFKKHKSLPLHKRNNTREKSYECKEYKKGFRKYLHLTEHLRDHTGVIPYECNECGKAFVVFQHFIRHRKIHTDLKPYECNGCEKAFRFYSQLIQHQIIHTGMKPYECKQCGKAFRRHSHLTEHQKIHVGLKPFECKECGETFRLYRHMCLHQKIHHGVKPYKCKECGKAFGHRSSLYQHKKIHSGEKPYKCEQCEKAFVRSYLLVEHQRSHTGEKPHECMECGKAFGKGSSLLKHKRIHSSEKLYDCKDCGKAFCRGSQLTQHQRIHTGEKPHECKECGKTFKLHSYLIQHQIIHTDLKPYECKQCGKAFSRVGDLKTHQSIHAGEKPYECKECGKTFRLNSQLIYHQTIHTGLKPYVCKECKKAFRSISGLSQHKRIHTGEKPYECKECDKAFNRSDRLTQHETIHTGVKPQKCKECGKAFSHCYQLSQHQRFHHGERLLM

SEQ ID NO: 99920 - protein, 552 aa, Homo sapiens
  Payload ID: 19917
  Gene Name: zinc finger protein 404
  Uniprot ID: Q494X3
  ENSP ID: ENSP00000466051
MARVPLTFSDVAIDFSQEEWEYLNSDQRDLYRDVMLENYTNLVSLDFNFTTESNKLSSEKRNYEVNAYHQETWKRNKTFNLMRFIFRTDPQYTIEFGRQQRPKVGCFSQMIFKKHKSLPLHKRNNTREKSYECKEYKKGFRKYLHLTEHLRDHTGVIPYECNECGKAFVVFQHFIRHRKIHTDLKPYECNGCEKAFRFYSQLIQHQIIHTGMKPYECKQCGKAFRRHSHLTEHQKIHVGLKPFECKECGETFRLYRHMCLHQKIHHGVKPYKCKECGKAFGHRSSLYQHKKIHSGEKPYKCEQCEKAFVRSYLLVEHQRSHTGEKPHECMECGKAFGKGSSLLKHKRIHSSEKLYDCKDCGKAFCRGSQLTQHQRIHTGEKPHECKECGKTFKLHSYLIQHQIIHTDLKPYECKQCGKAFSRVGDLKTHQSIHAGEKPYECKECGKTFRLNSQLIYHQTIHTGLKPYVCKECKKAFRSISGLSQHKRIHTGEKPYECKECDKAFNRSDRLTQHETIHTGVKPQKCKECGKAFSHCYQLSQHQRFHHGERLLM

SEQ ID NO: 99921 - protein, 2248 aa, Homo sapiens
  Payload ID: 19918
  Gene Name: zinc finger protein 407
  Uniprot ID: Q9C0G0
  ENSP ID: ENSP00000299687
MMDSENKPENDEDEKINKEAQDLTKLSSHNEDGGPVSDVIASFPENSMGKRGFSESSNSDSVVIGEDRNKHASKRRKLDEAEPLKSGKQGICRLETSESSVTEGGIALDETGKETFLSDCTVGGTCLPNALSPSCNFSTIDVVSLKTDTEKTSAQEMVSLDLERESPFPPKEISVSCTIGNVDTVLKCSICGHLFSSCSDLEKHAESHMQQPKEHTCCHCSHKAESSSALHMHIKQAHGPQKVFSCDLCGFQCSEENLLNAHYLGKTHLRRQNLAARGGFVQILTKQPFPKKSRTMATKNVHSKPRTSKSIAKNSDSKGLRNVGSTFKDFRGSISKQSGSSSELLVEMMPSRNTLSQEVEIVEEHVTSLGLAQNPENQSRKLDTLVTSEGLLEKLESTKNTLQAAHGNSVTSRPRPERNILVLGNSFRRRSSTFTLKGQAKKRFNLLGIKRGTSETQRMYMKHLRTQMKTHDAESVLKHLEACSSVQRVCVTTSETQEAEQGQGSARPPDSGLHSLTVKPASGSQTLCACTDCGQVATNRTDLEIHVKRCHAREMKFYCRTCDFSSMSRRDLDEHLHSNQHQQTASVLSCQCCSFISLDEINLRDHMKEKHNMHFLCTPCNLFFLSEKDVEEHKATEKHINSLVQPKTLQSSNSDLVLQTLPLSTLESENAKESMDDSGKASQEEPLKSRVSHGNEVRHSSKPQFQCKKCFYKTRSSTVLTRHIKLRHGQDYHFLCKACNLYSLSKEGMEKHIKRSKHLENAKKNNIGLSFEECIERVCIGANDKKEEFDVSGNGRIEGHIGVQLQEHSYLEKGMLASEELSQSGGSTKDDELASTTTPKRGRPKGNISRTCSHCGLLASSITNLTVHIRRKHSHQYSYLCKVCKYYTVTKGDMERHCATKKHKGRVEIEASGKHSSDIIVGPEGGSLEAGKKNAGSAVTMSDEHANKPAESPTSVLEKPDRGNSIEAEVENVFHSLDGEVNSHLLDKKEQISSEPEDFAQPGDVYSQRDVTGTGENKCLHCEFSAHSSASLELHVKRKHTKEFEFYCMACDYYAVTRREMTRHAATEKHKMKRQSYLNSANVEAGSADMSKNIIMPEEEHQQNSEEFQIISGQPSDTLKSRNAADCSILNENTNLDMSKVLCAADSVEVETEEESNFNEDHSFCETFQQAPVKDKVRKPEEMMSLTMSSNYGSPSRFQNENSGSSALNCETAKKNHEISNDAGELRVHCEGEGGNAGDGGGVVPHRHLCPVTLDGERSAESPVLVVTRITREQGNLESGGQNRVARGHGLEDLKGVQEDPVLGNKEILMNSQHETEFILEEDGPASDSTVESSDVYETIISIDDKGQAMYSFGRFDSSIIRIKNPEDGELIDQSEEGLIATGVRISELPLKDCAQGVKKKKSEGSSIGESTRIRCDDCGFLADGLSGLNVHIAMKHPTKEKHFHCLLCGKSFYTESNLHQHLASAGHMRNEQASVEELPEGGATFKCVKCTEPFDSEQNLFLHIKGQHEELLREVNKYIVEDTEQINREREENQGNVCKYCGKMCRSSNSMAFLAHIRTHTGSKPFKCKICHFATAQLGDARNHVKRHLGMREYKCHVCGVAFVMKKHLNTHLLGKHGVGTPKERKFTCHLCDRSFTEKWALNNHMKLHTGEKPFKCTWPTCHYSFLTASAMKDHYRTHTGEKSFLCDLCGFAGGTRHALTKHRRQHTGEKPFKCDECNFASTTQSHLTRHKRVHTGEKPYRCPWCDYRSNCAENIRKHILHTGKHEGVKMYNCPKCDYGTNVPVEFRNHLKEQHPDIENPDLAYLHAGIVSKSYECRLKGQGATFVETDSPFTAAALAEEPLVKEKPLRSSRRPAPPPEQVQQVIIFQGYDGEFALDPSVEETAAATLQTLAMAGQVARVVHITEDGQVIATSQSGAHVGSVVPGPILPEQLADGATQVVVVGGSMEGHGMDESLSPGGAVIQQVTKQEILNLSEAGVAPPEASSALDALLCAVTELGEVEGRAGLEEQGRPGAKDVLIQLPGQEVSHVAADPEAPEIQMFPQAQESPAAVEVLTQVVHPSAAMASQERAQVAFKKMVQGVLQFAVCDTAAAGQLVKDGVTQVVVSEEGAVHMVAGEGAQIIMQEAQGEHMDLVESDGEISQIIVTEELVQAMVQESSGGFSEGTTHYILTELPPGVQDEPGLYSHTVLETADSQELLQAGATLGTEAGAPSRAEQLASVVIYTQEGSSAAAAIQSQRESSELQEA

SEQ ID NO: 99922 - protein, 1660 aa, Homo sapiens
  Payload ID: 19918
  Gene Name: zinc finger protein 407
  Uniprot ID: Q9C0G0
  ENSP ID: ENSP00000310359
MMDSENKPENDEDEKINKEAQDLTKLSSHNEDGGPVSDVIASFPENSMGKRGFSESSNSDSVVIGEDRNKHASKRRKLDEAEPLKSGKQGICRLETSESSVTEGGIALDETGKETFLSDCTVGGTCLPNALSPSCNFSTIDVVSLKTDTEKTSAQEMVSLDLERESPFPPKEISVSCTIGNVDTVLKCSICGHLFSSCSDLEKHAESHMQQPKEHTCCHCSHKAESSSALHMHIKQAHGPQKVFSCDLCGFQCSEENLLNAHYLGKTHLRRQNLAARGGFVQILTKQPFPKKSRTMATKNVHSKPRTSKSIAKNSDSKGLRNVGSTFKDFRGSISKQSGSSSELLVEMMPSRNTLSQEVEIVEEHVTSLGLAQNPENQSRKLDTLVTSEGLLEKLESTKNTLQAAHGNSVTSRPRPERNILVLGNSFRRRSSTFTLKGQAKKRFNLLGIKRGTSETQRMYMKHLRTQMKTHDAESVLKHLEACSSVQRVCVTTSETQEAEQGQGSARPPDSGLHSLTVKPASGSQTLCACTDCGQVATNRTDLEIHVKRCHAREMKFYCRTCDFSSMSRRDLDEHLHSNQHQQTASVLSCQCCSFISLDEINLRDHMKEKHNMHFLCTPCNLFFLSEKDVEEHKATEKHINSLVQPKTLQSSNSDLVLQTLPLSTLESENAKESMDDSGKASQEEPLKSRVSHGNEVRHSSKPQFQCKKCFYKTRSSTVLTRHIKLRHGQDYHFLCKACNLYSLSKEGMEKHIKRSKHLENAKKNNIGLSFEECIERVCIGANDKKEEFDVSGNGRIEGHIGVQLQEHSYLEKGMLASEELSQSGGSTKDDELASTTTPKRGRPKGNISRTCSHCGLLASSITNLTVHIRRKHSHQYSYLCKVCKYYTVTKGDMERHCATKKHKGRVEIEASGKHSSDIIVGPEGGSLEAGKKNAGSAVTMSDEHANKPAESPTSVLEKPDRGNSIEAEVENVFHSLDGEVNSHLLDKKEQISSEPEDFAQPGDVYSQRDVTGTGENKCLHCEFSAHSSASLELHVKRKHTKEFEFYCMACDYYAVTRREMTRHAATEKHKMKRQSYLNSANVEAGSADMSKNIIMPEEEHQQNSEEFQIISGQPSDTLKSRNAADCSILNENTNLDMSKVLCAADSVEVETEEESNFNEDHSFCETFQQAPVKDKVRKPEEMMSLTMSSNYGSPSRFQNENSGSSALNCETAKKNHEISNDAGELRVHCEGEGGNAGDGGGVVPHRHLCPVTLDGERSAESPVLVVTRITREQGNLESGGQNRVARGHGLEDLKGVQEDPVLGNKEILMNSQHETEFILEEDGPASDSTVESSDVYETIISIDDKGQAMYSFGRFDSSIIRIKNPEDGELIDQSEEGLIATGVRISELPLKDCAQGVKKKKSEGSSIGESTRIRCDDCGFLADGLSGLNVHIAMKHPTKEKHFHCLLCGKSFYTESNLHQHLASAGHMRNEQASVEELPEGGATFKCVKCTEPFDSEQNLFLHIKGQHEELLREVNKYIVEDTEQINREREENQGNVCKYCGKMCRSSNSMAFLAHIRTHTGSKPFKCKICHFATAQLGDARNHVKRHLGMREYKCHVCGVAFVMKKHLNTHLLGKHGVGTPKERVKVAYRKIGTLPGIQNNRNASSASEAQSLCEHFS

SEQ ID NO: 99923 - protein, 1660 aa, Homo sapiens; identical to SEQ ID NO: 99922
  Payload ID: 19918
  Gene Name: zinc finger protein 407
  Uniprot ID: Q9C0G0
  ENSP ID: ENSP00000462348

SEQ ID NO: 99924 - protein, 1815 aa, Homo sapiens
  Payload ID: 19918
  Gene Name: zinc finger protein 407
  Uniprot ID: Q9C0G0
  ENSP ID: ENSP00000463270
MMDSENKPENDEDEKINKEAQDLTKLSSHNEDGGPVSDVIASFPENSMGKRGFSESSNSDSVVIGEDRNKHASKRRKLDEAEPLKSGKQGICRLETSESSVTEGGIALDETGKETFLSDCTVGGTCLPNALSPSCNFSTIDVVSLKTDTEKTSAQEMVSLDLERESPFPPKEISVSCTIGNVDTVLKCSICGHLFSSCSDLEKHAESHMQQPKEHTCCHCSHKAESSSALHMHIKQAHGPQKVFSCDLCGFQCSEENLLNAHYLGKTHLRRQNLAARGGFVQILTKQPFPKKSRTMATKNVHSKPRTSKSIAKNSDSKGLRNVGSTFKDFRGSISKQSGSSSELLVEMMPSRNTLSQEVEIVEEHVTSLGLAQNPENQSRKLDTLVTSEGLLEKLESTKNTLQAAHGNSVTSRPRPERNILVLGNSFRRRSSTFTLKGQAKKRFNLLGIKRGTSETQRMYMKHLRTQMKTHDAESVLKHLEACSSVQRVCVTTSETQEAEQGQGSARPPDSGLHSLTVKPASGSQTLCACTDCGQVATNRTDLEIHVKRCHAREMKFYCRTCDFSSMSRRDLDEHLHSNQHQQTASVLSCQCCSFISLDEINLRDHMKEKHNMHFLCTPCNLFFLSEKDVEEHKATEKHINSLVQPKTLQSSNSDLVLQTLPLSTLESENAKESMDDSGKASQEEPLKSRVSHGNEVRHSSKPQFQCKKCFYKTRSSTVLTRHIKLRHGQDYHFLCKACNLYSLSKEGMEKHIKRSKHLENAKKNNIGLSFEECIERVCIGANDKKEEFDVSGNGRIEGHIGVQLQEHSYLEKGMLASEELSQSGGSTKDDELASTTTPKRGRPKGNISRTCSHCGLLASSITNLTVHIRRKHSHQYSYLCKVCKYYTVTKGDMERHCATKKHKGRVEIEASGKHSSDIIVGPEGGSLEAGKKNAGSAVTMSDEHANKPAESPTSVLEKPDRGNSIEAEVENVFHSLDGEVNSHLLDKKEQISSEPEDFAQPGDVYSQRDVTGTGENKCLHCEFSAHSSASLELHVKRKHTKEFEFYCMACDYYAVTRREMTRHAATEKHKMKRQSYLNSANVEAGSADMSKNIIMPEEEHQQNSEEFQIISGQPSDTLKSRNAADCSILNENTNLDMSKVLCAADSVEVETEEESNFNEDHSFCETFQQAPVKDKVRKPEEMMSLTMSSNYGSPSRFQNENSGSSALNCETAKKNHEISNDAGELRVHCEGEGGNAGDGGGVVPHRHLCPVTLDGERSAESPVLVVTRITREQGNLESGGQNRVARGHGLEDLKGVQEDPVLGNKEILMNSQHETEFILEEDGPASDSTVESSDVYETIISIDDKGQAMYSFGRFDSSIIRIKNPEDGELIDQSEEGLIATGVRISELPLKDCAQGVKKKKSEGSSIGESTRIRCDDCGFLADGLSGLNVHIAMKHPTKEKHFHCLLCGKSFYTESNLHQHLASAGHMRNEQASVEELPEGGATFKCVKCTEPFDSEQNLFLHIKGQHEELLREVNKYIVEDTEQINREREENQGNVCKYCGKMCRSSNSMAFLAHIRTHTGSKPFKCKICHFATAQLGDARNHVKRHLGMREYKCHVCGVAFVMKKHLNTHLLGKHGVGTPKERKFTCHLCDRSFTEKWALNNHMKLHTGEKPFKCTWPTCHYSFLTASAMKDHYRTHTGEKSFLCDLCGFAGGTRHALTKHRRQHTGEKPFKCDECNFASTTQSHLTRHKRVHTGEKPYRCPWCDYRSNCAENIRKHILHTGKHEGVKMYNCPKCDYGTNVPVEFRNHLKEQHPDIENPDLAYLHAGKGQKL

SEQ ID NO: 99925 - protein, 137 aa, Homo sapiens
  Payload ID: 19918
  Gene Name: zinc finger protein 407
  ENSP ID: ENSP00000479246
  MOD_RES (1)..(1): Any amino acid
XCHLCDRSFTEKWALNNHMKLHTGEKPFKCTWPTCHYSFLTASAMKDHYRTHTGEKSFLCDLCGFAGGTRHALTKHRRQHTGEKPFKCDECNFASTTQSHLTRHKRVHTGEKPYRCPWCDYSFFVSTYSEILPVWSL

SEQ ID NO: 99926 - protein, 129 aa, Homo sapiens
  Payload ID: 19918
  Gene Name: zinc finger protein 407
  ENSP ID: ENSP00000481798
KFTCHLCDRSFTEKWALNNHMKLHTGEKPFKCTWPTCHYSFLTASAMKDHYRTHTGEKSFLCDLCGFAGGTRHALTKHRRQHTGEKPFKCDECNFASTTQSHLTRHKRVHTGEKPYRCPWCDYSAYDWV

SEQ ID NO: 99927 - protein, 720 aa, Homo sapiens
  Payload ID: 19919
  Gene Name: zinc finger protein 408
  Uniprot ID: Q9H9D4
  ENSP ID: ENSP00000309606
MEEAEELLLEGKKALQLAREPRLGLDLGWNPSGEGCTQGLKDVPPEPTRDILALKSLPRGLALGPSLAKEQRLGVWCVGDPLQPGLLWGPLEEESASKEKGEGVKPRQEENLSLGPWGDVCACEQSSGWTSLVQRGRLESEGNVAPVRISERLHLQVYQLVLPGSELLLWPQPSSEGPSLTQPGLDKEAAVAVVTEVESAVQQEVASPGEDAAEPCIDPGSQSPSGIQAENMVSPGLKFPTQDRISKDSQPLGPLLQDGDVDEECPAQAQMPPELQSNSATQQDPDGSGASFSSSARGTQPHGYLAKKLHSPSDQCPPRAKTPEPGAQQSGFPTLSRSPPGPAGSSPKQGRRYRCGECGKAFLQLCHLKKHAFVHTGHKPFLCTECGKSYSSEESFKAHMLGHRGVRPFPCPQCDKAYGTQRDLKEHQVVHSGARPFACDQCGKAFARRPSLRLHRKTHQVPAAPAPCPCPVCGRPLANQGSLRNHMRLHTGEKPFLCPHCGRAFRQRGNLRGHLRLHTGERPYRCPHCADAFPQLPELRRHLISHTGEAHLCPVCGKALRDPHTLRAHERLHSGERPFPCPQCGRAYTLATKLRRHLKSHLEDKPYRCPTCGMGYTLPQSLRRHQLSHRPEAPCSPPSVPSAASEPTVVLLQAEPQLLDTHREEEVSPARDVVEVTISESQEKCFVVPEEPDAAPSLVLIHKDMGLGAWAEVVEVEMGT

SEQ ID NO: 99928 - protein, 779 aa, Homo sapiens
  Payload ID: 19920
  Gene Name: zinc finger protein 41
  Uniprot ID: P51814
  ENSP ID: ENSP00000315173
MAANGDSPPWSPALAAEGRGSSCEASVSFEDVTVDFSKEEWQHLDPAQRRLYWDVTLENYSHLLSVGYQIPKSEAAFKLEQGEGPWMLEGEAPHQSCSGEAIGKMQQQGIPGGIFFHCERFDQPIGEDSLCSILEELWQDNDQLEQRQENQNNLLSHVKVLIKERGYEHKNIEKIIHVTTKLVPSIKRLHNCDTILKHTLNSHNHNRNSATKNLGKIFGNGNNFPHSPSSTKNENAKTGANSCEHDHYEKHLSHKQAPTHHQKIHPEEKLYVCTECVMGFTQKSHLFEHQRIHAGEKSRECDKSNKVFPQKPQVDVHPSVYTGEKPYLCTQCGKVFTLKSNLITHQKIHTGQKPYKCSECGKAFFQRSDLFRHLRIHTGEKPYECSECGKGFSQNSDLSIHQKTHTGEKHYECNECGKAFTRKSALRMHQRIHTGEKPYVCADCGKAFIQKSHFNTHQRIHTGEKPYECSDCGKSFTKKSQLHVHQRIHTGEKPYICTECGKVFTHRTNLTTHQKTHTGEKPYMCAECGKAFTDQSNLIKHQKTHTGEKPYKCNGCGKAFIWKSRLKIHQKSHIGERHYECKDCGKAFIQKSTLSVHQRIHTGEKPYVCPECGKAFIQKSHFIAHHRIHTGEKPYECSDCGKCFTKKSQLRVHQKIHTGEKPNICAECGKAFTDRSNLITHQKIHTREKPYECGDCGKTFTWKSRLNIHQKSHTGERHYECSKCGKAFIQKATLSMHQIIHTGKKPYACTECQKAFTDRSNLIKHQKMHSGEKRYKASD

SEQ ID NO: 99929 - protein, 779 aa, Homo sapiens; identical to SEQ ID NO: 99928
  Payload ID: 19920
  Gene Name: zinc finger protein 41
  Uniprot ID: P51814
  ENSP ID: ENSP00000366265

SEQ ID NO: 99930 - protein, 178 aa, Homo sapiens
  Payload ID: 19920
  Gene Name: zinc finger protein 41
  ENSP ID: ENSP00000390385
MGTLPHGPRPWLQRDVAAHVSADHAALNSIVSLQASVSFEDVTVDFSKEEWQHLDPAQRRLYWDVTLENYSHLLSVGYQIPKSEAAFKLEQGEGPWMLEGEAPHQSCSGEAIGKMQQQGIPGGIFFHCERFDQPIGEDSLCSILEELWQDNDQLEQRQENQNNLLSHVKVLIKERGYE

SEQ ID NO: 99931 - protein, 431 aa, Homo sapiens
  Payload ID: 19921
  Gene Name: zinc finger protein 410
  Uniprot ID: Q86VK4
  ENSP ID: ENSP00000323293
MLSDELESKPELLVQFVQNTSIPLGQGLVESEAKDITCLSLLPVTEASECSRLMLPDDTTNHSNSSKEVPSSAVLRSLRVNVGPDGEETRAQTVQKSPEFLSTSESSSLLQDLQPSDSTSFILLNLTRAGLGSSAEHLVFVQDEAEDSGNDFLSSESTDSSIPWFLRVQELAHDSLIAATRAQLAKNAKTSSNGENVHLGSGDGQSKDSGPLPQVEKKLKCTVEGCDRTFVWPAHFKYHLKTHRNDRSFICPAEGCGKSFYVLQRLKVHMRTHNGEKPFMCHESGCGKQFTTAGNLKNHRRIHTGEKPFLCEAQGCGRSFAEYSSLRKHLVVHSGEKPHQCQVCGKTFSQSGSRNVHMRKHHLQLGAAGSQEQEQTEVLAEGSPRSLSSVPDVTHHLVTMQSGRQSYEVSVLTAVNPQELLNQGDLTERRT

SEQ ID NO: 99932 - protein, 425 aa, Homo sapiens
  Payload ID: 19921
  Gene Name: zinc finger protein 410
  ENSP ID: ENSP00000334170
MLPDDTTNHSNSSKEVPSSAVLRSLRVNVGPDGEETRAQTVQKSPEFLSTSESSSLLQDLQPSDSTSFILLNLTRAGLGSSAEHLVFVQDEAEDSGNDFLSSESTDSSIPWFLRVQELAHDSLIAATRAQLAKNAKTSSNGENVHLGSGDGQSKDSGPLPQVEKKLKCTVEGCDRTFVWPAHFKYHLKTHRNDRSFICPAEGCGKSFYVLQRLKVHMRTHNGEKPFMCHESGCGKQFTTAGNLKNHRRIHTGEKPFLCEAQGCGRSFAEYSSLRKHLVVHSGEKPHQCQVCGKTFSQSGSRNVHMRKHHLQLGAAGSQEQEQTAEPLMGSSLLEEASVPSKNLVSMNSQPSLGGESLNLPNTNSILGVDDEVLAEGSPRSLSSVPDVTHHLVTMQSGRQSYEVSVLTAVNPQELLNQGDLTERRT

SEQ ID NO: 99933 - protein, 272 aa, Homo sapiens
  Payload ID: 19921
  Gene Name: zinc finger protein 410
  Uniprot ID: Q86VK4
  ENSP ID: ENSP00000381208
MLSDELESKPELLVQFVQNTSIPLGQGLVESEAKDITCLSLLPVTEASECSRLMLPDDTTNHSNSSKEVPSSAVLRSLRVNVGPDGEETRAQTVQKSPEFLSTSESSSLLQDLQPSDSTSFILLNLTRAGLGSSAEHLVFVQDEAEDSGNDFLSSESTDSSIPWFLRVQELAHDSLIAATRAQLAKNAKTSSNGENVHLGSGDGQSKDSGPLPQVEKKLKCTVEGCDRTFVWPAHFKYHLKTHRRLWEKLLCAAEAEGAHEDPQWREALYVP

SEQ ID NO: 99934 - protein, 516 aa, Homo sapiens
  Payload ID: 19921
  Gene Name: zinc finger protein 410
  Uniprot ID: Q86VK4
  ENSP ID: ENSP00000407130
MLSDELESKPELLVQFVQNTSIPLGQGLVESEAKDITCLSLLPVTEASECSRLMLPEPVPWREEDGKSGCSDLNDTTNHSNSSKEVPSSAVLRSLRVNVGPDGEETRAQTVQKSPEFLSTSESSSLLQDLQPSDSTSFILLNLTRAGLGSSAEHLVFVQDEAEDSGNDFLSSESTDSSIPWFLRVQELAHDSLIAATRAQLAKNAKTSSNGENVHLGSGDGQSKDSGPLPQVEKKLKCTVEGCDRTFVWPAHFKYHLKTHRNDRSFICPAEGCGKSFYVLQRLKVHMRTHNGEKPFMCHESGCGKQFTTAGNLKNHRRIHTGEKPFLCEAQGCGRSFAEYSSLRKHLVVHSGEKPHQCQVCGKTFSQSGSRNVHMRKHHLQLGAAGSQEQEQTAEPLMGSSLLEEASVPSKNLVSMNSQPSLGGESLNLPNTNSILGVDDEVLAEGSPRSLSSVPDVTHHLVTMQSGRQSYEVSVLTAVNPQESLAPLPRLECSGAFSAHCNLCLPGSSDSPASAS

SEQ ID NO: 99935 - protein, 405 aa, Homo sapiens
  Payload ID: 19921
  Gene Name: zinc finger protein 410
  Uniprot ID: Q86VK4
  ENSP ID: ENSP00000442228
MLSDELESKPELLVQFVQNTSIPLGQGLVESEAKDITCLSLLPVTEASECSRLMLPGLGSSAEHLVFVQDEAEDSGNDFLSSESTDSSIPWFLRVQELAHDSLIAATRAQLAKNAKTSSNGENVHLGSGDGQSKDSGPLPQVEKKLKCTVEGCDRTFVWPAHFKYHLKTHRNDRSFICPAEGCGKSFYVLQRLKVHMRTHNGEKPFMCHESGCGKQFTTAGNLKNHRRIHTGEKPFLCEAQGCGRSFAEYSSLRKHLVVHSGEKPHQCQVCGKTFSQSGSRNVHMRKHHLQLGAAGSQEQEQTAEPLMGSSLLEEASVPSKNLVSMNSQPSLGGESLNLPNTNSILGVDDEVLAEGSPRSLSSVPDVTHHLVTMQSGRQSYEVSVLTAVNPQELLNQGDLTERRT

SEQ ID NO: 99936 - protein, 127 aa, Homo sapiens
  Payload ID: 19921
  Gene Name: zinc finger protein 410
  ENSP ID: ENSP00000450569
MLSDELESKPECCLFSPQLLVQFVQNTSIPLGQGLVESEAKDITCLSLLPVTEASECSRLMLPDDTTNHSNSSKEVPSSAVLRSLRVNVGPDGEETRAQTVQKSPEFLSTSESSSLLQDLQPSDSTS

SEQ ID NO: 99937 - protein, 96 aa, Homo sapiens
  Payload ID: 19921
  Gene Name: zinc finger protein 410
  ENSP ID: ENSP00000450650
MLSDELESKPELLVQFVQNTSIPLGQGLVESEAKDITCLSLLPVTEASECSRLMLPGGPFLSCFEKPSGECGSRRRGDESSDCTEIPGVFVHFRVF

SEQ ID NO: 99938 - protein, 110 aa, Homo sapiens
  Payload ID: 19921
  Gene Name: zinc finger protein 410
  ENSP ID: ENSP00000450884
MRKHHLQLGAAGSQEQEQTAEPLMGSSLLEEASVPSKNLVSMNSQPSLGGESLNLPNTNSILGVDDEVLAEGSPRSLSSVPDVTHHLVTMQSGRQSYEVSVLTAVNPQEV

SEQ ID NO: 99939 - protein, 167 aa, Homo sapiens
  Payload ID: 19921
  Gene Name: zinc finger protein 410
  ENSP ID: ENSP00000451073
MLPDDTTNHSNSSKEVPSSAVLRSLRVNVGPDGEETRAQTVQKSPEFLSTSESSSLLQDLQPSDSTSFILLNLTRAGLGSSAEHLVFVQDEAEDSGNDFLSSESTDSSIPWFLRVQELAHDSLIAATRAQLAKNAKTSSNGEARRHFPCHYSVQRDFGNAVAGLSCI

SEQ ID NO: 99940 - protein, 70 aa, Homo sapiens
  Payload ID: 19921
  Gene Name: zinc finger protein 410
  ENSP ID: ENSP00000451116
MLSDELESKPELLVQFVQNTSIPLGQGLVESEAKDITCLSLLPVTEASECSRLMLPDDTTNHSNSSKEVP

SEQ ID NO: 99941 - protein, 74 aa, Homo sapiens
  Payload ID: 19921
  Gene Name: zinc finger protein 410
  ENSP ID: ENSP00000451458
MLSDELESKPELLVQFVQNTSIPLGQGLVESEAKDITCLSLLPVTEASECSRLMLPDDTTNHSNSSKEVPSSAV

SEQ ID NO: 99942 - protein, 169 aa, Homo sapiens
  Payload ID: 19921
  Gene Name: zinc finger protein 410
  ENSP ID: ENSP00000451620
  MOD_RES (1)..(1): Any amino acid
XCQVCGKTFSQSGSRNVHMRKHHLQLGAAGSQEQEQTAEPLMGSSLLEEASVPSKNLVSMNSQPSLGGESLNLPNTNSILGVDDEVLAEGSPRSLSSVPDVTHHLVTMQSGRQSYEVSVLTAVNPQEVESCYVAQAGVQWHHLGSLQPLPPEFKRFFCLSLLSSWDHSY

SEQ ID NO: 99943 - protein, 94 aa, Homo sapiens
  Payload ID: 19921
  Gene Name: zinc finger protein 410
  ENSP ID: ENSP00000451748
MRTHNGEKPFMCHESGCGKQFTTAGNLKNHRRIHTGEKPFLCEAQGCGRSFAEYSSLRKHLVVHSGEKPHQCQVCGKTFSQSGSRNVHMRKHHL

SEQ ID NO: 99944 - protein, 478 aa, Homo sapiens
  Payload ID: 19921
  Gene Name: zinc finger protein 410
  Uniprot ID: Q86VK4
  ENSP ID: ENSP00000451763
MLSDELESKPELLVQFVQNTSIPLGQGLVESEAKDITCLSLLPVTEASECSRLMLPDDTTNHSNSSKEVPSSAVLRSLRVNVGPDGEETRAQTVQKSPEFLSTSESSSLLQDLQPSDSTSFILLNLTRAGLGSSAEHLVFVQDEAEDSGNDFLSSESTDSSIPWFLRVQELAHDSLIAATRAQLAKNAKTSSNGENVHLGSGDGQSKDSGPLPQVEKKLKCTVEGCDRTFVWPAHFKYHLKTHRNDRSFICPAEGCGKSFYVLQRLKVHMRTHNGEKPFMCHESGCGKQFTTAGNLKNHRRIHTGEKPFLCEAQGCGRSFAEYSSLRKHLVVHSGEKPHQCQVCGKTFSQSGSRNVHMRKHHLQLGAAGSQEQEQTAEPLMGSSLLEEASVPSKNLVSMNSQPSLGGESLNLPNTNSILGVDDEVLAEGSPRSLSSVPDVTHHLVTMQSGRQSYEVSVLTAVNPQELLNQGDLTERRT

SEQ ID NO: 99945 - protein, 86 aa, Homo sapiens
  Payload ID: 19921
  Gene Name: zinc finger protein 410
  ENSP ID: ENSP00000451807
MLPDDTTNHSNSSKEVPSSAVLRSLRVNVGPDGEETRAQTVQKSPEFLSTSESSSLLQDLQPSDSTSFILLNLTRAGLGSSAEHLV

SEQ ID NO: 99946 - protein, 96 aa, Homo sapiens; identical to SEQ ID NO: 99937
  Payload ID: 19921
  Gene Name: zinc finger protein 410
  ENSP ID: ENSP00000451867

SEQ ID NO: 99947 - protein, 125 aa, Homo sapiens
  Payload ID: 19921
  Gene Name: zinc finger protein 410
  ENSP ID: ENSP00000452023
MLSDELESKPELLVQFVQNTSIPLGQGLVESEAKDITCLSLLPVTEASECSRLMLPDDTTNHSNSSKEVPSSAVLRSLRVNVGPDGEETRAQTVQKSPEFLSTSESSSLLQDLQPSDSTSFILLN

SEQ ID NO: 99948 - protein, 129 aa, Homo sapiens
  Payload ID: 19921
  Gene Name: zinc finger protein 410
  ENSP ID: ENSP00000452199
MLPDDTTNHSNSSKEVPSSAVLRSLRVNVGPDGEETRAQTVQKSPEFLSTSESSSLLQDLQPSDSTSFILLNLTRAGLGSSAEHLVFVQDEAEDSGNDFLSSESTDSSIPWFLRVQELAHDSLIAATRA

SEQ ID NO: 99949 - protein, 516 aa, Homo sapiens; identical to SEQ ID NO: 99934
  Payload ID: 19921
  Gene Name: zinc finger protein 410
  Uniprot ID: Q86VK4
  ENSP ID: ENSP00000483073

SEQ ID NO: 99950 - protein, 312 aa, Homo sapiens
  Payload ID: 19922
  Gene Name: zinc finger protein 414
  Uniprot ID: Q96IQ9
  ENSP ID: ENSP00000255616
MEEKPSGPIPDMLATAEPSSSETDKEVLSPAVPAAAPSSSMSEEPGPEQAATPPVWERGGAGGMQQGSSPAPDSCQPGPGPSPGLTSIVSGTSEDLRPPRRRPPPGKQIPCSSPGCCLSFPSVRDLAQHLRTHCPPTQSLEGKLFRCSALSCTETFPSMQELVAHSKLHYKPNRYFKCENCLLRFRTHRSLFKHLHVCAEHAQSPAPPPPPALDREPPAPERPPEVDPASAPGLPFPLLEPFTTPAPAPTGPFLPYLNPAPFGLSPPRLRPFLAAAPGPPASSAAVWKKSQGAGSSPRRPQGGSDAPSGACR

SEQ ID NO: 99951 - protein, 390 aa, Homo sapiens
  Payload ID: 19922
  Gene Name: zinc finger protein 414
  Uniprot ID: Q96IQ9
  ENSP ID: ENSP00000377504
MEEKPSGPIPDMLATAEPSSSETDKEVLSPAVPAAAPSSSMSEEPGPEQAATPPVWERGGAGGMQQGSSPAPDSCQPGPGPSPGLTSIVSGTSEDLRPPRRRPPPGKQIPCSSPGCCLSFPSVRDLAQHLRTHCPPTQSLEGKLFRCSALSCTETFPSMQELVAHSKLHYKPNRYFKCENCLLRFRTHRSLFKHLHVCAEHAQSPAPPPPPALDREPPAPERPPEVDPASAPGLPFPLLEPFTTPAPAPTGPFLPYLNPAPFGLSPPRLRPFLAAAPGPPASSAAVWKKSQGAGSSPRRPQGGSDAPSGHAAPSRIVWEHTRGRYSCMQCAFSTASRPAMTLHLEDHRPGAPAAPAAGPPRPDAPADPAPLAPKVSPLLSEGELPVFSQL

SEQ ID NO: 99952 - protein, 120 aa, Homo sapiens
  Payload ID: 19922
  Gene Name: zinc finger protein 414
  ENSP ID: ENSP00000471378
  MOD_RES (1)..(1): Any amino acid
XSPPRLRPFLAAAPGPPASSAAVWKKSQGAGSSPRRPQGGSDAPSGHAAPSRIVWEHTRGRYSCMQCAFSTASRPAMTLHLEDHRPGAPAAPAAGPPRPDAPAGKAEECAGGEGGGGPRR

SEQ ID NO: 99953 - protein, 154 aa, Homo sapiens
  Payload ID: 19922
  Gene Name: zinc finger protein 414
  ENSP ID: ENSP00000471863
  MOD_RES (1)..(1): Any amino acid
XHYKPNRYFKCENCLLRFRTHRSLFKHLHVCAEHAQSPAPPPPPALDREPPAPERPPEVDPASAPGLPFPLLEPFTTPAPAPTGPFLPYLNPAPFGLSPPRLRPFLAAAPGPPASSAAVWKKSQGAGSSPRRPQGGSDAPSGACRARGPEPHRV

SEQ ID NO: 99954 - protein, 45 aa, Homo sapiens
  Payload ID: 19922
  Gene Name: zinc finger protein 414
  ENSP ID: ENSP00000472741
MGSKSLAPALAAASVFPASVTWHSICEPTARPHSPWKASSSAAQP

SEQ ID NO: 99955 - protein, 171 aa, Homo sapiens
  Payload ID: 19922
  Gene Name: zinc finger protein 414
  ENSP ID: ENSP00000473079
  MOD_RES (1)..(1): Any amino acid
XRYFKFPPEVVRKGRCHSCTGAGRCENCLLRFRTHRSLFKHLHVCAEHAQSPAPPPPPALDREPPAPERPPEVDPASAPGLPFPLLEPFTTPAPAPTGPFLPYLNPAPFGLSPPRLRPFLAAAPGPPASSAAVWKKSQGAGSSPRRPQGGSDAPSGHAAPSRIVWEHTRGR

SEQ ID NO: 99956 - protein, 555 aa, Homo sapiens
  Payload ID: 19923
  Gene Name: zinc finger protein 415
  Uniprot ID: Q09FC8
  ENSP ID: ENSP00000243643
MAFTQLTFRDVAIEFSQDEWKCLNSTQRTLYRDVMLENYRNLVSLDLSRNCVIKELAPQQEGNPGEVFHTVTLEQHEKHDIEEFCFREIKKKIHDFDCQWRDDERNCNKVTTAPKENLTCRRDQRDRRGIGNKSIKHQLGLSFLPHPHELQQFQAEGKIYECNHVEKSVNHGSSVSPPQIISSTIKTHVSNKYGTDFICSSLLTQEQKSCIREKPYRYIECDKALNHGSHMTVRQVSHSGEKGYKCDLCGKVFSQKSNLARHWRVHTGEKPYKCNECDRSFSRNSCLALHRRVHTGEKPYKCYECDKVFSRNSCLALHQKTHIGEKPYTCKECGKAFSVRSTLTNHQVIHSGKKPYKCNECGKVFSQTSSLATHQRIHTGEKPYKCNECGKVFSQTSSLARHWRIHTGEKPYKCNECGKVFSYNSHLASHRRVHTGEKPYKCNECGKAFSVHSNLTTHQVIHTGEKPYKCNQCGKGFSVHSSLTTHQVIHTGEKPYKCNECGKSFSVRPNLTRHQIIHTGKKPYKCSDCGKSFSVRPNLFRHQIIHTKEKPYKRN

SEQ ID NO: 99957 - protein, 555 aa, Homo sapiens; identical to SEQ ID NO: 99956
  Payload ID: 19923
  Gene Name: zinc finger protein 415
  Uniprot ID: Q09FC8
  ENSP ID: ENSP00000395055

SEQ ID NO: 99958 - protein, 555 aa, Homo sapiens
  Payload ID: 19923
  Gene Name: zinc finger protein 415
  Uniprot ID: Q09FC8
  ENSP ID: ENSP00000439435
MDGDGLTFRDVAIEFSQDEWKCLNSTQRTLYRDVMLENYRNLVSLDLSRNCVIKELAPQQEGNPGEVFHTVTLEQHEKHDIEEFCFREIKKKIHDFDCQWRDDERNCNKVTTAPKENLTCRRDQRDRRGIGNKSIKHQLGLSFLPHPHELQQFQAEGKIYECNHVEKSVNHGSSVSPPQIISSTIKTHVSNKYGTDFICSSLLTQEQKSCIREKPYRYIECDKALNHGSHMTVRQVSHSGEKGYKCDLCGKVFSQKSNLARHWRVHTGEKPYKCNECDRSFSRNSCLALHRRVHTGEKPYKCYECDKVFSRNSCLALHQKTHIGEKPYTCKECGKAFSVRSTLTNHQVIHSGKKPYKCNECGKVFSQTSSLATHQRIHTGEKPYKCNECGKVFSQTSSLARHWRIHTGEKPYKCNECGKVFSYNSHLASHRRVHTGEKPYKCNECGKAFSVHSNLTTHQVIHTGEKPYKCNQCGKGFSVHSSLTTHQVIHTGEKPYKCNECGKSFSVRPNLTRHQIIHTGKKPYKCSDCGKSFSVRPNLFRHQIIHTKEKPYKRN

SEQ ID NO: 99959 - protein, 73 aa, Homo sapiens
  Payload ID: 19923
  Gene Name: zinc finger protein 415
  ENSP ID: ENSP00000468917
MAFTQLTFRDVAIEFSQDEWKCLNSTQRTLYRDVMLENYRNLVSLGWSAMVQSRLTATFASRIQMILLPQPPE

SEQ ID NO: 99960 - protein, 75 aa, Homo sapiens
  Payload ID: 19923
  Gene Name: zinc finger protein 415
  ENSP ID: ENSP00000469483
MAFTQLTFRDVAIEFSQDEWKCLNSTQRTLYRDVMLENYRNLVSLGEDNFLPEVKICPWYLSIFPCVPLGSPCIT

SEQ ID NO: 99961 - protein, 73 aa, Homo sapiens; identical to SEQ ID NO: 99959
  Payload ID: 19923
  Gene Name: zinc finger protein 415
  ENSP ID: ENSP00000469656

SEQ ID NO: 99962 - protein, 73 aa, Homo sapiens
  Payload ID: 19923
  Gene Name: zinc finger protein 415
  ENSP ID: ENSP00000470272
MDGDGLTFRDVAIEFSQDEWKCLNSTQRTLYRDVMLENYRNLVSLGWSAMVQSRLTATFASRIQMILLPQPPE

SEQ ID NO: 99963 - protein, 106 aa, Homo sapiens
  Payload ID: 19923
  Gene Name: zinc finger protein 415
  ENSP ID: ENSP00000470410
MAFTQLTFRDVAIEFSQDEWKCLNSTQRTLYRDVMLENYRNLVSLDLSRNCVIKELAPQQEGNPGEVFHTVTLEQHEKHDIEEFCFREIKKKIHDFDCQWRDDERN

SEQ ID NO: 99964 - protein, 109 aa, Homo sapiens
  Payload ID: 19923
  Gene Name: zinc finger protein 415
  ENSP ID: ENSP00000471167
MDGDGLTFRDVAIEFSQDEWKCLNSTQRTLYRDVMLENYRNLVSLEYYPMWEHRKEPWTIESQVRVARKPKGWEWIKGVKTGWSAMVQSRLTATFASRIQMILLPQPPE

SEQ ID NO: 99965 - protein, 163 aa, Homo sapiens
  Payload ID: 19923
  Gene Name: zinc finger protein 415
  ENSP ID: ENSP00000471386
MTPSLSLSEPTCNRDKGLDQKTSIIDFQRLLAHEEETQKRRAKESGMAFTQLTFRDVAIEFSQDEWKCLNSTQRTLYRDVMLENYRNLVSLDLSRNCVIKELAPQQEGNPGEVFHTVTLEQHEKHDIEEFCFREIKKKIHDFDCQWRDDERNCNKVTTAPKEN

SEQ ID NO: 99966 - protein, 103 aa, Homo sapiens
  Payload ID: 19923
  Gene Name: zinc finger protein 415
  ENSP ID: ENSP00000471718
MTPSLSLSEPTCNRDKGLDQKTSMTSLTSSPACVLLAPSAPAKHASFLFLGRACSCLKAFTWAVPLLELAGPSAAALTSKDSWHMRKKPRRGEQRSQEWLLLS

SEQ ID NO: 99967 - protein, 59 aa, Homo sapiens
  Payload ID: 19923
  Gene Name: zinc finger protein 415
  ENSP ID: ENSP00000471834
MAFTQLTFRDVAIEFSQDEWKCLNSTQRTLYRDVMLENYRNLVSLDPSVIASLLIQAKG

SEQ ID NO: 99968 - protein, 59 aa, Homo sapiens; identical to SEQ ID NO: 99967
  Payload ID: 19923
  Gene Name: zinc finger protein 415
  ENSP ID: ENSP00000472003

SEQ ID NO: 99969 - protein, 109 aa, Homo sapiens
  Payload ID: 19923
  Gene Name: zinc finger protein 415
  ENSP ID: ENSP00000472516
MAFTQLTFRDVAIEFSQDEWKCLNSTQRTLYRDVMLENYRNLVSLEYYPMWEHRKEPWTIESQVRVARKPKGWEWIKGVKTGWSAMVQSRLTATFASRIQMILLPQPPE

SEQ ID NO: 99970 - protein, 109 aa, Homo sapiens; identical to SEQ ID NO: 99969
  Payload ID: 19923
  Gene Name: zinc finger protein 415
  ENSP ID: ENSP00000472584

SEQ ID NO: 99971 - protein, 59 aa, Homo sapiens; identical to SEQ ID NO: 99967
  Payload ID: 19923
  Gene Name: zinc finger protein 415
  ENSP ID: ENSP00000472673

SEQ ID NO: 99972 - protein, 106 aa, Homo sapiens
  Payload ID: 19923
  Gene Name: zinc finger protein 415
  ENSP ID: ENSP00000472797
MTPSLSLSEPTCNRDKGLDQKTSMTSLTSSPACVLLAPSAPAKHASFLFLGRACSCLKAFTWAVPLLELAGPSAAALTSKDSWHMRKKPRRGEQRSQEWLLLRSVS

SEQ ID NO: 99973 - protein, 325 aa, Homo sapiens
  Payload ID: 19923
  Gene Name: zinc finger protein 415
  Uniprot ID: Q09FC8
  ENSP ID: ENSP00000472911
MTVRQVSHSGEKGYKCDLCGKVFSQKSNLARHWRVHTGEKPYKCNECDRSFSRNSCLALHRRVHTGEKPYKCYECDKVFSRNSCLALHQKTHIGEKPYTCKECGKAFSVRSTLTNHQVIHSGKKPYKCNECGKVFSQTSSLATHQRIHTGEKPYKCNECGKVFSQTSSLARHWRIHTGEKPYKCNECGKVFSYNSHLASHRRVHTGEKPYKCNECGKAFSVHSNLTTHQVIHTGEKPYKCNQCGKGFSVHSSLTTHQVIHTGEKPYKCNECGKSFSVRPNLTRHQIIHTGKKPYKCSDCGKSFSVRPNLFRHQIIHTKEKPYKRN

SEQ ID NO: 99974 - protein, 23 aa, Homo sapiens
  Payload ID: 19923
  Gene Name: zinc finger protein 415
  ENSP ID: ENSP00000473008
MAFTQLTFRDVAIEFSQDEWKCL

SEQ ID NO: 99975 - protein, 594 aa, Homo sapiens
  Payload ID: 19924
  Gene Name: zinc finger protein 416
  Uniprot ID: Q9BWM5
  ENSP ID: ENSP00000196489
MAAAVLRDSTSVPVTAEAKLMGFTQGCVTFEDVAIYFSQEEWGLLDEAQRLLYRDVMLENFALITALVCWHGMEDEETPEQSVSVEGVPQVRTPEASPSTQKIQSCDMCVPFLTDILHLTDLPGQELYLTGACAVFHQDQKHHSAEKPLESDMDKASFVQCCLFHESGMPFTSSEVGKDFLAPLGILQPQAIANYEKPNKISKCEEAFHVGISHYKWSQCRRESSHKHTFFHPRVCTGKRLYESSKCGKACCCECSLVQLQRVHPGERPYECSECGKSFSQTSHLNDHRRIHTGERPYVCGQCGKSFSQRATLIKHHRVHTGERPYECGECGKSFSQSSNLIEHCRIHTGERPYECDECGKAFGSKSTLVRHQRTHTGEKPYECGECGKLFRQSFSLVVHQRIHTTARPYECGQCGKSFSLKCGLIQHQLIHSGARPFECDECGKSFSQRTTLNKHHKVHTAERPYVCGECGKAFMFKSKLVRHQRTHTGERPFECSECGKFFRQSYTLVEHQKIHTGLRPYDCGQCGKSFIQKSSLIQHQVVHTGERPYECGKCGKSFTQHSGLILHRKSHTVERPRDSSKCGKPYSPRSNIV

SEQ ID NO: 99976 - protein, 575 aa, Homo sapiens
  Payload ID: 19925
  Gene Name: zinc finger protein 417
  Uniprot ID: Q8TAU3
  ENSP ID: ENSP00000311319
MAAAAPRRPTQQGTVTFEDVAVNFSQEEWCLLSEAQRCLYRDVMLENLALISSLGCWCGSKDEEAPCKQRISVQRESQSRTPRAGVSPKKAHPCEMCGLILEDVFHFADHQETHHKQKLNRSGACGKNLDDTAYLHQHQKQHIGEKFYRKSVREASFVKKRKLRVSQEPFVFREFGKDVLPSSGLCQEAAAVEKTDSETMHGPPFQEGKTNYSCGKRTKAFSTKHSVIPHQKLFTRDGCYVCSDCGKSFSRYVSFSNHQRDHTAKGPYDCGECGKSYSRKSSLIQHQRVHTGKTAYPCEECGKSFSQKGSLISHQRVHTGERPYECREYGKSFGQKGNLIQHQQGHTGERAYHCGECGKSFRQKFCFINHQRVHTGERPYKCGECGKSFGQKGNLVQHQRGHTGERPYECKECGKSFRYRSHLTEHQRLHTGERPYNCRECGKLFNRKYHLLVHERVHTGERPYACEVCGKLFGNKNCVTIHQRIHTGERPYECNECGKSFLSSSALHVHKRVHSGQKPYKCSECGKSFAECSSLIKHRRIHTGERPYECTKCGKTFQRSSTLLHHQSSHRRKAL

SEQ ID NO: 99977 - protein, 15 aa, Homo sapiens
  Payload ID: 19925
  Gene Name: zinc finger protein 417
  ENSP ID: ENSP00000469176
MLENLALISSLGCWC

SEQ ID NO: 99978 - protein, 51 aa, Homo sapiens
  Payload ID: 19925
  Gene Name: zinc finger protein 417
  ENSP ID: ENSP00000471325
MLENLALISSLGCWCGSKDEEAPCKQRISVQRESQSRTPRAGVSPKKAHPC

SEQ ID NO: 99979 - protein, 21 aa, Homo sapiens
  Payload ID: 19925
  Gene Name: zinc finger protein 417
  ENSP ID: ENSP00000471471
MLENLALISSLGCWCGSKDEE

SEQ ID NO: 99980 - protein, 57 aa, Homo sapiens
  Payload ID: 19925
  Gene Name: zinc finger protein 417
  ENSP ID: ENSP00000471689
MLENLALISSLGCWCGSKDEEAPCKQRISVQRESQSRTPRAGVSPKKAHPCEMCGLI

SEQ ID NO: 99981 - protein, 574 aa, Homo sapiens
  Payload ID: 19925
  Gene Name: zinc finger protein 417
  ENSP ID: ENSP00000472272
MAAAAPRRPTQGTVTFEDVAVNFSQEEWCLLSEAQRCLYRDVMLENLALISSLGCWCGSKDEEAPCKQRISVQRESQSRTPRAGVSPKKAHPCEMCGLILEDVFHFADHQETHHKQKLNRSGACGKNLDDTAYLHQHQKQHIGEKFYRKSVREASFVKKRKLRVSQEPFVFREFGKDVLPSSGLCQEAAAVEKTDSETMHGPPFQEGKTNYSCGKRTKAFSTKHSVIPHQKLFTRDGCYVCSDCGKSFSRYVSFSNHQRDHTAKGPYDCGECGKSYSRKSSLIQHQRVHTGKTAYPCEECGKSFSQKGSLISHQRVHTGERPYECREYGKSFGQKGNLIQHQQGHTGERAYHCGECGKSFRQKFCFINHQRVHTGERPYKCGECGKSFGQKGNLVQHQRGHTGERPYECKECGKSFRYRSHLTEHQRLHTGERPYNCRECGKLFNRKYHLLVHERVHTGERPYACEVCGKLFGNKNCVTIHQRIHTGERPYECNECGKSFLSSSALHVHKRVHSGQKPYKCSECGKSFAECSSLIKHRRIHTGERPYECTKCGKTFQRSSTLLHHQSSHRRKAL

SEQ ID NO: 99982 - protein, 90 aa, Homo sapiens
  Payload ID: 19925
  Gene Name: zinc finger protein 417
  ENSP ID: ENSP00000472352
  MOD_RES (1)..(1): Any amino acid
XVAVNFSQEEWCLLSEAQRCLYRDVMLENLALISSLDCPLHLCQFPDLSPCWRVCLDKPYLFLRPAALRWVKEWNVCASAKAAETSASAL

SEQ ID NO: 99983 - protein, 676 aa, Homo sapiens
  Payload ID: 19926
  Gene Name: zinc finger protein 418
  Uniprot ID: Q8TF45
  ENSP ID: ENSP00000379451
MQGTVAFEDVAVNFSQEEWSLLSEVQRCLYHDVMLENWVLISSLGCWCGSEDEEAPSKKSISIQRVSQVSTPGAGVSPKKAHSCEMCGAILGDILHLADHQGTHHKQKLHRCEAWGNKLYDSSNRPHQNQYLGEKPYRSSVEEALFVKRCKFHVSEESSIFIQSGKDFLPSSGLLLQEATHTGEKSNSKPECESPFQWGDTHYSCGECMKHSSTKHVFVQQQRLPSREECYCWECGKSFSKYDSVSNHQRVHTGKRPYECGECGKSFSHKGSLVQHQRVHTGKRPYECGECGKSFSHKGSLVQHQRVHTGERPYECGECGKSFSQNGTLIKHQRVHTGERPYECEECGKCFTQKGNLIQHQRGHTSERPYECEECGKCFSQKGTLTEHHRVHTRERPYECGECGKSFSRKGHLRNHQRGHTGERPYECGECGKSFSRKGNLIQHQRSHTGERPYECRECRKLFRGKSHLIEHQRVHTGERPYECNECGKSFQDSSGFRVHQRVHTGEKPFECSECGKSFPQSCSLLRHRRVHTGERPYECGECGKSFHQSSSLLRHQKTHTAERPYECRECGKFFSSLLEHRRVHTGERPYECRECGKTFTRRSAHFKHQRLHTRGKPYECSECGKSFAETFSLTEHRRVHTGERPYECSECGKSFHRSSSLLRHQRVHTERSPYK

SEQ ID NO: 99984 - protein, 697 aa, Homo sapiens
  Payload ID: 19926
  Gene Name: zinc finger protein 418
  ENSP ID: ENSP00000407039
MQEGLHRMTWDCIAIGSHENSVQGTVAFEDVAVNFSQEEWSLLSEVQRCLYHDVMLENWVLISSLGCWCGSEDEEAPSKKSISIQRVSQVSTPGAGVSPKKAHSCEMCGAILGDILHLADHQGTHHKQKLHRCEAWGNKLYDSSNRPHQNQYLGEKPYRSSVEEALFVKRCKFHVSEESSIFIQSGKDFLPSSGLLLQEATHTGEKSNSKPECESPFQWGDTHYSCGECMKHSSTKHVFVQQQRLPSREECYCWECGKSFSKYDSVSNHQRVHTGKRPYECGECGKSFSHKGSLVQHQRVHTGKRPYECGECGKSFSHKGSLVQHQRVHTGERPYECGECGKSFSQNGTLIKHQRVHTGERPYECEECGKCFTQKGNLIQHQRGHTSERPYECEECGKCFSQKGTLTEHHRVHTRERPYECGECGKSFSRKGHLRNHQRGHTGERPYECGECGKSFSRKGNLIQHQRSHTGERPYECRECRKLFRGKSHLIEHQRVHTGERPYECNECGKSFQDSSGFRVHQRVHTGEKPFECSECGKSFPQSCSLLRHRRVHTGERPYECGECGKSFHQSSSLLRHQKTHTAERPYECRECGKFFSSLLEHRRVHTGERPYECRECGKTFTRRSAHFKHQRLHTRGKPYECSECGKSFAETFSLTEHRRVHTGERPYECSECGKSFHRSSSLLRHQRVHTERSPYK

SEQ ID NO: 99985 - protein, 73 aa, Homo sapiens
  Payload ID: 19926
  Gene Name: zinc finger protein 418
  ENSP ID: ENSP00000468855
MQEGLHRMTWDCIAIGSHENSVEEWSLLSEVQRCLYHDVMLENWVLISSLGCWCGSEDEEAPSKKSISIQRVS

SEQ ID NO: 99986 - protein, 591 aa, Homo sapiens
  Payload ID: 19926
  Gene Name: zinc finger protein 418
  ENSP ID: ENSP00000468968
MCGAILGDILHLADHQGTHHKQKLHRCEAWGNKLYDSSNRPHQNQYLGEKPYRSSVEEALFVKRCKFHVSEESSIFIQSGKDFLPSSGLLLQEATHTGEKSNSKPECESPFQWGDTHYSCGECMKHSSTKHVFVQQQRLPSREECYCWECGKSFSKYDSVSNHQRVHTGKRPYECGECGKSFSHKGSLVQHQRVHTGKRPYECGECGKSFSHKGSLVQHQRVHTGERPYECGECGKSFSQNGTLIKHQRVHTGERPYECEECGKCFTQKGNLIQHQRGHTSERPYECEECGKCFSQKGTLTEHHRVHTRERPYECGECGKSFSRKGHLRNHQRGHTGERPYECGECGKSFSRKGNLIQHQRSHTGERPYECRECRKLFRGKSHLIEHQRVHTGERPYECNECGKSFQDSSGFRVHQRVHTGEKPFECSECGKSFPQSCSLLRHRRVHTGERPYECGECGKSFHQSSSLLRHQKTHTAERPYECRECGKFFSSLLEHRRVHTGERPYECRECGKTFTRRSAHFKHQRLHTRGKPYECSECGKSFAETFSLTEHRRVHTGERPYECSECGKSFHRSSSLLRHQRVHTERSPYK

SEQ ID NO: 99987 - protein, 98 aa, Homo sapiens
  Payload ID: 19926
  Gene Name: zinc finger protein 418
  ENSP ID: ENSP00000469034
MQQGTVAFEDVAVNFSQEEWSLLSEVQRCLYHDVMLENWVLISSLGCWCGSEDEEAPSKKSISIQRVSQVSTPGAGVSPKKAHSCEMCGAILGDILHL

SEQ ID NO: 99988 - protein, 128 aa, Homo sapiens
  Payload ID: 19926
  Gene Name: zinc finger protein 418
  ENSP ID: ENSP00000470127
MQGTVAFEDVAVNFSQEEWSLLSEVQRCLYHDVMLENWVLISSLGCWCGSEDEEAPSKKSISIQRVSQNVRLSAQAGVARSQLTAASTSRVQAILLPQPPGDLKGISLCPPHLFIFGKLYAFASSPRL

SEQ ID NO: 99989 - protein, 676 aa, Homo sapiens; identical to SEQ ID NO: 99983
  Payload ID: 19926
  Gene Name: zinc finger protein 418
  Uniprot ID: Q8TF45
  ENSP ID: ENSP00000471652

SEQ ID NO: 99990 - protein, 93 aa, Homo sapiens
  Payload ID: 19926
  Gene Name: zinc finger protein 418
  ENSP ID: ENSP00000472062
MQQGTVAFEDVAVNFSQEEWSLLSEVQRCLYHDVMLENWVLISSLGCWCGSEDEEAPSKKSISIQRVSQVSTPGAGVSPKKAHSCEMCGAILG

SEQ ID NO: 99991 - protein, 676 aa, Homo sapiens; identical to SEQ ID NO: 99983
  Payload ID: 19926
  Gene Name: zinc finger protein 418
  Uniprot ID: Q8TF45
  ENSP ID: ENSP00000483763

SEQ ID NO: 99992 - protein, 510 aa, Homo sapiens
  Payload ID: 19927
  Gene Name: zinc finger protein 419
  Uniprot ID: Q96HQ0
  ENSP ID: ENSP00000221735
MAAAALRDPAQVPVAADLLTDHEEGYVTFEDVAVYFSQEEWRLLDDAQRLLYRNVMLENFTLLASLGLASSKTHEITQLESWEEPFMPAWEVVTSAIPRGCWHGAEAEEAPEQIASVGLLSSNIQQHQKQHCGEKPLKRQEGRVPVLRSCKVHLSEKSLQSREVGKALLISSGVLKHQVTHTGEKSHRSSKSREAFHAGKRHYKCSECGKAFGQKYLLVQHQRLHAGKKTYECSECGKLFRDMSNLFIHQIVHTGERPYGCSNCGKSFSRNAHLIEHQRVHTGEKPFTCSECGKAFRHNSTLVQHHKIHTGVRPYECSECGKLFSFNSSLMKHQRIHTGERPYKCSECGKFYSHKSNLIKHWRVHTGERPYKCSDCGKFFTQCSSLMQHQKVHTGEKPFKCNECGRFFRENSTLVRHQRVHTGAKPYECRECGKFFSQSSTLMQHRKVHIGEKPFKCNECGRLFRENSSLVKHQRVHTGAKPYECRECGKFFRHNSSLFKHRRIHTGEMQ

SEQ ID NO: 99993 - protein, 478 aa, Homo sapiens
  Payload ID: 19927
  Gene Name: zinc finger protein 419
  Uniprot ID: Q96HQ0
  ENSP ID: ENSP00000299860
MAAAALRDPAQVPVAADLLTDHEEQGYVTFEDVAVYFSQEEWRLLDDAQRLLYRNVMLENFTLLASLGCWHGAEAEEAPEQIASVGLLSSNIQQHQKQHCGEKPLKRQEGRVPVLRSCKVHLSEKSLQSREVGKALLISSGVLKHQVTHTGEKSHRSSKSREAFHAGKRHYKCSECGKAFGQKYLLVQHQRLHAGKKTYECSECGKLFRDMSNLFIHQIVHTGERPYGCSNCGKSFSRNAHLIEHQRVHTGEKPFTCSECGKAFRHNSTLVQHHKIHTGVRPYECSECGKLFSFNSSLMKHQRIHTGERPYKCSECGKFYSHKSNLIKHWRVHTGERPYKCSDCGKFFTQCSSLMQHQKVHTGEKPFKCNECGRFFRENSTLVRHQRVHTGAKPYECRECGKFFSQSSTLMQHRKVHIGEKPFKCNECGRLFRENSSLVKHQRVHTGAKPYECRECGKFFRHNSSLFKHRRIHTGEMQ

SEQ ID NO: 99994 - protein, 442 aa, Homo sapiens
  Payload ID: 19927
  Gene Name: zinc finger protein 419
  ENSP ID: ENSP00000346136
MAAAALRDPAQQGYVTFEDVAVYFSQEEWRLLDDAQRLLYRNVMLENFTLLASLGLASSKTHEITQLESWEEPFMPAWEVVTSAIPRGCWHGAEAEEAPEQIASVGLLSSNIQQHQKQHCGEKPLKRQEGRVPVLRSCKVHLSEKSLQSREVGKALLISSGVLKHQVTHTGEKSHRSSKSREAFHAGKRHYKCSECGKAFGQKYLLVQHQRLHAGKKTYECSECGKLFRDMSNLFIHQIVHTGERPYGCSNCGKSFSRNAHLIEHQRVHTGEKPFTCSECGKAFRHNSTLVQHHKIHTGVRPYECSECGKLFSFNSSLMKHQRIHTGERPYKCSECGKFYSHKSNLIKHWRVHTGERPYKCSDCGKFFTQCSSLMQHQKVHTGEKPFKCNECGRFFRENSSLVKHQRVHTGAKPYECRECGKFFRHNSSLFKHRRIHTGEMQ

SEQ ID NO: 99995 - protein, 511 aa, Homo sapiens
  Payload ID: 19927
  Gene Name: zinc finger protein 419
  Uniprot ID: Q96HQ0
  ENSP ID: ENSP00000388864
MAAAALRDPAQVPVAADLLTDHEEQGYVTFEDVAVYFSQEEWRLLDDAQRLLYRNVMLENFTLLASLGLASSKTHEITQLESWEEPFMPAWEVVTSAIPRGCWHGAEAEEAPEQIASVGLLSSNIQQHQKQHCGEKPLKRQEGRVPVLRSCKVHLSEKSLQSREVGKALLISSGVLKHQVTHTGEKSHRSSKSREAFHAGKRHYKCSECGKAFGQKYLLVQHQRLHAGKKTYECSECGKLFRDMSNLFIHQIVHTGERPYGCSNCGKSFSRNAHLIEHQRVHTGEKPFTCSECGKAFRHNSTLVQHHKIHTGVRPYECSECGKLFSFNSSLMKHQRIHTGERPYKCSECGKFYSHKSNLIKHWRVHTGERPYKCSDCGKFFTQCSSLMQHQKVHTGEKPFKCNECGRFFRENSTLVRHQRVHTGAKPYECRECGKFFSQSSTLMQHRKVHIGEKPFKCNECGRLFRENSSLVKHQRVHTGAKPYECRECGKFFRHNSSLFKHRRIHTGEMQ

SEQ ID NO: 99996 - protein, 498 aa, Homo sapiens
  Payload ID: 19927
  Gene Name: zinc finger protein 419
  Uniprot ID: Q96HQ0
  ENSP ID: ENSP00000390916
MAAAALRDPAQQGYVTFEDVAVYFSQEEWRLLDDAQRLLYRNVMLENFTLLASLGLASSKTHEITQLESWEEPFMPAWEVVTSAIPRGCWHGAEAEEAPEQIASVGLLSSNIQQHQKQHCGEKPLKRQEGRVPVLRSCKVHLSEKSLQSREVGKALLISSGVLKHQVTHTGEKSHRSSKSREAFHAGKRHYKCSECGKAFGQKYLLVQHQRLHAGKKTYECSECGKLFRDMSNLFIHQIVHTGERPYGCSNCGKSFSRNAHLIEHQRVHTGEKPFTCSECGKAFRHNSTLVQHHKIHTGVRPYECSECGKLFSFNSSLMKHQRIHTGERPYKCSECGKFYSHKSNLIKHWRVHTGERPYKCSDCGKFFTQCSSLMQHQKVHTGEKPFKCNECGRFFRENSTLVRHQRVHTGAKPYECRECGKFFSQSSTLMQHRKVHIGEKPFKCNECGRLFRENSSLVKHQRVHTGAKPYECRECGKFFRHNSSLFKHRRIHTGEMQ

SEQ ID NO: 99997 - protein, 464 aa, Homo sapiens
  Payload ID: 19927
  Gene Name: zinc finger protein 419
  Uniprot ID: Q96HQ0
  ENSP ID: ENSP00000392129
MAAAALRDPAQGYVTFEDVAVYFSQEEWRLLDDAQRLLYRNVMLENFTLLASLGCWHGAEAEEAPEQIASVGLLSSNIQQHQKQHCGEKPLKRQEGRVPVLRSCKVHLSEKSLQSREVGKALLISSGVLKHQVTHTGEKSHRSSKSREAFHAGKRHYKCSECGKAFGQKYLLVQHQRLHAGKKTYECSECGKLFRDMSNLFIHQIVHTGERPYGCSNCGKSFSRNAHLIEHQRVHTGEKPFTCSECGKAFRHNSTLVQHHKIHTGVRPYECSECGKLFSFNSSLMKHQRIHTGERPYKCSECGKFYSHKSNLIKHWRVHTGERPYKCSDCGKFFTQCSSLMQHQKVHTGEKPFKCNECGRFFRENSTLVRHQRVHTGAKPYECRECGKFFSQSSTLMQHRKVHIGEKPFKCNECGRLFRENSSLVKHQRVHTGAKPYECRECGKFFRHNSSLFKHRRIHTGEMQ

SEQ ID NO: 99998 - protein, 497 aa, Homo sapiens
  Payload ID: 19927
  Gene Name: zinc finger protein 419
  Uniprot ID: Q96HQ0
  ENSP ID: ENSP00000414709
MAAAALRDPAQGYVTFEDVAVYFSQEEWRLLDDAQRLLYRNVMLENFTLLASLGLASSKTHEITQLESWEEPFMPAWEVVTSAIPRGCWHGAEAEEAPEQIASVGLLSSNIQQHQKQHCGEKPLKRQEGRVPVLRSCKVHLSEKSLQSREVGKALLISSGVLKHQVTHTGEKSHRSSKSREAFHAGKRHYKCSECGKAFGQKYLLVQHQRLHAGKKTYECSECGKLFRDMSNLFIHQIVHTGERPYGCSNCGKSFSRNAHLIEHQRVHTGEKPFTCSECGKAFRHNSTLVQHHKIHTGVRPYECSECGKLFSFNSSLMKHQRIHTGERPYKCSECGKFYSHKSNLIKHWRVHTGERPYKCSDCGKFFTQCSSLMQHQKVHTGEKPFKCNECGRFFRENSTLVRHQRVHTGAKPYECRECGKFFSQSSTLMQHRKVHIGEKPFKCNECGRLFRENSSLVKHQRVHTGAKPYECRECGKFFRHNSSLFKHRRIHTGEMQ

SEQ ID NO: 99999 - protein, 110 aa, Homo sapiens
  Payload ID: 19927
  Gene Name: zinc finger protein 419
  ENSP ID: ENSP00000427723
MAAAALRDPAQVPVAADLLTDHEEQGYVTFEDVAVYFSQEEWRLLDDAQRLLYRNVMLENFTLLASLGLASSKTHEITQLESWEEPFMPAWEVVTSAIPRGSWWVELREV

SEQ ID NO: 100000 - protein, 114 aa, Homo sapiens
  Payload ID: 19927
  Gene Name: zinc finger protein 419
  ENSP ID: ENSP00000428181
MAAAALRDPAQVPVAADLLTDHEEQGYVTFEDVAVYFSQEEWRLLDDAQRLLYRNVMLENFTLLASLGKVLTPHPSILSWARLFLLFLGRGLFFPKLNCGHSFLLQYPEVAIVI

SEQ ID NO: 100001 - protein, 113 aa, Homo sapiens
  Payload ID: 19927
  Gene Name: zinc finger protein 419
  ENSP ID: ENSP00000428515
MAAAALRDPAQGYVTFEDVAVYFSQEEWRLLDDAQRLLYRNVMLENFTLLASLGKVLTPHPSILSWARLFLLFLGRGLFFPKLNCGHSFLLQYPEVAIVIGLGCVYYHLLSPS

SEQ ID NO: 100002 - protein, 121 aa, Homo sapiens
  Payload ID: 19927
  Gene Name: zinc finger protein 419
  ENSP ID: ENSP00000428523
MAAAALRDPAQQGYVTFEDVAVYFSQEEWRLLDDAQRLLYRNVMLENFTLLASLGCWHGAEAEEAPEQIASVGLLSSNIQQHQKQHCGEKPLKRQEGRVPVLRSCKVHLSEKSLQSREVGK

SEQ ID NO: 100003 - protein, 97 aa, Homo sapiens
  Payload ID: 19927
  Gene Name: zinc finger protein 419
  ENSP ID: ENSP00000429471
MAAAALRDPAQQGYVTFEDVAVYFSQEEWRLLDDAQRLLYRNVMLENFTLLASLGLASSKTHEITQLESWEEPFMPAWEVVTSAIPRGSWWVELREV

SEQ ID NO: 100004 - protein, 87 aa, Homo sapiens
  Payload ID: 19927
  Gene Name: zinc finger protein 419
  ENSP ID: ENSP00000429504
MAAAALRDPAQVPVAADLLTDHEEGYVTFEDVAVYFSQEEWRLLDDAQRLLYRNVMLENFTLLASLGKVLTPHPSILSWARLFLLFL

SEQ ID NO: 100005 - protein, 173 aa, Homo sapiens
  Payload ID: 19927
  Gene Name: zinc finger protein 419
  ENSP ID: ENSP00000429628
MAAAALRDPAQVPVAADLLTDHEEGYVTFEDVAVYFSQEEWRLLDDAQRLLYRNVMLENFTLLASLGCWHGAEAEEAPEQIASVGLLSSNIQQHQKQHCGEKPLKRQEGRVPVLRSCKVHLSEKSLQSREVGKALLISSGVLKHQVTHTGEKSHRSSKSREAFHAGKRHYKCS

SEQ ID NO: 100006 - protein, 50 aa, Homo sapiens
  Payload ID: 19927
  Gene Name: zinc finger protein 419
  ENSP ID: ENSP00000429880
MLENFTLLASLGCWHGAEAEEAPEQIASVGLLSSNIQQHQKQHCGEKPLK

SEQ ID NO: 100007 - protein, 427 aa, Homo sapiens
  Payload ID: 19927
  Gene Name: zinc finger protein 419
  ENSP ID: ENSP00000481121
QGYVTFEDVAVYFSQEEWRLLDDAQRLLYRNVMLENFTLLASLGKVLTPHPSILSWARLFLLFLGRGLFFPKLNFVTSAIPRGSWAIPHLSVLHVSPSHQQNPSAVAFTECVQIASVGLLSSNIQQHQKQHCGEKPLKRQEGRVPVLRSCKVHLSEKSLQSREVGKALLISSGVLKHQVTHTGEKSHRSSKSREAFHAGKRHYKCSECGKAFGQKYLLVQHQRLHAGKKTPYGCSNCGKSFSRNAHLIEHQRVHTGEKPFTCSECGKAFRHNSTLVQHHKIHTGVRPYECSECGKLFSFNSSLMKHQRIHTGERPYKCSECGKFYSHKSNLIKHWRVHTGERPYKCSDCGKFFTQCSSLMQHQKVHTGEKPFKCNECGRFFRENSTLVRHQRVHTGAKPYECRECGKFFSQSSTLMQHRKVHIGEKP

SEQ ID NO: 100008 - protein, 536 aa, Homo sapiens
  Payload ID: 19928
  Gene Name: zinc finger protein 420
  Uniprot ID: Q8TAQ5
  ENSP ID: ENSP00000306102
MARKLVMFRDVAIDFSQEEWECLDSAQRDLYRDVMLENYSNLVSLDLPSRCASKDLSPEKNTYETELSQWEMSDRLENCDLEESNSRDYLEAKGKMEKQQENQKEYFRQGMIIYDKMSIFNQHTYLSQHSRCHSTEKPYKCKECGKAFRRASHLTQHQSIHTGEKPYECKQCGKAFSRDSQLSLHQRLHTGEKPYACKECGKAFTQSSQLILHHRIHTGEKPYKCEECGKAFIRSSQLTRHQKVHTGEKPYECKECGKAFTQNSQLTLHQRLHTGEKLYECKECRKVFTQLSQLILHKRIHTGEKPYECKECGKAFICGSQLSQHQKIHNGEKPYECKECGRAFIRGSLLMQHQRIHTGEKPYKCEECGKAFIRGSQLTQHQRIHTNEKPYECKECGKMFSHGSQLTQHQRIHTGEKPYQCKECGKAFNRGSLLTRHQRIHTGEKPYECKECGKTFSRGSELTQHERIHTAFLAGQQDRSDIYMSRRFTKSIFPVFFSVPTMWTSKLELRYSHGDFENGIWVLWIMEQKYRRSLQP

SEQ ID NO: 100009 - protein, 688 aa, Homo sapiens
  Payload ID: 19928
  Gene Name: zinc finger protein 420
  Uniprot ID: Q8TAQ5
  ENSP ID: ENSP00000338770
MARKLVMFRDVAIDFSQEEWECLDSAQRDLYRDVMLENYSNLVSLDLPSRCASKDLSPEKNTYETELSQWEMSDRLENCDLEESNSRDYLEAKGKMEKQQENQKEYFRQGMIIYDKMSIFNQHTYLSQHSRCHSTEKPYKCKECGKAFRRASHLTQHQSIHTGEKPYECKQCGKAFSRDSQLSLHQRLHTGEKPYACKECGKAFTQSSQLILHHRIHTGEKPYKCEECGKAFIRSSQLTRHQKVHTGEKPYECKECGKAFTQNSQLTLHQRLHTGEKLYECKECRKVFTQLSQLILHKRIHTGEKPYECKECGKAFICGSQLSQHQKIHNGEKPYECKECGRAFIRGSLLMQHQRIHTGEKPYKCEECGKAFIRGSQLTQHQRIHTNEKPYECKECGKMFSHGSQLTQHQRIHTGEKPYQCKECGKAFNRGSLLTRHQRIHTGEKPYECKECGKTFSRGSELTQHERIHTGEKPYECKECGKSFIRGSQLTQHQRIHTGEKPYECKECRMAFTQSSHLSQHQRLHTGEKPYVCNECGKAFARGLLLIQHQRIHTGEKPYQCKECGKAFIRGSQLTQHQRIHTGEKPYECKECGKAFSHGSQLTLHQRIHTGEKPYECRECRKAFTQSSHLSRHQRIHTGEKPYQCKECGKAFTRGSQLTQHQRIHISEKSFEYKECGIDFSHGSQVYM

SEQ ID NO: 100010 - protein, 51 aa, Homo sapiens
  Payload ID: 19928
  Gene Name: zinc finger protein 420
  ENSP ID: ENSP00000465346
MARKLVMFRDVAIDFSQEEWECLDSAQRDLYRDVMLENYSNLVSLAHQIST

SEQ ID NO: 100011 - protein, 88 aa, Homo sapiens
  Payload ID: 19928
  Gene Name: zinc finger protein 420
  ENSP ID: ENSP00000466057
MARKLVMFRDVAIDFSQEEWECLDSAQRDLYRDVMLENYSNLVSLDLPSRCASKDLSPEKNTYETELSQWEMSDRLENCDLEESNSRD

SEQ ID NO: 100012 - protein, 47 aa, Homo sapiens
  Payload ID: 19928
  Gene Name: zinc finger protein 420
  ENSP ID: ENSP00000467369
MARKLVMFRDVAIDFSQEEWECLDSAQRDLYRDVMLENYSNLVSLAL

SEQ ID NO: 100013 - protein, 163 aa, Homo sapiens
  Payload ID: 19928
  Gene Name: zinc finger protein 420
  ENSP ID: ENSP00000467772
MARKLVMFRDVAIDFSQEEWECLDSAQRDLYRDVMLENYSNLVSLDLPSRCASKDLSPEKNTYETELSQWEMSDRLENCDLEESNSRDYLEAKGKMEKQQENQKEYFRQGMIIYDKMSIFNQHTYLSQHSRCHSTEKPYKCKECGKAFRRASHLTQHQSIHTG

SEQ ID NO: 100014 - protein, 79 aa, Homo sapiens
  Payload ID: 19928
  Gene Name: zinc finger protein 420
  ENSP ID: ENSP00000468387
MSDRLENCDLEESNSRDYLEAKGKMEKQQENQKEYFRQGMIIYDKMSIFNQHTYLSQHSRCHSTEKPYKCKECGKAFRR

SEQ ID NO: 100015 - protein, 89 aa, Homo sapiens
  Payload ID: 19928
  Gene Name: zinc finger protein 420
  ENSP ID: ENSP00000468736
  MOD_RES (1)..(1): Any amino acid
XCKECGKMFSHGSQLTQHQRIHTGEKPYQCKECGKAFNRGSLLTRHQRIHTGEKPYECKECGKTFSRGSELTQHERIHTAGAPLLSWGL

SEQ ID NO: 100016 - protein, 1284 aa, Homo sapiens
  Payload ID: 19929
  Gene Name: zinc finger protein 423
  Uniprot ID: Q2M1K9
  ENSP ID: ENSP00000262383
MHKKRVEEGEASDFSLAWDSSVTAAGGLEGEPECDQKTSRALEDRNSVTSQEERNEDDEDMEDESIYTCDHCQQDFESLADLTDHRAHRCPGDGDDDPQLSWVASSPSSKDVASPTQMIGDGCDLGLGEEEGGTGLPYPCQFCDKSFIRLSYLKRHEQIHSDKLPFKCTYCSRLFKHKRSRDRHIKLHTGDKKYHCHECEAAFSRSDHLKIHLKTHSSSKPFKCTVCKRGFSSTSSLQSHMQAHKKNKEHLAKSEKEAKKDDFMCDYCEDTFSQTEELEKHVLTRHPQLSEKADLQCIHCPEVFVDENTLLAHIHQAHANQKHKCPMCPEQFSSVEGVYCHLDSHRQPDSSNHSVSPDPVLGSVASMSSATPDSSASVERGSTPDSTLKPLRGQKKMRDDGQGWTKVVYSCPYCSKRDFNSLAVLEIHLKTIHADKPQQSHTCQICLDSMPTLYNLNEHVRKLHKNHAYPVMQFGNISAFHCNYCPEMFADINSLQEHIRVSHCGPNANPSDGNNAFFCNQCSMGFLTESSLTEHIQQAHCSVGSAKLESPVVQPTQSFMEVYSCPYCTNSPIFGSILKLTKHIKENHKNIPLAHSKKSKAEQSPVSSDVEVSSPKRQRLSASANSISNGEYPCNQCDLKFSNFESFQTHLKLHLELLLRKQACPQCKEDFDSQESLLQHLTVHYMTTSTHYVCESCDKQFSSVDDLQKHLLDMHTFVLYHCTLCQEVFDSKVSIQVHLAVKHSNEKKMYRCTACNWDFRKEADLQVHVKHSHLGNPAKAHKCIFCGETFSTEVELQCHITTHSKKYNCKFCSKAFHAIILLEKHLREKHCVFDAATENGTANGVPPMATKKAEPADLQGMLLKNPEAPNSHEASEDDVDASEPMYGCDICGAAYTMEVLLQNHRLRDHNIRPGEDDGSRKKAEFIKGSHKCNVCSRTFFSENGLREHLQTHRGPAKHYMCPICGERFPSLLTLTEHKVTHSKSLDTGTCRICKMPLQSEEEFIEHCQMHPDLRNSLTGFRCVVCMQTVTSTLELKIHGTFHMQKLAGSSAASSPNGQGLQKLYKCALCLKEFRSKQDLVKLDVNGLPYGLCAGCMARSANGQVGGLAPPEPADRPCAGLRCPECSVKFESAEDLESHMQVDHRDLTPETSGPRKGTQTSPVPRKKTYQCIKCQMTFENEREIQIHVANHMIEEGINHECKLCNQMFDSPAKLLCHLIEHSFEGMGGTFKCPVCFTVFVQANKLQQHIFAVHGQEDKIYDCSQCPQKFFFQTELQNHTMSQHAQ

SEQ ID NO: 100017 - protein, 1167 aa, Homo sapiens
  Payload ID: 19929
  Gene Name: zinc finger protein 423
  ENSP ID: ENSP00000442321
MIGDGCDLGLGEEEGGTGLPYPCQFCDKSFIRLSYLKRHEQIHSDKLPFKCTYCSRLFKHKRSRDRHIKLHTGDKKYHCHECEAAFSRSDHLKIHLKTHSSSKPFKCTVCKRGFSSTSSLQSHMQAHKKNKEHLAKSEKEAKKDDFMCDYCEDTFSQTEELEKHVLTRHPQLSEKADLQCIHCPEVFVDENTLLAHIHQAHANQKHKCPMCPEQFSSVEGVYCHLDSHRQPDSSNHSVSPDPVLGSVASMSSATPDSSASVERGSTPDSTLKPLRGQKKMRDDGQGWTKVVYSCPYCSKRDFNSLAVLEIHLKTIHADKPQQSHTCQICLDSMPTLYNLNEHVRKLHKNHAYPVMQFGNISAFHCNYCPEMFADINSLQEHIRVSHCGPNANPSDGNNAFFCNQCSMGFLTESSLTEHIQQAHCSVGSAKLESPVVQPTQSFMEVYSCPYCTNSPIFGSILKLTKHIKENHKNIPLAHSKKSKAEQSPVSSDVEVSSPKRQRLSASANSISNGEYPCNQCDLKFSNFESFQTHLKLHLELLLRKQACPQCKEDFDSQESLLQHLTVHYMTTSTHYVCESCDKQFSSVDDLQKHLLDMHTFVLYHCTLCQEVFDSKVSIQVHLAVKHSNEKKMYRCTACNWDFRKEADLQVHVKHSHLGNPAKAHKCIFCGETFSTEVELQCHITTHSKKYNCKFCSKAFHAIILLEKHLREKHCVFDAATENGTANGVPPMATKKAEPADLQGMLLKNPEAPNSHEASEDDVDASEPMYGCDICGAAYTMEVLLQNHRLRDHNIRPGEDDGSRKKAEFIKGSHKCNVCSRTFFSENGLREHLQTHRGPAKHYMCPICGERFPSLLTLTEHKVTHSKSLDTGTCRICKMPLQSEEEFIEHCQMHPDLRNSLTGFRCVVCMQTVTSTLELKIHGTFHMQKLAGSSAASSPNGQGLQKLYKCALCLKEFRSKQDLVKLDVNGLPYGLCAGCMARSANGQVGGLAPPEPADRPCAGLRCPECSVKFESAEDLESHMQVDHRDLTPETSGPRKGTQTSPVPRKKTYQCIKCQMTFENEREIQIHVANHMIEEGINHECKLCNQMFDSPAKLLCHLIEHSFEGMGGTFKCPVCFTVFVQANKLQQHIFAVHGQEDKIYDCSQCPQKFFFQTELQNHTMSQHAQ

SEQ ID NO: 100018 - protein, 1167 aa, Homo sapiens; identical to SEQ ID NO: 100017
  Payload ID: 19929
  Gene Name: zinc finger protein 423
  ENSP ID: ENSP00000455061

SEQ ID NO: 100019 - protein, 1284 aa, Homo sapiens; identical to SEQ ID NO: 100016
  Payload ID: 19929
  Gene Name: zinc finger protein 423
  Uniprot ID: Q2M1K9
  ENSP ID: ENSP00000455426

SEQ ID NO: 100020 - protein, 1224 aa, Homo sapiens
  Payload ID: 19929
  Gene Name: zinc finger protein 423
  Uniprot ID: Q2M1K9
  ENSP ID: ENSP00000455588
MEDESIYTCDHCQQDFESLADLTDHRAHRCPGDGDDDPQLSWVASSPSSKDVASPTQMIGDGCDLGLGEEEGGTGLPYPCQFCDKSFIRLSYLKRHEQIHSDKLPFKCTYCSRLFKHKRSRDRHIKLHTGDKKYHCHECEAAFSRSDHLKIHLKTHSSSKPFKCTVCKRGFSSTSSLQSHMQAHKKNKEHLAKSEKEAKKDDFMCDYCEDTFSQTEELEKHVLTRHPQLSEKADLQCIHCPEVFVDENTLLAHIHQAHANQKHKCPMCPEQFSSVEGVYCHLDSHRQPDSSNHSVSPDPVLGSVASMSSATPDSSASVERGSTPDSTLKPLRGQKKMRDDGQGWTKVVYSCPYCSKRDFNSLAVLEIHLKTIHADKPQQSHTCQICLDSMPTLYNLNEHVRKLHKNHAYPVMQFGNISAFHCNYCPEMFADINSLQEHIRVSHCGPNANPSDGNNAFFCNQCSMGFLTESSLTEHIQQAHCSVGSAKLESPVVQPTQSFMEVYSCPYCTNSPIFGSILKLTKHIKENHKNIPLAHSKKSKAEQSPVSSDVEVSSPKRQRLSASANSISNGEYPCNQCDLKFSNFESFQTHLKLHLELLLRKQACPQCKEDFDSQESLLQHLTVHYMTTSTHYVCESCDKQFSSVDDLQKHLLDMHTFVLYHCTLCQEVFDSKVSIQVHLAVKHSNEKKMYRCTACNWDFRKEADLQVHVKHSHLGNPAKAHKCIFCGETFSTEVELQCHITTHSKKYNCKFCSKAFHAIILLEKHLREKHCVFDAATENGTANGVPPMATKKAEPADLQGMLLKNPEAPNSHEASEDDVDASEPMYGCDICGAAYTMEVLLQNHRLRDHNIRPGEDDGSRKKAEFIKGSHKCNVCSRTFFSENGLREHLQTHRGPAKHYMCPICGERFPSLLTLTEHKVTHSKSLDTGTCRICKMPLQSEEEFIEHCQMHPDLRNSLTGFRCVVCMQTVTSTLELKIHGTFHMQKLAGSSAASSPNGQGLQKLYKCALCLKEFRSKQDLVKLDVNGLPYGLCAGCMARSANGQVGGLAPPEPADRPCAGLRCPECSVKFESAEDLESHMQVDHRDLTPETSGPRKGTQTSPVPRKKTYQCIKCQMTFENEREIQIHVANHMIEEGINHECKLCNQMFDSPAKLLCHLIEHSFEGMGGTFKCPVCFTVFVQANKLQQHIFAVHGQEDKIYDCSQCPQKFFFQTELQNHTMSQHAQ

SEQ ID NO: 100021 - protein, 1224 aa, Homo sapiens; identical to SEQ ID NO: 100020
  Payload ID: 19929
  Gene Name: zinc finger protein 423
  Uniprot ID: Q2M1K9
  ENSP ID: ENSP00000457664

SEQ ID NO: 100022 - protein, 1224 aa, Homo sapiens; identical to SEQ ID NO: 100020
  Payload ID: 19929
  Gene Name: zinc finger protein 423
  Uniprot ID: Q2M1K9
  ENSP ID: ENSP00000457928

SEQ ID NO: 100023 - protein, 102 aa, Homo sapiens
  Payload ID: 19929
  Gene Name: zinc finger protein 423
  ENSP ID: ENSP00000479288
  MOD_RES (1)..(1): Any amino acid
XEEGEASDFSLAWDSSVTAAGGLEGEPECDQKTSRALEDRNSVTSQEERNEDDEDMEDESIYTCDHCQQDFESLADLTDHRAHRCPGGNAKQPQDSDRWLHG

SEQ ID NO: 100024 - protein, 752 aa, Homo sapiens
  Payload ID: 19930
  Gene Name: zinc finger protein 425
  Uniprot ID: Q6IV72
  ENSP ID: ENSP00000367300
MAEPASVTVTFDDVALYFSEQEWEILEKWQKQMYKQEMKTNYETLDSLGYAFSKPDLITWMEQGRMLLISEQGCLDKTRRTTSPPTDEQLNMKNTGKLLCFDDEGTPRTKEEDCRLNGPQKQDLCAALRGKERKILLAQTATFQSPSLRETEILNKKVSITAYDPDKKDLRHKPRETPGRLEIPTGPRCYSCYVCRKVFQVRRDLLKHKRSHSKSQLCRYPKYKNSSRGKSELRRTQRLLCQKKRFQCSECEKSYFLKGSLVTHQVVHTGQRPYPCPECDKTFRYRANLKKHLCLHRGERPFCCGECGRAFVQQCELTEHLRLHSGEKPFQCPQCDRCFRLKRGMKVHLTQHSGKRPFHCPECGRSFSRKAALKTHQRTHSEEKPFSCGECGRKFIYKIKLDEHIRVHTGEKPFSCPECNKSFRLKRSLKAHGLQHIGKRPFQCPECSRGFFWRNAMRAHQRLHSEQKPFPCAECGKRFTRPSKLACHTRVHDRQKEFPCGECKKTFSQQSRLTQHLKVHTTEKPFSCAECGRSFRRRAHLTEHTRLHSGEEPFQCPECDKSFSWKASMKFHQRMHRDEKPFACGECDKTYTHQSQLTEHLRLHSGEKPYQCPECEKTFRLKGNLKSHLLQHSGQKPFSCVMCGKSFTQQYRLTEHIRVHSGEKPFQCPECDKSYCIRGSLKVHLYKHSGERPFQCPECGKGFLQKRSLKAHLCLHSGERPFSCDECGRSFTYVGALKTHIAVHAKEKPSSL

SEQ ID NO: 100025 - protein, 149 aa, Homo sapiens
  Payload ID: 19930
  Gene Name: zinc finger protein 425
  ENSP ID: ENSP00000420379
MAEPASVRRAGGGCRLCRNSGPCRSWIGVTVTFDDVALYFSEQEWEILEKWQKQMYKQEMKTNYETLDSLGYAFSKPDLITWMEQGRMLLISEQGCLDKTRRTTSPPTDEQLNMKNTGKLLCFDDEGTPRTKEEDCRLNGPQKQDLCAA

SEQ ID NO: 100026 - protein, 554 aa, Homo sapiens
  Payload ID: 19931
  Gene Name: zinc finger protein 426
  Uniprot ID: Q9BUY5
  ENSP ID: ENSP00000253115
MAAADLSHGHYLSGDPVCLHEEKTPAGRIVADCLTDCYQDSVTFDDVAVDFTQEEWTLLDSTQRSLYSDVMLENYKNLATVGGQIIKPSLISWLEQEESRTVQGGVLQGWEMRLETQWSILQQDFLRGQTSIGIQLEGKHNGRELCDCEQCGEVFSEHSCLKTHVRTQSTGNTHDCNQYGKDFLTLCEKTSTGEKLSEFNQSEKIFSLTPNIVYQRTSTQEKSFECSHCGKSFINESYLQAHMRTHNGEKLYEWRNYGPGFIDSTSLSVLIETLNAKKPYKCKECGKGYRYPAYLSIHMRTHTGEKPYECKECGKAFNYSNSFQIHGRTHTGEKPYVCKECGKAFTQYSGLSMHVRSHSGDKPYECKECGKSFLTSSRLIQHIRTHTGEKPFVCVECGKAFAVSSNLSGHLRTHTEEKACECKICGKVFGYPSCLNNHMRTHSAQKPYTCKECGKAFNYSTHLKIHMRIHTGEKPYECKQCGKAFSHSSSFQIHERTHTGEKPYECKECGKAFTCSSSFRIHEKTHTEEKPYKCQQCGKAYSHPRSLRRHEQIH

SEQ ID NO: 100027 - protein, 554 aa, Homo sapiens; identical to SEQ ID NO: 100026
  Payload ID: 19931
  Gene Name: zinc finger protein 426
  Uniprot ID: Q9BUY5
  ENSP ID: ENSP00000439017

SEQ ID NO: 100028 - protein, 118 aa, Homo sapiens
  Payload ID: 19931
  Gene Name: zinc finger protein 426
  ENSP ID: ENSP00000466469
MAAADLSHGHYLSGDPVCLHEEKTPAGRIVADCLTDCYQDSVTFDDVAVDFTQEEWTLLDSTQRSLYSDVMLENYKNLATVGGQIIKPSLISWLEQEESRTVQGGVLQGRKTQWKGTL

SEQ ID NO: 100029 - protein, 516 aa, Homo sapiens
  Payload ID: 19931
  Gene Name: zinc finger protein 426
  ENSP ID: ENSP00000468100
MDSVTFDDVAVDFTQEEWTLLDSTQRSLYSDVMLENYKNLATVGGQIIKPSLISWLEQEESRTVQGGVLQGWEMRLETQWSILQQDFLRGQTSIGIQLEGKHNGRELCDCEQCGEVFSEHSCLKTHVRTQSTGNTHDCNQYGKDFLTLCEKTSTGEKLSEFNQSEKIFSLTPNIVYQRTSTQEKSFECSHCGKSFINESYLQAHMRTHNGEKLYEWRNYGPGFIDSTSLSVLIETLNAKKPYKCKECGKGYRYPAYLSIHMRTHTGEKPYECKECGKAFNYSNSFQIHGRTHTGEKPYVCKECGKAFTQYSGLSMHVRSHSGDKPYECKECGKSFLTSSRLIQHIRTHTGEKPFVCVECGKAFAVSSNLSGHLRTHTEEKACECKICGKVFGYPSCLNNHMRTHSAQKPYTCKECGKAFNYSTHLKIHMRIHTGEKPYECKQCGKAFSHSSSFQIHERTHTGEKPYECKECGKAFTCSSSFRIHEKTHTEEKPYKCQQCGKAYSHPRSLRRHEQIH

SEQ ID NO: 100030 - protein, 188 aa, Homo sapiens
  Payload ID: 19932
  Gene Name: zinc finger protein 428
  Uniprot ID: Q96B54
  ENSP ID: ENSP00000300811
MTETREPAETGGYASLEEDDEDLSPGPEHSSDSEYTLSEPDSEEEEDEEEEEEETTDDPEYDPGYKVKQRLGGGRGGPSRRAPRAAQPPAQPCQLCGRSPLGEAPPGTPPCRLCCPATAPQEAPAPEGRALGEEEEEPPRAGEGRPAGREEEEEEEEEGTYHCTECEDSFDNLGELHGHFMLHARGEV

SEQ ID NO: 100031 - protein, 218 aa, Homo sapiens
  Payload ID: 19932
  Gene Name: zinc finger protein 428
  ENSP ID: ENSP00000469484
MTETREPAETGGYASLEEDDEDLSPGWKGVAQSWLKCSLELLGSSDPPASASREAGTTGPEHSSDSEYTLSEPDSEEEEDEEEEEEETTDDPEYDPGYKVKQRLGGGRGGPSRRAPRAAQPPAQPCQLCGRSPLGEAPPGTPPCRLCCPATAPQEAPAPEGRALGEEEEEPPRAGEGRPAGREEEEEEEEEGTYHCTECEDSFDNLGELHGHFMLHAR

SEQ ID NO: 100032 - protein, 674 aa, Homo sapiens
  Payload ID: 19933
  Gene Name: zinc finger protein 429
  Uniprot ID: Q86V71
  ENSP ID: ENSP00000351280
MGPLTFTDVAIEFSLEEWQCLDTAQQNLYRNVMLENYRNLVFLGIAVSKPDLITCLEKEKEPCKMKRHEMVDEPPVVCSHFAEDFWPEQDIKDSFQKVTLRRYDKRGHENLQLRKGYKTVGDCKLYKGGYNGLNQCLTLTQSKMYHCDIYVKVFYAFSNADRYKTRHTGKKPFQCKKCGKSFCMLSQLTQHKKIHIRENTYRCKEFGNAFNQSSALTNHKRIYVGEKHYRCEECGKAFNHYSTLTNHKRIHTGEKPYKCKECGKAFSRYSTLTTHKRIHSGEKPYKCDECGKTFSISSTFTKHKIIHTEEKPYKCKECGKAFNRSSTLTSHKRIHTGEKPYKCEECGKAFNWSSTLTKHKVIHTGEKPYKCEECGKAFNQSSRLTRHKKIHTGEEPYKFEKCGRVFTCSSTLTQDKKIHTGEKPYNCEECGKVFTYSSTLTRHKRIHTEEKPYKCNECGKAFNRSSHLTSHRRIHTGEKPYKCEECGKAFKQSSNLNSHKKIHSGEKPYKCEECGKAFILSSRLTQHKKIHTGEKPYKCEECGKAFNRSSRLTQHKKIHTGEKPYKCKQCDKAFTHSSNLSSHKKIHSGEKPYKCEECGKAFNRSSRLTQHKKIHTREKPYKCEECAKAFTRSSRLTQHKKIHRMGVVAHACNPSTLGGRGGRITRSGDRDRPG

SEQ ID NO: 100033 - protein, 93 aa, Homo sapiens
  Payload ID: 19933
  Gene Name: zinc finger protein 429
  ENSP ID: ENSP00000469739
  MOD_RES (1)..(1): Any amino acid
XGVSLLLPRLECSGTISAHYNFPLPGSSDSPASASSVVGITGLLQLARGPLQTLFTWESQIEAVEWQKLLPAPSSGSFITEGHQPDANRSSPV

SEQ ID NO: 100034 - protein, 122 aa, Homo sapiens
  Payload ID: 19933
  Gene Name: zinc finger protein 429
  ENSP ID: ENSP00000470300
MGPLTFTDVAIEFSLEEWQCLDTAQQNLYRNVMLENYRNLVFLGIAVSKPDLITCLEKEKEPCKMKRHEMVDEPPDGVSLLLPRLECSGTISAHYNFPLPGSSDSPASASSVVGITGWGTSG

SEQ ID NO: 100035 - protein, 585 aa, Homo sapiens
  Payload ID: 19933
  Gene Name: zinc finger protein 429
  ENSP ID: ENSP00000479286
MGPLTFTDVAIEFSLEEWQCLDTAQQNLYRNVMLENYRNLVFLGIAVSKPDLITCLEKEKEPCKMKRHEMVDEPPVVCSHFAEDFWPEQDIKDSFQKVTLRRYDKRGHENLQLRKGYKTVGDCKLYKGGYNGLNQCLTLTQSKMYHCDIYVKVFYAFSNADRYKTRHTGKKPFQCKKCGKSFCMLSQLTQHKKIHIRENTYRCKEFGNAFNQSSALTNHKRIYVGEKHYRCEECGKAFNHYSTLTNHKRIHSGEKPYKCDECGKTFSISSTFTKHKIIHTEEKPYKCKECGKAFNRPQPLLAIIHTGEKPYKCEECAKPLTGLQLTKHKVIHTGEKPYKCEECGKAFNQSSRLTRHKKIHTGEEPYKFEKCGRVFTCSSTLTQDKKIHTGEKPYNCEECGKVFTYSSTLTRHKRIHTEEKPYKCNECGKAFNRSSHLTSHRRIHTGEKPYKCEECGKAFKQSSNLNSHKKIHSGEKPYKCEECGKAFILSSRLTQHKKIHTGEKPYKCEECGKAFNRSSRLTQHKKIHTGEKPYKCKQCDKAFTHSSNLSSHKKIHSGEKPYKCEECGKAFNRSSRLTQHKKENS

SEQ ID NO: 100036 - protein, 809 aa, Homo sapiens
  Payload ID: 19934
  Gene Name: zinc finger protein 43
  Uniprot ID: P17038
  ENSP ID: ENSP00000347045
MGPLTFMDVAIEFCLEEWQCLDIAQQNLYRNVMLENYRNLVFLGIAVSKPDLITCLEQEKEPWEPMRRHEMVAKPPVMCSHFTQDFWPEQHIKDPFQKATLRRYKNCEHKNVHLKKDHKSVDECKVHRGGYNGFNQCLPATQSKIFLFDKCVKAFHKFSNSNRHKISHTEKKLFKCKECGKSFCMLPHLAQHKIIHTRVNFCKCEKCGKAFNCPSIITKHKRINTGEKPYTCEECGKVFNWSSRLTTHKKNYTRYKLYKCEECGKAFNKSSILTTHKIIRTGEKFYKCKECAKAFNQSSNLTEHKKIHPGEKPYKCEECGKAFNWPSTLTKHKRIHTGEKPYTCEECGKAFNQFSNLTTHKRIHTAEKFYKCTECGEAFSRSSNLTKHKKIHTEKKPYKCEECGKAFKWSSKLTEHKLTHTGEKPYKCEECGKAFNWPSTLTKHNRIHTGEKPYKCEVCGKAFNQFSNLTTHKRIHTAEKPYKCEECGKAFSRSSNLTKHKKIHIEKKPYKCEECGKAFKWSSKLTEHKITHTGEKPYKCEECGKAFNHFSILTKHKRIHTGEKPYKCEECGKAFTQSSNLTTHKKIHTGEKFYKCEECGKAFTQSSNLTTHKKIHTGGKPYKCEECGKAFNQFSTLTKHKIIHTEEKPYKCEECGKAFKWSSTLTKHKIIHTGEKPYKCEECGKAFKLSSTLSTHKIIHTGEKPYKCEKCGKAFNRSSNLIEHKKIHTGEQPYKCEECGKAFNYSSHLNTHKRIHTKEQPYKCKECGKAFNQYSNLTTHNKIHTGEKLYKPEDVTVILTTPQTFSNIK

SEQ ID NO: 100037 - protein, 818 aa, Homo sapiens
  Payload ID: 19934
  Gene Name: zinc finger protein 43
  ENSP ID: ENSP00000350085
MPGHPGSWEMGPLTFMDVAIEFCLEEWQCLDIAQQNLYRNVMLENYRNLVFLGIAVSKPDLITCLEQEKEPWEPMRRHEMVAKPPVMCSHFTQDFWPEQHIKDPFQKATLRRYKNCEHKNVHLKKDHKSVDECKVHRGGYNGFNQCLPATQSKIFLFDKCVKAFHKFSNSNRHKISHTEKKLFKCKECGKSFCMLPHLAQHKIIHTRVNFCKCEKCGKAFNCPSIITKHKRINTGEKPYTCEECGKVFNWSSRLTTHKKNYTRYKLYKCEECGKAFNKSSILTTHKIIRTGEKFYKCKECAKAFNQSSNLTEHKKIHPGEKPYKCEECGKAFNWPSTLTKHKRIHTGEKPYTCEECGKAFNQFSNLTTHKRIHTAEKFYKCTECGEAFSRSSNLTKHKKIHTEKKPYKCEECGKAFKWSSKLTEHKLTHTGEKPYKCEECGKAFNWPSTLTKHNRIHTGEKPYKCEVCGKAFNQFSNLTTHKRIHTAEKPYKCEECGKAFSRSSNLTKHKKIHIEKKPYKCEECGKAFKWSSKLTEHKITHTGEKPYKCEECGKAFNHFSILTKHKRIHTGEKPYKCEECGKAFTQSSNLTTHKKIHTGEKFYKCEECGKAFTQSSNLTTHKKIHTGGKPYKCEECGKAFNQFSTLTKHKIIHTEEKPYKCEECGKAFKWSSTLTKHKIIHTGEKPYKCEECGKAFKLSSTLSTHKIIHTGEKPYKCEKCGKAFNRSSNLIEHKKIHTGEQPYKCEECGKAFNYSSHLNTHKRIHTKEQPYKCKECGKAFNQYSNLTTHNKIHTGEKLYKPEDVTVILTTPQTFSNIK

SEQ ID NO: 100038 - protein, 121 aa, Homo sapiens
  Payload ID: 19934
  Gene Name: zinc finger protein 43
  ENSP ID: ENSP00000469424
MRRHEMVAKPPVMCSHFTQDFWPEQHIKDPFQKATLRRYKNCEHKNVHLKKDHKSVDECKVHRGGYNGFNQCLPATQSKIFLFDKCVKAFHKFSNSNRHKISHTEKKLFKCKECGKSFCML

SEQ ID NO: 100039 - protein, 803 aa, Homo sapiens
  Payload ID: 19934
  Gene Name: zinc finger protein 43
  Uniprot ID: P17038
  ENSP ID: ENSP00000469578
MDVAIEFCLEEWQCLDIAQQNLYRNVMLENYRNLVFLGIAVSKPDLITCLEQEKEPWEPMRRHEMVAKPPVMCSHFTQDFWPEQHIKDPFQKATLRRYKNCEHKNVHLKKDHKSVDECKVHRGGYNGFNQCLPATQSKIFLFDKCVKAFHKFSNSNRHKISHTEKKLFKCKECGKSFCMLPHLAQHKIIHTRVNFCKCEKCGKAFNCPSIITKHKRINTGEKPYTCEECGKVFNWSSRLTTHKKNYTRYKLYKCEECGKAFNKSSILTTHKIIRTGEKFYKCKECAKAFNQSSNLTEHKKIHPGEKPYKCEECGKAFNWPSTLTKHKRIHTGEKPYTCEECGKAFNQFSNLTTHKRIHTAEKFYKCTECGEAFSRSSNLTKHKKIHTEKKPYKCEECGKAFKWSSKLTEHKLTHTGEKPYKCEECGKAFNWPSTLTKHNRIHTGEKPYKCEVCGKAFNQFSNLTTHKRIHTAEKPYKCEECGKAFSRSSNLTKHKKIHIEKKPYKCEECGKAFKWSSKLTEHKITHTGEKPYKCEECGKAFNHFSILTKHKRIHTGEKPYKCEECGKAFTQSSNLTTHKKIHTGEKFYKCEECGKAFTQSSNLTTHKKIHTGGKPYKCEECGKAFNQFSTLTKHKIIHTEEKPYKCEECGKAFKWSSTLTKHKIIHTGEKPYKCEECGKAFKLSSTLSTHKIIHTGEKPYKCEKCGKAFNRSSNLIEHKKIHTGEQPYKCEECGKAFNYSSHLNTHKRIHTKEQPYKCKECGKAFNQYSNLTTHNKIHTGEKLYKPEDVTVILTTPQTFSNIK

SEQ ID NO: 100040 - protein, 803 aa, Homo sapiens; identical to SEQ ID NO: 100039
  Payload ID: 19934
  Gene Name: zinc finger protein 43
  Uniprot ID: P17038
  ENSP ID: ENSP00000469645

SEQ ID NO: 100041 - protein, 803 aa, Homo sapiens; identical to SEQ ID NO: 100039
  Payload ID: 19934
  Gene Name: zinc finger protein 43
  Uniprot ID: P17038
  ENSP ID: ENSP00000470275

SEQ ID NO: 100042 - protein, 53 aa, Homo sapiens
  Payload ID: 19934
  Gene Name: zinc finger protein 43
  ENSP ID: ENSP00000470996
MRRHEMVAKPPVMCSHFTQDFWPEQHIKDPFQKATLRRYKNCEHKNVHLKKDH

SEQ ID NO: 100043 - protein, 60 aa, Homo sapiens
  Payload ID: 19934
  Gene Name: zinc finger protein 43
  ENSP ID: ENSP00000471176
MDVAIEFCLEEWQCLDIAQQNLYRNVMLENYRNLVFLGIAVSKPDLITCLEQEKEPWEPM

SEQ ID NO: 100044 - protein, 84 aa, Homo sapiens
  Payload ID: 19934
  Gene Name: zinc finger protein 43
  ENSP ID: ENSP00000471373
MDVAIEFCLEEWQCLDIAQQNLYRNVMLENYRNLVFLGIAVSKPDLITCLEQEKEPWEPMRRHEMVAKPPGGIVSLLNVFFDVQ

SEQ ID NO: 100045 - protein, 475 aa, Homo sapiens
  Payload ID: 19934
  Gene Name: zinc finger protein 43
  ENSP ID: ENSP00000485165
  MOD_RES (1)..(1): Any amino acid
XHTGEKPYTCEECGKAFNQFSNLTTHKRIHTAEKFYKCTECGEAFSRSSNLTKHKKIHTEKKPYKCEECGKAFKWSSKLTEHKLTHTGEKPYKCEECGKAFNWPSTLTKHNRIHTGEKPYKCEVCGKAFNQFSNLTTHKRIHTAEKPYKCEECGKAFSRSSNLTKHKKIHIEKKPYKCEECGKAFKWSSKLTEHKITHTGEKPYKCEECGKAFNHFSILTKHKRIHTGEKPYKCEECGKAFTQSSNLTTHKKIHTGEKFYKCEECGKAFTQSSNLTTHKKIHTGGKPYKCEECGKAFNQFSTLTKHKIIHTEEKPYKCEECGKAFKWSSTLTKHKIIHTGEKPYKCEECGKAFKLSSTLSTHKIIHTGEKPYKCEKCGKAFNRSSNLIEHKKIHTGEQPYKCEECGKAFNYSSHLNTHKRIHTKEQPYKCKECGKAFNQYSNLTTHNKIHTGEKLYKPEDVTVILTTPQTFSNIK

SEQ ID NO: 100046 - protein, 475 aa, Homo sapiens; identical to SEQ ID NO: 100045
  Payload ID: 19934
  Gene Name: zinc finger protein 43
  ENSP ID: ENSP00000485406
  MOD_RES (1)..(1): Any amino acid

SEQ ID NO: 100047 - protein, 475 aa, Homo sapiens; identical to SEQ ID NO: 100045
  Payload ID: 19934
  Gene Name: zinc finger protein 43
  ENSP ID: ENSP00000485470
  MOD_RES (1)..(1): Any amino acid

SEQ ID NO: 100048 - protein, 475 aa, Homo sapiens; identical to SEQ ID NO: 100045
  Payload ID: 19934
  Gene Name: zinc finger protein 43
  ENSP ID: ENSP00000485651
  MOD_RES (1)..(1): Any amino acid

SEQ ID NO: 100049 - protein, 570 aa, Homo sapiens
  Payload ID: 19935
  Gene Name: zinc finger protein 430
  Uniprot ID: Q9H8G1
  ENSP ID: ENSP00000261560
MENLKSGVYPLKEASGCPGADRNLLVYSFYEKGPLTFRDVAIEFSLEEWQCLDTAQQDLYRKVMLENYRNLVFLAGIAVSKPDLITCLEQGKEPWNMKRHAMVDQPPVTYSHFAQDLWPEQGIKDSFQEVILRRYGKCGHEDLQLRTGCKSVDECNLHKECYDELNQCLTTTQSEIFQYDKYVNVFYKFSNPNIQKIRHTGKKPFKCKKCDKSFCMLLHLTQHKRIHIRENSYQCEECGKVFNWFSTLTRHRRIHTGEKPYKCEQCGKAFKQSSTLTTHKIIHTGEKPYRCEECGKTFNRSSHLTTHKRIHTGEKPYRCEECGRAFNRSSHLTTHKIIHTGEKPYKCEECGKAFNQSSTLTTHKIIHAGEKPYKCEECGKAFYRFSYLTKHKIIHTGEKFYKCEECGKGFNWSSTLTKHKRIHTGEKPYKCEQCGKAFNESSNLTAHKIIHTGEKPYKCEECGKAFNRSPKLTAHKVIHSGEKPYKCEECGKAFNQFSNLTKHKITHIGDTSYKYLECDKAFSQSSTLTKHKVIHTGEKPYNCEEYGKAFNQSSNLIEQSNSYWRETLQM

SEQ ID NO: 100050 - protein, 108 aa, Homo sapiens
  Payload ID: 19935
  Gene Name: zinc finger protein 430
  ENSP ID: ENSP00000469148
MENLKSGVYPLKEASGCPGADRNLLVYSFYEKGPLTFRDVAIEFSLEEWQCLDTAQQDLYRKVMLENYRNLVFLGIAVSKPDLITCLEQGKEPWNMKRHAMVDQPPGR

SEQ ID NO: 100051 - protein, 73 aa, Homo sapiens
  Payload ID: 19935
  Gene Name: zinc finger protein 430
  ENSP ID: ENSP00000469787
  MOD_RES (1)..(1): Any amino acid
XLTKHKITHIGDTSYKYLECDKAFSQSSTLTKHKNIHTEEEPYECEEYGKAFNKSSILTRHKIILAGCGGSHL

SEQ ID NO: 100052 - protein, 113 aa, Homo sapiens
  Payload ID: 19935
  Gene Name: zinc finger protein 430
  ENSP ID: ENSP00000471313
MENLKSGVYPLKEASGCPGADRNLLVYSFYEKGPLTFRDVAIEFSLEEWQCLDTAQQDLYRKVMLENYRNLVFLAGIAVSKPDLITCLEQGKEPWNMKRHAMVDQPPGWSAMA

SEQ ID NO: 100053 - protein, 128 aa, Homo sapiens
  Payload ID: 19935
  Gene Name: zinc finger protein 430
  ENSP ID: ENSP00000473069
MENLKSGVYPLKEASGCPGADRNLLVYSFYEKGPLTFRDVAIEFSLEEWQCLDTAQQDLYRKVMLENYRNLVFLAGIAVSKPDLITCLEQGKEPWNMKRHAMVDQPPESVFLRLDLGLLVSRDLTALA

SEQ ID NO: 100054 - protein, 107 aa, Homo sapiens
  Payload ID: 19935
  Gene Name: zinc finger protein 430
  ENSP ID: ENSP00000481970
MENLKSGVYPLKEASGCPGADRNLLVYSFYEKGPLTFRDVAIEFSLEEWQCLDTAQQDLYRKVMLENYRNLVFLAGIAVSKPDLITCLEQGKEPWNMKRHAMVDQPP

SEQ ID NO: 100055 - protein, 107 aa, Homo sapiens; identical to SEQ ID NO: 100054
  Payload ID: 19935
  Gene Name: zinc finger protein 430
  ENSP ID: ENSP00000485069

SEQ ID NO: 100056 - protein, 108 aa, Homo sapiens; identical to SEQ ID NO: 100050
  Payload ID: 19935
  Gene Name: zinc finger protein 430
  ENSP ID: ENSP00000485210

SEQ ID NO: 100057 - protein, 107 aa, Homo sapiens; identical to SEQ ID NO: 100054
  Payload ID: 19935
  Gene Name: zinc finger protein 430
  ENSP ID: ENSP00000485410

SEQ ID NO: 100058 - protein, 107 aa, Homo sapiens
  Payload ID: 19935
  Gene Name: zinc finger protein 430
  ENSP ID: ENSP00000487036
ENLKSGVYPLKEASGCPGADRNLLVYSFYEKGPLTFRDVAIEFSLEEWQCLDTAQQDLYRKVMLENYRNLVFLGIAVSKPDLITCLEQGKEPWNMKRHAMVDQPPGR

SEQ ID NO: 100059 - protein, 576 aa, Homo sapiens
  Payload ID: 19936
  Gene Name: zinc finger protein 431
  Uniprot ID: Q8TF32
  ENSP ID: ENSP00000308578
MDDLKYGVYPLKEASGCPGAERNLLVYSYFEKETLTFRDVAIEFSLEEWECLNPAQQNLYMNVMLENYKNLVFLGVAVSKQDPVTCLEQEKEPWNMKRHEMVDEPPAMCSYFTKDLWPEQDIKDSFQQVILRRYGKCEHENLQLRKGSASVDEYKVHKEGYNELNQCLTTTQSKIFPCDKYVKVFHKFLNANRHKTRHTGKKPFKCKKCGKSFCMLLHLSQHKRIHIRENSYQCEECGKAFKWFSTLTRHKRIHTGEKPFKCEECGKAFKQSSTLTTHKIIHTGEKPYRCEECGKAFNRSSHLTTHKIIHTGEKPYKCEECGKAFNQSSTLSTHKFIHAGEKPYKCEECDKAFNRFSYLTKHKIIHTGEKSYKCEECGKGFNWSSTLTKHKRIHTGEKPYKCEVCGKAFNESSNLTTHKMIHTGEKPYKCEECGKAFNRSPQLTAHKIIHTGEKPYKCEECGKAFSQSSILTTHKRIHTGEKPYKCEECGKAFNRSSNLTKHKIIHTGEKSYKCEECGKAFNQSSTLTKHRKIHTRQKPYNCEECDNTFNQSSNLIKQNNSYWRETLQMSRMWESL

SEQ ID NO: 100060 - protein, 40 aa, Homo sapiens
  Payload ID: 19936
  Gene Name: zinc finger protein 431
  ENSP ID: ENSP00000469460
MDDLKYGVYPLKEASGCPGAERNLLVYSYFEKARSGGSHL

SEQ ID NO: 100061 - protein, 122 aa, Homo sapiens
  Payload ID: 19936
  Gene Name: zinc finger protein 431
  ENSP ID: ENSP00000470528
MDDLKYGVYPLKEASGCPGAERNLLVYSYFEKETLTFRDVAIEFSLEEWECLNPAQQNLYMNVMLENYKNLVFLGVAVSKQDPVTCLEQEKEPWNMKRHEMVDEPPGKTDHDLRLRELELSQ

SEQ ID NO: 100062 - protein, 144 aa, Homo sapiens
  Payload ID: 19936
  Gene Name: zinc finger protein 431
  ENSP ID: ENSP00000470668
MDDLKYGVYPLKEASGCPGAERNLLVYSYFEKETLTFRDVAIEFSLEEWECLNPAQQNLYMNVMLENYKNLVFLGVAVSKQDPVTCLEQEKEPWNMKRHEMVDEPPGYMCRMCSYVFLFYQRPLARARHKRFFSTSNTEKIWQM

SEQ ID NO: 100063 - protein, 325 aa, Homo sapiens
  Payload ID: 19936
  Gene Name: zinc finger protein 431
  ENSP ID: ENSP00000471876
MDDLKYGVYPLKEASGCPGAERNLLVYSYFEKSRSVAQAGMQWRSLSWLTVISASQVQVILVPQPPELLGLQETLTFRDVAIEFSLEEWECLNPAQQNLYMNVMLENYKNLVFLGVAVSKQDPVTCLEQEKEPWNMKRHEMVDEPPAMCSYFTKDLWPEQDIKDSFQQVILRRYGKCEHENLQLRKGSASVDEYKVHKEGYNELNQCLTTTQSKIFPCDKYVKVFHKFLNANRHKTRHTGKKPFKCKKCGKSFCMLLHLSQHKRIHIRENSYQCEECGKAFKWFSTLTRHKRIHTGEKPFKCEECGKAFKQSSTLTTHKIIHTGE

SEQ ID NO: 100064 - protein, 652 aa, Homo sapiens
  Payload ID: 19937
  Gene Name: zinc finger protein 432
  Uniprot ID: O94892
  ENSP ID: ENSP00000221315
MINAQELLTLEDVTVEFTWEEWQLLGPFQKDLYRDVMLEIYSNLLSMGYQVSKPDALSKLERGEEPWTMEDERHSRICPENNEVDDHLQDHLENQRMLKSVEQYHEHNAFGNTASQTKSLCLFRENHDTFELYIKTLKSNLSLVNQNKSCEINNSTKFSGDGKSFLHGNYEELYSAAKFSVSTKANSTKSQVSKHQRTHEIEKNHVCSECGKAFVKKSQLTDHERVHTGEKPYGCTLCAKVFSRKSRLNEHQRIHKREKSFICSECGKVFTMKSRLIEHQRTHTGEKPYICNECGKGFPGKRNLIVHQRNHTGEKSYICSECGKGFTGKSMLIIHQRTHTGEKPYICSECGKGFTTKHYVIIHQRNHTGEKPYICNECGKGFTMKSRMIEHQRTHTGEKPYICSECGKGFPRKSNLIVHQRNHTVEKSYLCSECGKGFTVKSMLIIHQRTHTGEKPYTCSECGKGFPLKSRLIVHQRTHTGEKPYRCSECGKGFIVNSGLMLHQRTHTGEKPYICNECGKGFAFKSNLVVHQRTHTGEKPFMCSECGKGFTMKRYLIVHQQIHTEEKSCICSECGRGFAKETELALHKQVHTGEKPYGCNECGKGFTMKSRLIVHQRTHTGEKPFVCSECRKAFSSKRNLIVHQRTHNGNKP

SEQ ID NO: 100065 - protein, 81 aa, Homo sapiens
  Payload ID: 19937
  Gene Name: zinc finger protein 432
  ENSP ID: ENSP00000470341
MINAQELLTLEDVTVEFTWEEWQLLGPFQKDLYRDVMLEIYSNLLSMGYQVSKPDALSKLERGEEPWTMEDERHSRICPGM

SEQ ID NO: 100066 - protein, 652 aa, Homo sapiens; identical to SEQ ID NO: 100064
  Payload ID: 19937
  Gene Name: zinc finger protein 432
  Uniprot ID: O94892
  ENSP ID: ENSP00000470488

SEQ ID NO: 100067 - protein, 179 aa, Homo sapiens
  Payload ID: 19937
  Gene Name: zinc finger protein 432
  ENSP ID: ENSP00000471172
MINAQELLTLEDVTVEFTWEEWQLLGPFQKDLYRDVMLEIYSNLLSMGYQVSKPDALSKLERGEEPWTMEDERHSRICPENNEVDDHLQDHLENQRMLKSVEQYHEHNAFGNTASQTKSLCLFRENHDTFELYIKTLKSNLSLVNQNKSCEINNSTKFSGDGKSFLHGNYEELYSAAKF

SEQ ID NO: 100068 - protein, 124 aa, Homo sapiens
  Payload ID: 19937
  Gene Name: zinc finger protein 432
  ENSP ID: ENSP00000471244
MINAQELLTLEDVTVEFTWEEWQLLGPFQKDLYRDVMLEIYSNLLSMGYQVSKPDALSKLERGEEPWTMEDERHSRICPENNEVDDHLQDHLENQRMLKSVEQYHEHNAFGNTASQTKSLCLFR

SEQ ID NO: 100069 - protein, 36 aa, Homo sapiens
  Payload ID: 19937
  Gene Name: zinc finger protein 432
  ENSP ID: ENSP00000472337
MINAQELLTLEDVTVEFTWEEWQLLGPFQKDLYRDV

SEQ ID NO: 100070 - protein, 673 aa, Homo sapiens
  Payload ID: 19938
  Gene Name: zinc finger protein 433
  Uniprot ID: Q8N7K0
  ENSP ID: ENSP00000339767
MMFQDSVAFEDVAVTFTQEEWALLDPSQKNLCRDVMQETFRNLASIGKKWKPQNIYVEYENLRRNLRIVGERLFESKEGHQHGEILTQVPDDMLKKTTTGVKSCESSVYGEVGSAHSSLNRHIRDDTGHKAYEYQEYGQKPYKCKYCKKPFNCLSSVQTHERAHSGRKLYVCEECGKTFISHSNLQRHRIMHRGDGPYKCKFCGKALMFLSLYLIHKRTHTGEKPYQCKQCGKAFSHSSSLRIHERTHTGEKPYKCNECGKAFHSSTCLHAHKRTHTGEKPYECKQCGKAFSSSHSFQIHERTHTGEKPYECKECGKAFKCPSSVRRHERTHSRKKPYECKHCGKVLSYLTSFQNHLGMHTGEISHKCKICGKAFYSPSSLQTHEKTHTGEKPYKCNQCGKAFNSSSSFRYHERTHTGEKPYECKQCGKAFRSASLLQTHGRTHTGEKPYACKECGKPFSNFSFFQIHERMHREEKPYECKGYGKTFSLPSLFHRHERTHTGGKTYECKQCGRSFNCSSSFRYHGRTHTGEKPYECKQCGKAFRSASQLQIHGRTHTGEKPYECKQCGKAFGSASHLQMHGRTHTGEKPYECKQCGKSFGCASRLQMHGRTHTGEKPYKCKQCGKAFGCPSNLRRHGRTHTGEKPYKCNQCGKVFRCSSQLQVHGRAHCIDTP

SEQ ID NO: 100071 - protein, 638 aa, Homo sapiens
  Payload ID: 19938
  Gene Name: zinc finger protein 433
  Uniprot ID: Q8N7K0
  ENSP ID: ENSP00000393416
MQETFRNLASIGKKWKPQNIYVEYENLRRNLRIVGERLFESKEGHQHGEILTQVPDDMLKKTTTGVKSCESSVYGEVGSAHSSLNRHIRDDTGHKAYEYQEYGQKPYKCKYCKKPFNCLSSVQTHERAHSGRKLYVCEECGKTFISHSNLQRHRIMHRGDGPYKCKFCGKALMFLSLYLIHKRTHTGEKPYQCKQCGKAFSHSSSLRIHERTHTGEKPYKCNECGKAFHSSTCLHAHKRTHTGEKPYECKQCGKAFSSSHSFQIHERTHTGEKPYECKECGKAFKCPSSVRRHERTHSRKKPYECKHCGKVLSYLTSFQNHLGMHTGEISHKCKICGKAFYSPSSLQTHEKTHTGEKPYKCNQCGKAFNSSSSFRYHERTHTGEKPYECKQCGKAFRSASLLQTHGRTHTGEKPYACKECGKPFSNFSFFQIHERMHREEKPYECKGYGKTFSLPSLFHRHERTHTGGKTYECKQCGRSFNCSSSFRYHGRTHTGEKPYECKQCGKAFRSASQLQIHGRTHTGEKPYECKQCGKAFGSASHLQMHGRTHTGEKPYECKQCGKSFGCASRLQMHGRTHTGEKPYKCKQCGKAFGCPSNLRRHGRTHTGEKPYKCNQCGKVFRCSSQLQVHGRAHCIDTP

SEQ ID NO: 100072 - protein, 77 aa, Homo sapiens
  Payload ID: 19938
  Gene Name: zinc finger protein 433
  ENSP ID: ENSP00000407475
MASFGASLWPDLGACSQHLSLYHSVTVELAASTARHPASSLQEDSVAFEDVAVTFTQEEWALLDPSQKNLCRDVMQE

SEQ ID NO: 100073 - protein, 166 aa, Homo sapiens
  Payload ID: 19938
  Gene Name: zinc finger protein 433
  ENSP ID: ENSP00000414857
MLVLSILLYTCEMFQDSVAFEDVAVTFTQEEWALLDPSQKNLCRDVMQETFRNLASIGKKWKPQNIYVEYENLRRNLRIVGERLFESKEGHQHGEILTQVPDDMLKKTTTGVKSCESSVYGEVGSAHSSLNRHIRDDTGHKAYEYQEYGQKPYKCKYCKKPFNCLS

SEQ ID NO: 100074 - protein, 41 aa, Homo sapiens
  Payload ID: 19938
  Gene Name: zinc finger protein 433
  ENSP ID: ENSP00000446484
MGDRNCRENHASMPGKVSGSLEVMKSMFKVLTDLVPGFSGL

SEQ ID NO: 100075 - protein, 77 aa, Homo sapiens
  Payload ID: 19938
  Gene Name: zinc finger protein 433
  ENSP ID: ENSP00000447205
MFQDSVAFEDVAVTFTQEEWALLDPSQKNLCRDVMQETFRNLASIGKKWKPQNIYVEYENLRRNLRIVGERLFESKE

SEQ ID NO: 100076 - protein, 117 aa, Homo sapiens
  Payload ID: 19938
  Gene Name: zinc finger protein 433
  ENSP ID: ENSP00000447951
MLVLSILLYTCEMFQDSVAFEDVAVTFTQEEWALLDPSQKNLCRDVMQETFRNLASIGKKWKPQNIYVEYENLRRNLRIVGERLFESKEGHQHGEILTQVPDDMLKKTTTGVKSCES

SEQ ID NO: 100077 - protein, 207 aa, Homo sapiens
  Payload ID: 19938
  Gene Name: zinc finger protein 433
  ENSP ID: ENSP00000448099
MDSVAFEDVAVTFTQEEWALLDPSQKNLCRDVMQETFRNLASIGKKWKPQNIYVEYENLRRNLRIVGERLFESKEGHQHGEILTQVPDDMLKKTTTGVKSCESSVYGEVGSAHSSLNRHIRDDTGHKAYEYQEYGQKPYKCKYCKKPFNCLSSVQTHERAHSGRKLYVCEECGKTFISHSNLQRHRIMHRGDGPYKCKFCGKALMFL

SEQ ID NO: 100078 - protein, 119 aa, Homo sapiens
  Payload ID: 19938
  Gene Name: zinc finger protein 433
  ENSP ID: ENSP00000448233
MQETFRNLASIGKKWKPQNIYVEYENLRRNLRIVGERLFESKEGHQHGEILTQVPDDMLKKTTTGVKSCESSVYGEVGSAHSSLNRHIRDDTGHKAYEYQEYGQKPYKCKYCKKPFNCL

SEQ ID NO: 100079 - protein, 52 aa, Homo sapiens
  Payload ID: 19938
  Gene Name: zinc finger protein 433
  ENSP ID: ENSP00000448806
MQETFRNLASIGKKWKPQNIYVEYENLRRNLRIVGERLFESKEGHQHGEILT

SEQ ID NO: 100080 - protein, 470 aa, Homo sapiens
  Payload ID: 19939
  Gene Name: zinc finger protein 436
  Uniprot ID: Q9C0F3
  ENSP ID: ENSP00000313582
MAATLLMAGSQAPVTFEDMAMYLTREEWRPLDAAQRDLYRDVMQENYGNVVSLDFEIRSENEVNPKQEISEDVQFGTTSERPAENAEENPESEEGFESGDRSERQWGDLTAEEWVSYPLQPVTDLLVHKEVHTGIRYHICSHCGKAFSQISDLNRHQKTHTGDRPYKCYECGKGFSRSSHLIQHQRTHTGERPYDCNECGKSFGRSSHLIQHQTIHTGEKPHKCNECGKSFCRLSHLIQHQRTHSGEKPYECEECGKSFSRSSHLAQHQRTHTGEKPYECNECGRGFSERSDLIKHYRVHTGERPYKCDECGKNFSQNSDLVRHRRAHTGEKPYHCNECGENFSRISHLVQHQRTHTGEKPYECNACGKSFSRSSHLITHQKIHTGEKPYECNECWRSFGERSDLIKHQRTHTGEKPYECVQCGKGFTQSSNLITHQRVHTGEKPYECTECEKSFSRSSALIKHKRVHTD

SEQ ID NO: 100081 - protein, 470 aa, Homo sapiens; identical to SEQ ID NO: 100080
  Payload ID: 19939
  Gene Name: zinc finger protein 436
  Uniprot ID: Q9C0F3
  ENSP ID: ENSP00000363736

SEQ ID NO: 100082 - protein, 470 aa, Homo sapiens; identical to SEQ ID NO: 100080
  Payload ID: 19939
  Gene Name: Zinc finger protein 436
  ENSP ID: ENSP00000489127

SEQ ID NO: 100083 - protein, 470 aa, Homo sapiens; identical to SEQ ID NO: 100080
  Payload ID: 19939
  Gene Name: Zinc finger protein 436
  ENSP ID: ENSP00000489469

SEQ ID NO: 100084 - protein, 818 aa, Homo sapiens
  Payload ID: 19940
  Gene Name: zinc finger protein 438
  Uniprot ID: Q7Z4V0
  ENSP ID: ENSP00000333571
MDSESNIPSGTIQSRKGLQNKSQFRTIAPKIVPKVLTSRMLPCHSPSRSDQVNLGPSINSKLLGMSTQNYALMQVAGQEGTFSLVALPHVASAQPIQKPRMSLPENLKLPIPRYQPPRNSKASRKKPILIFPKSGCSKAPAQTQMCPQMSPSPPHHPELLYKPSPFEEVPSLEQAPASISTAALTNGSDHGDLRPPVTNTHGSLNPPATPASSTPEEPAKQDLTALSGKAHFVSKITSSKPSAVASEKFKEQVDLAKTMTNLSPTILGNAVQLISSVPKGKLPIPPYSRMKTMEVYKIKSDANIAGFSLPGPKADCDKIPSTTEGFNAATKVASRLPVPQVSQQSACESAFCPPTKLDLNHKTKLNSGAAKRKGRKRKVPDEILAFQGKRRKYIINKCRDGKERVKNDPQEFRDQKLGTLKKYRSIMPKPIMVIPTLASLASPTTLQSQMLGGLGQDVLLNNSLTPKYLGCKQDNSSSPKPSSVFRNGFSGIKKPWHRCHVCNHHFQFKQHLRDHMNTHTNRRPYSCRICRKSYVRPGSLSTHMKLHHGENRLKKLMCCEFCAKVFGHIRVYFGHLKEVHRVVISTEPAPSELQPGDIPKNRDMSVRGMEGSLERENKSNLEEDFLLNQADEVKLQIKCGRCQITAQSFAEIKFHLLDVHGEEIEGRLQEGTFPGSKGTQEELVQHASPDWKRHPERGKPEKVHSSSEESHACPRLKRQLHLHQNGVEMLMENEGPQSGTNKPRETCQGPECPGLHTFLLWSHSGFNCLLCAEMLGRKEDLLHHWKHQHNCEDPSKLWAILNTVSNQGVIELSSEAEK

SEQ ID NO: 100085 - protein, 828 aa, Homo sapiens
  Payload ID: 19940
  Gene Name: zinc finger protein 438
  Uniprot ID: Q7Z4V0
  ENSP ID: ENSP00000354663
MQNSVSVPPKDEGESNIPSGTIQSRKGLQNKSQFRTIAPKIVPKVLTSRMLPCHSPSRSDQVNLGPSINSKLLGMSTQNYALMQVAGQEGTFSLVALPHVASAQPIQKPRMSLPENLKLPIPRYQPPRNSKASRKKPILIFPKSGCSKAPAQTQMCPQMSPSPPHHPELLYKPSPFEEVPSLEQAPASISTAALTNGSDHGDLRPPVTNTHGSLNPPATPASSTPEEPAKQDLTALSGKAHFVSKITSSKPSAVASEKFKEQVDLAKTMTNLSPTILGNAVQLISSVPKGKLPIPPYSRMKTMEVYKIKSDANIAGFSLPGPKADCDKIPSTTEGFNAATKVASRLPVPQVSQQSACESAFCPPTKLDLNHKTKLNSGAAKRKGRKRKVPDEILAFQGKRRKYIINKCRDGKERVKNDPQEFRDQKLGTLKKYRSIMPKPIMVIPTLASLASPTTLQSQMLGGLGQDVLLNNSLTPKYLGCKQDNSSSPKPSSVFRNGFSGIKKPWHRCHVCNHHFQFKQHLRDHMNTHTNRRPYSCRICRKSYVRPGSLSTHMKLHHGENRLKKLMCCEFCAKVFGHIRVYFGHLKEVHRVVISTEPAPSELQPGDIPKNRDMSVRGMEGSLERENKSNLEEDFLLNQADEVKLQIKCGRCQITAQSFAEIKFHLLDVHGEEIEGRLQEGTFPGSKGTQEELVQHASPDWKRHPERGKPEKVHSSSEESHACPRLKRQLHLHQNGVEMLMENEGPQSGTNKPRETCQGPECPGLHTFLLWSHSGFNCLLCAEMLGRKEDLLHHWKHQHNCEDPSKLWAILNTVSNQGVIELSSEAEK

SEQ ID NO: 100086 - protein, 392 aa, Homo sapiens
  Payload ID: 19940
  Gene Name: zinc finger protein 438
  ENSP ID: ENSP00000364460
MPKPIMVIPTLASLASPTTLQSQMLGGLGQDVLLNNSLTPKYLGCKQDNSSSPKPSSVFRNGFSGIKKPWHRCHVCNHHFQFKQHLRDHMNTHTNRRPYSCRICRKSYVRPGSLSTHMKLHHGENRLKKLMCCEFCAKVFGHIRVYFGHLKEVHRVVISTEPAPSELQPGDIPKNRDMSVRGMEGSLERENKSNLEEDFLLNQADEVKLQIKCGRCQITAQSFAEIKFHLLDVHGEEIEGRLQEGTFPGSKGTQEELVQHASPDWKRHPERGKPEKVHSSSEESHACPRLKRQLHLHQNGVEMLMENEGPQSGTNKPRETCQGPECPGLHTFLLWSHSGFNCLLCAEMLGRKEDLLHHWKHQHNCEDPSKLWAILNTVSNQGVIELSSEAEK

SEQ ID NO: 100087 - protein, 828 aa, Homo sapiens; identical to SEQ ID NO: 100085
  Payload ID: 19940
  Gene Name: zinc finger protein 438
  Uniprot ID: Q7Z4V0
  ENSP ID: ENSP00000387546

SEQ ID NO: 100088 - protein, 828 aa, Homo sapiens; identical to SEQ ID NO: 100085
  Payload ID: 19940
  Gene Name: zinc finger protein 438
  Uniprot ID: Q7Z4V0
  ENSP ID: ENSP00000406934

SEQ ID NO: 100089 - protein, 828 aa, Homo sapiens; identical to SEQ ID NO: 100085
  Payload ID: 19940
  Gene Name: zinc finger protein 438
  Uniprot ID: Q7Z4V0
  ENSP ID: ENSP00000412363

SEQ ID NO: 100090 - protein, 818 aa, Homo sapiens; identical to SEQ ID NO: 100084
  Payload ID: 19940
  Gene Name: zinc finger protein 438
  Uniprot ID: Q7Z4V0
  ENSP ID: ENSP00000413060

SEQ ID NO: 100091 - protein, 779 aa, Homo sapiens
  Payload ID: 19940
  Gene Name: zinc finger protein 438
  Uniprot ID: Q7Z4V0
  ENSP ID: ENSP00000445461
MLPCHSPSRSDQVNLGPSINSKLLGMSTQNYALMQVAGQEGTFSLVALPHVASAQPIQKPRMSLPENLKLPIPRYQPPRNSKASRKKPILIFPKSGCSKAPAQTQMCPQMSPSPPHHPELLYKPSPFEEVPSLEQAPASISTAALTNGSDHGDLRPPVTNTHGSLNPPATPASSTPEEPAKQDLTALSGKAHFVSKITSSKPSAVASEKFKEQVDLAKTMTNLSPTILGNAVQLISSVPKGKLPIPPYSRMKTMEVYKIKSDANIAGFSLPGPKADCDKIPSTTEGFNAATKVASRLPVPQVSQQSACESAFCPPTKLDLNHKTKLNSGAAKRKGRKRKVPDEILAFQGKRRKYIINKCRDGKERVKNDPQEFRDQKLGTLKKYRSIMPKPIMVIPTLASLASPTTLQSQMLGGLGQDVLLNNSLTPKYLGCKQDNSSSPKPSSVFRNGFSGIKKPWHRCHVCNHHFQFKQHLRDHMNTHTNRRPYSCRICRKSYVRPGSLSTHMKLHHGENRLKKLMCCEFCAKVFGHIRVYFGHLKEVHRVVISTEPAPSELQPGDIPKNRDMSVRGMEGSLERENKSNLEEDFLLNQADEVKLQIKCGRCQITAQSFAEIKFHLLDVHGEEIEGRLQEGTFPGSKGTQEELVQHASPDWKRHPERGKPEKVHSSSEESHACPRLKRQLHLHQNGVEMLMENEGPQSGTNKPRETCQGPECPGLHTFLLWSHSGFNCLLCAEMLGRKEDLLHHWKHQHNCEDPSKLWAILNTVSNQGVIELSSEAEK

SEQ ID NO: 100092 - protein, 95 aa, Homo sapiens
  Payload ID: 19940
  Gene Name: zinc finger protein 438
  ENSP ID: ENSP00000476810
MQNSVSVPPKDEGESNIPSGTIQSRKGLQNKSQFRTIAPKIVPKVLTSRMLPCHSPSRSDQVRCPGPLKRKLRFSFSCHLAQTSQRFINIVVKMS

SEQ ID NO: 100093 - protein, 499 aa, Homo sapiens
  Payload ID: 19941
  Gene Name: zinc finger protein 439
  Uniprot ID: Q8NDP4
  ENSP ID: ENSP00000305077
MLSLSPILLYTCEMFQDPVAFKDVAVNFTQEEWALLDISQKNLYREVMLETFWNLTSIGKKWKDQNIEYEYQNPRRNFRSVTEEKVNEIKEDSHCGETFTPVPDDRLNFQKKKASPEVKSCDSFVCEVGLGNSSSNMNIRGDTGHKACECQEYGPKPWKSQQPKKAFRYHPSLRTQERDHTGKKPYACKECGKNIIYHSSIQRHMVVHSGDGPYKCKFCGKAFHCLSLYLIHERTHTGEKPYECKQCGKSFSYSATHRIHERTHIGEKPYECQECGKAFHSPRSCHRHERSHMGEKAYQCKECGKAFMCPRYVRRHERTHSRKKLYECKQCGKALSSLTSFQTHIRMHSGERPYECKTCGKGFYSAKSFQRHEKTHSGEKPYKCKQCGKAFTRSGSFRYHERTHTGEKPYECKQCGKAFRSAPNLQLHGRTHTGEKPYQCKECGKAFRSASQLRIHRRIHTGEKPYECKKCGKAFRYVQNFRFHERTQTHKNALWRKTL

SEQ ID NO: 100094 - protein, 118 aa, Homo sapiens
  Payload ID: 19941
  Gene Name: zinc finger protein 439
  ENSP ID: ENSP00000388234
MFQDPVAFKDVAVNFTQEEWALLDISQKNLYREVMLETFWNLTSIGKKWKDQNIEYEYQNPRRNFRSVTEEKVNEIKEDSHCGETFTPVPDDRLNFQKKKASPEVKSCDSFVCEVGLG

SEQ ID NO: 100095 - protein, 363 aa, Homo sapiens
  Payload ID: 19941
  Gene Name: zinc finger protein 439
  ENSP ID: ENSP00000395632
MNIRGDTGHKACECQEYGPKPWKSQQPKKAFRYHPSLRTQERDHTGKKPYACKECGKNIIYHSSIQRHMVVHSGDGPYKCKFCGKAFHCLSLYLIHERTHTGEKPYECKQCGKSFSYSATHRIHERTHIGEKPYECQECGKAFHSPRSCHRHERSHMGEKAYQCKECGKAFMCPRYVRRHERTHSRKKLYECKQCGKALSSLTSFQTHIRMHSGERPYECKTCGKGFYSAKSFQRHEKTHSGEKPYKCKQCGKAFTRSGSFRYHERTHTGEKPYECKQCGKAFRSAPNLQLHGRTHTGEKPYQCKECGKAFRSASQLRIHRRIHTGEKPYECKKCGKAFRYVQNFRFHERTQTHKNALWRKTL

SEQ ID NO: 100096 - protein, 64 aa, Homo sapiens
  Payload ID: 19942
  Gene Name: zinc finger protein 44
  ENSP ID: ENSP00000346681
MALCYGTFWGYPKMLEAANLMEGLVDIGPWVTLPRGQPEVLEWGLPKDQAGELGTVDKSGLSGL

SEQ ID NO: 100097 - protein, 615 aa, Homo sapiens
  Payload ID: 19942
  Gene Name: zinc finger protein 44
  ENSP ID: ENSP00000347910
MDSVAFEDVAVNFTHEEWALLGPSQKNLYRDVMRETIRNLNCIGMKWENQNIDDQHQNLRRNPRCDVVERFGKSKDGSQCGETLSQIRNSIVNKNTPARVDACGSSVNGEVIMGHSSLNCYIRVDTGHKHRECHEYAEKSYTHKQCGKGLSYRHSFQTCERPHTGKKPYDCKECGKTFSSPGNLRRHMVVKGGDGPYKCELCGKAFFWPSLLRMHERTHTGEKPYECKQCSKAFPVYSSYLRHEKIHTGEKPYECKQCSKAFPDYSSYLRHERTHTGEKPYKCKQCGKAFSVSGSLRVHERIHTGEKPYTCKQCGKAFCHLGSFQRHMIMHSGDGPHKCKICGKGFDFPGSARIHEGTHTLEKPYECKQCGKLLSHRSSFRRHMMAHTGDGPHKCTVCGKAFDSPSVFQRHERTHTGEKPYECKQCGKAFRTSSSLRKHETTHTGEQPYKCKCGKAFSDLFSFQSHETTHSEEEPYECKECGKAFSSFKYFCRHERTHSEEKSYECQICGKAFSRFSYLKTHERTHTAEKPYECKQCRKAFFWPSFLLRHERTHTGERPYECKHCGKAFSRSSFCREHERTHTGEKPYECKECGKAFSSLSSFNRHKRTHWKDIL

SEQ ID NO: 100098 - protein, 663 aa, Homo sapiens
  Payload ID: 19942
  Gene Name: zinc finger protein 44
  Uniprot ID: P15621
  ENSP ID: ENSP00000348419
MALCYGTFWGYPKMLEAANLMEGLVDIGPWVTLPRGQPEVLEWGLPKDQDSVAFEDVAVNFTHEEWALLGPSQKNLYRDVMRETIRNLNCIGMKWENQNIDDQHQNLRRNPRCDVVERFGKSKDGSQCGETLSQIRNSIVNKNTPARVDACGSSVNGEVIMGHSSLNCYIRVDTGHKHRECHEYAEKSYTHKQCGKGLSYRHSFQTCERPHTGKKPYDCKECGKTFSSPGNLRRHMVVKGGDGPYKCELCGKAFFWPSLLRMHERTHTGEKPYECKQCSKAFPVYSSYLRHEKIHTGEKPYECKQCSKAFPDYSSYLRHERTHTGEKPYKCKQCGKAFSVSGSLRVHERIHTGEKPYTCKQCGKAFCHLGSFQRHMIMHSGDGPHKCKICGKGFDFPGSARIHEGTHTLEKPYECKQCGKLLSHRSSFRRHMMAHTGDGPHKCTVCGKAFDSPSVFQRHERTHTGEKPYECKQCGKAFRTSSSLRKHETTHTGEQPYKCKCGKAFSDLFSFQSHETTHSEEEPYECKECGKAFSSFKYFCRHERTHSEEKSYECQICGKAFSRFSYLKTHERTHTAEKPYECKQCRKAFFWPSFLLRHERTHTGERPYECKHCGKAFSRSSFCREHERTHTGEKPYECKECGKAFSSLSSFNRHKRTHWKDIL

SEQ ID NO: 100099 - protein, 637 aa, Homo sapiens
  Payload ID: 19942
  Gene Name: zinc finger protein 44
  Uniprot ID: P15621
  ENSP ID: ENSP00000377008
MALCYGTFWGYPKMLEAANLMEGLVDIGPWVTLPRGQPEVLEWGLPKDQDSVAFEDVAVNFTHEEWALLGPSQKNLYRDVMRETIRNLNCIGMKWENQNIDDQHQNLRRNPRCDVVERFGKSKDGSQCGETLSQIRNSIVNKNTPARVDACGSSVNGEVIMGHSSLNCYIRVDTGHKHRECHEYAEKSYTHKQCGKGLSYRHSFQTCERPHTGKKPYDCKECGKTFSSPGNLRRHMVVKGGDGPYKCELCGKAFFWPSLLRMHERTHTGEKPYECKQCSKAFPVYSSYLRHEKIHTGEKPYECKQCSKAFPDYSSYLRHERTHTGEKPYKCKQCGKAFSVSGSLRVHERIHTGEKPYTCKQCGKAFCHLGSFQRHMIMHSGDGPHKCKICGKGFDFPGSARIHEGTHTLEKPYECKQCGKLLSHRSSFRRHMMAHTGDGPHKCTVCGKAFDSPSVFQRHERTHTGEKPYECKQCGKAFRTSSSLRKHETTHTGEQPYKCKCGKAFSDLFSFQSHETTHSEEEPYECKECGKAFSSFKYFCRHERTHSEEKSYECQICGKAFSRFSYLKTHERTHTAEKPYECKQCRKAFFWPSFLLRHERTHTGERPYECKHCGKAFSRSSFCREHERTHTGEKPYE

SEQ ID NO: 100100 - protein, 589 aa, Homo sapiens
  Payload ID: 19942
  Gene Name: zinc finger protein 44
  Uniprot ID: P15621
  ENSP ID: ENSP00000380850
MDSVAFEDVAVNFTHEEWALLGPSQKNLYRDVMRETIRNLNCIGMKWENQNIDDQHQNLRRNPRCDVVERFGKSKDGSQCGETLSQIRNSIVNKNTPARVDACGSSVNGEVIMGHSSLNCYIRVDTGHKHRECHEYAEKSYTHKQCGKGLSYRHSFQTCERPHTGKKPYDCKECGKTFSSPGNLRRHMVVKGGDGPYKCELCGKAFFWPSLLRMHERTHTGEKPYECKQCSKAFPVYSSYLRHEKIHTGEKPYECKQCSKAFPDYSSYLRHERTHTGEKPYKCKQCGKAFSVSGSLRVHERIHTGEKPYTCKQCGKAFCHLGSFQRHMIMHSGDGPHKCKICGKGFDFPGSARIHEGTHTLEKPYECKQCGKLLSHRSSFRRHMMAHTGDGPHKCTVCGKAFDSPSVFQRHERTHTGEKPYECKQCGKAFRTSSSLRKHETTHTGEQPYKCKCGKAFSDLFSFQSHETTHSEEEPYECKECGKAFSSFKYFCRHERTHSEEKSYECQICGKAFSRFSYLKTHERTHTAEKPYECKQCRKAFFWPSFLLRHERTHTGERPYECKHCGKAFSRSSFCREHERTHTGEKPYE

SEQ ID NO: 100101 - protein, 154 aa, Homo sapiens
  Payload ID: 19942
  Gene Name: zinc finger protein 44
  ENSP ID: ENSP00000471655
MALCYGTFWGYPKMLEAANLMEGLVDIGPWVTLPRGQPEVLEWGLPKDQDSVAFEDVAVNFTHEEWALLGPSQKNLYRDVMRETIRNLNCIGMKWENQNIDDQHQNLRRNPRLSETWLQNFILIHYGHLVALSDGGLLQFSTGQGLPVTQAGVQ

SEQ ID NO: 100102 - protein, 595 aa, Homo sapiens
  Payload ID: 19943
  Gene Name: zinc finger protein 440
  Uniprot ID: Q8IYI8
  ENSP ID: ENSP00000305373
MDPVAFKDVAVNFTQEEWALLDISQRKLYREVMLETFRNLTSLGKRWKDQNIEYEHQNPRRNFRSLIEEKVNEIKDDSHCGETFTPVPDDRLNFQEKKASPEVKSCESFVCGEVGLGNSSFNMNIRGDIGHKAYEYQEYGPKPCKCQQPKKAFRYRPSFRTQERDHTGEKPNACKVCGKTFISHSSVRRHMVMHSGDGPYKCKFCGKAFHCLRLYLIHERIHTGEKPCECKQCGKSFSYSATHRIHKRTHTGEKPYEYQECGKAFHSPRSYRRHERIHMGEKAYQCKECGKAFTCPRYVRIHERTHSRKNLYECKQCGKALSSLTSFQTHVRLHSGERPYECKICGKDFCSVNSFQRHEKIHSGEKPYKCKQCGKAFPHSSSLRYHERTHTGEKPYECKQCGKAFRSASHLRVHGRTHTGEKPYECKECGKAFRYVNNLQSHERTQTHIRIHSGERRYKCKICGKGFYCPKSFQRHEKTHTGEKLYECKQRSVVPSVVPVPFDIMKGLTLERSPINASNVGKPSELCQSFECMVGLTLKRNPMSVSNDGKPSDLPHTFEYVVGHTMERSPMHVRNVGNPSDLPRTFEFMKGHKHT

SEQ ID NO: 100103 - protein, 272 aa, Homo sapiens
  Payload ID: 19943
  Gene Name: zinc finger protein 440
  ENSP ID: ENSP00000393489
MMFQDPVAFKDVAVNFTQEEWALLDISQRKLYREVMLETFRNLTSLGKRWKDQNIEYEHQNPRRNFRSLIEEKVNEIKDDSHCGETFTPVPDDRLNFQEKKASPEVKSCESFVCGEVGLGNSSFNMNIRGDIGHKAYEYQEYGPKPCKCQQPKKAFRYRPSFRTQERDHTGEKPNACKVCGKTFISHSSVRRHMVMHSGDGPYKCKFCGKAFHCLRLYLIHERIHTGEKPCECKQCGKSFSYSATHRIHKRTHTGEKPYEYQECGKAFHSPR

SEQ ID NO: 100104 - protein, 53 aa, Homo sapiens
  Payload ID: 19943
  Gene Name: zinc finger protein 440
  ENSP ID: ENSP00000404425
MNIRGDIGHKAYEYQEYGPKPCKCQQPKKAFRYRPSFRTQERDHTGEKPNACK

SEQ ID NO: 100105 - protein, 169 aa, Homo sapiens
  Payload ID: 19943
  Gene Name: zinc finger protein 440
  ENSP ID: ENSP00000411974
MFQDPVAFKDVAVNFTQEEWALLDISQRKLYREVMLETFRNLTSLGKRWKDQNIEYEHQNPRRNFRSLIEEKVNEIKDDSHCGETFTPVPDDRLNFQEKKASPEVKSCESFVCGEVGLGNSSFNMNIRGDIGHKAYEYQEYGPKPCKCQQPKKAFRYRPSFRTQERDHT

SEQ ID NO: 100106 - protein, 49 aa, Homo sapiens
  Payload ID: 19943
  Gene Name: zinc finger protein 440
  ENSP ID: ENSP00000465030
MLETFRNLTSLGKRWKDQNIEYEHQNPRRNFRSLIEEKVNEIKDDSHCG

SEQ ID NO: 100107 - protein, 693 aa, Homo sapiens
  Payload ID: 19944
  Gene Name: zinc finger protein 441
  Uniprot ID: Q8N8Z8
  ENSP ID: ENSP00000350576
MDSVAFEDVAINFTCEEWALLGPSQKSLYRDVMQETIRNLDCIGMIWQNHDIEEDQYKDLRRNLRCHMVERACEIKDNSQCGGPFTQTQDSIVNEKIPGVDPWESSECTDVLMGRSSLNCYVRVDSEHKPCEYQEYGEKPYTHTQCGTAFSYQPCFQIHERPQHGKKLYDCKECASFSSLENLQRHMAAHHGDGPRICKLCGNAFIWPSLFHMLRRTHTEEKPYEYEQCSTAFPAYSSTLRHERTHSGEKPYQCKQCGKAFSCSCYTQLYERTHTGEQSYECKQCGKAFYHLGSFQRHMIVHTGDGPHKCKICGKGFLSPSSVRRHKRTHTGEKPYECKYCGKAFSDCTGFRRHMITHTGDGPHKCKVCGKAFDSPSLCRRHETTHTGEKPYKCECGKAFSDFYYFRNHETTHTGEKPYKCKQCGKAFICCTYLQIHERIHTGERPYKCKQCGKAFRSSNYIRVHEKTHTGEKPYECKQCGKALSHLKSFQRHMIMHTGDGPHKCKICGKSFDSPSSFRRHERIHTGERPYKCKLCGKGFRSSSYIQLHERTHTGEKPYGCQQCGKALSDLSSFRRHMITHTGNGPHKCKICGKGFDYPSSVQRHERTHTGEKPYECKECGKAFSHSSYLRIHERVHTGEKPYKCKECGKPFHCPSAFHKHERTHSMEKPYKCKECGEAFHCISSFHKHEMTH

SEQ ID NO: 100108 - protein, 44 aa, Homo sapiens
  Payload ID: 19944
  Gene Name: zinc finger protein 441
  ENSP ID: ENSP00000386658
MDSVAFEDVAINFTCEEWALLGPSQKSLYRDVMQETIRNLDCID

SEQ ID NO: 100109 - protein, 627 aa, Homo sapiens
  Payload ID: 19945
  Gene Name: zinc finger protein 442
  Uniprot ID: Q9H7R0
  ENSP ID: ENSP00000242804
MIVFGGEDRSDLFLPDSQTNEERKQYDSVAFEDVAVNFTQEEWALLGPSQKSLYRDVMWETIRNLDCIGMKWEDTNIEDQHRNPRRSLRCHIIERFSESRQPDSTVNEKPPGVDPCKSSVCGEIMGCSFLNCYITFDAGHKPDECQEYGEKPHTHKQCGTAFNYHHSFQTQERPHTGKKRYDCKECGKTFSSSGNLRRHIIVQRGGGPYICKLCGKAFFWPSLFRMHERTHTGEKPYECKQCCKAFPIYSSYLRHERTHTGEKPYECKHCSKAFPDYSSYVRHERTHTGEKPYKCKRCGRAFSVSSSLRIHERTHTGEKPYECKQCGKAFHHLGSFQRHMIRHTGDGPHKCKICGKGFDCPSSLQSHERTHTGEKPYECKQCGKALSHHSSFRSHMIMHTGDGPHKCKVCGKAFIYPSVFQGHERTHTGEKPYECKECGKAFRISSSLRRHETTHTGEKPYKCKCGKAFIDFYSFQNHETTHTGEKPYECKECGKAFSCFTYLSQHRRTHMAEKPYECKTCKKAFSHFGNLKVHERIHTGEKPYECKECRKAFSWLTCLLRHERIHTGKKSYECQQCGKAFTRSRFLRGHEKTHTGEKMHECKECGKALSSLSSLHRHKRTHWRDTL

SEQ ID NO: 100110 - protein, 558 aa, Homo sapiens
  Payload ID: 19945
  Gene Name: zinc finger protein 442
  Uniprot ID: Q9H7R0
  ENSP ID: ENSP00000388634
MKWEDTNIEDQHRNPRRSLRCHIIERFSESRQPDSTVNEKPPGVDPCKSSVCGEIMGCSFLNCYITFDAGHKPDECQEYGEKPHTHKQCGTAFNYHHSFQTQERPHTGKKRYDCKECGKTFSSSGNLRRHIIVQRGGGPYICKLCGKAFFWPSLFRMHERTHTGEKPYECKQCCKAFPIYSSYLRHERTHTGEKPYECKHCSKAFPDYSSYVRHERTHTGEKPYKCKRCGRAFSVSSSLRIHERTHTGEKPYECKQCGKAFHHLGSFQRHMIRHTGDGPHKCKICGKGFDCPSSLQSHERTHTGEKPYECKQCGKALSHHSSFRSHMIMHTGDGPHKCKVCGKAFIYPSVFQGHERTHTGEKPYECKECGKAFRISSSLRRHETTHTGEKPYKCKCGKAFIDFYSFQNHETTHTGEKPYECKECGKAFSCFTYLSQHRRTHMAEKPYECKTCKKAFSHFGNLKVHERIHTGEKPYECKECRKAFSWLTCLLRHERIHTGKKSYECQQCGKAFTRSRFLRGHEKTHTGEKMHECKECGKALSSLSSLHRHKRTHWRDTL

SEQ ID NO: 100111 - protein, 154 aa, Homo sapiens
  Payload ID: 19945
  Gene Name: zinc finger protein 442
  ENSP ID: ENSP00000404935
MKWEDTNIEDQHRNPRRSLRCHIIERFSESRQPDSTVNEKPPGVDPCKSSVCGEIMGCSFLNCYITFDAGHKPDECQEYGEKPHTHKQCGTAFNYHHSFQTQERPHTGKKRYDCKECGKTFSSSGNLRRHIIVQRGGGPYICKLCGKAFFWPSL

SEQ ID NO: 100112 - protein, 627 aa, Homo sapiens; identical to SEQ ID NO: 100109
  Payload ID: 19945
  Gene Name: zinc finger protein 442
  Uniprot ID: Q9H7R0
  ENSP ID: ENSP00000440162

SEQ ID NO: 100113 - protein, 671 aa, Homo sapiens
  Payload ID: 19946
  Gene Name: zinc finger protein 443
  Uniprot ID: Q9Y2A4
  ENSP ID: ENSP00000301547
MASVALEDVAVNFTREEWALLGPCQKNLYKDVMQETIRNLDCVVMKWKDQNIEDQYRYPRKNLRCRMLERFVESKDGTQCGETSSQIQDSIVTKNTLPGVGPCESSMRGEKVMGHSSLNCYIRVGAGHKPHEYHECGEKPDTHKQRGKAFSYHNSFQTHERLHTGKKPYDCKECGKSFSSLGNLQRHMAVQRGDGPYKCKLCGKAFFWPSLLHMHERTHTGEKPYECKQCSKAFSFYSSYLRHERTHTGEKPYECKQCSKAFPFYSSYLRHERTHTGEKPYKCKQCSKAFPDSSSCLIHERTHTGEKPYTCKQCGKAFSVSGSLQRHETTHSAEKPYACQQCGKAFHHLGSFQRHMIRHTGNGPHKCKICGKGFDCPSSLQSHERTHTGEKPYECKQCGKALSHRSSFRSHMIMHTGDGPHKCKVCGKAFVYPSVFQRHERTHTAEKPYKCKQCGKAYRISSSLRRHETTHTGEKPYKCKLGKACIDFCSFQNHKTTHTGEKPYECKECGKAFSRFRYLSRHKRTHTGEKPYECKTCRKAFGHYDNLKVHERIHSGEKPYECKECGKAFSWLTCFLRHERIHMREKSYECPQCGKAFTHSRFLQGHEKTHTGENPYECKECGKAFASLSSLHRHKKTHWKKTHTGENPYECKECGKAFASLSSLHRHKKTH

SEQ ID NO: 100114 - protein, 64 aa, Homo sapiens
  Payload ID: 19946
  Gene Name: zinc finger protein 443
  ENSP ID: ENSP00000389105
MASVALEDVAVNFTREEWALLGPCQKNLYKDVMQETIRNLDCVVMKWKDQNIEDQYRYPRKNLR

SEQ ID NO: 100115 - protein, 327 aa, Homo sapiens
  Payload ID: 19947
  Gene Name: zinc finger protein 444
  Uniprot ID: Q8N0Y2
  ENSP ID: ENSP00000338860
MEVAVPVKQEAEGLALDSPWHRFRRFHLGDAPGPREALGLLRALCRDWLRPEVHTKEQMLELLVLEQFLSALPADTQAWVCSRQPQSGEEAVALLEELWGPAASPDGSSATRVPQDVTQGPGATGGKEDSGMIPLAGTAPGAEGPAPGDSQAVRPYKQEPSSPPLAPGLPAFLAAPGTTSCPECGKTSLKPAHLLRHRQSHSGEKPHACPECGKAFRRKEHLRRHRDTHPGSPGSPGPALRPLPAREKPHACCECGKTFYWREHLVRHRKTHSGARPFACWECGKGFGRREHVLRHQRIHGRAAASAQGAVAPGPDGGGPFPPWPLG

SEQ ID NO: 100116 - protein, 99 aa, Homo sapiens
  Payload ID: 19947
  Gene Name: zinc finger protein 444
  ENSP ID: ENSP00000465070
MEVAVPVKQEAEGLALDSPWHRFRRFHLGDAPGPREALGLLRALCRDWLRPEVHTKEQMLELLVLEQFLSALPADTQAWVCSRQPQSGEEAVALLEELW

SEQ ID NO: 100117 - protein, 90 aa, Homo sapiens
  Payload ID: 19947
  Gene Name: zinc finger protein 444
  ENSP ID: ENSP00000465171
MEVAVPVKQEAEGLALDSPWHRFRRFHLGDAPGPREALGLLRALCRDWLRPEVHTKEQMLELLVLEQFLSALPADTQAWVCSRQPQSGEE

SEQ ID NO: 100118 - protein, 44 aa, Homo sapiens
  Payload ID: 19947
  Gene Name: zinc finger protein 444
  ENSP ID: ENSP00000465466
MEVAVPVKQEAEGLALDSPWHRFRRFHLGDAPGPREALGLLRAL

SEQ ID NO: 100119 - protein, 72 aa, Homo sapiens
  Payload ID: 19947
  Gene Name: zinc finger protein 444
  ENSP ID: ENSP00000466287
MEVAVPVKQEAEGLALDSPWHRFRRFHLGDAPGPREALGLLRALCRDWLRPEVHTKEQMLELLVLEQFLSAL

SEQ ID NO: 100120 - protein, 70 aa, Homo sapiens
  Payload ID: 19947
  Gene Name: zinc finger protein 444
  ENSP ID: ENSP00000466666
MEVAVPVKQEAEGLALDSPWHRFRRFHLGDAPGPREALGLLRALCRDWLRPEVHTKEQMLELLVLEQFLS

SEQ ID NO: 100121 - protein, 326 aa, Homo sapiens
  Payload ID: 19947
  Gene Name: zinc finger protein 444
  Uniprot ID: Q8N0Y2
  ENSP ID: ENSP00000468069
MEVAVPVKQEAEGLALDSPWHRFRRFHLGDAPGPREALGLLRALCRDWLRPEVHTKEQMLELLVLEQFLSALPADTQAWVCSRQPQSGEEAVALLEELWGPAASPDGSSATRVPQDVTQGPGATGGKEDSGMIPLGTAPGAEGPAPGDSQAVRPYKQEPSSPPLAPGLPAFLAAPGTTSCPECGKTSLKPAHLLRHRQSHSGEKPHACPECGKAFRRKEHLRRHRDTHPGSPGSPGPALRPLPAREKPHACCECGKTFYWREHLVRHRKTHSGARPFACWECGKGFGRREHVLRHQRIHGRAAASAQGAVAPGPDGGGPFPPWPLG

SEQ ID NO: 100122 - protein, 77 aa, Homo sapiens
  Payload ID: 19947
  Gene Name: zinc finger protein 444
  ENSP ID: ENSP00000468762
MEVAVPVKQEAEGLALDSPWHRFRRFHLGDAPGPREALGLLRALCRDWLRPEVHTKEQMLELLVLEQFLSALPADTQ

SEQ ID NO: 100123 - protein, 1031 aa, Homo sapiens
  Payload ID: 19948
  Gene Name: zinc finger protein 445
  Uniprot ID: P59923
  ENSP ID: ENSP00000379387
MPPGRWHAAYPAQAQSSRERGRLQTVKKEEEDESYTPVQAARPQTLNRPGQELFRQLFRQLRYHESSGPLETLSRLRELCRWWLRPDVLSKAQILELLVLEQFLSILPGELRVWVQLHNPESGEEAVALLEELQRDLDGTSWRDPGPAQSPDVHWMGTGALRSAQIWSLASPLRSSSALGDHLEPPYEIEARDFLAGQSDTPAAQMPALFPREGCPGDQVTPTRSLTAQLQETMTFKDVEVTFSQDEWGWLDSAQRNLYRDVMLENYRNMASLVGPFTKPALISWLEAREPWGLNMQAAQPKGNPVAAPTGDDLQSKTNKFILNQEPLEEAETLAVSSGCPATSVSEGIGLRESFQQKSRQKDQCENPIQVRVKKEETNFSHRTGKDSEVSGSNSLDLKHVTYLRVSGRKESLKHGCGKHFRMSSHHYDYKKYGKGLRHMIGGFSLHQRIHSGLKGNKKDVCGKDFSLSSHHQRGQSLHTVGVSFKCSDCGRTFSHSSHLAYHQRLHTQEKAFKCRVCGKAFRWSSNCARHEKIHTGVKPYKCDLCEKAFRRLSAYRLHRETHAKKKFLELNQYRAALTYSSGFDHHLGDQSGEKLFDCSQCRKSFHCKSYVLEHQRIHTQEKPYKCTKCRKTFRWRSNFTRHMRLHEEEKFYKQDECREGFRQSPDCSQPQGAPAVEKTFLCQQCGKTFTRKKTLVDHQRIHTGEKPYQCSDCGKDFAYRSAFIVHKKKHAMKRKPEGGPSFSQDTVFQVPQSSHSKEEPYKCSQCGKAFRNHSFLLIHQRVHTGEKPYKCRECGKAFRWSSNLYRHQRIHSLQKQYDCHESEKTPNVEPKILTGEKRFWCQECGKTFTRKRTLLDHKGIHSGEKRYKCNLCGKSYDRNYRLVNHQRIHSTERPFKCQWCGKEFIGRHTLSSHQRKHTRAAQAERSPPARSSSQDTKLRLQKLKPSEEMPLEDCKEACSQSSRLTGLQDISIGKKCHKCSICGKTFNKSSQLISHKRFHTRERPFKCSKCGKTFRWSSNLARHMKNHIRD

SEQ ID NO: 100124 - protein, 1031 aa, Homo sapiens; identical to SEQ ID NO: 100123
  Payload ID: 19948
  Gene Name: zinc finger protein 445
  Uniprot ID: P59923
  ENSP ID: ENSP00000413073

SEQ ID NO: 100125 - protein, 273 aa, Homo sapiens [sequence omitted]

SEQ ID NO: 100126 - protein, 273 aa, Homo sapiens [sequence omitted]

SEQ ID NO: 100127 - protein, 1031 aa, Homo sapiens; identical to SEQ ID NO: 100123
  Payload ID: 19948
  Gene Name: zinc finger protein 445
  ENSP ID: ENSP00000489139

SEQ ID NO: 100128 - protein, 1031 aa, Homo sapiens; identical to SEQ ID NO: 100123
  Payload ID: 19948
  Gene Name: zinc finger protein 445
  ENSP ID: ENSP00000489368

SEQ ID NO: 100129 - protein, 336 aa, Homo sapiens
  Payload ID: 19949
  Gene Name: zinc finger protein 446
  ENSP ID: ENSP00000336565
MPSPLGPPCLPVMDPETTLEEPETARLRFRGFCYQEVAGPREALARLRELCCQWLQPEAHSKEQMLEMLVLEQFLGTLPPEIQAWVRGQRPGSPEEAAALVEGLQHDPGQLLGWITAHVLKQEVLPAAQKTEEPLGSPHPSGTVESPGEGPQDTRIEGSVQLSCSVKEEPNVDGQEVAPSSPPLAAQSPEGNHGHQEPASTSFHPPRIQGYRPTSQRHRPSQSWGCCSRGQASAEACAREMRVRVHLAAQRPSRPRAQGRQPGRACLGLPLLPPLCAQGHRQCPLSPHLQRRDWSRLPPPGSPTRASSVAAASTGSQCSSSTTGHTRVGQVCSPRG

SEQ ID NO: 100130 - protein, 141 aa, Homo sapiens
  Payload ID: 19949
  Gene Name: zinc finger protein 446
  ENSP ID: ENSP00000470963
MPSPLGPPCLPVMDPETTLEEPETARLRFRGFCYQEVAGPREALARLRELCCQWLQPEAHSKEQMLEMLVLEQFLGTLPPEIQAWVRGQRPGSPEEAAALVEGLQHDPGQLLGWITAHVLKQEVLPAAQKTEEPLGSPHPS

SEQ ID NO: 100131 - protein, 399 aa, Homo sapiens
  Payload ID: 19949
  Gene Name: zinc finger protein 446
  ENSP ID: ENSP00000472219
MPSPLGPPCLPVMDPETTLEEPETARLRFRGFCYQEVAGPREALARLRELCCQWLQPEAHSKEQMLEMLVLEQFLGTLPPEIQAWVRGQRPGSPEEAAALVEGLQHDPGQLLGWITAHVLKQEVLPAAQKTEEPLGSPHPSGTVESPGEGPQDTRIEGSVQLSCSVKEEPNVDGQEVAPSSPPLAAQSPEGNHGHQEPASTSFHPPRIQEEWGLLDRSQKELYWDAMLEKYGTVVSLGLPPHQPEAQAQSELGMLLTGTGVCRSLRSETRLEPAATPRKPYTCEQCGRGFDWKSVFVIHHRTHTSGPGVQSPGLATGESTEKPPQGEVAFPHHPRRSLTGPRSYPCEECGCSFSWKSQLVIHRKSHTGQRRHFCSDCGRAFDWKSQLVIHRKGHRPEVP

SEQ ID NO: 100132 - protein, 450 aa, Homo sapiens
  Payload ID: 19949
  Gene Name: zinc finger protein 446
  Uniprot ID: Q9NWS9
  ENSP ID: ENSP00000472802
MPSPLGPPCLPVMDPETTLEEPETARLRFRGFCYQEVAGPREALARLRELCCQWLQPEAHSKEQMLEMLVLEQFLGTLPPEIQAWVRGQRPGSPEEAAALVEGLQHDPGQLLGWITAHVLKQEVLPAAQKTEEPLGSPHPSGTVESPGEGPQDTRIEGSVQLSCSVKEEPNVDGQEVAPSSPPLAAQSPEGNHGHQEPASTSFHPPRIQEEWGLLDRSQKELYWDAMLEKYGTVVSLGLPPHQPEAQAQSELGMLLTGTGVCRSLRSGNESEGPPGCPEAQPPQGPGPAAWEGLSGAATPAPTVRPGTPPVPTQPTPAETRLEPAATPRKPYTCEQCGRGFDWKSVFVIHHRTHTSGPGVQSPGLATGESTEKPPQGEVAFPHHPRRSLTGPRSYPCEECGCSFSWKSQLVIHRKSHTGQRRHFCSDCGRAFDWKSQLVIHRKGHRPEVP

SEQ ID NO: 100133 - protein, 422 aa, Homo sapiens
  Payload ID: 19949
  Gene Name: zinc finger protein 446
  ENSP ID: ENSP00000478778
MPSPLGPPCLPVMDPETTLEEPETARLRFRGFCYQEVAGPREALARLRELCCQWLQPEAHSKEQMLEMLVLEQFLGTLPPEIQAWVRGQRPGSPEEAAALVEGLQHDPGQLLGWITAHVLKQEVLPAAQKTEEPLGSPHPSGTVESPGEGPQDTRIEGSVQLSCSVKEEPNVDGQEVAPSSPPLAAQSPEGNHGHQEPASTSFHPPRIQEEWGLLDRSQKELYWDAMLEKYGTVVSLGLPPHQPEAQAQSELGMLLTGTGVCRSLRSGNESEGPPGCPEAQPPQGPGPAAWEGLSGAATPAPTVRPGTPPVPTQPTPAETRLEPAATPRKPYTCEQCGRGFDWKSVFVIHHRTHTSGPGVQSPGLATGESTEKPPQGEVAFPHHPRRSLTGPRSYPCEECGCSFSWKSQLVIHRKSHRPEVP

SEQ ID NO: 100134 - protein, 422 aa, Homo sapiens
  Payload ID: 19949
  Gene Name: zinc finger protein 446
  ENSP ID: ENSP00000484676
MPSPLGPPCLPVMDPETTLEEPETARLRFRGFCYQEVAGPREALARLRELCCQWLQPEAHSKEQMLEMLVLEQFLGTLPPEIQAWVRGQRPGSPEEAAALVEGLQHDPGQLLGWITAHVLKQEVLPAAQKTEEPLGSPHPSGTVESPGEGPQDTRIEGSVQLSCSVKEEPNVDGQEVAPSSPPLAAQSPEGNHGHQEPASTSFHPPRIQGLPPHQPEAQAQSELGMLLTGTGVCRSLRSGNESEGPPGCPEAQPPQGPGPAAWEGLSGAATPAPTVRPGTPPVPTQPTPAETRLEPAATPRKPYTCEQCGRGFDWKSVFVIHHRTHTSGPGVQSPGLATGESTEKPPQGEVAFPHHPRRSLTGPRSYPCEECGCSFSWKSQLVIHRKSHTGQRRHFCSDCGRAFDWKSQLVIHRKGHRPEVP

SEQ ID NO: 100135 - protein, 518 aa, Homo sapiens
  Payload ID: 19950
  Gene Name: zinc finger protein 449
  Uniprot ID: Q6P9G9
  ENSP ID: ENSP00000339585
MAVALGCAIQASLNQGSVFQEYDTDCEVFRQRFRQFQYREAAGPHEAFNKLWELCCQWLKPKMRSKEQILELLVLEQFLTILPTEIETWVREHCPENRERVVSLIEDLQRELEIPEQQVDMHDMLLEELAPVGTAHIPPTMHLESPALQVMGPAQEAPVAEAWIPQAGPPELNYGATGECQNFLDPGYPLPKLDMNFSLENREEPWVKELQDSKEMKQLLDSKIGFEIGIENEEDTSKQKKMETMYPFIVTLEGNALQGPILQKDYVQLENQWETPPEDLQTDLAKLVDQQNPTLGETPENSNLEEPLNPKPHKKKSPGEKPHRCPQCGKCFARKSQLTGHQRIHSGEEPHKCPECGKRFLRSSDLYRHQRLHTGERPYECTVCKKRFTRRSHLIGHQRTHSEEETYKCLECGKSFCHGSSLKRHLKTHTGEKPHRCHNCGKSFSRLTALTLHQRTHTEERPFKCNYCGKSFRQRPSLVIHLRIHTGEKPYKCTHCSKSFRQRAGLIMHQVTHFRGLI

SEQ ID NO: 100136 - protein, 164 aa, Homo sapiens
  Payload ID: 19950
  Gene Name: zinc finger protein 449
  Uniprot ID: Q6P9G9
  ENSP ID: ENSP00000359797
MAVALGCAIQASLNQGSVFQEYDTDCEVFRQRFRQFQYREAAGPHEAFNKLWELCCQWLKPKMRSKEQILELLVLEQFLTILPTEIETWVREHCPENRERVVSLIEDLQRELEIPEQQVRKECGIFVIGPKEVAEAAGTRPHICLYVIPQPQDFSRVLFLFLFC

SEQ ID NO: 100137 - protein, 682 aa, Homo sapiens
  Payload ID: 19951
  Gene Name: zinc finger protein 45
  Uniprot ID: Q02386
  ENSP ID: ENSP00000269973
MTKSKEAVTFKDVAVVFSEEELQLLDLAQRKLYRDVMLENFRNVVSVGHQSTPDGLPQLEREEKLWMMKMATQRDNSSGAKNLKEMETLQEVGLRYLPHEELFCSQIWQQITRELIKYQDSVVNIQRTGCQLEKRDDLHYKDEGFSNQSSHLQVHRVHTGEKPYKGEHCVKSFSWSSHLQINQRAHAGEKPYKCEKCDNAFRRFSSLQAHQRVHSRAKSYTNDASYRSFSQRSHLPHHQRVPTGENPYKYEECGRNVGKSSHCQAPLIVHTGEKPYKCEECGVGFSQRSYLQVHLKVHTGKKPYKCEECGKSFSWRSRLQAHERIHTGEKPYKCNACGKSFSYSSHLNIHCRIHTGEKPYKCEECGKGFSVGSHLQAHQISHTGEKPYKCEECGKGFCRASNLLDHQRGHTGEKPYQCDACGKGFSRSSDFNIHFRVHTGEKPYKCEECGKGFSQASNLLAHQRGHTGEKPYKCGTCGKGFSRSSDLNVHCRIHTGEKPYKCERCGKAFSQFSSLQVHQRVHTGEKPYQCAECGKGFSVGSQLQAHQRCHTGEKPYQCEECGKGFCRASNFLAHRGVHTGEKPYRCDVCGKRFRQRSYLQAHQRVHTGERPYKCEECGKVFSWSSYLQAHQRVHTGEKPYKCEECGKGFSWSSSLIIHQRVHADDEGDKDFPSSEDSHRKTR

SEQ ID NO: 100138 - protein, 129 aa, Homo sapiens
  Payload ID: 19951
  Gene Name: zinc finger protein 45
  ENSP ID: ENSP00000467551
MLENFRNVVSVGHQSTPDGLPQLEREEKLWMMKMATQRDNSSGAKNLKEMETLQEVGLRYLPHEELFCSQIWQQITRELIKYQDSVVNIQRTGCQLEKRDDLHYKDEGFSNQSSHLQVHRVHTGEKPYK

SEQ ID NO: 100139 - protein, 682 aa, Homo sapiens; identical to SEQ ID NO: 100137
  Payload ID: 19951
  Gene Name: zinc finger protein 45
  Uniprot ID: Q02386
  ENSP ID: ENSP00000468579

SEQ ID NO: 100140 - protein, 682 aa, Homo sapiens; identical to SEQ ID NO: 100137
  Payload ID: 19951
  Gene Name: zinc finger protein 45
  Uniprot ID: Q02386
  ENSP ID: ENSP00000481895

SEQ ID NO: 100141 - protein, 1013 aa, Homo sapiens
  Payload ID: 19952
  Gene Name: zinc finger protein 451
  Uniprot ID: Q9Y4E5
  ENSP ID: ENSP00000350083
MGDPGSEIIESVPPAGPEASESTTDENEDDIQFVSEGPLRPVLEYIDLVSSDDEEPSTSYTDENIKRKDHIDYQKDKVALTLARLARHVEVEKQQKEEKNRAFREKIDFQHAHGLQELEFIRGHSDTEAARLCVDQWLKMPGLKTGTINCGTKSSFRRGGHTWVSGKPILCPIMHCNKEFDNGHLLLGHLKRFDHSPCDPTITLHGPFFSSFACVVCYKKFVTQQQYRDHLFDKEATDDGHNNNLLPQIIQCFACPNCFLLFSRKEECSKHMSGKNHFHQSFKLGDNKGIAHPISFPSFAKKLLISLCKDVPFQVKCVACHKTLRSHMELTAHFRVHCRNAGPVAVAEKSITQVAEKFILRGYCPDCNQVFVDETSTQNHKQNSGHKVRVINSVEESVLLYCHSSEGNKDPSSDLHLLLDQSKFSSLKRTMSIKESSSLECIAIPKKKMNLKDKSHEGVACVQKEKSVVKTWFCECNQRFPSEDAVEKHVFSANTMGYKCVVCGKVCDDSGVIRLHMSRIHGGAHLNNFLFWCRTCKKELTRKDTIMAHVTEFHNGHRYFYEMDEVEGETLPSSSTTLDNLTANKPSSAITVIDHSPANSSPRGKWQCRICEDMFDSQEYVKQHCMSLASHKFHRYSCAHCRKPFHKIETLYRHCQDEHDNEIKIKYFCGLCDLIFNVEEAFLSHYEEHHSIDYVFVSEKTETSIKTEDDFPVIETSNQLTCGCRESYICKVNRKEDYSRCLQIMLDKGKLWFRCSLCSATAQNLTDMNTHIHQVHKEKSDEEEQQYVIKCGTCTKAFHDPESAQQHFHRKHCFLQKPSVAHFGSEKSNLYKFTASASHTERKLKQAINYSKSLDMEKGVENDLSYQNIGGNTNWKPPLNCKIYNYLNRIGCFFLHPRCSKRKDAADFAICMHAGRLDEQLPKQIPFTILSGDQGFLELENQFKKTQRPAHILNPHHLEGDMMCALLNSISDTTKECDSDDNMGAKNTSIGEEFISTEDVELEEAIRRSLEEM

SEQ ID NO: 100142 - protein, 73 aa, Homo sapiens
  Payload ID: 19952
  Gene Name: zinc finger protein 451
  ENSP ID: ENSP00000359736
MGDPGSEIIESVPPAGPEASESTTDENEDDIQFVSEGPLRPVLEYIDLVSSDDEEPSTSYTDGSALCLMTLPL

SEQ ID NO: 100143 - protein, 1061 aa, Homo sapiens
  Payload ID: 19952
  Gene Name: zinc finger protein 451
  Uniprot ID: Q9Y4E5
  ENSP ID: ENSP00000359740
MGDPGSEIIESVPPAGPEASESTTDENEDDIQFVSEGPLRPVLEYIDLVSSDDEEPSTSYTDENIKRKDHIDYQKDKVALTLARLARHVEVEKQQKEEKNRAFREKIDFQHAHGLQELEFIRGHSDTEAARLCVDQWLKMPGLKTGTINCGTKSSFRRGGHTWVSGKPILCPIMHCNKEFDNGHLLLGHLKRFDHSPCDPTITLHGPFFSSFACVVCYKKFVTQQQYRDHLFDKEATDDGHNNNLLPQIIQCFACPNCFLLFSRKEECSKHMSGKNHFHQSFKLGDNKGIAHPISFPSFAKKLLISLCKDVPFQVKCVACHKTLRSHMELTAHFRVHCRNAGPVAVAEKSITQVAEKFILRGYCPDCNQVFVDETSTQNHKQNSGHKVRVINSVEESVLLYCHSSEGNKDPSSDLHLLLDQSKFSSLKRTMSIKESSSLECIAIPKKKMNLKDKSHEGVACVQKEKSVVKTWFCECNQRFPSEDAVEKHVFSANTMGYKCVVCGKVCDDSGVIRLHMSRIHGGAHLNNFLFWCRTCKKELTRKDTIMAHVTEFHNGHRYFYEMDEVEGETLPSSSTTLDNLTANKPSSAITVIDHSPANSSPRGKWQCRICEDMFDSQEYVKQHCMSLASHKFHRYSCAHCRKPFHKIETLYRHCQDEHDNEIKIKYFCGLCDLIFNVEEAFLSHYEEHHSIDYVFVSEKTETSIKTEDDFPVIETSNQLTCGCRESYICKVNRKEDYSRCLQIMLDKGKLWFRCSLCSATAQNLTDMNTHIHQVHKEKSDEEEQQYVIKCGTCTKAFHDPESAQQHFHRKHCFLQKPSVAHFGSEKSNLYKFTASASHTERKLKQAINYSKSLDMEKGVENDLSYQNIEEEIVELPDLDYLRTMTHIVFVDFDNWSNFFGHLPGHLNQGTFIWGFQGGNTNWKPPLNCKIYNYLNRIGCFFLHPRCSKRKDAADFAICMHAGRLDEQLPKQIPFTILSGDQGFLELENQFKKTQRPAHILNPHHLEGDMMCALLNSISDTTKECDSDDNMGAKNTSIGEEFISTEDVELEEAIRRSLEEM

SEQ ID NO: 100144 - protein, 559 aa, Homo sapiens
  Payload ID: 19952
  Gene Name: zinc finger protein 451
  Uniprot ID: Q9Y4E5
  ENSP ID: ENSP00000359742
MGDPGSEIIESVPPAGPEASESTTDENEDDIQFVSEGPLRPVLEYIDLVSSDDEEPSTSYTDRMPESKVPSSENHRPEMCSSCNVPLPIGDSSSFSGSCSSSPERIVSQTSSVENPLENQKNDQNNSDTKISETETLKSSQNFQTLPSSPLLVPQESLASSEVKENLRIDSSSASQHGRDAILYLQTQVAEMSRVIRDLQSRSCFRFHHSRPSENSSVPWDISTSKEENLSTVEEETDYKSPSADDKGQPSDPSQSSFTGLLKRMEQRGVIKRVTLQSEAESCEGKPDCVTSKKRLVPPLHPLLRIATTEVFKDPADCHPSSFMGHRVYPVAKDTSPFQPNPPAEGPIVEALEHSKRGNTTSPLDSTSKEMEVMGCRFYHAASIAARAASYMAYMTQYQRKLWEDMEDLVHDPEFDRGKARCIISDGMDAGLWQLCTTRDIMDSVVRVMAMAIDYRRQAWLRLTSLTKKTQEKISHLPFDGTSLFGQDVKAVVAEDNNIKENDYKDHKYYNQHRYFYSHDQKAHYHNRGYSKGDWYKPRNHPYRYRKKGDSPERHGYKN

SEQ ID NO: 100145 - protein, 75 aa, Homo sapiens
  Payload ID: 19952
  Gene Name: zinc finger protein 451
  ENSP ID: ENSP00000359744
MGDPGSEIIESVPPAGPEASESTTDENEDDIQFVSEGPLRPVLEYIDLVSSDDEEPSTSYTDVPYTTGFFCSRTT

SEQ ID NO: 100146 - protein, 1041 aa, Homo sapiens
  Payload ID: 19952
  Gene Name: zinc finger protein 451
  ENSP ID: ENSP00000421645
MGDPGSEIIESVPPAGPEASESTTDENEDDIQFVSEGPLRPVLEYIDLVSSDDEEPSTSYTDENIKRKDHIDYQKDKVALTLARLARHVEVEKQQKEEKNRAFREKIDFQHAHGLQELEFIRGHSDTEAARLCVDQWLKMPGLKTGTINCGTKSSFRRGGHTWVSGKPILCPIMHCNKEFDNGHLLLGHLKRFDHSPCDPTITLHGPFFSSFACVVCYKKFVTQQQYRDHLFDKEATDDGHNNNLLPQIIQCFACPNCFLLFSRKEECSKHMSGKNHFHQSFKLGDNKGIAHPISFPSFAKKLLISLCKDVPFQVKCVACHKTLRSHMELTAHFRVHCRNAGPVAVAEKSITQVAEKFILRGYCPDCNQVFVDETSTQNHKQNSGHKVRVINSVEESVLLYCHSSEGNKDPSSDLHLLLDQSKFSSLKRTMSIKESSSLECIAIPKKKMNLKDKSHEGVACVQKEKSVVKTWFCECNQRFPSEDAVEKHVFSANTMGYKCVVCGKVCDDSGVIRLHMSRIHGGAHLNNFLFWCRTCKKELTRKDTIMAHVTEFHNGHRYFYEMDEVEGETLPSSSTTLDNLTANKPSSAITVIDHSPANSSPRGKWQCRICEDMFDSQEYVKQHCMSLASHKFHRYSCAHCRKPFHKIETLYRHCQDEHDNEIKIKYFCGLCDLIFNVEEAFLSHYEEHHSIDYVFVSEKTETSIKTEDDFPVIETSNQLTCGCRESYICKVNRKEDYSRCLQIMLDKGKLWFRCSLCSATAQNLTDMNTHIHQVHKEKSDEEEQQYVIKCGTCTKAFHDPESAQQHFHRKHCFLQKPSVAHFGSEKSNLYKFTASASHTERKLKQAINYSKSLDMEKGVENDLSYQNIEEEIVELPDLDYLRTMTHIVFVDFDNWSNFFGHLPGHLNQGTFIWGFQGGNTNWKPPLNCKIYNYLNRIGCFFLHPRCSKRKDAADFAICMHAGRLDEQLPKQIPFTILSGDQGFLELENQFKKTQRPAHILNPHHLEGDMMCALLNSISDTTKGTQLQSQCKPPKRRRLHC

SEQ ID NO: 100147 - protein, 151 aa, Homo sapiens
  Payload ID: 19952
  Gene Name: zinc finger protein 451
  ENSP ID: ENSP00000421786
MGDPGSEEGPLRPVLEYIDLVSSDDEEPSTSYTDRMPESKVPSSENHRPEMCSSCNVPLPIGDSSSFSGSCSSSPERIVSQTSSVENPLENQKNDQNNSDTKISETETLKSSQNFQTLPSSPLLVPQESLASSEVKENLRIDSSSASQHGR

SEQ ID NO: 100148 - protein, 72 aa, Homo sapiens
  Payload ID: 19952
  Gene Name: zinc finger protein 451
  ENSP ID: ENSP00000424329
MGDPGSELALRHLSQQRMKMKTTFSLSVKDHYDLFLNTLIWSAVMMKSLAPLILMRILNVKTILIIRRIKLL

SEQ ID NO: 100149 - protein, 40 aa, Homo sapiens
  Payload ID: 19952
  Gene Name: zinc finger protein 451
  ENSP ID: ENSP00000424723
MPGLKTGTINCGTKSSFRRGGHTWVSGKPILCPIMHCNKE

SEQ ID NO: 100150 - protein, 53 aa, Homo sapiens
  Payload ID: 19952
  Gene Name: zinc finger protein 451
  ENSP ID: ENSP00000425047
MGDPGSEIIESVPPAGPEASESTTDENEDDIQFVSITKELHIQYLSHLLQRNF

SEQ ID NO: 100151 - protein, 158 aa, Homo sapiens
  Payload ID: 19952
  Gene Name: zinc finger protein 451
  ENSP ID: ENSP00000427558
MGDPGSEEGPLRPVLEYIDLVSSDDEEPSTSYTDENIKRKDHIDYQKDKVALTLARLARHVEVEKQQKEEKNRAFREKIDFQHAHGLQELEFIRGHSDTEAARLCVDQWLKMPGLKTGTINCGTKSSFRRGGHTWVSGKPILCPIMHCNKEFDNGHLL

SEQ ID NO: 100152 - protein, 75 aa, Homo sapiens; identical to SEQ ID NO: 100145
  Payload ID: 19952
  Gene Name: zinc finger protein 451
  ENSP ID: ENSP00000476915

SEQ ID NO: 100153 - protein, 522 aa, Homo sapiens
  Payload ID: 19953
  Gene Name: zinc finger protein 454
  Uniprot ID: Q8N9F8
  ENSP ID: ENSP00000326249
MAVSHLPTMVQESVTFKDVAILFTQEEWGQLSPAQRALYRDVMLENYSNLVSLGLLGPKPDTFSQLEKREVWMPEDTPGGFCLDWMTMPASKKSTVKAEIPEEELDQWTIKERFSSSSHWKCASLLEWQCGGQEISLQRVVLTHPNTPSQECDESGSTMSSSLHSDQSQGFQPSKNAFECSECGKVFSKSSTLNKHQKIHNEKNANQKIHIKEKRYECRECGKAFHQSTHLIHHQRIHTGEKPYECKECGKAFSVSSSLTYHQKIHTGEKPFECNLCGKAFIRNIHLAHHHRIHTGEKPFKCNICEKAFVCRAHLTKHQNIHSGEKPYKCNECGKAFNQSTSFLQHQRIHTGEKPFECNECGKAFRVNSSLTEHQRIHTGEKPYKCNECGKAFRDNSSFARHRKIHTGEKPYRCGLCEKAFRDQSALAQHQRIHTGEKPYTCNICEKAFSDHSALTQHKRIHTREKPYKCKICEKAFIRSTHLTQHQRIHTGEKPYKCNKCGKAFNQTANLIQHQRHHIGEK

SEQ ID NO: 100154 - protein, 522 aa, Homo sapiens; identical to SEQ ID NO: 100153
  Payload ID: 19953
  Gene Name: zinc finger protein 454
  Uniprot ID: Q8N9F8
  ENSP ID: ENSP00000430354

SEQ ID NO: 100155 - protein, 562 aa, Homo sapiens
  Payload ID: 19954
  Gene Name: zinc finger protein 460
  Uniprot ID: Q14592
  ENSP ID: ENSP00000353491
MAAAWMAPAQESVTFEDVAVTFTQEEWGQLDVTQRALYVEVMLETCGLLVALGDSTKPETVEPIPSHLALPEEVSLQEQLAQGVPRYSYLGQAMDQDGPSEMQEYFLRPGTDPQSEKLHGKMSLEHEGLATADGICSMMIQNQVSPEDALYGFDSYGPVTDSLIHEGENSYKFEEMFNENCFLVQHEQILPRVKPYDCPECGKAFGKSKHLLQHHIIHTGEKPYKCLECGKDFNRRSHLTRHQRTHNGDKPFVCSECGRTFNRGSHLTRHQRVHSGEKPFVCNECGKAFTYRSNFVLHNKSHNEKKPFACSECGKGFYESTALIQHFIIHTGERPFKCLECGKAFNCRSHLKQHERIHTGEKPFVCSQCGKAFTHYSTYVLHERAHTGEKPFECKECGKAFSIRKDLIRHFNIHTGEKPYECLQCGKAFTRMSGLTRHQWIHTGEKPYVCIQCGKAFCRTTNLIRHFSIHTGEKPYECVECGKAFNRRSPLTRHQRIHTAEKSHEPIQSGNVSCESTDLIQHSIIHTESSPVSAVNMETPSIAAHSSSLDINGFIVEETLPL

SEQ ID NO: 100156 - protein, 521 aa, Homo sapiens
  Payload ID: 19954
  Gene Name: zinc finger protein 460
  Uniprot ID: Q14592
  ENSP ID: ENSP00000446167
MLETCGLLVALGDSTKPETVEPIPSHLALPEEVSLQEQLAQGVPRYSYLGQAMDQDGPSEMQEYFLRPGTDPQSEKLHGKMSLEHEGLATADGICSMMIQNQVSPEDALYGFDSYGPVTDSLIHEGENSYKFEEMFNENCFLVQHEQILPRVKPYDCPECGKAFGKSKHLLQHHIIHTGEKPYKCLECGKDFNRRSHLTRHQRTHNGDKPFVCSECGRTFNRGSHLTRHQRVHSGEKPFVCNECGKAFTYRSNFVLHNKSHNEKKPFACSECGKGFYESTALIQHFIIHTGERPFKCLECGKAFNCRSHLKQHERIHTGEKPFVCSQCGKAFTHYSTYVLHERAHTGEKPFECKECGKAFSIRKDLIRHFNIHTGEKPYECLQCGKAFTRMSGLTRHQWIHTGEKPYVCIQCGKAFCRTTNLIRHFSIHTGEKPYECVECGKAFNRRSPLTRHQRIHTAEKSHEPIQSGNVSCESTDLIQHSIIHTESSPVSAVNMETPSIAAHSSSLDINGFIVEETLPL

SEQ ID NO: 100157 - protein, 127 aa, Homo sapiens
  Payload ID: 19954
  Gene Name: zinc finger protein 460
  ENSP ID: ENSP00000471285
MLETCGLLVALGDSTKPETVEPIPSHLALPEEVSLQEQLAQGVPRYSYLGQAMDQDGPSEMQEYFLRPGTDPQSEKLHGKMSLEHEGLATADGICSMMIQNQVSPEDALYGFDSYGPVTDSLIHEGE

SEQ ID NO: 100158 - protein, 540 aa, Homo sapiens
  Payload ID: 19955
  Gene Name: zinc finger protein 461
  ENSP ID: ENSP00000353515
MAHELVMFRDVAIDVSQEEWECLNPAQRNLYKEVMLENYSNLVSLGLSVSKPAVISSLEQGKEPWMVVREETGRWCPDLASRDEPQKLSPKRDIYETELSQWVNMEEFKSHSPERSIFSAIWEGNCHFEQHQGQEEGYFRQLMINHENMPIFSQHTLLTQEFYDREKISECKKCRKIFSYHLFFSHHKRTHSKELSECKECTEIVNTPCLFKQQTIQNGDKCNECKECWKAFVHCSQLKHLRIHNGEKRYECNECGKAFNYGSELTLHQRIHTGEKPYECKECGKAFRQRSQLTQHQRLHTGEKPYECKQCGKAFIRGFQLTEHLRLHTGEKPYECKECGKTFRHRSHLTIHQRIHTGEKPYECRECGKAFSYHSSFSHHQKIHSGKKPYECHECGKAFCDGLQLTLHQRIHTGEKPYECKECGKTFRQCSHLKRHQRIHTGEKPHECMICGKAFRLHSHLIQHQRIHTGEKPYECKECGKAFSYHSSFSHHQRIHSGKKPYQCGKAFNHRLQLNLHQTLHTGEKPVRFPLLPPHPSLAS

SEQ ID NO: 100159 - protein, 41 aa, Homo sapiens
  Payload ID: 19955
  Gene Name: zinc finger protein 461
  ENSP ID: ENSP00000380102
MAHELVMFRDVAIDVSQEEWECLNPAQRNLYKEDFLFLSQP

SEQ ID NO: 100160 - protein, 71 aa, Homo sapiens
  Payload ID: 19955
  Gene Name: zinc finger protein 461
  ENSP ID: ENSP00000464914
MFRDVAIDVSQEEWECLNPAQRNLYKEVMLENYSNLVSLGLSVSKPAVISSLEQGKEPWMVVREETGRWCP

SEQ ID NO: 100161 - protein, 46 aa, Homo sapiens
  Payload ID: 19955
  Gene Name: zinc finger protein 461
  ENSP ID: ENSP00000465235
MAHELVMFRDVAIDVSQEEWECLNPAQRNLYKEVMLENYSNLVSLG

SEQ ID NO: 100162 - protein, 70 aa, Homo sapiens
  Payload ID: 19955
  Gene Name: zinc finger protein 461
  ENSP ID: ENSP00000465668
MAHELVMFRDVAIDVSQEEWECLNPAQRNLYKEARVQWRDLGSPQPLPPSFKQFSCLSLPSSCDYRTFCF

SEQ ID NO: 100163 - protein, 563 aa, Homo sapiens
  Payload ID: 19955
  Gene Name: zinc finger protein 461
  Uniprot ID: Q8TAF7
  ENSP ID: ENSP00000467931
MAHELVMFRDVAIDVSQEEWECLNPAQRNLYKEVMLENYSNLVSLGLSVSKPAVISSLEQGKEPWMVVREETGRWCPGTWKTWGFHNNFLDNNEATDINADLASRDEPQKLSPKRDIYETELSQWVNMEEFKSHSPERSIFSAIWEGNCHFEQHQGQEEGYFRQLMINHENMPIFSQHTLLTQEFYDREKISECKKCRKIFSYHLFFSHHKRTHSKELSECKECTEIVNTPCLFKQQTIQNGDKCNECKECWKAFVHCSQLKHLRIHNGEKRYECNECGKAFNYGSELTLHQRIHTGEKPYECKECGKAFRQRSQLTQHQRLHTGEKPYECKQCGKAFIRGFQLTEHLRLHTGEKPYECKECGKTFRHRSHLTIHQRIHTGEKPYECRECGKAFSYHSSFSHHQKIHSGKKPYECHECGKAFCDGLQLTLHQRIHTGEKPYECKECGKTFRQCSHLKRHQRIHTGEKPHECMICGKAFRLHSHLIQHQRIHTGEKPYECKECGKAFSYHSSFSHHQRIHSGKKPYQCGKAFNHRLQLNLHQTLHTGEKPVRFPLLPPHPSLAS

SEQ ID NO: 100164 - protein, 142 aa, Homo sapiens
  Payload ID: 19955
  Gene Name: zinc finger protein 461
  ENSP ID: ENSP00000468822
MVVREETGRWCPDLASRDEPQKLSPKRDIYETELSQWVNMEEFKSHSPERSIFSAIWEGNCHFEQHQGQEEGYFRQLMINHENMPIFSQHTLLTQEFYDREKISECKKCRKIFSYHLFFSHHKRTHSKELSECKECTEIVNT

SEQ ID NO: 100165 - protein, 258 aa, Homo sapiens
  Payload ID: 19955
  Gene Name: zinc finger protein 461
  ENSP ID: ENSP00000479057
EKRYECNECGKAFNYGSELTLHQRIHTGEKPYECKECGKAFRQRSQLTQHQRLHTGEKPYECKQCGKAFIRGFQLTEHLRLHTGEKPYECKECGKTFRHRSHLTIHQRIHTGEKPYECRECGKAFSYHSSFSHHQKIHSGKKPYECHECGKAFCDGLQLTLHQRIHTGEKPYECKECGKTFRQCSHLKRHQRIHTGEKPHECMICGKAFRLHSHLIQHQRIHTGEKPYECKECGKAFSYHSSFSHHQRIHSDATTAIS

SEQ ID NO: 100166 - protein, 563 aa, Homo sapiens
  Payload ID: 19955
  Gene Name: zinc finger protein 461
  ENSP ID: ENSP00000479585
LTHELVMFRDVAIDVSQEEWECLNPAQRNLYKEVMLENYSNLVSLGLSVSKPAVISSLEQGKEPWMVVREETGRWCPGTWKTWGFHNNFLDNNEATDINADLASRDEPQKLSPKRDIYETELSQWVNMEEFKSHSPERSIFSAIWEGNCHFEQHQGQEEGYFRQLMINHENMPIFSQHTLLTQEFYDREKISECKKCRKIFSYHLFFSHHKRTHSKELSECKECTEIVNTPCLFKQQTIQNGDKCNECKECWKAFVHCSQLKHLRIHNGEKRYECNECGKAFNYGSELTLHQRIHTGEKPYECKECGKAFRQRSQLTQHQRLHTGEKPYECKQCGKAFIRGFQLTEHLRLHTGEKPYECKECGKTFRHRSHLTIHQRIHTGEKPYECRECGKAFSYHSSFSHHQKIHSGKKPYECHECGKAFCDGLQLTLHQRIHTGEKPYECKECGKTFRQCSHLKRHQRIHTGEKPHECMICGKAFRLHSHLIQHQRIHTGEKPYECKECGKAFSYHSSFSHHQRIHSGKKPYQCGKAFNHRLQLNLHQTLHTGEKPVRFPLLPPHPSLAS

SEQ ID NO: 100167 - protein, 2506 aa, Homo sapiens
  Payload ID: 19956
  Gene Name: zinc finger protein 462
  Uniprot ID: Q96JM2
  ENSP ID: ENSP00000277225
MEVLQCDGCDFRAPSYEDLKAHIQDVHTAFLQPTDVAEDNVNELRCGSVNASNQTEVEFSSIKDEFAIAEDLSGQNATSLGTGGYYGHSPGYYGQHIAANPKPTNKFFQCKFCVRYFRSKNLLIEHTRKVHGAQAEGSSSGPPVPGSLNYNIMMHEGFGKVFSCQFCTYKSPRRARIIKHQKMYHKNNLKETTAPPPAPAPMPDPVVPPVSLQDPCKELPAEVVERSILESMVKPLTKSRGNFCCEWCSYQTPRRERWCDHMMKKHRSMVKILSSLRQQQEGTNLPDVPNKSAPSPTSNSTYLTMNAASREIPNTTVSNFRGSMGNSIMRPNSSASKFSPMSYPQMKPKSPHNSGLVNLTERSRYGMTDMTNSSADLETNSMLNDSSSDEELNEIDSENGLSAMDHQTSGLSAEQLMGSDGNKLLETKGIPFRRFMNRFQCPFCPFLTMHRRSISRHIENIHLSGKTAVYKCDECPFTCKSSLKLGAHKQCHTGTTSDWDAVNSQSESISSSLNEGVVSYESSSINGRKSGVMLDPLQQQQPPQPPPPPPPPPPSQPQPLQQPQPPQLQPPHQVPPQPQTQPPPTQQPQPPTQAAPLHPYKCTMCNYSTTTLKGLRVHQQHKHSFCDNLPKFEGQPSSLPLENETDSHPSSSNTVKKSQTSILGLSSKNNFVAKASRKLANDFPLDLSPVKKRTRIDEIASNLQSKINQTKQQEDAVINVEDDEEEEEDNEVEIEVELDREEEPTEPIIEVPTSFSAQQIWVRDTSEPQKEPNFRNITHDYNATNGAEIELTLSEDEEDYYGSSTNLKDHQVSNTALLNTQTPIYGTEHNSENTDFGDSGRLYYCKHCDFNNKSARSVSTHYQRMHPYIKFSFRYILDPNDHSAVYRCLECYIDYTNFEDLQQHYGEHHPEAMNVLNFDHSDLIYRCRFCSYTSPNVRSLMPHYQRMHPTVKINNAMIFSSYVVEQQEGLNTESQTLREILNSAPKNMATSTPVARGGGLPATFNKNTPKTFTPECENQKDPLVNTVVVYDCDVCSFASPNMHSVLVHYQKKHPEEKASYFRIQKTMRMVSVDRGSALSQLSFEVGAPMSPKMSNMGSPPPPQPPPPDLSTELYYCKHCSYSNRSVVGVLVHYQKRHPEIKVTAKYIRQAPPTAAMMRGVEGPQGSPRPPAPIQQLNRSSSERDGPPVENEMFFCQHCDYGNRTVKGVLIHYQKKHRDFKANADVIRQHTATIRSLCDRNQKKPASCVLVSPSNLERDKTKLRALKCRQCSYTSPYFYALRKHIKKDHPALKATVTSIMRWAFLDGLIEAGYHCEWCIYSHTEPNGLLLHYQRRHPEHYVDYTYMATKLWAGPDPSPPSLTMPAEAKTYRCRDCVFEAVSIWDITNHYQAFHPWAMNGDESVLLDIIKEKDAVEKPILSSEELAGPVNCENSIPTPFPEQEAECPEDARLSPEKSLQLASANPAISSTPYQCTVCQSEYNNLHGLLTHYGKKHPGMKVKAADFAQDIDINPGAVYKCRHCPYINTRIHGVLTHYQKRHPSIKVTAEDFVHDVEQSADISQNDVEETSRIFKQGYGAYRCKLCPYTHGTLEKLKIHYEKYHNQPEFDVFSQSPPKLPVPLEPEMTTEVSPSQVSITEEEVGEEPVSTSHFSTSHLVSHTVFRCQLCKYFCSTRKGIARHYRIKHNNVRAQPEGKNNLFKCALCAYTNPIRKGLAAHYQKRHDIDAYYTHCLAASRTISDKPNKVIIPSPPKDDSPQLSEELRRAVEKKKCSLCSFQSFSKKGIVSHYMKRHPGVFPKKQHASKLGGYFTAVYADEHEKPTLMEEEERGNFEKAEVEGEAQEIEWLPFRCIKCFKLSFSTAELLCMHYTDHHSRDLKRDFIILGNGPRLQNSTYQCKHCDSKLQSTAELTSHLNIHNEEFQKRAKRQERRKQLLSKQKYADGAFADFKQERPFGHLEEVPKIKERKVVGYKCKFCVEVHPTLRAICNHLRKHVQYGNVPAVSAAVKGLRSHERSHLALAMFTREDKYSCQYCSFVSAFRHNLDRHMQTHHGHHKPFRCKLCSFKSSYNSRLKTHILKAHAGEHAYKCSWCSFSTMTISQLKEHSLKVHGKALTLPRPRIVSLLSSHSHHSSQKATPAEEVEDSNDSSYSEPPDVQQQLNHYQSAALARNNSRVSPVPLSGAAAGTEQKTEAVLHCEFCEFSSGYIQSIRRHYRDKHGGKKLFKCKDCSFYTGFKSAFTMHVEAGHSAVPEEGPKDLRCPLCLYHTKYKRNMIDHIVLHREERVVPIEVCRSKLSKYLQGVVFRCDKCTFTCSSDESLQQHIEKHNELKPYKCQLCYYETKHTEELDSHLRDEHKVSRNFELVGRVNLDQLEQMKEKMESSSSDDEDKEEEMNSKAEDRELMRFSDHGAALNTEKRFPCEFCGRAFSQGSEWERHVLRHGMALNDTKQVSREEIHPKEIMENSVKMPSIEEKEDDEAIGIDFSLKNETVAICVVTADKSLLENAEAKKE

SEQ ID NO: 100168 - protein, 1449 aa, Homo sapiens
  Payload ID: 19956
  Gene Name: zinc finger protein 462
  ENSP ID: ENSP00000363818
HCSYSNRSVVGVLVHYQKRHPEIKVTAKYIRQAPPTAAMMRGVEGPQGSPRPPAPIQQLNRSSSERDGPPVENEMFFCQHCDYGNRTVKGVLIHYQKKHRDFKANADVIRQHTATIRSLCDRNQKKPASCVLVSPSNLERDKTKLRALKCRQCSYTSPYFYALRKHIKKDHPALKATVTSIMRWAFLDGLIEAGYHCEWCIYSHTEPNGLLLHYQRRHPEHYVDYTYMATKLWAGPDPSPPSLTMPAEAKTYRCRDCVFEAVSIWDITNHYQAFHPWAMNGDESVLLDIIKEKDAVEKPILSSEELAGPVNCENSIPTPFPEQEAECPEDARLSPEKSLQLASANPAISSTPYQCTVCQSEYNNLHGLLTHYGKKHPGMKVKAADFAQDIDINPGAVYKCRHCPYINTRIHGVLTHYQKRHPSIKVTAEDFVHDVEQSADISQNDVEETSRIFKQGYGAYRCKLCPYTHGTLEKLKIHYEKYHNQPEFDVFSQSPPKLPVPLEPEMTTEVSPSQVSITEEEVGEEPVSTSHFSTSHLVSHTVFRCQLCKYFCSTRKGIARHYRIKHNNVRAQPEGKNNLFKCALCAYTNPIRKGLAAHYQKRHDIDAYYTHCLAASRTISDKPNKVIIPSPPKDDSPQLSEELRRAVEKKKCSLCSFQSFSKKGIVSHYMKRHPGVFPKKQHASKLGGYFTAVYADEHEKPTLMEEEERGNFEKAEVEGEAQEIEWLPFRCIKCFKLSFSTAELLCMHYTDHHSRDLKRDFIILGNGPRLQNSTYQCKHCDSKLQSTAELTSHLNIHNEEFQKRAKRQERRKQLLSKQKYADGAFADFKQERPFGHLEEVPKIKERKVVGYKCKFCVEVHPTLRAICNHLRKHVQYGNVPAVSAAVKEADDPAHLFLDGLEAAKDASGALVGRVDGEHCLLDGMLEDETRPGGYHCSQCDRVLMSMQGLRSHERSHLALAMFTREDKYSCQYCSFVSAFRHNLDRHMQTHHGHHKPFRCKLCSFKSSYNSRLKTHILKAHAGEHAYKCSWCSFSTMTISQLKEHSLKVHGKALTLPRPRIVSLLSSHSHHSSQKATPAEEVEDSNDSSYSEPPDVQQQLNHYQSAALARNNSRVSPVPLSGAAAGTEQKTEAVLHCEFCEFSSGYIQSIRRHYRDKHGGKKLFKCKDCSFYTGFKSAFTMHVEAGHSAVPEEGPKDLRCPLCLYHTKYKRNMIDHIVLHREERVVPIEVCRSKLSKYLQGVVFRCDKCTFTCSSDESLQQHIEKHNELKPYKCQLCYYETKHTEELDSHLRDEHKVSRNFELVGRVNLDQLEQMKEKMESSSSDDEDKEEEMNSKAEDRELMRFSDHGAALNTEKRFPCEFCGRAFSQGSEWERHVLRHGMALNDTKQVSREEIHPKEIMENSVKMPSIEEKEDDEAIGIDFSLKNETVAICVVTADKSLLENAEAKKE

SEQ ID NO: 100169 - protein, 1412 aa, Homo sapiens
  Payload ID: 19956
  Gene Name: zinc finger protein 462
  Uniprot ID: Q96JM2
  ENSP ID: ENSP00000397306
MMRGVEGPQGSPRPPAPIQQLNRSSSERDGPPVENEMFFCQHCDYGNRTVKGVLIHYQKKHRDFKANADVIRQHTATIRSLCDRNQKKPASCVLVSPSNLERDKTKLRALKCRQCSYTSPYFYALRKHIKKDHPALKATVTSIMRWAFLDGLIEAGYHCEWCIYSHTEPNGLLLHYQRRHPEHYVDYTYMATKLWAGPDPSPPSLTMPAEAKTYRCRDCVFEAVSIWDITNHYQAFHPWAMNGDESVLLDIIKEKDAVEKPILSSEELAGPVNCENSIPTPFPEQEAECPEDARLSPEKSLQLASANPAISSTPYQCTVCQSEYNNLHGLLTHYGKKHPGMKVKAADFAQDIDINPGAVYKCRHCPYINTRIHGVLTHYQKRHPSIKVTAEDFVHDVEQSADISQNDVEETSRIFKQGYGAYRCKLCPYTHGTLEKLKIHYEKYHNQPEFDVFSQSPPKLPVPLEPEMTTEVSPSQVSITEEEVGEEPVSTSHFSTSHLVSHTVFRCQLCKYFCSTRKGIARHYRIKHNNVRAQPEGKNNLFKCALCAYTNPIRKGLAAHYQKRHDIDAYYTHCLAASRTISDKPNKVIIPSPPKDDSPQLSEELRRAVEKKKCSLCSFQSFSKKGIVSHYMKRHPGVFPKKQHASKLGGYFTAVYADEHEKPTLMEEEERGNFEKAEVEGEAQEIEWLPFRCIKCFKLSFSTAELLCMHYTDHHSRDLKRDFIILGNGPRLQNSTYQCKHCDSKLQSTAELTSHLNIHNEEFQKRAKRQERRKQLLSKQKYADGAFADFKQERPFGHLEEVPKIKERKVVGYKCKFCVEVHPTLRAICNHLRKHVQYGNVPAVSAAVKQEADDPAHLFLDGLEAAKDASGALVGRVDGEHCLLDGMLEDETRPGGYHCSQCDRVLMSMQGLRSHERSHLALAMFTREDKYSCQYCSFVSAFRHNLDRHMQTHHGHHKPFRCKLCSFKSSYNSRLKTHILKAHAGEHAYKCSWCSFSTMTISQLKEHSLKVHGKALTLPRPRIVSLLSSHSHHSSQKATPAEEVEDSNDSSYSEPPDVQQQLNHYQSAALARNNSRVSPVPLSGAAAGTEQKTEAVLHCEFCEFSSGYIQSIRRHYRDKHGGKKLFKCKDCSFYTGFKSAFTMHVEAGHSAVPEEGPKDLRCPLCLYHTKYKRNMIDHIVLHREERVVPIEVCRSKLSKYLQGVVFRCDKCTFTCSSDESLQQHIEKHNELKPYKCQLCYYETKHTEELDSHLRDEHKVSRNFELVGRVNLDQLEQMKEKMESSSSDDEDKEEEMNSKAEDRELMRFSDHGAALNTEKRFPCEFCGRAFSQGSEWERHVLRHGMALNDTKQVSREEIHPKEIMENSVKMPSIEEKEDDEAIGIDFSLKNETVAICVVTADKSLLENAEAKKE

SEQ ID NO: 100170 - protein, 208 aa, Homo sapiens
  Payload ID: 19956
  Gene Name: zinc finger protein 462
  ENSP ID: ENSP00000405837
  MOD_RES (1)..(1): Any amino acid
XEHSLKVHGKALTLPRPRIVSLLSSHSHHSSQKATPAEEVEDSNDSSYSEPPDVQQQLNHYQSAALARNNSRVSPVPLSGAAAGTEQKTEAVLHCEFCEFSSGYIQSIRRHYRDKHGGKKLFKCKDCSFYTGFKSAFTMHVEAGHSAVPEEGPKDLRCPLCLYHTKYKRNMIDHIVLHRGNLSNLVFLDAAGGRQQRWPSRDALSEWQ

SEQ ID NO: 100171 - protein, 110 aa, Homo sapiens
  Payload ID: 19956
  Gene Name: zinc finger protein 462
  ENSP ID: ENSP00000476222
MEVLQCDGCDFRAPSYEDLKAHIQDVHTAFLQPTDVAEDNVNELRCGSVNASNQTEVEFSSIKDEFAIAEDLSGQNATSLGTGGYYGHSPGYYAFWSLRRGAKDQGEESG

SEQ ID NO: 100172 - protein, 595 aa, Homo sapiens
  Payload ID: 19957
  Gene Name: zinc finger protein 467
  Uniprot ID: Q7Z7K2
  ENSP ID: ENSP00000304769
MRETLEALSSLGFSVGQPEMAPQSEPREGSHNAQEQMSSSREERALGVCSGHEAPTPEEGAHTEQAEAPCRGQACSAQKAQPVGTCPGEEWMIRKVKVEDEDQEAEEEVEWPQHLSLLPSPFPAPDLGHLAAAYKLEPGAPGALSGLALSGWGPMPEKPYGCGECERRFRDQLTLRLHQRLHRGEGPCACPDCGRSFTQRAHMLLHQRSHRGERPFPCSECDKRFSKKAHLTRHLRTHTGERPYPCAECGKRFSQKIHLGSHQKTHTGERPFPCTECEKRFRKKTHLIRHQRIHTGERPYQCAQCARSFTHKQHLVRHQRVHQTAGPARPSPDSSASPHSTAPSPTPSFPGPKPFACSDCGLSFGWKKNLATHQCLHRSEGRPFGCDECALGATVDAPAAKPLASAPGGPGCGPGSDPVVPQRAPSGERSFFCPDCGRGFSHGQHLARHPRVHTGERPFACTQCDRRFGSRPNLVAHSRAHSGARPFACAQCGRRFSRKSHLGRHQAVHTGSRPHACAVCARSFSSKTNLVRHQAIHTGSRPFSCPQCGKSFSRKTHLVRHQLIHGEAAHAAPDAALAAPAWSAPPEVAPPPLFF

SEQ ID NO: 100173 - protein, 146 aa, Homo sapiens
  Payload ID: 19957
  Gene Name: zinc finger protein 467
  ENSP ID: ENSP00000418011
MRETLEALSSLGFSVGQPEMAPQSEPREGSHNAQEQMSSSREERALGVCSGHEAPTPEEGAHTEQAEAPCRGQACSAQKAQPVGTCPVSRGPCHETAWGEQGDLGCCPKVWPPRDTCFLPAVSASAQHTQLGPPRTETQRTLAGNR

SEQ ID NO: 100174 - protein, 127 aa, Homo sapiens
  Payload ID: 19958
  Gene Name: zinc finger protein 468
  ENSP ID: ENSP00000243639
MALPQGLLTFRDVAIEFSQEEWKCLDPAQRTLYRDVMLENYRNLVSLEFWSVIPAKVQWCHLRSLQPPLPRFKQFSCLSLPSTWDYRYLFQMHVEDVVVNRARQYRSDPHRDIAQTSKSSHWRILFP

SEQ ID NO: 100175 - protein, 127 aa, Homo sapiens [sequence omitted]

SEQ ID NO: 100176 - protein, 45 aa, Homo sapiens
  Payload ID: 19958
  Gene Name: zinc finger protein 468
  ENSP ID: ENSP00000469733
MDGHGVRVLWCQCSWAAGIVQGPHLDALSAHCGPGLEQLPMGVTY

SEQ ID NO: 100177 - protein, 137 aa, Homo sapiens
  Payload ID: 19958
  Gene Name: zinc finger protein 468
  ENSP ID: ENSP00000469779
MALPQGLLTFRDVAIEFSQEEWKCLDPAQRTLYRDVMLENYRNLVSLVRRSEVCCTDIWAEVIVADISSKCMLKTLSSTGQGNTEVIHTGTLHRQASHHIGEFCFHEIEKDIHGFEFQWKEDETNGHAAPMTEIKEL

SEQ ID NO: 100178 - protein, 522 aa, Homo sapiens
  Payload ID: 19958
  Gene Name: zinc finger protein 468
  Uniprot ID: Q5VIY5
  ENSP ID: ENSP00000470381
MALPQGLLTFRDVAIEFSQEEWKCLDPAQRTLYRDVMLENYRNLVSLDISSKCMLKTLSSTGQGNTEVIHTGTLHRQASHHIGEFCFHEIEKDIHGFEFQWKEDETNGHAAPMTEIKELAGSTGQHDQRHAGNKRIKDQLGSSFHLHLPEPHIFQSEGKIGNQVEKSINNASSVSTSQRICCRPKTHISNKYGNNSLHSSLLTQKWEVHMREKSFECIQSFKSFNCSSLLKKHQIIHLEEKQCKCDVCGKVFNQKRYLACHRRCHTGEKPYKCNECGKTFGHNSSLFIHKALHTGEKPYECEECDKVFSRKSHLERHKRIHTGEKPYKCKVCDEAFAYNSYLAKHTILHTGEKPYTCNECGKVFNRLSTLARHHRLHTGEKPYKCEECDKVFSRKSHLERHRRIHSGEKPYKCEECCKVFSRKSNLERHRRIHTGEKPYKCKVCDKAFQRDSHLAQHQRVHTGEKPYKCNECGKTFGQTSSLIIHRRLHTGEKPYKCNECGKTFSQMSSLVYHHRLHSGEKP

SEQ ID NO: 100179 - protein, 45 aa, Homo sapiens
  Payload ID: 19958
  Gene Name: zinc finger protein 468
  ENSP ID: ENSP00000470717
MLENYRNLVSLEFWSVIPAKVQWCHLRSLQPPLPRFKQFSCLSLP

SEQ ID NO: 100180 - protein, 77 aa, Homo sapiens
  Payload ID: 19958
  Gene Name: zinc finger protein 468
  ENSP ID: ENSP00000471675
MALPQVPSLVTQCHELGKRLHWAGPGKGSHPDMDGHGVRVLWCQCSWAAGIVQGPHLDALSAHCGPGLEQLPMGVTY

SEQ ID NO: 100181 - protein, 3925 aa, Homo sapiens
  Payload ID: 19959
  Gene Name: zinc finger protein 469
  Uniprot ID: Q96JG9
  ENSP ID: ENSP00000402343
MPGERPRGAPPPTMTGDLQPRQVASSPGHPSQPPLEDNTPATRTTKGAREAGGQAQAMELPEAQPRQARDGELKPPSLRGQAPSSTPGKRGSPQTPPGRSPLQAPSRLAGRAEGSPPQRYILGIASSRTKPTLDETPENPQLEAAQLPEVDTPQGPGTGAPLRPGLPRTEAQPAAEELGFHRCFQEPPSSFTSTNYTSPSATPRPPAPGPPQSRGTSPLQPGSYPEYQASGADSWPPAAENSFPGANFGVPPAEPEPIPKGSRPGGSPRGVSFQFPFPALHGASTKPFPADVAGHAFTNGPLVFAFHQPQGAWPEEAVGTGPAYPLPTQPAPSPLPCYQGQPGGLNRHSDLSGALSSPGAAHSAPRPFSDSLHKSLTKILPERPPSAQDGLGSTRGPPSSLPQRHFPGQAYRASGVDTSPGPPDTELAAPGPPPARLPQLWDPTAAPYPTPPGGPLAATRSMFFNGQPSPGQRLCLPQSAPLPWPQVLPTARPSPHGMEMLSRLPFPAGGPEWQGGSQGALGTAGKTPGPREKLPAVRSSQGGSPALFTYNGMTDPGAQPLFFGVAQPQVSPHGTPSLPPPRVVGASPSESPLPSPATNTAGSTCSSLSPMSSSPANPSSEESQLPGPLGPSAFFHPPTHPQETGSPFPSPEPPHSLPTHYQPEPAKAFPFPADGLGAEGAFQCLEETPFPHEGPEVGRGGLQGFPRAPPPYPTHHFSLSSASLDQLDVLLTCRQCDRNYSSLAAFLAHRQFCGLLLARAKDGHQRSPGPPGLPSPPAAPRVPADAHAGLLSHAKTFLLAGDAQAEGKDDPLRTGFLPSLAATPFPLPASDLDMEDDAKLDSLITEALNGMEYQSDNPEIDSSFIDVFADEEPSGPRGPSSGHPLKSKAGVTPESKAPPPLPAATPDPQTPRPGDRGCPARGRPKTRSLGLAPTEADAPSQGRQQRRGKQLKLFRKDLDSGGAAEGSGSGGGGRASGLRPRRNDGLGERPPPRPRRPRTQAPGSRADPAPRVPRAAALPEETRSSRRRRLPPRKDPRKRKARGGAWGKELILKIVQQKNRLREYDFASESEEDEQPPPRGPGFRGRRGRGEKRKEVELTQGPREDEPQKPRKAARQEAGGDGAPANPEEPGGSRPGPGRSPQARGPSRSLETGAAAREGGPKCADRPSVAPKDPLQVPTNTETSEETRPSLDFPQEAKEPETAEESAPDSTEFTEALRSPPAACAGEMGASPGLLIPEQPPPSRHDTGTPKPSGSLANTAPHGSSPTPGVGSLLGGPGGTQAPVSHNSKDPPARQPGEFLAPVANPSSTACPKPSVLSSKISSFGCDPAGFNRDPLGVPVAKKGPQPYSSPHSELFLGPKDLAGCFLEELHPKPSARDAPPASSSCLCQDGEDAGSLEPQLPRSPPGTAETEPGRAASPPTLESSSLFPDLPVDRFDPPLYGSLSANRDSGLPFACADPPQKTVPSDPPYPSFLLLEEVSPMLPSHFPDLSGGKVLSKTCPPERTVVPGAAPSLPGKGSGCSVALMSHLSEDELEIQKLVTELESQLQRSKDTRGAPRELAEAESVGRVELGTGTEPPSQRRTCQATVPHEDTFSAADLTRVGESTAHREGAESAVATVEAVQGRPGGTWPCPASFHPGHAALLPCAQEDLVSGAPFSPRGANFHFQPVQKAGASKTGLCQAEGDSRPPQDVCLPEPSKQPGPQLDAGSLAKCSPDQELSFPKNKEAASSQESEDSLRLLPCEQRGGFLPEPGTADQPHRGAPAPEAFGSPAVHLAPDLAFQGDGAPPLDATWPFGASPSHAAQGHSAGRAGGHLHPTAGRPGFEGNEFAPAGASSLTAPRGREAWLVPVPSPACVSNTHPSRRSQDPALSPPIRQLQLPGPGVAKSKDGILGLQELTPAAQSPPRVNPSGLEGGTVEGGKVACGPAQGSPGGVQVTTLPAVAGHQLGLEADGHWGLLGQAEKTQGQGTANQLQPENGVSPGGTDNHASVNASPKTALTGPTEGAVLLEKCKGSRAAMSLQEEAEPTPSPPSPNRESLALALTAAHSRSGSEGRTPERASSPGLNKPLLATGDSPAPSVGDLAACAPSPTSAAHMPCSLGPLPREDPLTSPSRAQGGLGGQLPASPSCRDPPGPQQLLACSPAWAPLEEADGVQATTDTGAEDSPVAPPSLTTSPCDPKEALAGCLLQGEGSPLEDPSSWPPGSVSAVTCTHSGDTPKDSTLRIPEDSRKEKLWESPGRATSPPLAGAVSPSVAVRATGLSSTPTGDEAQAGRGLPGPDPQSRGAPPHTNPDRMPRGHSSYSPSNTARLGHREGQAVTAVPTEPPTLQGAGPDSPACLEGEMGTSSKEPEDPGTPETGRSGATKMPRVTCPSTGLGLGRTTAPSSTASDFQSDSPQSHRNASHQTPQGDPLGPQDLKQRSRGYKKKPASTENGQWKGQAPHGPVTCEVCAASFRSGPGLSRHKARKHRPHPGAPAEPSPAALPAQQPLEPLAQKCQPPRKKSHRVSGKERPNHSRGDPSHVTQPPPAQGSKEVLRAPGSPHSQQLHPPSPTEHEVDVKTPASKPRPDQAREDELHPKQAEKREGRRWRREPTVDSPSHSEGKSNKKRGKLRGRRLREESILPVSADVISDGRGSRPSPAMASYAASPSHCLSVEGGPEADGEQPPRLATLGPGVMEGAAETDQEALCAGETGAQKPPGDRMLCPGRMDGAALGEQPTGQKGASARGFWGPRETKALGVCKESGSEPAEDSSRAHSRSEEGVWEENTPPLGPLGFPETSSSPADSTTSSCLQGLPDNPDTQGGVQGPEGPTPDASGSSAKDPPSLFDDEVSFSQLFPPGGRLTRKRNPHVYGKRCEKPVLPLPTQPSFEEGGDPTLGPARLPTDLSDSSSLCLCHEDPWEDEDPAGLPESFLLDGFLNSRVPGIDPWAPGLSLWALEPSREAGAEKLPSHCPEDDRPEAIPELHMVPAAWRGLEMPAPADDSSSSLGDVSPEPPSLERERCDGGLPGNTHLLPLRATDFEVLSTKFEMQDLCFLGPFEDPVGLPGPSFLDFEGTASSQGPQSRRTEEAAGAGRAQGRGRPAKGRRASYKCKVCFQRFRSLGELDLHKLAHTPAPPPTCYMCVERRFGSRELLRGHLQERHAQSKAGPWACGMCLKEVADVWMYNEHLREHAVRFARRGQARRSLGDLPGGLEGSSAVAHLLNSITEPAPKHHRGKRSAGKAAGSPGDPWGQEGEAKKDSPGERAKPRARSTPSNPDGAATPDSASATALADAGSPGPPRTTPSPSPDPWAGGEPLLQATPVHEACKDPSRDCHHCGKRFPKPFKLQRHLAVHSPQRVYLCPRCPRVYPEHGELLAHLGGAHGLLERPELQHTPLYACELCATVMRIIKKSFACSSCNYTFAKKEQFDRHMNKHLRGGRQPFAFRGVRRPGAPGQKARALEGTLPSKRRRVAMPGSAPGPGEDRPPPRGSSPILSEGSLPALLHLCSEVAPSTTKGWPETLERPVDPVTHPIRGCELPSNHQECPPPSLSPFPAALADGRGDCALDGALERPENEASPGSPGPLLQQALPLGASLPRPGARGQDAEGKRAPLVFSGKRRAPGARGRCAPDHFQEDHLLQKEKEVSSSHMVSEGGPRGAFHKGSATKPAGCQSSSKDRSAASTPSKALKFPVHPRKAVGSLAPGELARGTENGMKPATPKAKPGPSSQGSGSPRPGTKTGGGSQPQPASGQLQSETATTPAKPSFPSRSPAPERLPARAQAKSCTKGPREAGEQGPHGSLGPKEKGESSTKRKKGQVPGPARSESVGSFGRAPSAPDKPPRTPRKQATPSRVLPTKPKPNSQNKPRPPPSEQRKAEPGHTQRKDRLGKAFPQGRPLLRPPKRGTAVHGAEPAEPHTHRTAEAQSDLLSQLFGQRLTGFKIPLKKDASE

SEQ ID NO: 100182 - protein, 3953 aa, Homo sapiens
  Payload ID: 19959
  Gene Name: zinc finger protein 469
  ENSP ID: ENSP00000456500
MPGERPRGAPPPTMTGDLQPRQVASSPGHPSQPPLEDNTPATRTTKGAREAGGQAQAMELPEAQPRQARDGELKPPSLRGQAPSSTPGKRGSPQTPPGRSPLQAPSRLAGRAEGSPPQRYILGIASSRTKPTLDETPENPQLEAAQLPEVDTPQGPGTGAPLRPGLPRTEAQPAAEELGFHRCFQEPPSSFTSTNYTSPSATPRPPAPGPPQSRGTSPLQPGSYPEYQASGADSWPPAAENSFPGANFGVPPAEPEPIPKGSRPGGSPRGVSFQFPFPALHGASTKPFPADVAGHAFTNGPLVFAFHQPQGAWPEEAVGTGPAYPLPTQPAPSPLPCYQGQPGGLNRHSDLSGALSSPGAAHSAPRPFSDSLHKSLTKILPERPPSAQDGLGSTRGPPSSLPQRHFPGQAYRASGVDTSPGPPDTELAAPGPPPARLPQLWDPTAAPYPTPPGGPLAATRSMFFNGQPSPGQRLCLPQSAPLPWPQVLPTARPSPHGMEMLSRLPFPAGGPEWQGGSQGALGTAGKTPGPREKLPAVRSSQGGSPALFTYNGMTDPGAQPLFFGVAQPQVSPHGTPSLPPPRVVGASPSESPLPSPATNTAGSTCSSLSPMSSSPANPSSEESQLPGPLGPSAFFHPPTHPQETGSPFPSPEPPHSLPTHYQPEPAKAFPFPADGLGAEGAFQCLEETPFPHEGPEVGRGGLQGFPRAPPPYPTHHFSLSSASLDQLDVLLTCRQCDRNYSSLAAFLAHRQFCGLLLARAKDGHQRSPGPPGLPSPPAAPRVPADAHAGLLSHAKTFLLAGDAQAEGKDDPLRTGFLPSLAATPFPLPASDLDMEDDAKLDSLITEALNGMEYQSDNPEIDSSFIDVFADEEPSGPRGPSSGHPLKSKAGVTPESKAPPPLPAATPDPQTPRPGDRGCPARGRPKTRSLGLAPTEADAPSQGRQQRRGKQLKLFRKDLDSGGAAEGSGSGGGGRASGLRPRRNDGLGERPPPRPRRPRTQAPGSRADPAPRVPRAAALPEETRSSRRRRLPPRKDPRKRKARGGAWGKELILKIVQQKNRRHRRLGRRAGRCGSLAAGRPRPGAEDRRLREYDFASESEEDEQPPPRGPGFRGRRGRGEKRKEVELTQGPREDEPQKPRKAARQEAGGDGAPANPEEPGGSRPGPGRSPQARGPSRSLETGAAAREGGPKCADRPSVAPKDPLQVPTNTETSEETRPSLDFPQEAKEPETAEESAPDSTEFTEALRSPPAACAGEMGASPGLLIPEQPPPSRHDTGTPKPSGSLANTAPHGSSPTPGVGSLLGGPGGTQAPVSHNSKDPPARQPGEFLAPVANPSSTACPKPSVLSSKISSFGCDPAGFNRDPLGVPVAKKGPQPYSSPHSELFLGPKDLAGCFLEELHPKPSARDAPPASSSCLCQDGEDAGSLEPQLPRSPPGTAETEPGRAASPPTLESSSLFPDLPVDRFDPPLYGSLSANRDSGLPFACADPPQKTVPSDPPYPSFLLLEEVSPMLPSHFPDLSGGKVLSKTCPPERTVVPGAAPSLPGKGSGCSVALMSHLSEDELEIQKLVTELESQLQRSKDTRGAPRELAEAESVGRVELGTGTEPPSQRRTCQATVPHEDTFSAADLTRVGESTAHREGAESAVATVEAVQGRPGGTWPCPASFHPGHAALLPCAQEDLVSGAPFSPRGANFHFQPVQKAGASKTGLCQAEGDSRPPQDVCLPEPSKQPGPQLDAGSLAKCSPDQELSFPKNKEAASSQESEDSLRLLPCEQRGGFLPEPGTADQPHRGAPAPEAFGSPAVHLAPDLAFQGDGAPPLDATWPFGASPSHAAQGHSAGRAGGHLHPTAGRPGFEGNEFAPAGASSLTAPRGREAWLVPVPSPACVSNTHPSRRSQDPALSPPIRQLQLPGPGVAKSKDGILGLQELTPAAQSPPRVNPSGLEGGTVEGGKVACGPAQGSPGGVQVTTLPAVAGHQLGLEADGHWGLLGQAEKTQGQGTANQLQPENGVSPGGTDNHASVNASPKTALTGPTEGAVLLEKCKGSRAAMSLQEEAEPTPSPPSPNRESLALALTAAHSRSGSEGRTPERASSPGLNKPLLATGDSPAPSVGDLAACAPSPTSAAHMPCSLGPLPREDPLTSPSRAQGGLGGQLPASPSCRDPPGPQQLLACSPAWAPLEEADGVQATTDTGAEDSPVAPPSLTTSPCDPKEALAGCLLQGEGSPLEDPSSWPPGSVSAVTCTHSGDTPKDSTLRIPEDSRKEKLWESPGRATSPPLAGAVSPSVAVRATGLSSTPTGDEAQAGRGLPGPDPQSRGAPPHTNPDRMPRGHSSYSPSNTARLGHREGQAVTAVPTEPPTLQGAGPDSPACLEGEMGTSSKEPEDPGTPETGRSGATKMPRVTCPSTGLGLGRTTAPSSTASDFQSDSPQSHRNASHQTPQGDPLGPQDLKQRSRGYKKKPASTENGQWKGQAPHGPVTCEVCAASFRSGPGLSRHKARKHRPHPGAPAEPSPAALPAQQPLEPLAQKCQPPRKKSHRVSGKERPNHSRGDPSHVTQPPPAQGSKEVLRAPGSPHSQQLHPPSPTEHEVDVKTPASKPRPDQAREDELHPKQAEKREGRRWRREPTVDSPSHSEGKSNKKRGKLRGRRLREESILPVSADVISDGRGSRPSPAMASYAASPSHCLSVEGGPEADGEQPPRLATLGPGVMEGAAETDQEALCAGETGAQKPPGDRMLCPGRMDGAALGEQPTGQKGASARGFWGPRETKALGVCKESGSEPAEDSSRAHSRSEEGVWEENTPPLGPLGFPETSSSPADSTTSSCLQGLPDNPDTQGGVQGPEGPTPDASGSSAKDPPSLFDDEVSFSQLFPPGGRLTRKRNPHVYGKRCEKPVLPLPTQPSFEEGGDPTLGPARLPTDLSDSSSLCLCHEDPWEDEDPAGLPESFLLDGFLNSRVPGIDPWAPGLSLWALEPSREAGAEKLPSHCPEDDRPEAIPELHMVPAAWRGLEMPAPADDSSSSLGDVSPEPPSLERERCDGGLPGNTHLLPLRATDFEVLSTKFEMQDLCFLGPFEDPVGLPGPSFLDFEGTASSQGPQSRRTEEAAGAGRAQGRGRPAKGRRASYKCKVCFQRFRSLGELDLHKLAHTPAPPPTCYMCVERRFGSRELLRGHLQERHAQSKAGPWACGMCLKEVADVWMYNEHLREHAVRFARRGQARRSLGDLPGGLEGSSAVAHLLNSITEPAPKHHRGKRSAGKAAGSPGDPWGQEGEAKKDSPGERAKPRARSTPSNPDGAATPDSASATALADAGSPGPPRTTPSPSPDPWAGGEPLLQATPVHEACKDPSRDCHHCGKRFPKPFKLQRHLAVHSPQRVYLCPRCPRVYPEHGELLAHLGGAHGLLERPELQHTPLYACELCATVMRIIKKSFACSSCNYTFAKKEQFDRHMNKHLRGGRQPFAFRGVRRPGAPGQKARALEGTLPSKRRRVAMPGSAPGPGEDRPPPRGSSPILSEGSLPALLHLCSEVAPSTTKGWPETLERPVDPVTHPIRGCELPSNHQECPPPSLSPFPAALADGRGDCALDGALERPENEASPGSPGPLLQQALPLGASLPRPGARGQDAEGKRAPLVFSGKRRAPGARGRCAPDHFQEDHLLQKEKEVSSSHMVSEGGPRGAFHKGSATKPAGCQSSSKDRSAASTPSKALKFPVHPRKAVGSLAPGELARGTENGMKPATPKAKPGPSSQGSGSPRPGTKTGGGSQPQPASGQLQSETATTPAKPSFPSRSPAPERLPARAQAKSCTKGPREAGEQGPHGSLGPKEKGESSTKRKKGQVPGPARSESVGSFGRAPSAPDKPPRTPRKQATPSRVLPTKPKPNSQNKPRPPPSEQRKAEPGHTQRKDRLGKAFPQGRPLLRPPKRGTAVHGAEPAEPHTHRTAEAQSDLLSQLFGQRLTGFKIPLKKDASE

SEQ ID NO: 100183 - protein, 717 aa, Homo sapiens
  Payload ID: 19960
  Gene Name: zinc finger protein 470
  Uniprot ID: Q6ECI4
  ENSP ID: ENSP00000333223
MKSQEEVEVAGIKLCKAMSLGSVTFTDVAIDFSQDEWEWLNLAQRSLYKKVMLENYRNLVSVGLCISKPDVISLLEQEKDPWVIKGGMNRGLCPDLECVWVTKSLSLNQDIYEEKLPPAIIMERLKSYDLECSTLGKNWKCEDLFERELVNQKTHFRQETITHIDTLIEKRDHSNKSGTVFHLNTLSYIKQIFPMEERIFNFHTDKKSLKTHSVVKKHKQDRGEKKLLKCNDCEKIFSKISTLTLHQRIHTGEKPYECIECGKAFSQSAHLAQHQRIHTGEKPFECTECGKAFSQNAHLVQHQRVHTGEKPYQCKQCNKAFSQLAHLAQHQRVHTGEKPYECIECGKAFSDCSSLAHHRRIHTGKRPYECIDCGKAFRQNASLIRHRRYYHTGEKPFDCIDCGKAFTDHIGLIQHKRTHTGERPYKCNVCGKAFSHGSSLTVHQRIHTGEKPYECNICEKAFSHRGSLTLHQRVHTGEKPYECKECGKAFRQSTHLAHHQRIHTGEKPYECKECSKTFSQNAHLAQHQKIHTGEKPYECKECGKAFSQIAHLVQHQRVHTGEKPYECIECGKAFSDGSYLVQHQRLHSGKRPYECLECGKAFRQRASLICHQRCHTGEKPYECNVCGKAFSHRKSLTLHQRIHTGEKPYECKECSKAFSQVAHLTLHKRIHTGERPYECKECGKAFRQSVHLAHHQRIHTGESSVILSSALPYHQVL

SEQ ID NO: 100184 - protein, 717 aa, Homo sapiens; identical to SEQ ID NO: 100183
  Payload ID: 19960
  Gene Name: zinc finger protein 470
  Uniprot ID: Q6ECI4
  ENSP ID: ENSP00000375590

SEQ ID NO: 100185 - protein, 102 aa, Homo sapiens
  Payload ID: 19960
  Gene Name: zinc finger protein 470
  ENSP ID: ENSP00000471379
MKSQEEVEVAGIKLCKAMSLGSVTFTDVAIDFSQDEWEWLNLAQRSLYKKVMLENYRNLVSVGLCISKPDVISLLEQEKDPWVIKGGMNRGLCPDILKMPHQ

SEQ ID NO: 100186 - protein, 46 aa, Homo sapiens
  Payload ID: 19960
  Gene Name: zinc finger protein 470
  ENSP ID: ENSP00000472891
  MOD_RES (1)..(1): Any amino acid
XSKPDVISLLEQEKDPWVIKGGMNRGLCPAPPNAGLYHHQIYLLKS

SEQ ID NO: 100187 - protein, 626 aa, Homo sapiens
  Payload ID: 19961
  Gene Name: zinc finger protein 471
  Uniprot ID: Q9BX82
  ENSP ID: ENSP00000309161
MNVEVVKVMPQDLVTFKDVAIDFSQEEWQWMNPAQKRLYRSMMLENYQSLVSLGLCISKPYVISLLEQGREPWEMTSEMTRSPFSDWESIYVTQELPLKQFMYDDACMEGITSYGLECSTFEENWKWEDLFEKQMGSHEMFSKKEIITHKETITKETEFKYTKFGKCIHLENIEESIYNHTSDKKSFSKNSMVIKHKKVYVGKKLFKCNECDKTFTHSSSLTVHFRIHTGEKPYACEECGKAFKQRQHLAQHHRTHTGEKLFECKECRKAFKQSEHLIQHQRIHTGEKPYKCKECRKAFRQPAHLAQHQRIHTGEKPYECKECGKAFSDGSSFARHQRCHTGKRPYECIECGKAFRYNTSFIRHWRSYHTGEKPFNCIDCGKAFSVHIGLILHRRIHTGEKPYKCGVCGKTFSSGSSRTVHQRIHTGEKPYECDICGKDFSHHASLTQHQRVHSGEKPYECKECGKAFRQNVHLVSHLRIHTGEKPYECKECGKAFRISSQLATHQRIHTGEKPYECIECGNAFKQRSHLAQHQKTHTGEKPYECNECGKAFSQTSNLTQHQRIHTGEKPYKCTECGKAFSDSSSCAQHQRLHTGQRPYQCFECGKAFRRKLSLICHQRSHTGEEP

SEQ ID NO: 100188 - protein, 247 aa, Homo sapiens
  Payload ID: 19961
  Gene Name: zinc finger protein 471
  Uniprot ID: Q9BX82
  ENSP ID: ENSP00000466224
MNVEVVKVMPQDLVTFKDVAIDFSQEEWQWMNPAQKRLYRSMMLENYQSLVSLGLCISKPYVISLLEQGREPWEMTSEMTRSPFSEFILVKNHMHVRNVEKPSSKGNTLLNITEHILERNSLNVKNVGKPSNKVNTLFSIKEFILEKNHINVRNAEKPSDSLHTLLSIREFILERNPMNVKNVAKPSVMARLLLDIRDVTLAKDPMNVLSVGRLLGITHLLFVTGGVIILERSLLIALIVGKPSVFT

SEQ ID NO: 100189 - protein, 76 aa, Homo sapiens
  Payload ID: 19961
  Gene Name: zinc finger protein 471
  ENSP ID: ENSP00000467570
MNVEVVKVMPQDLVTFKDVAIDFSQEEWQWMNPAQKRLYRSMMLENYQSLVSLGLCISKPYVISLLEQGREPWEMT

SEQ ID NO: 100190 - protein, 871 aa, Homo sapiens
  Payload ID: 19962
  Gene Name: zinc finger protein 473
  Uniprot ID: Q8WTR7
  ENSP ID: ENSP00000270617
MAEEFVTLKDVGMDFTLGDWEQLGLEQGDTFWDTALDNCQDLFLLDPPRPNLTSHPDGSEDLEPLAGGSPEATSPDVTETKNSPLMEDFFEEGFSQEIIEMLSKDGFWNSNFGEACIEDTWLDSLLGDPESLLRSDIATNGESPTECKSHELKRGLSPVSTVSTGEDSMVHNVSEKTLTPAKSKEYRGEFFSYSDHSQQDSVQEGEKPYQCSECGKSFSGSYRLTQHWITHTREKPTVHQECEQGFDRNASLSVYPKTHTGYKFYVCNEYGTTFSQSTYLWHQKTHTGEKPCKSQDSDHPPSHDTQPGEHQKTHTDSKSYNCNECGKAFTRIFHLTRHQKIHTRKRYECSKCQATFNLRKHLIQHQKTHAAKTTSECQECGKIFRHSSLLIEHQALHAGEEPYKCNERGKSFRHNSTLKIHQRVHSGEKPYKCSECGKAFHRHTHLNEHRRIHTGYRPHKCQECVRSFSRPSHLMRHQAIHTAEKPYSCAECKETFSDNNRLVQHQKMHTVKTPYECQECGERFICGSTLKCHESVHAREKQGFFVSGKILDQNPEQKEKCFKCNKCEKTFSCSKYLTQHERIHTRGVKPFECDQCGKAFGQSTRLIHHQRIHSRVRLYKWGEQGKAISSASLIKLQSFHTKEHPFKCNECGKTFSHSAHLSKHQLIHAGENPFKCSKCDRVFTQRNYLVQHERTHARKKPLVCNECGKTFRQSSCLSKHQRIHSGEKPYVCDYCGKAFGLSAELVRHQRIHTGEKPYVCQECGKAFTQSSCLSIHRRVHTGEKPYRCGECGKAFAQKANLTQHQRIHTGEKPYSCNVCGKAFVLSAHLNQHLRVHTQETLYQCQRCQKAFRCHSSLSRHQRVHNKQQYCL

SEQ ID NO: 100191 - protein, 871 aa, Homo sapiens; identical to SEQ ID NO: 100190
  Payload ID: 19962
  Gene Name: zinc finger protein 473
  Uniprot ID: Q8WTR7
  ENSP ID: ENSP00000375697

SEQ ID NO: 100192 - protein, 859 aa, Homo sapiens
  Payload ID: 19962
  Gene Name: zinc finger protein 473
  ENSP ID: ENSP00000388961
MDFTLGDWEQLGLEQGDTFWDTALDNCQDLFLLDPPRPNLTSHPDGSEDLEPLAGGSPEATSPDVTETKNSPLMEDFFEEGFSQEIIEMLSKDGFWNSNFGEACIEDTWLDSLLGDPESLLRSDIATNGESPTECKSHELKRGLSPVSTVSTGEDSMVHNVSEKTLTPAKSKEYRGEFFSYSDHSQQDSVQEGEKPYQCSECGKSFSGSYRLTQHWITHTREKPTVHQECEQGFDRNASLSVYPKTHTGYKFYVCNEYGTTFSQSTYLWHQKTHTGEKPCKSQDSDHPPSHDTQPGEHQKTHTDSKSYNCNECGKAFTRIFHLTRHQKIHTRKRYECSKCQATFNLRKHLIQHQKTHAAKTTSECQECGKIFRHSSLLIEHQALHAGEEPYKCNERGKSFRHNSTLKIHQRVHSGEKPYKCSECGKAFHRHTHLNEHRRIHTGYRPHKCQECVRSFSRPSHLMRHQAIHTAEKPYSCAECKETFSDNNRLVQHQKMHTVKTPYECQECGERFICGSTLKCHESVHAREKQGFFVSGKILDQNPEQKEKCFKCNKCEKTFSCSKYLTQHERIHTRGVKPFECDQCGKAFGQSTRLIHHQRIHSRVRLYKWGEQGKAISSASLIKLQSFHTKEHPFKCNECGKTFSHSAHLSKHQLIHAGENPFKCSKCDRVFTQRNYLVQHERTHARKKPLVCNECGKTFRQSSCLSKHQRIHSGEKPYVCDYCGKAFGLSAELVRHQRIHTGEKPYVCQECGKAFTQSSCLSIHRRVHTGEKPYRCGECGKAFAQKANLTQHQRIHTGEKPYSCNVCGKAFVLSAHLNQHLRVHTQETLYQCQRCQKAFRCHSSLSRHQRVHNKQQYCL

SEQ ID NO: 100193 - protein, 102 aa, Homo sapiens
  Payload ID: 19962
  Gene Name: zinc finger protein 473
  ENSP ID: ENSP00000470862
MAEEFVTLKDVGMDFTLGDWEQLGLEQGDTFWDTALDNCQDLFLLDPPRPNLTSHPDGSEDLEPLAGGSPEATSPDVTETKNSPLMEDFFEEGFSQEIIEML

SEQ ID NO: 100194 - protein, 74 aa, Homo sapiens
  Payload ID: 19962
  Gene Name: zinc finger protein 473
  ENSP ID: ENSP00000470956
MAEEFVTLKDVGMDFTLGDWEQLGLEQGDTFWDTALDNCQDLFLLDPPRPNLTSHPDGSEDLEPLAGGSPEATS

SEQ ID NO: 100195 - protein, 77 aa, Homo sapiens
  Payload ID: 19962
  Gene Name: zinc finger protein 473
  ENSP ID: ENSP00000471595
MAEEFVTLKDVGMDFTLGDWEQLGLEQGDTFWDTALDNCQDLFLLDPPRPNLTSHPDGSEDLEPLAGGSPEATSPGF

SEQ ID NO: 100196 - protein, 64 aa, Homo sapiens
  Payload ID: 19962
  Gene Name: zinc finger protein 473
  ENSP ID: ENSP00000472687
MDFTLGDWEQLGLEQGDTFWDTALDNCQDLFLLGFSQESSQPAVSPSSAHQCHTVRQQQGPDSS

SEQ ID NO: 100197 - protein, 871 aa, Homo sapiens; identical to SEQ ID NO: 100190
  Payload ID: 19962
  Gene Name: zinc finger protein 473
  Uniprot ID: Q8WTR7
  ENSP ID: ENSP00000472808

SEQ ID NO: 100198 - protein, 364 aa, Homo sapiens
  Payload ID: 19963
  Gene Name: zinc finger protein 474
  Uniprot ID: Q6S9Z5
  ENSP ID: ENSP00000296600
MERGKKKRISNKLQQTFHHSKEPTFLINQAGLLSSDSYSSLSPETESVNPGENIKTDTQKKRPGTVILSKLSSRRIISESQLSPPVIPARRPGFRVCYICGREFGSQSIAIHEPQCLQKWHIENSKLPKHLRRPEPSKPQSLSSSGSYSLQATNEAAFQSAQAQLLPCESCGRTFLPDHLLVHHRSCKPKGEGPRAPHSNSSDHLTGLKKACSGTPARPRTVICYICGKEFGTLSLPIHEPKCLEKWKMENDRLPVELHQPLPQKPQPLPNAQSSQAGPNQAQLVFCPHCSRIFTSDRLLVHQRSCKTHPYGPKYQNLNLGSKGGLKEYTNSKQQRNRAAPSVTDKVIHATQDALGEPGGALCL

SEQ ID NO: 100199 - protein, 63 aa, Homo sapiens
  Payload ID: 19963
  Gene Name: zinc finger protein 474
  ENSP ID: ENSP00000422285
MERGKKKRISNKLQQTFHHSKEPTFLINQAGLLSSDSYSSLSPETESVNPGENIKTDTQKKRP

SEQ ID NO: 100200 - protein, 36 aa, Homo sapiens
  Payload ID: 19963
  Gene Name: zinc finger protein 474
  ENSP ID: ENSP00000424794
MERGKKKRISNKLQQTFHHSKEPTFLINQAGLLSSD

SEQ ID NO: 100201 - protein, 524 aa, Homo sapiens
  Payload ID: 19964
  Gene Name: zinc finger protein 479
  Uniprot ID: Q96JC4
  ENSP ID: ENSP00000324518
MAKRPGPPGSREMGLLTFRDIAIEFSLEEWQCLDCAQRNLYRDVMLENYRNLVSLGIAVSKPDLITCLEQNKESQNIKRNEMVAKHPVTRSHFTQDLQPEQGIKDSLQKVIPRTYGKCGHEKLQFKKCCKSVGEYEVHKGGYSEVNQCLSTTQNKIFQTHKYVKVFGKFSNSNRDKTRYTGNKHFKCNKYGKSFCMLSHLNQHQVIHTREKSYKCKECGKSFNCSSNHTTHKIIHTGEKPYRCEECGKAFSWSANLTRHKRTHTGEKPYTCEECGQAFRRSSALTNHKRIHTGERPYKCEECGKAFSVSSTLTDHKRIHTGEKPCRCEECGKAFSWSSNLTRHKRIHTREKPYACEECGQAFSLSSNLMRHRRIHTGEKPYTCEECGQDFRRSSALTIHKRIHTGERPYKCEECGKVFSLSSTLTDHKRIHTGERPYKCEECGKAFSLSSTLTDHKRIHTGERPYTCEECGKAFNCSSTLMQHKRIHTGEKPYKCEECEQAFKWHSSLAKHKIIHTGEKPYKCE

SEQ ID NO: 100202 - protein, 524 aa, Homo sapiens; identical to SEQ ID NO: 100201
  Payload ID: 19964
  Gene Name: zinc finger protein 479
  Uniprot ID: Q96JC4
  ENSP ID: ENSP00000333776

SEQ ID NO: 100203 - protein, 412 aa, Homo sapiens [sequence omitted]

SEQ ID NO: 100204 - protein, 618 aa, Homo sapiens
  Payload ID: 19965
  Gene Name: zinc finger protein 48
  Uniprot ID: Q96MX3
  ENSP ID: ENSP00000324056
MERAVEPWGPDLHRPEEREPQRGARTGLGSENVISQPNEFEHTPQEDDLGFKEEDLAPDHEVGNASLKPEGIQNWDDLWVQREGLGKPQPRDRGPRLLGEPRWGQASSDRAAVCGECGKSFRQMSDLVKHQRTHTGEKPYKCGVCGKGFGDSSARIKHQRTHSGEKPYRARPPAQGPPKIPRSRIPAGERPTICGECGKSFRQSSDLVKHQRTHTGEKPYKCGICGKGFGDSSARIKHQRTHRGEQPPRPVVPRRQPSRAATAATQGPKAQDKPYICTDCGKRFVLSCSLLSHQRSHLGPKPFGCDVCGKEFARGSDLVKHLRVHTGEKPYLCPECGKGFADSSARVKHLRTHSGERPHACPECDRTFSLSSTLLRHRLTHMEPQDFSFPGYPLPALIPSPPPPPLGTSPPLTPRSPSHSGEPFGLPGLEPEPGGPQAGEPPPPLAGDKPHKCPECGKGFRRSSDLVKHHRVHTGEKPYLCPECGKGFADSSARVKHLRTHRGERARPPPPSTLLRPHNPPGPVPMAPRPRVRAQPSGPSQPHVCGFCGKEFPRSSDLVKHRRTHTGEKPYKCAECGKGFGDSSARIKHQRGHLVLTPFGIGDGRARPLKQEAATGLE

SEQ ID NO: 100205 - protein, 110 aa, Homo sapiens
  Payload ID: 19965
  Gene Name: zinc finger protein 48
  ENSP ID: ENSP00000417204
MRSEWLALSAGRGGRRGWLETHSHNYEEPRASPPSCSPGGTRLIPPSSGRRPRLRVAPGPHAAARRPQSYRRRGRPPQARSSSKVLERLRAAPRFRFPSPPPVAAPGTPG

SEQ ID NO: 100206 - protein, 143 aa, Homo sapiens
  Payload ID: 19965
  Gene Name: zinc finger protein 48
  ENSP ID: ENSP00000432548
MERAVEPWGPDLHRPEEREPQRGARTGLGSENVISQPNEFEHTPQEDDLGFKEEDLAPDHEVGNASLKPEGIQNWDDLWVQREGLGKPQPRDRGPRLLGEPRWGQASSDRAAVCGECGKSFRQMSDLVKHQRTHTGEKPYKCG

SEQ ID NO: 100207 - protein, 147 aa, Homo sapiens
  Payload ID: 19965
  Gene Name: zinc finger protein 48
  ENSP ID: ENSP00000435674
MERAVEPWGPDLHRPEEREPQRGARTGLGSENVISQPNEFEHTPQEDDLGFKEEDLAPDHEVGNASLKPEGIQNWDDLWVQREGLGKPQPRDRGPRLLGEPRWGQASSDRAAVCGECGKSFRQMSDLVKHQRTHTGEKPYKCGVCGK

SEQ ID NO: 100208 - protein, 495 aa, Homo sapiens
  Payload ID: 19965
  Gene Name: zinc finger protein 48
  ENSP ID: ENSP00000479658
MSDLVKHQRTHTGEKPYKCGVCGKGFGDSSARIKHQRTHSGEKPYRARPPAQGPPKIPRSRIPAGERPTICGECGKSFRQSSDLVKHQRTHTGEKPYKCGICGKGFGDSSARIKHQRTHRGEQPPRPVVPRRQPSRAATAATQGPKAQDKPYICTDCGKRFVLSCSLLSHQRSHLGPKPFGCDVCGKEFARGSDLVKHLRVHTGEKPYLCPECGKGFADSSARVKHLRTHSGERPHACPECDRTFSLSSTLLRHRLTHMEPQDFSFPGYPLPALIPSPPPPPLGTSPPLTPRSPSHSGEPFGLPGLEPEPGGPQAGEPPPPLAGDKPHKCPECGKGFRRSSDLVKHHRVHTGEKPYLCPECGKGFADSSARVKHLRTHRGERARPPPPSTLLRPHNPPGPVPMAPRPRVRAQPSGPSQPHVCGFCGKEFPRSSDLVKHRRTHTGEKPYKCAECGKGFGDSSARIKHQRGHLVLTPFGIGDGRARPLKQEAATGLE

SEQ ID NO: 100209 - protein, 618 aa, Homo sapiens; identical to SEQ ID NO: 100204
  Payload ID: 19965
  Gene Name: zinc finger protein 48
  Uniprot ID: Q96MX3
  ENSP ID: ENSP00000480262

SEQ ID NO: 100210 - protein, 618 aa, Homo sapiens; identical to SEQ ID NO: 100204
  Payload ID: 19965
  Gene Name: zinc finger protein 48
  Uniprot ID: Q96MX3
  ENSP ID: ENSP00000483937

SEQ ID NO: 100211 - protein, 492 aa, Homo sapiens
  Payload ID: 19966
  Gene Name: zinc finger protein 480
  ENSP ID: ENSP00000334164
MLCDEKAQKRRKRKAKESGMALPQGHLTFRDVAIEFSQAEWKCLDPAQRALYKDVMLENYRNLVSLGSSYALGSNAEDKPIKKQLGVSFHLHLSELELFPDERVINGCNQVENFINHSSSVSCLQEMSSSVKTPIFNRNDFDDSSFLPQEQKVHLREKPYECNEHSKVFRVSSSLTKHQVIHTVEKPYKCNSCGKVFSRNSHLAEHCRIHTGEKPYKCNVCGKVFSYNSNFARHQRIHTREKPYECNECGKVFSNNSYLARHQRIHAEEKPYKCNECGKGFSHKSSLANHWRIYTGEKPYKCDECGKAFYRIALLVRHQKIHTGEKPYKCNECGKVFIQNSHLAQHWRIHTGEKPYKCNECGKVFNQLSNLARHRRIHTGEKPYKCNECGKAFSEYSGLSAHLVIHTGEKPYKCSECGKAFRHKLSLTNHQRIHTGERPYKCNECGKVFNRIAHLARHRKIHTGEKPYKCNECGKAFSRISYLAQHWTIHMG

SEQ ID NO: 100212 - protein, 458 aa, Homo sapiens
  Payload ID: 19966
  Gene Name: zinc finger protein 480
  Uniprot ID: Q8WV37
  ENSP ID: ENSP00000335670
MLEQRREPWSGESEVKIAKNSDGRECIKGVNTGSSYALGSNAEDKPIKKQLGVSFHLHLSELELFPDERVINGCNQVENFINHSSSVSCLQEMSSSVKTPIFNRNDFDDSSFLPQEQKVHLREKPYECNEHSKVFRVSSSLTKHQVIHTVEKPYKCNSCGKVFSRNSHLAEHCRIHTGEKPYKCNVCGKVFSYNSNFARHQRIHTREKPYECNECGKVFSNNSYLARHQRIHAEEKPYKCNECGKGFSHKSSLANHWRIYTGEKPYKCDECGKAFYRIALLVRHQKIHTGEKPYKCNECGKVFIQNSHLAQHWRIHTGEKPYKCNECGKVFNQLSNLARHRRIHTGEKPYKCNECGKAFSEYSGLSAHLVIHTGEKPYKCSECGKAFRHKLSLTNHQRIHTGERPYKCNECGKVFNRIAHLARHRKIHTGEKPYKCNECGKAFSRISYLAQHWTIHMG

SEQ ID NO: 100213 - protein, 535 aa, Homo sapiens
  Payload ID: 19966
  Gene Name: zinc finger protein 480
  Uniprot ID: Q8WV37
  ENSP ID: ENSP00000417424
MLCDEKAQKRRKRKAKESGMALPQGHLTFRDVAIEFSQAEWKCLDPAQRALYKDVMLENYRNLVSLGISLPDLNINSMLEQRREPWSGESEVKIAKNSDGRECIKGVNTGSSYALGSNAEDKPIKKQLGVSFHLHLSELELFPDERVINGCNQVENFINHSSSVSCLQEMSSSVKTPIFNRNDFDDSSFLPQEQKVHLREKPYECNEHSKVFRVSSSLTKHQVIHTVEKPYKCNSCGKVFSRNSHLAEHCRIHTGEKPYKCNVCGKVFSYNSNFARHQRIHTREKPYECNECGKVFSNNSYLARHQRIHAEEKPYKCNECGKGFSHKSSLANHWRIYTGEKPYKCDECGKAFYRIALLVRHQKIHTGEKPYKCNECGKVFIQNSHLAQHWRIHTGEKPYKCNECGKVFNQLSNLARHRRIHTGEKPYKCNECGKAFSEYSGLSAHLVIHTGEKPYKCSECGKAFRHKLSLTNHQRIHTGERPYKCNECGKVFNRIAHLARHRKIHTGEKPYKCNECGKAFSRISYLAQHWTIHMG

SEQ ID NO: 100214 - protein, 61 aa, Homo sapiens
  Payload ID: 19966
  Gene Name: zinc finger protein 480
  ENSP ID: ENSP00000418618
MLCDEKAQKRRKRKAKESGMALPQGAAMHWEAMQKTNQLKNNLEYPFTYICLNWSYFQMKG

SEQ ID NO: 100215 - protein, 535 aa, Homo sapiens; identical to SEQ ID NO: 100213
  Payload ID: 19966
  Gene Name: zinc finger protein 480
  Uniprot ID: Q8WV37
  ENSP ID: ENSP00000471754

SEQ ID NO: 100216 - protein, 165 aa, Homo sapiens
  Payload ID: 19966
  Gene Name: zinc finger protein 480
  ENSP ID: ENSP00000473023
MLCDEKAQKRRKRKAKESGMALPQGHLTFRDVAIEFSQAEWKCLDPAQRALYKDVMLENYRNLVSLGISLPDLNINSMLEQRREPWSGESEVKIAKNSDGRECIKGVNTGWSAMVQSRLTATSTSWVQAVLLPQPPEQLGLQGAAMHWEAMQKTNQLKNNLEYPF

SEQ ID NO: 100217 - protein, 744 aa, Homo sapiens
  Payload ID: 19967
  Gene Name: zinc finger protein 483
  Uniprot ID: Q8TF39
  ENSP ID: ENSP00000311679
MQAVVPLNKMTAISPEPQTLASTEQNEVPRVVTSGEQEAILRGNAADAESFRQRFRWFCYSEVAGPRKALSQLWELCNQWLRPDIHTKEQILELLVFEQFLTILPGEIRIWVKSQHPESSEEVVTLIEDLTQMLEEKDPVSQDSTVSQEENSKEDKMVTVCPNTESCESITLKDVAVNFSRGEWKKLEPFQKELYKEVLLENLRNLEFLDFPVSKLELISQLKWVELPWLLEEVSKSSRLDESALDKIIERCLRDDDHGLMEESQQYCGSSEEDHGNQGNSKGRVAQNKTLGSGSRGKKFDPDKSPFGHNFKETSDLIKHLRVYLRKKSRRYNESKKPFSFHSDLVLNRKEKTAGEKSRKSNDGGKVLSHSSALTEHQKRQKIHLGDRSQKCSKCGIIFIRRSTLSRRKTPMCEKCRKDSCQEAALNKDEGNESGEKTHKCSKCGKAFGYSASLTKHRRIHTGEKPYMCNECGKAFSDSSSLTPHHRTHSGEKPFKCDDCGKGFTLSAHLIKHQRIHTGEKPYKCKDCGRPFSDSSSLIQHQRIHTGEKPYTCSNCGKSFSHSSSLSKHQRIHTGEKPYKCGECGKAFRQNSCLTRHQRIHTGEKPYLCNDCGMTFSHFTSVIYHQRLHSGEKPYKCNQCEKAFPTHSLLSRHQRIHTGVKPYKCKECGKSFSQSSSLNEHHRIHTGEKPYECNYCGATFSRSSILVEHLKIHTGRREYECNECEKTFKSNSGLIRHRGFHSAE

SEQ ID NO: 100218 - protein, 256 aa, Homo sapiens
  Payload ID: 19967
  Gene Name: zinc finger protein 483
  Uniprot ID: Q8TF39
  ENSP ID: ENSP00000350871
MQAVVPLNKMTAISPEPQTLASTEQNEVPRVVTSGEQEAILRGNAADAESFRQRFRWFCYSEVAGPRKALSQLWELCNQWLRPDIHTKEQILELLVFEQFLTILPGEIRIWVKSQHPESSEEVVTLIEDLTQMLEEKDPVSQDSTVSQEENSKEDKMVTVCPNTESCESITLKDVAVNFSRGEWKKLEPFQKELYKEVLLENLRNLEFLDFPVSKLELISQLKWVELPWLLEEVSKSSRLDIHGAVKKMQMFSEAE

SEQ ID NO: 100219 - protein, 178 aa, Homo sapiens
  Payload ID: 19967
  Gene Name: zinc finger protein 483
  ENSP ID: ENSP00000363494
MQAVVPLNKMTAISPEPQTLASTEQNEVPRVVTSGEQEAILRGNAADAESFRQRFRWFCYSEVAGPRKALSQLWELCNQWLRPDIHTKEQILELLVFEQFLTILPGEIRIWVKSQHPESSEEVVTLIEDLTQMLEEKGEIYRWREEAGDIASKSESKFLKRRQFTAKEESEVRSWDWV

SEQ ID NO: 100220 - protein, 244 aa, Homo sapiens
  Payload ID: 19967
  Gene Name: zinc finger protein 483
  ENSP ID: ENSP00000438048
MQAVVPLNKMTAISPEPQTLASTEQNEVPRVVTSGEQEAILRGNAADAESFRQRFRWFCYSEVAGPRKALSQLWELCNQWLRPDIHTKEQILELLVFEQFLTILPGEIRIWVKSQHPESSEEVVTLIEDLTQMLEEKDPVSQDSTVSQEENSKEDKMVTVCPNTESCESITLKDVAVNFSRGEWKKLEPFQKELYKEVLLENLRNLEFLDFPVSKLELISQLKWVELPWLLEEVSKSSRLGSVI

SEQ ID NO: 100221 - protein, 852 aa, Homo sapiens
  Payload ID: 19968
  Gene Name: zinc finger protein 484
  Uniprot ID: Q5JVG2
  ENSP ID: ENSP00000364645
MTKSLESVSFKDVTVDFSRDEWQQLDLAQKSLYREVMLENYFNLISVGCQVPKPEVIFSLEQEEPCMLDGEIPSQSRPDGDIGFGPLQQRMSEEVSFQSEININLFTRDDPYSILEELWKDDEHTRKCGENQNKPLSRVVFINKKTLANDSIFEYKDIGEIVHVNTHLVSSRKRPHNCNSCGKNLEPIITLYNRNNATENSDKTIGDGDIFTHLNSHTEVTACECNQCGKPLHHKQALIQQQKIHTRESLYLFSDYVNVFSPKSHAFAHESICAEEKQHECHECEAVFTQKSQLDGSQRVYAGICTEYEKDFSLKSNRQKTPYEGNYYKCSDYGRAFIQKSDLFRCQRIHSGEKPYEYSECEKNLPQNSNLNIHKKIHTGGKHFECTECGKAFTRKSTLSMHQKIHTGEKPYVCTECGKAFIRKSHFITHERIHTGEKPYECSDCGKSFIKKSQLHVHQRIHTGENPFICSECGKVFTHKTNLIIHQKIHTGERPYICTVCGKAFTDRSNLIKHQKIHTGEKPYKCSDCGKSFTWKSRLRIHQKCHTGERHYECSECGKAFIQKSTLSMHQRIHRGEKPYVCTECGKAFFHKSHFITHERIHTGEKPYECSICGKSFTKKSQLHVHQQIHTGEKPYRCAECGKAFTDRSNLFTHQKIHTGEKPYKCSDCGKAFTRKSGLHIHQQSHTGERHYECSECGKAFARKSTLIMHQRIHTGEKPYICNECGKSFIQKSHLNRHRRIHTGEKPYECSDCGKSFIKKSQLHEHHRIHTGEKPYICAECGKAFTIRSNLIKHQKIHTKQKPYKCSDLGKALNWKPQLSMPQKSDNGEVECSMPQLWCGDSEGDQGQLSSI

SEQ ID NO: 100222 - protein, 816 aa, Homo sapiens
  Payload ID: 19968
  Gene Name: zinc finger protein 484
  Uniprot ID: Q5JVG2
  ENSP ID: ENSP00000364646
MLENYFNLISVGCQVPKPEVIFSLEQEEPCMLDGEIPSQSRPDGDIGFGPLQQRMSEEVSFQSEININLFTRDDPYSILEELWKDDEHTRKCGENQNKPLSRVVFINKKTLANDSIFEYKDIGEIVHVNTHLVSSRKRPHNCNSCGKNLEPIITLYNRNNATENSDKTIGDGDIFTHLNSHTEVTACECNQCGKPLHHKQALIQQQKIHTRESLYLFSDYVNVFSPKSHAFAHESICAEEKQHECHECEAVFTQKSQLDGSQRVYAGICTEYEKDFSLKSNRQKTPYEGNYYKCSDYGRAFIQKSDLFRCQRIHSGEKPYEYSECEKNLPQNSNLNIHKKIHTGGKHFECTECGKAFTRKSTLSMHQKIHTGEKPYVCTECGKAFIRKSHFITHERIHTGEKPYECSDCGKSFIKKSQLHVHQRIHTGENPFICSECGKVFTHKTNLIIHQKIHTGERPYICTVCGKAFTDRSNLIKHQKIHTGEKPYKCSDCGKSFTWKSRLRIHQKCHTGERHYECSECGKAFIQKSTLSMHQRIHRGEKPYVCTECGKAFFHKSHFITHERIHTGEKPYECSICGKSFTKKSQLHVHQQIHTGEKPYRCAECGKAFTDRSNLFTHQKIHTGEKPYKCSDCGKAFTRKSGLHIHQQSHTGERHYECSECGKAFARKSTLIMHQRIHTGEKPYICNECGKSFIQKSHLNRHRRIHTGEKPYECSDCGKSFIKKSQLHEHHRIHTGEKPYICAECGKAFTIRSNLIKHQKIHTKQKPYKCSDLGKALNWKPQLSMPQKSDNGEVECSMPQLWCGDSEGDQGQLSSI

SEQ ID NO: 100223 - protein, 854 aa, Homo sapiens
  Payload ID: 19968
  Gene Name: zinc finger protein 484
  Uniprot ID: Q5JVG2
  ENSP ID: ENSP00000378881
MSVLSLPESVSFKDVTVDFSRDEWQQLDLAQKSLYREVMLENYFNLISVGCQVPKPEVIFSLEQEEPCMLDGEIPSQSRPDGDIGFGPLQQRMSEEVSFQSEININLFTRDDPYSILEELWKDDEHTRKCGENQNKPLSRVVFINKKTLANDSIFEYKDIGEIVHVNTHLVSSRKRPHNCNSCGKNLEPIITLYNRNNATENSDKTIGDGDIFTHLNSHTEVTACECNQCGKPLHHKQALIQQQKIHTRESLYLFSDYVNVFSPKSHAFAHESICAEEKQHECHECEAVFTQKSQLDGSQRVYAGICTEYEKDFSLKSNRQKTPYEGNYYKCSDYGRAFIQKSDLFRCQRIHSGEKPYEYSECEKNLPQNSNLNIHKKIHTGGKHFECTECGKAFTRKSTLSMHQKIHTGEKPYVCTECGKAFIRKSHFITHERIHTGEKPYECSDCGKSFIKKSQLHVHQRIHTGENPFICSECGKVFTHKTNLIIHQKIHTGERPYICTVCGKAFTDRSNLIKHQKIHTGEKPYKCSDCGKSFTWKSRLRIHQKCHTGERHYECSECGKAFIQKSTLSMHQRIHRGEKPYVCTECGKAFFHKSHFITHERIHTGEKPYECSICGKSFTKKSQLHVHQQIHTGEKPYRCAECGKAFTDRSNLFTHQKIHTGEKPYKCSDCGKAFTRKSGLHIHQQSHTGERHYECSECGKAFARKSTLIMHQRIHTGEKPYICNECGKSFIQKSHLNRHRRIHTGEKPYECSDCGKSFIKKSQLHEHHRIHTGEKPYICAECGKAFTIRSNLIKHQKIHTKQKPYKCSDLGKALNWKPQLSMPQKSDNGEVECSMPQLWCGDSEGDQGQLSSI

SEQ ID NO: 100224 - protein, 816 aa, Homo sapiens; identical to SEQ ID NO: 100222
  Payload ID: 19968
  Gene Name: zinc finger protein 484
  Uniprot ID: Q5JVG2
  ENSP ID: ENSP00000378882

SEQ ID NO: 100225 - protein, 441 aa, Homo sapiens
  Payload ID: 19969
  Gene Name: zinc finger protein 485
  Uniprot ID: Q8NCK3
  ENSP ID: ENSP00000354694
MAPRAQIQGPLTFGDVAVAFTRIEWRHLDAAQRALYRDVMLENYGNLVSVGLLSSKPKLITQLEQGAEPWTEVREAPSGTHAVEDYWFETKMSALKQSTSEASVLGERTKSVMMEKGLDWEGRSSTEKNYKCKECGKVFKYNSSFISHQRNHTSEKPHKCKECGIAFMNSSSLLNHHKVHAGKQPYRCIECGKFLKKHSTFINHQRIHSREKPHKCIECGKTFRKNSILLSHQRIHTGQKPYKCNDCGKAFAQNAALTRHERIHSGEKPFKCNKCGRAFRDNSTVLEHQKIHTGEKPYQCNECGKAFRKSSTLISHQRMHTGEKPYHCSKCGKSFRYSSSFAGHQKTHSGNKPYQCRDCGKAFTKSSTLTGHQRIHTGEKPYHCKKCGKAFRHSSGLVEHQRLHTGEKPYKCNECGKAFPRSSALKQHKKIHNKERAMKCS

SEQ ID NO: 100226 - protein, 441 aa, Homo sapiens; identical to SEQ ID NO: 100225
  Payload ID: 19969
  Gene Name: zinc finger protein 485
  Uniprot ID: Q8NCK3
  ENSP ID: ENSP00000363558

SEQ ID NO: 100227 - protein, 117 aa, Homo sapiens
  Payload ID: 19969
  Gene Name: zinc finger protein 485
  ENSP ID: ENSP00000393570
MAPRAQIQGPLTFGDVAVAFTRIEWRHLDAAQRALYRDVMLENYGNLVSVGLLSSKPKLITQLEQGAEPWTEVREAPSGTHAVEDYWFETKMSALKQSTSEASVLGERTKSVMMEKG

SEQ ID NO: 100228 - protein, 463 aa, Homo sapiens
  Payload ID: 19970
  Gene Name: zinc finger protein 486
  Uniprot ID: Q96H40
  ENSP ID: ENSP00000335042
MPGPLRSLEMESLQFRDVAVEFSLEEWHCLDTAQQNLYRDVMLENYRHLVFLGIIVSKPDLITCLEQGIKPLTMKRHEMIAKPPVVCSHFAQDLWPEQSIKDSYQKVILRKFEKCGHGNLHFKKGCESVDECKLHKRGYNGLNQCLTTTQSKIFQCGKYVKVFHQFSNSKRHKRRHTEKKPLKYIEGDKAFNQSSTHTTHKKIDTGEKPYKCEECGKAFNRSSHLTTHKITHTREKPYKCEECGKVFKYFSSFTTHKKIHSGEKPYICEECGKAFMYPYTLTTHKIIHTGEQPYKCKECDKAFNHPATLSSHKKIHTGEKPYTCDKCGKAFISSSILSKHEKIHTGEKPYKCEECGKAFTRSSHLTMHKIIHTGEKPYKCEECGKAFTWSAGLHKHRRTHTGEKPYKCEECGKAYTTSSNLTEHKTTHTGEKPYKCKECGKAFNWSSDLNKHKRIHIGQKPRT

SEQ ID NO: 100229 - protein, 128 aa, Homo sapiens
  Payload ID: 19970
  Gene Name: zinc finger protein 486
  ENSP ID: ENSP00000469306
MPGPLRSLEMESLQFRDVAVEFSLEEWHCLDTAQQNLYRDVMLENYRHLVFLGIIVSKPDLITCLEQGIKPLTMKRHEMIAKPPGPGMVVAPICNPRILGGQHRRIPGAQKFETSLGKIWRPLFIKII

SEQ ID NO: 100230 - protein, 189 aa, Homo sapiens
  Payload ID: 19971
  Gene Name: zinc finger protein 487
  ENSP ID: ENSP00000314093
  MOD_RES (1)..(1): Any amino acid
XRPRPRTPSRGPSDLRFRGEAGLRRVFLKKAGGSVSFSDVAVGFTQEEWQHLDSAQRTPYRDMMLENYSLLLSVGYCITKPEVVCKLEHGQVLWILEEESPSQSHLDCCIDDDLMEKRQENQDQHLQKVDFVNNKTLTMDRNGVLGKTFSLDTNPILSRKIRGNCDSSGMNLNNISELIISNRSSFVRN

SEQ ID NO: 100231 - protein, 208 aa, Homo sapiens
  Payload ID: 19971
  Gene Name: zinc finger protein 487
  Uniprot ID: B1APH4
  ENSP ID: ENSP00000392335
MMLENYSLLLSVGYCITKPEVVCKLEHGQVLWILEEESPSQSHLDCCIDDDLMEKRQENQDQHLQKVDFVNNKTLTMDRNGVLGKTFSLDTNPILSRKIRGNCDSSGMNLNNISELIISNRSSFVRNPAECNVRGKFLLCMKRENPYARGKPLEYDGNGKAVSQNEDLFRHQYIQTLKQCFEYNQCGKAFHEEAACSTHKRVCSWETL

SEQ ID NO: 100232 - protein, 6 aa, Homo sapiens
  Payload ID: 19971
  Gene Name: zinc finger protein 487
  ENSP ID: ENSP00000395135
MMLENY

SEQ ID NO: 100233 - protein, 113 aa, Homo sapiens
  Payload ID: 19971
  Gene Name: zinc finger protein 487
  ENSP ID: ENSP00000395343
MMLENYSLLLSVDCCIDDDLMEKRQENQDQHLQKVDFVNNKTLTMDRNGVLGKTFSLDTNPILSRKIRGNCDSSGMNLNNISELIISNRSSFVRNPAECNVRGKFLLCMKREN

SEQ ID NO: 100234 - protein, 340 aa, Homo sapiens
  Payload ID: 19972
  Gene Name: zinc finger protein 488
  Uniprot ID: Q96MN9
  ENSP ID: ENSP00000462269
MPEWPPCLSVAPALVITMAAGKGAPLSPSAENRWRLSEPELGRGCKPVLLEKTNRLGPEAAVGRAGRDVGSAELALLVAPGKPRPGKPLPPKTRGEQRQSAFTELPRMKDRQVDAQAQEREHDDPTGQPGAPQLTQNIPRGPAGSKVFSVWPSGARSEQRSAFSKPTKRPAERPELTSVFPAGESADALGELSGLLNTTDLACWGRLSTPKLLVGDLWNLQALPQNAPLCSTFLGAPTLWLEHTQAQVPPPSSSSTTSWALLPPTLTSLGLSTQNWCAKCNLSFRLTSDLVFHMRSHHKKEHAGPDPHSQKRREEALACPVCQEHFRERHHLSRHMTSHS

SEQ ID NO: 100235 - protein, 233 aa, Homo sapiens
  Payload ID: 19972
  Gene Name: zinc finger protein 488
  Uniprot ID: Q96MN9
  ENSP ID: ENSP00000468133
MKDRQVDAQAQEREHDDPTGQPGAPQLTQNIPRGPAGSKVFSVWPSGARSEQRSAFSKPTKRPAERPELTSVFPAGESADALGELSGLLNTTDLACWGRLSTPKLLVGDLWNLQALPQNAPLCSTFLGAPTLWLEHTQAQVPPPSSSSTTSWALLPPTLTSLGLSTQNWCAKCNLSFRLTSDLVFHMRSHHKKEHAGPDPHSQKRREEALACPVCQEHFRERHHLSRHMTSHS

SEQ ID NO: 100236 - protein, 529 aa, Homo sapiens
  Payload ID: 19973
  Gene Name: zinc finger protein 490
  Uniprot ID: Q9ULM2
  ENSP ID: ENSP00000311521
MRRNSSLSFQMERPLEEQVQSKWSSSQGRTGTGGSDVLQMQNSEHHGQSIKTQTDSISLEDVAVNFTLEEWALLDPGQRNIYRDVMRATFKNLACIGEKWKDQDIEDEHKNQGRNLRSPMVEALCENKEDCPCGKSTSQIPDLNTNLETPTGLKPCDCSVCGEVFMHQVSLNRHMRSHTEQKPNECHEYGEKPHKCKECGKTFTRSSSIRTHERIHTGEKPYECKECGKAFAFLFSFRNHIRIHTGETPYECKECGKAFRYLTALRRHEKNHTGEKPYKCKQCGKAFIYYQPFLTHERTHTGEKPYECKQCGKAFSCPTYLRSHEKTHTGEKPFVCRECGRAFFSHSSLRKHVKTHTGVQPYTCKKCGEAFKSSSSCEVHERTHFGEKPYECKQCGKAFNSSSYLQLHERVHTGEKTYECKECGKAFLYSTHFRIHERTHTREKPYECKQCGRVFIYFSHLRRHERSHTGVKPCECKQCGKAFTCLNSLKVHKRIHTGERPFQCRQCGKAFSYSKSLHVHERTHSRQKP

SEQ ID NO: 100237 - protein, 60 aa, Homo sapiens
  Payload ID: 19973
  Gene Name: zinc finger protein 490
  ENSP ID: ENSP00000402719
MRRNSSLSFQMERPLEEQVQSKWSSSQGRTGTGGSDVLQIYGYKCTCVTWIYFIVAKSGF

SEQ ID NO: 100238 - protein, 131 aa, Homo sapiens
  Payload ID: 19973
  Gene Name: zinc finger protein 490
  ENSP ID: ENSP00000404112
MDSISLEDVAVNFTLEEWALLDPGQRNIYRDVMRATFKNLACIGEKWKDQDIEDEHKNQGRNLRSPMVEALCENKEDCPCGKSTSQIPDLNTNLETPTGLKPCDCSVCGEVFMHQVSLNRHMRSHTEQKPN

SEQ ID NO: 100239 - protein, 437 aa, Homo sapiens
  Payload ID: 19974
  Gene Name: zinc finger protein 491
  Uniprot ID: Q8N8L2
  ENSP ID: ENSP00000313443
MGERLFESAEGSQCGETFTQVPEDMLNKKTLPGVKSCESGTCGEIFMGYSSFNRNIRTDTGHQPHKCQKFLEKPYKHKQRRKALSHSHCFRTHERPHTREKPFDCKECEKSFISPASIRRYMVTHSGDGPYKCKFCGKALDCLSLYLTHERTHTGEKRYECKQCGKAFSWHSSVRIHERTHTGEKPYECKECGKSFNFSSSFRRHERTHTGEKPYKCKECGKAFNCPSSFHRHERTHTGEKPYECKLYGKALSRLISFRRHMRMHTGERPHKCKICGKAFYSPSSFQRHERSHTGEKPYKCKQCGKAFTCSTSFQYHERTHTGEKPDGCKQCGKAFRSAKYIRIHGRTHTGEKPYECKQCGKAFHCVSSFHRHERTHAGEKPYECKHCGKAFTCSIYIRIHERIHTGEKPYQCKECGKAFIRSSYCRKHERTHTINI

SEQ ID NO: 100240 - protein, 139 aa, Homo sapiens
  Payload ID: 19974
  Gene Name: zinc finger protein 491
  ENSP ID: ENSP00000392176
MGERLFESAEGSQCGETFTQVPEDMLNKKTLPGVKSCESGTCGEIFMGYSSFNRNIRTDTGHQPHKCQKFLEKPYKHKQRRKALSHSHCFRTHERPHTREKPFDCKECEKSFISPASIRRYMVTHSGDGPYKCKFCGKA

SEQ ID NO: 100241 - protein, 531 aa, Homo sapiens
  Payload ID: 19975
  Gene Name: zinc finger protein 492
  Uniprot ID: Q9P255
  ENSP ID: ENSP00000413660
MLENYRNLVFVGIAASKPDLITCLEQGKEPWNVKRHEMVAEPPVVCSYFARDLWPKQGKKNYFQKVILRRYKKCGCENLQLRKYCKSMDECKVHKECYNGLNQCLTTTQNKIFQCDKYVKVFHKFSNSNRHTIRHTGKKSFKCKECEKSFCMLSHLAQHKRIHSGEKPYKCKECGKAYNETSNLSTHKRIHTGKKPYKCEECGKAFNRLSHLTTHKIIHTGKKPYKCEECGKAFNQSANLTTHKRIHTGEKPYKCEECGRAFSQSSTLTAHKIIHAGEKPYKCEECGKAFSQSSTLTTHKIIHTGEKFYKCEECGKAFSQLSHLTTHKRIHSGEKPYKCEECGKAFKQSSTLTTHKRIHAGEKFYKCEVCSKAFSRFSHLTTHKRIHTGEKPYKCEECGKAFNLSSQLTTHKIIHTGEKPYKCEECGKAFNQSSTLSKHKVIHTGEKPYKYEECGKAFNQSSHLTTHKMIHTGEKPYKCEECGKAFNNSSILNRHKMIHTGEKLYKPESCNNACDNIAKISKYKRNCAGEK

SEQ ID NO: 100242 - protein, 103 aa, Homo sapiens
  Payload ID: 19976
  Gene Name: zinc finger protein 493
  Uniprot ID: Q6ZR52
  ENSP ID: ENSP00000340651
MPGPPESLDMGPLTFRDVAIEFSLEEWQCLDTAQQDLYRKVMLENYRNLVFLAGIAVSKPDLVTCLEQGKDPWNMKGHSTVVKPPVETGFHRFSQDGLYLLTS

SEQ ID NO: 100243 - protein, 646 aa, Homo sapiens
  Payload ID: 19976
  Gene Name: zinc finger protein 493
  Uniprot ID: Q6ZR52
  ENSP ID: ENSP00000347691
MNECNVHKEGYNELNQYLTTTQSKIFQCDKYVKVFHKLLNSNRHNTKHTGKKPFKCKKCGKSFCMLLHLCQHKRIHIRENSYRCEECGKAFIWFSTLTRHRRVHTGEKSYKYECGKSFNQDSNLTTHKRIHTGQKPYKCEECGTSFYQFSYLTRHKLIHTREKPYKCEQYGKTFNQSSTLTGHKIIHNGEKPYKCEECGKAFSIFSTPTKHKIIHTEEKSHRCEEYCKAYKESSHLTTHKRIHTGEKPYKCEECGKAFSIFSTLTKHKIIHTEEKSHRCEECGKAYKESSHLTTHKRIHTGEKPYKCEECGKTFSVFSILTKHKIIHTEEKPYKCEECGKAFKRSSTLTKHRIIHTEEKPYKCEECGKAFNQSSTLSIHKIIHTGEKPYKCEECGKAFKRSSTLTIHKMIHTGEKPYKCEECGKAFNRSSHLTTHKRIHTGHKPYKCKECGKSFSVFSTLTKHKIIHTDKKPYKCEECGKAFNRSSILSIHKKIHTGEKPYKCEECGKAFKRSSHLAGHKQIHSVQKPYKCEECGKAFSIFSTLTKHKIIHTEEKPYKCEKCGKTFYRFSNLNTHKIIHTGEKPCKCEECGKAFNHSSNLIKHKLIHTGDKPYKCEACGKAFRRSSHLSRHKIIHIGIHTEETVQK

SEQ ID NO: 100244 - protein, 774 aa, Homo sapiens
  Payload ID: 19976
  Gene Name: zinc finger protein 493
  Uniprot ID: Q6ZR52
  ENSP ID: ENSP00000376110
MPGPPESLDMGPLTFRDVAIEFSLEEWQCLDTAQQDLYRKVMLENYRNLVFLGIAVSKPDLVTCLEQGKDPWNMKGHSTVVKPPVICSHFAEDFCPGPGIKDSFQKVILREYVKCGHKDLQLRKGCKSMNECNVHKEGYNELNQYLTTTQSKIFQCDKYVKVFHKLLNSNRHNTKHTGKKPFKCKKCGKSFCMLLHLCQHKRIHIRENSYRCEECGKAFIWFSTLTRHRRVHTGEKSYKYECGKSFNQDSNLTTHKRIHTGQKPYKCEECGTSFYQFSYLTRHKLIHTREKPYKCEQYGKTFNQSSTLTGHKIIHNGEKPYKCEECGKAFSIFSTPTKHKIIHTEEKSHRCEEYCKAYKESSHLTTHKRIHTGEKPYKCEECGKAFSIFSTLTKHKIIHTEEKSHRCEECGKAYKESSHLTTHKRIHTGEKPYKCEECGKTFSVFSILTKHKIIHTEEKPYKCEECGKAFKRSSTLTKHRIIHTEEKPYKCEECGKAFNQSSTLSIHKIIHTGEKPYKCEECGKAFKRSSTLTIHKMIHTGEKPYKCEECGKAFNRSSHLTTHKRIHTGHKPYKCKECGKSFSVFSTLTKHKIIHTDKKPYKCEECGKAFNRSSILSIHKKIHTGEKPYKCEECGKAFKRSSHLAGHKQIHSVQKPYKCEECGKAFSIFSTLTKHKIIHTEEKPYKCEKCGKTFYRFSNLNTHKIIHTGEKPCKCEECGKAFNHSSNLIKHKLIHTGDKPYKCEACGKAFRRSSHLSRHKIIHIGIHTEETVQK

SEQ ID NO: 100245 - protein, 48 aa, Homo sapiens
  Payload ID: 19976
  Gene Name: zinc finger protein 493
  ENSP ID: ENSP00000469170
MPGPPESLDMVRVLGPTSRERGRSCSEPVGSGCGGTQASPQSAPQSAP

SEQ ID NO: 100246 - protein, 95 aa, Homo sapiens
  Payload ID: 19976
  Gene Name: zinc finger protein 493
  ENSP ID: ENSP00000469368
MPGPPESLDMGPLTFRDVAIEFSLEEWQCLDTAQQDLYRKVMLENYRNLVFLAGIAVSKPDLVTCLEQGKDPWNMKGHSTVVKPPGFLPPSVTAS

SEQ ID NO: 100247 - protein, 94 aa, Homo sapiens
  Payload ID: 19976
  Gene Name: zinc finger protein 493
  ENSP ID: ENSP00000469680
MPGPPESLDMGPLTFRDVAIEFSLEEWQCLDTAQQDLYRKVMLENYRNLVFLGIAVSKPDLVTCLEQGKDPWNMKGHSTVVKPPGFLPPSVTAS

SEQ ID NO: 100248 - protein, 48 aa, Homo sapiens; identical to SEQ ID NO: 100245
  Payload ID: 19976
  Gene Name: zinc finger protein 493
  ENSP ID: ENSP00000472110

SEQ ID NO: 100249 - protein, 587 aa, Homo sapiens
  Payload ID: 19977
  Gene Name: zinc finger protein 496
  Uniprot ID: Q96IT1
  ENSP ID: ENSP00000294753
MPTALCPRVLAPKESEEPRKMRSPPGENPSPQGELPSPESSRRLFRRFRYQEAAGPREALQRLWDLCGGWLRPERHTKEQILELLVLEQFLAILPREIQSWVRAQEPESGEQAVAAVEALEREPGRPWQWLKHCEDPVVIDDGDSPLDQEQEQLPVEPHSDLAKNQDAQPITLAQCLGLPSRPPSQLSGDPVLQDAFLLQEENVRDTQQVTTLQLPPSRVSPFKDMILCFSEEDWSLLDPAQTGFYGEFIIGEDYGVSMPPNDLAAQPDLSQGEENEPRVPELQDLQGKEVPQVSYLDSPSLQPFQVEERRKREELQVPEFQACPQTVVPQNTYPAGGNPRSLENSLDEEVTIEIVLSSSGDEDSQHGPYCTEELGSPTEKQRSLPASHRSSTEAGGEVQTSKKSYVCPNCGKIFRWRVNFIRHLRSRREQEKPHECSVCGELFSDSEDLDGHLESHEAQKPYRCGACGKSFRLNSHLLSHRRIHLQPDRLQPVEKREQAASEDADKGPKEPLENGKAKLSFQCCECGKAFQRHDHLARHRSHFHLKDKARPFQCRYCVKSFTQNYDLLRHERLHMKRRSKQALNSY

SEQ ID NO: 100250 - protein, 512 aa, Homo sapiens
  Payload ID: 19977
  Gene Name: zinc finger protein 496
  ENSP ID: ENSP00000473324
QAVAAVEALEREPGRPWQWLKHCEDPVVIDDGDSPLDQEQEQLPVEPHSDLAKNQDAQPITLAQCLGLPSRPPSQLSGDPVLQDAFLLQEENVRDTQQVTTLQLPPRIFQFNNHRSNGYILEMLGSGGKKAQIISVLSQIYVSRVSPFKDMILCFSEEDWSLLDPAQTGFYGEFIIGEDYGVSMPPNDLAAQPDLSQGEENEPRVPELQDLQGKEVPQVSYLDSPSLQPFQVEERRKREELQVPEFQACPQTVVPQNTYPAGGNPRSLENSLDEEVTIEIVLSSSGDEDSQHGPYCTEELGSPTEKQRSLPASHRSSTEAGGEVQTSKKSYVCPNCGKIFRWRVNFIRHLRSRREQEKPHECSVCGELFSDSEDLDGHLESHEAQKPYRCGACGKSFRLNSHLLSHRRIHLQPDRLQPVEKREQAASEDADKGPKEPLENGKAKLSFQCCECGKAFQRHDHLARHRSHFHLKDKARPFQCRYCVKSFTQNYDLLRHERLHMKRRSKQALNSY

SEQ ID NO: 100251 - protein, 498 aa, Homo sapiens
  Payload ID: 19978
  Gene Name: zinc finger protein 497
  Uniprot ID: Q6ZNH5
  ENSP ID: ENSP00000311183
MESPRGWTLQVAPEEGQVLCNVKTATRGLSEGAVSGGWGAWENSTEVPREAGDGQRQQATLGAADEQGGPGRELGPADGGRDGAGPRSEPADRALRPSPLPEEPGCRCGECGKAFSQGSYLLQHRRVHTGEKPYTCPECGKAFAWSSNLSQHQRIHSGEKPYACRECGKAFRAHSQLIHHQETHSGLKPFRCPDCGKSFGRSTTLVQHRRTHTGEKPYECPECGKAFSWNSNFLEHRRVHTGARPHACRDCGKAFSQSSNLAEHLKIHAGARPHACPDCGKAFVRVAGLRQHRRTHSSEKPFPCAECGKAFRESSQLLQHQRTHTGERPFECAECGQAFVMGSYLAEHRRVHTGEKPHACAQCGKAFSQRSNLLSHRRTHSGAKPFACADCGKAFRGSSGLAHHRLSHTGERPFACAECGKAFRGSSELRQHQRLHSGERPFVCAHCSKAFVRKSELLSHRRTHTGERPYACGECGKPFSHRCNLNEHQKRHGGRAAP

SEQ ID NO: 100252 - protein, 498 aa, Homo sapiens; identical to SEQ ID NO: 100251
  Payload ID: 19978
  Gene Name: zinc finger protein 497
  Uniprot ID: Q6ZNH5
  ENSP ID: ENSP00000402815

SEQ ID NO: 100253 - protein, 108 aa, Homo sapiens
  Payload ID: 19978
  Gene Name: zinc finger protein 497
  ENSP ID: ENSP00000471650
METGPSCSSQTGVSTFLTLGAPPCEARRGEWCHSRASAGHRREMESPRGWTLQVAPEEGQVLCNVKTATRGLSEGAVSGGWGAWENSTEVPREAGDGQRQQATLGAAD

SEQ ID NO: 100254 - protein, 480 aa, Homo sapiens
  Payload ID: 19979
  Gene Name: zinc finger protein 500
  Uniprot ID: O60304
  ENSP ID: ENSP00000219478
MATVPGLQPLPTLEQDLEQEEILIVKVEEDFCLEEEPSVETEDPSPETFRQLFRLFCYQEVAGPREALSRLWELCCRWLRPELRTKEQILELLVLEQFLTVLPGEIQARVREQQPESGEEAVVLVEGLQRKPRKHRQRGSELLSDDEVPLGIGGQFLKHQAEAQPEDLSLEEEARFSSQQPPAQLSHRPQRGPLLWPERGPPAPRHQEMASASPFLSAWSQVPVNLEDVAVYLSGEEPRCMDPAQRDAPLENEGPGIQLEDGGDGREDAPLRMEWYRVLSARCQGPGHPLPGQRPAPVRGLVRPDQPRGGPPPGRRASHGADKPYTCPECGKGFSKTSHLTKHQRTHTGERPYKCLVCGKGFSDRSNFSTHQRVHTGEKPYPCPECGKRFSQSSSLVIHRRTHSGERPYACTQCGKRFNNSSHFSAHRRTHTGEKPYTCPACGRGFRRGTDLHKHQRTHMGAGSLPTLQPVAPGGPGAKA

SEQ ID NO: 100255 - protein, 441 aa, Homo sapiens
  Payload ID: 19979
  Gene Name: zinc finger protein 500
  Uniprot ID: O60304
  ENSP ID: ENSP00000445714
MATVPGLQPLPTLEQDLEQEEILIVKVEEDFCLEEEPSVETEDPSPETFRQLFRLFCYQEVAGPREALSRLWELCCRWLRPELRTKEQILELLVLEQFLTVLPGEIQARVREQQPESGEEAVVLVEGLQRKPRKHRQRGSELLSDDEVPLGIGGQFLKHQAEAQPEDLSLEEEARFSSQQPPAQLSHRPQRGPLLWPERGPPAPRHQEMASASPFLSAWSQVPVNLEDVAVYLSGEEPRCMDPAQRDAPLENEGPGIQLEDGGDGREDAPLRMEWYRVLSARCQGPGHPLPGQRPAPVRGLVRPDQPRGGPPPGRRASHGADKPYTCPECGKGFSKTSHLTKHQRTHTGERPYKCLVCGKGFSDRSNFSTHQRVHTGEKPYPCPECGKRFSQSSSLVIHRRTHSGERPYACTQCGKRFNNSSHFSAHRRTHTGHILRSGCT

SEQ ID NO: 100256 - protein, 92 aa, Homo sapiens
  Payload ID: 19979
  Gene Name: zinc finger protein 500
  ENSP ID: ENSP00000464747
MEWYRVLSARCQGPGHPLPGQRPAPVRGLVRPDQPRGGPPPGRRASHGADKPYTCPECGKGFSKTSHLTKHQRTHTGERPYKCLVCGKGFSD

SEQ ID NO: 100257 - protein, 73 aa, Homo sapiens
  Payload ID: 19979
  Gene Name: zinc finger protein 500
  ENSP ID: ENSP00000465073
  MOD_RES (1)..(1): Any amino acid
XSSTAGHTAGSGPMPAPSAGSASTTARTSAPTAGRTQVKKRKRKQILVTPLSKSSLKARLAAHSAIIPALWKA

SEQ ID NO: 100258 - protein, 142 aa, Homo sapiens
  Payload ID: 19979
  Gene Name: zinc finger protein 500
  ENSP ID: ENSP00000466375
MATVPGLQPLPTLEQDLEQEEILIVKVEEDFCLEEEPSVETEDPSPETFRQLFRLFCYQEVAGPREALSRLWELCCRWLRPELRTKEQILELLVLEQFLTVLPGEIQARVREQQPESGEEAVVLVEGLQRKPRKHRQRGDSS

SEQ ID NO: 100259 - protein, 121 aa, Homo sapiens
  Payload ID: 19979
  Gene Name: zinc finger protein 500
  ENSP ID: ENSP00000467598
MATVPGLQPLPTLEQDLEQEEILIVKVEEDFCLEEEPSVETEDPSPETFRQLFRLFCYQEVAGPREALSRLWELCCRWLRPELRTKEQILELLVLEQFLTVLPGEIQARVREQQPESGEEA

SEQ ID NO: 100260 - protein, 25 aa, Homo sapiens
  Payload ID: 19979
  Gene Name: zinc finger protein 500
  ENSP ID: ENSP00000468393
MATVPGLQPLPTLEQDLEQEEILIV

SEQ ID NO: 100261 - protein, 271 aa, Homo sapiens
  Payload ID: 19980
  Gene Name: zinc finger protein 501
  Uniprot ID: Q96CX3
  ENSP ID: ENSP00000379363
MNSSQISLRMKHGRVNMQKKPSKCSECGKFFTQRSSLTQHQRIHRGEKPYVCSECGSCFRKQSNLTQHLRIHTGEKPYKCNECEKAFQTKAILVQHLRIHTGEKPYKCNECGKAFCQSPSLIKHQRIHTGEKPYKCTECGKAFSQSICLTRHQRSHSGDKPFKCNECGKAFNQSACLMQHQRIHSGEKPYTCTECGKAFTQNSSLVEHERTHTGEKLYKCSECEKTFRKQAHLSEHYRIHTGEKPYECVGCGKSFRHSSALLRHQRLHAGE

SEQ ID NO: 100262 - protein, 271 aa, Homo sapiens; identical to SEQ ID NO: 100261
  Payload ID: 19980
  Gene Name: zinc finger protein 501
  Uniprot ID: Q96CX3
  ENSP ID: ENSP00000482632

SEQ ID NO: 100263 - protein, 271 aa, Homo sapiens; identical to SEQ ID NO: 100261
  Payload ID: 19980
  Gene Name: Zinc finger protein 501
  ENSP ID: ENSP00000485862

SEQ ID NO: 100264 - protein, 271 aa, Homo sapiens; identical to SEQ ID NO: 100261
  Payload ID: 19980
  Gene Name: Zinc finger protein 501
  ENSP ID: ENSP00000487032

SEQ ID NO: 100265 - protein, 544 aa, Homo sapiens
  Payload ID: 19981
  Gene Name: zinc finger protein 502
  Uniprot ID: Q8TBZ5
  ENSP ID: ENSP00000296091
MLNMQGAEERDIRRETCPGWVNKNKPALEQDVCKIDSSGIVVKRFQEDEYQDSTFEEKYACEGMKENSPREIAESCLFQEGGFGRITFIHKEAPPEIISQGYNFEKSLLLTSSLVTRLRVSTEESLHQWETSNIQTNDISDQSKCPTLCTQKKSWKCNECGKTFTQSSSLTQHQRTHTGERPYTCEECGKAFSRSSFLVQHQRIHTGVKPYGCEQCGKTFRCRSFLTQHQRIHTGEKPYKCNECGNSFRNHSHLTEHQRIHTGEKPYKCNRCGKAFNQNTHLIHHQRIHTGEKPYICSECGSSFRKHSNLTQHQRIHTGEKPHKCDECGKTFQTKANLSQHQRIHSGEKPYKCKECGKAFCQSPSLIKHQRIHTGEKPYKCKECGKAFTQSTPLTKHQRIHTGERPYKCSECGKAFIQSICLIRHQRSHTGEKPYKCNECGKGFNQNTCLTQHMRIHTGEKPYKCKECGKAFAHSSSLTEHHRTHTGEKLYKCSECEKTFRKYAHLSEHYRIHTGEKPYECIECGKFFRHSSVLFRHQKLHSGD

SEQ ID NO: 100266 - protein, 544 aa, Homo sapiens; identical to SEQ ID NO: 100265
  Payload ID: 19981
  Gene Name: zinc finger protein 502
  Uniprot ID: Q8TBZ5
  ENSP ID: ENSP00000397390

SEQ ID NO: 100267 - protein, 155 aa, Homo sapiens
  Payload ID: 19981
  Gene Name: zinc finger protein 502
  ENSP ID: ENSP00000401717
MLNMQGAEERDIRRETCPGWVNKNKPALEQDVCKIDSSGIVVKRFQEDEYQDSTFEEKYACEGMKENSPREIAESCLFQEGGFGRITFIHKEAPPEIISQGYNFEKSLLLTSSLVTRLRVSTEESLHQWETSNIQTNDISDQSKCPTLCTQKKSW

SEQ ID NO: 100268 - protein, 544 aa, Homo sapiens; identical to SEQ ID NO: 100265
  Payload ID: 19981
  Gene Name: zinc finger protein 502
  Uniprot ID: Q8TBZ5
  ENSP ID: ENSP00000406469

SEQ ID NO: 100269 - protein, 544 aa, Homo sapiens; identical to SEQ ID NO: 100265
  Payload ID: 19981
  Gene Name: Zinc finger protein 502
  ENSP ID: ENSP00000485847

SEQ ID NO: 100270 - protein, 544 aa, Homo sapiens; identical to SEQ ID NO: 100265
  Payload ID: 19981
  Gene Name: Zinc finger protein 502
  ENSP ID: ENSP00000486576

SEQ ID NO: 100271 - protein, 544 aa, Homo sapiens; identical to SEQ ID NO: 100265
  Payload ID: 19981
  Gene Name: Zinc finger protein 502
  ENSP ID: ENSP00000487139

SEQ ID NO: 100272 - protein, 155 aa, Homo sapiens; identical to SEQ ID NO: 100267
  Payload ID: 19981
  Gene Name: Zinc finger protein 502
  ENSP ID: ENSP00000487297

SEQ ID NO: 100273 - protein, 646 aa, Homo sapiens
  Payload ID: 19982
  Gene Name: zinc finger protein 503
  Uniprot ID: Q96F45
  ENSP ID: ENSP00000361602
MSTAPSLSALRSSKHSGGGGGGGGGGGADPAWTSALSGNSSGPGPGSSPAGSTKPFVHAVPPSDPLRQANRLPIKVLKMLTARTGHILHPEYLQPLPSTPVSPIELDAKKSPLALLAQTCSQIGKPDPSPSSKLSSVASNGGGAGGAGGGAAGDKDTKSGPLKLSDIGVEDKSSFKPYSKPGSDKKEPGGGGGGGGGGGGGGGGVSSEKSGFRVPSATCQPFTPRTGSPSSSASACSPGGMLSSAGGAPEGKDDKKDTDVGGGGKGTGGASAEGGPTGLAHGRISCGGGINVDVNQHPDGGPGGKALGSDCGGSSGSSSGSGPSAPTSSSVLGSGLVAPVSPYKPGQTVFPLPPAGMTYPGSLAGAYAGYPPQFLPHGVALDPTKPGSLVGAQLAAAAAGSLGCSKPAGSSPLAGASPPSVMTASLCRDPYCLSYHCASHLAGAAAASASCAHDPAAAAAALKSGYPLVYPTHPLHGVHSSLTAAAAAGATPPSLAGHPLYPYGFMLPNDPLPHICNWVSANGPCDKRFATSEELLSHLRTHTAFPGTDKLLSGYPSSSSLASAAAAAMACHMHIPTSGAPGSPGTLALRSPHHALGLSSRYHPYSKSPLPTPGAPVPVPAATGPYYSPYALYGQRLTTASALGYQ

SEQ ID NO: 100274 - protein, 283 aa, Homo sapiens
  Payload ID: 19982
  Gene Name: zinc finger protein 503
  ENSP ID: ENSP00000438988
MSTAPSLSALRSSKHSGGGGGGGGGGGADPAWTSALSGNSSGPGPGSSPAGSTKPFVHAVPPSDPLRQANRLPIKVLKMLTARTGHILHPEYLQPLPSTPVSPIELDAKKSPLALLAQTCSQIGKPDPSPALAGHPLYPYGFMLPNDPLPHICNWVSANGPCDKRFATSEELLSHLRTHTAFPGTDKLLSGYPSSSSLASAAAAAMACHMHIPTSGAPGSPGTLALRSPHHALGLSSRYHPYSKSPLPTPGAPVPVPAATGPYYSPYALYGQRLTTASALGYQ

SEQ ID NO: 100275 - protein, 444 aa, Homo sapiens
  Payload ID: 19983
  Gene Name: zinc finger protein 506
  Uniprot ID: Q5JVG8
  ENSP ID: ENSP00000393835
MGPLQFRDVAIEFSLEEWHCLDAAQRNLYRDVMLENYRNLIFLGIVVSKPNLITCLEQGKKPLTMKRHEMIAKPPVMYSHFAQDLWSEQSIKDSFQKVILRRYEKCRHDNLQLKKGCESVDECPVHKRGYNGLKQCLATTQRKIFQCDEYVKFLHKFSNSNKHKIRDTGKKSFKCIEYGKTFNQSSTRTTYKKIDAGEKRYKCEECGKAYKQSSHLTTHKKIHTGEKPYKCEECGKAYKQSCNLTTHKIIHTGEKPYRCRECGKAFNHPATLFSHKKIHTGEKPYKCDKCGKAFISSSTLTKHEIIHTGEKPYKCEECGKAFNRSSNLTKHKRIHTGDVPYKCDECGKTFTWYSSLSKHKRAHTGEKPYKCEECGKAFTAFSTLTEHKIIHTGEKPYKCEECGKAFNWSSALNKHKKIHIRQKPCIVKNVENLLNVPQPLISIR

SEQ ID NO: 100276 - protein, 412 aa, Homo sapiens
  Payload ID: 19983
  Gene Name: zinc finger protein 506
  Uniprot ID: Q5JVG8
  ENSP ID: ENSP00000408892
MGPLQFRDVAIEFSLEEWHCLDAAQRNLYRDVMLENYRNLIFLVMYSHFAQDLWSEQSIKDSFQKVILRRYEKCRHDNLQLKKGCESVDECPVHKRGYNGLKQCLATTQRKIFQCDEYVKFLHKFSNSNKHKIRDTGKKSFKCIEYGKTFNQSSTRTTYKKIDAGEKRYKCEECGKAYKQSSHLTTHKKIHTGEKPYKCEECGKAYKQSCNLTTHKIIHTGEKPYRCRECGKAFNHPATLFSHKKIHTGEKPYKCDKCGKAFISSSTLTKHEIIHTGEKPYKCEECGKAFNRSSNLTKHKRIHTGDVPYKCDECGKTFTWYSSLSKHKRAHTGEKPYKCEECGKAFTAFSTLTEHKIIHTGEKPYKCEECGKAFNWSSALNKHKKIHIRQKPCIVKNVENLLNVPQPLISIR

SEQ ID NO: 100277 - protein, 444 aa, Homo sapiens; identical to SEQ ID NO: 100275
  Payload ID: 19983
  Gene Name: zinc finger protein 506
  Uniprot ID: Q5JVG8
  ENSP ID: ENSP00000440625

SEQ ID NO: 100278 - protein, 78 aa, Homo sapiens
  Payload ID: 19983
  Gene Name: zinc finger protein 506
  ENSP ID: ENSP00000445149
MGPLQFRDVAIEFSLEEWHCLDAAQRNLYRDVMLENYRNLIFLGIVVSKPNLITCLEQGKKPLTMKRHEMIAKPPGGL

SEQ ID NO: 100279 - protein, 137 aa, Homo sapiens
  Payload ID: 19983
  Gene Name: zinc finger protein 506
  ENSP ID: ENSP00000464733
MGPLQFRDVAIEFSLEEWHCLDAAQRNLYRDVMLENYRNLIFLGIVVSKPNLITCLEQGKKPLTMKRHEMIAKPPDGVSVFHPGWSAVARSRLTATSTSQVDCLRSGVQDHPGQHSETPSEEALLSRGHSLWMNKVH

SEQ ID NO: 100280 - protein, 92 aa, Homo sapiens
  Payload ID: 19983
  Gene Name: zinc finger protein 506
  ENSP ID: ENSP00000464837
MGPLQFRDVAIEFSLEEWHCLDAAQRNLYRDVMLENYRNLIFLGIVVSKPNLITCLEQGKKPLTMKRHEMIAKPPETGFHRVSQDGLHLLTL

SEQ ID NO: 100281 - protein, 107 aa, Homo sapiens
  Payload ID: 19983
  Gene Name: zinc finger protein 506
  ENSP ID: ENSP00000467047
MGPLQFRDVAIEFSLEEWHCLDAAQRNLYRDVMLENYRNLIFLGIVVSKPNLITCLEQGKKPLTMKRHEMIAKPPDGVSVFHPGCSELRSRHCIPVWATEQDSISKK

SEQ ID NO: 100282 - protein, 444 aa, Homo sapiens; identical to SEQ ID NO: 100275
  Payload ID: 19983
  Gene Name: zinc finger protein 506
  Uniprot ID: Q5JVG8
  ENSP ID: ENSP00000468150

SEQ ID NO: 100283 - protein, 148 aa, Homo sapiens
  Payload ID: 19983
  Gene Name: zinc finger protein 506
  ENSP ID: ENSP00000468206
MYSHFAQDLWSEQSIKDSFQKVILRRYEKCRHDNLQLKKGCESVDECPVHKRGYNGLKQCLATTQRKIFQCDEYVKFLHKFSNSNKHKIRDTGKKSFKCIEYGKTFNQSSTRTTYKKIDAGEKRYKCEECGKAYKQSSHLTTHKKIHT

SEQ ID NO: 100284 - protein, 108 aa, Homo sapiens
  Payload ID: 19983
  Gene Name: zinc finger protein 506
  ENSP ID: ENSP00000468217
MGPLQFRDVAIEFSLEEWHCLDAAQRNLYRDVMLENYRNLIFLGIVVSKPNLITCLEQGKKPLTMKRHEMIAKPPGQARWLMPIIPALWRAKAGGSSEVRSSRKSGGP

SEQ ID NO: 100285 - protein, 953 aa, Homo sapiens
  Payload ID: 19984
  Gene Name: zinc finger protein 507
  Uniprot ID: Q8TCN5
  ENSP ID: ENSP00000312277
MEESSSVAMLVPDIGEQEAILTAESIISPSLEIDEQRKTKPDPLIHVIQKLSKIVENEKSQKCLLIGKKRPRSSAATHSLETQELCEIPAKVIQSPAADTRRAEMSQTNFTPDTLAQNEGKAMSYQCSLCKFLSSSFSVLKDHIKQHGQQNEVILMCSECHITSRSQEELEAHVVNDHDNDANIHTQSKAQQCVSPSSSLCRKTTERNETIPDIPVSVDNLQTHTVQTASVAEMGRRKWYAYEQYGMYRCLFCSYTCGQQRMLKTHAWKHAGEVDCSYPIFENENEPLGLLDSSAAAAPGGVDAVVIAIGESELSIHNGPSVQVQICSSEQLSSSSPLEQSAERGVHLSQSVTLDPNEEEMLEVISDAEENLIPDSLLTSAQKIISSSPNKKGHVNVIVERLPSAEETLSQKRFLMNTEMEEGKDLSLTEAQIGREGMDDVYRADKCTVDIGGLIIGWSSSEKKDELMNKGLATDENAPPGRRRTNSESLRLHSLAAEALVTMPIRAAELTRANLGHYGDINLLDPDTSQRQVDSTLAAYSKMMSPLKNSSDGLTSLNQSNSTLVALPEGRQELSDGQVKTGISMSLLTVIEKLRERTDQNASDDDILKELQDNAQCQPNSDTSLSGNNVVEYIPNAERPYRCRLCHYTSGNKGYIKQHLRVHRQRQPYQCPICEHIADNSKDLESHMIHHCKTRIYQCKQCEESFHYKSQLRNHEREQHSLPDTLSIATSNEPRISSDTADGKCVQEGNKSSVQKQYRCDVCDYTSTTYVGVRNHRRIHNSDKPYRCSLCGYVCSHPPSLKSHMWKHASDQNYNYEQVNKAINDAISQSGRVLGKSPGKTQLKSSEESADPVTGSSENAVSSSELMSQTPSEVLGTNENEKLSPTSNTSYSLEKISSLAPPSMEYCVLLFCCCICGFESTSKENLLDHMKEHEGEIVNIILNKDHNTALNTN

SEQ ID NO: 100286 - protein, 953 aa, Homo sapiens; identical to SEQ ID NO: 100285
  Payload ID: 19984
  Gene Name: zinc finger protein 507
  Uniprot ID: Q8TCN5
  ENSP ID: ENSP00000348162

SEQ ID NO: 100287 - protein, 957 aa, Homo sapiens
  Payload ID: 19984
  Gene Name: zinc finger protein 507
  ENSP ID: ENSP00000441549
MEESSSVAMLVPDIGEQEAILTAESIISPSLEIDEQRKTKPDPLIHVIQKLSKIVENEKSQKCLLIGKKRPRSSAATHSLETQELCEIPAKVIQSPAADTRRAEMSQTNFTPDTLAQNEGKAMSYQCSLCKFLSSSFSVLKDHIKQHGQQNEVILMCSECHITSRSQEELEAHVVNDHDNDANIHTQSKAQQCVSPSSSLCRKTTERNETIPDIPVSVDNLQTHTVQTASVAEMGRRKWYAYEQYGMYRCLFCSYTCGQQRMLKTHAWKHAGEVDCSYPIFENENEPLGLLDSSAAAAPGGVDAVVIAIGESELSIHNGPSVQVQICSSEQLSSSSPLEQSAERGVHLSQSVTLDPNEEEMLEVISDAEENLIPDSLLTSAQKIISSSPNKKGHVNVIVERLPSAEETLSQKRFLMNTEMEEGKDLSLTEAQIGREGMDDVYRADKCTVDIGGLIIGWSSSEKKDELMNKGLATDENAPPGRRRTNSESLRLHSLAAEALVTMPIRAAELTRANLGHYGDINLLDPDTSQRQVDSTLAAYSKMMSPLKNSSDGLTSLNQSNSTLVALPEGRQELSDGQVKTGISMSLLTVIEKLRERTDQNASDDDILKELQDNAQCQPNSDTSLSGNNVVEYIPNAERPYRCRLCHYTSGNKGYIKQHLRVHRQRQPYQCPICEHIADNSKDLESHMIHHCKTRIYQCKQCEESFHYKSQLRNHEREQHSLPDTLSIATSNEPRISSDTADGKCVQEGNKSSVQKQYRCDVCDYTSTTYVGVRNHRRIHNSDKPYRKEFRCSLCGYVCSHPPSLKSHMWKHASDQNYNYEQVNKAINDAISQSGRVLGKSPGKTQLKSSEESADPVTGSSENAVSSSELMSQTPSEVLGTNENEKLSPTSNTSYSLEKISSLAPPSMEYCVLLFCCCICGFESTSKENLLDHMKEHEGEIVNIILNKDHNTALNTN

SEQ ID NO: 100288 - protein, 683 aa, Homo sapiens
  Payload ID: 19985
  Gene Name: zinc finger protein 510
  Uniprot ID: Q9Y2H8
  ENSP ID: ENSP00000223428
MSPHPEAITDCVTLNTVGQLAEGGYPLRFSTLFQEQQKMNISQASVSFKDVTIEFTQEEWQQMAPVQKNLYRDVMLENYSNLVSVGYCCFKPEVIFKLEQGEEPWFSEEEFSNQSHPKDYRGDDLIKQNKKIKDKHLEQAICINNKTLTTEEEKVLGKPFTLHVAAVASTKMSCKCNSWEVNLQSISEFIINNRNYSTKKIGCGNVCENSPFKINFEKTQTGEKFYEHNKNMKALNYNENLPKHPKFQTLEQAFECNKIGKAFNDKANCVKHNSSHTGETSSKDDEFRKNCDKKTLFDHRRTGTGKKHLHLNQCGKSFEKSTVEEYNKLNMGIKHYELNPSGNNFNRKAHLTDPQTAVIEENPLVSNDRTQTWVKSSEYHENKKSYQTSVHRVRRRSHSMMKPYKCNECGKSFCQKGHLIQHQRTHTGEKPFECSECGKTFSQKSHLSTHQRIHTAEKPYKCNECGKTFVQKSTLRGHQRIHTGEKPYECSECGKTFVQKSTLRDHHRIHTGEKSFQCNQCGKTFGQKSNLRIHQRTHTGEKTYQCNECEKSFWRKDHLIQHQKTHTGEKPFKCNECGKTFARTSTLRVHQRIHTGEKPFKCNECGKKFVRKAILSDHQRIHTGEKPFQCNKCGKTFGQKSNLRIHQRTHSGEKSYECNEYGKLCKKSTLSLYQKIQGEGNPY

SEQ ID NO: 100289 - protein, 134 aa, Homo sapiens
  Payload ID: 19985
  Gene Name: zinc finger protein 510
  ENSP ID: ENSP00000363772
MSPHPEAITDCVTLNTVGQLAEGGYPLRFSTLFQEQQKMNISQASVSFKDVTIEFTQEEWQQMAPVQKNLYRDVMLENYSNLVSVGYCCFKPEVIFKLEQGEEPWFSEEEFSNQSHPSELLSSSRHNSAGVVRL

SEQ ID NO: 100290 - protein, 683 aa, Homo sapiens; identical to SEQ ID NO: 100288
  Payload ID: 19985
  Gene Name: zinc finger protein 510
  Uniprot ID: Q9Y2H8
  ENSP ID: ENSP00000364379

SEQ ID NO: 100291 - protein, 262 aa, Homo sapiens
  Payload ID: 19986
  Gene Name: zinc finger protein 511
  Uniprot ID: Q8NB15
  ENSP ID: ENSP00000351929
MQLPPALCARLAAGPGAAEPLPVERDPAAGAAPFRFVARPVRFPREHQFFEDGDVQRHLYLQDVIMQVADVPEKPRVPAFACQVAGCCQVFDALDDYEHHYHTLHGNVCSFCKRAFPSGHLLDAHILEWHDSLFQILSERQDMYQCLVEGCTEKFKTSRDRKDHMVRMHLYPADFRFDKPKKSRSPASAEAPGDSGERSEGEAMEICSEPVAASPAPAGERRIYRHRSVSELFLKPVLNMCSVLRILGCTWAAALLILNSER

SEQ ID NO: 100292 - protein, 252 aa, Homo sapiens
  Payload ID: 19986
  Gene Name: zinc finger protein 511
  Uniprot ID: Q8NB15
  ENSP ID: ENSP00000355251
MQLPPALCARLAAGPGAAEPLPVERDPAAGAAPFRFVARPVRFPREHQFFEDGDVQRHLYLQDVIMQVADVPEKPRVPAFACQVAGCCQVFDALDDYEHHYHTLHGNVCSFCKRAFPSGHLLDAHILEWHDSLFQILSERQDMYQCLVEGCTEKFKTSRDRKDHMVRMHLYPADFRFDKPKKSRSPASAEAPGDSGERSEGEAMEICSEPVAASPAPAGERRIYRHRIPSTICFGQGAARGFKSNKKKTKQC

SEQ ID NO: 100293 - protein, 567 aa, Homo sapiens
  Payload ID: 19987
  Gene Name: zinc finger protein 512
  Uniprot ID: Q96ME7
  ENSP ID: ENSP00000347648
MSSRLGAVPATSGPTTFKQQRSTRIVGAKNSRTQCSIKDNSFQYTIPHDDSLSGSSSASSCEPVSDFPASFRKSTYWMKMRRIKPAATSHVEGSGGVSAKGKRKPRQEEDEDYREFPQKKHKLYGRKQRPKTQPNPKSQARRIRKEPPVYAAGSLEEQWYLEIVDKGSVSCPTCQAVGRKTIEGLKKHMENCKQEMFTCHHCGKQLRSLAGMKYHVMANHNSLPILKAGDEIDEPSERERLRTVLKRLGKLRCMRESCSSSFTSIMGYLYHVRKCGKGAAELEKMTLKCHHCGKPYRSKAGLAYHLRSEHGPISFFPESGQPECLKEMNLESKSGGRVQRRSAKIAVYHLQELASAELAKEWPKRKVLQDLVPDDRKLKYTRPGLPTFSQEVLHKWKTDIKKYHRIQCPNQGCEAVYSSVSGLKAHLGSCTLGNFVAGKYKCLLCQKEFVSESGVKYHINSVHAEDWFVVNPTTTKSFEKLMKIKQRQQEEEKRRQQHRSRRSLRRRQQPGIELPETELSLRVGKDQRRNNEELVVSASCKEPEQEPVPAQFQKVKPPKTNHKRGRK

SEQ ID NO: 100294 - protein, 566 aa, Homo sapiens
  Payload ID: 19987
  Gene Name: zinc finger protein 512
  ENSP ID: ENSP00000369040
MSSRLGAVPATSGPTTFKQQRSTRIVGAKNRTQCSIKDNSFQYTIPHDDSLSGSSSASSCEPVSDFPASFRKSTYWMKMRRIKPAATSHVEGSGGVSAKGKRKPRQEEDEDYREFPQKKHKLYGRKQRPKTQPNPKSQARRIRKEPPVYAAGSLEEQWYLEIVDKGSVSCPTCQAVGRKTIEGLKKHMENCKQEMFTCHHCGKQLRSLAGMKYHVMANHNSLPILKAGDEIDEPSERERLRTVLKRLGKLRCMRESCSSSFTSIMGYLYHVRKCGKGAAELEKMTLKCHHCGKPYRSKAGLAYHLRSEHGPISFFPESGQPECLKEMNLESKSGGRVQRRSAKIAVYHLQELASAELAKEWPKRKVLQDLVPDDRKLKYTRPGLPTFSQEVLHKWKTDIKKYHRIQCPNQGCEAVYSSVSGLKAHLGSCTLGNFVAGKYKCLLCQKEFVSESGVKYHINSVHAEDWFVVNPTTTKSFEKLMKIKQRQQEEEKRRQQHRSRRSLRRRQQPGIELPETELSLRVGKDQRRNNEELVVSASCKEPEQEPVPAQFQKVKPPKTNHKRGRK

SEQ ID NO: 100295 - protein, 490 aa, Homo sapiens
  Payload ID: 19987
  Gene Name: zinc finger protein 512
  Uniprot ID: Q96ME7
  ENSP ID: ENSP00000395660
MKMRRIKPAATSHVEGSGGVSAKGKRKPRQEEDEDYREFPQKKHKLYGRKQRPKTQPNPKSQARRIRKEPPVYAAGSLEEQWYLEIVDKGSVSCPTCQAVGRKTIEGLKKHMENCKQEMFTCHHCGKQLRSLAGMKYHVMANHNSLPILKAGDEIDEPSERERLRTVLKRLGKLRCMRESCSSSFTSIMGYLYHVRKCGKGAAELEKMTLKCHHCGKPYRSKAGLAYHLRSEHGPISFFPESGQPECLKEMNLESKSGGRVQRRSAKIAVYHLQELASAELAKEWPKRKVLQDLVPDDRKLKYTRPGLPTFSQEVLHKWKTDIKKYHRIQCPNQGCEAVYSSVSGLKAHLGSCTLGNFVAGKYKCLLCQKEFVSESGVKYHINSVHAEDWFVVNPTTTKSFEKLMKIKQRQQEEEKRRQQHRSRRSLRRRQQPGIELPETELSLRVGKDQRRNNEELVVSASCKEPEQEPVPAQFQKVKPPKTNHKRGRK

SEQ ID NO: 100296 - protein, 538 aa, Homo sapiens
  Payload ID: 19987
  Gene Name: zinc finger protein 512
  Uniprot ID: Q96ME7
  ENSP ID: ENSP00000407038
MSSRLGAVPATSGPTTFKQQRSTRIVGAKNRTQCSIKDNSFQYTIPHDDSLSGSSSASSCEPVSDFPASFRKSTYWMKMRRIKPAATSHVEGSGGVSAKGKRKPRQEEDEDYREFPQKKHKLYGSLEEQWYLEIVDKGSVSCPTCQAVGRKTIEGLKKHMENCKQEMFTCHHCGKQLRSLAGMKYHVMANHNSLPILKAGDEIDEPSERERLRTVLKRLGKLRCMRESCSSSFTSIMGYLYHVRKCGKGAAELEKMTLKCHHCGKPYRSKAGLAYHLRSEHGPISFFPESGQPECLKEMNLESKSGGRVQRRSAKIAVYHLQELASAELAKEWPKRKVLQDLVPDDRKLKYTRPGLPTFSQEVLHKWKTDIKKYHRIQCPNQGCEAVYSSVSGLKAHLGSCTLGNFVAGKYKCLLCQKEFVSESGVKYHINSVHAEDWFVVNPTTTKSFEKLMKIKQRQQEEEKRRQQHRSRRSLRRRQQPGIELPETELSLRVGKDQRRNNEELVVSASCKEPEQEPVPAQFQKVKPPKTNHKRGRK

SEQ ID NO: 100297 - protein, 490 aa, Homo sapiens; identical to SEQ ID NO: 100295
  Payload ID: 19987
  Gene Name: zinc finger protein 512
  Uniprot ID: Q96ME7
  ENSP ID: ENSP00000451572

SEQ ID NO: 100298 - protein, 892 aa, Homo sapiens
  Payload ID: 19988
  Gene Name: zinc finger protein 512B
  Uniprot ID: Q96KM6
  ENSP ID: ENSP00000217130
MTDPFCVGGRRLPGSSKSGPGKDGSRKEVRLPMLHDPPKMGMPVVRGGQTVPGQAPLCFDPGSPASDKTEGKKKGRPKAENQALRDIPLSLMNDWKDEFKAHSRVKCPNSGCWLEFPSIYGLKYHYQRCQGGAISDRLAFPCPFCEAAFTSKTQLEKHRIWNHMDRPLPASKPGPISRPVTISRPVGVSKPIGVSKPVTIGKPVGVSKPIGISKPVSVGRPMPVTKAIPVTRPVPVTKPVTVSRPMPVTKAMPVTKPITVTKSVPVTKPVPVTKPITVTKLVTVTKPVPVTKPVTVSRPIVVSKPVTVSRPIAISRHTPPCKMVLLTRSENKAPRATGRNSGKKRAADSLDTCPIPPKQARPENGEYGPSSMGQSSAFQLSADTSSGSLSPGSRPSGGMEALKAAGPASPPEEDPERTKHRRKQKTPKKFTGEQPSISGTFGLKGLVKAEDKARVHRSKKQEGPGPEDARKKVPAAPITVSKEAPAPVAHPAPGGPEEQWQRAIHERGEAVCPTCNVVTRKTLVGLKKHMEVCQKLQDALKCQHCRKQFKSKAGLNYHTMAEHSAKPSDAEASEGGEQEERERLRKVLKQMGRLRCPQEGCGAAFSSLMGYQYHQRRCGKPPCEVDSPSFPCTHCGKTYRSKAGHDYHVRSEHTAPPPEEPTDKSPEAEDPLGVERTPSGRVRRTSAQVAVFHLQEIAEDELARDWTKRRMKDDLVPETARLNYTRPGLPTLNPQLLEAWKNEVKEKGHVNCPNDCCEAIYSSVSGLKAHLASCSKGAHLAGKYRCLLCPKEFSSESGVKYHILKTHAENWFRTSADPPPKHRSQDSLVPKKEKKKNLAGGKKRGRKPKERTPEEPVAKLPPRRDDWPPGCRDKGARGSTGRKVGVSKAPEK

SEQ ID NO: 100299 - protein, 892 aa, Homo sapiens; identical to SEQ ID NO: 100298
  Payload ID: 19988
  Gene Name: zinc finger protein 512B
  Uniprot ID: Q96KM6
  ENSP ID: ENSP00000358904

SEQ ID NO: 100300 - protein, 892 aa, Homo sapiens; identical to SEQ ID NO: 100298
  Payload ID: 19988
  Gene Name: zinc finger protein 512B
  Uniprot ID: Q96KM6
  ENSP ID: ENSP00000393795

SEQ ID NO: 100301 - protein, 541 aa, Homo sapiens
  Payload ID: 19989
  Gene Name: zinc finger protein 513
  Uniprot ID: Q8N8E2
  ENSP ID: ENSP00000318373
MPRRKQSHPQPVKCEGVKVDTEDSLDEGPGALVLESDLLLGQDLEFEEEEEEEEGDGNSDQLMGFERDSEGDSLGARPGLPYGLSDDESGGGRALSAESEVEEPARGPGEARGERPGPACQLCGGPTGEGPCCGAGGPGGGPLLPPRLLYSCRLCTFVSHYSSHLKRHMQTHSGEKPFRCGRCPYASAQLVNLTRHTRTHTGEKPYRCPHCPFACSSLGNLRRHQRTHAGPPTPPCPTCGFRCCTPRPARPPSPTEQEGAVPRRPEDALLLPDLSLHVPPGGASFLPDCGQLRGEGEGLCGTGSEPLPELLFPWTCRGCGQELEEGEGSRLGAAMCGRCMRGEAGGGASGGPQGPSDKGFACSLCPFATHYPNHLARHMKTHSGEKPFRCARCPYASAHLDNLKRHQRVHTGEKPYKCPLCPYACGNLANLKRHGRIHSGDKPFRCSLCNYSCNQSMNLKRHMLRHTGEKPFRCATCAYTTGHWDNYKRHQKVHGHGGAGGPGLSASEGWAPPHSPPSVLSSRGPPALGTAGSRAVHTDSS

SEQ ID NO: 100302 - protein, 479 aa, Homo sapiens
  Payload ID: 19989
  Gene Name: zinc finger protein 513
  Uniprot ID: Q8N8E2
  ENSP ID: ENSP00000384874
MGFERDSEGDSLGARPGLPYGLSDDESGGGRALSAESEVEEPARGPGEARGERPGPACQLCGGPTGEGPCCGAGGPGGGPLLPPRLLYSCRLCTFVSHYSSHLKRHMQTHSGEKPFRCGRCPYASAQLVNLTRHTRTHTGEKPYRCPHCPFACSSLGNLRRHQRTHAGPPTPPCPTCGFRCCTPRPARPPSPTEQEGAVPRRPEDALLLPDLSLHVPPGGASFLPDCGQLRGEGEGLCGTGSEPLPELLFPWTCRGCGQELEEGEGSRLGAAMCGRCMRGEAGGGASGGPQGPSDKGFACSLCPFATHYPNHLARHMKTHSGEKPFRCARCPYASAHLDNLKRHQRVHTGEKPYKCPLCPYACGNLANLKRHGRIHSGDKPFRCSLCNYSCNQSMNLKRHMLRHTGEKPFRCATCAYTTGHWDNYKRHQKVHGHGGAGGPGLSASEGWAPPHSPPSVLSSRGPPALGTAGSRAVHTDSS

SEQ ID NO: 100303 - protein, 116 aa, Homo sapiens
  Payload ID: 19989
  Gene Name: zinc finger protein 513
  ENSP ID: ENSP00000394226
MGFERDSEGDSLGARPGLPYGLSDDESGGGRALSAESEVEEPARGPGEARGERPGPACQLCGGPTGEGPCCGAGGPGGGPLLPPRLLYSCRLCTFVSHYSSHLKRHMQTHSGEKPF

SEQ ID NO: 100304 - protein, 400 aa, Homo sapiens
  Payload ID: 19990
  Gene Name: zinc finger protein 514
  Uniprot ID: Q96K75
  ENSP ID: ENSP00000295208
MTFEDVAVEFSQWEWGQLNPAQKDLYREVMLENFRNLAILGLLVSKPYVICQLEEGGEPFMVEREISTGAHSDWKRRSKSKESMPSWGISKEELFQVVSVEKHIQDVLQFSKLKAACGCDGQLEMQQIKQERHLKQMSTIHKSATTLSRDYKWNGFGRSLGLRSVLVNQHSILMGEGSYKCDTEFRQTLGGNNSQRTHPEKKSCKCNECGKSFHFQSELRRHQRCHTGEKPYECSDCGRAFGHISSLIKHQRTHTGEKPYECSECGRAFSQSSSLVLHYRFHTGEKPYKCNECGRAFGHTSSLIKHQRTHTGEKPYECRECGRTFSQSSSLIVHYRFHTGEKPYKCNKCGRAFSQSSSLTQHYRFHTGEKPYKCNECGRAFAHTASLIKHQRSHAGKKTL

SEQ ID NO: 100305 - protein, 71 aa, Homo sapiens
  Payload ID: 19990
  Gene Name: zinc finger protein 514
  ENSP ID: ENSP00000399647
MIKSYFRNKATFFQDLMTFEDVAVEFSQWEWGQLNPAQKDLYREVMLENFRNLAILGLLVSKPYVICQLEE

SEQ ID NO: 100306 - protein, 400 aa, Homo sapiens; identical to SEQ ID NO: 100304
  Payload ID: 19990
  Gene Name: zinc finger protein 514
  Uniprot ID: Q96K75
  ENSP ID: ENSP00000405509

SEQ ID NO: 100307 - protein, 1163 aa, Homo sapiens
  Payload ID: 19991
  Gene Name: zinc finger protein 516
  Uniprot ID: Q92618
  ENSP ID: ENSP00000394757
MDRNREAEMELRRGPSPTRAGRGHEVDGDKATCHTCCICGKSFPFQSSLSQHMRKHTGEKPYKCPYCDHRASQKGNLKIHIRSHRTGTLIQGHEPEAGEAPLGEMRASEGLDACASPTKSASACNRLLNGASQADGARVLNGASQADSGRVLLRSSKKGAEGSACAPGEAKAAVQCSFCKSQFERKKDLELHVHQAHKPFKCRLCSYATLREESLLSHIERDHITAQGPGSGEACVENGKPELSPGEFPCEVCGQAFSQTWFLKAHMKKHRGSFDHGCHICGRRFKEPWFLKNHMKAHGPKTGSKNRPKSELDPIATINNVVQEEVIVAGLSLYEVCAKCGNLFTNLDSLNAHNAIHRRVEASRTRAPAEEGAEGPSDTKQFFLQCLNLRPSAAGDSCPGTQAGRRVAELDPVNSYQAWQLATRGKVAEPAEYLKYGAWDEALAGDVAFDKDRREYVLVSQEKRKREQDAPAAQGPPRKRASGPGDPAPAGHLDPRSAARPNRRAAATTGQGKSSECFECGKIFRTYHQMVLHSRVHRRARRERDSDGDRAARARCGSLSEGDSASQPSSPGSACAAADSPGSGLADEAAEDSGEEGAPEPAPGGQPRRCCFSEEVTSTELSSGDQSHKMGDNASERDTGESKAGIAASVSILENSSRETSRRQEQHRFSMDLKMPAFHPKQEVPVPGDGVEFPSSTGAEGQTGHPAEKLSDLHNKEHSGGGKRALAPDLMPLDLSARSTRDDPSNKETASSLQAALVVHPCPYCSHKTYYPEVLWMHKRIWHRVSCNSVAPPWIQPNGYKSIRSNLVFLSRSGRTGPPPALGGKECQPLLLARFTRTQVPGGMPGSKSGSSPLGVVTKAASMPKNKESHSGGPCALWAPGPDGYRQTKPCHGQEPHGAATQGPLAKPRQEASSKPVPAPGGGGFSRSATPTPTVIARAGAQPSANSKPVEKFGVPPAGAGFAPTNKHSAPDSLKAKFSAQPQGPPPAKGEGGAPPLPPREPPSKAAQELRTLATCAAGSRGDAALQAQPGVAGAPPVLHSIKQEPVAEGHEKRLDILNIFKTYIPKDFATLYQGWGVSGPGLEHRGTLRTQARPGEFVCIECGKSFHQPGHLRAHMRAHSVVFESDGPRGSEVHTTSADAPKQGRDHSNTGTVQTVPLRKGT

SEQ ID NO: 100308 - protein, 25 aa, Homo sapiens
  Payload ID: 19991
  Gene Name: zinc finger protein 516
  ENSP ID: ENSP00000445902
  MOD_RES (1)..(1): Any amino acid
XDFATLYQGWGVSGPGLEHRGERPF

SEQ ID NO: 100309 - protein, 75 aa, Homo sapiens
  Payload ID: 19991
  Gene Name: zinc finger protein 516
  ENSP ID: ENSP00000446211
MDRNREAEMELRRGPSPTRAGRGHEVDGDKATCHTCCICGKSFPFQSSLSQHMRKHTGEKPYKCPYCDHRASQKG

SEQ ID NO: 100310 - protein, 517 aa, Homo sapiens
  Payload ID: 19991
  Gene Name: zinc finger protein 516
  ENSP ID: ENSP00000478712
  MOD_RES (1)..(1): Any amino acid
XCFSEEVTSTELSSGDQSHKMGDNASERDTGESKAGIAASVSILENSSRETSRRQEQHRFSMDLKMPAFHPKQEVPVPGDGVEFPSSTGAEGQTGHPAEKLSDLHNKEHSGGGKRALAPDLMPLDLSARSTRDDPSNKETASSLQAALVVHPCPYCSHKTYYPEVLWMHKRIWHRVSCNSVAPPWIQPNGYKSIRSNLVFLSRSGRTGPPPALGGKECQPLLLARFTRTQVPGGMPGSKSGSSPLGVVTKAASMPKNKESHSGGPCALWAPGPDGYRQTKPCHGQEPHGAATQGPLAKPRQEASSKPVPAPGGGGFSRSATPTPTVIARAGAQPSANSKPVEKFGVPPAGAGFAPTNKHSAPDSLKAKFSAQPQGPPPAKGEGGAPPLPPREPPSKAAQELRTLATCAAGSRGDAALQAQPGVAGAPPVLHSIKQEPVAEGHEKRLDILNIFKTYIPKDFATLYQGWGVSGPGLEHRGTLRTQARPGEFVCIECGKSFHQPGHLRAHMRAHSGERPF

SEQ ID NO: 100311 - protein, 492 aa, Homo sapiens
  Payload ID: 19992
  Gene Name: zinc finger protein 517
  Uniprot ID: Q6ZMY9
  ENSP ID: ENSP00000353058
MAMALPMPGPQEAVVFEDVAVYFTRIEWSCLAPDQQALYRDVMLENYGNLASLGFLVAKPALISLLEQGEEPGALILQVAEQSVAKASLCTDSRMEAGIMESPLQRKLSRQAGLPGTVWGCLPWGHPVGGHPAPPHPHGGPEDGSDKPTHPRAREHSASPRVLQEDLGRPVGSSAPRYRCVCGKAFRYNSLLLRHQIIHTGAKPFQCTECGKAFKQSSILLRHQLIHTEEKPFQCGECGKAFRQSTQLAAHHRVHTRERPYACGECGKAFSRSSRLLQHQKFHTGEKPFACTECGKAFCRRFTLNEHGRIHSGERPYRCLRCGQRFIRGSSLLKHHRLHAQEGAQDGGVGQGALLGAAQRPQAGDPPHECPVCGRPFRHNSLLLLHLRLHTGEKPFECAECGKAFGRKSNLTLHQKIHTKEKPFACTECGKAFRRSYTLNEHYRLHSGERPYRCRACGRACSRLSTLIQHQKVHGREPGEDTEGRRAPCWAS

SEQ ID NO: 100312 - protein, 459 aa, Homo sapiens
  Payload ID: 19992
  Gene Name: zinc finger protein 517
  ENSP ID: ENSP00000432025
  MOD_RES (1)..(1): Any amino acid
XCSSTEGPWNGDGTPDAWTSGFLVAKPALISLLEQGEEPGALILQVAEQSVAKASLCTDSRMEAGIMESPLQRKLSRQAGLPGTVWGCLPWGHPVGGHPAPPHPHGGPEDGSDKPTHPRAREHSASPRVLQEDLGRPVGSSAPRYRCVCGKAFRYNSLLLRHQIIHTGAKPFQCTECGKAFKQSSILLRHQLIHTEEKPFQCGECGKAFRQSTQLAAHHRVHTRERPYACGECGKAFSRSSRLLQHQKFHTGEKPFACTECGKAFCRRFTLNEHGRIHSGERPYRCLRCGQRFIRGSSLLKHHRLHAQEGAQDGGVGQGALLGAAQRPQAGDPPHECPVCGRPFRHNSLLLLHLRLHTGEKPFECAECGKAFGRKSNLTLHQKIHTKEKPFACTECGKAFRRSYTLNEHYRLHSGERPYRCRACGRACSRLSTLIQHQKVHGREPGEDTEGRRAPCWAS

SEQ ID NO: 100313 - protein, 142 aa, Homo sapiens
  Payload ID: 19992
  Gene Name: zinc finger protein 517
  ENSP ID: ENSP00000433299
MAMALPMPGPQEAVVFEDVAVYFTRIEWSCLAPDQQALYRDVMLENYGNLASLGFLVAKPALISLLEQGEEPGALILQVAEQSVAKASLCTEDPNTLPSRSQEGSPASSEGGPGEKGVAGRVAGGGAASSWPHGEHPVTPNR

SEQ ID NO: 100314 - protein, 492 aa, Homo sapiens; identical to SEQ ID NO: 100311
  Payload ID: 19992
  Gene Name: zinc finger protein 517
  Uniprot ID: Q6ZMY9
  ENSP ID: ENSP00000435166

SEQ ID NO: 100315 - protein, 130 aa, Homo sapiens
  Payload ID: 19992
  Gene Name: zinc finger protein 517
  ENSP ID: ENSP00000435791
MAMALPMPGPQEAVVFEDVAVYFTRIEWSCLAPDQQALYRDVMLENYGNLASLALISLLEQGEEPGALILQVAEQSVAKASLCTDSRMEAGIMESPLQRKLSRQAGLPGTVWGCLPWGHPVGGHPAPPHP

SEQ ID NO: 100316 - protein, 492 aa, Homo sapiens; identical to SEQ ID NO: 100311
  Payload ID: 19992
  Gene Name: zinc finger protein 517
  Uniprot ID: Q6ZMY9
  ENSP ID: ENSP00000436103

SEQ ID NO: 100317 - protein, 1483 aa, Homo sapiens
  Payload ID: 19993
  Gene Name: zinc finger protein 518A
  Uniprot ID: Q6AHZ1
  ENSP ID: ENSP00000479684
MPSEQKQLFCDEKQTTLKKDYDVKNEIVDRSAPKPKISGSIHYALKNVKIDLPKINIPNEVLLKHEVDKYRKLFQSKQQTARKSISIKTVSCVEECTLLHKSERAEEEGVKMSAKILNFSCLKCRDNTRYSPNDLQKHFQMWHHGELPSYPCEMCNFSANDFQVFKQHRRTHRSTLVKCDICNNESVYTLLNLTKHFTSTHCVNGNFQCEKCKFSTQDVGTFVQHIHRHNEIHYKCGKCHHVCFTKGELQKHLHIHSGTFPFTCQYCSYGATRREHLVRHVITLHKEHLYAKEKLEKDKYEKRMAKTSAGLKLILKRYKIGASRKTFWKRKKINSGSDRSIEKNTQVLKKMNKTQTKSEDQSHVVQEHLSEEKDERLHCENNDKAPESESEKPTPLSTGQGNRAEEGPNASSGFMKTAVLGPTLKNVMMKNNKLAVSPNYNATFMGFKMMDGKQHIVLKLVPIKQNVCSPGSQSGAAKDGTANLQPQTLDTNGFLTGVTTELNDTVYMKAATPFSCSSSILSGKASSEKEMTLISQRNNMLQTMDYEKSVSSLSATSELVTASVNLTTKFETRDNVDFWGNHLTQSHPEVLGTTIKSPDKVNCVAKPNAYNSGDMHNYCINYGNCELPVESSNQGSLPFHNYSKVNNSNKRRRFSGTAVYENPQRESSSSKTVVQQPISESFLSLVRQESSKPDSLLASISLLNDKDGTLKAKSEIEEQYVLEKGQNIDGQNLYSNENQNLECATEKSKWEDFSNVDSPMMPRITSVFSLQSQQASEFLPPEVNQLLQDVLKIKPDVKQDSSNTPNKGLPLHCDQSFQKHEREGKIVESSKDFKVQGIFPVPPGSVGINVPTNDLNLKFGKEKQVSSIPQDVRDSEKMPRISGFGTLLKTQSDAIITQQLVKDKLRATTQNLGSFYMQSPLLNSEQKKTIIVQTSKGFLIPLNITNKPGLPVIPGNALPLVNSQGIPASLFVNKKPGMVLTLNNGKLEGVSAVKTEGAPARGTVTKEPCKTPILKVEPNNNCLTPGLCSSIGSCLSMKSSSENTLPLKGPYILKPTSSVKAVLIPNMLSEQQSTKLNISDSVKQQNEIFPKPPLYTFLPDGKQAVFLKCVMPNKTELLKPKLVQNSTYQNIQPKKPEGTPQRILLKIFNPVLNVTAANNLSVSNSASSLQKDNVPSNQIIGGEQKEPESRDALPFLLDDLMPANEIVITSTATCPESSEEPICVSDCSESRVLRCKTNCRIERNFNRKKTSKKIFSKTKTHGSKDSETAFVSRNRNCKRKCRDSYQEPPRRKATLHRKCKEKAKPEDVRETFGFSRPRLSKDSIRTLRLFPFSSKQLVKCPRRNQPVVVLNHPDADAPEVVSVMKTIAKFNGHVLKVSLSKRTINALLKPVCYNPPKTTYDDFSKRHKTFKPVSSVKERFVLKLTLKKTSKNNYQIVKTTSENILKAKFNCWFCGRVFDNQDTWAGHGQRHLMEATRDWNMLE

SEQ ID NO: 100318 - protein, 338 aa, Homo sapiens
  Payload ID: 19993
  Gene Name: zinc finger protein 518A
  ENSP ID: ENSP00000480280
MPSEQKQLFCDEKQTTLKKDYDVKNEIVDRSAPKPKISGSIHYALKNVKIDLPKINIPNEVLLKHEVDKYRKLFQSKQQTARKSISIKTVSCVEECTLLHKSERAEEEGVKMSAKILNFSCLKCRDNTRYSPNDLQKHFQMWHHGELPSYPCEMCNFSANDFQVFKQHRRTHRSTLVKCDICNNESVYTLLNLTKHFTSTHCVNGNFQCEKCKFSTQDVGTFVQHIHRHNEIHYKCGKCHHVCFTKGELQKHLHIHSGTFPFTCQYCSYGATRREHLVRHVITLHKEHLYAKEKLEKDKYEKRMAKTSAGLKLILKRYKIGASRKTFWKRKKINSGSD

SEQ ID NO: 100319 - protein, 1483 aa, Homo sapiens; identical to SEQ ID NO: 100317
  Payload ID: 19993
  Gene Name: zinc finger protein 518A
  Uniprot ID: Q6AHZ1
  ENSP ID: ENSP00000481657

SEQ ID NO: 100320 - protein, 1483 aa, Homo sapiens; identical to SEQ ID NO: 100317
  Payload ID: 19993
  Gene Name: zinc finger protein 518A
  Uniprot ID: Q6AHZ1
  ENSP ID: ENSP00000485614

SEQ ID NO: 100321 - protein, 1074 aa, Homo sapiens
  Payload ID: 19994
  Gene Name: zinc finger protein 518B
  Uniprot ID: Q9C0D4
  ENSP ID: ENSP00000317614
MKDIGQQLYTTHLNGGHNSLTMSPKQPDANGAPRPNRQEAQTLLYQGSEAEAAMMTIATCAKCKSVHKISLQDLQKGTGKDGMYVCFQCSLGAAPPNFHFVSNNSSATHVGNKTENFSSSVNSKFKVRNFKPGKYYCDKCRFSTKDPLQYKKHTLQHEEIKFICSHCSYISYTKGEFQRHLVKHTGIFPYQCEYCDYGAIRNDYIVKHTKRVHERAGAKRPVKAVAKLEPKRTGTSKQNPELLKASNPRTTFQNKWSDQLSGFSLHANKDKMHNIMLLPEPKEYQKDVVCIPNKMTLSEPNEVNLFENKNVEVEVLSPAKEPVQPGMPLTVVAPAELVVPANCLAQLIDVKVVNGTQQLVLKLFPLEENNCLEAGRDNGGNSERMVKEKGSNEQEKVLSAEKTKSLTVDGNVGKLVGIDSFQPSVQKQLKNVKWVRSYDFIMPNSSVHNNGKSFINSETIEDFQKKNNLYPHRTAFPSVALKGHSLASVFKNSVLRSLGAASNPFPYKAAVCFAESGRNLHSSSQQLLPFAASPATCSFSGEKGLLPVSENDLESTSKVNIPVKVVSSNRKQEDNQTEEHKAVSTVGQISSQHKSEYLHINITGEDRSQQPGDKPLELKNSERTNNTNDGPVISSVFSLSSGSENVPEGIKWNSSTSKIKSIELLRRKIAQLIESCGKPSSLASNSAHRRSVGQASKGTSKATSEGIQEINVSLTGLGHSTGTLQKPPNDGGITGNRQLTHQQIYPHFADGSNRKTKSRVARKAHVATPVLIPKGAVLRVLNSSENAHIIEATCEAPVSIPCSERQLIKPVPFCPVRQADSDLQPLRSERGPIDMSPNIETPLRPKLRKESAVCSTIHRKTGLLYGQQGSSELNKQGRLLSRSLSISRNKTKQVHLSRKKNKIQAEPSRCLKDPSIFQVARQLRLIAAKPDQLIKCPRRNQPVIVLNHPDVDSPEVTNVMKVINKYKGNVLKVVLSERTRCQLGIRRHHVRLTYQNAEEASQIKRQMMLKMKLKKVHKNNYQVVDSLPDDSSQCVFKCWFCGRLYEDQEEWMSHGQRHLIEATRDWDVLSSKGK

SEQ ID NO: 100322 - protein, 75 aa, Homo sapiens
  Payload ID: 19994
  Gene Name: zinc finger protein 518B
  ENSP ID: ENSP00000425298
MKDIGQQLYTTHLNGGHNSLTMSPKQPDANGAPRPNRQEAQTLLYQGSEAEAAMMTIATCAKCKSVHKISLQDLQ

SEQ ID NO: 100323 - protein, 540 aa, Homo sapiens
  Payload ID: 19995
  Gene Name: zinc finger protein 519
  Uniprot ID: Q8TB69
  ENSP ID: ENSP00000464872
MELLTFRDVAIEFSPEEWKCLDPAQQNLYRDVMLENYRNLVSLAVYSYYNQGILPEQGIQDSFKKATLGRYGSCGLENICLWKNWESIGEGEGQKECYNLCSQYLTTSHNKHLTVKGDKEYRIFQKKPQFLSAAPTEPCIPMNKYQHKFLKSVFCNKNQINFNHDSNISKHHSTHFLENYYNCNECEKVFYQSSKLIFPENIHIQKKPYNSNECGETSDPFSKLTQHQRIYIGESSQRCNKKCIIVFSQSHLKGHKIINTGEKSVKYKERGKAFTRGLHLGHQKIHTGEKPYKCKKCDKAFNKSSHLAQHQRIHTGEKPFKCKECGKAFNRGSYLTQHQRIHTGERAFKCEECGKAFNRGSYLTQHQRIHTGEKPFRCKECGKAFNRSSYVTQHQRMHTGEKPFKCKECGKAFNRASHLTQHQRIHTGEKHFKCKECGKAFNRGSHLTRHQRIHTGEKSFKCEECGKAFIWGSHLTQHQRVHTGEKFFKCKECGKAFTRSSHLTQHQRIHTGEKPFKCKECGKAFNRRSTLTQHQIIHTR

SEQ ID NO: 100324 - protein, 80 aa, Homo sapiens
  Payload ID: 19995
  Gene Name: zinc finger protein 519
  ENSP ID: ENSP00000465159
MELLTFRDVAIEFSPEEWKCLDPAQQNLYRDVMLENYRNLVSLELHTEHHQRTDGHFISLGEGQVYHAVMAIPASIGVWV

SEQ ID NO: 100325 - protein, 50 aa, Homo sapiens
  Payload ID: 19995
  Gene Name: zinc finger protein 519
  ENSP ID: ENSP00000468250
MELLTFRDVAIEFSPEEWKCLDPAQQNLYRDVMLENYRNLVSLVEKRDCL

SEQ ID NO: 100326 - protein, 1311 aa, Homo sapiens
  Payload ID: 19996
  Gene Name: zinc finger protein 521
  Uniprot ID: Q96K83
  ENSP ID: ENSP00000354794
MSRRKQAKPRSLKDPNCKLEDKTEDGEALDCKKRPEDGEELEDEAVHSCDSCLQVFESLSDITEHKINQCQLTDGVDVEDDPTCSWPASSPSSKDQTSPSHGEGCDFGEEEGGPGLPYPCQFCDKSFSRLSYLKHHEQSHSDKLPFKCTYCSRLFKHKRSRDRHIKLHTGDKKYHCSECDAAFSRSDHLKIHLKTHTSNKPYKCAICRRGFLSSSSLHGHMQVHERNKDGSQSGSRMEDWKMKDTQKCSQCEEGFDFPEDLQKHIAECHPECSPNEDRAALQCVYCHELFVEETSLMNHMEQVHSGEKKNSCSICSESFHTVEELYSHMDSHQQPESCNHSNSPSLVTVGYTSVSSTTPDSNLSVDSSTMVEAAPPIPKSRGRKRAAQQTPDMTGPSSKQAKVTYSCIYCNKQLFSSLAVLQIHLKTMHLDKPEQAHICQYCLEVLPSLYNLNEHLKQVHEAQDPGLIVSAMPAIVYQCNFCSEVVNDLNTLQEHIRCSHGFANPAAKDSNAFFCPHCYMGFLTDSSLEEHIRQVHCDLSGSRFGSPVLGTPKEPVVEVYSCSYCTNSPIFNSVLKLNKHIKENHKNIPLALNYIHNGKKSRALSPLSPVAIEQTSLKMMQAVGGAPARPTGEYICNQCGAKYTSLDSFQTHLKTHLDTVLPKLTCPQCNKEFPNQESLLKHVTIHFMITSTYYICESCDKQFTSVDDLQKHLLDMHTFVFFRCTLCQEVFDSKVSIQLHLAVKHSNEKKVYRCTSCNWDFRNETDLQLHVKHNHLENQGKVHKCIFCGESFGTEVELQCHITTHSKKYNCKFCSKAFHAIILLEKHLREKHCVFETKTPNCGTNGASEQVQKEEVELQTLLTNSQESHNSHDGSEEDVDTSEPMYGCDICGAAYTMETLLQNHQLRDHNIRPGESAIVKKKAELIKGNYKCNVCSRTFFSENGLREHMQTHLGPVKHYMCPICGERFPSLLTLTEHKVTHSKSLDTGNCRICKMPLQSEEEFLEHCQMHPDLRNSLTGFRCVVCMQTVTSTLELKIHGTFHMQKTGNGSAVQTTGRGQHVQKLYKCASCLKEFRSKQDLVKLDINGLPYGLCAGCVNLSKSASPGINVPPGTNRPGLGQNENLSAIEGKGKVGGLKTRCSSCNVKFESESELQNHIQTIHRELVPDSNSTQLKTPQVSPMPRISPSQSDEKKTYQCIKCQMVFYNEWDIQVHVANHMIDEGLNHECKLCSQTFDSPAKLQCHLIEHSFEGMGGTFKCPVCFTVFVQANKLQQHIFSAHGQEDKIYDCTQCPQKFFFQTELQNHTMTQHSS

SEQ ID NO: 100327 - protein, 1244 aa, Homo sapiens
  Payload ID: 19996
  Gene Name: zinc finger protein 521
  ENSP ID: ENSP00000382352
MSRRKQAKPRSLKDPNCKLEDKTEDGEALDCKKRPEDGEELEDEAVHSCDSCLQVFESLSDITEHKINQCQLTDGVDVEDDPTCSWPASSPSSKDQTSPSHGEGCDFGEEEGGPGLPYPCQFCDKSFSRLSYLKHHEQSHSDKLPFKCTYCSRLFKHKRSRDRHIKLHTGDKKYHCSECDAAFSRSDHLKIHLKTHTSNKPYKCAICRRGFLSSSSLHGHMQVHERNKDGSQSGSRMEDWKMKDTQKCSQCEEGFDFPEDLQKHIAECHPECSPNEDRAALQCVYCHELFVEETSLMNHMEQVHSGEKKNSCSICSESFHTVEELYSHMDSHQQPESCNHSNSPSLVTVGYTSVSSTTPDSNLSVDSSTMVEAAPPIPKSRGRKRAAQQTPDMTGPSSKQAKVTYSCIYCNKQLFSSLAVLQIHLKTMHLDKPEQAHICQYCLEVLPSLYNLNEHLKQVHEAQDPGLIVSAMPAIVYQCNFCSEVVNDLNTLQEHIRCSHGFANPAAKDSNAFFCPHCYMGFLTDSSLEEHIRQVHCDLSGSRFGSPVLGTPKEPVVEVYSCSYCTNSPIFNSVLKLNKHIKENHKNIPLALNYIHNGKKSRALSPLSPVAIEQTSLKMMQAVGGAPARPTGEYICNQCGAKYTSLDSFQTHLKTHLDTVLPKLTCPQCNKEFPNQESLLKHVTIHFMITSTYYICESCDKQFTSVDDLQKHLLDMHTFVFFRCTLCQEVFDSKVSIQLHLAVKHSNEKKVYRCTSCNWDFRNETDLQLHVKHNHLENQGKVHKCIFCGESFGTEVELQCHITTHSKKYNCKFCSKAFHAIILLEKHLREKHCVFETKTPNCGTNGASEQVQKEEVELQTLLTNSQESHNSHDGSEEDVDTSEPMYGCDICGAAYTMETLLQNHQLRDHNIRPGESAIVKKKAELIKGNYKCNVCSRTFFSENGLREHMQTHLGPVKHYMCPICGERFPSLLTLTEHKVTHSKSLDTGNCRICKMPLQSEEEFLEHCQMHPDLRNSLTGFRCVVCMQTVTSTLELKIHGTFHMQKTGNGSAVQTTGRGQHVQKLYKCASCLKEFRSKQDLVKLDINGLPYGLCAGCVNLSKSASPGINVPPGTNRPGLGQNENLSAIEGKGKVGGLKTRCSSCNVKFESESELQNHIQTIHRELVPDSNSTQLKTPQVSPMPRISPSQSDEDIVFSMTEETSAHANTTEIWNLSIASPRRPINASSVRWFSTMNGIFRFMLQIT

SEQ ID NO: 100328 - protein, 1311 aa, Homo sapiens; identical to SEQ ID NO: 100326
  Payload ID: 19996
  Gene Name: zinc finger protein 521
  Uniprot ID: Q96K83
  ENSP ID: ENSP00000440768

SEQ ID NO: 100329 - protein, 224 aa, Homo sapiens
  Payload ID: 19996
  Gene Name: zinc finger protein 521
  ENSP ID: ENSP00000462724
MSRRKQAKPRSLKDPNCKLEDKTEDGEALDCKKRPEDGEELEDEAVHSCDSCLQVFESLSDITEHKINQCQLTDGVDVEDDPTCSWPASSPSSKDQTSPSHGEGCDFGEEEGGPGLPYPCQFCDKSFSRLSYLKHHEQSHSDKLPFKCTYCSRLFKHKRSRDRHIKLHTGDKKYHCSECDAAFSRSDHLKIHLKTHTSNKPYKCAICRRGFLSSSSLHGHMQVH

SEQ ID NO: 100330 - protein, 30 aa, Homo sapiens
  Payload ID: 19996
  Gene Name: zinc finger protein 521
  ENSP ID: ENSP00000462746
MSRRKQAKPRSLKDPNCKLEDKTEDGEALD

SEQ ID NO: 100331 - protein, 1091 aa, Homo sapiens
  Payload ID: 19996
  Gene Name: zinc finger protein 521
  ENSP ID: ENSP00000463000
MQVHERNKDGSQSGSRMEDWKMKDTQKCSQCEEGFDFPEDLQKHIAECHPECSPNEDRAALQCVYCHELFVEETSLMNHMEQVHSGEKKNSCSICSESFHTVEELYSHMDSHQQPESCNHSNSPSLVTVGYTSVSSTTPDSNLSVDSSTMVEAAPPIPKSRGRKRAAQQTPDMTGPSSKQAKVTYSCIYCNKQLFSSLAVLQIHLKTMHLDKPEQAHICQYCLEVLPSLYNLNEHLKQVHEAQDPGLIVSAMPAIVYQCNFCSEVVNDLNTLQEHIRCSHGFANPAAKDSNAFFCPHCYMGFLTDSSLEEHIRQVHCDLSGSRFGSPVLGTPKEPVVEVYSCSYCTNSPIFNSVLKLNKHIKENHKNIPLALNYIHNGKKSRALSPLSPVAIEQTSLKMMQAVGGAPARPTGEYICNQCGAKYTSLDSFQTHLKTHLDTVLPKLTCPQCNKEFPNQESLLKHVTIHFMITSTYYICESCDKQFTSVDDLQKHLLDMHTFVFFRCTLCQEVFDSKVSIQLHLAVKHSNEKKVYRCTSCNWDFRNETDLQLHVKHNHLENQGKVHKCIFCGESFGTEVELQCHITTHSKKYNCKFCSKAFHAIILLEKHLREKHCVFETKTPNCGTNGASEQVQKEEVELQTLLTNSQESHNSHDGSEEDVDTSEPMYGCDICGAAYTMETLLQNHQLRDHNIRPGESAIVKKKAELIKGNYKCNVCSRTFFSENGLREHMQTHLGPVKHYMCPICGERFPSLLTLTEHKVTHSKSLDTGNCRICKMPLQSEEEFLEHCQMHPDLRNSLTGFRCVVCMQTVTSTLELKIHGTFHMQKTGNGSAVQTTGRGQHVQKLYKCASCLKEFRSKQDLVKLDINGLPYGLCAGCVNLSKSASPGINVPPGTNRPGLGQNENLSAIEGKGKVGGLKTRCSSCNVKFESESELQNHIQTIHRELVPDSNSTQLKTPQVSPMPRISPSQSDEKKTYQCIKCQMVFYNEWDIQVHVANHMIDEGLNHECKLCSQTFDSPAKLQCHLIEHSFEGMGGTFKCPVCFTVFVQANKLQQHIFSAHGQEDKIYDCTQCPQKFFFQTELQNHTMTQHSS

SEQ ID NO: 100332 - protein, 184 aa, Homo sapiens
  Payload ID: 19996
  Gene Name: zinc finger protein 521
  ENSP ID: ENSP00000463748
  MOD_RES (1)..(1): Any amino acid
XQKTGNGSAVQTTGRGQHVQKLYKCASCLKEFRSKQDLVKLDINGLPYGLCAGCVNLSKSASPGINVPPGTNRPGLGQNENLSAIEGKGKVGGLKTRCSSCNVKFESESELQNHIQTIHRELVPDSNSTQLKTPQVSPMPRISPSQSDEKKTYQCIKCQMVFYNEWDIQVHVANHMIDSKTKDL

SEQ ID NO: 100333 - protein, 144 aa, Homo sapiens
  Payload ID: 19996
  Gene Name: zinc finger protein 521
  ENSP ID: ENSP00000464415
MSRRKQAKPRSLKDPNCKLEDKTEDGEALDCKKRPEDGEELEDEAVHSCDSCLQVFESLSDITEHKINQCQLTDGVDVEDDPTCSWPASSPSSKDQTSPSHGEGCDFGEEEGGPGLPYPCQFCDKSFSRLSYLKHHEQSHSDKL

SEQ ID NO: 100334 - protein, 264 aa, Homo sapiens
  Payload ID: 19997
  Gene Name: zinc finger protein 524
  Uniprot ID: Q96C55
  ENSP ID: ENSP00000301073
MDTPSPDPLPSPLPGEEEKPLALSPPVPRGRRGRRPGGATSSNRTLKASLPRKRGRPPKSGQEPPLVQVQGVTAPVGSSGGSDLLLIDDQGVPYTVSEGSAAGPEGSGPRKAPHFCPVCLRAFPYLSDLERHSISHSELKPHQCKVCGKTFKRSSHLRRHCNIHAGLRPFRCPLCPRRFREAGELAHHHRVHSGERPYQCPICRLRFTEANTLRRHAKRKHPEAMGVPLCAPDPGSEPPWDEEGIPATAGAEEEEETEGKGEPA

SEQ ID NO: 100335 - protein, 264 aa, Homo sapiens; identical to SEQ ID NO: 100334
  Payload ID: 19997
  Gene Name: zinc finger protein 524
  Uniprot ID: Q96C55
  ENSP ID: ENSP00000466907

SEQ ID NO: 100336 - protein, 130 aa, Homo sapiens
  Payload ID: 19997
  Gene Name: zinc finger protein 524
  ENSP ID: ENSP00000467175
MDTPSPDPLPSPLPGEEEKPLALSPPVPRGRRGRRPGGATSSNRTLKASLPRKRGRPPKSGQEPPLVQVQGVTAPVGSSGGSDLLLIDDQGVPYTVSEGSAAGPEGSGPRKAPHFCPVCLRAFPYLSDLE

SEQ ID NO: 100337 - protein, 479 aa, Homo sapiens
  Payload ID: 19998
  Gene Name: zinc finger protein 525
  ENSP ID: ENSP00000417696
MALPQGLLTFRDVAIEFSQEEWKCLDPAQRTLYRDVMLENYRNLVSLGISSKCTMKEFSSTAQGNTEVIHTGTLQRHERHHIGDFSFQEIEKDIHNFEFQWQEDERNGHEAPMTKIKKLMGSTEQYDHRHAGNKPIKYQLGSSFHSHLSELHIFQPKGKINNQVEKSINDASSVSTAQRISCRPKTHISNNYGDNFLNYSLLTQRQEVRMREKSFQCIESGKAFNYSSLLRKHQIIHLGEKQYKCDVCDKVFIRKRYLARHRRCHTGEKPYKCNECGKSFSQMSSLTYHHRLHTGEKPYKCEECDKAFRHNSALQRHRRIHTGEKPHKCNECGKTFSQKSYLACHRSIHTGKKPYECEECDKAFSFKSNLESHRITHTGEKPYKCNDCGKTFSHMSTLTCHRRLHTGEKPYKCEECDEAFRFKSSLERHRRIHNGEKLYKCNECGKTFSQELSLTCHCRLHSGEKPCKCGECDKAYSFK

SEQ ID NO: 100338 - protein, 50 aa, Homo sapiens
  Payload ID: 19998
  Gene Name: zinc finger protein 525
  ENSP ID: ENSP00000418468
MALPQGLLTFRDVAIEFSQEEWKCLDPAQRTLYRDVMLENYRNLVSLGFL

SEQ ID NO: 100339 - protein, 443 aa, Homo sapiens
  Payload ID: 19998
  Gene Name: zinc finger protein 525
  ENSP ID: ENSP00000419136
MLENYRNLVSLGISSKCTMKEFSSTAQGNTEVIHTGTLQRHERHHIGDFSFQEIEKDIHNFEFQWQEDERNGHEAPMTKIKKLMGSTEQYDHRHAGNKPIKYQLGSSFHSHLSELHIFQPKGKINNQVEKSINDASSVSTAQRISCRPKTHISNNYGDNFLNYSLLTQRQEVRMREKSFQCIESGKAFNYSSLLRKHQIIHLGEKQYKCDVCDKVFIRKRYLARHRRCHTGEKPYKCNECGKSFSQMSSLTYHHRLHTGEKPYKCEECDKAFRHNSALQRHRRIHTGEKPHKCNECGKTFSQKSYLACHRSIHTGKKPYECEECDKAFSFKSNLESHRITHTGEKPYKCNDCGKTFSHMSTLTCHRRLHTGEKPYKCEECDEAFRFKSSLERHRRIHNGEKLYKCNECGKTFSQELSLTCHCRLHSGEKPCKCGECDKAYSFK

SEQ ID NO: 100340 - protein, 119 aa, Homo sapiens
  Payload ID: 19998
  Gene Name: zinc finger protein 525
  ENSP ID: ENSP00000420476
MALPQGLLTFRDVAIEFSQEEWKCLDPAQRTLYRDVMLENYRNLVSLGSCCAVEVGLDLLGSRHPPRPPKKLGLQAPTPVPNYWLLFLNFLHMCVLRANMSLLWTTSSWFLLIESVFAF

SEQ ID NO: 100341 - protein, 52 aa, Homo sapiens
  Payload ID: 19998
  Gene Name: zinc finger protein 525
  ENSP ID: ENSP00000470407
MALPQGLLTFRDVAIEFSQEEWKCLDPAQRTLYRDVMLENYRNLVSLDGVFL

SEQ ID NO: 100342 - protein, 51 aa, Homo sapiens
  Payload ID: 19998
  Gene Name: zinc finger protein 525
  ENSP ID: ENSP00000489237
MSSHKTFRIKRFLAKKQKQNHPTPLWIQIKTGNKIRYDSKRRHWRRTKLGL

SEQ ID NO: 100343 - protein, 670 aa, Homo sapiens
  Payload ID: 19999
  Gene Name: zinc finger protein 526
  Uniprot ID: Q8TF50
  ENSP ID: ENSP00000301215
MAEVVAEVAEMPTQMSPGAVEMSTPMSAEMMEMSTEVTEMTPGEALASSLFFQHHQFMCSECGSLYNTLEEVLSHQEQHMLAVSEEEALTTQNVGLEPELVPGAEGPFQCGECSQLILSPGELLAHQDAHLRESANQIQYQCWDCQELFPSPELWVAHRKAQHLSATVAEPPVPPPLPPPTPLPPPSPPSEVKMEPYECPECSTLCATPEEFLEHQGTHFDSLEKEERNGLEEEEEDDEEDEEDDEEMEDEEAMAEVGDDAVGGDESTAGWAQGCGDCPQHQPSAGARRQHRRTAHSPASATHPFHCSQCQRSFSSANRLQAHGRAHVGGTHECTTCSKVFKKAASLEQHLRLHRGEARYLCVDCGRGFGTELTLVAHRRAHTANPLHRCRCGKTFSNMTKFLYHRRTHAGKSGAPPTGATAPPAPAEPTPPPPPPAPPAQLPCPQCSKSFASASRLSRHRRAVHGPPERRHRCGVCGKGFKKLIHVRNHLRTHTGERPFQCHSCGKTFASLANLSRHQLTHTGARPYQCLDCGKRFTQSSNLQQHRRLHLRPVAFARAPRLPITGLYNKSPYYCGTCGRWFRAMAGLRLHQRVHARARTLTLQPPRSPSPAPPPPPEPQQTIMCTELGETIAIIETSQPLALEDTLQLCQAALGASEAGGLLQLDTAFV

SEQ ID NO: 100344 - protein, 68 aa, Homo sapiens
  Payload ID: 19999
  Gene Name: zinc finger protein 526
  ENSP ID: ENSP00000473075
MAEVVAEVAEMPTQMSPGAVEMSTPMSAEMMEMSTEVTEMTPGEALASSLFFQHHQFMCSECGSLYNT

SEQ ID NO: 100345 - protein, 94 aa, Homo sapiens
  Payload ID: 20000
  Gene Name: zinc finger protein 527
  ENSP ID: ENSP00000348501
MAVGLCKAMSQGLVTFRDVALDFSQEEWEWLKPSQKDLYRDVMLENYRNLVWLGDGCSCCSTLRTTVTAEASSSSSSIQASFHSLALPLMSILA

SEQ ID NO: 100346 - protein, 609 aa, Homo sapiens
  Payload ID: 20000
  Gene Name: zinc finger protein 527
  Uniprot ID: Q8NB42
  ENSP ID: ENSP00000390179
MAVGLCKAMSQGLVTFRDVALDFSQEEWEWLKPSQKDLYRDVMLENYRNLVWLGLSISKPNMISLLEQGKEPWMVERKMSQGHCADWESWCEIEELSPKWFIDEDEISQEMVMERLASHGLECSSFREAWKYKGEFELHQGNAERHFMQVTAVKEISTGKRDNEFSNSGRSIPLKSVFLTQQKVPTIQQVHKFDIYDKLFPQNSVIIEYKRLHAEKESLIGNECEEFNQSTYLSKDIGIPPGEKPYESHDFSKLLSFHSLFTQHQTTHFGKLPHGYDECGDAFSCYSFFTQPQRIHSGEKPYACNDCGKAFSHDFFLSEHQRTHIGEKPYECKECNKAFRQSAHLAQHQRIHTGEKPFACNECGKAFSRYAFLVEHQRIHTGEKPYECKECNKAFRQSAHLNQHQRIHTGEKPYECNQCGKAFSRRIALTLHQRIHTGEKPFKCSECGKTFGYRSHLNQHQRIHTGEKPYECIKCGKFFRTDSQLNRHHRIHTGERPFECSKCGKAFSDALVLIHHKRSHAGEKPYECNKCGKAFSCGSYLNQHQRIHTGEKPYECSECGKAFHQILSLRLHQRIHAGEKPYKCNECGNNFSCVSALRRHQRIHNRETL

SEQ ID NO: 100347 - protein, 146 aa, Homo sapiens
  Payload ID: 20000
  Gene Name: zinc finger protein 527
  ENSP ID: ENSP00000466096
MAVGLCKAMSQGLVTFRDVALDFSQEEWEWLKPSQKDLYRDVMLENYRNLVWLGLSISKPNMISLLEQGKEPWMVERKMSQGHCAGSHSVAQAGVQWHDLGSLQPIPTELKQSSHLSMHTTAPDVVRMVVRRSCSPSLCSLCLAGF

SEQ ID NO: 100348 - protein, 58 aa, Homo sapiens
  Payload ID: 20000
  Gene Name: zinc finger protein 527
  ENSP ID: ENSP00000467136
MAVGLCKAMSQGLVTFRDVALDFSQEEWEWLKPSQKDLYRDVMLENYRNLDSPFLSPT

SEQ ID NO: 100349 - protein, 124 aa, Homo sapiens
  Payload ID: 20000
  Gene Name: zinc finger protein 527
  ENSP ID: ENSP00000468344
MAVGLCKAMSQGLVTFRDVALDFSQEEWEWLKPSQKDLYRDVMLENYRNLVWLGLSISKPNMISLLEQGKEPWMVERKMSQGHCAGSHSVAQAGVQWHDLGSLQPIPTELKQSSHLSMHTTAPG

SEQ ID NO: 100350 - protein, 157 aa, Homo sapiens
  Payload ID: 20000
  Gene Name: zinc finger protein 527
  ENSP ID: ENSP00000468517
MAVGLCKAMSQGLVTFRDVALDFSQEEWEWLKPSQKDLYRDVMLENYRNLVWLDWESWCEIEELSPKWFIDEDEISQEMVMERLASHGLECSSFREAWKYKGEFELHQGNAERHFMQVTAVKEISTGKRDNEFSNSGRSIPLKSVFLTQQKVPTIQQ

SEQ ID NO: 100351 - protein, 628 aa, Homo sapiens
  Payload ID: 20001
  Gene Name: zinc finger protein 528
  Uniprot ID: Q3MIS6
  ENSP ID: ENSP00000353652
MALTQGPLKFMDVAIEFSQEEWKCLDPAQRTLYRDVMLENYRNLVSLGICLPDLSVTSMLEQKRDPWTLQSEEKIANDPDGRECIKGVNTERSSKLGSNAGNKPCKNQLGFTFQLHLSDLQLFQAERKISGCKHFEKPVSDNSSVSPLEKISSSVKSHLLNKYRNNFDHAPLLPQEQKAHIREKAYKCNEHGQVFRASASLTNQVIHNADNPYKCSECGKVFSCSSKLVIHRRMHTGEKPYKCHECGKLFSSNSNLSQHQRIHTGEKPYKCHECDKVFRSSSKLAQHQRIHTGEKPYKCHECDKVFNQIAHLVRHQKIHTGEKPYSCNKCGKVFSRHSYLAEHQTVHTGEKPYKCEECGKAFSVRSSLITHQLIHTGRKPYKCKECDKVFGRKCFLTSHQRIHTRERPYGCSQCGKIFSQKSDLIRHRKTHTDEKPYKCNKCGTAFREFSDLTAHFLIHSGEKPYECKECGKVFRYKSSLTSHHRIHTGEKPYKCNRCGKVFSRSSNLVCHQKIHTGEKPYKCNQCGKVFNQASYLTRHQIIHTGERPYRCSKCGKAFRGCSGLTAHLAIHTEKKSHECKECGKIFTQKSSLTNHHRIHIGEKPYKCTLCSKVFSHNSDLAQHQRVHS

SEQ ID NO: 100352 - protein, 81 aa, Homo sapiens
  Payload ID: 20001
  Gene Name: zinc finger protein 528
  ENSP ID: ENSP00000375664
MALTQGPLKFMDVAIEFSQEEWKCLDPAQRTLYRDVMLENYRNLVSLGICLPDLSVTSMLEQKRDPWTLQSEEKIANDPDG

SEQ ID NO: 100353 - protein, 123 aa, Homo sapiens
  Payload ID: 20001
  Gene Name: zinc finger protein 528
  ENSP ID: ENSP00000375665
MDVAIEFSQEEWKCLDPAQRTLYRDVMLENYRNLVSLGICLPDLSVTSMLEQKRDPWTLQSEEKIANDPDGRECIKGVNTVPLLQQNLLCSRPQSPMFGGHLSDILGVPLLGHQLPPAQTLGD

SEQ ID NO: 100354 - protein, 85 aa, Homo sapiens
  Payload ID: 20001
  Gene Name: zinc finger protein 528
  ENSP ID: ENSP00000404087
  MOD_RES (1)..(1): Any amino acid
XLYRDVMLENYRNLVSLGICLPDLSVTSMLEQKRDPWTLQSEEKIANDPDGRECIKGVNTDSPLLQCITSVPCVFCTASMIHTIP

SEQ ID NO: 100355 - protein, 14 aa, Homo sapiens
  Payload ID: 20001
  Gene Name: zinc finger protein 528
  ENSP ID: ENSP00000413711
MALTQGPLKFMDVA

SEQ ID NO: 100356 - protein, 8 aa, Homo sapiens
  Payload ID: 20001
  Gene Name: zinc finger protein 528
  ENSP ID: ENSP00000432992
MDVAIEFS

SEQ ID NO: 100357 - protein, 3 aa, Homo sapiens
  Payload ID: 20001
  Gene Name: zinc finger protein 528
  ENSP ID: ENSP00000434962
MDV

SEQ ID NO: 100358 - protein, 106 aa, Homo sapiens
  Payload ID: 20001
  Gene Name: zinc finger protein 528
  ENSP ID: ENSP00000469481
MALTQGPLKFMDVAIEFSQEEWKCLDPAQRTLYRDVMLENYRNLVSLGICLPDLSVTSMLEQKRDPWTLQSEEKIANDPDGRECIKGVNTGESSGGQSGGPIIFVF

SEQ ID NO: 100359 - protein, 91 aa, Homo sapiens
  Payload ID: 20001
  Gene Name: zinc finger protein 528
  ENSP ID: ENSP00000470536
MALTQGPLKFMDVAIEFSQEEWKCLDPAQRTLYRDVMLENYRNLVSLGICLPDLSVTSMLEQKRDPWTLQSEEKIANDPDGRECIKGVNTG

SEQ ID NO: 100360 - protein, 458 aa, Homo sapiens
  Payload ID: 20002
  Gene Name: zinc finger protein 529
  ENSP ID: ENSP00000334695
MESSKLCGLEGSIFRNDWQSKSKIDLQGPEVGYFSQMKIISENVPSYKTHESLTLPRRTHDSEKPYEYKEYEKVFSCDLEFDEYQKIHTGGKNYECNQCWKTFGIDNSSMLQLNIHTGVKPCKYMEYGNTCSFYKDFNVYQKIHNEKFYKCKEYRRTFERVGKVTPLQRVHDGEKHFECSFCGKSFRVHAQLTRHQKIHTDEKTYKCMECGKDFRFHSQLTEHQRIHTGEKPYKCMHCEKVFRISSQLIEHQRIHTGEKPYACKECGKAFGVCRELARHQRIHTGKKPYECKACGKVFRNSSSLTRHQRIHTGEKPYKCKECEKAFGVGSELTRHERIHSGQKPYECKECGKFFRLTSALIQHQRIHSGEKPYECKVCGKAFRHSSALTEHQRIHTGEKPYECKACGKAFRHSSSFTKHQRIHTDDKPYECKECGNSFSVVGHLTCQPKIYTGEKSFD

SEQ ID NO: 100361 - protein, 563 aa, Homo sapiens
  Payload ID: 20002
  Gene Name: zinc finger protein 529
  Uniprot ID: Q6P280
  ENSP ID: ENSP00000465578
MANSSFIGDHVHGAPHAVMPEVEFPDQFFTVLTMDHELVTLRDVVINFSQEEWEYLDSAQRNLYWDVMMENYSNLLSLDLESRNETKHLSVGKDIIQNTGSQWEVMESSKLCGLEGSIFRNDWQSKSKIDLQGPEVGYFSQMKIISENVPSYKTHESLTLPRRTHDSEKPYEYKEYEKVFSCDLEFDEYQKIHTGGKNYECNQCWKTFGIDNSSMLQLNIHTGVKPCKYMEYGNTCSFYKDFNVYQKIHNEKFYKCKEYRRTFERVGKVTPLQRVHDGEKHFECSFCGKSFRVHAQLTRHQKIHTDEKTYKCMECGKDFRFHSQLTEHQRIHTGEKPYKCMHCEKVFRISSQLIEHQRIHTGEKPYACKECGKAFGVCRELARHQRIHTGKKPYECKACGKVFRNSSSLTRHQRIHTGEKPYKCKECEKAFGVGSELTRHERIHSGQKPYECKECGKFFRLTSALIQHQRIHSGEKPYECKVCGKAFRHSSALTEHQRIHTGEKPYECKACGKAFRHSSSFTKHQRIHTDDKPYECKECGNSFSVVGHLTCQPKIYTGEKSFD

SEQ ID NO: 100362 - protein, 85 aa, Homo sapiens
  Payload ID: 20002
  Gene Name: zinc finger protein 529
  ENSP ID: ENSP00000465682
MMENYSNLLSLDLESRNETKHLSVGKDIIQNTGSQWEVMESSKLCGLEGSIFRNDWQSKSKIDLQGPEVGYFSQMKIISENVPSY

SEQ ID NO: 100363 - protein, 112 aa, Homo sapiens
  Payload ID: 20002
  Gene Name: zinc finger protein 529
  ENSP ID: ENSP00000465917
  MOD_RES (1)..(1): Any amino acid
XVGKVTPLQRVHDGEKHFECSFCGKSFRVHAQLTRHQKIHTDEKTYKCMECGKDFRFHSQLTEHQRIHTGRLNNLLLEEAEKTMEGKWKLLTYSFPHAGVHLYLRFSCRKKS

SEQ ID NO: 100364 - protein, 92 aa, Homo sapiens
  Payload ID: 20002
  Gene Name: zinc finger protein 529
  ENSP ID: ENSP00000466182
MPEVEFPDQFFTVLTMDHELVTLRDVVINFSQEEWEYLDSAQRNLYWDVMMENYSNLLSLDLESRNETKHLSVGKDIIQNTGSQWEVMESSK

SEQ ID NO: 100365 - protein, 72 aa, Homo sapiens
  Payload ID: 20002
  Gene Name: zinc finger protein 529
  ENSP ID: ENSP00000468594
EKVFRISSQLIEHQRIHTGEKPYACKECGKAFGVCRELARHQRIHTGYTNQDPNEENSFKYLIKLLTQAMRT

SEQ ID NO: 100366 - protein, 110 aa, Homo sapiens
  Payload ID: 20002
  Gene Name: zinc finger protein 529
  ENSP ID: ENSP00000468619
MANSSFIGDHVHGAPHAVMPEVEFPDQFFTVLTMDHELVTLRDVVINFSQEEWEYLDSAQRNLYWDVMMENYSNLLSLDLESRNETKHLSVGKDIIQNTGSQWEVMESSK

SEQ ID NO: 100367 - protein, 599 aa, Homo sapiens
  Payload ID: 20003
  Gene Name: zinc finger protein 530
  Uniprot ID: Q6P9A1
  ENSP ID: ENSP00000332861
MAAALRAPTQQVFVAFEDVAIYFSQEEWELLDEMQRLLYRDVMLENFAVMASLGCWCGAVDEGTPSAESVSVEELSQGRTPKADTSTDKSHPCEICTPVLRDILQMIELHASPCGQKLYLGGASRDFWMSSNLHQLQKLDNGEKLFKVDGDQASFMMNCRFHVSGKPFTFGEVGRDFSATSGLLQHQVTPTIERPHSRIRHLRVPTGRKPLKYTESRKSFREKSVFIQHQRADSGERPYKCSECGKSFSQSSGFLRHRKAHGRTRTHECSECGKSFSRKTHLTQHQRVHTGERPYDCSECGKSFRQVSVLIQHQRVHTGERPYECSECGKSFSHSTNLYRHRSAHTSTRPYECSECGKSFSHSTNLFRHWRVHTGVRPYECSECGKAFSCNIYLIHHQRFHTGERPYVCSECGKSFGQKSVLIQHQRVHTGERPYECSECGKVFSQSSGLFRHRRAHTKTKPYECSECEKSFSCKTDLIRHQTVHTGERPYECSVCGKSFIRKTHLIRHQTVHTNERPYECDECGKSYSQSSALLQHRRVHTGERPYECRECGKSFTRKNHLIQHKTVHTGERPYECSECGKSFSQSSGLLRHRRVHVQ

SEQ ID NO: 100368 - protein, 28 aa, Homo sapiens
  Payload ID: 20003
  Gene Name: zinc finger protein 530
  ENSP ID: ENSP00000471527
MQRLLYRDVMLENFAVMASLGIIECFQE

SEQ ID NO: 100369 - protein, 32 aa, Homo sapiens
  Payload ID: 20003
  Gene Name: zinc finger protein 530
  ENSP ID: ENSP00000472024
MQRLLYRDVMLENFAVMASLGCWCGAVDEGTP

SEQ ID NO: 100370 - protein, 599 aa, Homo sapiens; identical to SEQ ID NO: 100367
  Payload ID: 20003
  Gene Name: zinc finger protein 530
  Uniprot ID: Q6P9A1
  ENSP ID: ENSP00000472564

SEQ ID NO: 100371 - protein, 1301 aa, Homo sapiens
  Payload ID: 20004
  Gene Name: zinc finger protein 532
  Uniprot ID: Q9HCE3
  ENSP ID: ENSP00000338217
MTMGDMKTPDFDDLLAAFDIPDMVDPKAAIESGHDDHESHMKQNAHGEDDSHAPSSSDVGVSVIVKNVRNIDSSEGGEKDGHNPTGNGLHNGFLTASSLDSYSKDGAKSLKGDVPASEVTLKDSTFSQFSPISSAEEFDDDEKIEVDDPPDKEDMRSSFRSNVLTGSAPQQDYDKLKALGGENSSKTGLSTSGNVEKNKAVKRETEASSINLSVYEPFKVRKAEDKLKESSDKVLENRVLDGKLSSEKNDTSLPSVAPSKTKSSSKLSSCIAAIAALSAKKAASDSCKEPVANSRESSPLPKEVNDSPRAADKSPESQNLIDGTKKPSLKQPDSPRSISSENSSKGSPSSPAGSTPAIPKVRIKTIKTSSGEIKRTVTRVLPEVDLDSGKKPSEQTASVMASVTSLLSSPASAAVLSSPPRAPLQSAVVTNAVSPAELTPKQVTIKPVATAFLPVSAVKTAGSQVINLKLANNTTVKATVISAASVQSASSAIIKAANAIQQQTVVVPASSLANAKLVPKTVHLANLNLLPQGAQATSELRQVLTKPQQQIKQAIINAAASQPPKKVSRVQVVSSLQSSVVEAFNKVLSSVNPVPVYIPNLSPPANAGITLPTRGYKCLECGDSFALEKSLTQHYDRRSVRIEVTCNHCTKNLVFYNKCSLLSHARGHKEKGVVMQCSHLILKPVPADQMIVSPSSNTSTSTSTLQSPVGAGTHTVTKIQSGITGTVISAPSSTPITPAMPLDEDPSKLCRHSLKCLECNEVFQDETSLATHFQQAADTSGQKTCTICQMLLPNQCSYASHQRIHQHKSPYTCPECGAICRSVHFQTHVTKNCLHYTRRVGFRCVHCNVVYSDVAALKSHIQGSHCEVFYKCPICPMAFKSAPSTHSHAYTQHPGIKIGEPKIIYKCSMCDTVFTLQTLLYRHFDQHIENQKVSVFKCPDCSLLYAQKQLMMDHIKSMHGTLKSIEGPPNLGINLPLSIKPATQNSANQNKEDTKSMNGKEKLEKKSPSPVKKSMETKKVASPGWTCWECDCLFMQRDVYISHVRKEHGKQMKKHPCRQCDKSFSSSHSLCRHNRIKHKGIRKVYACSHCPDSRRTFTKRLMLEKHVQLMHGIKDPDLKEMTDATNEEETEIKEDTKVPSPKRKLEEPVLEFRPPRGAITQPLKKLKINVFKVHKCAVCGFTTENLLQFHEHIPQHKSDGSSYQCRECGLCYTSHVSLSRHLFIVHKLKEPQPVSKQNGAGEDNQQENKPSHEDESPDGAVSDRKCKVCAKTFETEAALNTHMRTHGMAFIKSKRMSSAEK

SEQ ID NO: 100372 - protein, 124 aa, Homo sapiens
  Payload ID: 20004
  Gene Name: zinc finger protein 532
  ENSP ID: ENSP00000464894
PSKLCRHSLKCLECNEVFQDETSLATHFQQAADTSGQQMKKHPCRQCDKSFSSSHSLCRHNRIKHKGIRKVYACSHCPDSRRTFTKRLMLEKHVQLMHGIKDPDLKEMTDATNEEETEIKEDTK

SEQ ID NO: 100373 - protein, 93 aa, Homo sapiens
  Payload ID: 20004
  Gene Name: zinc finger protein 532
  ENSP ID: ENSP00000465236
MTMGDMKTPDFDDLLAAFDIPDMVDPKAAIESGHDDHESHMKQNAHGEDDSHAPSSSDVGVSVIVKNVRNIDSSEGGEKDGHNPTGNGLHNGF

SEQ ID NO: 100374 - protein, 1301 aa, Homo sapiens; identical to SEQ ID NO: 100371
  Payload ID: 20004
  Gene Name: zinc finger protein 532
  Uniprot ID: Q9HCE3
  ENSP ID: ENSP00000465709

SEQ ID NO: 100375 - protein, 81 aa, Homo sapiens
  Payload ID: 20004
  Gene Name: zinc finger protein 532
  ENSP ID: ENSP00000465802
MTMGDMKTPDFDDLLAAFDIPDMVDPKAAIESGHDDHESHMKQNAHGEDDSHAPSSSDVGVSVIVKNVRNIDSSEGGEKDG

SEQ ID NO: 100376 - protein, 118 aa, Homo sapiens
  Payload ID: 20004
  Gene Name: zinc finger protein 532
  ENSP ID: ENSP00000465873
MTMGDMKTPDFDDLLAAFDIPDMVDPKAAIESGHDDHESHMKQNAHGEDDSHAPSSSDVGVSVIVKNVRNIDSSEGGEKDGHNPTGNGLHNGFLTASSLDSYSKDGAKSLKGDVPASE

SEQ ID NO: 100377 - protein, 160 aa, Homo sapiens
  Payload ID: 20004
  Gene Name: zinc finger protein 532
  ENSP ID: ENSP00000466002
MTMGDMKTPDFDDLLAAFDIPDMVDPKAAIESGHDDHESHMKQNAHGEDDSHAPSSSDVGVSVIVKNVRNIDSSEGGEKDGHNPTGNGLHNGFLTASSLDSYSKDGAKSLKGDVPASEVTLKDSTFSQFSPISSAEEFDDDEKIEVDDPPDKEDMRSSFR

SEQ ID NO: 100378 - protein, 1301 aa, Homo sapiens; identical to SEQ ID NO: 100371
  Payload ID: 20004
  Gene Name: zinc finger protein 532
  Uniprot ID: Q9HCE3
  ENSP ID: ENSP00000466007

SEQ ID NO: 100379 - protein, 118 aa, Homo sapiens
  Payload ID: 20004
  Gene Name: zinc finger protein 532
  ENSP ID: ENSP00000466172
  MOD_RES (1)..(1): Any amino acid
XLKPVPADQMIVSPSSNTSTSTSTLQSPVGAGTHTVTKIQSGITGTVISAPSSTPITPAMPLDEDPSKLCRHSLKCLECNEVFQDETSLATHFQQAADTSGQNGMEPARWLTPVVPAL

SEQ ID NO: 100380 - protein, 68 aa, Homo sapiens
  Payload ID: 20004
  Gene Name: zinc finger protein 532
  ENSP ID: ENSP00000466488
MTMGDMKTPDFDDLLAAFDIPDMVDPKAAIESGHDDHESHMKQNAHGEDDSHAPSSSDVGVSVIVKNV

SEQ ID NO: 100381 - protein, 116 aa, Homo sapiens
  Payload ID: 20004
  Gene Name: zinc finger protein 532
  ENSP ID: ENSP00000466808
KPVPADQMIVSPSSNTSTSTSTLQSPVGAGTHTVTKIQSGITGTVISAPSSTPITPAMPLDEDPSKLCRHSLKCLECNEVFQDETSLATHFQQAADTSGQNGMEPARWLTPVVPAL

SEQ ID NO: 100382 - protein, 107 aa, Homo sapiens
  Payload ID: 20004
  Gene Name: zinc finger protein 532
  ENSP ID: ENSP00000467229
MTMGDMKTPDFDDLLAAFDIPDMVDPKAAIESGHDDHESHMKQNAHGEDDSHAPSSSDVGVSVIVKNVRNIDSSEGGEKDGHNPTGNGLHNGFLTASSLDSYSKDGA

SEQ ID NO: 100383 - protein, 121 aa, Homo sapiens
  Payload ID: 20004
  Gene Name: zinc finger protein 532
  ENSP ID: ENSP00000467402
MTMGDMKTPDFDDLLAAFDIPDMVDPKAAIESGHDDHESHMKQNAHGEDDSHAPSSSDVGVSVIVKNVRNIDSSEGGEKDGHNPTGNGLHNGFLTASSLDSYSKDGAKSLKGDVPASEVTL

SEQ ID NO: 100384 - protein, 129 aa, Homo sapiens
  Payload ID: 20004
  Gene Name: zinc finger protein 532
  ENSP ID: ENSP00000467903
  MOD_RES (1)..(1): Any amino acid
XSLLYAQKQLMMDHIKSMHGTLKSIEGPPNLGINLPLSIKPATQNSANQNKEDTKSMNGKEKLEKKSPSPVKKSMETKKVASPGWTCWECDCLFMQRDVYISHVRKEHGKWEEEPHPLTSSRSSVTPSH

SEQ ID NO: 100385 - protein, 124 aa, Homo sapiens
  Payload ID: 20004
  Gene Name: zinc finger protein 532
  ENSP ID: ENSP00000468009
MTMGDMKTPDFDDLLAAFDIPDMVDPKAAIESGHDDHESHMKQNAHGEDDSHAPSSSDVGVSVIVKNVRNIDSSEGGEKDGHNPTGNGLHNGFLTASSLDSYSKDGAKSLKGDVPASEVTLKDS

SEQ ID NO: 100386 - protein, 73 aa, Homo sapiens
  Payload ID: 20004
  Gene Name: zinc finger protein 532
  ENSP ID: ENSP00000468073
MTMGDMKTPDFDDLLAAFDIPDMVDPKAAIESGHDDHESHMKQNAHGEDDSHAPSSSDVGVSVIVKNVRNIDS

SEQ ID NO: 100387 - protein, 1301 aa, Homo sapiens; identical to SEQ ID NO: 100371
  Payload ID: 20004
  Gene Name: zinc finger protein 532
  Uniprot ID: Q9HCE3
  ENSP ID: ENSP00000468238

SEQ ID NO: 100388 - protein, 1301 aa, Homo sapiens; identical to SEQ ID NO: 100371
  Payload ID: 20004
  Gene Name: zinc finger protein 532
  Uniprot ID: Q9HCE3
  ENSP ID: ENSP00000468532

SEQ ID NO: 100389 - protein, 136 aa, Homo sapiens
  Payload ID: 20004
  Gene Name: zinc finger protein 532
  ENSP ID: ENSP00000468551
MHLSICSSTHPSVHPPTQLSVYQEHLLKLMTMGDMKTPDFDDLLAAFDIPDMVDPKAAIESGHDDHESHMKQNAHGEDDSHAPSSSDVGVSVIVKNVRNIDSSEGGEKDGHNPTGNGLHNGFLTASSLDSYSKDGA

SEQ ID NO: 100390 - protein, 193 aa, Homo sapiens
  Payload ID: 20005
  Gene Name: zinc finger protein 534
  ENSP ID: ENSP00000301085
MALTQGQLSFSDVAIEFSQEEWKCLDPGQKALYRDVMLENYRNLVSLGICLPDLSVTSMLEQKRDPWTLQSEVKIINNPDGRECIKGVNTDFSLLAWDARVFRVEAWRASGGAEEPTGPNFVGNDSPLPSPLALLPFPSVSASLGDAKRARLTAEGRGHGTLRAGPAPRPRSAAPHAPDAVQRWPPEQRLPRS

SEQ ID NO: 100391 - protein, 674 aa, Homo sapiens
  Payload ID: 20005
  Gene Name: zinc finger protein 534
  Uniprot ID: Q76KX8
  ENSP ID: ENSP00000327538
MALTQGQLSFSDVAIEFSQEEWKCLDPGQKALYRDVMLENYRNLVSLGEDNVRPEACICSGICLPDLSVTSMLEQKRDPWTLQSEVKIINNPDGRECIKGVNTEKSSKLGSSAGNKSLKNQHGLTLQLHLTEWQPFQAVRNIYGCKHVEKSISDNSSVSPVQISFFSVKTHIFNNYRNDFLFSTLLPQEQKVHIREKPYGCNEHGKVFRVSSSLTNRQVIHIADKTYKCSDCGEIFSSNSNFAQHQRIHTGEKPYKYNECGKVFNQNSHLAQHQKIHTGQKPYNNKECGKVFSHHAYLAQHRKIHTGEKPYKCSECGKAFSVCSSLTAHLVIHTGEKPYDCKECGKVFRHKSSLTTHQTVHTGERPYKCNECGKGFSRIAFLARHRKVHTGEKPYKCNECGKVFIGNSRLARHRKIHTGGRRYKCNECGKAFRTCSDLTAHLLIHTGEKPYECIDCGKVFRHKSSLTYHCRIHTGEKPYKCNECGKVFSQNSNLQRHRKIHTGEKLYKCNECGKVFRQNSHLAQHRDIHTGEKPYSCNECGKVFRRNSHLVRHRNVHTGEKPYSCNECGKVFSRNSHLARHRNIHTGEKPHSCNECGKVFSRNSHLARHRKIHTGEKLYKCNECSKVFSRNSRLAQHRNIHTGVKPYSCNECGKVFSKNSILVQHCSIHTREKP

SEQ ID NO: 100392 - protein, 661 aa, Homo sapiens
  Payload ID: 20005
  Gene Name: zinc finger protein 534
  Uniprot ID: Q76KX8
  ENSP ID: ENSP00000391358
MALTQGQLSFSDVAIEFSQEEWKCLDPGQKALYRDVMLENYRNLVSLGICLPDLSVTSMLEQKRDPWTLQSEVKIINNPDGRECIKGVNTEKSSKLGSSAGNKSLKNQHGLTLQLHLTEWQPFQAVRNIYGCKHVEKSISDNSSVSPVQISFFSVKTHIFNNYRNDFLFSTLLPQEQKVHIREKPYGCNEHGKVFRVSSSLTNRQVIHIADKTYKCSDCGEIFSSNSNFAQHQRIHTGEKPYKYNECGKVFNQNSHLAQHQKIHTGQKPYNNKECGKVFSHHAYLAQHRKIHTGEKPYKCSECGKAFSVCSSLTAHLVIHTGEKPYDCKECGKVFRHKSSLTTHQTVHTGERPYKCNECGKGFSRIAFLARHRKVHTGEKPYKCNECGKVFIGNSRLARHRKIHTGGRRYKCNECGKAFRTCSDLTAHLLIHTGEKPYECIDCGKVFRHKSSLTYHCRIHTGEKPYKCNECGKVFSQNSNLQRHRKIHTGEKLYKCNECGKVFRQNSHLAQHRDIHTGEKPYSCNECGKVFRRNSHLVRHRNVHTGEKPYSCNECGKVFSRNSHLARHRNIHTGEKPHSCNECGKVFSRNSHLARHRKIHTGEKLYKCNECSKVFSRNSRLAQHRNIHTGVKPYSCNECGKVFSKNSILVQHCSIHTREKP

SEQ ID NO: 100393 - protein, 150 aa, Homo sapiens
  Payload ID: 20005
  Gene Name: zinc finger protein 534
  ENSP ID: ENSP00000409421
MALTQGQLSFSDVAIEFSQEEWKCLDPGQKALYRDVMLENYRNLVSLDFSLLAWDARVFRVEAWRASGGAEEPTGPNFVGNDSPLPSPLALLPFPSVSASLGDAKRARLTAEGRGHGTLRAGPAPRPRSAAPHAPDAVQRWPPEQRLPRS

SEQ ID NO: 100394 - protein, 193 aa, Homo sapiens; identical to SEQ ID NO: 100390
  Payload ID: 20005
  Gene Name: zinc finger protein 534
  ENSP ID: ENSP00000480956

SEQ ID NO: 100395 - protein, 1300 aa, Homo sapiens
  Payload ID: 20006
  Gene Name: zinc finger protein 536
  Uniprot ID: O15090
  ENSP ID: ENSP00000347730
MEEASLCLGVSSAEPEAEPHLSGPVLNGQYAMSQKLHQITSQLSHAFPELHPRPNPEEKPPASLEEKAHVPMSGQPMGSQMALLANQLGREVDTSLNGRVDLQQFLNGQNLGIMSQMSDIEDDARKNRKYPCPLCGKRFRFNSILSLHMRTHTGEKPFKCPYCDHRAAQKGNLKIHLRTHKLGNLGKGRGRVREENRLLHELEERAILRDKQLKGSLLQPRPDLKPPPHAQQAPLAACTLALQANHSVPDVAHPVPSPKPASVQEDAVAPAAGFRCTFCKGKFKKREELDRHIRILHKPYKCTLCDFAASQEEELISHVEKAHITAESAQGQGPNGGGEQSANEFRCEVCGQVFSQAWFLKGHMRKHKDSFEHCCQICGRRFKEPWFLKNHMKVHLNKLSVKNKSPSDPEVPVPMGGMSQEAHANLYSRYLSCLQSGFMTPDKAGLSEPSQLYGKGELPMKEKEALGKLLSPISSMAHGVPEGDKHSLLGCLNLVPPLKSSCIERLQAAAKAAEMDPVNSYQAWQLMARGMAMEHGFLSKEHPLQRNHEDTLANAGVLFDKEKREYVLVGADGSKQKMPADLVHSTKVGSQRDLPSKLDPLESSRDFLSHGLNQTLEYNLQGPGNMKEKPTECPDCGRVFRTYHQVVVHSRVHKRDRKGEEDGLHVGLDERRGSGSDQESQSVSRSTTPGSSNVTEESGVGGGLSQTGSAQEDSPHPSSPSSSDIGEEAGRSAGVQQPALLRDRSLGSAMKDCPYCGKTFRTSHHLKVHLRIHTGEKPYKCPHCDYAGTQSASLKYHLERHHRERQNGAGPLSGQPPNQDHKDEMSSKASLFIRPDILRGAFKGLPGIDFRGGPASQQWTSGVLSSGDHSGQATGMSSEVPSDALKGTDLPSKSTHFSEIGRAYQSIVSNGVNFQGSLQAFMDSFVLSSLKKEKDMKDKALADPPSMKVHGVDGGEEKPSGKSSQRKSEKSQYEPLDLSVRPDAASLPGSSVTVQDSIAWHGCLFCAFTTSSMELMALHLQANHLGKAKRKDNTIGVTVNCKDQAREASKMALLPSLQSNKDLGLSNMISSLDSASEKMAQGQLKETLGEQKSGAWTGHVDPAFCNFPSDFYKQFGVYPGMVGSGASSSCPNKEPDGKAHSEEDVPILIPETTSKNTTDDLSDIASSEDMDSSKGENNDEEDVETEPEMMTKPLSALSKDSSSDGGDSLQPTGTSQPVQGLVSPLSQAPEKQWHSQGLLQAQDPLAGLPKPERGPQSLDKPMNMLSVLRAYSSDGLAAFNGLASSTANSGCIKRPDLCGK

SEQ ID NO: 100396 - protein, 138 aa, Homo sapiens
  Payload ID: 20006
  Gene Name: zinc finger protein 536
  ENSP ID: ENSP00000465268
MEEASLCLGVSSAEPEAEPHLSGPVLNGQYAMSQKLHQITSQLSHAFPELHPRPNPEEKPPASLEEKAHVPMSGQPMGSQMALLANQLGREVDTSLNGRVDLQQFLNGQNLGIMSQMSDIEDDARKNRKYPCPLCGKR

SEQ ID NO: 100397 - protein, 949 aa, Homo sapiens
  Payload ID: 20006
  Gene Name: zinc finger protein 536
  ENSP ID: ENSP00000465771
MEEASLCLGVSSAEPEAEPHLSGPVLNGQYAMSQKLHQITSQLSHAFPELHPRPNPEEKPPASLEEKAHVPMSGQPMGSQMALLANQLGREVDTSLNGRVDLQQFLNGQNLGIMSQMSDIEDDARKNRKYPCPLCGKRFRFNSILSLHMRTHTGEKPFKCPYCDHRAAQKGNLKIHLRTHKLGNLGKGRGRVREENRLLHELEERAILRDKQLKGSLLQPRPDLKPPPHAQQAPLAACTLALQANHSVPDVAHPVPSPKPASVQEDAVAPAAGFRCTFCKGKFKKREELDRHIRILHKPYKCTLCDFAASQEEELISHVEKAHITAESAQGQGPNGGGEQSANEFRCEVCGQVFSQAWFLKGHMRKHKDSFEHCCQICGRRFKEPWFLKNHMKVHLNKLSVKNKSPSDPEVPVPMGGMSQEAHANLYSRYLSCLQSGFMTPDKAGLSEPSQLYGKGELPMKEKEALGKLLSPISSMAHGVPEGDKHSLLGCLNLVPPLKSSCIERLQAAAKAAEMDPVNSYQAWQLMARGMAMEHGFLSKEHPLQRNHEDTLANAGVLFDKEKREYVLVGADGSKQKMPADLVHSTKVGSQRDLPSKLDPLESSRDFLSHGLNQTLEYNLQGPGNMKEKPTECPDCGRVFRTYHQVVVHSRVHKRDRKGEEDGLHVGLDERRGSGSDQESQSVSRSTTPGSSNVTEESGVGGGLSQTGSAQEDSPHPSSPSSSDIGEEAGRSAGVQQPALLRDRSLGSAMKDCPYCGKTFRTSHHLKVHLRIHTGEKPYKCPHCDYAGTQSASLKYHLERHHRERQNGAGPLSGQPPNQDHKDEMSSKASLFIRPDILRGAFKGLPGIDFRGGPASQQWTSGVLSSGDHSGQATGMSSEVPSDALKGTDLPSKSTHFSEIGRAYQSIVSNGVNFQGSLQAFMDSFVLSSLKKEKDMKDKALADPPSMKV

SEQ ID NO: 100398 - protein, 137 aa, Homo sapiens
  Payload ID: 20006
  Gene Name: zinc finger protein 536
  ENSP ID: ENSP00000467909
DPLAGLPKPERGPQSLDKPMNMLSVLRAYSSDGLAAFNGLASSTANSGCIKRPDLCGHRPFQCRYCPYSASQKGNLKTHVLCVHRMPFDNSQYPDRRFKRSRVDSEASGNFEEPTAVKAGSSADLTEEGGKGQEETN

SEQ ID NO: 100399 - protein, 660 aa, Homo sapiens
  Payload ID: 20007
  Gene Name: zinc finger protein 540
  Uniprot ID: Q8NDQ6
  ENSP ID: ENSP00000324598
MAHALVTFRDVAIDFSQKEWECLDTTQRKLYRDVMLENYNNLVSLGYSGSKPDVITLLEQGKEPCVVARDVTGRQCPGLLSRHKTKKLSSEKDIHEISLSKESIIEKSKTLRLKGSIFRNEWQNKSEFEGQQGLKERSISQKKIVSKKMSTDRKRPSFTLNQRIHNSEKSCDSHLVQHGKIDSDVKHDCKECGSTFNNVYQLTLHQKIHTGEKSCKCEKCGKVFSHSYQLTLHQRFHTGEKPYECQECGKTFTLYPQLNRHQKIHTGKKPYMCKKCDKGFFSRLELTQHKRIHTGKKSYECKECGKVFQLIFYFKEHERIHTGKKPYECKECGKAFSVCGQLTRHQKIHTGVKPYECKECGKTFRLSFYLTEHRRTHAGKKPYECKECGKSFNVRGQLNRHKTIHTGIKPFACKVCEKAFSYSGDLRVHSRIHTGEKPYECKECGKAFMLRSVLTEHQRLHTGVKPYECKECGKTFRVRSQISLHKKIHTDVKPYKCVRCGKTFRFGFYLTEHQRIHTGEKPYKCKECGKAFIRRGNLKEHLKIHSGLKPYDCKECGKSFSRRGQFTEHQKIHTGVKPYKCKECGKAFSRSVDLRIHQRIHTGEKPYECKQCGKAFRLNSHLTEHQRIHTGEKPYECKVCRKAFRQYSHLYQHQKTHNVI

SEQ ID NO: 100400 - protein, 660 aa, Homo sapiens; identical to SEQ ID NO: 100399
  Payload ID: 20007
  Gene Name: zinc finger protein 540
  Uniprot ID: Q8NDQ6
  ENSP ID: ENSP00000343768

SEQ ID NO: 100401 - protein, 552 aa, Homo sapiens
  Payload ID: 20007
  Gene Name: zinc finger protein 540
  ENSP ID: ENSP00000465503
MAHALVTFRDVAIDFSQKEWECLDTTQRKLYRDVMLENYNNLVSLGYSGSKPDVITLLEQGKEPCVVARDVTGRQCPGLLSRHKTKKLSSEKDIHEISLSKESIIEKSKTLRLKGSIFRNEWQNKSEFEGQQGLKERSISQKKIVSKKMSTDRKRPSFTLNQRIHNSEKSCDSHLVQHGKIDSDVKHDCKECGSTFNNVYQLTLHQKIHTGEKSCKCEKCGKVFSHSYQLTLHQRFHTGEKPYECQECGKTFTLYPQLNRHQKIHTGKKPYMCKKCDKGFFSRLELTQHKRIHTGKKSYECKECGKVFQLIFYFKEHERIHTGKKPYECKECGKAFSVCGQLTRHQKIHTGVKPYECKECGKTFRLSFYLTEHRRTHAGKKPYECKECGKSFNVRGQLNRHKTIHTGIKPFACKVCEKAFSYSGDLRVHSRIHTGEKPYECKECGKAFMLRSVLTEHQRLHTGVKPYECKECGKTFRVRSQISLHKKIHTDVKPYKCVRCGKTFRFGFYLTEHQRIHTGEKPYKCKECGKAFIRRGNLKEHLKIHSGLKPYD

SEQ ID NO: 100402 - protein, 660 aa, Homo sapiens; identical to SEQ ID NO: 100399
  Payload ID: 20007
  Gene Name: zinc finger protein 540
  Uniprot ID: Q8NDQ6
  ENSP ID: ENSP00000466274

SEQ ID NO: 100403 - protein, 628 aa, Homo sapiens
  Payload ID: 20007
  Gene Name: zinc finger protein 540
  Uniprot ID: Q8NDQ6
  ENSP ID: ENSP00000467118
MAHALVTFRDVAIDFSQKEWECLDTTQRKLYRDVMLENYNNLVSLGLLSRHKTKKLSSEKDIHEISLSKESIIEKSKTLRLKGSIFRNEWQNKSEFEGQQGLKERSISQKKIVSKKMSTDRKRPSFTLNQRIHNSEKSCDSHLVQHGKIDSDVKHDCKECGSTFNNVYQLTLHQKIHTGEKSCKCEKCGKVFSHSYQLTLHQRFHTGEKPYECQECGKTFTLYPQLNRHQKIHTGKKPYMCKKCDKGFFSRLELTQHKRIHTGKKSYECKECGKVFQLIFYFKEHERIHTGKKPYECKECGKAFSVCGQLTRHQKIHTGVKPYECKECGKTFRLSFYLTEHRRTHAGKKPYECKECGKSFNVRGQLNRHKTIHTGIKPFACKVCEKAFSYSGDLRVHSRIHTGEKPYECKECGKAFMLRSVLTEHQRLHTGVKPYECKECGKTFRVRSQISLHKKIHTDVKPYKCVRCGKTFRFGFYLTEHQRIHTGEKPYKCKECGKAFIRRGNLKEHLKIHSGLKPYDCKECGKSFSRRGQFTEHQKIHTGVKPYKCKECGKAFSRSVDLRIHQRIHTGEKPYECKQCGKAFRLNSHLTEHQRIHTGEKPYECKVCRKAFRQYSHLYQHQKTHNVI

SEQ ID NO: 100404 - protein, 100 aa, Homo sapiens
  Payload ID: 20007
  Gene Name: zinc finger protein 540
  ENSP ID: ENSP00000467667
MAHALVTFRDVAIDFSQKEWECLDTTQRKLYRDVMLENYNNLVSLAGYSGSKPDVITLLEQGKEPCVVARDVTGRQCPGLLSRHKTKKLSSEKDIHEISL

SEQ ID NO: 100405 - protein, 29 aa, Homo sapiens
  Payload ID: 20007
  Gene Name: zinc finger protein 540
  ENSP ID: ENSP00000468113
MAHVCYPGIRPRNYLQKRTFMKSVYPKRV

SEQ ID NO: 100406 - protein, 679 aa, Homo sapiens
  Payload ID: 20008
  Gene Name: zinc finger protein 541
  ENSP ID: ENSP00000263351
  MOD_RES (1)..(1): Any amino acid
XHSFQWLRNLPGCPKSKGNNVFVVHKPSAVPSREGSESGPGPSSGSPSEESPPGPGGGLEDALPFPAALLRVPAEAPSDPRSASGEDDPCAPKKVKVDCDSFLCQNPGEPGLQEAQKAGGLPADASPLFRQLFLKSQEPLVSHEQMQVFQMITKSQRIFSHAQVAAVSSQLPAPEGKPAALRPLQGPWPQQPPPLAPAVDSLHAGPGNPEAEGSPARRRKTTPGVPREASPGSTRRDAKGGLKVAAVPTPLAAPSLDPSRNPDISSLAKQLRSSKGTLDLEDIFPSTGQRQTQLGGEEPPGASLPGKQAPAENGAASRITKGEKGPACSRGGGYRLLGNPRAPRFSGFRKEKAKMDMCCAASPSQVAMASFSSAGPPADPSKSKLTIFSRIQGGNIYRLPHPVKEENVAGRGNQQNGSPTDWTKPRSTFVCKNCSQMFYTEKGLSSHMCFHSDQWPSPRGKQEPQVFGTEFCKPLRQVLRPEGDRHSPPGTKKPLDPTAAAPLVVPQSIPVVPVTRHIGSMAMIQTKTVAQCVEYYYIWKKMIKFDCGRAPGLEKRVKREPEEVERTEEKVPCSPRERPSHHPTPKLKTKSYRRESILSSSPNAGSKRTPELLGSAESQGIFPCRECERVFDKIKSRNAHMKRHRLQDHVEPIIRVKWPVKPFQLKEEELGADIGPLQW

SEQ ID NO: 100407 - protein, 1365 aa, Homo sapiens
  Payload ID: 20008
  Gene Name: zinc finger protein 541
  ENSP ID: ENSP00000313258
MDQYSLGDEGALPSEMHLPSFSESQGLNCSDTLNRDLGPNTRGFLYAGLSGLDPDPSLPTPDMSSEVLEDNLDTLSLYSGKDSDSVKLLEEYADSESQASLQDLGLGVLKAKEADEGGRATSGSARKGKRQHSSPQNPLLDCSLCGKVFSSASSLSKHYLTHSQERKHVCKICSKAFKRQDHLTGHMLTHQKTKPFVCIEQGCSKSYCDYRSLRRHYEVHHGLCILKEAPPEEEACGDSPHAHESAGQPPPSSLRSLVPPEARSPGSLLPHRDLLRRIVSSIVHQKTPSPGPAPAGASDSEGRNTACPCPASSGSSSCTPAGPHAAPAALDTELPEEPCLPQKEPATDVFTAPNSRAAENGAPDPPEPEPDTALLQARSTAECWPEGGSVPACLPLFRGQTVPASSQPSSHSFQWLRNLPGCPKSKGNNVFVVHKPSAVPSREGSESGPGPSSGSPSEESPPGPGGGLEDALPFPAALLRVPAEAPSDPRSASGEDDPCAPKKVKVDCDSFLCQNPGEPGLQEAQKAGGLPADASPLFRQLFLKSQEPLVSHEQMQVFQMITKSQRIFSHAQVAAVSSQLPAPEGKPAALRPLQGPWPQQPPPLAPAVDSLHAGPGNPEAEGSPARRRKTTPGVPREASPGSTRRDAKGGLKVAAVPTPLAAPSLDPSRNPDISSLAKQLRSSKGTLDLEDIFPSTGQRQTQLGGEEPPGASLPGKQAPAENGAASRITKGEKGPACSRGGGYRLLGNPRAPRFSGFRKEKAKMDMCCAASPSQVAMASFSSAGPPADPSKSKLTIFSRIQGGNIYRLPHPVKEENVAGRGNQQNGSPTDWTKPRSTFVCKNCSQMFYTEKGLSSHMCFHSDQWPSPRGKQEPQVFGTEFCKPLRQVLRPEGDRHSPPGTKKPLDPTAAAPLVVPQSIPVVPVTRHIGSMAMMEWCSRWLQATTCGSKLLQGQEKDGEERDSKESSQQRKRKKRPPPSTAGEPGPAGCHQSRLRSPMFLVDCLLKGLFQCSPYTPPPMLSPIREGSGVYFNTLCSTSTQASPDQLISSMLDQVDGSFGICVVKDDTKISIEPHINIGSRFQAEIPELQERSLAGTDEHVASLVWKPWGDMMISSETQDRVTELCNVACSSVMPGGGTNLELALHCLHEAQGNVQVALETLLLRGPHKPRTHLLADYRYTGSDVWTPIEKRLFKKAFYAHKKDFYLIHKMIQTKTVAQCVEYYYIWKKMIKFDCGRAPGLEKRVKREPEEVERTEEKVPCSPRERPSHHPTPKLKTKSYRRESILSSSPNAGSKRTPELLGSAESQGIFPCRECERVFDKIKSRNAHMKRHRLQDHVEPIIRVKWPVKPFQLKEEELGADIGPLQW

SEQ ID NO: 100408 - protein, 1346 aa, Homo sapiens
  Payload ID: 20008
  Gene Name: zinc finger protein 541
  Uniprot ID: Q9H0D2
  ENSP ID: ENSP00000375770
MDQYSLGDEGALPSEMHLPSFSESQGLNCSDTLNRDLGPNTRGFLYAGLSGLDPDPSLPTPDMSSEVLEDNLDTLSLYSGKDSDSVKLLEEYADSESQASLQDLGLGVLKAKEADEGGRATSGSARKGKRQHSSPQNPLLDCSLCGKVFSSASSLSKHYLTHSQERKHVCKICSKAFKRQDHLTGHMLTHQKTKPFVCIEQGCSKSYCDYRSLRRHYEVHHGLCILKEAPPEEEACGDSPHAHESAGQPPPSSLRSLVPPEARSPGSLLPHRDLLRRIVSSIVHQKTPSPGPAPAGASDSEGRNTACPCPASSGSSSCTPAGPHAAPAALDTELPEEPCLPQKEPATDVFTAPNSRAAENGAPDPPEPEPDTALLQARSTAECWPEGGSVPACLPLFRGQTVPASSQPSSHSFQWLRNLPGCPKSKGNNVFVVHKPSAVPSREGSESGPGPSSGSPSEESPPGPGGGLEDALPFPAALLRVPAEAPSDPRSASGEDDPCAPKKVKVDCDSFLCQNPGEPGLQEAQKAGGLPADASPLFRQLFLKSQEPLVSHEQMQVFQMITKSQRIFSHAQVAAVSSQLPAPEGKPAALRPLQGPWPQQPPPLAPAVDSLHAGPGNPEAEGSPARRRKTTPGVPREASPGSTRRDAKGGLKVAAVPTPLAAPSLDPSRNPDISSLAKQLRSSKGTLDLEDIFPSTGQRQTQLGGEEPPGASLPGKQAPAENGAASRITKGEKGPACSRGGGYRLLGNPRAPRFSGFRKEKAKMDMCCAASPSQVAMASFSSAGPPADPSKSKLTIFSRIQGGNIYRLPHPVKEENVAGRGNQQNGSPTDWTKPRSTFVCKNCSQMFYTEKGLSSHMCFHSDQWPSPRGKQEPQVFGTEFCKPLRQVLRPEGDRHSPPGTKKPLDPTAAAPLVVPQSIPVVPVTRHIGSMAMGQEKDGEERDSKESSQQRKRKKRPPPSTAGEPGPAGCHQSRLRSPMFLVDCLLKGLFQCSPYTPPPMLSPIREGSGVYFNTLCSTSTQASPDQLISSMLDQVDGSFGICVVKDDTKISIEPHINIGSRFQAEIPELQERSLAGTDEHVASLVWKPWGDMMISSETQDRVTELCNVACSSVMPGGGTNLELALHCLHEAQGNVQVALETLLLRGPHKPRTHLLADYRYTGSDVWTPIEKRLFKKAFYAHKKDFYLIHKMIQTKTVAQCVEYYYIWKKMIKFDCGRAPGLEKRVKREPEEVERTEEKVPCSPRERPSHHPTPKLKTKSYRRESILSSSPNAGSKRTPELLGSAESQGIFPCRECERVFDKIKSRNAHMKRHRLQDHVEPIIRVKWPVKPFQLKEEELGADIGPLQW

SEQ ID NO: 100409 - protein, 866 aa, Homo sapiens
  Payload ID: 20008
  Gene Name: zinc finger protein 541
  ENSP ID: ENSP00000471665
  MOD_RES (1)..(1): Any amino acid
XKSKGNNVFVVHKPSAVPSREGSESGPGPSSGSPSEESPPGPGGGLEDALPFPAALLRVPAEAPSDPRSASGEDDPCAPKKVKVDCDSFLCQNPGEPGLQEAQKAGGLPADASPLFRQLFLKSQEPLVSHEQMQVFQMITKSQRIFSHAQVAAVSSQLPAPEGKPAALRPLQGPWPQQPPPLAPAVDSLHAGPGNPEAEGSPARRRKTTPGVPREASPGSTRRDAKGGLKVAAVPTPLAAPSLDPSRNPDISSLAKQLRSSKGTLDLEDIFPSTGQRQTQLGGEEPPGASLPGKQAPAENGAASRITKGEKGPACSRGGGYRLLGNPRAPRFSGFRKEKAKMDMCCAASPSQVAMASFSSAGPPADPSKSKLTIFSRIQGGNIYRLPHPVKEENVAGRGNQQNGSPTDWTKPRSTFVCKNCSQMFYTEKGLSSHMCFHSDQWPSPRGKQEPQGQEKDGEERDSKESSQQRKRKKRPPPSTAGEPGPAGCHQSRLRSPMFLVDCLLKGLFQCSPYTPPPMLSPIREGSGVYFNTLCSTSTQASPDQLISSMLDQVDGSFGICVVKDDTKISIEPHINIGSRFQAEIPELQERSLAGTDEHVASLVWKPWGDMMISSETQDRVTELCNVACSSVMPGGGTNLELALHCLHEAQGNVQVALETLLLRGPHKPRTHLLADYRYTGSDVWTPIEKRLFKKAFYAHKKDFYLIHKMIQTKTVAQCVEYYYIWKKMIKFDCGRAPGLEKRVKREPEEVERTEEKVPCSPRERPSHHPTPKLKTKSYRRESILSSSPNAGSKRTPELLGSAESQGIFPCRECERVFDKIKSRNAHMKRHRLQDHVEPIIRVKWPVKPFQLKEEELGADIGPLQW

SEQ ID NO: 100410 - protein, 600 aa, Homo sapiens
  Payload ID: 20009
  Gene Name: zinc finger protein 543
  Uniprot ID: Q08ER8
  ENSP ID: ENSP00000322545
MAASAQVSVTFEDVAVTFTQEEWGQLDAAQRTLYQEVMLETCGLLMSLGCPLFKPELIYQLDHRQELWMATKDLSQSSYPGDNTKPKTTEPTFSHLALPEEVLLQEQLTQGASKNSQLGQSKDQDGPSEMQEVHLKIGIGPQRGKLLEKMSSERDGLGSDDGVCTKITQKQVSTEGDLYECDSHGPVTDALIREEKNSYKCEECGKVFKKNALLVQHERIHTQVKPYECTECGKTFSKSTHLLQHLIIHTGEKPYKCMECGKAFNRRSHLTRHQRIHSGEKPYKCSECGKAFTHRSTFVLHHRSHTGEKPFVCKECGKAFRDRPGFIRHYIIHTGEKPYECIECGKAFNRRSYLTWHQQIHTGVKPFECNECGKAFCESADLIQHYIIHTGEKPYKCMECGKAFNRRSHLKQHQRIHTGEKPYECSECGKAFTHCSTFVLHKRTHTGEKPYECKECGKAFSDRADLIRHFSIHTGEKPYECVECGKAFNRSSHLTRHQQIHTGEKPYECIQCGKAFCRSANLIRHSIIHTGEKPYECSECGKAFNRGSSLTHHQRIHTGRNPTIVTDVGRPFMTAQTSVNIQELLLGKEFLNITTEENLW

SEQ ID NO: 100411 - protein, 715 aa, Homo sapiens
  Payload ID: 20010
  Gene Name: zinc finger protein 544
  Uniprot ID: Q6NX49
  ENSP ID: ENSP00000269829
MEARSMLVPPQASVCFEDVAMAFTQEEWEQLDLAQRTLYREVTLETWEHIVSLGLFLSKSDVISQLEQEEDLCRAEQEAPRDWKATLEENRLNSEKDRAREELSHHVEVYRSGPEEPPSLVLGKVQDQSNQLREHQENSLRFMVLTSERLFAQREHCELELGGGYSLPSTLSLLPTTLPTSTGFPKPNSQVKELKQNSAFINHEKNGADGKHCESHQCARAFCQSIYLSKLGNVETGKKNPYEYIVSGDSLNYGSSLCFHGRTFSVKKSDDCKDYGNLFSHSVSLNEQKPVHFGKSQYECDECRETCSESLCLVQTERSGPGETPFRCEERCAAFPMASSFSDCNIIQTTEKPSVCNQCGKSFSCCKLIHQRTHTGEKPFECTQCGKSFSQSYDLVIHQRTHTGEKPYECDLCGKSFTQRSKLITHQRIHTGEKPYQCIECRKSFRWNSNLIVHQRIHTGEKPYECTHCGKSFSQSYELVTHKRTHTGEKPFKCTQCGKSFSQKYDLVVHQRTHTGEKPYECNLCGKSFSQSSKLITHQRIHTGEKPYQCIECGKSFRWNSNLVIHQRIHTGEKPYDCTHCGKSFSQSYQLVAHKRTHTGEKPYECNECGKAFNRSTQLIRHLQIHTGEKPYKCNQCNKAFARSSYLVMHQRTHTGEKPFECSQCGKAFSGSSNLLSHHRIHSGEKPYECSDCGKSFRQQSQLVVHRRTHTGEKP

SEQ ID NO: 100412 - protein, 97 aa, Homo sapiens
  Payload ID: 20010
  Gene Name: zinc finger protein 544
  ENSP ID: ENSP00000468975
MEARSMLVPPQASVCFEDVAMAFTQEEWEQLDLAQRTLYREVTLETWEHIVSLGLFLSKSDVISQLEQEEDLCRAEQEAPRDGVSLLLPRLECNGTI

SEQ ID NO: 100413 - protein, 573 aa, Homo sapiens
  Payload ID: 20010
  Gene Name: zinc finger protein 544
  ENSP ID: ENSP00000469514
MVLTSERLFAQREHCELELGGGYSLPSTLSLLPTTLPTSTGFPKPNSQVKELKQNSAFINHEKNGADGKHCESHQCARAFCQSIYLSKLGNVETGKKNPYEYIVSGDSLNYGSSLCFHGRTFSVKKSDDCKDYGNLFSHSVSLNEQKPVHFGKSQYECDECRETCSESLCLVQTERSGPGETPFRCEERCAAFPMASSFSDCNIIQTTEKPSVCNQCGKSFSCCKLIHQRTHTGEKPFECTQCGKSFSQSYDLVIHQRTHTGEKPYECDLCGKSFTQRSKLITHQRIHTGEKPYQCIECRKSFRWNSNLIVHQRIHTGEKPYECTHCGKSFSQSYELVTHKRTHTGEKPFKCTQCGKSFSQKYDLVVHQRTHTGEKPYECNLCGKSFSQSSKLITHQRIHTGEKPYQCIECGKSFRWNSNLVIHQRIHTGEKPYDCTHCGKSFSQSYQLVAHKRTHTGEKPYECNECGKAFNRSTQLIRHLQIHTGEKPYKCNQCNKAFARSSYLVMHQRTHTGEKPFECSQCGKAFSGSSNLLSHHRIHSGEKPYECSDCGKSFRQQSQLVVHRRTHTGEKP

SEQ ID NO: 100414 - protein, 715 aa, Homo sapiens; identical to SEQ ID NO: 100411
  Payload ID: 20010
  Gene Name: zinc finger protein 544
  Uniprot ID: Q6NX49
  ENSP ID: ENSP00000469635

SEQ ID NO: 100415 - protein, 97 aa, Homo sapiens
  Payload ID: 20010
  Gene Name: zinc finger protein 544
  ENSP ID: ENSP00000470645
MEARSMLVPPQASVCFEDVAMAFTQEEWEQLDLAQRTLYREVTLETWEHIVSLGLFLSKSDVISQLEQEEDLCRAEQEAPRGTRPSKKQRRYRARRI

SEQ ID NO: 100416 - protein, 139 aa, Homo sapiens
  Payload ID: 20010
  Gene Name: zinc finger protein 544
  ENSP ID: ENSP00000470843
MEARSMLVPPQASVCFEDVAMAFTQEEWEQLDLAQRTLYREVTLETWEHIVSLGLFLSKSDVISQLEQEEDLCRAEQEAPREKGMLPGSFLGLPIEDRFSLLEGCLIQFPQQLPLAQERGPAKSRDGTGPEGSERVWPA

SEQ ID NO: 100417 - protein, 74 aa, Homo sapiens
  Payload ID: 20010
  Gene Name: zinc finger protein 544
  ENSP ID: ENSP00000471452
MEARSMLVPPQASVCFEDVAMAFTQEEWEQLDLAQRTLYREVTLETWEHIVSLAGARRGPVQGRAGGPPSLKKW

SEQ ID NO: 100418 - protein, 75 aa, Homo sapiens
  Payload ID: 20010
  Gene Name: zinc finger protein 544
  ENSP ID: ENSP00000471480
MEARSMLVPPQASVCFEDVAMAFTQEEWEQLDLAQRTLYREVTLETWEHIVSLAGARRGPVQGRAGGPPRLESYP

SEQ ID NO: 100419 - protein, 687 aa, Homo sapiens
  Payload ID: 20010
  Gene Name: zinc finger protein 544
  ENSP ID: ENSP00000471684
MEARSMLVPPQASVCFEDVAMAFTQEEWEQLDLAQRTLYREVTLETWEHIVSLDWKATLEENRLNSEKDRAREELSHHVEVYRSGPEEPPSLVLGKVQDQSNQLREHQENSLRFMVLTSERLFAQREHCELELGGGYSLPSTLSLLPTTLPTSTGFPKPNSQVKELKQNSAFINHEKNGADGKHCESHQCARAFCQSIYLSKLGNVETGKKNPYEYIVSGDSLNYGSSLCFHGRTFSVKKSDDCKDYGNLFSHSVSLNEQKPVHFGKSQYECDECRETCSESLCLVQTERSGPGETPFRCEERCAAFPMASSFSDCNIIQTTEKPSVCNQCGKSFSCCKLIHQRTHTGEKPFECTQCGKSFSQSYDLVIHQRTHTGEKPYECDLCGKSFTQRSKLITHQRIHTGEKPYQCIECRKSFRWNSNLIVHQRIHTGEKPYECTHCGKSFSQSYELVTHKRTHTGEKPFKCTQCGKSFSQKYDLVVHQRTHTGEKPYECNLCGKSFSQSSKLITHQRIHTGEKPYQCIECGKSFRWNSNLVIHQRIHTGEKPYDCTHCGKSFSQSYQLVAHKRTHTGEKPYECNECGKAFNRSTQLIRHLQIHTGEKPYKCNQCNKAFARSSYLVMHQRTHTGEKPFECSQCGKAFSGSSNLLSHHRIHSGEKPYECSDCGKSFRQQSQLVVHRRTHTGEKP

SEQ ID NO: 100420 - protein, 75 aa, Homo sapiens; identical to SEQ ID NO: 100418
  Payload ID: 20010
  Gene Name: zinc finger protein 544
  ENSP ID: ENSP00000472512

SEQ ID NO: 100421 - protein, 75 aa, Homo sapiens; identical to SEQ ID NO: 100418
  Payload ID: 20010
  Gene Name: zinc finger protein 544
  ENSP ID: ENSP00000472614

SEQ ID NO: 100422 - protein, 687 aa, Homo sapiens; identical to SEQ ID NO: 100419
  Payload ID: 20010
  Gene Name: zinc finger protein 544
  ENSP ID: ENSP00000472721

SEQ ID NO: 100423 - protein, 106 aa, Homo sapiens
  Payload ID: 20010
  Gene Name: zinc finger protein 544
  ENSP ID: ENSP00000485736
MEARSMLVPPQASVCFEDVAMAFTQEEWEQLDLAQRTLYREVTLETWEHIVSLGLFLSKSDVISQLEQEEDLCRAEQEAPRGTSGLSQVTGVVADGSFRFPVWDFT

SEQ ID NO: 100424 - protein, 836 aa, Homo sapiens
  Payload ID: 20011
  Gene Name: zinc finger protein 546
  Uniprot ID: Q86UE3
  ENSP ID: ENSP00000339823
MQVDPPLHGPPNDFLIFQIIPLHSLSIMPRFLWILCFSMEETQGELTSSCGSKTMANVSLAFRDVSIDLSQEEWECLDAVQRDLYKDVMLENYSNLVSLGYTIPKPDVITLLEQEKEPWIVMREGTRNWFTDLEYKYITKNLLSEKNVCKIYLSQLQTGEKSKNTIHEDTIFRNGLQCKHEFERQERHQMGCVSQMLIQKQISHPLHPKIHAREKSYECKECRKAFRQQSYLIQHLRIHTGERPYKCMECGKAFCRVGDLRVHHTIHAGERPYECKECGKAFRLHYHLTEHQRIHSGVKPYECKECGKAFSRVRDLRVHQTIHAGERPYECKECGKAFRLHYQLTEHQRIHTGERPYECKVCGKTFRVQRHISQHQKIHTGVKPYKCNECGKAFSHGSYLVQHQKIHTGEKPYECKECGKSFSFHAELARHRRIHTGEKPYECRECGKAFRLQTELTRHHRTHTGEKPYECKECGKAFICGYQLTLHLRTHTGEIPYECKECGKTFSSRYHLTQHYRIHTGEKPYICNECGKAFRLQGELTRHHRIHTCEKPYECKECGKAFIHSNQFISHQRIHTSESTYICKECGKIFSRRYNLTQHFKIHTGEKPYICNECGKAFRFQTELTQHHRIHTGEKPYKCTECGKAFIRSTHLTQHHRIHTGEKPYECTECGKTFSRHYHLTQHHRGHTGEKPYICNECGNAFICSYRLTLHQRIHTGELPYECKECGKTFSRRYHLTQHFRLHTGEKPYSCKECGNAFRLQAELTRHHIVHTGEKPYKCKECGKAFSVNSELTRHHRIHTGEKPYQCKECGKAFIRSDQLTLHQRNHISEEVLCIM

SEQ ID NO: 100425 - protein, 126 aa, Homo sapiens
  Payload ID: 20011
  Gene Name: zinc finger protein 546
  ENSP ID: ENSP00000469168
MEETQGELTSSCGSKTMANVSLAFRDVSIDLSQEEWECLDAVQRDLYKDVMLENYSNLVSLGYTIPKPDVITLLEQEKEPWIVMREGTRNWFTESRSVTQAGVQWHNLGSLQPPPPGFKQFFCLSL

SEQ ID NO: 100426 - protein, 139 aa, Homo sapiens
  Payload ID: 20011
  Gene Name: zinc finger protein 546
  ENSP ID: ENSP00000469334
MEETQGELTSSCGSKTMANVSLAFRDVSIDLSQEEWECLDAVQRDLYKDVMLENYSNLVSLGYTIPKPDVITLLEQEKEPWIVMREGTRNWFTDLEYKYITKNLLSEKNVCKIYLSQLQTGEKSKNTIHEDTIFRNGLQ

SEQ ID NO: 100427 - protein, 810 aa, Homo sapiens
  Payload ID: 20011
  Gene Name: zinc finger protein 546
  ENSP ID: ENSP00000469540
MQPRFLWILCFSMEETQGELTSSCGSKTMANVSLAFRDVSIDLSQEEWECLDAVQRDLYKDVMLENYSNLVSLGYTIPKPDVITLLEQEKEPWIVMREGTRNWFTDLEYKYITKNLLSEKNVCKIYLSQLQTGEKSKNTIHEDTIFRNGLQCKHEFERQERHQMGCVSQMLIQKQISHPLHPKIHAREKSYECKECRKAFRQQSYLIQHLRIHTGERPYKCMECGKAFCRVGDLRVHHTIHAGERPYECKECGKAFRLHYHLTEHQRIHSGVKPYECKECGKAFSRVRDLRVHQTIHAGERPYECKECGKAFRLHYQLTEHQRIHTGERPYECKVCGKTFRVQRHISQHQKIHTGVKPYKCNECGKAFSHGSYLVQHQKIHTGEKPYECKECGKSFSFHAELARHRRIHTGEKPYECRECGKAFRLQTELTRHHRTHTGEKPYECKECGKAFICGYQLTLHLRTHTGEIPYECKECGKTFSSRYHLTQHYRIHTGEKPYICNECGKAFRLQGELTRHHRIHTCEKPYECKECGKAFIHSNQFISHQRIHTSESTYICKECGKIFSRRYNLTQHFKIHTGEKPYICNECGKAFRFQTELTQHHRIHTGEKPYKCTECGKAFIRSTHLTQHHRIHTGEKPYECTECGKTFSRHYHLTQHHRGHTGEKPYICNECGNAFICSYRLTLHQRIHTGELPYECKECGKTFSRRYHLTQHFRLHTGEKPYSCKECGNAFRLQAELTRHHIVHTGEKPYKCKECGKAFSVNSELTRHHRIHTGEKPYQCKECGKAFIRSDQLTLHQRNHISEEVLCIM

SEQ ID NO: 100428 - protein, 37 aa, Homo sapiens
  Payload ID: 20011
  Gene Name: zinc finger protein 546
  ENSP ID: ENSP00000470423
MQSLVLLPRLECSDVILAYCNLHLPGKLHEPKWQRLQ

SEQ ID NO: 100429 - protein, 124 aa, Homo sapiens
  Payload ID: 20011
  Gene Name: zinc finger protein 546
  ENSP ID: ENSP00000472403
MQVDPPLHGPPNDFLIFQIIPLHSLSIMPRFLWILCFSMEETQGELTSSCGSKTMANVSLAFRDVSIDLSQEEWECLDAVQRDLYKDVMLENYSNLVSLGYTIPKPDVITLLEQEKEPWIVMRE

SEQ ID NO: 100430 - protein, 139 aa, Homo sapiens; identical to SEQ ID NO: 100426
  Payload ID: 20011
  Gene Name: Zinc finger protein 546
  ENSP ID: ENSP00000486015

SEQ ID NO: 100431 - protein, 124 aa, Homo sapiens; identical to SEQ ID NO: 100429
  Payload ID: 20011
  Gene Name: Zinc finger protein 546
  ENSP ID: ENSP00000486294

SEQ ID NO: 100432 - protein, 126 aa, Homo sapiens; identical to SEQ ID NO: 100425
  Payload ID: 20011
  Gene Name: Zinc finger protein 546
  ENSP ID: ENSP00000486807

SEQ ID NO: 100433 - protein, 836 aa, Homo sapiens; identical to SEQ ID NO: 100424
  Payload ID: 20011
  Gene Name: Zinc finger protein 546
  ENSP ID: ENSP00000487125

SEQ ID NO: 100434 - protein, 810 aa, Homo sapiens; identical to SEQ ID NO: 100427
  Payload ID: 20011
  Gene Name: Zinc finger protein 546
  ENSP ID: ENSP00000487351

SEQ ID NO: 100435 - protein, 37 aa, Homo sapiens; identical to SEQ ID NO: 100428
  Payload ID: 20011
  Gene Name: Zinc finger protein 546
  ENSP ID: ENSP00000487382

SEQ ID NO: 100436 - protein, 402 aa, Homo sapiens
  Payload ID: 20012
  Gene Name: zinc finger protein 547
  Uniprot ID: Q8IVP9
  ENSP ID: ENSP00000282282
MAEMNPAQGHVVFEDVAIYFSQEEWGHLDEAQRLLYRDVMLENLALLSSLGCCHGAEDEEAPLEPGVSVGVSQVMAPKPCLSTQNTQPCETCSSLLKDILRLAEHDGTHPEQGLYTCPAHLHQHQKEQIREKLSRGDGGRPTFVKNHRVHMAGKTFLCSECGKAFSHKHKLSDHQKIHTGERTYKCSKCGILFMERSTLNRHQRTHTGERPYECNECGKAFLCKSHLVRHQTIHSGERPYECSECGKLFMWSSTLITHQRVHTGKRPYGCSECGKFFKCNSNLFRHYRIHTGKRSYGCSECGKFFMERSTLSRHQRVHTGERPYECNECGKFFSLKSVLIQHQRVHTGERPYECSECGKAFLTKSHLICHQTVHTAAKQCSECGKFFRYNSTLLRHQKVHTG

SEQ ID NO: 100437 - protein, 41 aa, Homo sapiens
  Payload ID: 20012
  Gene Name: zinc finger protein 547
  ENSP ID: ENSP00000468929
MAEMNPAQGHVVFEDVAIYFSQEEWGHLDEAQRLLYRDVML

SEQ ID NO: 100438 - protein, 148 aa, Homo sapiens
  Payload ID: 20012
  Gene Name: zinc finger protein 547
  ENSP ID: ENSP00000470111
MYSSFPIWQGHVVFEDVAIYFSQEEWGHLDEAQRLLYRDVMLENLALLSSLGCCHGAEDEEAPLEPGVSVGVSQVMAPKPCLSTQNTQPCETCSSLLKDILRLAEHDGTHPEQGLYTCPAHLHQHQKEQIREKLSRGDGGRPTFVKNH

SEQ ID NO: 100439 - protein, 45 aa, Homo sapiens
  Payload ID: 20012
  Gene Name: zinc finger protein 547
  ENSP ID: ENSP00000470884
MAEMNPAQMESCCVVTQAGVQWHDLGSLQPAPPGFKQFCLNLPSS

SEQ ID NO: 100440 - protein, 545 aa, Homo sapiens
  Payload ID: 20013
  Gene Name: zinc finger protein 548
  Uniprot ID: Q8NEK5
  ENSP ID: ENSP00000337555
MNLTEGPLAMAEMDPTQGRVVFEDVAIYFSQEEWGHLDEAQRLLYRDVMLENLALLSSLGSWHGAEDEEAPSQQGFSVGVSEVTASKPCLSSQKVHPSETCGPPLKDILCLVEHNGIHPEQHIYICEAELFQHPKQQIGENLSRGDDWIPSFGKNHRVHMAEEIFTCMEGWKDLPATSCLLQHQGPQSEWKPYRDTEDREAFQTGQNDYKCSECGKTFTCSYSFVEHQKIHTGERSYECNKCGKFFKYSANFMKHQTVHTSERTYECRECGKSFMYNYRLMRHKRVHTGERPYECNTCGKFFRYSSTFVRHQRVHTGERPYECRECGKFFMDSSTLIKHQRVHTGERPYKCNDCGKFFRYISTLIRHQRIHTGERPYECSVCGELFRYNSSLVKHWRNHTGERPYKCSECGKSFRYHCRLIRHQRVHTGERPYECSECGKFFRYNSNLIKHWRNHTGERPYECRECGKAFSHKHILVEHQKIHSGERPYECSECQKAFIRKSHLVHHQKIHSEERLVCSMNVGNSLAKTPTSLNIRDFTMEKVYH

SEQ ID NO: 100441 - protein, 533 aa, Homo sapiens
  Payload ID: 20013
  Gene Name: zinc finger protein 548
  Uniprot ID: Q8NEK5
  ENSP ID: ENSP00000379482
MNLTEGRVVFEDVAIYFSQEEWGHLDEAQRLLYRDVMLENLALLSSLGSWHGAEDEEAPSQQGFSVGVSEVTASKPCLSSQKVHPSETCGPPLKDILCLVEHNGIHPEQHIYICEAELFQHPKQQIGENLSRGDDWIPSFGKNHRVHMAEEIFTCMEGWKDLPATSCLLQHQGPQSEWKPYRDTEDREAFQTGQNDYKCSECGKTFTCSYSFVEHQKIHTGERSYECNKCGKFFKYSANFMKHQTVHTSERTYECRECGKSFMYNYRLMRHKRVHTGERPYECNTCGKFFRYSSTFVRHQRVHTGERPYECRECGKFFMDSSTLIKHQRVHTGERPYKCNDCGKFFRYISTLIRHQRIHTGERPYECSVCGELFRYNSSLVKHWRNHTGERPYKCSECGKSFRYHCRLIRHQRVHTGERPYECSECGKFFRYNSNLIKHWRNHTGERPYECRECGKAFSHKHILVEHQKIHSGERPYECSECQKAFIRKSHLVHHQKIHSEERLVCSMNVGNSLAKTPTSLNIRDFTMEKVYH

SEQ ID NO: 100442 - protein, 57 aa, Homo sapiens
  Payload ID: 20013
  Gene Name: zinc finger protein 548
  ENSP ID: ENSP00000468847
MAEMDPTQGRVVFEDVAIYFSQEEWGHLDEAQRLLYRDVMLENLALLSSLGSWHGAE

SEQ ID NO: 100443 - protein, 87 aa, Homo sapiens
  Payload ID: 20013
  Gene Name: zinc finger protein 548
  ENSP ID: ENSP00000469101
MNLTEGPLAMAEMDPTQGRVVFEDVAIYFSQEEWGHLDEAQRLLYRDVMLENLALLSSLGKALTLAQCPGLGCVTPFYPKAALRFPQ

SEQ ID NO: 100444 - protein, 75 aa, Homo sapiens
  Payload ID: 20013
  Gene Name: zinc finger protein 548
  ENSP ID: ENSP00000469598
MVILKCLKMDMSHRQVDIKGPLAMAEMDPTQGRVVFEDVAIYFSQEEWGHLDEAQRLLYRDVMLENLALLSSLGS

SEQ ID NO: 100445 - protein, 56 aa, Homo sapiens
  Payload ID: 20013
  Gene Name: zinc finger protein 548
  ENSP ID: ENSP00000469700
MNLTENGVGEVSIKSRFPGEDHRLDFGHGDSQMSQDGYVTQTGGHKGGLCVERTGG

SEQ ID NO: 100446 - protein, 114 aa, Homo sapiens
  Payload ID: 20013
  Gene Name: zinc finger protein 548
  ENSP ID: ENSP00000470982
MAEMDPTQGRVVFEDVAIYFSQEEWGHLDEAQRLLYRDVMLENLALLSSLGSWHGAEDEEAPSQQGFSVGVSEVTASKPCLSSQKVHPSETCGPPLKDILCLVEHNGIHPEQHI

SEQ ID NO: 100447 - protein, 63 aa, Homo sapiens
  Payload ID: 20013
  Gene Name: zinc finger protein 548
  ENSP ID: ENSP00000471923
MNLTENGVGEVSIKSRFPGEDHRLDFGHGDSQMSQDGYVTQTGGHKGSPGDGRNGPYTGPCGL

SEQ ID NO: 100448 - protein, 47 aa, Homo sapiens
  Payload ID: 20013
  Gene Name: zinc finger protein 548
  ENSP ID: ENSP00000472618
MNLTEVGSVLREQGAETWGPDHWWLHRHHTLSRTVQTWHNRDSGLHL

SEQ ID NO: 100449 - protein, 44 aa, Homo sapiens
  Payload ID: 20013
  Gene Name: zinc finger protein 548
  ENSP ID: ENSP00000473004
MAEMDPTQGRVVFEDVAIYFSQEEWGHLDEAQRLLYRDVMLENL

SEQ ID NO: 100450 - protein, 63 aa, Homo sapiens
  Payload ID: 20013
  Gene Name: zinc finger protein 548
  ENSP ID: ENSP00000473179
MNLTEGPLAMAEMDPTQGRVVFEDVAIYFSQEEWGHLDEAQRLLYRDVMLENLALLSSLAFLF

SEQ ID NO: 100451 - protein, 627 aa, Homo sapiens
  Payload ID: 20014
  Gene Name: zinc finger protein 549
  Uniprot ID: Q6P9A3
  ENSP ID: ENSP00000240719
MAEAALVITPQGHVTFEDIAVYFSQEEWGLLDEAQRCLYHDVMLENFSLMASVGCLHGIEAEEAPSEQTLSAQGVSQARTPKLGPSIPNAHSCEMCILVMKDILYLSEHQGTLPWQKPYTSVASGKWFSFGSNLQQHQNQDSGEKHIRKEESSALLLNSCKIPLSDNLFPCKDVEKDFPTILGLLQHQTTHSRQEYAHRSRETFQQRRYKCEQVFNEKVHVTEHQRVHTGEKAYKRREYGKSLNSKYLFVEHQRTHNAEKPYVCNICGKSFLHKQTLVGHQQRIHTRERSYVCIECGKSLSSKYSLVEHQRTHNGEKPYVCNVCGKSFRHKQTFVGHQQRIHTGERPYVCMECGKSFIHSYDRIRHQRVHTGEGAYQCSECGKSFIYKQSLLDHHRIHTGERPYECKECGKAFIHKKRLLEHQRIHTGEKPYVCIICGKSFIRSSDYMRHQRIHTGERAYECSDCGKAFISKQTLLKHHKIHTRERPYECSECGKGFYLEVKLLQHQRIHTREQLCECNECGKVFSHQKRLLEHQKVHTGEKPCECSECGKCFRHRTSLIQHQKVHSGERPYNCTACEKAFIYKNKLVEHQRIHTGEKPYECGKCGKAFNKRYSLVRHQKVHITEEP

SEQ ID NO: 100452 - protein, 640 aa, Homo sapiens
  Payload ID: 20014
  Gene Name: zinc finger protein 549
  Uniprot ID: Q6P9A3
  ENSP ID: ENSP00000365407
MAEAALVITPQIPMVTEEFVKPSQGHVTFEDIAVYFSQEEWGLLDEAQRCLYHDVMLENFSLMASVGCLHGIEAEEAPSEQTLSAQGVSQARTPKLGPSIPNAHSCEMCILVMKDILYLSEHQGTLPWQKPYTSVASGKWFSFGSNLQQHQNQDSGEKHIRKEESSALLLNSCKIPLSDNLFPCKDVEKDFPTILGLLQHQTTHSRQEYAHRSRETFQQRRYKCEQVFNEKVHVTEHQRVHTGEKAYKRREYGKSLNSKYLFVEHQRTHNAEKPYVCNICGKSFLHKQTLVGHQQRIHTRERSYVCIECGKSLSSKYSLVEHQRTHNGEKPYVCNVCGKSFRHKQTFVGHQQRIHTGERPYVCMECGKSFIHSYDRIRHQRVHTGEGAYQCSECGKSFIYKQSLLDHHRIHTGERPYECKECGKAFIHKKRLLEHQRIHTGEKPYVCIICGKSFIRSSDYMRHQRIHTGERAYECSDCGKAFISKQTLLKHHKIHTRERPYECSECGKGFYLEVKLLQHQRIHTREQLCECNECGKVFSHQKRLLEHQKVHTGEKPCECSECGKCFRHRTSLIQHQKVHSGERPYNCTACEKAFIYKNKLVEHQRIHTGEKPYECGKCGKAFNKRYSLVRHQKVHITEEP

SEQ ID NO: 100453 - protein, 104 aa, Homo sapiens
  Payload ID: 20014
  Gene Name: zinc finger protein 549
  ENSP ID: ENSP00000469280
MAEAALVITPQIPMVTEEFVKPSQGHVTFEDIAVYFSQEEWGLLDEAQRCLYHDVMLENFSLMASVAGLSQSNHKDSCSQQKVPVSLNNCVAQCSPDDGHYDPK

SEQ ID NO: 100454 - protein, 13 aa, Homo sapiens
  Payload ID: 20014
  Gene Name: zinc finger protein 549
  ENSP ID: ENSP00000471315
MAEAALVITPQLD

SEQ ID NO: 100455 - protein, 381 aa, Homo sapiens
  Payload ID: 20015
  Gene Name: zinc finger protein 550
  ENSP ID: ENSP00000422344
MLVTFKDVAVTFTREEWRQLDLAQRTLYREVMLETCGLLVSLGDRAQVHTREPTTYPPVLSERAFLRGSLTLESSTSSDSRLGRARDEEGLLEMQKGKVTPETDLHKETHLGKVSLEGEGLGTDDGLHSRALQEWLSADVLHECDSQQPGKDALIHAGTNPYKCKQCGKGFNRKWYLVRHQRVHTGMKPYECNACGKAFSQSSTLIRHYLIHTGEKPYKCLECGKAFKRRSYLMQHHPIHTGEKPYECSQCRKAFTHRSTFIRHNRTHTGEKPFECKECEKAFSNRAHLIQHYIIHTGEKPYDCMACGKAFRCSSELIQHQRIHTGEKPYECTQCGKAFHRSTYLIQHSVIHTGEMPYKCIECGKAFKRRSHLLQHQRVHT

SEQ ID NO: 100456 - protein, 339 aa, Homo sapiens
  Payload ID: 20015
  Gene Name: zinc finger protein 550
  ENSP ID: ENSP00000445978
  MOD_RES (1)..(1): Any amino acid
XDRAQVHTREPTTYPPVLSERAFLRGSLTLESSTSSDSRLGRARDEEGLLEMQKGKVTPETDLHKETHLGKVSLEGEGLGTDDGLHSRALQEWLSADVLHECDSQQPGKDALIHAGTNPYKCKQCGKGFNRKWYLVRHQRVHTGMKPYECNACGKAFSQSSTLIRHYLIHTGEKPYKCLECGKAFKRRSYLMQHHPIHTGEKPYECSQCRKAFTHRSTFIRHNRTHTGEKPFECKECEKAFSNRAHLIQHYIIHTGEKPYDCMACGKAFRCSSELIQHQRIHTGEKPYECTQCGKAFHRSTYLIQHSVIHTGEMPYKCIECGKAFKRRSHLLQHQRVHT

SEQ ID NO: 100457 - protein, 422 aa, Homo sapiens
  Payload ID: 20015
  Gene Name: zinc finger protein 550
  Uniprot ID: Q7Z398
  ENSP ID: ENSP00000446224
MAETKDAAQMLVTFKDVAVTFTREEWRQLDLAQRTLYREVMLETCGLLVSLGHRVPKPELVHLLEHGQELWIVKRGLSHATCAGDRAQVHTREPTTYPPVLSERAFLRGSLTLESSTSSDSRLGRARDEEGLLEMQKGKVTPETDLHKETHLGKVSLEGEGLGTDDGLHSRALQEWLSADVLHECDSQQPGKDALIHAGTNPYKCKQCGKGFNRKWYLVRHQRVHTGMKPYECNACGKAFSQSSTLIRHYLIHTGEKPYKCLECGKAFKRRSYLMQHHPIHTGEKPYECSQCRKAFTHRSTFIRHNRTHTGEKPFECKECEKAFSNRAHLIQHYIIHTGEKPYDCMACGKAFRCSSELIQHQRIHTGEKPYECTQCGKAFHRSTYLIQHSVIHTGEMPYKCIECGKAFKRRSHLLQHQRVHT

SEQ ID NO: 100458 - protein, 422 aa, Homo sapiens; identical to SEQ ID NO: 100457
  Payload ID: 20015
  Gene Name: zinc finger protein 550
  Uniprot ID: Q7Z398
  ENSP ID: ENSP00000469537

SEQ ID NO: 100459 - protein, 422 aa, Homo sapiens; identical to SEQ ID NO: 100457
  Payload ID: 20015
  Gene Name: zinc finger protein 550
  Uniprot ID: Q7Z398
  ENSP ID: ENSP00000469580

SEQ ID NO: 100460 - protein, 422 aa, Homo sapiens; identical to SEQ ID NO: 100457
  Payload ID: 20015
  Gene Name: zinc finger protein 550
  Uniprot ID: Q7Z398
  ENSP ID: ENSP00000469679

SEQ ID NO: 100461 - protein, 125 aa, Homo sapiens
  Payload ID: 20015
  Gene Name: zinc finger protein 550
  ENSP ID: ENSP00000472973
MAETKDAAQMLVTFKDVAVTFTREEWRQLDLAQRTLYREVMLETCGLLVSLGHRVPKPELVHLLEHGQELWIVKRGLSHATCAGQEPRKEEGPMSNSGKDRKLLEKGEEQSPAEVDGVVLRDLTY

SEQ ID NO: 100462 - protein, 670 aa, Homo sapiens
  Payload ID: 20016
  Gene Name: zinc finger protein 551
  Uniprot ID: Q7Z340
  ENSP ID: ENSP00000282296
MPAPVGRRSPPSPRSSMAAVALRDSAQGMTFEDVAIYFSQEEWELLDESQRFLYCDVMLENFAHVTSLGYCHGMENEAIASEQSVSIQVRTSKGNTPTQKTHLSEIKMCVPVLKDILPAAEHQTTSPVQKSYLGSTSMRGFCFSADLHQHQKHYNEEEPWKRKVDEATFVTGCRFHVLNYFTCGEAFPAPTDLLQHEATPSGEEPHSSSSKHIQAFFNAKSYYKWGEYRKASSHKHTLVQHQSVCSEGGLYECSKCEKAFTCKNTLVQHQQIHTGQKMFECSECEESFSKKCHLILHKIIHTGERPYECSDREKAFIHKSEFIHHQRRHTGGVRHECGECRKTFSYKSNLIEHQRVHTGERPYECGECGKSFRQSSSLFRHQRVHSGERPYQCCECGKSFRQIFNLIRHRRVHTGEMPYQCSDCGKSFSCKSELIQHQRIHSGERPYECRECGKSFRQFSNLIRHRSIHTGDRPYECSECEKSFSRKFILIQHQRVHTGERPYECSECGKSFTRKSDLIQHRRIHTGTRPYECSECGKSFRQRSGLIQHRRLHTGERPYECSECGKSFSQSASLIQHQRVHTGERPYECSECGKSFSQSSSLIQHQRGHTGERPYECSQCGKPFTHKSDLIQHQRVHTGERPYECSECGKSFSRKSNLIRHRRVHTEERP

SEQ ID NO: 100463 - protein, 58 aa, Homo sapiens
  Payload ID: 20016
  Gene Name: zinc finger protein 551
  ENSP ID: ENSP00000472230
MAAVALRDSAQGMTFEDVAIYFSQEEWELLDESQRFLYCDVMLENFAHVTSLDQATNI

SEQ ID NO: 100464 - protein, 556 aa, Homo sapiens
  Payload ID: 20016
  Gene Name: zinc finger protein 551
  ENSP ID: ENSP00000472674
MTFEDVAIYFSQEEWELLDESQRFLYCDVMLENFAHVTSLGYCHGMENEAIASEQSVSIQVRTSKGNTPTQKTHLSEIKMCVPVLKDILPAAEHQTTSPVQKSYLGSTSMRGFCFSADLHQHQKHYNEEEPWKRKVDEATFVTGCRFHVLNYFTCGEAFPAPTDLLQHEATPSGEEPHSSSSKHIQAFFNAKSYYKWGEYRKASSHKHTLVQHQSVCSEGGLYECSKCEKAFTCKNTLVQHQQIHTGQKMFECSECEESFSKKCHLILHKIIHTGERPYECSDREKAFIHKSEFIHHQRRHTGGVRHECGECRKTFSYKSNLIEHQRVHTGERPYECGECGKSFRQSSSLFRHQRVHSGERPYQCCECGKSFRQIFNLIRHRRVHTGEMPYQCSDCGKSFSCKSELIQHQRIHSGERPYECRECGKSFRQFSNLIRHRSIHTGDRPYECSECEKSFSRKFILIQHQRVHTGERPYECSECGKSFTRKSDLIQHRRIHTGTRPYECSECGKSFRQRSGLIQHRRLHTGERPYECSECGKSFSQSASLIQHQRVHTGE

SEQ ID NO: 100465 - protein, 407 aa, Homo sapiens
  Payload ID: 20017
  Gene Name: zinc finger protein 552
  Uniprot ID: Q9H707
  ENSP ID: ENSP00000375582
MAAAALRFPVQGTVTFEDVAVKFTQEEWNLLSEAQRCLYRDVTLENLALMSSLGCWCGVEDEAAPSKQSIYIQRETQVRTPMAGVSPKKAHPCEMCGPILGDILHVADHQGTHHKQKLHRCEAWGNKLYDSGNFHQHQNEHIGEKPYRGSVEEALFAKRCKLHVSGESSVFSESGKDFLLRSGLLQQEATHTGKSNSKTECVSLFHGGKSHYSCGGCMKHFSTKDILSQHERLLPTEEPSVWCECGKSSSKYDSFSNHQGVHTREKPYTCGICGKLFNSKSHLLVHQRIHTGEKPYECEVCQKFFRHKYHLIAHQRVHTGERPYECSDCGKSFTHSSTFRVHKRVHTGQKPYECSECGKSFAESSSLTKHRRVHTGEKPYGCSECEKKFRQISSLRHHQRVHKRKGL

SEQ ID NO: 100466 - protein, 49 aa, Homo sapiens
  Payload ID: 20017
  Gene Name: zinc finger protein 552
  ENSP ID: ENSP00000470362
MAAAALRFPVQVIVAPSVLSGHLLVTQVLKQRGSGTCLRLCNPDPASGH

SEQ ID NO: 100467 - protein, 62 aa, Homo sapiens
  Payload ID: 20017
  Gene Name: zinc finger protein 552
  ENSP ID: ENSP00000472459
  MOD_RES (1)..(1): Any amino acid
XDVAVKFTQEEWNLLSEAQRCLYRDVTLENLALMSSLGKETVAPLLPVPPLGEREAEEKTAA

SEQ ID NO: 100468 - protein, 538 aa, Homo sapiens
  Payload ID: 20018
  Gene Name: zinc finger protein 554
  Uniprot ID: Q86TJ5
  ENSP ID: ENSP00000321132
MVTCAHLGRRARLPAAQPSACPGTCFSQEERMAAGYLPRWSQELVTFEDVSMDFSQEEWELLEPAQKNLYREVMLENYRNVVSLEALKNQCTDVGIKEGPLSPAQTSQVTSLSSWTGYLLFQPVASSHLEQREALWIEEKGTPQASCSDWMTVLRNQDSTYKKVALQEEPASGINMIKLIREDGGWKQLEDSHEDPQGLLSQKASLHVVAVPQEKATAWHGFGENGNLSPALVLSQGSSKGNHLCGSELDITSLASDSVLNHHQLGYADRRPCESNECGNAIRQNSHFIQHGGKMFVYLENGQSLNHGMALTIHNKINTAEKPFECHQCGKVFNRRHSLSEHQRIHTGEKPYECQECGRAFTHSSTLTRHLRTHTGEKPYGCGECGKAFNRISSLTQHQRIHTGEKPYKCEDCGKSFCQSSYLILHKRTHTGEKPYECSECGKAFSDRSSLNQHERTHTGENPYECKQCGRAFSQRSSLVRHERTHTGEKPYRCQECGKAFSQSSSLVTHQKTHSSQKTYKIIDCGKAFYQNRHLIGY

SEQ ID NO: 100469 - protein, 68 aa, Homo sapiens
  Payload ID: 20018
  Gene Name: zinc finger protein 554
  ENSP ID: ENSP00000464865
MVTCAHLGRRARLPAAQPSACPGTCFSQEERMAAGYLPRWSQAGLPWHNLRSLQPLPPGSSDSPASAS

SEQ ID NO: 100470 - protein, 181 aa, Homo sapiens
  Payload ID: 20018
  Gene Name: zinc finger protein 554
  ENSP ID: ENSP00000467997
MVTCAHLGRRARLPAAQPSACPGTCFSQEERMAAGYLPRWSQELVTFEDVSMDFSQEEWELLEPAQKNLYREVMLENYRNVVSLEALKNQCTDVGIKEGPLSPAQTSQVTSLSSWTGYLLFQPVASSHLEQREALWIEEKGTPQASCSVSLLLPRLQCSGVISAHCNLHLPGSSDSSASAS

SEQ ID NO: 100471 - protein, 628 aa, Homo sapiens
  Payload ID: 20019
  Gene Name: zinc finger protein 555
  Uniprot ID: Q8NEP9
  ENSP ID: ENSP00000334853
MDSVVFEDVAVDFTLEEWALLDSAQRDLYRDVMLETFQNLASVDDETQFKASGSVSQQDIYGEKIPKESKIATFTRNVSWASVLGKIWDSLSIEDQTTNQGRNLSRNHGLERLCESNDQCGEALSQIPHLNLYKKIPPGVKQYEYNTYGKVFMHRRTSLKSPITVHTGHKPYQCQECGQAYSCRSHLRMHVRTHNGERPYVCKLCGKTFPRTSSLNRHVRIHTAEKTYECKQCGKAFIDFSSLTSHLRSHTGEKPYKCKECGKAFSYSSTFRRHTITHTGEKPYKCKECAEAFSYSSTFRRHMISHTGEKPHKCKECGEAFSYSSAFRRHMITHTGEKPYECKQCGKTFIYLQSFRRHERIHTGEKPYECKQCGKTFIYPQSFRRHERTHGGEKPYECNQCGKAFSHPSSFRGHMRVHTGEKPYECKQCGKTFNWPISLRKHMRTHTREKPYECKQCGKAFSLSACFREHVRMHPEDKSYECKLCGKAFYCHISLQKHMRRHTAEKLYKCKQCGKAFSWPELLQQHVRTHTVEKPYECKECGKVFKWPSSLPIHMRLHTGEKPYQCKHCGKAFNCSSSLRRHVRIHTTEKQYKCNVGHPPANEFMCSASEKSHQERDLIKVVNMVLPL

SEQ ID NO: 100472 - protein, 111 aa, Homo sapiens
  Payload ID: 20019
  Gene Name: zinc finger protein 555
  ENSP ID: ENSP00000466982
MLETFQNLASVDDETQFKASGSVSQQDIYGEKIPKESKIATFTRNVSWASVLGKIWDSLSIEDQTTNQGRNLSRNHGLERLCESNDQCGEALSQIPHLNLYKKIPPGVKQY

SEQ ID NO: 100473 - protein, 627 aa, Homo sapiens
  Payload ID: 20019
  Gene Name: zinc finger protein 555
  Uniprot ID: Q8NEP9
  ENSP ID: ENSP00000467893
MDSVVFEDVAVDFTLEEWALLDSAQRDLYRDVMLETFQNLASVDDETQFKASGSVSQQDIYGEKIPKESKIATFTRNVSWASVLGKIWDSLSIEDQTTNQGRNLRNHGLERLCESNDQCGEALSQIPHLNLYKKIPPGVKQYEYNTYGKVFMHRRTSLKSPITVHTGHKPYQCQECGQAYSCRSHLRMHVRTHNGERPYVCKLCGKTFPRTSSLNRHVRIHTAEKTYECKQCGKAFIDFSSLTSHLRSHTGEKPYKCKECGKAFSYSSTFRRHTITHTGEKPYKCKECAEAFSYSSTFRRHMISHTGEKPHKCKECGEAFSYSSAFRRHMITHTGEKPYECKQCGKTFIYLQSFRRHERIHTGEKPYECKQCGKTFIYPQSFRRHERTHGGEKPYECNQCGKAFSHPSSFRGHMRVHTGEKPYECKQCGKTFNWPISLRKHMRTHTREKPYECKQCGKAFSLSACFREHVRMHPEDKSYECKLCGKAFYCHISLQKHMRRHTAEKLYKCKQCGKAFSWPELLQQHVRTHTVEKPYECKECGKVFKWPSSLPIHMRLHTGEKPYQCKHCGKAFNCSSSLRRHVRIHTTEKQYKCNVGHPPANEFMCSASEKSHQERDLIKVVNMVLPL

SEQ ID NO: 100474 - protein, 456 aa, Homo sapiens
  Payload ID: 20020
  Gene Name: zinc finger protein 556
  Uniprot ID: Q9HAH1
  ENSP ID: ENSP00000302603
MDTVVFEDVVVDFTLEEWALLNPAQRKLYRDVMLETFKHLASVDNEAQLKASGSISQQDTSGEKLSLKQKIEKFTRKNIWASLLGKNWEEHSVKDKHNTKERHLSRNPRVERPCKSSKGNKRGRTFRKTRNCNRHLRKNCCTSVRRYECSQCGKLFTHSSSLIRHKRAHSGQKLYKCKECGKAFSRPSYLQTHEKTHSGEKPYACQSCGKTFLRSHSLTEHVRTHTGEKPYECGQCGKGFSCPKSFRAHVMMHAGGRPYECKHCGKAFRCQKSFRVHMIMHAGGRPYECKQCGKAYCWATSFQRHVRIHNGEKPYKCGKCGKAFGWPSSLHKHARTHAKKKPVSGGSVGKSSARPRPSTDVKSQTREKVYKCETCGKTYGWSSSLHKHERKHTGEKPVNAASVGKPSGGLCSSKNVRTQIGQKPSKCEKCGKAFSCPKAFQGHVRSHTGKKSCTSK

SEQ ID NO: 100475 - protein, 69 aa, Homo sapiens
  Payload ID: 20020
  Gene Name: zinc finger protein 556
  ENSP ID: ENSP00000465533
MDTVVFEDVVVDFTLEEWALLNPAQRKLYRDVMLETFKHLASIMRLSLKPVGLFLSRILLEKNYPSNRK

SEQ ID NO: 100476 - protein, 455 aa, Homo sapiens
  Payload ID: 20020
  Gene Name: zinc finger protein 556
  ENSP ID: ENSP00000467366
MDTVVFEDVVVDFTLEEWALLNPAQRKLYRDVMLETFKHLASVDNEAQLKASGSISQQDTSGEKLSLKQKIEKFTRKNIWASLLGKNWEEHSVKDKHNTKERHLRNPRVERPCKSSKGNKRGRTFRKTRNCNRHLRKNCCTSVRRYECSQCGKLFTHSSSLIRHKRAHSGQKLYKCKECGKAFSRPSYLQTHEKTHSGEKPYACQSCGKTFLRSHSLTEHVRTHTGEKPYECGQCGKGFSCPKSFRAHVMMHAGGRPYECKHCGKAFRCQKSFRVHMIMHAGGRPYECKQCGKAYCWATSFQRHVRIHNGEKPYKCGKCGKAFGWPSSLHKHARTHAKKKPVSGGSVGKSSARPRPSTDVKSQTREKVYKCETCGKTYGWSSSLHKHERKHTGEKPVNAASVGKPSGGLCSSKNVRTQIGQKPSKCEKCGKAFSCPKAFQGHVRSHTGKKSCTSK

SEQ ID NO: 100477 - protein, 430 aa, Homo sapiens
  Payload ID: 20021
  Gene Name: zinc finger protein 557
  Uniprot ID: Q8N988
  ENSP ID: ENSP00000252840
MAAVVLPPTAALSSLFPASQREGHTEGGELVNELLKSWLKGLVTFEDVAVEFTQEEWALLDPAQRTLYRDVMLENCRNLASLGNQVDKPRLISQLEQEDKVMTEERGILSGTCPDVENPFKAKGLTPKLHVFRKEQSRNMKMERNHLGATLNECNQCFKVFSTKSSLTRHRKIHTGERPYGCSECGKSYSSRSYLAVHKRIHNGEKPYECNDCGKTFSSRSYLTVHKRIHNGEKPYECSDCGKTFSNSSYLRPHLRIHTGEKPYKCNQCFREFRTQSIFTRHKRVHTGEGHYVCNQCGKAFGTRSSLSSHYSIHTGEYPYECHDCGRTFRRRSNLTQHIRTHTGEKPYTCNECGKSFTNSFSLTIHRRIHNGEKSYECSDCGKSFNVLSSVKKHMRTHTGKKPYECNYCGKSFTSNSYLSVHTRMHNRQM

SEQ ID NO: 100478 - protein, 423 aa, Homo sapiens
  Payload ID: 20021
  Gene Name: zinc finger protein 557
  Uniprot ID: Q8N988
  ENSP ID: ENSP00000404065
MAAVVLPPTAASQREGHTEGGELVNELLKSWLKGLVTFEDVAVEFTQEEWALLDPAQRTLYRDVMLENCRNLASLGNQVDKPRLISQLEQEDKVMTEERGILSGTCPDVENPFKAKGLTPKLHVFRKEQSRNMKMERNHLGATLNECNQCFKVFSTKSSLTRHRKIHTGERPYGCSECGKSYSSRSYLAVHKRIHNGEKPYECNDCGKTFSSRSYLTVHKRIHNGEKPYECSDCGKTFSNSSYLRPHLRIHTGEKPYKCNQCFREFRTQSIFTRHKRVHTGEGHYVCNQCGKAFGTRSSLSSHYSIHTGEYPYECHDCGRTFRRRSNLTQHIRTHTGEKPYTCNECGKSFTNSFSLTIHRRIHNGEKSYECSDCGKSFNVLSSVKKHMRTHTGKKPYECNYCGKSFTSNSYLSVHTRMHNRQM

SEQ ID NO: 100479 - protein, 402 aa, Homo sapiens
  Payload ID: 20022
  Gene Name: zinc finger protein 558
  Uniprot ID: Q96NG5
  ENSP ID: ENSP00000301475
MAAVILPSTAAPSSLFPASQQKGHTQGGELVNELLTSWLRGLVTFEDVAVEFTQEEWALLDPAQRTLYRDVMLENCRNLASLGCRVNKPSLISQLEQDKKVVTEERGILPSTCPDLETLLKAKWLTPKKNVFRKEQSKGVKTERSHRGVKLNECNQCFKVFSTKSNLTQHKRIHTGEKPYDCSQCGKSFSSRSYLTIHKRIHNGEKPYECNHCGKAFSDPSSLRLHLRIHTGEKPYECNQCFHVFRTSCNLKSHKRIHTGENHHECNQCGKAFSTRSSLTGHNSIHTGEKPYECHDCGKTFRKSSYLTQHVRTHTGEKPYECNECGKSFSSSFSLTVHKRIHTGEKPYECSDCGKAFNNLSAVKKHLRTHTGEKPYECNHCGKSFTSNSYLSVHKRIHNRWI

SEQ ID NO: 100480 - protein, 402 aa, Homo sapiens; identical to SEQ ID NO: 100479
  Payload ID: 20022
  Gene Name: zinc finger protein 558
  Uniprot ID: Q96NG5
  ENSP ID: ENSP00000471277

SEQ ID NO: 100481 - protein, 84 aa, Homo sapiens
  Payload ID: 20023
  Gene Name: zinc finger protein 559
  Uniprot ID: Q9BR84
  ENSP ID: ENSP00000325393
MVAGWLTNYSQDSVTFEDVAVDFTQEEWTLLDQTQRNLYRDVMLENYKNLVAVDWESHINTKWSAPQQNFLQGKTSSVVEMNSE

SEQ ID NO: 100482 - protein, 538 aa, Homo sapiens
  Payload ID: 20023
  Gene Name: zinc finger protein 559
  Uniprot ID: Q9BR84
  ENSP ID: ENSP00000377461
MVAGWLTNYSQDSVTFEDVAVDFTQEEWTLLDQTQRNLYRDVMLENYKNLVAVDWESHINTKWSAPQQNFLQGKTSSVVEMERNHFGEELFDFNQCEKALSEHSCLKTHRRTYFRKKTCECNQCEKAFRKPSIFTLHKKTDIGEELPNCNQCETAFSQHLHLVCKKTSQNLHLVCKKTHTQEKPYKCSDCEKGLPSSSHLRECVRIYGGERPYTHKEYVETFSHSTALFVHMQTQDGEKFYECKACGKPFTESSYLTQHLRTHSRVLPIEHKKFGKAFAFSPDLAKHIRLRTRGKHYVCNECGKEFTCFSKLNIHIRVHTGEKPYECNKCGKAFTDSSGLIKHRRTHTGEKPYECKECGKAFANSSHLTVHMRTHTGEKPYQCKECGKAFINSSSFKSHMQTHPGVKPYDCQQCGKAFIRSSFLIRHLRSHSAERPFECEECGKAFRYSSHLSQHKRIHTGERPYKCQKCGQAFSISSGLTVHMRTHTGERPFECQECGKAFTRSTYLIRHLRSHSVEKPYKECGQTFSNSSCLTECV

SEQ ID NO: 100483 - protein, 39 aa, Homo sapiens
  Payload ID: 20023
  Gene Name: zinc finger protein 559
  ENSP ID: ENSP00000465526
MLAIGLSLCDHLSQDVFCLHESKFEEERMVAGWLTNYSQ

SEQ ID NO: 100484 - protein, 149 aa, Homo sapiens
  Payload ID: 20023
  Gene Name: zinc finger protein 559
  ENSP ID: ENSP00000465787
MLAIGLSLCDHLSQDVFCLHESKFEEERMVAGWLTNYSQDSVTFEDVAVDFTQEEWTLLDQTQRNLYRDVMLENYKNLVAVDWESHINTKWSAPQQNFLQGKTSSVVEMSLTVSPRLECSGTISAHGSFHLPGSSNSCASASRVAGTCA

SEQ ID NO: 100485 - protein, 81 aa, Homo sapiens
  Payload ID: 20023
  Gene Name: zinc finger protein 559
  ENSP ID: ENSP00000466325
MLAIGLSLCDHLSQDVFCLHESKFEEERMVAGWLTNYSQDSVTFEDVAVDFTQEEWTLLDQTQRNLYRDVMLENYKNLVAV

SEQ ID NO: 100486 - protein, 112 aa, Homo sapiens
  Payload ID: 20023
  Gene Name: zinc finger protein 559
  ENSP ID: ENSP00000466496
MLAIGLSLCDHLSQDVFCLHESKFEEERMVAGWLTNYSQDSVTFEDVAVDFTQEEWTLLDQTQRNLYRDVMLENYKNLVAVDWESHINTKWSAPQQNFLQGKTSSVVEMNSE

SEQ ID NO: 100487 - protein, 52 aa, Homo sapiens
  Payload ID: 20023
  Gene Name: zinc finger protein 559
  ENSP ID: ENSP00000466745
QTQRNLYRDVMLENYKNLVAVDWESHINTKWSAPQQNFLQGKTSSVVEMETN

SEQ ID NO: 100488 - protein, 84 aa, Homo sapiens; identical to SEQ ID NO: 100481
  Payload ID: 20023
  Gene Name: zinc finger protein 559
  Uniprot ID: Q9BR84
  ENSP ID: ENSP00000467048

SEQ ID NO: 100489 - protein, 175 aa, Homo sapiens
  Payload ID: 20023
  Gene Name: zinc finger protein 559
  ENSP ID: ENSP00000467841
MVAGWLTNYSQDSVTFEDVAVDFTQEEWTLLDQTQRNLYRDVMLENYKNLVAVDWESHINTKWSAPQQNFLQGKTSSVVEMVRFRRYNLLSSMLEEDWKFLKMEKQHNNLETFETSVFHPKIICLLERLWIMSLTNTLNIPQNIFVYIFPSTFPYVSQMFLINNSLLGRYQLSSI

SEQ ID NO: 100490 - protein, 602 aa, Homo sapiens
  Payload ID: 20023
  Gene Name: zinc finger protein 559
  ENSP ID: ENSP00000468153
MRITAAILTARSRWRLRNSISAFLFTVTFAWCPPGLSNLTILSCPDHLSQDVFCLHESKFEEERMVAGWLTNYSQDSVTFEDVAVDFTQEEWTLLDQTQRNLYRDVMLENYKNLVAVDWESHINTKWSAPQQNFLQGKTSSVVEMERNHFGEELFDFNQCEKALSEHSCLKTHRRTYFRKKTCECNQCEKAFRKPSIFTLHKKTDIGEELPNCNQCETAFSQHLHLVCKKTSQNLHLVCKKTHTQEKPYKCSDCEKGLPSSSHLRECVRIYGGERPYTHKEYVETFSHSTALFVHMQTQDGEKFYECKACGKPFTESSYLTQHLRTHSRVLPIEHKKFGKAFAFSPDLAKHIRLRTRGKHYVCNECGKEFTCFSKLNIHIRVHTGEKPYECNKCGKAFTDSSGLIKHRRTHTGEKPYECKECGKAFANSSHLTVHMRTHTGEKPYQCKECGKAFINSSSFKSHMQTHPGVKPYDCQQCGKAFIRSSFLIRHLRSHSAERPFECEECGKAFRYSSHLSQHKRIHTGERPYKCQKCGQAFSISSGLTVHMRTHTGERPFECQECGKAFTRSTYLIRHLRSHSVEKPYKECGQTFSNSSCLTECV

SEQ ID NO: 100491 - protein, 68 aa, Homo sapiens
  Payload ID: 20023
  Gene Name: zinc finger protein 559
  ENSP ID: ENSP00000468299
MVAGWLTNYSQDSVTFEDVAVDFTQEEWTLLDQTQRNLYRDVMLENYKNLVAVDWESHINTKWSAPQQ

SEQ ID NO: 100492 - protein, 147 aa, Homo sapiens
  Payload ID: 20023
  Gene Name: zinc finger protein 559
  ENSP ID: ENSP00000474260
MERNHFGEELFDFNQCEKALSEHSCLKTHRRTYFRKKTCECNQCEKAFRKPSIFTLHKKTDIGEELPNCNQCETAFSQHLHLVCKKTSQNLHLVCKKTHTQEKPYKCSDCEKGLPSSSHLRECVRIYGGERPYTHKEYVETFSHSTA

SEQ ID NO: 100493 - protein, 524 aa, Homo sapiens
  Payload ID: 20023
  Gene Name: zinc finger protein 559
  ENSP ID: ENSP00000474719
ILTARSRWRLRNSISAFLFTVTFAWCPPGLSNLTILSCPDWESHINTKWSAPQQNFLQGKTSSVVEMERNHFGEELFDFNQCEKALSEHSCLKTHRRTYFRKKTCECNQCEKAFRKPSIFTLHKKTDIGEELPNCNQCETAFSQHLHLVCKKTSQNLHLVCKKTHTQEKPYKCSDCEKGLPSSSHLRECVRIYGGERPYTHKEYVETFSHSTALFVHMQTQDGEKFYECKACGKPFTESSYLTQHLRTHSRVLPIEHKKFGKAFAFSPDLAKHIRLRTRGKHYVCNECGKEFTCFSKLNIHIRVHTGEKPYECNKCGKAFTDSSGLIKHRRTHTGEKPYECKECGKAFANSSHLTVHMRTHTGEKPYQCKECGKAFINSSSFKSHMQTHPGVKPYDCQQCGKAFIRSSFLIRHLRSHSAERPFECEECGKAFRYSSHLSQHKRIHTGERPYKCQKCGQAFSISSGLTVHMRTHTGERPFECQECGKAFTRSTYLIRHLRSHSVEKPYKECGQTFSNSSCLTECV

SEQ ID NO: 100494 - protein, 538 aa, Homo sapiens; identical to SEQ ID NO: 100482
  Payload ID: 20023
  Gene Name: zinc finger protein 559
  Uniprot ID: Q9BR84
  ENSP ID: ENSP00000474760

SEQ ID NO: 100495 - protein, 790 aa, Homo sapiens
  Payload ID: 20024
  Gene Name: zinc finger protein 560
  Uniprot ID: Q96MR9
  ENSP ID: ENSP00000301480
MAYCLTNCYQYSVTFEDTAVDFTQEEWILLDPVQRNLYRDVMLENYENVAKVGFQLFKPSVISWLEEEELRTLQQGVLQDWAIKHQTSVSALQQEFWKIQTSNGIQMDLVTFDSVAVEFTQEEWTLLDPAQRNLYSDVMLENYKNLSSVGYQLFKPSLISWLEEEEELSTLPRVLQEWKMCLKTKGPALWQDNFCLKTLNGIQLARNQNGEELYDCKQCEDVFCKHPCLKTNMSTQNRGNTSECIQYAKDLLSLYNKTSTIRKVSVFSKHGKSFRLILNVQVQRKCTQDKSFEGTDYGKAFIYQSYLEAHRKTQSGEKLNEWKQCGEAFTHSTSHAVNVETHIIKNPYECKECGKDFRYPTHLNNHMQTHIGIKPYKCKHCGKTFTVPSGFLEHVRTHTGEKPYGCKECGKAFGTSAGLIEHIRCHAREKTFKCDHCGKAFISYPSLFGHLRVHNGEKPYEHKEYGKAFGTSSGVIEDRRSNTGQKRFDCDQCGKVFVSFSSLFAHLRTHTGEKPFKCYKCGKPFTSSACLRIHMRTHTEERLYQCKKCGKAFTKCSYLTKHLRTHAGEKPYECMKCGKAFTERSYLTKHLRRHSGEKPYECKKCGKAFTERSDLTKHLRRHTGDKPYEYKDCGKAFVVSSSLVDHLRTHTGYKPYKCNACEKAYSRSCVLTQHLKTHAAEKTSECNACGNSFRNSMCFHDRLKTLTKIKPYKCKDCGKAFTCHSDLTNHVRIHTGEKPYKCKECGKAFRTSSGRIQHLRTHMGEKPFECDQCGKAFASFSARIAHLKTH

SEQ ID NO: 100496 - protein, 486 aa, Homo sapiens
  Payload ID: 20025
  Gene Name: zinc finger protein 561
  Uniprot ID: Q8N587
  ENSP ID: ENSP00000303915
MAAIYLSRGFFSREPICPFEEKTKVERMVEDYLASGYQDSVTFDDVAVDFTPEEWALLDTTEKYLYRDVMLENYMNLASVEWEIQPRTKRSSLQQGFLKNQIFSGIQMTRGYSGWKLCDCKNCGEVFREQFCLKTHMRVQNGGNTSEGNCYGKDTLSVHKEASTGQELSKFNPCGKVFTLTPGLAVHLEVLNARQPYKCKECGKGFKYFASLDNHMGIHTDEKLCEFQEYGRAVTASSHLKQCVAVHTGKKSKKTKKCGKSFTNFSQLYAPVKTHKGEKSFECKECGRSFRNSSCLNDHIQIHTGIKPHKCTYCGKAFTRSTQLTEHVRTHTGIKPYECKECGQAFAQYSGLSIHIRSHSGKKPYQCKECGKAFTTSTSLIQHTRIHTGEKPYECVECGKTFITSSRRSKHLKTHSGEKPFVCKICGKAFLYSSRLNVHLRTHTGEKPFVCKECGKAFAVSSRLSRHERIHTGEKPYECKDMSVTI

SEQ ID NO: 100497 - protein, 90 aa, Homo sapiens
  Payload ID: 20025
  Gene Name: zinc finger protein 561
  ENSP ID: ENSP00000370284
MAAIYLSRGFFSREPICPFEEKTKVERMVEDYLASGYQDSVTFDDVAVDFTPEEWALLDTTEKYLYRDVMLENYMNLASVDKRLQWMETL

SEQ ID NO: 100498 - protein, 61 aa, Homo sapiens
  Payload ID: 20025
  Gene Name: zinc finger protein 561
  ENSP ID: ENSP00000391503
MAAIYLSRGFFSREPICPFEEKTKVERMVEDYLASGYQHLSGICSVLRSVLHRHQWDRKSS

SEQ ID NO: 100499 - protein, 287 aa, Homo sapiens
  Payload ID: 20025
  Gene Name: zinc finger protein 561
  ENSP ID: ENSP00000392013
MHIITPSASENGSHLFVPWEPICPFEEKTKVERMVEDYLASGYQDSVTFDDVAVDFTPEEWALLDTTEKYLYRDVMLENYMNLASVEWEIQPRTKRSSLQQGFLKNQIFSGIQMTRGYSGWKLCDCKNCGEVFREQFCLKTHMRVQNGGNTSEGNCYGKDTLSVHKEASTGQELSKFNPCGKVFTLTPGLAVHLEVLNARQPYKCKECGKGFKYFASLDNHMGIHTDEKLCEFQEYGRAVTASSHLKQCVAVHTGKKSKKTKKCGKSFTNFSQLYAPVKTHKGEKSF

SEQ ID NO: 100500 - protein, 417 aa, Homo sapiens
  Payload ID: 20025
  Gene Name: zinc finger protein 561
  ENSP ID: ENSP00000393074
MLENYMNLASVEWEIQPRTKRSSLQQGFLKNQIFSGIQMTRGYSGWKLCDCKNCGEVFREQFCLKTHMRVQNGGNTSEGNCYGKDTLSVHKEASTGQELSKFNPCGKVFTLTPGLAVHLEVLNARQPYKCKECGKGFKYFASLDNHMGIHTDEKLCEFQEYGRAVTASSHLKQCVAVHTGKKSKKTKKCGKSFTNFSQLYAPVKTHKGEKSFECKECGRSFRNSSCLNDHIQIHTGIKPHKCTYCGKAFTRSTQLTEHVRTHTGIKPYECKECGQAFAQYSGLSIHIRSHSGKKPYQCKECGKAFTTSTSLIQHTRIHTGEKPYECVECGKTFITSSRRSKHLKTHSGEKPFVCKICGKAFLYSSRLNVHLRTHTGEKPFVCKECGKAFAVSSRLSRHERIHTGEKPYECKDMSVTI

SEQ ID NO: 100501 - protein, 76 aa, Homo sapiens
  Payload ID: 20025
  Gene Name: zinc finger protein 561
  ENSP ID: ENSP00000397599
MAAIYLSRGFFSREPICPFEEKTKVERMVEDYLASGYQDSVTFDDVAVDFTPEEWALLDTTEKYLYRDVMLENYMN

SEQ ID NO: 100502 - protein, 43 aa, Homo sapiens
  Payload ID: 20025
  Gene Name: zinc finger protein 561
  ENSP ID: ENSP00000402974
MAAIYLSRGFFSREPICPFEEKTKVERMVEDYLASGYQVSAVC

SEQ ID NO: 100503 - protein, 38 aa, Homo sapiens
  Payload ID: 20025
  Gene Name: zinc finger protein 561
  ENSP ID: ENSP00000405257
MAAIYLSRGFFSREPICPFEEKTKVERMVEDYLASGYQ

SEQ ID NO: 100504 - protein, 43 aa, Homo sapiens; identical to SEQ ID NO: 100502
  Payload ID: 20025
  Gene Name: zinc finger protein 561
  ENSP ID: ENSP00000406079

SEQ ID NO: 100505 - protein, 41 aa, Homo sapiens
  Payload ID: 20025
  Gene Name: zinc finger protein 561
  ENSP ID: ENSP00000408053
MAAIYLSRGFFSREPICPFEEKTKVERMVEDYLASGYQDSV

SEQ ID NO: 100506 - protein, 354 aa, Homo sapiens
  Payload ID: 20026
  Gene Name: zinc finger protein 562
  Uniprot ID: Q6V9R5
  ENSP ID: ENSP00000293648
MSAFDMSHDFFFCLTSEWEIQPRTKRSSLQQGFLKNQIFTGIQMQTRSYSGWKLCENCGEVFSEQFCLKTHMRAQNGGNTFEGNCYGKDSISVHKEASIGQELSKFNPCGKVFTLTPGLAVHLEILNGRQPYKCKECGKGFKYFASLDNHMGIHIGEKLCEFQECERAITTSSHLKQCVAVHTGKKSEKTKNCGKSFTNFSQLSAHAKTHKGEKSFECKECGRSFRNSSSFNVHIQIHTGIKPHKCTECGKAFTRSTHLTQHVRTHTGIKPYECKECGQAFTQYTGLAIHIRNHTGEKPYQCKECGKAFNRSSTLTQHRRIHTGEKPYECVECGKTFITSSHRSKHLKTHSGER

SEQ ID NO: 100507 - protein, 426 aa, Homo sapiens
  Payload ID: 20026
  Gene Name: zinc finger protein 562
  Uniprot ID: Q6V9R5
  ENSP ID: ENSP00000410734
MSAFDMSHGFFPREPICPFEEKTKIGTMVEDHRSNSYQDSVTFDDVAVEFTPEEWALLDTTQKYLYRDVMLENYMNLASVDFFFCLTSEWEIQPRTKRSSLQQGFLKNQIFTGIQMQTRSYSGWKLCENCGEVFSEQFCLKTHMRAQNGGNTFEGNCYGKDSISVHKEASIGQELSKFNPCGKVFTLTPGLAVHLEILNGRQPYKCKECGKGFKYFASLDNHMGIHIGEKLCEFQECERAITTSSHLKQCVAVHTGKKSEKTKNCGKSFTNFSQLSAHAKTHKGEKSFECKECGRSFRNSSSFNVHIQIHTGIKPHKCTECGKAFTRSTHLTQHVRTHTGIKPYECKECGQAFTQYTGLAIHIRNHTGEKPYQCKECGKAFNRSSTLTQHRRIHTGEKPYECVECGKTFITSSHRSKHLKTHSGER

SEQ ID NO: 100508 - protein, 425 aa, Homo sapiens
  Payload ID: 20026
  Gene Name: zinc finger protein 562
  ENSP ID: ENSP00000464716
MSAFDMSHGFFPREPICPFEEKTKIGTMVEDHRSNSYQDSVTFDDVAVEFTPEEWALLDTTQKYLYRDVMLENYMNLASVDFFFCLTSEWEIQPRTKRSSLQQGFLKNQIFTGIQMTRSYSGWKLCENCGEVFSEQFCLKTHMRAQNGGNTFEGNCYGKDSISVHKEASIGQELSKFNPCGKVFTLTPGLAVHLEILNGRQPYKCKECGKGFKYFASLDNHMGIHIGEKLCEFQECERAITTSSHLKQCVAVHTGKKSEKTKNCGKSFTNFSQLSAHAKTHKGEKSFECKECGRSFRNSSSFNVHIQIHTGIKPHKCTECGKAFTRSTHLTQHVRTHTGIKPYECKECGQAFTQYTGLAIHIRNHTGEKPYQCKECGKAFNRSSTLTQHRRIHTGEKPYECVECGKTFITSSHRSKHLKTHSGER

SEQ ID NO: 100509 - protein, 116 aa, Homo sapiens
  Payload ID: 20026
  Gene Name: zinc finger protein 562
  ENSP ID: ENSP00000466039
MSAFDMSHGFFPREPICPFEEKTKIGTMVEDHRSNSYQDSVTFDDVAVEFTPEEWALLDTTQKYLYRDVMLENYMNLASVDFFFCLTSEWEIQPRTKRSSLQQGFLKNQIFTGIQM

SEQ ID NO: 100510 - protein, 43 aa, Homo sapiens
  Payload ID: 20026
  Gene Name: zinc finger protein 562
  ENSP ID: ENSP00000466728
MSAFDMSHGFFPREPICPFEEKTKIGTMVEDHRSNSYQISFSA

SEQ ID NO: 100511 - protein, 120 aa, Homo sapiens
  Payload ID: 20026
  Gene Name: zinc finger protein 562
  ENSP ID: ENSP00000466911
MDSVTFDDVAVEFTPEEWALLDTTQKYLYRDVMLENYMNLASVDFFFCLTSEWEIQPRTKRSSLQQGFLKNQIFTGIQMQTRSYSGWKLCENCGEVFSEQFCLKTHMRAQNGGNTFEGNC

SEQ ID NO: 100512 - protein, 91 aa, Homo sapiens
  Payload ID: 20026
  Gene Name: zinc finger protein 562
  ENSP ID: ENSP00000468039
MSAFDMSHGFFPREPICPFEEKTKIGTMVEDHRSNSYQDSVTFDDVAVEFTPEEWALLDTTQKYLYRDVMLENYMNLASVADKKLQWMETL

SEQ ID NO: 100513 - protein, 10 aa, Homo sapiens
  Payload ID: 20026
  Gene Name: zinc finger protein 562
  ENSP ID: ENSP00000468775
MSAFDMSHGF

SEQ ID NO: 100514 - protein, 476 aa, Homo sapiens
  Payload ID: 20027
  Gene Name: zinc finger protein 563
  Uniprot ID: Q8TA94
  ENSP ID: ENSP00000293725
MDAVAFEDVAVNFTQEEWALLGPSQKNLYRYVMQETIRNLDCIRMIWEEQNTEDQYKNPRRNLRCHMVERFSESKDSSQCGETFSLIRDSIVNNSICPGEDPCQSAECEEVIMGHLSLNSHIRVDSGHKPHEYQEYGEKPHTHKQRGKAFSYHHSFQSRGRPHTGKKRYECKECGKTFSSRRNLRRHMVVQGGNRPYKCKLCGKAFFWPSLLRMHERTHTGEKPYECKQCSKAFPFYSSYRRHERMHTGEKPYECKQCSKALPDSSSYIRHERTHTGEKPYTCKQCGKAFSVSSSLRRHETTHSAEKPYECKQCGKTFHHLGSFQIHMKRHTGDRPHKCKICGKGFDRPSLVRYHERIHTGEKPYECKQCGKTLSHSSSFRRHMIMHTGGGPHKCKICGKAFVYPSVCQRHEKSHSGEKPYECKQCGKALSHSSSFRRHMVMHTGDGPNKCKVCGKAFVYPSVCQRHEKTHWRETI

SEQ ID NO: 100515 - protein, 229 aa, Homo sapiens
  Payload ID: 20027
  Gene Name: zinc finger protein 563
  ENSP ID: ENSP00000469879
MDAVAFEDVAVNFTQEEWALLGPSQKNLYRYVMQETIRNLDCIRMIWEEQNTEDQYKNPRRNLRCHMVERFSESKDSSQCGETFSLIRDSIVNNSICPGEDPCQSAECEEVIMGHLSLNSHIRVDSGHKPHEYQEYGEKPHTHKQRGKAFSYHHSFQSRGRPHTGKKRYECKECGKTFSSRRNLRRHMVVQGGNRPYKFPIEDMRECTLGRNRMNVSSVLKPCLIPVPI

SEQ ID NO: 100516 - protein, 194 aa, Homo sapiens
  Payload ID: 20027
  Gene Name: zinc finger protein 563
  ENSP ID: ENSP00000471960
MQETIRNLDCIRMIWEEQNTEDQYKNPRRNLSHIRVDSGHKPHEYQEYGEKPHTHKQRGKAFSYHHSFQSRGRPHTGKKRYECKECGKTFSSRRNLRRHMVVQGGNRPYKCKLCGKAFFWPSLLRMHERTHTGEKPYECKQCSKAFPFYSSYRRHERMHTGEKPYECKQCSKALPDSSSYIRHERTHTGEKPYT

SEQ ID NO: 100517 - protein, 129 aa, Homo sapiens
  Payload ID: 20027
  Gene Name: zinc finger protein 563
  ENSP ID: ENSP00000472052
MQETIRNLDCIRMIWEEQNTEDQYKNPRRNLRCHMVERFSESKDSSQCGETFSLIRDSIVNNSICPGEDPCQSAECEEVIMGHLSLNSHIRVDSGHKPHEYQEYGEKPHTHKQRGKAFSYHHSFQSRGR

SEQ ID NO: 100518 - protein, 553 aa, Homo sapiens
  Payload ID: 20028
  Gene Name: zinc finger protein 564
  Uniprot ID: Q8TBZ8
  ENSP ID: ENSP00000340004
MDSVASEDVAVNFTLEEWALLDPSQKKLYRDVMRETFRNLACVGKKWEDQSIEDWYKNQGRILRNHMEEGLSESKEYDQCGEAFSQILNLNLNKKIPTIVRPCECSLCGKVFMHHSSLSRHIRSHLGHKPYDYQEYGEKPYKCKQCGKAFSSCQSFRRHERTHTGEKPYACPECGKAFISLPSVRRHMIKHTGDGPYKCQECGKAFDRPSLFQIHERTHTGEKPYECQECAKAFISLPSFQRHMIRHTGDGPYKCQECGKAFDRPSLFRIHERTHTGEKPHECKQCGKAFISFTNFQSHMIRHTGDGPYKCKVCGRAFIFPSYVRKHERTHTGEKPYECNKCGKTFSSSSNVRTHERTHTGEKPYECKECGKAFISLPSVRRHMIKHTGDGPYKCQVCGRAFDCPSSFQIHERTHTGEKPYECQVCGKAFISLKRIRKHMILHTGDGPYKCQVCGKAFDCPSSVRTHERTHTGEKPYECKECGKAFNYASSIRIHERTHTGEKPYECKQCGKTFSYSSSFQRHERAHNGDKPYVKNVGKLSFITQPSNTCENE

SEQ ID NO: 100519 - protein, 21 aa, Homo sapiens
  Payload ID: 20028
  Gene Name: zinc finger protein 564
  ENSP ID: ENSP00000408822
MGRDFVVMDNCSVSFHLDFGD

SEQ ID NO: 100520 - protein, 69 aa, Homo sapiens
  Payload ID: 20028
  Gene Name: zinc finger protein 564
  ENSP ID: ENSP00000415828
MTEFRSVAQAGVQWEDLSSLQPSPSGFKQFSCLSLLSNWDYRHAPPRPATFCIFGRNWVSPCWPGLSGL

SEQ ID NO: 100521 - protein, 35 aa, Homo sapiens
  Payload ID: 20028
  Gene Name: zinc finger protein 564
  ENSP ID: ENSP00000470670
MRETFRNLACVGKKWEDQSIEDWYKNQGRILRNHM

SEQ ID NO: 100522 - protein, 499 aa, Homo sapiens
  Payload ID: 20029
  Gene Name: zinc finger protein 565
  Uniprot ID: Q8N9K5
  ENSP ID: ENSP00000306869
MAQGLVTFRDVAIEFSLEEWKCLEPAQRDLYREVTLENFGHLASLGLSISKPDVVSLLEQGKEPWMIANDVTGPWCPDLESRCEKFLQKDIFEIGAFNWEIMESLKCSDLEGSDFRADWECEGQFERQVNEECYFKQVNVTYGHMPVFQHHTSHTVRQSRETGEKLMECHECGKAFSRGSHLIQHQKIHTGEKPFGCKECGKAFSRASHLVQHQRIHTGEKPYDCKDCGKAFGRTSELILHQRLHTGVKPYECKECGKTFRQHSQLILHQRTHTGEKPYVCKDCGKAFIRGSQLTVHRRIHTGARPYECKECGKAFRQHSQLTVHQRIHTGEKPYECKECGKGFIHSSEVTRHQRIHSGEKPYECKECGKAFRQHAQLTRHQRVHTGDRPYECKDCGKAFSRSSYLIQHQRIHTGDKPYECKECGKAFIRVSQLTHHQRIHTCEKPYECRECGMAFIRSSQLTEHQRIHPGIKPYECRECGQAFILGSQLIEHYRIHTG

SEQ ID NO: 100523 - protein, 539 aa, Homo sapiens
  Payload ID: 20029
  Gene Name: zinc finger protein 565
  Uniprot ID: Q8N9K5
  ENSP ID: ENSP00000347234
MRRGPWERWSLASHRLDAGLCTCPREESREIRAGQIVLKAMAQGLVTFRDVAIEFSLEEWKCLEPAQRDLYREVTLENFGHLASLGLSISKPDVVSLLEQGKEPWMIANDVTGPWCPDLESRCEKFLQKDIFEIGAFNWEIMESLKCSDLEGSDFRADWECEGQFERQVNEECYFKQVNVTYGHMPVFQHHTSHTVRQSRETGEKLMECHECGKAFSRGSHLIQHQKIHTGEKPFGCKECGKAFSRASHLVQHQRIHTGEKPYDCKDCGKAFGRTSELILHQRLHTGVKPYECKECGKTFRQHSQLILHQRTHTGEKPYVCKDCGKAFIRGSQLTVHRRIHTGARPYECKECGKAFRQHSQLTVHQRIHTGEKPYECKECGKGFIHSSEVTRHQRIHSGEKPYECKECGKAFRQHAQLTRHQRVHTGDRPYECKDCGKAFSRSSYLIQHQRIHTGDKPYECKECGKAFIRVSQLTHHQRIHTCEKPYECRECGMAFIRSSQLTEHQRIHPGIKPYECRECGQAFILGSQLIEHYRIHTG

SEQ ID NO: 100524 - protein, 499 aa, Homo sapiens; identical to SEQ ID NO: 100522
  Payload ID: 20029
  Gene Name: zinc finger protein 565
  Uniprot ID: Q8N9K5
  ENSP ID: ENSP00000376013

SEQ ID NO: 100525 - protein, 259 aa, Homo sapiens
  Payload ID: 20029
  Gene Name: zinc finger protein 565
  ENSP ID: ENSP00000465906
MIANDVTGPWCPDLESRCEKFLQKDIFEIGAFNWEIMESLKCSDLEGSDFRADWECEGQFERQVNEECYFKQVNVTYGHMPVFQHHTSHTVRQSRETGEKLMECHECGKAFSRGSHLIQHQKIHTGEKPFGCKECGKAFSRASHLVQHQRIHTGEKPYDCKDCGKAFGRTSELILHQRLHTGVKPYECKECGKTFRQHSQLILHQRTHTGEKPYVCKDCGKAFIRGSQLTVHRRIHTGARPYECKECGKAFRQHSQLTV

SEQ ID NO: 100526 - protein, 56 aa, Homo sapiens
  Payload ID: 20029
  Gene Name: zinc finger protein 565
  ENSP ID: ENSP00000468673
MAQGLVTFRDVAIEFSLEEWKCLEPAQRDLYREVTLENFGHLASLGLSISKPDVVS

SEQ ID NO: 100527 - protein, 419 aa, Homo sapiens
  Payload ID: 20030
  Gene Name: zinc finger protein 566
  Uniprot ID: Q969W8
  ENSP ID: ENSP00000376010
MAQESVMFSDVSVDFSQEEWECLNDDQRDLYRDVMLENYSNLVSMAGHSISKPNVISYLEQGKEPWLADRELTRGQWPVLESRCETKKLFLKKEIYEIESTQWEIMEKLTRRDFQCSSFRDDWECNRQFKKELGSQGGHFNQLVFTHEDLPTLSHHPSFTLQQIINSKKKFCASKEYRKTFRHGSQFATHEIIHTIEKPYECKECGKSFRHPSRLTHHQKIHTGKKPFECKECGKTFICGSDLTRHHRIHTGEKPYECKECGKAFSSGSNFTRHQRIHTGEKPYECKECGKAFSSGSNFTQHQRIHTGEKPYECKECGNAFSQSSQLIKHQRIHTGEKPYECKECEKAFRSGSDLTRHQRIHTGEKPYECKICGKAYSQSSQLISHHRIHTSEKPYEYRECGKNFNYDPQLIQHQNLYW

SEQ ID NO: 100528 - protein, 157 aa, Homo sapiens
  Payload ID: 20030
  Gene Name: zinc finger protein 566
  ENSP ID: ENSP00000400651
MAQESVMFSDVSVDFSQEEWECLNDDQRDLYRDVMLENYSNLVSMAGHSISKPNVISYLEQGKEPWLADRELTRGQWPVLESRCETKKLFLKKEIYEIESTQWEIMEKLTRRDFQCSSFRDDWECNRQFKKELGSQGGHFNQLVFTHEDLPTLSHHP

SEQ ID NO: 100529 - protein, 418 aa, Homo sapiens
  Payload ID: 20030
  Gene Name: zinc finger protein 566
  Uniprot ID: Q969W8
  ENSP ID: ENSP00000401259
MAQESVMFSDVSVDFSQEEWECLNDDQRDLYRDVMLENYSNLVSMGHSISKPNVISYLEQGKEPWLADRELTRGQWPVLESRCETKKLFLKKEIYEIESTQWEIMEKLTRRDFQCSSFRDDWECNRQFKKELGSQGGHFNQLVFTHEDLPTLSHHPSFTLQQIINSKKKFCASKEYRKTFRHGSQFATHEIIHTIEKPYECKECGKSFRHPSRLTHHQKIHTGKKPFECKECGKTFICGSDLTRHHRIHTGEKPYECKECGKAFSSGSNFTRHQRIHTGEKPYECKECGKAFSSGSNFTQHQRIHTGEKPYECKECGNAFSQSSQLIKHQRIHTGEKPYECKECEKAFRSGSDLTRHQRIHTGEKPYECKICGKAYSQSSQLISHHRIHTSEKPYEYRECGKNFNYDPQLIQHQNLYW

SEQ ID NO: 100530 - protein, 233 aa, Homo sapiens
  Payload ID: 20030
  Gene Name: zinc finger protein 566
  ENSP ID: ENSP00000411526
MAQESVMFSDVSVDFSQEEWECLNDDQRDLYRDVMLENYSNLVSMGHSISKPNVISYLEQGKEPWLADRELTRGQWPVLESRCETKKLFLKKEIYEIESTQWEIMEKLTRRDFQCSSFRDDWECNRQFKKELGSQGGHFNQLVFTHEDLPTLSHHPSFTLQQIINSKKKFCASKEYRKTFRHGSQFATHEIIHTIEKPYECKECGKSFRHPSRLTHHQKIHTGKKPFECKECG

SEQ ID NO: 100531 - protein, 418 aa, Homo sapiens; identical to SEQ ID NO: 100529
  Payload ID: 20030
  Gene Name: zinc finger protein 566
  Uniprot ID: Q969W8
  ENSP ID: ENSP00000415520

SEQ ID NO: 100532 - protein, 314 aa, Homo sapiens
  Payload ID: 20030
  Gene Name: zinc finger protein 566
  ENSP ID: ENSP00000465343
MEKLTRRDFQCSSFRDDWECNRQFKKELGSQGGHFNQLVFTHEDLPTLSHHPSFTLQQIINSKKKFCASKEYRKTFRHGSQFATHEIIHTIEKPYECKECGKSFRHPSRLTHHQKIHTGKKPFECKECGKTFICGSDLTRHHRIHTGEKPYECKECGKAFSSGSNFTRHQRIHTGEKPYECKECGKAFSSGSNFTQHQRIHTGEKPYECKECGNAFSQSSQLIKHQRIHTGEKPYECKECEKAFRSGSDLTRHQRIHTGEKPYECKICGKAYSQSSQLISHHRIHTSEKPYEYRECGKNFNYDPQLIQHQNLYW

SEQ ID NO: 100533 - protein, 77 aa, Homo sapiens
  Payload ID: 20030
  Gene Name: zinc finger protein 566
  ENSP ID: ENSP00000467764
FECKECGKTFICGSDLTRHHRIHTGEKPYECKECGKAFSSGSNFTRHQRIHTEKWITIHFPEICFFTFNCTFWIFLQ

SEQ ID NO: 100534 - protein, 616 aa, Homo sapiens
  Payload ID: 20031
  Gene Name: zinc finger protein 567
  Uniprot ID: Q8N184
  ENSP ID: ENSP00000353957
MDVMLENYCHLISVGCHMTKPDVILKLERGEEPWTSFAGHTCLEENWKAEDFLVKFKEHQEKYSRSVVSINHKKLVKEKSKIYEKTFTLGKNPVNSKNLPPEYDTHGRILKNVSELIISNLNPARKRLSEYNGYGKSLLSTKQETTHPEVKSHNQSARAFSHNEVLMQYQKTETPAQSFGYNDCEKSFLQRGGLITHSRPYKGENPSVYNKKRRATNIEKKHTCNECGKSFCRKSVLILHQGIHSEEKPYQCHQCGNAFRRKSYLIDHQRTHTGEKPFVCNECGKSFRLKTALTDHQRTHTGEKSYECLQCRNAFRLKSHLIRHQRTHTGEKPYECNDCGKSFRQKTTLSLHQRIHTGEKPYICKECGKSFHQKANLTVHQRTHTGEKPYICNECGKSFSQKTTLALHEKTHNEEKPYICSECGKSFRQKTTLVAHQRTHTGEKSYECPHCGKAFRMKSYLIDHHRTHTGEKPYECNECGKSFSQKTNLNLHQRIHTGEKPYVCNECGKSFRQKATLTVHQKIHTGQKSYECPQCGKAFSRKSYLIHHQRTHTGEKPYKCSECGKCFRQKTNLIVHQRTHTGEKPYVCNECGKSFSYKRNLIVHQRTHKGENIEMQ

SEQ ID NO: 100535 - protein, 647 aa, Homo sapiens
  Payload ID: 20031
  Gene Name: zinc finger protein 567
  Uniprot ID: Q8N184
  ENSP ID: ENSP00000441838
MAQGSVSFNDVTVDFTQEEWQHLDHAQKTLYMDVMLENYCHLISVGCHMTKPDVILKLERGEEPWTSFAGHTCLEENWKAEDFLVKFKEHQEKYSRSVVSINHKKLVKEKSKIYEKTFTLGKNPVNSKNLPPEYDTHGRILKNVSELIISNLNPARKRLSEYNGYGKSLLSTKQETTHPEVKSHNQSARAFSHNEVLMQYQKTETPAQSFGYNDCEKSFLQRGGLITHSRPYKGENPSVYNKKRRATNIEKKHTCNECGKSFCRKSVLILHQGIHSEEKPYQCHQCGNAFRRKSYLIDHQRTHTGEKPFVCNECGKSFRLKTALTDHQRTHTGEKSYECLQCRNAFRLKSHLIRHQRTHTGEKPYECNDCGKSFRQKTTLSLHQRIHTGEKPYICKECGKSFHQKANLTVHQRTHTGEKPYICNECGKSFSQKTTLALHEKTHNEEKPYICSECGKSFRQKTTLVAHQRTHTGEKSYECPHCGKAFRMKSYLIDHHRTHTGEKPYECNECGKSFSQKTNLNLHQRIHTGEKPYVCNECGKSFRQKATLTVHQKIHTGQKSYECPQCGKAFSRKSYLIHHQRTHTGEKPYKCSECGKCFRQKTNLIVHQRTHTGEKPYVCNECGKSFSYKRNLIVHQRTHKGENIEMQ

SEQ ID NO: 100536 - protein, 64 aa, Homo sapiens
  Payload ID: 20031
  Gene Name: zinc finger protein 567
  ENSP ID: ENSP00000466458
HLDHAQKTLYMDVMLENYCHLISVGCHMTKPDVILKLERGEEPWTSFAGHTCLGGEDGLTGCLS

SEQ ID NO: 100537 - protein, 616 aa, Homo sapiens; identical to SEQ ID NO: 100534
  Payload ID: 20031
  Gene Name: zinc finger protein 567
  Uniprot ID: Q8N184
  ENSP ID: ENSP00000467379

SEQ ID NO: 100538 - protein, 592 aa, Homo sapiens
  Payload ID: 20031
  Gene Name: zinc finger protein 567
  ENSP ID: ENSP00000467712
MDVMLENYCHLISVGCHMTKPDVILKLERGEEPWTSFAGHTCLEENWKAEDFLVKFKEHQEKYSRSVVSINHKKLVKEKSKIYEKTFTLGKNPVNSKNLPPEYDTHGRILKNVSELIISNLNPARKRLSEYNGYGKSLLSTKQETTHPEVKSHNQSARAFSHNEVLMQYQKTETPAQSFGYNDCEKSFLQRGGLITHSRPYKGENPSVYNKKRRATNIEKKHTCNECGKSFCRKSVLILHQGIHSEEKPYQCHQCGNAFRRKSYLIDHQRTHTGEKPFVCNECGKSFRLKTALTDHQRTHTGEKSYECLQCRNAFRLKSHLIRHQRTHTGEKPYECNDCGKSFRQKTTLSLHQRIHTGEKPYICKECGKSFHQKANLTVHQRTHTGEKPYICNECGKSFSQKTTLALHEKTHNEEKPYICSECGKSFRQKTTLVAHQRTHTGEKSYECPHCGKAFRMKSYLIDHHRTHTGEKPYECNECGKSFSQKTNLNLHQRIHTGEKPYVCNECGKSFRQKATLTVHQKIHTGQKSYECPQCGKAFSRKSYLIHHQRTHTGEKPYKCSECGKCFRQKTNLIVHQRTHTGGEDGLTGCLS

SEQ ID NO: 100539 - protein, 50 aa, Homo sapiens
  Payload ID: 20031
  Gene Name: zinc finger protein 567
  ENSP ID: ENSP00000468750
LENYCHLISVGCHMTKPDVILKLERGEEPWTSFAGHTCLGGEDGLTGCLS

SEQ ID NO: 100540 - protein, 644 aa, Homo sapiens
  Payload ID: 20032
  Gene Name: zinc finger protein 568
  Uniprot ID: Q3ZCX4
  ENSP ID: ENSP00000334685
MTSQSSVISNSCVTMERLSHMMERKAWCSQESALSEEEEDTTRPLETVTFKDVAVDLTQEEWEQMKPAQRNLYRDVMLENYSNLVTVGCQVTKPDVIFKLEQEEEPWVMEEEMFGRHCPEVWEVDEQIKKQQETLVRKVTSISKKILIKEKVIECKKVAKIFPLSSDIVTSRQSFYDCDSLDKGLEHNLDLLRYEKGCVREKQSNEFGKPFYHCASYVVTPFKCNQCGQDFSHKFDLIRHERIHAGEKPYECKECGKAFSRKENLITHQKIHTGEKPYKCNECGKAFIQMSNLIRHHRIHTGEKPYACKDCWKAFSQKSNLIEHERIHTGEKPYECKECGKSFSQKQNLIEHEKIHTGEKPYACNECGRAFSRMSSVTLHMRSHTGEKPYKCNKCGKAFSQCSVFIIHMRSHTGEKPYVCSECGKAFSQSSSLTVHMRNHTAEKPYECKECGKAFSRKENLITHQKIHTGEKPYECSECGKAFIQMSNLIRHQRIHTGEKPYACTVCGKAFSQKSNLTEHEKIHTGEKPYHCNQCGKAFSQRQNLLEHEKIHTGEKPFKCNECGKAFSRISSLTLHVRSHTGEKPYECNKCGKAFSQCSLLIIHMRSHTGEKPFECNECGKAFSQRASLSIHKRGHTGERHQVY

SEQ ID NO: 100541 - protein, 583 aa, Homo sapiens
  Payload ID: 20032
  Gene Name: zinc finger protein 568
  ENSP ID: ENSP00000389794
MTSQSSVISNSCVTMERLSHMMERKAWCSQESALSEEEEDTTRPLETVTFKDVAVDLTQEEWEQMKPAQRNLYRDVMLENYSNLVTVGCQVTKPDVIFKLEQEEEPWVMEEEMFGRHCPEPRRGENCCASEVMAEGLKFKDVVIYFSQKEWECLHSAQKDLYRDVMLENYGNLVLLGLSDTKPNVISLLEQKKEPWMVKRKETKEWCPDWEFGRETKNLSPKENIYEIRSPQQEKARVIREIRCQVERQQGHQEGHFRPAVIPFTSMQCTAHREYQWLHTGEKSCECRKCKNAFRYQSCPIQHEIIHNKEKEPECGECRKIFNSGSDLIKHQTLHESKKHSENNKCAFNHDSGITQPQSINTGEKPHKCKECGKAFRSSSQISQHQRMHLGEKPYKCRECGKAFPSTAQLNLHQRIHTDEKYYESKACGKAFTRPSHLFRHQRIHTGEKPHKCKECGKAFRYDTQLSLHQIIHTGERRYECRECGKVYSCASQLSLHQRIHTGEKPHECKECGKAFISDSHLIRHQSVHTGEKPCKCKECGKSFRRGSELTRHQRAHTGEKPYECKECEKAFTCSTELVRHQK

SEQ ID NO: 100542 - protein, 580 aa, Homo sapiens
  Payload ID: 20032
  Gene Name: zinc finger protein 568
  Uniprot ID: Q3ZCX4
  ENSP ID: ENSP00000394514
MKPAQRNLYRDVMLENYSNLVTVGCQVTKPDVIFKLEQEEEPWVMEEEMFGRHCPEVWEVDEQIKKQQETLVRKVTSISKKILIKEKVIECKKVAKIFPLSSDIVTSRQSFYDCDSLDKGLEHNLDLLRYEKGCVREKQSNEFGKPFYHCASYVVTPFKCNQCGQDFSHKFDLIRHERIHAGEKPYECKECGKAFSRKENLITHQKIHTGEKPYKCNECGKAFIQMSNLIRHHRIHTGEKPYACKDCWKAFSQKSNLIEHERIHTGEKPYECKECGKSFSQKQNLIEHEKIHTGEKPYACNECGRAFSRMSSVTLHMRSHTGEKPYKCNKCGKAFSQCSVFIIHMRSHTGEKPYVCSECGKAFSQSSSLTVHMRNHTAEKPYECKECGKAFSRKENLITHQKIHTGEKPYECSECGKAFIQMSNLIRHQRIHTGEKPYACTVCGKAFSQKSNLTEHEKIHTGEKPYHCNQCGKAFSQRQNLLEHEKIHTGEKPFKCNECGKAFSRISSLTLHVRSHTGEKPYECNKCGKAFSQCSLLIIHMRSHTGEKPFECNECGKAFSQRASLSIHKRGHTGERHQVY

SEQ ID NO: 100543 - protein, 382 aa, Homo sapiens
  Payload ID: 20032
  Gene Name: zinc finger protein 568
  ENSP ID: ENSP00000399643
MAEGLKFKDVVIYFSQKEWECLHSAQKDLYRDVMLENYGNLVLLGLSDTKPNVISLLEQKKEPWMVKRKETKEWCPDWEFGRETKNLSPKENIYEIRSPQQEKARVIREIRCQVERQQGHQEGHFRPAVIPFTSMQCTAHREYQWLHTGEKSCECRKCKNAFRYQSCPIQHEIIHNKEKEPECGECRKIFNSGSDLIKHQTLHESKKHSENNKCAFNHDSGITQPQSINTGEKPHKCKECGKAFRSSSQISQHQRMHLGEKPYKCRECGKAFPSTAQLNLHQRIHTDEKYYESKACGKAFTRPSHLFRHQRIHTGEKPHKCKECGKAFRYDTQLSLHQIIHTGERRYECRECGKVYSCASQLSLHQRIHTGEKPHECKECGK

SEQ ID NO: 100544 - protein, 171 aa, Homo sapiens
  Payload ID: 20032
  Gene Name: zinc finger protein 568
  ENSP ID: ENSP00000407012
MTSQSSVISNSCVTMERLSHMMERKAWCSQESALSEEEEDTTRPLETVTFKDVAVDLTQEEWEQMKPAQRNLYRDVMLENYSNLVTVGCQVTKPDVIFKLEQEEEPWVMEEEMFGRHCPEPRRGENCCASEVMAEMEFCPCCPGWSAMARSQLTATSASRVEVILLPQPPE

SEQ ID NO: 100545 - protein, 79 aa, Homo sapiens
  Payload ID: 20032
  Gene Name: zinc finger protein 568
  ENSP ID: ENSP00000407153
MVKRKETKEWCPDWEFGRETKNLSPKENIYEIRSPQQEKARVIREIRCQVERQQGHQEGHFRPAVIPFTSMQCTAHREY

SEQ ID NO: 100546 - protein, 571 aa, Homo sapiens
  Payload ID: 20032
  Gene Name: zinc finger protein 568
  Uniprot ID: Q3ZCX4
  ENSP ID: ENSP00000413396
MKPAQRNLYRDVMLENYSNLVTVGCQVTKPDVIFKLEQEEEPWVMEEEMFGRHCPEPRRGENCCASEVMAEGLKFKDVVIYFSQKEWECLHSAQKDLYRDVMLENYGNLVLLGLSDTKPNVISLLEQKKEPWMVKRKETKEWCPDWEFGRETKNLSPKENIYEIRSPQQEKARVIREIRCQVERQQGHQEGHFRPAVIPFTSMQCTAHREYQWLHTGEKSCECRKCKNAFRYQSCPIQHEIIHNKEKEPECGECRKIFNSGSDLIKHQTLHESKKHSENNKCAFNHDSGITQPQSINTGEKPHKCKECGKAFRSSSQISQHQRMHLGEKPYKCRECGKAFPSTAQLNLHQRIHTDEKYYESKACGKAFTRPSHLFRHQRIHTGEKPHKCKECGKAFRYDTQLSLHQIIHTGERRYECRECGKVYSCASQLSLHQRIHTGEKPHECKECGKAFISDSHLIRHQSVHTGEKPCKCKECGKSFRRGSELTRHQRAHTGEKPYECKECEKAFTCSTELVRHQKVHTGERPHKCKECGKAFIRRSELTHHERSHTGEKPYECKECGKPFGGGSELS

SEQ ID NO: 100547 - protein, 39 aa, Homo sapiens
  Payload ID: 20032
  Gene Name: zinc finger protein 568
  ENSP ID: ENSP00000465833
MAEMEFCPCCPGWSAMARSQLTATSASRVEVILLPQPPE

SEQ ID NO: 100548 - protein, 25 aa, Homo sapiens
  Payload ID: 20032
  Gene Name: zinc finger protein 568
  ENSP ID: ENSP00000465977
MAEGLKFKDVVIYFSQKEWECLHSA

SEQ ID NO: 100549 - protein, 58 aa, Homo sapiens
  Payload ID: 20032
  Gene Name: zinc finger protein 568
  ENSP ID: ENSP00000466125
MVKRKETKEWCPDWEFGRETKNLSPKENIYEIRSPQQEKARVIREIRCQVERQQGHQE

SEQ ID NO: 100550 - protein, 530 aa, Homo sapiens
  Payload ID: 20032
  Gene Name: zinc finger protein 568
  ENSP ID: ENSP00000466901
MKPAQRNLYRDVMLENYSNLVTVGCQVTKPDVIFKLEQEEEPWVMEEEMFGRHCPEVWEVDEQIKKQQETLVRKVTSISKKILIKEKVIECKKVAKIFPLSSDIVTSRQSFYDCDSLDKGLEHNLDLLRYEKGCVREKQSNEFGKPFYHCASYVVTPFKCNQCGQDFSHKFDLIRHERIHAGEKPYECKECGKAFSRKENLITHQKIHTGEKPYKCNECGKAFIQMSNLIRHHRIHTGEKPYACKDCWKAFSQKSNLIEHERIHTGEKPYECKECGKSFSQKQNLIEHEKIHTGEKPYACNECGRAFSRMSSVTLHMRSHTGEKPYKCNKCGKAFSQCSVFIIHMRSHTGEKPYVCSECGKAFSQSSSLTVHMRNHTAEKPYECKECGKAFSRKENLITHQKIHTGEKPYECSECGKAFIQMSNLIRHQRIHTGEKPYACTVCGKAFSQKSNLTEHEKIHTGEKPYHCNQCGKAFSQRQNLLEHEKIHTGEKPFKCNECGKAFSRISSLTLHVRSHTGEKPYECNKCGKA

SEQ ID NO: 100551 - protein, 7 aa, Homo sapiens
  Payload ID: 20032
  Gene Name: zinc finger protein 568
  ENSP ID: ENSP00000467578
MKPAQRN

SEQ ID NO: 100552 - protein, 377 aa, Homo sapiens
  Payload ID: 20032
  Gene Name: zinc finger protein 568
  ENSP ID: ENSP00000480246
MKPAQRNLYRDVMLENYSNLVTVGCQVTKPDVIFKLEQEEEPWVMEEEMFGRHCPEVWEVDEQIKKQQETLVRKVTSISKKILIKEKVIECKKVAKIFPLSSDIVTSRQSFYDCDSLDKGLEHNLDLLRYEKGCVREKQSNEFGKPFYHCASYVVTPFKCNQCGQDFSHKFDLIRHERIHAGEKPYECKECGKAFSRKENLITHQKIHTGEKPYKCNECGKAFIQMSNLIRHHRIHTGEKPYACKDCWKAFSQKSNLIEHERIHTGEKPYECKECGKSFSQKQNLIEHEKIHTGEKPYACNECGRAFSRMSSVTLHMRSHTGEKPYKCNKCGKAFSQCSVFIIHMRSHTGEKPYVCSECGKAFSQSSSLTVHAKSYS

SEQ ID NO: 100553 - protein, 644 aa, Homo sapiens; identical to SEQ ID NO: 100540
  Payload ID: 20032
  Gene Name: zinc finger protein 568
  Uniprot ID: Q3ZCX4
  ENSP ID: ENSP00000481819

SEQ ID NO: 100554 - protein, 635 aa, Homo sapiens
  Payload ID: 20032
  Gene Name: zinc finger protein 568
  ENSP ID: ENSP00000482444
MTSQSSVISNSCVTMERLSHMMERKAWCSQESALSEEEEDTTRPLETVTFKDVAVDLTQEEWEQMKPAQRNLYRDVMLENYSNLVTVGCQVTKPDVIFKLEQEEEPWVMEEEMFGRHCPEPRRGENCCASEVMAEGLKFKDVVIYFSQKEWECLHSAQKDLYRDVMLENYGNLVLLGLSDTKPNVISLLEQKKEPWMVKRKETKEWCPDWEFGRETKNLSPKENIYEIRSPQQEKARVIREIRCQVERQQGHQEGHFRPAVIPFTSMQCTAHREYQWLHTGEKSCECRKCKNAFRYQSCPIQHEIIHNKEKEPECGECRKIFNSGSDLIKHQTLHESKKHSENNKCAFNHDSGITQPQSINTGEKPHKCKECGKAFRSSSQISQHQRMHLGEKPYKCRECGKAFPSTAQLNLHQRIHTDEKYYESKACGKAFTRPSHLFRHQRIHTGEKPHKCKECGKAFRYDTQLSLHQIIHTGERRYECRECGKVYSCASQLSLHQRIHTGEKPHECKECGKAFISDSHLIRHQSVHTGEKPCKCKECGKSFRRGSELTRHQRAHTGEKPYECKECEKAFTCSTELVRHQKVHTGERPHKCKECGKAFIRRSELTHHERSHTGEKPYECKECGKPFGGGSELS

SEQ ID NO: 100555 - protein, 686 aa, Homo sapiens
  Payload ID: 20033
  Gene Name: zinc finger protein 569
  Uniprot ID: Q5MCW4
  ENSP ID: ENSP00000325018
MTESQGTVTFKDVAIDFTQEEWKRLDPAQRKLYRNVMLENYNNLITVGYPFTKPDVIFKLEQEEEPWVMEEEVLRRHWQGEIWGVDEHQKNQDRLLRQVEVKFQKTLTEEKGNECQKKFANVFPLNSDFFPSRHNLYEYDLFGKCLEHNFDCHNNVKCLMRKEHCEYNEPVKSYGNSSSHFVITPFKCNHCGKGFNQTLDLIRHLRIHTGEKPYECSNCRKAFSHKEKLIKHYKIHSREQSYKCNECGKAFIKMSNLIRHQRIHTGEKPYACKECEKSFSQKSNLIDHEKIHTGEKPYECNECGKAFSQKQSLIAHQKVHTGEKPYACNECGKAFPRIASLALHMRSHTGEKPYKCDKCGKAFSQFSMLIIHVRIHTGEKPYECNECGKAFSQSSALTVHMRSHTGEKPYECKECRKAFSHKKNFITHQKIHTREKPYECNECGKAFIQMSNLVRHQRIHTGEKPYICKECGKAFSQKSNLIAHEKIHSGEKPYECNECGKAFSQKQNFITHQKVHTGEKPYDCNECGKAFSQIASLTLHLRSHTGEKPYECDKCGKAFSQCSLLNLHMRSHTGEKPYVCNECGKAFSQRTSLIVHMRGHTGEKPYECNKCGKAFSQSSSLTIHIRGHTGEKPFDCSKCGKAFSQISSLTLHMRKHTGEKPYHCIECGKAFSQKSHLVRHQRIHTH

SEQ ID NO: 100556 - protein, 686 aa, Homo sapiens; identical to SEQ ID NO: 100555
  Payload ID: 20033
  Gene Name: zinc finger protein 569
  Uniprot ID: Q5MCW4
  ENSP ID: ENSP00000375992

SEQ ID NO: 100557 - protein, 527 aa, Homo sapiens
  Payload ID: 20033
  Gene Name: zinc finger protein 569
  Uniprot ID: Q5MCW4
  ENSP ID: ENSP00000375993
MRKEHCEYNEPVKSYGNSSSHFVITPFKCNHCGKGFNQTLDLIRHLRIHTGEKPYECSNCRKAFSHKEKLIKHYKIHSREQSYKCNECGKAFIKMSNLIRHQRIHTGEKPYACKECEKSFSQKSNLIDHEKIHTGEKPYECNECGKAFSQKQSLIAHQKVHTGEKPYACNECGKAFPRIASLALHMRSHTGEKPYKCDKCGKAFSQFSMLIIHVRIHTGEKPYECNECGKAFSQSSALTVHMRSHTGEKPYECKECRKAFSHKKNFITHQKIHTREKPYECNECGKAFIQMSNLVRHQRIHTGEKPYICKECGKAFSQKSNLIAHEKIHSGEKPYECNECGKAFSQKQNFITHQKVHTGEKPYDCNECGKAFSQIASLTLHLRSHTGEKPYECDKCGKAFSQCSLLNLHMRSHTGEKPYVCNECGKAFSQRTSLIVHMRGHTGEKPYECNKCGKAFSQSSSLTIHIRGHTGEKPFDCSKCGKAFSQISSLTLHMRKHTGEKPYHCIECGKAFSQKSHLVRHQRIHTH

SEQ ID NO: 100558 - protein, 71 aa, Homo sapiens
  Payload ID: 20033
  Gene Name: zinc finger protein 569
  ENSP ID: ENSP00000464980
MDSARHHISHSTSAGPIPSQKEEEMTESQGTVTFKDVAIDFTQEEWKRLDPAQRKLYRNVMLENYNNLITV

SEQ ID NO: 100559 - protein, 21 aa, Homo sapiens
  Payload ID: 20033
  Gene Name: zinc finger protein 569
  ENSP ID: ENSP00000465577
MTESQEKYGELMSIRKTRTDF

SEQ ID NO: 100560 - protein, 260 aa, Homo sapiens
  Payload ID: 20033
  Gene Name: zinc finger protein 569
  ENSP ID: ENSP00000466221
MDSARHHISHSTSAGPIPSQKEEEMTESQGTVTFKDVAIDFTQEEWKRLDPAQRKLYRNVMLENYNNLITVGYPFTKPDVIFKLEQEEEPWVMEEEVLRRHWQGEIWGVDEHQKNQDRLLRQVEVKFQKTLTEEKGNECQKKFANVFPLNSDFFPSRHNLYEYDLFGKCLEHNFDCHNNVKCLMRKEHCEYNEPVKSYGNSSSHFVITPFKCNHCGKGFNQTLDLIRHLRIHTGEKPYECSNCRKAFSHKEKLIKHYKIH

SEQ ID NO: 100561 - protein, 104 aa, Homo sapiens
  Payload ID: 20033
  Gene Name: zinc finger protein 569
  ENSP ID: ENSP00000467046
MDSARHHISHSTSAGPIPSQKEEEMTESQGTVTFKDVAIDFTQEEWKRLDPAQRKLYRNVMLENYNNLITVGYPFTKPDVIFKLEQEEEPWVMEEEVLRRHWQG

SEQ ID NO: 100562 - protein, 555 aa, Homo sapiens
  Payload ID: 20034
  Gene Name: zinc finger protein 57
  Uniprot ID: Q68EA5
  ENSP ID: ENSP00000303696
MDSVVFEDVAVDFTLEEWALLDSAQRDLYRDVMLETFRNLASVDDGTQFKANGSVSLQDMYGQEKSKEQTIPNFTGNNSCAYTLEKNCEGYGTEDHHKNLRNHMVDRFCTHNEGNQYGEAIHQMPDLTLHKKVSAGEKPYECTKCRTVFTHLSSLKRHVKSHCGRKAPPGEECKQACICPSHLHSHGRTDTEEKPYKCQACGQTFQHPRYLSHHVKTHTAEKTYKCEQCRMAFNGFASFTRHVRTHTKDRPYKCQECGRAFIYPSTFQRHMTTHTGEKPYKCQHCGKAFTYPQAFQRHEKTHTGEKPYECKQCGKTFSWSETLRVHMRIHTGDKLYKCEHCGKAFTSSRSFQGHLRTHTGEKPYECKQCGKAFTWSSTFREHVRIHTQEQLYKCEQCGKAFTSSRSFRGHLRTHTGEKPYECKQCGKTFTWSSTFREHVRIHTQEQLHKCEHCGKAFTSSRAFQGHLRMHTGEKPYECKQCGKTFTWSSTLHNHVRMHTGEKPHKCKQCGMSFKWHSSFRNHLRMHTGQKSHECQSYSKAFSCQVILSKTSESTH

SEQ ID NO: 100563 - protein, 523 aa, Homo sapiens
  Payload ID: 20034
  Gene Name: zinc finger protein 57
  ENSP ID: ENSP00000430223
MLETFRNLASVDDGTQFKANGSVSLQDMYGQEKSKEQTIPNFTGNNSCAYTLEKNCEGYGTEDHHKNLRNHMVDRFCTHNEGNQYGEAIHQMPDLTLHKKVSAGEKPYECTKCRTVFTHLSSLKRHVKSHCGRKAPPGEECKQACICPSHLHSHGRTDTEEKPYKCQACGQTFQHPRYLSHHVKTHTAEKTYKCEQCRMAFNGFASFTRHVRTHTKDRPYKCQECGRAFIYPSTFQRHMTTHTGEKPYKCQHCGKAFTYPQAFQRHEKTHTGEKPYECKQCGKTFSWSETLRVHMRIHTGDKLYKCEHCGKAFTSSRSFQGHLRTHTGEKPYECKQCGKAFTWSSTFREHVRIHTQEQLYKCEQCGKAFTSSRSFRGHLRTHTGEKPYECKQCGKTFTWSSTFREHVRIHTQEQLHKCEHCGKAFTSSRAFQGHLRMHTGEKPYECKQCGKTFTWSSTLHNHVRMHTGEKPHKCKQCGMSFKWHSSFRNHLRMHTGQKSHECQSYSKAFSCQVILSKTSESTH

SEQ ID NO: 100564 - protein, 147 aa, Homo sapiens
  Payload ID: 20034
  Gene Name: zinc finger protein 57
  ENSP ID: ENSP00000430905
MLETFRNLASVDDGTQFKANGSVSLQDMYGQEKSKEQTIPNFTGNNSCAYTLEKNCEGYGTEDHHKNLRNHMVDRFCTHNEGNQYGEAIHQMPDLTLHKKVSAGEKPYECTKCRTVFTHLSSLKRHVKSHCGRKAPPGEECKQACIC

SEQ ID NO: 100565 - protein, 151 aa, Homo sapiens
  Payload ID: 20034
  Gene Name: zinc finger protein 57
  ENSP ID: ENSP00000468191
MLETFRNLASVDDGTQFKANGSVSLQDMYGQEKSKEQTIPNFTGNNSCAYTLEKNCEGYGTEDHHKNLRNHMVDRFCTHNEGNQYGEAIHQMPDLTLHKKVSAGEKPYECTKCRTVFTHLSSLKRHVKSHCGRKAPPGEECKQACICPSHL

SEQ ID NO: 100566 - protein, 557 aa, Homo sapiens [sequence omitted]

SEQ ID NO: 100567 - protein, 536 aa, Homo sapiens
  Payload ID: 20035
  Gene Name: zinc finger protein 570
  Uniprot ID: Q96NI8
  ENSP ID: ENSP00000331540
MAVGLLKAMYQELVTFRDVAVDFSQEEWDCLDSSQRHLYSNVMLENYRILVSLGLCFSKPSVILLLEQGKAPWMVKRELTKGLCSGWEPICETEELTPKQDFYEEHQSQKIIETLTSYNLEYSSLREEWKCEGYFERQPGNQKACFKEEIITHEEPLFDEREQEYKSWGSFHQNPLLCTQKIIPKEEKVHKHDTQKRSFKKNLMAIKPKSVCAEKKLLKCNDCEKVFSQSSSLTLHQRIHTGEKPYKCIECGKAFSQRSNLVQHQRIHTGEKPYECKECRKAFSQNAHLVQHLRVHTGEKPYECKVCRKAFSQFAYLAQHQRVHTGEKPYECIECGKAFSNRSSIAQHQRVHTGEKPYECNVCGKAFSLRAYLTVHQRIHTGERPYECKECGKAFSQNSHLAQHQRIHTGEKPYKCQECRKAFSQIAYLAQHQRVHTGEKPYECIECGKAFSNDSSLTQHQRVHTGEKPYECTVCGKAFSYCGSLAQHQRIHTGERPYECKECKKTFRQHAHLAHHQRIHIGESLSPPNPVNHQVL

SEQ ID NO: 100568 - protein, 86 aa, Homo sapiens
  Payload ID: 20035
  Gene Name: zinc finger protein 570
  ENSP ID: ENSP00000466484
MAVGLLKAMYQELVTFRDVAVDFSQEEWDCLDSSQRHLYSNVMLENYRILVSLGLCFSKPSVILLLEQGKAPWMVKRELTKGLCSG

SEQ ID NO: 100569 - protein, 44 aa, Homo sapiens
  Payload ID: 20035
  Gene Name: zinc finger protein 570
  ENSP ID: ENSP00000467139
MLENYRILVSLGLCFSKPSVILLLEQGKAPWMVKRELTKGLCSG

SEQ ID NO: 100570 - protein, 592 aa, Homo sapiens
  Payload ID: 20035
  Gene Name: zinc finger protein 570
  ENSP ID: ENSP00000467218
MCMYLFFLDFSIVGSGLRSGVWVSGSSSQAICVTPVRVESSEATAISQEKSQEEERMAVGLLKAMYQELVTFRDVAVDFSQEEWDCLDSSQRHLYSNVMLENYRILVSLGLCFSKPSVILLLEQGKAPWMVKRELTKGLCSGWEPICETEELTPKQDFYEEHQSQKIIETLTSYNLEYSSLREEWKCEGYFERQPGNQKACFKEEIITHEEPLFDEREQEYKSWGSFHQNPLLCTQKIIPKEEKVHKHDTQKRSFKKNLMAIKPKSVCAEKKLLKCNDCEKVFSQSSSLTLHQRIHTGEKPYKCIECGKAFSQRSNLVQHQRIHTGEKPYECKECRKAFSQNAHLVQHLRVHTGEKPYECKVCRKAFSQFAYLAQHQRVHTGEKPYECIECGKAFSNRSSIAQHQRVHTGEKPYECNVCGKAFSLRAYLTVHQRIHTGERPYECKECGKAFSQNSHLAQHQRIHTGEKPYKCQECRKAFSQIAYLAQHQRVHTGEKPYECIECGKAFSNDSSLTQHQRVHTGEKPYECTVCGKAFSYCGSLAQHQRIHTGERPYECKECKKTFRQHAHLAHHQRIHIGESLSPPNPVNHQVL

SEQ ID NO: 100571 - protein, 148 aa, Homo sapiens
  Payload ID: 20035
  Gene Name: zinc finger protein 570
  ENSP ID: ENSP00000467246
MAVGLLKAMYQELVTFRDVAVDFSQEEWDCLDSSQRHLYSNVMLENYRILVSLGLCFSKPSVILLLEQGKAPWMVKRELTKGLCSGWEPICETEELTPKQDFYEEHQSQKIIETLTSYNLEYSSLREEWKCEGYFERQPGNQKACFKE

SEQ ID NO: 100572 - protein, 44 aa, Homo sapiens
  Payload ID: 20035
  Gene Name: zinc finger protein 570
  ENSP ID: ENSP00000468034
MCMYLFFLDFSIVSVTVLLDFMTRDRERKVVWPDRLTSKQTWPY

SEQ ID NO: 100573 - protein, 609 aa, Homo sapiens
  Payload ID: 20036
  Gene Name: zinc finger protein 571
  Uniprot ID: Q7Z3V5
  ENSP ID: ENSP00000333660
MPHLLVTFRDVAIDFSQEEWECLDPAQRDLYRDVMLENYSNLISLDLESSCVTKKLSPEKEIYEMESLQWENMGKRINHHLQYNGLGDNMECKGNLEGQEASQEGLYMCVKITCEEKATESHSTSSTFHRIIPTKEKLYKCKECRQGFSYLSCLIQHEENHNIEKCSEVKKHRNTFSKKPSYIQHQRIQTGEKPYECMECGKAFGRTSDLIQHQKIHTNEKPYQCNACGKAFIRGSQLTEHQRVHTGEKPYECKKCGKAFSYCSQYTLHQRIHSGEKPYECKDCGKAFILGSQLTYHQRIHSGEKPYECKECGKAFILGSHLTYHQRVHTGEKPYICKECGKAFLCASQLNEHQRIHTGEKPYECKECGKTFFRGSQLTYHLRVHSGERPYKCKECGKAFISNSNLIQHQRIHTGEKPYKCKECGKAFICGKQLSEHQRIHTGEKPFECKECGKAFIRVAYLTQHEKIHGEKHYECKECGKTFVRATQLTYHQRIHTGEKPYKCKECDKAFIYGSQLSEHQRIHRGEKPYECKQCGKAFIRGSHLTEHLRTHTGEKPYECKECGRAFSRGSELTLHQRIHTGEKPYTCVQCGKDFRCPSQLTQHTRLHN

SEQ ID NO: 100574 - protein, 609 aa, Homo sapiens; identical to SEQ ID NO: 100573
  Payload ID: 20036
  Gene Name: zinc finger protein 571
  Uniprot ID: Q7Z3V5
  ENSP ID: ENSP00000351594

SEQ ID NO: 100575 - protein, 609 aa, Homo sapiens; identical to SEQ ID NO: 100573
  Payload ID: 20036
  Gene Name: zinc finger protein 571
  Uniprot ID: Q7Z3V5
  ENSP ID: ENSP00000392638

SEQ ID NO: 100576 - protein, 84 aa, Homo sapiens
  Payload ID: 20036
  Gene Name: zinc finger protein 571
  ENSP ID: ENSP00000466225
MDLLFQLLVTFRDVAIDFSQEEWECLDPAQRDLYRDVMLENYSNLISLDLESSCVTKKLSPEKEIYEMESLQWENMGKRINHHL

SEQ ID NO: 100577 - protein, 609 aa, Homo sapiens; identical to SEQ ID NO: 100573
  Payload ID: 20036
  Gene Name: zinc finger protein 571
  Uniprot ID: Q7Z3V5
  ENSP ID: ENSP00000467572

SEQ ID NO: 100578 - protein, 142 aa, Homo sapiens
  Payload ID: 20036
  Gene Name: zinc finger protein 571
  ENSP ID: ENSP00000468192
MPHLLVTFRDVAIDFSQEEWECLDPAQRDLYRDVMLENYSNLISLEPARTREEQHNLPVPKAGSVNLAAGFGHSRSQTGCGSSKGAEKGLQNVDFYLCPGNHPDTSCRDTYQFFCPDWTCVTLATYSGGSTRSSFHNSCFSS

SEQ ID NO: 100579 - protein, 529 aa, Homo sapiens
  Payload ID: 20037
  Gene Name: zinc finger protein 572
  Uniprot ID: Q7Z3I7
  ENSP ID: ENSP00000319305
MEQEKKLLVSDSNSFMERESLKSPFTGDTSMNNLETVHHNNSKADKLKEKPSEWSKRHRPQHYKHEDAKEMPLTWVQDEIWCHDSYESDGKSENWGNFIAKEEEKPNHQEWDSGEHTNACVQQNSSFVDRPYKCSECWKSFSNSSHLRTHQRTHSGEKPYKCSECAKCFCNSSHLIQHLRMHTGEKPYQCGECGKSFSNTSHLIIHERTHTGEKPYKCPECGKRFSSSSHLIQHHRSHTGEKPYECSVCGKGFSHSYVLIEHQRTHTGEKPYKCPDCGKSFSQSSSLIRHQRTHTGEKPYKCLECEKSFGCNSTLIKHQRIHTGEKPYQCPECGKNFSRSSNLITHQKMHTGEKSYESSEYEESLGQNCNVIEECRIQLGEKPYRCCECGKSFGLSSHLIRHQRTHTGEKPYRCSECWKTFSQSSTLVIHQRTHTGEKPYKCPDCGESFSQSFNLIRHRRTHIGEKPYKCTSCEKCFSRSAYLSQHRKIHVEKPFESPDVGDFPHEWTWKNCSGEMPFISSFSVSNSSS

SEQ ID NO: 100580 - protein, 607 aa, Homo sapiens
  Payload ID: 20038
  Gene Name: zinc finger protein 573
  Uniprot ID: Q86YE8
  ENSP ID: ENSP00000340171
MESCSVAQAGVQWPDLSSLQPPPPRFKQFSCHSLQVAGITDLDLQCEIISYIEVPTYETDISSTQLQSIYKREKLYECKKCQKKFSSGYQLILHHRFHVIERPYECKECGKNFRSGYQLTLHQRFHTGEKPYECTECGKNFRSGYQLTVHQRFHTGEKTYECRQCGKAFIYASHIVQHERIHTGGKPYECQECGRAFSQGGHLRIHQRVHTGEKPYKCKECGKTFSRRSNLVEHGQFHTDEKPYICEKCGKAFRRGHQLTVHQRVHTGKKPYECKECGKGYTTASYFLLHQRIHKGGKPYECKECKKTFTLYRNLTRHQNIHTGEKLFECKQCGKTYTTGSKLFQHQKTHTGEKPYECKECGKAFSLYGYLKQHQKIHTGMKHFECKECKKTFTLYRNLTRHQNIHTGKKLFECQECGKAYSTGSNLIQHRKTHTGEKPYKCKECGKTFSLHGYLNQHQKIHTGMKPYECKVCRKTFTFYRNLTLHQSIHTDEKPFECKECGKTFRRSSHLTAHQSIHADKKPYECKECGKAFKMYGYLTQHQKIHTGGKPYECKECGKAFSRASNLVQHERIHTGEKPYVCKQCGKTFRYGSALKAHQRIHRSIKV

SEQ ID NO: 100581 - protein, 577 aa, Homo sapiens
  Payload ID: 20038
  Gene Name: zinc finger protein 573
  Uniprot ID: Q86YE8
  ENSP ID: ENSP00000349861
MILREETQFTDLDLQCEIISYIEVPTYETDISSTQLQSIYKREKLYECKKCQKKFSSGYQLILHHRFHVIERPYECKECGKNFRSGYQLTLHQRFHTGEKPYECTECGKNFRSGYQLTVHQRFHTGEKTYECRQCGKAFIYASHIVQHERIHTGGKPYECQECGRAFSQGGHLRIHQRVHTGEKPYKCKECGKTFSRRSNLVEHGQFHTDEKPYICEKCGKAFRRGHQLTVHQRVHTGKKPYECKECGKGYTTASYFLLHQRIHKGGKPYECKECKKTFTLYRNLTRHQNIHTGEKLFECKQCGKTYTTGSKLFQHQKTHTGEKPYECKECGKAFSLYGYLKQHQKIHTGMKHFECKECKKTFTLYRNLTRHQNIHTGKKLFECQECGKAYSTGSNLIQHRKTHTGEKPYKCKECGKTFSLHGYLNQHQKIHTGMKPYECKVCRKTFTFYRNLTLHQSIHTDEKPFECKECGKTFRRSSHLTAHQSIHADKKPYECKECGKAFKMYGYLTQHQKIHTGGKPYECKECGKAFSRASNLVQHERIHTGEKPYVCKQCGKTFRYGSALKAHQRIHRSIKV

SEQ ID NO: 100582 - protein, 141 aa, Homo sapiens
  Payload ID: 20038
  Gene Name: zinc finger protein 573
  ENSP ID: ENSP00000367706
MFPVLEPHQVGLIRSYNSKTMTCELVTFRDVAIDFSRQEWEYLDPNQRDLYRDVMLENYRNLVSLGGHSISKPVVVDLLERGKEPWMILREETQFTDLDLQCEIISYIEVPTYETDISSTQLQSIYKREKLYECKKCQKKF

SEQ ID NO: 100583 - protein, 578 aa, Homo sapiens
  Payload ID: 20038
  Gene Name: zinc finger protein 573
  Uniprot ID: Q86YE8
  ENSP ID: ENSP00000375983
MLENYRNLVSLDLDLQCEIISYIEVPTYETDISSTQLQSIYKREKLYECKKCQKKFSSGYQLILHHRFHVIERPYECKECGKNFRSGYQLTLHQRFHTGEKPYECTECGKNFRSGYQLTVHQRFHTGEKTYECRQCGKAFIYASHIVQHERIHTGGKPYECQECGRAFSQGGHLRIHQRVHTGEKPYKCKECGKTFSRRSNLVEHGQFHTDEKPYICEKCGKAFRRGHQLTVHQRVHTGKKPYECKECGKGYTTASYFLLHQRIHKGGKPYECKECKKTFTLYRNLTRHQNIHTGEKLFECKQCGKTYTTGSKLFQHQKTHTGEKPYECKECGKAFSLYGYLKQHQKIHTGMKHFECKECKKTFTLYRNLTRHQNIHTGKKLFECQECGKAYSTGSNLIQHRKTHTGEKPYKCKECGKTFSLHGYLNQHQKIHTGMKPYECKVCRKTFTFYRNLTLHQSIHTDEKPFECKECGKTFRRSSHLTAHQSIHADKKPYECKECGKAFKMYGYLTQHQKIHTGGKPYECKECGKAFSRASNLVQHERIHTGEKPYVCKQCGKTFRYGSALKAHQRIHRSIKV

SEQ ID NO: 100584 - protein, 665 aa, Homo sapiens
  Payload ID: 20038
  Gene Name: zinc finger protein 573
  Uniprot ID: Q86YE8
  ENSP ID: ENSP00000440464
MFPVLEPHQVGLIRSYNSKTMTCFQELVTFRDVAIDFSRQEWEYLDPNQRDLYRDVMLENYRNLVSLGGHSISKPVVVDLLERGKEPWMILREETQFTDLDLQCEIISYIEVPTYETDISSTQLQSIYKREKLYECKKCQKKFSSGYQLILHHRFHVIERPYECKECGKNFRSGYQLTLHQRFHTGEKPYECTECGKNFRSGYQLTVHQRFHTGEKTYECRQCGKAFIYASHIVQHERIHTGGKPYECQECGRAFSQGGHLRIHQRVHTGEKPYKCKECGKTFSRRSNLVEHGQFHTDEKPYICEKCGKAFRRGHQLTVHQRVHTGKKPYECKECGKGYTTASYFLLHQRIHKGGKPYECKECKKTFTLYRNLTRHQNIHTGEKLFECKQCGKTYTTGSKLFQHQKTHTGEKPYECKECGKAFSLYGYLKQHQKIHTGMKHFECKECKKTFTLYRNLTRHQNIHTGKKLFECQECGKAYSTGSNLIQHRKTHTGEKPYKCKECGKTFSLHGYLNQHQKIHTGMKPYECKVCRKTFTFYRNLTLHQSIHTDEKPFECKECGKTFRRSSHLTAHQSIHADKKPYECKECGKAFKMYGYLTQHQKIHTGGKPYECKECGKAFSRASNLVQHERIHTGEKPYVCKQCGKTFRYGSALKAHQRIHRSIKV

SEQ ID NO: 100585 - protein, 665 aa, Homo sapiens; identical to SEQ ID NO: 100584
  Payload ID: 20038
  Gene Name: zinc finger protein 573
  Uniprot ID: Q86YE8
  ENSP ID: ENSP00000465020

SEQ ID NO: 100586 - protein, 104 aa, Homo sapiens
  Payload ID: 20038
  Gene Name: zinc finger protein 573
  ENSP ID: ENSP00000465148
MFPVLEPHQVGLIRSYNSKTMTCFQELVTFRDVAIDFSRQEWEYLDPNQRDLYRDVMLENYRNLVSLEMRSRSVARVGLKLLVSSDPPTSAFQNAGIIGVSHHA

SEQ ID NO: 100587 - protein, 104 aa, Homo sapiens; identical to SEQ ID NO: 100586
  Payload ID: 20038
  Gene Name: zinc finger protein 573
  ENSP ID: ENSP00000465857

SEQ ID NO: 100588 - protein, 110 aa, Homo sapiens
  Payload ID: 20038
  Gene Name: zinc finger protein 573
  ENSP ID: ENSP00000466316
MFPVLEPHQVGLIRSYNSKTMTCFQELVTFRDVAIDFSRQEWEYLDPNQRDLYRDVMLENYRNLVSLGGHSISKPVVVDLLERGKEPWMILREETQFTEMGVSLGCSAGL

SEQ ID NO: 100589 - protein, 44 aa, Homo sapiens
  Payload ID: 20038
  Gene Name: zinc finger protein 573
  ENSP ID: ENSP00000466356
MFPVLEPHQVGLIRSYNSKTMTCEDIPFLNQLWLIYWSEEKSPG

SEQ ID NO: 100590 - protein, 125 aa, Homo sapiens
  Payload ID: 20038
  Gene Name: zinc finger protein 573
  ENSP ID: ENSP00000467929
MFPVLEPHQVGLIRSYNSKTMTCNWGRPLKFCPTKYMKFQELVTFRDVAIDFSRQEWEYLDPNQRDLYRDVMLENYRNLVSLGGHSISKPVVVDLLERGKEPWMILREETQFTEMGVSLGCSAGL

SEQ ID NO: 100591 - protein, 102 aa, Homo sapiens
  Payload ID: 20038
  Gene Name: zinc finger protein 573
  ENSP ID: ENSP00000468391
MFPVLEPHQVGLIRSYNSKTMTCNWGRPLKFCPTKYMKFQELVTFRDVAIDFSRQEWEYLDPNQRDLYRDVMLENYRNLVSLGGHSISKPVVVDLLERGKEP

SEQ ID NO: 100592 - protein, 986 aa, Homo sapiens
  Payload ID: 20039
  Gene Name: zinc finger protein 574
  ENSP ID: ENSP00000222339
MPRATWANSKERSWAESERGPRDTGNGGSKAERHIQEIETGRGGDRAKAHRRQRMRLRGTERASLGPGRRLGDSRGTDMPGARAQGLAAAMTEESEETVLYIEHRYVCSECNQLYGSLEEVLMHQNSHVPQQHFELVGVADPGVTVATDTASGTGLYQTLVQESQYQCLECGQLLMSPSQLLEHQELHLKMMAPQEAVPAEPSPKAPPLSSSTIHYECVDCKALFASQELWLNHRQTHLRATPTKAPAPVVLGSPVVLGPPVGQARVAVEHSYRKAEEGGEGATVPSAAATTTEVVTEVELLLYKCSECSQLFQLPADFLEHQATHFPAPVPESQEPALQQEVQASSPAEVPVSQPDPLPASDHSYELRNGEAIGRDRRGRRARRNNSGEAGGAATQELFCSACDQLFLSPHQLQQHLRSHREGVFKCPLCSRVFPSPSSLDQHLGDHSSESHFLCVDCGLAFGTEALLLAHRRAHTPNPLHSCPCGKTFVNLTKFLYHRRTHGVGGVPLPTTPVPPEEPVIGFPEPAPAETGEPEAPEPPVSEETSAGPAAPGTYRCLLCSREFGKALQLTRHQRFVHRLERRHKCSICGKMFKKKSHVRNHLRTHTGERPFPCPDCSKPFNSPANLARHRLTHTGERPYRCGDCGKAFTQSSTLRQHRLVHAQHFPYRCQECGVRFHRPYRLLMHRYHHTGEYPYKCRECPRSFLLRRLLEVHQLVVHAGRQPHRCPSCGAAFPSSLRLREHRCAAAAAQAPRRFECGTCGKKVGSAARLQAHEAAHAAAGPGEVLAKEPPAPRAPRATRAPVASPAALGSTATASPAAPARRRGLECSECKKLFSTETSLQVHRRIHTGERPYPCPDCGKAFRQSTHLKDHRRLHTGERPFACEVCGKAFAISMRLAEHRRIHTGERPYSCPDCGKSYRSFSNLWKHRKTHQQQHQAAVRQQLAEAEAAVGLAVMETAVEALPLVEAIEIYPLAEAEGVQISG

SEQ ID NO: 100593 - protein, 896 aa, Homo sapiens
  Payload ID: 20039
  Gene Name: zinc finger protein 574
  Uniprot ID: Q6ZN55
  ENSP ID: ENSP00000351939
MTEESEETVLYIEHRYVCSECNQLYGSLEEVLMHQNSHVPQQHFELVGVADPGVTVATDTASGTGLYQTLVQESQYQCLECGQLLMSPSQLLEHQELHLKMMAPQEAVPAEPSPKAPPLSSSTIHYECVDCKALFASQELWLNHRQTHLRATPTKAPAPVVLGSPVVLGPPVGQARVAVEHSYRKAEEGGEGATVPSAAATTTEVVTEVELLLYKCSECSQLFQLPADFLEHQATHFPAPVPESQEPALQQEVQASSPAEVPVSQPDPLPASDHSYELRNGEAIGRDRRGRRARRNNSGEAGGAATQELFCSACDQLFLSPHQLQQHLRSHREGVFKCPLCSRVFPSPSSLDQHLGDHSSESHFLCVDCGLAFGTEALLLAHRRAHTPNPLHSCPCGKTFVNLTKFLYHRRTHGVGGVPLPTTPVPPEEPVIGFPEPAPAETGEPEAPEPPVSEETSAGPAAPGTYRCLLCSREFGKALQLTRHQRFVHRLERRHKCSICGKMFKKKSHVRNHLRTHTGERPFPCPDCSKPFNSPANLARHRLTHTGERPYRCGDCGKAFTQSSTLRQHRLVHAQHFPYRCQECGVRFHRPYRLLMHRYHHTGEYPYKCRECPRSFLLRRLLEVHQLVVHAGRQPHRCPSCGAAFPSSLRLREHRCAAAAAQAPRRFECGTCGKKVGSAARLQAHEAAHAAAGPGEVLAKEPPAPRAPRATRAPVASPAALGSTATASPAAPARRRGLECSECKKLFSTETSLQVHRRIHTGERPYPCPDCGKAFRQSTHLKDHRRLHTGERPFACEVCGKAFAISMRLAEHRRIHTGERPYSCPDCGKSYRSFSNLWKHRKTHQQQHQAAVRQQLAEAEAAVGLAVMETAVEALPLVEAIEIYPLAEAEGVQISG

SEQ ID NO: 100594 - protein, 896 aa, Homo sapiens; identical to SEQ ID NO: 100593
  Payload ID: 20039
  Gene Name: zinc finger protein 574
  Uniprot ID: Q6ZN55
  ENSP ID: ENSP00000469029

SEQ ID NO: 100595 - protein, 125 aa, Homo sapiens
  Payload ID: 20039
  Gene Name: zinc finger protein 574
  ENSP ID: ENSP00000471611
MTEESEETVLYIEHRYVCSECNQLYGSLEEVLMHQNSHVPQQHFELVGVADPGVTVATDTASGTGLYQTLVQESQYQCLECGQLLMSPSQLLEHQELHLKMMAPQEAVPAEPSPKAPPLSSSTIH

SEQ ID NO: 100596 - protein, 544 aa, Homo sapiens
  Payload ID: 20039
  Gene Name: zinc finger protein 574
  ENSP ID: ENSP00000478729
MSMWEDLCQPYQVPLSPAYSWGRGCPLPTTPVPPEEPVIGFPEPAPAETGEPEAPEPPVSEETSAGPAAPGTYRCLLCSREFGKALQLTRHQRFVHRLERRHKCSICGKMFKKKSHVRNHLRTHTGERPFPCPDCSKPFNSPANLARHRLTHTGERPYRCGDCGKAFTQSSTLRQHRLVHAQHFPYRCQECGVRFHRPYRLLMHRYHHTGEYPYKCRECPRSFLLRRLLEVHQLVVHAGRQPHRCPSCGAAFPSSLRLREHRCAAAAAQAPRRFECGTCGKKVGSAARLQAHEAAHAAAGPGEVLAKEPPAPRAPRATRAPVASPAALGSTATASPAAPARRRGLECSECKKLFSTETSLQVHRRIHTGERPYPCPDCGKAFRQSTHLKDTGACTQVSGPLPVKCVARPLPSPCAWQNIAASTQANDPTPALTVARATAPSPTSGSTARPISSSIRQLCGSSWQRRRLPLAWPSWRLLWRRYPWWKPLRSTLWPRLRGSRSVADSARLPLWHLHSLLLKALQHPLKHLYILCPFLFPSPPPCKF

SEQ ID NO: 100597 - protein, 245 aa, Homo sapiens
  Payload ID: 20040
  Gene Name: zinc finger protein 575
  Uniprot ID: Q86XF7
  ENSP ID: ENSP00000315870
MLERGAESAAGATDPSPTGKEPVTKEAPHQGPPQKPSQSAPGPTASAGSPPRPRRRPPPQRPHRCPDCDKAFSYPSKLATHRLAHGGARPHPCPDCPKAFSYPSKLAAHRLTHSGARPHPCPHCPKSFGHRSKLAAHLWTHAPTRPYPCPDCPKSFCYPSKLAAHRHTHHATDARPYPCPHCPKAFSFPSKLAAHRLCHDPPTAPGSQATAWHRCSSCGQAFGQRRLLLLHQRSHHQVEHKGERD

SEQ ID NO: 100598 - protein, 344 aa, Homo sapiens
  Payload ID: 20040
  Gene Name: zinc finger protein 575
  ENSP ID: ENSP00000413956
MSLVPGLTSIEQPQPQLLDQLGIPRRCFQDWVDQNGLPGLSVTQQIRGITLLRRLECSNTIIAHCRHELLGPPTLSPSAWSSPASPPPRALPLGSCASKMLERGAESAAGATDPSPTGKEPVTKEAPHQGPPQKPSQSAPGPTASAGSPPRPRRRPPPQRPHRCPDCDKAFSYPSKLATHRLAHGGARPHPCPDCPKAFSYPSKLAAHRLTHSGARPHPCPHCPKSFGHRSKLAAHLWTHAPTRPYPCPDCPKSFCYPSKLAAHRHTHHATDARPYPCPHCPKAFSFPSKLAAHRLCHDPPTAPGSQATAWHRCSSCGQAFGQRRLLLLHQRSHHQVEHKGERD

SEQ ID NO: 100599 - protein, 101 aa, Homo sapiens
  Payload ID: 20040
  Gene Name: zinc finger protein 575
  ENSP ID: ENSP00000471083
MLERGAESAAGATDPSPTGKEPVTKEAPHQGPPQKPSQSAPGPTASAGSPPRPRRRPPPQRPHRCPDCDKAFSYPSKLATHRLAHGGARPHPCPDCPKAFS

SEQ ID NO: 100600 - protein, 245 aa, Homo sapiens; identical to SEQ ID NO: 100597
  Payload ID: 20040
  Gene Name: zinc finger protein 575
  Uniprot ID: Q86XF7
  ENSP ID: ENSP00000472578

SEQ ID NO: 100601 - protein, 170 aa, Homo sapiens
  Payload ID: 20041
  Gene Name: zinc finger protein 576
  Uniprot ID: Q9H609
  ENSP ID: ENSP00000337852
MEDPNPEENMKQQDSPKERSPQSPGGNICHLGAPKCTRCLITFADSKFQERHMKREHPADFVAQKLQGVLFICFTCARSFPSSKALITHQRSHGPAAKPTLPVATTTAQPTFPCPDCGKTFGQAVSLRRHRQMHEVRAPPGTFACTECGQDFAQEAGLHQHYIRHARGEL

SEQ ID NO: 100602 - protein, 170 aa, Homo sapiens; identical to SEQ ID NO: 100601
  Payload ID: 20041
  Gene Name: zinc finger protein 576
  Uniprot ID: Q9H609
  ENSP ID: ENSP00000375827

SEQ ID NO: 100603 - protein, 170 aa, Homo sapiens; identical to SEQ ID NO: 100601
  Payload ID: 20041
  Gene Name: zinc finger protein 576
  Uniprot ID: Q9H609
  ENSP ID: ENSP00000435463

SEQ ID NO: 100604 - protein, 170 aa, Homo sapiens; identical to SEQ ID NO: 100601
  Payload ID: 20041
  Gene Name: zinc finger protein 576
  Uniprot ID: Q9H609
  ENSP ID: ENSP00000435899

SEQ ID NO: 100605 - protein, 170 aa, Homo sapiens; identical to SEQ ID NO: 100601
  Payload ID: 20041
  Gene Name: zinc finger protein 576
  Uniprot ID: Q9H609
  ENSP ID: ENSP00000435934

SEQ ID NO: 100606 - protein, 170 aa, Homo sapiens; identical to SEQ ID NO: 100601
  Payload ID: 20041
  Gene Name: zinc finger protein 576
  Uniprot ID: Q9H609
  ENSP ID: ENSP00000436182

SEQ ID NO: 100607 - protein, 485 aa, Homo sapiens
  Payload ID: 20042
  Gene Name: zinc finger protein 577
  Uniprot ID: Q9BSK1
  ENSP ID: ENSP00000301399
MKNATIVMSVRREQGSSSGEGSLSFEDVAVGFTREEWQFLDQSQKVLYKEVMLENYINLVSIGYRGTKPDSLFKLEQGEPPGIAEGAAHSQICPGFVIQSRRYAGKDSDAFGGYGRSCLHIKRDKTLTGVKYHRCVKPSSPKSQLNDLQKICAGGKPHECSVCGRAFSRKAQLIQHQRTERGEKPHGCGECGKTFMRKIQLTEHQRTHTGEKPHECSECGKAFSRKSQLMVHQRTHTGEKPYRCSKCGKAFSRKCRLNRHQRSHTGEKLYGCSVCGKAFSQKAYLTAHQRLHTGDKPYKCSDCGRTFYFKSDLTRHQRIHTGEKPYECSECEKAFRSKSKLIQHQRTHTGERPYSCRECGKAFAHMSVLIKHEKTHIRETAINSLTVEKPSSRSHTSLYMSELIQEQKTVNTVPIEMPSSGTPPLLNKSERLVGRNVVIVEQPFPRNQAFVVNQEFEQRISLTNEVNVAPSVINYILYLTDIVSE

SEQ ID NO: 100608 - protein, 426 aa, Homo sapiens
  Payload ID: 20042
  Gene Name: zinc finger protein 577
  Uniprot ID: Q9BSK1
  ENSP ID: ENSP00000389652
MKNATIVMSVRREQGSSSGEGSLSFEDVAVGFTREEWQFLDQSQKVLYKEVMLENYINLVSIGYRGTKPDSLFKLEQGEPPGIAEGAAHSQICPGGKPHECSVCGRAFSRKAQLIQHQRTERGEKPHGCGECGKTFMRKIQLTEHQRTHTGEKPHECSECGKAFSRKSQLMVHQRTHTGEKPYRCSKCGKAFSRKCRLNRHQRSHTGEKLYGCSVCGKAFSQKAYLTAHQRLHTGDKPYKCSDCGRTFYFKSDLTRHQRIHTGEKPYECSECEKAFRSKSKLIQHQRTHTGERPYSCRECGKAFAHMSVLIKHEKTHIRETAINSLTVEKPSSRSHTSLYMSELIQEQKTVNTVPIEMPSSGTPPLLNKSERLVGRNVVIVEQPFPRNQAFVVNQEFEQRISLTNEVNVAPSVINYILYLTDIVSE

SEQ ID NO: 100609 - protein, 111 aa, Homo sapiens
  Payload ID: 20042
  Gene Name: zinc finger protein 577
  ENSP ID: ENSP00000394828
MKNATIVMSVRREQGSSSGEGSLSFEDVAVGFTREEWQFLDQSQKVLYKEVMLENYINLVSIGYRGTKPDSLFKLEQGEPPGIAEGAAHSQICPGYSFRRRTLQMEGMQES

SEQ ID NO: 100610 - protein, 480 aa, Homo sapiens
  Payload ID: 20042
  Gene Name: zinc finger protein 577
  ENSP ID: ENSP00000404509
MKNATIVMSVRREQGSSSGEGSLSFEDVAVGFTREEWQFLDQSQKVLYKEVMLENYINLVSIGYRGTKPDSLFKLEQGEPPGIAEGAAHSQICPGFVIQSRRYAGKDSDAFGGYGRSCLHIKRDKTLTGVKYHRCVKPSSPKSQLNDLQKICAGGKPHECSVCGRAFSRKAQLIQHQRTERGEKPHGCGECGKTFMRKIQLTEHQRTHTGEKPHECSECGKAFSRKSQLMVHQRTHTGEKPYRCSKCGKAFSRKCRLNRHQRSHTGEKLYGCSVCGKAFSQKAYLTAHQRLHTGDKPYKCSDCGRTFYFKSDLTRHQRIHTGEKPYECSECEKAFRSKSKLIQHQRTHTGERPYSCRECGKAFAHMSVLIKHEKTHIRETAINSLTVEKPSSRSHTSLYMSELIQEQKTVNTVPIEMPSSGTPPLLNKSERLVGRNVVIVEQPFPRNQAFVVNQEFEQRISLTNEVNVAPSVINYILYLT

SEQ ID NO: 100611 - protein, 44 aa, Homo sapiens
  Payload ID: 20042
  Gene Name: zinc finger protein 577
  ENSP ID: ENSP00000407476
MKNATIVMSVRREQGSSSGEGSLSFEDVAVGFTREEWQFLDQSQ

SEQ ID NO: 100612 - protein, 426 aa, Homo sapiens; identical to SEQ ID NO: 100608
  Payload ID: 20042
  Gene Name: zinc finger protein 577
  Uniprot ID: Q9BSK1
  ENSP ID: ENSP00000413476

SEQ ID NO: 100613 - protein, 62 aa, Homo sapiens
  Payload ID: 20042
  Gene Name: zinc finger protein 577
  ENSP ID: ENSP00000413560
MKNATIVMSVRREQGSSSGEGSLSFEDVAVGFTREEWQFLDQSQKVLYKEVMLENYINLVSI

SEQ ID NO: 100614 - protein, 58 aa, Homo sapiens
  Payload ID: 20042
  Gene Name: zinc finger protein 577
  ENSP ID: ENSP00000415307
MKNATIVMSVRREQGSSSGEGSLSFEDVAVGFTREEWQFLDQSQKVLYKEVMLENYIN

SEQ ID NO: 100615 - protein, 59 aa, Homo sapiens
  Payload ID: 20042
  Gene Name: zinc finger protein 577
  ENSP ID: ENSP00000467321
MKNATIVMSVRREQGSSSGEGSLSFEDVAVGFTREEWQFLDQSQKVLYKEVMLENYINL

SEQ ID NO: 100616 - protein, 14 aa, Homo sapiens
  Payload ID: 20042
  Gene Name: zinc finger protein 577
  ENSP ID: ENSP00000467575
MKNATIVMSVRREQ

SEQ ID NO: 100617 - protein, 590 aa, Homo sapiens
  Payload ID: 20043
  Gene Name: zinc finger protein 578
  Uniprot ID: Q96N58
  ENSP ID: ENSP00000459216
MLHEEAAQKRKGKEPGMALPQGRLTFRDVAIEFSLAEWKFLNPAQRALYREVMLENYRNLEAVDISSKRMMKEVLSTGQGNTEVIHTGMLQRHESYHTGDFCFQEIEKDIHDFEFQSQKDERNGHEASMPKIKELMGSTDRHDQRHAGNKPIKDQLGLSFHLHLPELHIFQPEEKIANQVEKSVNDASSISTSQRISCRPETHTPNNYGNNFFHSSLLTQKQEVHMREKSFQCNETGEAFNCSSFVRKHQIIHLGEKQYKFDICGKVFNEKRYLARHRRCHTSEKPYKCNECGKSFSYKSSLTCHRRCHTGEKPYKCNECGKSFSYKSSLTCHHRCHTGEKPYKCNECGKSFSYKSSLRCHRRLHTGIKPYKCNECGKMFGQNSTLVIHKAIHTGEKPYKCNECGKAFNQQSHLSRHHRLHTGEKPYKCNDCGKAFIHQSSLARHHRLHTGEKSYKCEECDRVFSQKSNLERHKIIHTGEKPYKCNECHKTFSHRSSLPCHRRLHSGEKPYKCNECGKTFNVQSHLSRHHRLHTGEKPYKCKVCDKAFMCHSYLANHTRIHSGEKPYKCNECGKAHNHLIDSSIKPCMSS

SEQ ID NO: 100618 - protein, 253 aa, Homo sapiens
  Payload ID: 20043
  Gene Name: zinc finger protein 578
  ENSP ID: ENSP00000470790
MLHEEAAQKRKGKEPGMALPQGRLTFRDVAIEFSLAEWKFLNPAQRALYREVMLENYRNLEAVDISSKRMMKEVLSTGQGNTEVIHTGMLQRHESYHTGDFCFQEIEKDIHDFEFQSQKDERNGHEASMPKIKELMGSTDRHDQRHAGNKPIKDQLGLSFHLHLPELHIFQPEEKIANQVEKSVNDASSISTSQRISCRPETHTPNNYGNNFFHSSLLTQKQEVHMREKSFQCNETGEAFNCSSFVRKHQIIH

SEQ ID NO: 100619 - protein, 562 aa, Homo sapiens
  Payload ID: 20044
  Gene Name: zinc finger protein 579
  Uniprot ID: Q8NAF0
  ENSP ID: ENSP00000320188
MDPQPPPPAQGSPPHRGRGRGRGRGRGRGRGRGRGGAGAPRAPLPCPTCGRLFRFPYYLSRHRLSHSGLRPHACPLCPKAFRRPAHLSRHLRGHGPQPPLRCAACPRTFPEPAQLRRHLAQEHAGGEVELAIERVAKETAEPSWGPQDEGSEPPTTAAAGATEEEAVAAWPETWPAGEPSTLAAPTSAAEPRESESEEAEAGAAELRAELALAAGRQEEKQVLLQADWTLLCLRCREAFATKGELKAHPCLRPEGEQEGEGGPPPRPKRHQCSICLKAFARPWSLSRHRLVHSTDRPFVCPDCGLAFRLASYLRQHRRVHGPLSLLAPLPAAGKKDDKASGARNSAKGPEGGEGAECGGASEGGEGQNGGDAAPARPPAGEPRFWCPECGKGFRRRAHLRQHGVTHSGARPFQCVRCQREFKRLADLARHAQVHAGGPAPHPCPRCPRRFSRAYSLLRHQRCHRAELERAAALQALQAQAPTSPPPPPPPLKAEQEEEGLPLPLANIKEEPPSPGTPPQSPPAPPVFLSASCFDSQDHSAFEMEEEEVDSKAHLRGLGGLAS

SEQ ID NO: 100620 - protein, 15 aa, Homo sapiens
  Payload ID: 20044
  Gene Name: zinc finger protein 579
  ENSP ID: ENSP00000465146
MDPQPPPPAQGSPPH

SEQ ID NO: 100621 - protein, 172 aa, Homo sapiens
  Payload ID: 20045
  Gene Name: zinc finger protein 580
  Uniprot ID: Q9UK33
  ENSP ID: ENSP00000320050
MLLLPPRPPHPRSSSPEAMDPPPPKAPPFPKAEGPSSTPSSAAGPRPPRLGRHLLIDANGVPYTYTVQLEEEPRGPPQREAPPGEPGPRKGYSCPECARVFASPLRLQSHRVSHSDLKPFTCGACGKAFKRSSHLSRHRATHRARAGPPHTCPLCPRRFQDAAELAQHVRLH

SEQ ID NO: 100622 - protein, 172 aa, Homo sapiens; identical to SEQ ID NO: 100621
  Payload ID: 20045
  Gene Name: zinc finger protein 580
  Uniprot ID: Q9UK33
  ENSP ID: ENSP00000443957

SEQ ID NO: 100623 - protein, 172 aa, Homo sapiens; identical to SEQ ID NO: 100621
  Payload ID: 20045
  Gene Name: zinc finger protein 580
  Uniprot ID: Q9UK33
  ENSP ID: ENSP00000446126

SEQ ID NO: 100624 - protein, 22 aa, Homo sapiens
  Payload ID: 20045
  Gene Name: zinc finger protein 580
  ENSP ID: ENSP00000465028
MLLLPPRPPHPRSSSPEAMDPP

SEQ ID NO: 100625 - protein, 104 aa, Homo sapiens
  Payload ID: 20045
  Gene Name: zinc finger protein 580
  ENSP ID: ENSP00000467142
MLLLPPRPPHPRSSSPEAMDPPPPKAPPFPKAEGPSSTPSSAAGPRPPRLGRHLLIDANGVPYTYTVQLEEEPRGPPQREAPPGEPGPRKGYSCPECARVFASP

SEQ ID NO: 100626 - protein, 103 aa, Homo sapiens
  Payload ID: 20045
  Gene Name: zinc finger protein 580
  ENSP ID: ENSP00000468407
MLLLPPRPPHPRSSSPEAMDPPPPKAPPFPKAEGPSSTPSSAAGPRPPRLGRHLLIDANGVPYTYTVQLEEEPRGPPQREAPPGEPGPRKGYSCPECARVFAS

SEQ ID NO: 100627 - protein, 197 aa, Homo sapiens
  Payload ID: 20046
  Gene Name: zinc finger protein 581
  Uniprot ID: Q9P0T4
  ENSP ID: ENSP00000270451
MLVLPSPCPQPLAFSSVETMEGPPRRTCRSPEPGPSSSIGSPQASSPPRPNHYLLIDTQGVPYTVLVDEESQREPGASGAPGQKKCYSCPVCSRVFEYMSYLQRHSITHSEVKPFECDICGKAFKRASHLARHHSIHLAGGGRPHGCPLCPRRFRDAGELAQHSRVHSGERPFQCPHCPRRFMEQNTLQKHTRWKHP

SEQ ID NO: 100628 - protein, 197 aa, Homo sapiens; identical to SEQ ID NO: 100627
  Payload ID: 20046
  Gene Name: zinc finger protein 581
  Uniprot ID: Q9P0T4
  ENSP ID: ENSP00000466047

SEQ ID NO: 100629 - protein, 139 aa, Homo sapiens
  Payload ID: 20046
  Gene Name: zinc finger protein 581
  ENSP ID: ENSP00000466338
MLVLPSPCPQPLAFSSVETMEGPPRRTCRSPEPGPSSSIGSPQASSPPRPNHYLLIDTQGVPYTVLVDEESQREPGASGAPGQKKCYSCPVCSRVFEYMSYLQRHSITHSEVKPFECDICGKAFKRASHLARHHSIHLA

SEQ ID NO: 100630 - protein, 197 aa, Homo sapiens; identical to SEQ ID NO: 100627
  Payload ID: 20046
  Gene Name: zinc finger protein 581
  Uniprot ID: Q9P0T4
  ENSP ID: ENSP00000466564

SEQ ID NO: 100631 - protein, 517 aa, Homo sapiens
  Payload ID: 20047
  Gene Name: zinc finger protein 582
  Uniprot ID: Q96NG8
  ENSP ID: ENSP00000301310
MSLGSELFRDVAIVFSQEEWQWLAPAQRDLYRDVMLETYSNLVSLGLAVSKPDVISFLEQGKEPWMVERVVSGGLCPVLESRYDTKELFPKQHVYEVESPQWEIMESLTSYGLECSSFQDDWECRNQFDRQQGNPDRHFHQMIIRHEEMPTFDQHASLTFYQKIHTREKPFGYNKCRKDFWQKELLINHQGIYTNEKPYKCKECGKAFKYGSRLIQHENIHSGKKPYECKECGKAFNSGSNFIQHQRVHTGEKPYECKDCEKAFSRSSQLIEHQRTHTGEKPYQCKECGKAFNRISHLKVHYRIHTGEKPYACKECGKTFSHRSQLIQHQTVHTGRKLYECKECGKAFNQGSTLIRHQRIHTGEKPYECKVCGKAFRVSSQLKQHQRIHTGEKPYQCKVCGRAFKRVSHLTVHYRIHTGEKPYECKECGKAFSHCSQLIHHQVIHTEKKPYEYKECEKTLSHDSTTVQPQRMHNRETHVNIINVEKPSISSYPLLIIREFMLASNHMNGSNGESPLA

SEQ ID NO: 100632 - protein, 517 aa, Homo sapiens; identical to SEQ ID NO: 100631
  Payload ID: 20047
  Gene Name: zinc finger protein 582
  Uniprot ID: Q96NG8
  ENSP ID: ENSP00000465619

SEQ ID NO: 100633 - protein, 78 aa, Homo sapiens
  Payload ID: 20047
  Gene Name: zinc finger protein 582
  ENSP ID: ENSP00000465639
MSLGSELFRDVAIVFSQEEWQWLAPAQRDLYRDVMLETYSNLVSLGLAVSKPDVISFLEQGKEPWMVERVVSGGLCPG

SEQ ID NO: 100634 - protein, 178 aa, Homo sapiens
  Payload ID: 20047
  Gene Name: zinc finger protein 582
  ENSP ID: ENSP00000466452
MSLGSELFRDVAIVFSQEEWQWLAPAQRDLYRDVMLETYSNLVSLGLAVSKPDVISFLEQGKEPWMVERVVSGGLCPVLESRYDTKELFPKQHVYEVESPQWEIMESLTSYGLECSSFQDDWECRNQFDRQQGNPDRHFHQMIIRHEEMPTFDQHASLTFYQKIHTREKPFGYNKCRK

SEQ ID NO: 100635 - protein, 181 aa, Homo sapiens
  Payload ID: 20047
  Gene Name: zinc finger protein 582
  ENSP ID: ENSP00000466875
MSLGSELFRDVAIVFSQEEWQWLAPAQRDLYRDVMLETYSNLVSLGLAVSKPDVISFLEQGKEPWMVERVVSGGLCPVLESRYDTKELFPKQHVYEVESPQWEIMESLTSYGLECSSFQDDWECRNQFDRQQGNPDRHFHQMIIRHEEMPTFDQHASLTFYQKIHTREKPFGYNKCRKDFW

SEQ ID NO: 100636 - protein, 103 aa, Homo sapiens
  Payload ID: 20047
  Gene Name: zinc finger protein 582
  ENSP ID: ENSP00000468679
MSLGSELFRDVAIVFSQEEWQWLAPAQRDLYRDVMLETYSNLVSLGLAVSKPDVISFLEQGKEPWMVERVVSGGLCPGAKGQRGRDAGCACCKRTEQNPGQLW

SEQ ID NO: 100637 - protein, 517 aa, Homo sapiens; identical to SEQ ID NO: 100631
  Payload ID: 20047
  Gene Name: zinc finger protein 582
  Uniprot ID: Q96NG8
  ENSP ID: ENSP00000483414

SEQ ID NO: 100638 - protein, 569 aa, Homo sapiens
  Payload ID: 20048
  Gene Name: zinc finger protein 583
  Uniprot ID: Q96ND8
  ENSP ID: ENSP00000291598
MSKDLVTFGDVAVNFSQEEWEWLNPAQRNLYRKVMLENYRSLVSLGVSVSKPDVISLLEQGKEPWMVKKEGTRGPCPDWEYVFKNSEFSSKQETYEESSKVVTVGARHLSYSLDYPSLREDCQSEDWYKNQLGSQEVHLSQLIITHKEILPEVQNKEYNKSWQTFHQDTIFDIQQSFPTKEKAHKHEPQKKSYRKKSVEMKHRKVYVEKKLLKCNDCEKVFNQSSSLTLHQRIHTGEKPYACVECGKTFSQSANLAQHKRIHTGEKPYECKECRKAFSQNAHLAQHQRVHTGEKPYQCKECKKAFSQIAHLTQHQRVHTGERPFECIECGKAFSNGSFLAQHQRIHTGEKPYVCNVCGKAFSHRGYLIVHQRIHTGERPYECKECRKAFSQYAHLAQHQRVHTGEKPYECKVCRKAFSQIAYLDQHQRVHTGEKPYECIECGKAFSNSSSLAQHQRSHTGEKPYMCKECRKTFSQNAGLAQHQRIHTGEKPYECNVCGKAFSYSGSLTLHQRIHTGERPYECKDCRKSFRQRAHLAHHERIHTMESFLTLSSPSPSTSNQLPRPVGFIS

SEQ ID NO: 100639 - protein, 137 aa, Homo sapiens
  Payload ID: 20048
  Gene Name: zinc finger protein 583
  ENSP ID: ENSP00000375657
MSKDLVTFGDVAVNFSQEEWEWLNPAQRNLYRKVMLENYRSLVSLGVSVSKPDVISLLEQGKEPWMVKKEGTRGPCPDWEYVFKNSEFSSKQETYEESSKVVTVGARHLSYSLDYPSLREDCQSEDWYKNQLGSQEV

SEQ ID NO: 100640 - protein, 569 aa, Homo sapiens; identical to SEQ ID NO: 100638
  Payload ID: 20048
  Gene Name: zinc finger protein 583
  Uniprot ID: Q96ND8
  ENSP ID: ENSP00000388502

SEQ ID NO: 100641 - protein, 129 aa, Homo sapiens
  Payload ID: 20048
  Gene Name: zinc finger protein 583
  ENSP ID: ENSP00000444291
MSKDLVTFGDVAVNFSQEEWEWLNPAQRNLYRKVMLENYRSLVSLGVSVSKPDVISLLEQGKEPWMVKKEGTRGPCPDWEYVFKNSEFSSKQETYEESSKVVTVGARHLSYSLDYPSLREDCQSEDWYK

SEQ ID NO: 100642 - protein, 421 aa, Homo sapiens
  Payload ID: 20049
  Gene Name: zinc finger protein 584
  Uniprot ID: Q8IVC4
  ENSP ID: ENSP00000306756
MAGEAEAQLDPSLQGLVMFEDVTVYFSREEWGLLNVTQKGLYRDVMLENFALVSSLGLAPSRSPVFTQLEDDEQSWVPSWVDVTPVSRAEARRGFGLDGLCRVEDERAHPEHLKSYRVIQHQDTHSEGKPRRHTEHGAAFPPGSSCGQQQEVHVAEKLFKCSDCGKVFLKAFALLDHLITHSEERPFRCPTGRSAFKKSAHINPRKIHTGETAHVCNECGKAFSYPSKLRKHQKVHTGIKPFKCSDCGKTFNRKDALVLHQRIHTGERPYECSKCGKTFSVLSTLIRHRKVHIGERPYECTECGKFFKYNNSFILHQRVHTGERPFECKQCGKGYVTRSGLYQHWKVHTGERPYECSLCGKTFTTRSYRNRHQQFHTEERSYECTECGKAFKHSSTLLQHKKVHTPERRQEDRAHGKVVSC

SEQ ID NO: 100643 - protein, 145 aa, Homo sapiens
  Payload ID: 20049
  Gene Name: zinc finger protein 584
  ENSP ID: ENSP00000320731
MAGEAEGLVMFEDVTVYFSREEWGLLNVTQKGLYRDVMLENFALVSSLGLAPSRSPVFTQLEDDEQSWVPSWVDVTPVSRAEARRGFGLGPACSCLSGLRLLIALLCICAELSTVGDSVRVLKCAHILKQMVCVEWRMREPILSI

SEQ ID NO: 100644 - protein, 93 aa, Homo sapiens
  Payload ID: 20049
  Gene Name: zinc finger protein 584
  ENSP ID: ENSP00000470404
MLENFALVSSLGLAPSRSPVFTQLEDDEQSWVPSWVDVTPVSRAEARRGFGLVCHLYHDFQAPHVPASLACVSSLPFSVSVQSCLLLATQCVS

SEQ ID NO: 100645 - protein, 376 aa, Homo sapiens
  Payload ID: 20049
  Gene Name: zinc finger protein 584
  ENSP ID: ENSP00000471105
MLENFALVSSLGLAPSRSPVFTQLEDDEQSWVPSWVDVTPVSRAEARRGFGLDGLCRVEDERAHPEHLKSYRVIQHQDTHSEGKPRRHTEHGAAFPPGSSCGQQQEVHVAEKLFKCSDCGKVFLKAFALLDHLITHSEERPFRCPTGRSAFKKSAHINPRKIHTGETAHVCNECGKAFSYPSKLRKHQKVHTGIKPFKCSDCGKTFNRKDALVLHQRIHTGERPYECSKCGKTFSVLSTLIRHRKVHIGERPYECTECGKFFKYNNSFILHQRVHTGERPFECKQCGKGYVTRSGLYQHWKVHTGERPYECSLCGKTFTTRSYRNRHQQFHTEERSYECTECGKAFKHSSTLLQHKKVHTPERRQEDRAHGKVVSC

SEQ ID NO: 100646 - protein, 32 aa, Homo sapiens
  Payload ID: 20049
  Gene Name: zinc finger protein 584
  ENSP ID: ENSP00000472853
MAGEAEDLHLRDPLCLPSWRMMNSRGCPAGWM

SEQ ID NO: 100647 - protein, 29 aa, Homo sapiens
  Payload ID: 20049
  Gene Name: zinc finger protein 584
  ENSP ID: ENSP00000473184
MAGEAEVSRGCLRGMRGPTRTCTFEIPCV

SEQ ID NO: 100648 - protein, 769 aa, Homo sapiens
  Payload ID: 20050
  Gene Name: zinc finger protein 585A
  Uniprot ID: Q6P3V2
  ENSP ID: ENSP00000292841
MPANWTSPQKSSALAPEDHGSSYEGSVSFRDVAIDFSREEWRHLDPSQRNLYRDVMLETYSHLLSVGYQVPEAEVVMLEQGKEPWALQGERPRQSCPGEKLWDHNQCRKILSYKQVSSQPQKMYPGEKAYECAKFEKIFTQKSQLKVHLKVLAGEKLYVCIECGKAFVQKPEFIIHQKTHMREKPFKCNECGKSFFQVSSLFRHQRIHTGEKLYECSQCGKGFSYNSDLSIHEKIHTGERHHECTDCGKAFTQKSTLKMHQKIHTGERSYICIECGQAFIQKTHLIAHRRIHTGEKPYECSNCGKSFISKSQLQVHQRVHTRVKPYICTEYGKVFSNNSNLVTHKKVQSREKSSICTECGKAFTYRSELIIHQRIHTGEKPYECSDCGKAFTQKSALTVHQRIHTGEKSYICMKCGLAFIQKAHLIAHQIIHTGEKPHKCGHCGKLFTSKSQLHVHKRIHTGEKPYMCNKCGKAFTNRSNLITHQKTHTGEKSYICSKCGKAFTQRSDLITHQRIHTGEKPYECNTCGKAFTQKSHLNIHQKIHTGERQYECHECGKAFNQKSILIVHQKIHTGEKPYVCTECGRAFIRKSNFITHQRIHTGEKPYECSDCGKSFTSKSQLLVHQPVHTGEKPYVCAECGKAFSGRSNLSKHQKTHTGEKPYICSECGKTFRQKSELITHHRIHTGEKPYECSDCGKSFTKKSQLQVHQRIHTGEKPYVCAECGKAFTDRSNLNKHQTTHTGDKPYKCGICGKGFVQKSVFSVHQSSHA

SEQ ID NO: 100649 - protein, 714 aa, Homo sapiens
  Payload ID: 20050
  Gene Name: zinc finger protein 585A
  ENSP ID: ENSP00000349440
MLETYSHLLSVGYQVPEAEVVMLEQGKEPWALQGERPRQSCPGEKLWDHNQCRKILSYKQVSSQPQKMYPGEKAYECAKFEKIFTQKSQLKVHLKVLAGEKLYVCIECGKAFVQKPEFIIHQKTHMREKPFKCNECGKSFFQVSSLFRHQRIHTGEKLYECSQCGKGFSYNSDLSIHEKIHTGERHHECTDCGKAFTQKSTLKMHQKIHTGERSYICIECGQAFIQKTHLIAHRRIHTGEKPYECSNCGKSFISKSQLQVHQRVHTRVKPYICTEYGKVFSNNSNLVTHKKVQSREKSSICTECGKAFTYRSELIIHQRIHTGEKPYECSDCGKAFTQKSALTVHQRIHTGEKSYICMKCGLAFIQKAHLIAHQIIHTGEKPHKCGHCGKLFTSKSQLHVHKRIHTGEKPYMCNKCGKAFTNRSNLITHQKTHTGEKSYICSKCGKAFTQRSDLITHQRIHTGEKPYECNTCGKAFTQKSHLNIHQKIHTGERQYECHECGKAFNQKSILIVHQKIHTGEKPYVCTECGRAFIRKSNFITHQRIHTGEKPYECSDCGKSFTSKSQLLVHQPVHTGEKPYVCAECGKAFSGRSNLSKHQKTHTGEKPYICSECGKTFRQKSELITHHRIHTGEKPYECSDCGKSFTKKSQLQVHQRIHTGEKPYVCAECGKAFTDRSNLNKHQTTHTGDKPYKCGICGKGFVQKSVFSVHQSSHA

SEQ ID NO: 100650 - protein, 714 aa, Homo sapiens; identical to SEQ ID NO: 100649
  Payload ID: 20050
  Gene Name: zinc finger protein 585A
  ENSP ID: ENSP00000375998

SEQ ID NO: 100651 - protein, 25 aa, Homo sapiens
  Payload ID: 20050
  Gene Name: zinc finger protein 585A
  ENSP ID: ENSP00000466185
MPANWTSPQKSSALAPEDHGSSYEC

SEQ ID NO: 100652 - protein, 113 aa, Homo sapiens
  Payload ID: 20050
  Gene Name: zinc finger protein 585A
  ENSP ID: ENSP00000466825
MPANWTSPQKSSALAPEDHGSSYEGSVSFRDVAIDFSREEWRHLDPSQRNLYRDVMLETYSHLLSVGYQVPEAEVVMLEQGKEPWALQGERPRQSCPAPCLVNSHHLQESFRG

SEQ ID NO: 100653 - protein, 56 aa, Homo sapiens; identical to SEQ ID NO: 20359
  Payload ID: 20051
  Gene Name: zinc finger protein 585B
  ENSP ID: ENSP00000432760

SEQ ID NO: 100654 - protein, 769 aa, Homo sapiens
  Payload ID: 20051
  Gene Name: zinc finger protein 585B
  Uniprot ID: Q52M93
  ENSP ID: ENSP00000433773
MPASWTSPQKSSALAPEDHGSSYEGSVSFRDVAIDFSREEWRHLDLSQRNLYRDVMLETYSHLLSVGYQVPKPEVVMLEQGKEPWALQGERPRHSCPGEKLWDHNQHRKIIGYKPASSQDQKIYSGEKSYECAEFGKSFTWKSQFKVHLKVPTGEKLYVCIECGRAFVQKPEFITHQKTHMREKPYKCNECGKSFFQVSSLFRHHRIHTGEKLYECSECGKGFPYNSDLSIHEKIHTGERHHECTDCGKAFTQKSTLKIHQKIHTGERSYICIECGQAFIQKTQLIAHRRIHSGEKPYECNNCGKSFISKSQLQVHQRVHTRVKPYICTEYGKVFSNNSNLITHEKIQSREKSSICTECGKAFTYRSELIIHQRIHTGEKPYECSDCGRAFTQKSALTVHQRIHTGEKSYICMKCGLAFIRKAHLITHQIIHTGEKPYKCGHCGKLFTSKSQLHVHKRIHTGEKPYVCNKCGKAFTNRSNLITHQKTHTGEKSYICSKCGKAFTQRSDLITHQRIHTGEKPYECNTCGKAFTQKSNLNIHQKIHTGERQYECHECGKAFNQKSILIVHQKIHTGEKPYVCTECGRAFIRKSNFITHQRIHTGEKPYECSDCGKSFTSKSQLLVHQPVHTGEKPYVCAECGKAFSGRSNLSKHQKTHTGEKPYICSECGKTFRQKSELITHHRIHTGEKPYECSDCGKSFTKKSQLQVHQRIHTGEKPYVCAECGKAFSNRSNLNKHQTTHTGDKPYKCGICGKGFVQKSVFSVHQSSHA

SEQ ID NO: 100655 - protein, 35 aa, Homo sapiens
  Payload ID: 20051
  Gene Name: zinc finger protein 585B
  ENSP ID: ENSP00000434541
MPASWTSPQKSSALAPEDHGSSYEAGVLWCNHGSL

SEQ ID NO: 100656 - protein, 157 aa, Homo sapiens
  Payload ID: 20051
  Gene Name: zinc finger protein 585B
  ENSP ID: ENSP00000435268
MPASWTSPQKSSALAPEDHGSSYEGSVSFRDVAIDFSREEWRHLDLSQRNLYRDVMLETYSHLLSVGYQVPKPEVVMLEQGKEPWALQGERPRHSCPGEKLWDHNQHRKIIGYKPASSQDQKIYSGEKSYECAEFGKSFTWKSQFKASQNSYRRKTI

SEQ ID NO: 100657 - protein, 714 aa, Homo sapiens
  Payload ID: 20051
  Gene Name: zinc finger protein 585B
  ENSP ID: ENSP00000436774
MLETYSHLLSVGYQVPKPEVVMLEQGKEPWALQGERPRHSCPGEKLWDHNQHRKIIGYKPASSQDQKIYSGEKSYECAEFGKSFTWKSQFKVHLKVPTGEKLYVCIECGRAFVQKPEFITHQKTHMREKPYKCNECGKSFFQVSSLFRHHRIHTGEKLYECSECGKGFPYNSDLSIHEKIHTGERHHECTDCGKAFTQKSTLKIHQKIHTGERSYICIECGQAFIQKTQLIAHRRIHSGEKPYECNNCGKSFISKSQLQVHQRVHTRVKPYICTEYGKVFSNNSNLITHEKIQSREKSSICTECGKAFTYRSELIIHQRIHTGEKPYECSDCGRAFTQKSALTVHQRIHTGEKSYICMKCGLAFIRKAHLITHQIIHTGEKPYKCGHCGKLFTSKSQLHVHKRIHTGEKPYVCNKCGKAFTNRSNLITHQKTHTGEKSYICSKCGKAFTQRSDLITHQRIHTGEKPYECNTCGKAFTQKSNLNIHQKIHTGERQYECHECGKAFNQKSILIVHQKIHTGEKPYVCTECGRAFIRKSNFITHQRIHTGEKPYECSDCGKSFTSKSQLLVHQPVHTGEKPYVCAECGKAFSGRSNLSKHQKTHTGEKPYICSECGKTFRQKSELITHHRIHTGEKPYECSDCGKSFTKKSQLQVHQRIHTGEKPYVCAECGKAFSNRSNLNKHQTTHTGDKPYKCGICGKGFVQKSVFSVHQSSHA

SEQ ID NO: 100658 - protein, 137 aa, Homo sapiens
  Payload ID: 20051
  Gene Name: zinc finger protein 585B
  ENSP ID: ENSP00000465871
MQLNEEINKGSVSFRDVAIDFSREEWRHLDLSQRNLYRDVMLETYSHLLSVGYQVPKPEVVMLEQGKEPWALQGERPRHSCPGEKLWDHNQHRKIIGYKPASSQDQKIYSGEKSYECAEFGKSFTWKSQFKVHLKVP

SEQ ID NO: 100659 - protein, 60 aa, Homo sapiens
  Payload ID: 20051
  Gene Name: zinc finger protein 585B
  ENSP ID: ENSP00000467283
MPASWTSPQKSSALAPEDHGSSYESFALVAQAGVQWHNLGSPQPLPPGFKRFSCLSLPSS

SEQ ID NO: 100660 - protein, 84 aa, Homo sapiens
  Payload ID: 20051
  Gene Name: zinc finger protein 585B
  ENSP ID: ENSP00000467380
MQLNEEINKGSVSFRDVAIDFSREEWRHLDLSQRNLYRDVMLETYSHLLSVGYQVPKPEVVMLEQGKEPWALQGERPRHSCPGE

SEQ ID NO: 100661 - protein, 359 aa, Homo sapiens
  Payload ID: 20052
  Gene Name: zinc finger protein 586
  Uniprot ID: Q9NXT0
  ENSP ID: ENSP00000375583
MLETLTLISSLGCWHGGEDEAAPSKQSTCIHIYKDQGGHSGERPYECGEYRKLFKNKSCLTEPRRDHKHRNVRTGERPYECSKYGKLFHQKPTLHIHERFHTGQKTYECSECGKSFHQSSSLLQRQTLHTRERPYECIECGKAFAEKSSLINHRKVHSGAKRYECNECGKSFAYTSSLIKHRRIHTGERPYECSECGRSFAENSSLIKHLRVHTGERPYECVECGKSFRRSSSLLQHQRVHTRERPYECSECGKSFSLRSNLIHHQRVHTGERHECGQCGKSFSRKSSLIIHLRVHTGERPYECSDCGKSFAENSSLIKHLRVHTGERPYECIDCGKSFRHSSSFRRHQRVHTGMRPYK

SEQ ID NO: 100662 - protein, 210 aa, Homo sapiens
  Payload ID: 20052
  Gene Name: zinc finger protein 586
  Uniprot ID: Q9NXT0
  ENSP ID: ENSP00000379454
MAAAAALRAPAQVVGMEGKMRQHLLSRARVYIYTKTREVIVEKGLMSVGNIGNYLRTSPASLNPEEITNTGMFALEKGLMSAANMGNYFTKSLHSIFMRDFILGKRPMSAVSVENHFTKALHSCSVRHFTLEKGLMSVLNVGKPLLKSPVSLTTGKFTLEQSVMNAMNVGSPLLIHLVSLNTGGFTLERGLMSAVNVGDPLLKTPVLLNT

SEQ ID NO: 100663 - protein, 402 aa, Homo sapiens
  Payload ID: 20052
  Gene Name: zinc finger protein 586
  Uniprot ID: Q9NXT0
  ENSP ID: ENSP00000379458
MAAAAALRAPAQSSVTFEDVAVNFSLEEWSLLNEAQRCLYRDVMLETLTLISSLGCWHGGEDEAAPSKQSTCIHIYKDQGGHSGERPYECGEYRKLFKNKSCLTEPRRDHKHRNVRTGERPYECSKYGKLFHQKPTLHIHERFHTGQKTYECSECGKSFHQSSSLLQRQTLHTRERPYECIECGKAFAEKSSLINHRKVHSGAKRYECNECGKSFAYTSSLIKHRRIHTGERPYECSECGRSFAENSSLIKHLRVHTGERPYECVECGKSFRRSSSLLQHQRVHTRERPYECSECGKSFSLRSNLIHHQRVHTGERHECGQCGKSFSRKSSLIIHLRVHTGERPYECSDCGKSFAENSSLIKHLRVHTGERPYECIDCGKSFRHSSSFRRHQRVHTGMRPYK

SEQ ID NO: 100664 - protein, 101 aa, Homo sapiens
  Payload ID: 20052
  Gene Name: zinc finger protein 586
  ENSP ID: ENSP00000470397
MAAAAALRAPAQSSVTFEDVAVNFSLEEWSLLNEAQGCLYHDVMLETLTLISSLGGVPPHRLFPTGACGPQVPSSRIRPSPGHCPRPSLYLSLSPPHPTGV

SEQ ID NO: 100665 - protein, 76 aa, Homo sapiens
  Payload ID: 20052
  Gene Name: zinc finger protein 586
  ENSP ID: ENSP00000471663
MAAAAALRAPAQSSVTFEDVAVNFSLEEWSLLNEAQGCLYHDVMLETLTLISSLERVHSPAVLQQEHTEQRRQGHL

SEQ ID NO: 100666 - protein, 23 aa, Homo sapiens
  Payload ID: 20052
  Gene Name: zinc finger protein 586
  ENSP ID: ENSP00000472972
MAAAAALRAPAQMHLWVAPSLQP

SEQ ID NO: 100667 - protein, 575 aa, Homo sapiens
  Payload ID: 20053
  Gene Name: zinc finger protein 587
  Uniprot ID: Q96SQ5
  ENSP ID: ENSP00000345479
MAAAVPRRPTQQGTVTFEDVAVNFSQEEWCLLSEAQRCLYRDVMLENLALISSLGCWCGSKDEEAPCKQRISVQRESQSRTPRAGVSPKKAHPCEMCGLILEDVFHFADHQETHHKQKLNRSGACGKNLDDTAYLHQHQKQHIGEKFYRKSVREASFVKKRKLRVSQEPFVFREFGKDVLPSSGLCQEEAAVEKTDSETMHGPPFQEGKTNYSCGKRTKAFSTKHSVIPHQKLFTRDGCYVCSDCGKSFSRYVSFSNHQRDHTAKGPYDCGECGKSYSRKSSLIQHQRVHTGQTAYPCEECGKSFSQKGSLISHQLVHTGEGPYECRECGKSFGQKGNLIQHQQGHTGERAYHCGECGKSFRQKFCFINHQRVHTGERPYKCGECGKSFGQKGNLVHHQRGHTGERPYECKECGKSFRYRSHLTEHQRLHTGERPYNCRECGKLFNRKYHLLVHERVHTGERPYACEVCGKLFGNKHSVTIHQRIHTGERPYECSECGKSFLSSSALHVHKRVHSGQKPYKCSECGKSFSECSSLIKHRRIHTGERPYECTKCGKTFQRSSTLLHHQSSHRRKAL

SEQ ID NO: 100668 - protein, 574 aa, Homo sapiens
  Payload ID: 20053
  Gene Name: zinc finger protein 587
  Uniprot ID: Q96SQ5
  ENSP ID: ENSP00000393865
MAAAVPRRPTQGTVTFEDVAVNFSQEEWCLLSEAQRCLYRDVMLENLALISSLGCWCGSKDEEAPCKQRISVQRESQSRTPRAGVSPKKAHPCEMCGLILEDVFHFADHQETHHKQKLNRSGACGKNLDDTAYLHQHQKQHIGEKFYRKSVREASFVKKRKLRVSQEPFVFREFGKDVLPSSGLCQEEAAVEKTDSETMHGPPFQEGKTNYSCGKRTKAFSTKHSVIPHQKLFTRDGCYVCSDCGKSFSRYVSFSNHQRDHTAKGPYDCGECGKSYSRKSSLIQHQRVHTGQTAYPCEECGKSFSQKGSLISHQLVHTGEGPYECRECGKSFGQKGNLIQHQQGHTGERAYHCGECGKSFRQKFCFINHQRVHTGERPYKCGECGKSFGQKGNLVHHQRGHTGERPYECKECGKSFRYRSHLTEHQRLHTGERPYNCRECGKLFNRKYHLLVHERVHTGERPYACEVCGKLFGNKHSVTIHQRIHTGERPYECSECGKSFLSSSALHVHKRVHSGQKPYKCSECGKSFSECSSLIKHRRIHTGERPYECTKCGKTFQRSSTLLHHQSSHRRKAL

SEQ ID NO: 100669 - protein, 532 aa, Homo sapiens
  Payload ID: 20053
  Gene Name: zinc finger protein 587
  ENSP ID: ENSP00000406999
MLENLALISSLGCWCGSKDEEAPCKQRISVQRESQSRTPRAGVSPKKAHPCEMCGLILEDVFHFADHQETHHKQKLNRSGACGKNLDDTAYLHQHQKQHIGEKFYRKSVREASFVKKRKLRVSQEPFVFREFGKDVLPSSGLCQEEAAVEKTDSETMHGPPFQEGKTNYSCGKRTKAFSTKHSVIPHQKLFTRDGCYVCSDCGKSFSRYVSFSNHQRDHTAKGPYDCGECGKSYSRKSSLIQHQRVHTGQTAYPCEECGKSFSQKGSLISHQLVHTGEGPYECRECGKSFGQKGNLIQHQQGHTGERAYHCGECGKSFRQKFCFINHQRVHTGERPYKCGECGKSFGQKGNLVHHQRGHTGERPYECKECGKSFRYRSHLTEHQRLHTGERPYNCRECGKLFNRKYHLLVHERVHTGERPYACEVCGKLFGNKHSVTIHQRIHTGERPYECSECGKSFLSSSALHVHKRVHSGQKPYKCSECGKSFSECSSLIKHRRIHTGERPYECTKCGKTFQRSSTLLHHQSSHRRKAL

SEQ ID NO: 100670 - protein, 402 aa, Homo sapiens
  Payload ID: 20054
  Gene Name: zinc finger protein 587B
  Uniprot ID: E7ETH6
  ENSP ID: ENSP00000392410
MAVVATLRLSAQGTVTFEDVAVKFTQEEWNLLSEAQRCLYRDVTLENLALMSSLGCWCGVEDEAAPSKQSIYIQRETQVRTPVTGVSPKKAHPCEMCGPILGDILHVADHQGTHHKQKLHRCEAWGNKLYDSGNFHQHQNEHIGEKPYRGSVEEALFVKRCKLHVSGESSVFSESGKDFLPRSGLLQQEASHTGEKSNSKTECVSPFQCGGAHYSHGDSMKHFSTKHILSQHQRLLPREECYVCCECGKSFSKYVSFSNHQRVHSGKRPYECGECEKSFSQKSSLIQHQQFHTGGKPYGCEECGKYFSLEGYLRRHQKVHAGKGPYECGECGKSFSSNVNLKSHQRIHTGERPYKCGECEKSFSRKPSLSYHQRFGRPRWVDHKDRKEFKTSLGNIVKSCLF

SEQ ID NO: 100671 - protein, 633 aa, Homo sapiens
  Payload ID: 20054
  Gene Name: zinc finger protein 587B
  ENSP ID: ENSP00000469623
MAVVATLRLSAQGTVTFEDVAVKFTQEEWNLLSEAQRCLYRDVTLENLALMSSLGCWCGVEDEAAPSKQSIYIQRETQVRTPVTGVSPKKAHPCEMCGPILGDILHVADHQGTHHKQKLHRCEAWGNKLYDSGNFHQHQNEHIGEKPYRGSVEEALFVKRCKLHVSGESSVFSESGKDFLPRSGLLQQEASHTGEKSNSKTECVSPFQCGGAHYSHGDSMKHFSTKHILSQHQRLLPREECYVCCECGKSFSKYVSFSNHQRVHSGKRPYECGECEKSFSQKSSLIQHQQFHTGGKPYGCEECGKYFSLEGYLRRHQKVHAGKGPYECGECGKSFSSNVNLKSHQRIHTGERPYKCGECEKSFSRKPSLSYHQRIHTEVRPYKCGECGKSYISKGHLRIHQRMHTGERPYKCGDCGKSFNEKGHLRSHQRVHTTERPYKCGECGKCFSHKGNLILHQHGHTRKRPYMCWECGKLFKKKSHLLVHQRIHSGEKPYACEACQKFFRHKCHLTAHQRVHTGERPYECSDCGKSFTHSCAFIVHKRVHTGQKPYECSECGKSFAASSYLTSHRRVHTGQKPYECSECGKSFAGISSLTNHRRVHTGEKPYGCSECEKKFRKSSSLRYHQRVHERKAL

SEQ ID NO: 100672 - protein, 431 aa, Homo sapiens
  Payload ID: 20054
  Gene Name: zinc finger protein 587B
  ENSP ID: ENSP00000472004
MSSLGCWCGVEDEAAPSKQSIYIQRETQVRTPVTGVSPKKAHPCEMCGPILGDILHVADHQGTHHKQKLHRCEAWGNKLYDSGNFHQHQNEHIGEKPYRGSVEEALFVKRCKLHVSGESSVFSESGKDFLPRSGLLQQEASHTGEKSNSKTECVSPFQCGGAHYSHGDSMKHFSTKHILSQHQRLLPREECYVCCECGKSFSKYVSFSNHQRVHSGKRPYECGECEKSFSQKSSLIQHQQFHTGGKPYGCEECGKYFSLEGYLRRHQKVHAGKGPYECGECGKSFSSNVNLKSHQRIHTGERPYKCGECEKSFSRKPSLSYHQRIHTEVRPYKCGECGKSYISKGHLRIHQRMHTGERPYKCGDCGKSFNEKGHLRSHQRVHTTERPYKCGECGKCFSHKGNLILHQHGHTRKRPYMCWECGKLFKKKSHL

SEQ ID NO: 100673 - protein, 364 aa, Homo sapiens
  Payload ID: 20055
  Gene Name: zinc finger protein 589
  Uniprot ID: Q86UQ0
  ENSP ID: ENSP00000346729
MWAPREQLLGWTAEALPAKDSAWPWEEKPRYLGPVTFEDVAVLFTEAEWKRLSLEQRNLYKEVMLENLRNLVSLAESKPEVHTCPSCPLAFGSQQFLSQDELHNHPIPGFHAGNQLHPGNPCPEDQPQSQHPSDKNHRGAEAEDQRVEGGVRPLFWSTNERGALVGFSSLFQRPPISSWGGNRILEIQLSPAQNASSEEVDRISKRAETPGFGAVTFGECALAFNQKSNLFRQKAVTAEKSSDKRQSQVCRECGRGFSRKSQLIIHQRTHTGEKPYVCGECGRGFIVESVLRNHLSTHSGEKPYVCSHCGRGFSCKPYLIRHQRTHTREKSFMCTVCGRGFREKSELIKHQRIHTGDKPYVCRD

SEQ ID NO: 100674 - protein, 96 aa, Homo sapiens
  Payload ID: 20055
  Gene Name: zinc finger protein 589
  ENSP ID: ENSP00000392719
MWAPREQLLGWTAEALPAKDSAWPWEEKPRYLGPVTFEDVAVLFTEAEWKRLSLEQRNLYKEVMLENLRNLVSLVLELGSPRSGLLPLDLNLDLWL

SEQ ID NO: 100675 - protein, 89 aa, Homo sapiens
  Payload ID: 20055
  Gene Name: zinc finger protein 589
  ENSP ID: ENSP00000401106
MWAPREQLLGWTAEALPAKDSAWPWEEKPRYLVPVADGALARGVRRIWTLLGSRCDTAFNYSCLSFLDFHHFPETTSWKLRPAGHCWAC

SEQ ID NO: 100676 - protein, 80 aa, Homo sapiens
  Payload ID: 20055
  Gene Name: zinc finger protein 589
  ENSP ID: ENSP00000404398
MWAPREQLLGWTAEALPAKDSAWPWEEKPRYLGPVTFEDVAVLFTEAEWKRLSLEQRNLYKEVMLENLRNLVSLVLSYQI

SEQ ID NO: 100677 - protein, 364 aa, Homo sapiens; identical to SEQ ID NO: 100673
  Payload ID: 20055
  Gene Name: zinc finger protein 589
  Uniprot ID: Q86UQ0
  ENSP ID: ENSP00000404592

SEQ ID NO: 100678 - protein, 177 aa, Homo sapiens
  Payload ID: 20055
  Gene Name: zinc finger protein 589
  ENSP ID: ENSP00000408719
MWAPREQLLGWTAEALPAKDSAWPWEEKPRYLGPVTFEDVAVLFTEAEWKRLSLEQRNLYKEVMLENLRNLVSLESKPEVHTCPSCPLAFGSQQFLSQDELHNHPIPGFHAGNQLHPGNPCPEDQPQSQHPSDKNHRGAEAEDQRVEGGVRPLFWILELGSPRSGLLPLDLNLDLWL

SEQ ID NO: 100679 - protein, 1267 aa, Homo sapiens
  Payload ID: 20056
  Gene Name: zinc finger protein 592
  Uniprot ID: Q92610
  ENSP ID: ENSP00000299927
MGDMKTPDFDDLLAAFDIPDPTSLDAKEAIQTPSEENESPLKPPGICMDESVSLSHSGSAPDVPAVSVIVKNTSRQESFEAEKDHITPSLLHNGFRGSDLPPDPHNCGKFDSTFMNGDSARSFPGKLEPPKSEPLPTFNQFSPISSPEPEDPIKDNGFGIKPKHSDSYFPPPLGCGAVGGPVLEALAKFPVPELHMFDHFCKKEPKPEPLPLGSQQEHEQSGQNTVEPHKDPDATRFFGEALEFNSHPSNSIGESKGLARELGTCSSVPPRQRLKPAHSKLSSCVAALVALQAKRVASVTKEDQPGHTKDLSGPTKESSKGSPKMPKSPKSPRSPLEATRKSIKPSDSPRSICSDSSSKGSPSVAASSPPAIPKVRIKTIKTSSGEIKRTVTRILPDPDDPSKSPVGSPLGSAIAEAPSEMPGDEVPVEEHFPEAGTNSGSPQGARKGDESMTKASDSSSPSCSSGPRVPKGAAPGSQTGKKQQSTALQASTLAPANLLPKAVHLANLNLVPHSVAASVTAKSSVQRRSQPQLTQMSVPLVHQVKKAAPLIVEVFNKVLHSSNPVPLYAPNLSPPADSRIHVPASGYCCLECGDAFALEKSLSQHYGRRSVHIEVLCTLCSKTLLFFNKCSLLRHARDHKSKGLVMQCSQLLVKPISADQMFVSAPVNSTAPAAPAPSSSPKHGLTSGSASPPPPALPLYPDPVRLIRYSIKCLECHKQMRDYMVLAAHFQRTTEETEGLTCQVCQMLLPNQCSFCAHQRIHAHKSPYCCPECGVLCRSAYFQTHVKENCLHYARKVGYRCIHCGVVHLTLALLKSHIQERHCQVFHKCAFCPMAFKTASSTADHSATQHPTQPHRPSQLIYKCSCEMVFNKKRHIQQHFYQNVSKTQVGVFKCPECPLLFVQKPELMQHVKSTHGVPRNVDELSSLQSSADTSSSRPGSRVPTEPPATSVAARSSSLPSGRWGRPEAHRRVEARPRLRNTGWTCQECQEWVPDRESYVSHMKKSHGRTLKRYPCRQCEQSFHTPNSLRKHIRNNHDTVKKFYTCGYCTEDSPSFPRPSLLESHISLMHGIRNPDLSQTSKVKPPGGHSPQVNHLKRPVSGVGDAPGTSNGATVSSTKRHKSLFQCAKCSFATDSGLEFQSHIPQHQVDSSTAQCLLCGLCYTSASSLSRHLFIVHKVRDQEEEEEEEAAAAEMAVEVAEPEEGSGEEVPMETRENGLEECAGEPLSADPEARRLLGPAPEDDGGHNDHSQPQASQDQDSHTLSPQV

SEQ ID NO: 100680 - protein, 1267 aa, Homo sapiens; identical to SEQ ID NO: 100679
  Payload ID: 20056
  Gene Name: zinc finger protein 592
  Uniprot ID: Q92610
  ENSP ID: ENSP00000452877

SEQ ID NO: 100681 - protein, 858 aa, Homo sapiens
  Payload ID: 20056
  Gene Name: zinc finger protein 592
  ENSP ID: ENSP00000453491
MGDMKTPDFDDLLAAFDIPDPTSLDAKEAIQTPSEENESPLKPPGICMDESVSLSHSGSAPDVPAVSVIVKNTSRQESFEAEKDHITPSLLHNGFRGSDLPPDPHNCGKFDSTFMNGDSARSFPGKLEPPKSEPLPTFNQFSPISSPEPEDPIKDNGFGIKPKHSDSYFPPPLGCGAVGGPVLEALAKFPVPELHMFDHFCKKEPKPEPLPLGSQQEHEQSGQNTVEPHKDPDATRFFGEALEFNSHPSNSIGESKGLARELGTCSSVPPRQRLKPAHSKLSSCVAALVALQAKRVASVTKEDQPGHTKDLSGPTKESSKGSPKMPKSPKSPRSPLEATRKSIKPSDSPRSICSDSSSKGSPSVAASSPPAIPKVRIKTIKTSSGEIKRTVTRILPDPDDPSKSPVGSPLGSAIAEAPSEMPGDEVPVEEHFPEAGTNSGSPQGARKGDESMTKASDSSSPSCSSGPRVPKGAAPGSQTGKKQQSTALQASTLAPANLLPKAVHLANLNLVPHSVAASVTAKSSVQRRSQPQLTQMSVPLVHQVKKAAPLIVEVFNKVLHSSNPVPLYAPNLSPPADSRIHVPASGYCCLECGDAFALEKSLSQHYGRRSVHIEVLCTLCSKTLLFFNKCSLLRHARDHKSKGLVMQCSQLLVKPISADQMFVSAPVNSTAPAAPAPSSSPKHGLTSGSASPPPPALPLYPDPVRLIRYSIKCLECHKQMRDYMVLAAHFQRTTEETEGLTCQVCQMLLPNQCSFCAHQRIHAHKSPYCCPECGVLCRSAYFQTHVKENCLHYARKVHPLWCRPPDLGLAEKPHPGATLPGFPQMCILPHGLQDCQQHCRPQCHPAPHPAPQTLPAHL

SEQ ID NO: 100682 - protein, 156 aa, Homo sapiens
  Payload ID: 20057
  Gene Name: zinc finger protein 593
  ENSP ID: ENSP00000270812
MGRSRRTGAHRAHSLARQMKAKRRRPDLDEIHRELRPQGSARPQPDPNAEFDPDLPGGGLHRCLACARYFIDSTNLKTHFRSKDHKKRYEGVRRGLMDGCSADRALTWSAPNSCFSFSQAEAAERRALQSGRGGEGSGYGILCAPQAAGSAHGSVH

SEQ ID NO: 100683 - protein, 134 aa, Homo sapiens
  Payload ID: 20057
  Gene Name: zinc finger protein 593
  Uniprot ID: O00488
  ENSP ID: ENSP00000363384
MGRSRRTGAHRAHSLARQMKAKRRRPDLDEIHRELRPQGSARPQPDPNAEFDPDLPGGGLHRCLACARYFIDSTNLKTHFRSKDHKKRLKQLSVEPYSQEEAERAAGMGSYVPPRRLAVPTEVSTEVPEMDTST

SEQ ID NO: 100684 - protein, 807 aa, Homo sapiens
  Payload ID: 20058
  Gene Name: zinc finger protein 594
  Uniprot ID: Q96JF6
  ENSP ID: ENSP00000382513
MKEWKSKMEISEEKKSARAASEKLQRQITQECELVETSNSEDRLLKHWVSPLKDAMRHLPSQESGIREMHIIPQKAIVGEIGHGCNEGEKILSAGESSHRYEVSGQNFKQKSGLTEHQKIHNINKTYECKECEKTFNRSSNLIIHQRIHTGNKPYVCNECGKDSNQSSNLIIHQRIHTGKKPYICHECGKDFNQSSNLVRHKQIHSGGNPYECKECGKAFKGSSNLVLHQRIHSRGKPYLCNKCGKAFSQSTDLIIHHRIHTGEKPYECYDCGQMFSQSSHLVPHQRIHTGEKPLKCNECEKAFRQHSHLTEHQRLHSGEKPYECHRCGKTFSGRTAFLKHQRLHAGEKIEECEKTFSKDEELREEQRIHQEEKAYWCNQCGRNFQGTSDLIRHQVTHTGEKPYECKECGKTFNQSSDLLRHHRIHSGEKPCVCSKCGKSFRGSSDLIRHHRVHTGEKPYECSECGKAFSQRSHLVTHQKIHTGEKPYQCTECGKAFRRRSLLIQHRRIHSGEKPYECKECGKLFIWRTAFLKHQSLHTGEKLECEKTFSQDEELRGEQKIHQEAKAYWCNQCGRAFQGSSDLIRHQVTHTREKPYECKECGKTFNQSSDLLRHHRIHSGEKPYVCNKCGKSFRGSSDLIKHHRIHTGEKPYECSECGKAFSQRSHLATHQKIHTGEKPYQCSECGNAFRRRSLLIQHRRLHSGEKPYECKECGKLFMWHTAFLKHQRLHAGEKLEECEKTFSKDEELRKEQRTHQEKKVYWCNQCSRTFQGSSDLIRHQVTHTREKPYECKECGKTQSELRPSETS

SEQ ID NO: 100685 - protein, 807 aa, Homo sapiens; identical to SEQ ID NO: 100684
  Payload ID: 20058
  Gene Name: zinc finger protein 594
  Uniprot ID: Q96JF6
  ENSP ID: ENSP00000461032

SEQ ID NO: 100686 - protein, 102 aa, Homo sapiens
  Payload ID: 20058
  Gene Name: zinc finger protein 594
  ENSP ID: ENSP00000461696
MKEWKSKMEISEEKKSARAASEKLQRQITQECELVETSNSEDRLLKHWVSPLKDAMRHLPSQESGIREMHIIPQKAIVGEIGHGCNEGEKILSAGESSHRYE

SEQ ID NO: 100687 - protein, 85 aa, Homo sapiens
  Payload ID: 20059
  Gene Name: zinc finger protein 595
  ENSP ID: ENSP00000434858
MELVTFRDVAIEFSPEEWKCLDPAQQNLYRDVMLENYRNLVSLGFVISNPDLVTCLEQIKEPCNLKIHETAAKPPVVQHFWSLQF

SEQ ID NO: 100688 - protein, 465 aa, Homo sapiens
  Payload ID: 20059
  Gene Name: zinc finger protein 595
  ENSP ID: ENSP00000476367
MSHLTQHTGIHAGEKPYKCEKCGKAFNRSTSLSKHKRIHTGEKPYTCEECGKAFRRSTVLNEHKKIHTGEKPYKCEECGKAFTRSTTLNEHKKIHTGEKPYKCKECGKAFRWSTSLNEHKNIHTGEKPYKCKECGKAFRQSRSLNEHKNIHTGEKPYTCEKCGKAFNQSSSLIIHRSIHSEQKLYKCEECGKAFTWSSSLNKHKRIHTGEKPYTCEECGKAFYRSSHLAKHKRIHTGEKPYTCEECGKAFNQSSTLILHKRIHSGQKPYKCEECGKAFTRSTTLNEHKKIHTGEKPYKCEECGKAFIWSASLNEHKNIHTGEKPYKCKECGKAFNQSSGLIIHRSIHSEQKLYKCEECGKAFTRSTALNEHKKIHSGEKPYKCKECGKAYNLSSTLTKHKRIHTGEKPFTCEECGKAFNWSSSLTKHKIIHTGEKSYKCEECGKAFNRPSTLTVHKRIHTGKEHS

SEQ ID NO: 100689 - protein, 616 aa, Homo sapiens
  Payload ID: 20059
  Gene Name: zinc finger protein 595
  ENSP ID: ENSP00000476408
MELVTFRDVAIEFSPEEWKCLDPAQQNLYRDVMLENYRNLVSLAICSPFSQDLSPVQGIEDSFHKLILKRYEKCGHENLQLRKGCKRVNECKVQKGVNNGVYQCLSTTQSKIFQCNTCVKVFSKFSNSNKHKIRHTGEKPFKCTECGRSFYMSHLTQHTGIHAGEKPYKCEKCGKAFNRSTSLSKHKRIHTGEKPYTCEECGKAFRRSTVLNEHKKIHTGEKPYKCEECGKAFTRSTTLNEHKKIHTGEKPYKCKECGKAFRWSTSLNEHKNIHTGEKPYKCKECGKAFRQSRSLNEHKNIHTGEKPYTCEKCGKAFNQSSSLIIHRSIHSEQKLYKCEECGKAFTWSSSLNKHKRIHTGEKPYTCEECGKAFYRSSHLAKHKRIHTGEKPYTCEECGKAFNQSSTLILHKRIHSGQKPYKCEECGKAFTRSTTLNEHKKIHTGEKPYKCEECGKAFIWSASLNEHKNIHTGEKPYKCKECGKAFNQSSGLIIHRSIHSEQKLYKCEECGKAFTRSTALNEHKKIHSGEKPYKCKECGKAYNLSSTLTKHKRIHTGEKPFTCEECGKAFNWSSSLTKHKIIHTGEKSYKCEECGKAFNRPSTLTVHKRIHTGKEHS

SEQ ID NO: 100690 - protein, 648 aa, Homo sapiens
  Payload ID: 20059
  Gene Name: zinc finger protein 595
  ENSP ID: ENSP00000477392
MELVTFRDVAIEFSPEEWKCLDPAQQNLYRDVMLENYRNLVSLGFVISNPDLVTCLEQIKEPCNLKIHETAAKPPAICSPFSQDLSPVQGIEDSFHKLILKRYEKCGHENLQLRKGCKRVNECKVQKGVNNGVYQCLSTTQSKIFQCNTCVKVFSKFSNSNKHKIRHTGEKPFKCTECGRSFYMSHLTQHTGIHAGEKPYKCEKCGKAFNRSTSLSKHKRIHTGEKPYTCEECGKAFRRSTVLNEHKKIHTGEKPYKCEECGKAFTRSTTLNEHKKIHTGEKPYKCKECGKAFRWSTSLNEHKNIHTGEKPYKCKECGKAFRQSRSLNEHKNIHTGEKPYTCEKCGKAFNQSSSLIIHRSIHSEQKLYKCEECGKAFTWSSSLNKHKRIHTGEKPYTCEECGKAFYRSSHLAKHKRIHTGEKPYTCEECGKAFNQSSTLILHKRIHSGQKPYKCEECGKAFTRSTTLNEHKKIHTGEKPYKCEECGKAFIWSASLNEHKNIHTGEKPYKCKECGKAFNQSSGLIIHRSIHSEQKLYKCEECGKAFTRSTALNEHKKIHSGEKPYKCKECGKAYNLSSTLTKHKRIHTGEKPFTCEECGKAFNWSSSLTKHKIIHTGEKSYKCEECGKAFNRPSTLTVHKRIHTGKEHS

SEQ ID NO: 100691 - protein, 504 aa, Homo sapiens
  Payload ID: 20060
  Gene Name: zinc finger protein 596
  Uniprot ID: Q8TC21
  ENSP ID: ENSP00000310033
MPSPDSMTFEDIIVDFTQEEWALLDTSQRKLFQDVMLENISHLVSIGKQLCKSVVLSQLEQVEKLSTQRISLLQGREVGIKHQEIPFIQHIYQKGTSTISTMRSHTQEDPFLCNDLGEDFTQHIALTQNVITYMRTKHFVSKKFGKIFSDWLSFNQHKEIHTKCKSYGSHLFDYAFIQNSALRPHSVTHTREITLECRVCGKTFSKNSNLRRHEMIHTGEKPHGCHLCGKAFTHCSDLRKHERTHTGEKPYGCHLCGKAFSKSSNLRRHEMIHTREKAQICHLCGKAFTHCSDLRKHERTHLGDKPYGCLLCGKAFSKCSYLRQHERTHNGEKPYECHLCGKAFSHCSHLRQHERSHNGEKPHGCHLCGKAFTESSVLKRHERIHTGEKPYECHVCGKAFTESSDLRRHERTHTGEKPYECHLCGKAFNHSSVLRRHERTHTGEKPYECNICGKAFNRSYNFRLHRRVHTGEKPYVCPLCGKAFSKFFNLRQHERTHTKKAMNM

SEQ ID NO: 100692 - protein, 504 aa, Homo sapiens; identical to SEQ ID NO: 100691
  Payload ID: 20060
  Gene Name: zinc finger protein 596
  Uniprot ID: Q8TC21
  ENSP ID: ENSP00000318719

SEQ ID NO: 100693 - protein, 504 aa, Homo sapiens; identical to SEQ ID NO: 100691
  Payload ID: 20060
  Gene Name: zinc finger protein 596
  Uniprot ID: Q8TC21
  ENSP ID: ENSP00000381613

SEQ ID NO: 100694 - protein, 43 aa, Homo sapiens
  Payload ID: 20060
  Gene Name: zinc finger protein 596
  ENSP ID: ENSP00000429386
MPSPDSMTFEDIIVDFTQEEWALLDTSQRKLFQDVMLENISHL

SEQ ID NO: 100695 - protein, 146 aa, Homo sapiens
  Payload ID: 20060
  Gene Name: zinc finger protein 596
  ENSP ID: ENSP00000429671
MPSPDSMTFEDIIVDFTQEEWALLDTSQRKLFQDVMLENISHLVSIGKQLCKSVVLSQLEQVEKLSTQRISLLQGREVGIKHQEIPFIQHIYQKGTSTISTMRSHTQEDPFLCNDLGEDFTQHIALTQNVITYMRTKHFVSKKFGK

SEQ ID NO: 100696 - protein, 73 aa, Homo sapiens
  Payload ID: 20060
  Gene Name: zinc finger protein 596
  ENSP ID: ENSP00000430552
MPSPDSMTFEDIIVDFTQEEWALLDTSQRKLFQDVMLENISHLVSIGKQLCKSVVLSQLEQVEKLSTQRISLL

SEQ ID NO: 100697 - protein, 77 aa, Homo sapiens
  Payload ID: 20060
  Gene Name: zinc finger protein 596
  ENSP ID: ENSP00000430650
MPSPDSMTFEDIIVDFTQEEWALLDTSQRKLFQDVMLENISHLVSIGKQLCKSVVLSQLEQVEKLSTQRISLLQGEL

SEQ ID NO: 100698 - protein, 69 aa, Homo sapiens
  Payload ID: 20060
  Gene Name: zinc finger protein 596
  ENSP ID: ENSP00000476799
MLENISHLVSIGKQLCKSVVLSQLEQVEKLSTQRISLLQGREVGIKHQEIPFIQHIYQKGTSTISTMRS

SEQ ID NO: 100699 - protein, 133 aa, Homo sapiens
  Payload ID: 20060
  Gene Name: zinc finger protein 596
  ENSP ID: ENSP00000477126
MPSPDSMTFEDIIVDFTQEEWALLDTSQRKLFQDVMLENISHLVSIGKQLCKSVVLSQLEQVEKLSTQRISLLQGREVGIKHQEIPFIQHIYQKGTSTISTMRSHTQEDPFLCNDLGEDFTQHIALTQNVITY

SEQ ID NO: 100700 - protein, 424 aa, Homo sapiens
  Payload ID: 20061
  Gene Name: zinc finger protein 597
  Uniprot ID: Q96LX8
  ENSP ID: ENSP00000301744
MASMPPTPEAQGPILFEDLAVYFSQEECVTLHPAQRSLSKDGTKESLEDAALMGEEGKPEINQQLSLESMELDELALEKYPIAAPLVPYPEKSSEDGVGNPEAKILSGTPTYKRRVISLLVTIENHTPLVELSEYLGTNTLSEILDSPWEGAKNVYKCPECDQNFSDHSYLVLHQKIHSGEKKHKCGDCGKIFNHRANLRTHRRIHTGEKPYKCAKCSASFRQHSHLSRHMNSHVKEKPYTCSICGRGFMWLPGLAQHQKSHSAENTYESTNCDKHFNEKPNLALPEETFVSGPQYQHTKCMKSFRQSLYPALSEKSHDEDSERCSDDGDNFFSFSKFKPLQCPDCDMTFPCFSELISHQNIHTEERPHKCKTCEESFALDSELACHQKSHMLAEPFKCTVCGKTFKSNLHLITHKRTHIKNTT

SEQ ID NO: 100701 - protein, 904 aa, Homo sapiens
  Payload ID: 20062
  Gene Name: zinc finger protein 598
  Uniprot ID: Q86UK7
  ENSP ID: ENSP00000411409
MAAAGGAEGRRADMEAEAAAAPERGGGSCVLCCGDLEATALGRCDHPVCYRCSTKMRVLCEQRYCAVCREELRQVVFGKKLPAFATIPIHQLQHEKKYDIYFADGKVYALYRQLLQHECPRCPELPPFSLFGDLEQHMRRQHELFCCRLCLQHLQIFTYERKWYSRKDLARHRMQGDPDDTSHRGHPLCKFCDERYLDNDELLKHLRRDHYFCHFCDSDGAQDYYSDYAYLREHFREKHFLCEEGRCSTEQFTHAFRTEIDLKAHRTACHSRSRAEARQNRHIDLQFSYAPRHSRRNEGVVGGEDYEEVDRYSRQGRVARAGTRGAQQSRRGSWRYKREEEDREVAAAVRASVAAQQQEEARRSEDQEEGGRPKKEEAAARGPEDPRGPRRSPRTQGEGPGPKETSTNGPVSQEAFSVTGPAAPGCVGVPGALPPPSPKLKDEDFPSLSASTSSSCSTAATPGPVGLALPYAIPARGRSAFQEEDFPALVSSVPKPGTAPTSLVSAWNSSSSSKKVAQPPLSAQATGSGQPTRKAGKGSRGGRKGGPPFTQEEEEDGGPALQELLSTRPTGSVSSTLGLASIQPSKVGKKKKVGSEKPGTTLPQPPPATCPPGALQAPEAPASRAEGPVAVVVNGHMEGPAPARSAPKEPPGLPRPLGSFPCPTPQEDFPALGGPCPPRMPPPPGFSAVVLLKGTPPPPPPGLVPPISKPPPGFSGLLPSPHPACVPSPATTTTTKAPRLLPAPRAYLVPENFRERNLQLIQSIRDFLQSDEARFSEFKSHSGEFRQGLISAAQYYKSCRDLLGENFQKVFNELLVLLPDTAKQQELLSAHTDFCNREKPLSTKSKKNKKSAWQATTQQAGLDCRVCPTCQQVLAHGDASSHQALHAARDDDFPSLQAIARIIT

SEQ ID NO: 100702 - protein, 90 aa, Homo sapiens
  Payload ID: 20062
  Gene Name: zinc finger protein 598
  ENSP ID: ENSP00000455292
  MOD_RES (1)..(1): Any amino acid
XPTPSAPRSTSRPTGRPATVAAAPRHARTATSTCSSATRHGTRAGTRGSLVAKTTRRWTGTAARAEWPGLALAEPSRAAEEAGGKKRTEK

SEQ ID NO: 100703 - protein, 849 aa, Homo sapiens
  Payload ID: 20062
  Gene Name: zinc finger protein 598
  ENSP ID: ENSP00000455308
MRVLCEQRYCAVCREELRQVVFGKKLPAFATIPIHQLQHEKKYDIYFADGKVYALYRQLLQHECPRCPELPPFSLFGDLEQHMRRQHELFCCRLCLQHLQIFTYERKWYSRKDLARHRMQGDPDDTSHRGHPLCKFCDERYLDNDELLKHLRRDHYFCHFCDSDGAQDYYSDYAYLREHFREKHFLCEEGRCSTEQFTHAFRTEIDLKAHRTACHSRSRAEARQNRHIDLQFSYAPRHSRRNEGVVGGEDYEEVDRYSRQGRVARAGTRGAQQSRRGSWRYKREEEDREVAAAVRASVAAQQQEEARRSEDQEEGGRPKKEEAAARGPEDPRGPRRSPRTQGEGPGPKETSTNGPVSQEAFSVTGPAAPGCVGVPGALPPPSPKLKDEDFPSLSASTSSSCSTAATPGPVGLALPYAIPARGRSAFQEEDFPALVSSVPKPGTAPTSLVSAWNSSSSSKKVAQPPLSAQATGSGQPTRKAGKGSRGGRKGGPPFTQEEEEDGGPALQELLSTRPTGSVSSTLGLASIQPSKVGKKKKVGSEKPGTTLPQPPPATCPPGALQAPEAPASRAEGPVAVVVNGHMEGPAPARSAPKEPPGLPRPLGSFPCPTPQEDFPALGGPCPPRMPPPPGFSAVVLLKGTPPPPPPGLVPPISKPPPGFSGLLPSPHPACVPSPATTTTTKAPRLLPAPRAYLVPENFRERNLQLIQSIRDFLQSDEARFSEFKSHSGEFRQGLISAAQYYKSCRDLLGENFQKVFNELLVLLPDTAKQQELLSAHTDFCNREKPLSTKSKKNKKSAWQATTQQAGLDCRVCPTCQQVLAHGDASSHQALHAARDDDFPSLQAIARIIT

SEQ ID NO: 100704 - protein, 849 aa, Homo sapiens; identical to SEQ ID NO: 100703
  Payload ID: 20062
  Gene Name: zinc finger protein 598
  ENSP ID: ENSP00000455882

SEQ ID NO: 100705 - protein, 203 aa, Homo sapiens
  Payload ID: 20062
  Gene Name: zinc finger protein 598
  ENSP ID: ENSP00000456128
  MOD_RES (1)..(1): Any amino acid
XPKPGTAPTSLVSAWNSSSSSKKVAQPPLSAQATGSGQPTRKAGKGSRGGRKGGPPFTQEEEEDGGPALQELLSTRPTGSVSSTLGLASIQPSKVGKKKKVGSEKPGTTLPQPPPATCPPGALQAPEAPASRAEGPVAVVVNGHMEGPAPARSAPKEPPGLPRPLGSFPCPTPQEDFPALGGPCPPRMPPPPDPGCCLPHGRT

SEQ ID NO: 100706 - protein, 588 aa, Homo sapiens
  Payload ID: 20063
  Gene Name: zinc finger protein 599
  Uniprot ID: Q96NL3
  ENSP ID: ENSP00000333802
MAAPALALVSFEDVVVTFTGEEWGHLDLAQRTLYQEVMLETCRLLVSLGHPVPKPELIYLLEHGQELWTVKRGLSQSTCAGEKAKPKITEPTASQLAFSEESSFQELLAQRSSRDSRLGQARDEEKLIKIQEGNLRPGTNPHKEICPEKLSYKHDDLEPDDSLGLRVLQERVTPQDALHECDSQGPGKDPMTDARNNPYTCTECGKGFSKKWALVRHQQIHAGVKPYECNECGKACRYMADVIRHMRLHTGEKPYKCIECGKAFKRRFHLTEHQRIHTGDKPYECKECGKAFTHRSSFIQHNMTHTREKPFLCKECGKAFYYSSSFAQHMRIHTGKKLYECGECGKAFTHRSTFIQHNVTHTGEKPFLCKECGKTFCLNSSFTQHMRIHTGEKPYECGECGKAFTHRSTFIRHKRTHTGEKPFECKECGKAFCDSSSLIQHMRIHTGEKPYECSECGKAFTHHSVFIRHNRTHSGQKPLECKECAKAFYYSSSFTRHMRIHTGEKPYVCRECGKAFTQPANFVRHNRIHTGEKPFECKECEKAFCDNFALTQHMRTHTGEKPFECNECGKTFSHSSSFTHHRKIHTRV

SEQ ID NO: 100707 - protein, 82 aa, Homo sapiens
  Payload ID: 20063
  Gene Name: zinc finger protein 599
  ENSP ID: ENSP00000465262
MAAPALALVSFEDVVVTFTGEEWGHLDLAQRTLYQEVMLETCRLLVSLGHPVPKPELIYLLEHGQELWTVKRGLSQSTCAGW

SEQ ID NO: 100708 - protein, 95 aa, Homo sapiens
  Payload ID: 20063
  Gene Name: zinc finger protein 599
  Uniprot ID: Q96NL3
  ENSP ID: ENSP00000468446
MAAPALALVSFEDVVVTFTGEEWGHLDLAQRTLYQEVMLETCRLLVSLGHPVPKPELIYLLEHGQELWTVKRGLSQSTCAASFSLLWKSYHPGHG

SEQ ID NO: 100709 - protein, 722 aa, Homo sapiens
  Payload ID: 20064
  Gene Name: zinc finger protein 600
  Uniprot ID: Q6ZNG1
  ENSP ID: ENSP00000344791
MMKEVLSTGQGNTEVIHTGTLQRYQSYHIGDFCFQEIEKEIHDIEFQCQEDERNGHEAPMTKIKKLTGSTDQHDHRHAGNKPIKDQLGSSFYSHLPELHIIQIKGKIGNQFEKSTSDAPSVSTSQRISPRPQIHISNNYGNNSPNSSLLPQKQEVYMREKSFQCNESGKAFNCSSLLRKHQIPHLGDKQYKCDVCGKLFNHKQYLTCHCRCHTGEKPYKCNECGKSFSQVSSLTCHRRLHTAVKSHKCNECGKIFGQNSALVIHKAIHTGEKPYKCNECDKAFNQQSNLARHRRIHTGEKPYKCEECDKVFSRKSTLESHKRIHTGEKPYKCKVCDTAFTWNSQLARHKRIHTGEKTYKCNECGKTFSHKSSLVCHHRLHGGEKSYKCKVCDKAFAWNSHLVRHTRIHSGGKPYKCNECGKTFGQNSDLLIHKSIHTGEQPYKYEECEKVFSCGSTLETHKIIHTGEKPYKCKVCDKAFACHSYLAKHTRIHSGEKPYKCNECSKTFRLRSYLASHRRVHSGEKPYKCNECSKTFSQRSYLHCHRRLHSGEKPYKCNECGKTFSHKPSLVHHRRLHTGEKSYKCTVCDKAFVRNSYLARHTRIHTAEKPYKCNECGKAFNQQSQLSLHHRIHAGEKLYKCETCDKVFSRKSHLKRHRRIHPGKKPYKCKVCDKTFGSDSHLKQHTGLHTGEKPYKCNECGKAFSKQSTLIHHQAVHGVGKLD

SEQ ID NO: 100710 - protein, 508 aa, Homo sapiens
  Payload ID: 20064
  Gene Name: zinc finger protein 600
  ENSP ID: ENSP00000353410
MALPQGLLTFRDVAIEFSQEEWKCLDPAQRTLYRDVMLENYRNLVSLDISSKCMMKTFFSTGQGNTEAFHTGTLQRQASHHIGDFCFQKIEKDIHGFQFQWKEDETNDHAAPMTEIKELTGSTGQHDQRHAGNKHIKDQLGLSFHSHLPKHTIIHTGEKPYKCEECEKVFSRKSHLERHKRIHTGEKPYKCKVCDKAFAYNSYLAKHSIIHTGEKPYKCNECGKVFNQQANLACHHRVHTGEKPYKCNECGKTFSQMSNLVYHHRLHTGEKPYKCNECGKIFGQNSALVIHKAIHTGEKPYKCNECDKAFNQQSNLARHRRIHTGEKPYKCEECDKVFSRKSTLESHKRIHTGEKPYKCKVCDKAFVRNSYLARHTRIHTAEKPYKCNECGKAFNQQSQLSLHHRIHAGEKLYKCETCDKVFSRKSHLKRHRRIHTGEKPHMCDDCGKAFTSCSHLIRHQRIPTGQKSYKCQKCGKVLSPRSLLAEHQKIHFDNCSQCSEYSKPSSIN

SEQ ID NO: 100711 - protein, 641 aa, Homo sapiens
  Payload ID: 20065
  Gene Name: zinc finger protein 605
  Uniprot ID: Q86T29
  ENSP ID: ENSP00000353314
MIQSQISFEDVAVDFTLEEWQLLNPTQKNLYRDVMLENYSNLVFLEVWLDNPKMWLRDNQDNLKSMERGHKYDVFGKIFNSSINIVHVGLRSHKCGTGEKSLKCPFDLLIPKNNCERKKIDELNKKLLFCIKPGRTHGGIKYCDCSTCRKSSNEEPWLTANHITHTGVYLCMECGRFFNKKSQLVIHQRTHTGEKPYQCSECGKAFSQKSLLTVHQRTHSGEKPHGCSECQKAFSRKSLLILHQRIHTGEKPYGCSECGKAFSRKSQLKRHQITHTIEKPYSCSECGKAFSQKLKLITHQRAHTGEKPYPCSHCGKAFFWKSQLITHQRTHTGKKPYGCGECQKAFSRNSLLIRHQRIHTGEKPYECNECGEAFIRKPQLIKHQITHTGEKNYRCSDCEEAFFKKSELIRHQKIHLGEKPYGCIQCGKTFFGKSQLLTHHRTHTGEKPYECSECGKAFTQKSSLISHQRTHTGEKPYECSECRKTFSEKSSLIHHQRTHTGEKPFECSECRKAFAWKPQLLRHQRIHTGEKPYECSECGKAFVQKVQLIKHQRNHTGEKTYGCSDCAKAFFEKAQLIIHQRIHTGERPYKCGECGKSFTRKSHLMRHQRIHTGDKYYGCNECGTTFNRKSQLMIHQRNHII

SEQ ID NO: 100712 - protein, 672 aa, Homo sapiens
  Payload ID: 20065
  Gene Name: zinc finger protein 605
  Uniprot ID: Q86T29
  ENSP ID: ENSP00000376135
MIQSQISFEDVAVDFTLEEWQLLNPTQKNLYRDVMLENYSNLVFLGFQILKPDAMFKLEQQDPWIIGQEILNQNFSEVWLDNPKMWLRDNQDNLKSMERGHKYDVFGKIFNSSINIVHVGLRSHKCGTGEKSLKCPFDLLIPKNNCERKKIDELNKKLLFCIKPGRTHGGIKYCDCSTCRKSSNEEPWLTANHITHTGVYLCMECGRFFNKKSQLVIHQRTHTGEKPYQCSECGKAFSQKSLLTVHQRTHSGEKPHGCSECQKAFSRKSLLILHQRIHTGEKPYGCSECGKAFSRKSQLKRHQITHTIEKPYSCSECGKAFSQKLKLITHQRAHTGEKPYPCSHCGKAFFWKSQLITHQRTHTGKKPYGCGECQKAFSRNSLLIRHQRIHTGEKPYECNECGEAFIRKPQLIKHQITHTGEKNYRCSDCEEAFFKKSELIRHQKIHLGEKPYGCIQCGKTFFGKSQLLTHHRTHTGEKPYECSECGKAFTQKSSLISHQRTHTGEKPYECSECRKTFSEKSSLIHHQRTHTGEKPFECSECRKAFAWKPQLLRHQRIHTGEKPYECSECGKAFVQKVQLIKHQRNHTGEKTYGCSDCAKAFFEKAQLIIHQRIHTGERPYKCGECGKSFTRKSHLMRHQRIHTGDKYYGCNECGTTFNRKSQLMIHQRNHII

SEQ ID NO: 100713 - protein, 792 aa, Homo sapiens
  Payload ID: 20066
  Gene Name: zinc finger protein 606
  Uniprot ID: Q8WXB4
  ENSP ID: ENSP00000343617
MAAINPWASWGALTDQSWGMTAVDPWASWALCPQYPAWHVEGSLEEGRRATGLPAAQVQEPVTFKDVAVDFTQEEWGQLDLVQRTLYRDVMLETYGHLLSVGNQIAKPEVISLLEQGEEPWSVEQACPQRTCPEWVRNLESKALIPAQSIFEEEQSHGMKLERYIWDDPWFSRLEVLGCKDQLEMYHMNQSTAMRQMVFMQKQVLSQRSSEFCGLGAEFSQNLNFVPSQRVSQIEHFYKPDTHAQSWRCDSAIMYADKVTCENNDYDKTVYQSIQPIYPARIQTGDNLFKCTDAVKSFNHIIHFGDHKGIHTGEKLYEYKECHQIFNQSPSFNEHPRLHVGENQYNYKEYENIFYFSSFMEHQKIGTVEKAYKYNEWEKVFGYDSFLTQHTSTYTAEKPYDYNECGTSFIWSSYLIQHKKTHTGEKPYECDKCGKVFRNRSALTKHERTHTGIKPYECNKCGKAFSWNSHLIVHKRIHTGEKPYVCNECGKSFNWNSHLIGHQRTHTGEKPFECTECGKSFSWSSHLIAHMRMHTGEKPFKCDECEKAFRDYSALSKHERTHSGAKPYKCTECGKSFSWSSHLIAHQRTHTGEKPYNCQECGKAFRERSALTKHEIIHSGIKPYECNKCGKSCSQMAHLVRHQRTHTGEKPYECNKCGKSFSQSCHLVAHRRIHTGEKPYKCNQCERSFNCSSHLIAHRRTHTGEKPYRCNECGKAFNESSSLIVHLRNHTGEKPYKCNHCEKAFCKNSSLIIHQRMHSGEKRFICSECGKAFSGHSALLQHQRNHSEEKLN

SEQ ID NO: 100714 - protein, 69 aa, Homo sapiens
  Payload ID: 20066
  Gene Name: zinc finger protein 606
  ENSP ID: ENSP00000446487
MAAINPWASWGALTDQSWGMTAVDPWASWALCPQYPAWHVEGSLEEGRRATGLPAAQVQVRWGCPVPRG

SEQ ID NO: 100715 - protein, 58 aa, Homo sapiens
  Payload ID: 20066
  Gene Name: zinc finger protein 606
  ENSP ID: ENSP00000446845
MAAINPWASWGALTDQSWGMTAVDPWASWGTSDLQGRGRGLHPRRVGAAGPCSEDPVP

SEQ ID NO: 100716 - protein, 508 aa, Homo sapiens
  Payload ID: 20066
  Gene Name: zinc finger protein 606
  ENSP ID: ENSP00000446972
MAAINPWASWGALTDQSWGMTAVDPWASWALCPQYPAWHVEGSLEEGRRATGLPAAQVQEPVTFKDVAVDFTQEEWGQLDLVQRTLYRDVMLETYGHLLSVGNQIAKPEVISLLEQGEEPWSVEQACPQRTCPEWVRNLESKALIPAQSIFEEEQSHGMKLERYIWDDPWFSRLEVLGCKDQLEMYHMNQSTAMRQMVFMQKQVLSQRSSEFCGLGAEFSQNLNFVPSQRVSQIEHFYKPDTHAQSWRCDSAIMYADKVTCENNDYDKTVYQSIQPIYPARIQTGDNLFKCTDAVKSFNHIIHFGDHKGIHTGEKLYEYKECHQIFNQSPSFNEHPRLHVGENQYNYKEYENIFYFSSFMEHQKIGTVEKAYKYNEWEKVFGYDSFLTQHTSTYTAEKPYDYNECGTSFIWSSYLIQHKKTHTGEKPYECDKCGKVFRNRSALTKHERTHTGIKPYECNKCGKAFSWNSHLIVHKRIHTGEKPYVCNECGKSFNWNSHLIGHQRTHTG

SEQ ID NO: 100717 - protein, 66 aa, Homo sapiens
  Payload ID: 20066
  Gene Name: zinc finger protein 606
  ENSP ID: ENSP00000447075
MAAINPWASWGALTDQSWGMTAVDPWASWGESRAWSAVGCHIVASGCSALPQLGNRMGTRWGFRAG

SEQ ID NO: 100718 - protein, 88 aa, Homo sapiens
  Payload ID: 20066
  Gene Name: zinc finger protein 606
  ENSP ID: ENSP00000447726
MAAINPWASWGALTDQSWGMTAVDPWASWGESRAWSAVGCHIVASGCSALPQLGNRMGTRWGFRAGGPDLSLCRAGTRRNQKTSGQAW

SEQ ID NO: 100719 - protein, 69 aa, Homo sapiens; identical to SEQ ID NO: 100714
  Payload ID: 20066
  Gene Name: zinc finger protein 606
  ENSP ID: ENSP00000449865

SEQ ID NO: 100720 - protein, 696 aa, Homo sapiens
  Payload ID: 20067
  Gene Name: zinc finger protein 607
  Uniprot ID: Q96SK3
  ENSP ID: ENSP00000347338
MSYGSITFGDVAIDFSHQEWEYLSLVQKTLYQEVMMENYDNLVSLAGHSVSKPDLITLLEQGKEPWMIVREETRGECTDLDSRCEIISDGKMQLYRKHSCVTLHQRIHNGQKPYECKQCQKSFSHLTELMVHQTIHTSEEPDQCEKFRKAFSHLTDLRKHQKINAREKPYECEECGKVFSYPANLAQHGKVHVEKPYECKECGEAFRTSRQLTVHHRFHYGEKPYECKECGKAFSVYGRLSRHQSIHTGEKPFECNKCGKSFRLKAGLKVHQSIHTGEKPHECKECGKAFRQFSHLVGHKRIHTGEKPYECKECGKGFTCRYQLTMHQRIYSGEKHYECKENGEAFSSGHQLTAPHTFESVEKPYKCEECGKAFSVHGRLTRHQGIHSGKKPYECNKCGKSFRLNSSLKIHQNIHTGEKPYKCKECGKAFSQRAHLAHHNRIHTGYKPFECKECGKSFRCASYLVIHERIHTGEKPYVCQECGKGFSYSHKLTIHRRVHTGEKPYECKECGKAFSVSGQLTQHLSIHSGKKPFECNKCGKSFRFISVLKAHQNIHSAEKPYECKECGKAFRHATSLIYHDRTHAGEKSYECKECGETFSHASHLIIHERIHTSDKPYECKRCGKAFHCASYLVRHESVHADGNPYMCEECGKAFNSSHELSIHHRVHTGEKPFKCNKCRRSFRLRSILEVHQRIHI

SEQ ID NO: 100721 - protein, 695 aa, Homo sapiens
  Payload ID: 20067
  Gene Name: zinc finger protein 607
  Uniprot ID: Q96SK3
  ENSP ID: ENSP00000438015
MSYGSITFGDVAIDFSHQEWEYLSLVQKTLYQEVMMENYDNLVSLGHSVSKPDLITLLEQGKEPWMIVREETRGECTDLDSRCEIISDGKMQLYRKHSCVTLHQRIHNGQKPYECKQCQKSFSHLTELMVHQTIHTSEEPDQCEKFRKAFSHLTDLRKHQKINAREKPYECEECGKVFSYPANLAQHGKVHVEKPYECKECGEAFRTSRQLTVHHRFHYGEKPYECKECGKAFSVYGRLSRHQSIHTGEKPFECNKCGKSFRLKAGLKVHQSIHTGEKPHECKECGKAFRQFSHLVGHKRIHTGEKPYECKECGKGFTCRYQLTMHQRIYSGEKHYECKENGEAFSSGHQLTAPHTFESVEKPYKCEECGKAFSVHGRLTRHQGIHSGKKPYECNKCGKSFRLNSSLKIHQNIHTGEKPYKCKECGKAFSQRAHLAHHNRIHTGYKPFECKECGKSFRCASYLVIHERIHTGEKPYVCQECGKGFSYSHKLTIHRRVHTGEKPYECKECGKAFSVSGQLTQHLSIHSGKKPFECNKCGKSFRFISVLKAHQNIHSAEKPYECKECGKAFRHATSLIYHDRTHAGEKSYECKECGETFSHASHLIIHERIHTSDKPYECKRCGKAFHCASYLVRHESVHADGNPYMCEECGKAFNSSHELSIHHRVHTGEKPFKCNKCRRSFRLRSILEVHQRIHI

SEQ ID NO: 100722 - protein, 102 aa, Homo sapiens
  Payload ID: 20067
  Gene Name: zinc finger protein 607
  ENSP ID: ENSP00000466265
MSYGSITFGDVAIDFSHQEWEYLSLVQKTLYQEVMMENYDNLVSLGHSVSKPDLITLLEQGKEPWMIVREETRGECTAELQSKNCGFQLRDLQDSLHLRKNC

SEQ ID NO: 100723 - protein, 112 aa, Homo sapiens
  Payload ID: 20067
  Gene Name: zinc finger protein 607
  ENSP ID: ENSP00000466785
MQLYRKHSCVTLHQRIHNGQKPYECKQCQKSFSHLTELMVHQTIHTSEEPDQCEKFRKAFSHLTDLRKHQKINAREKPYECEECGKVFSYPANLAQHGKVHVEKPYECKECG

SEQ ID NO: 100724 - protein, 70 aa, Homo sapiens
  Payload ID: 20067
  Gene Name: zinc finger protein 607
  ENSP ID: ENSP00000468817
MSYGSITFGDVAIDFSHQEWEYLSLVQKTLYQEVMMENYDNLVSLDLDSRCEIISDGKMQLYRKHSCVTL

SEQ ID NO: 100725 - protein, 1512 aa, Homo sapiens
  Payload ID: 20068
  Gene Name: zinc finger protein 608
  Uniprot ID: Q9ULD9
  ENSP ID: ENSP00000307746
MSVNISTAGKGVDPNTVDTYDSGDDWEIGVGNLIIDLDADLEKDRQKFEMNNSTTTTSSSNSKDCGGPASSGAGATAALADGLKFASVQASAPQGNSHKETSKSKVKRSKTSKDANKSLPSAALYGIPEISSTGKRQEVQGRPGEATGMNSALGQSVSSGGSGNPNSNSTSTSTSAATAGAGSCGKSKEEKPGKSQSSRGAKRDKDAGKSRKDKHDLLQGHQNGSGSQAPSGGHLYGFGAKSNGGGASPFHCGGTGSGSVAAAGEVSKSAPDSGLMGNSMLVKKEEEEEESHRRIKKLKTEKVDPLFTVPAPPPPISSSLTPQILPSYFSPSSSNIAAPVEQLLVRTRSVGVNTCEVGVVTEPECLGPCEPGTSVNLEGIVWHETEEGVLVVNVTWRNKTYVGTLLDCTKHDWAPPRFCESPTSDLEMRGGRGRGKRARSAAAAPGSEASFTESRGLQNKNRGGANGKGRRGSLNASGRRTPPNCAAEDIKASPSSTNKRKNKPPMELDLNSSSEDNKPGKRVRTNSRSTPTTPQGKPETTFLDQGCSSPVLIDCPHPNCNKKYKHINGLRYHQAHAHLDPENKLEFEPDSEDKISDCEEGLSNVALECSEPSTSVSAYDQLKAPASPGAGNPPGTPKGKRELMSNGPGSIIGAKAGKNSGKKKGLNNELNNLPVISNMTAALDSCSAADGSLAAEMPKLEAEGLIDKKNLGDKEKGKKATNCKTDKNLSKLKSARPIAPAPAPTPPQLIAIPTATFTTTTTGTIPGLPSLTTTVVQATPKSPPLKPIQPKPTIMGEPITVNPALVSLKDKKKKEKRKLKDKEGKETGSPKMDAKLGKLEDSKGASKDLPGHFLKDHLNKNEGLANGLSESQESRMASIKAEADKVYTFTDNAPSPSIGSASRLECSTLVNGQAPMAPLHVLTQNGAESSAAKTSSPAYSDISDAADDGGSDSRSEGMRSKASSPSDIISSKDSVVKGHSSTTAQSSQLKESHSPYYHSYDPYYSPSYMHPGQVGAPAAGNSGSTQGMKIKKESEEDAEKKDKAEQLDSKKVDHNSASLQPQHQSVITQRHPALAQSLYYGQYAYGLYMDQKSLMATSPAYRQQYEKYYEDQRLAEQKMAQTGRGDCERKSELPLKELGKEETKQKNMPSATISKAPSTPEPNKNHSKLGPSVPNKTEETGKSQLLSNHQQQLQADSFKAKQMENHQLIKEAVEMKSVMDSMKQTGVDPTSRFKQDPDSRTWHHYVYQPKYLDQQKSEELDREKKLKEDSPRKTPNKESGVPSLPVSLTSIKEEPKEAKHPDSQSMEESKLKNDDRKTPVNWKDSRGTRVAVSSPMSQHQSYIQYLHAYPYPQMYDPSHPAYRAVSPVLMHSYPGAYLSPGFHYPVYGKMSGREETEKVNTSPSVNTKTTTESKALDLLQQHANQYRSKSPAPVEKATAEREREAERERDRHSPFGQRHLHTHHHTHVGMGYPLIPGQYDPFQGLTSAALVASQQVAAQASASGMFPGQRRE

SEQ ID NO: 100726 - protein, 707 aa, Homo sapiens
  Payload ID: 20068
  Gene Name: zinc finger protein 608
  ENSP ID: ENSP00000421899
MSVNISTAGKGVDPNTVDTYDSGDDWEIGVGNLIIDLDADLEKDRQKFEMNNSTTTTSSSNSKDCGGPASSGAGATAALADGLKFASVQASAPQGNSHKETSKSKVKRSKTSKDANKSLPSAALYGIPEISSTGKRQEVQGRPGEATGMNSALGQSVSSGGSGNPNSNSTSTSTSAATAGAGSCGKSKEEKPGKSQSSRGAKRDKDAGKSRKDKHDLLQGHQNGSGSQAPSGGHLYGFGAKSNGGGASPFHCGGTGSGSVAAAGEVSKSAPDSGLMGNSMLVKKEEEEEESHRRIKKLKTEKVDPLFTVPAPPPPISSSLTPQILPSYFSPSSSNIAAPVEQLLVRTRSVGVNTCEVGVVTEPECLGPCEPGTSVNLEGIVWHETEEGVLVVNVTWRNKTYVGTLLDCTKHDWAPPRFCESPTSDLEMRGGRGRGKRARSAAAAPGSEASFTESRGLQNKNRGGANGKGRRGSLNASGRRTPPNCAAEDIKASPSSTNKRKNKPPMELDLNSSSEDNKPGKRVRTNSRSTPTTPQGKPETTFLDQGCSSPVLIDCPHPNCNKKYKHINGLRYHQAHAHLDPENKLEFEPDSEDKISDCEEGLSNVALECSEPSTSVSAYDQLKAPASPGAGNPPGTPKGKRELMSNGPGSIIGAKAGKNSGKKKGLNNELNNLPVISNMTAALDSCSAADGSLAAEMPKLEAEGLID

SEQ ID NO: 100727 - protein, 715 aa, Homo sapiens
  Payload ID: 20068
  Gene Name: zinc finger protein 608
  ENSP ID: ENSP00000423279
MSVNISTAGKGVDPNTVDTYDSGDDWEIGVGNLIIDLDADLEKDRQKFEMNNSTTTTSSSNSKDCGGPASSGAGATAALADGLKFASVQASAPQGNSHKETSKSKVKRSKTSKDANKSLPSAALYGIPEISSTGKRQEVQGRPGEATGMNSALGQSVSSGGSGNPNSNSTSTSTSAATAGAGSCGKSKEEKPGKSQSSRGAKRDKDAGKSRKDKHDLLQGHQNGSGSQAPSGGHLYGFGAKSNGGGASPFHCGGTGSGSVAAAGEVSKSAPDSGLMGNSMLVKKEEEEEESHRRIKKLKTEKVDPLFTVPAPPPPISSSLTPQILPSYFSPSSSNIAAPVEQLLVRTRSVGVNTCEVGVVTEPECLGPCEPGTSVNLEGIVWHETEEGVLVVNVTWRNKTYVGTLLDCTKHDWAPPRFCESPTSDLEMRGGRGRGKRARSAAAAPGSEASFTESRGLQNKNRGGANGKGRRGSLNASGRRTPPNCAAEDIKASPSSTNKRKNKPPMELDLNSSSEDNKPGKRVRTNSRSTPTTPQGKPETTFLDQGCSSPVLIDCPHPNCNKKYKHINGLRYHQAHAHLDPENKLEFEPDSEDKISDCEEGLSNVALECSEPSTSVSAYDQLKAPASPGAGNPPGTPKGKRELMSNGPGSIIGAKAGKNSGKKKGLNNELNNLPVISNMTAALDSCSAADGSLAAEMPKLEAEGLIDKKNLGDKE

SEQ ID NO: 100728 - protein, 447 aa, Homo sapiens
  Payload ID: 20068
  Gene Name: zinc finger protein 608
  ENSP ID: ENSP00000424086
MSVNISTAGKGVDPNTVDTYDSGDDWEIGVGNLIIDLDADLEKDRQKFEMNNSTTTTSSSNSKDCGGPASSGAGATAALADGLKFASVQASAPQGNSHKETSKSKVKRSKTSKDANKSLPSAALYGIPEISSTGKRQEVQGRPGEATGMNSALGQSVSSGGSGNPNSNSTSTSTSAATAGAGSCGKSKEEKPGKSQSSRGAKRDKDAGKSRKDKHDLLQGHQNGSGSQAPSGGHLYGFGAKSNGGGASPFHCGGTGSGSVAAAGEVSKSAPDSGLMGNSMLVKKEEEEEESHRRIKKLKTEKVDPLFTVPAPPPPISSSLTPQILPSYFSPSSSNIAAPVEQLLVRTRSVGVNTCEVGVVTEPECLGPCEPGTSVNLEGIVWHETEEGVLVVNVTWRNKTYVGTLLDCTKHDWAPPRTQIQEHGIIMYTSPNIWISKSQKNLIERRN

SEQ ID NO: 100729 - protein, 1085 aa, Homo sapiens
  Payload ID: 20068
  Gene Name: zinc finger protein 608
  Uniprot ID: Q9ULD9
  ENSP ID: ENSP00000427657
MRGGRGRGKRARSAAAAPGSEASFTESRGLQNKNRGGANGKGRRGSLNASGRRTPPNCAAEDIKASPSSTNKRKNKPPMELDLNSSSEDNKPGKRVRTNSRSTPTTPQGKPETTFLDQGCSSPVLIDCPHPNCNKKYKHINGLRYHQAHAHLDPENKLEFEPDSEDKISDCEEGLSNVALECSEPSTSVSAYDQLKAPASPGAGNPPGTPKGKRELMSNGPGSIIGAKAGKNSGKKKGLNNELNNLPVISNMTAALDSCSAADGSLAAEMPKLEAEGLIDKKNLGDKEKGKKATNCKTDKNLSKLKSARPIAPAPAPTPPQLIAIPTATFTTTTTGTIPGLPSLTTTVVQATPKSPPLKPIQPKPTIMGEPITVNPALVSLKDKKKKEKRKLKDKEGKETGSPKMDAKLGKLEDSKGASKDLPGHFLKDHLNKNEGLANGLSESQESRMASIKAEADKVYTFTDNAPSPSIGSASRLECSTLVNGQAPMAPLHVLTQNGAESSAAKTSSPAYSDISDAADDGGSDSRSEGMRSKASSPSDIISSKDSVVKGHSSTTAQSSQLKESHSPYYHSYDPYYSPSYMHPGQVGAPAAGNSGSTQGMKIKKESEEDAEKKDKAEQLDSKKVDHNSASLQPQHQSVITQRHPALAQSLYYGQYAYGLYMDQKSLMATSPAYRQQYEKYYEDQRLAEQKMAQTGRGDCERKSELPLKELGKEETKQKNMPSATISKAPSTPEPNKNHSKLGPSVPNKTEETGKSQLLSNHQQQLQADSFKAKQMENHQLIKEAVEMKSVMDSMKQTGVDPTSRFKQDPDSRTWHHYVYQPKYLDQQKSEELDREKKLKEDSPRKTPNKESGVPSLPVSLTSIKEEPKEAKHPDSQSMEESKLKNDDRKTPVNWKDSRGTRVAVSSPMSQHQSYIQYLHAYPYPQMYDPSHPAYRAVSPVLMHSYPGAYLSPGFHYPVYGKMSGREETEKVNTSPSVNTKTTTESKALDLLQQHANQYRSKSPAPVEKATAEREREAERERDRHSPFGQRHLHTHHHTHVGMGYPLIPGQYDPFQGLTSAALVASQQVAAQASASGMFPGQRRE

SEQ ID NO: 100730 - protein, 447 aa, Homo sapiens; identical to SEQ ID NO: 100728
  Payload ID: 20068
  Gene Name: zinc finger protein 608
  ENSP ID: ENSP00000477767

SEQ ID NO: 100731 - protein, 1411 aa, Homo sapiens
  Payload ID: 20069
  Gene Name: zinc finger protein 609
  Uniprot ID: O15014
  ENSP ID: ENSP00000316527
MSLSSGASGGKGVDANPVETYDSGDEWDIGVGNLIIDLDADLEKDQQKLEMSGSKEVGIPAPNAVATLPDNIKFVTPVPGPQGKEGKSKSKRSKSGKDTSKPTPGTSLFTPSEGAASKKEVQGRSGDGANAGGLVAAIAPKGSEKAAKASRSVAGSKKEKENSSSKSKKERSEGVGTCSEKDPGVLQPVPLGGRGGQYDGSAGVDTGAVEPLGSIAIEPGAALNPLGTKPEPEEGENECRLLKKVKSEKMESPVSTPAVLPIHLLVPVVNNDISSPCEQIMVRTRSVGVNTCDVALATEPECLGPCEPGTSVNLEGIVWQETEDGMLVVNVTWRNKTYVGTLLDCTRHDWAPPRFCDSPTSDLEMRNGRGRGKRMRPNSNTPVNETATASDSKGTSNSSKTRAGANSKGRRGSQNSSEHRPPASSTSEDVKASPSSANKRKNKPLSDMELNSSSEDSKGSKRVRTNSMGSATGPLPGTKVEPTVLDRNCPSPVLIDCPHPNCNKKYKHINGLKYHQAHAHTDDDSKPEADGDSEYGEEPILHADLGSCNGASVSQKGSLSPARSATPKVRLVEPHSPSPSSKFSTKGLCKKKLSGEGDTDLGALSNDGSDDGPSVMDETSNDAFDSLERKCMEKEKCKKPSSLKPEKIPSKSLKSARPIAPAIPPQQIYTFQTATFTAASPGSSSGLTATVAQAMPNSPQLKPIQPKPTVMGEPFTVNPALTPAKDKKKKDKKKKESSKELESPLTPGKVCRAEEGKSPFRESSGDGMKMEGLLNGSSDPHQSRLASIKAEADKIYSFTDNAPSPSIGGSSRLENTTPTQPLTPLHVVTQNGAEASSVKTNSPAYSDISDAGEDGEGKVDSVKSKDAEQLVKEGAKKTLFPPQPQSKDSPYYQGFESYYSPSYAQSSPGALNPSSQAGVESQALKTKRDEEPESIEGKVKNDICEEKKPELSSSSQQPSVIQQRPNMYMQSLYYNQYAYVPPYGYSDQSYHTHLLSTNTAYRQQYEEQQKRQSLEQQQRGVDKKAEMGLKEREAALKEEWKQKPSIPPTLTKAPSLTDLVKSGPGKAKEPGADPAKSVIIPKLDDSSKLPGQAPEGLKVKLSDASHLSKEASEAKTGAECGRQAEMDPILWYRQEAEPRMWTYVYPAKYSDIKSEDERWKEERDRKLKEERSRSKDSVPKEDGKESTSSDCKLPTSEESRLGSKEPRPSVHVPVSSPLTQHQSYIPYMHGYSYSQSYDPNHPSYRSMPAVMMQNYPGSYLPSSYSFSPYGSKVSGGEDADKARASPSVTCKSSSESKALDILQQHASHYKSKSPTISDKTSQERDRGGCGVVGGGGSCSSVGGASGGERSVDRPRTSPSQRLMSTHHHHHHLGYSLLPAQYNLPYAAGLSSTAIVASQQGSTPSLYPPPRR

SEQ ID NO: 100732 - protein, 331 aa, Homo sapiens
  Payload ID: 20069
  Gene Name: zinc finger protein 609
  ENSP ID: ENSP00000388846
MSLSSGASGGKGVDANPVETYDSGDEWDIGVGNLIIDLDADLEKDQQKLEMSGSKEVGIPAPNAVATLPDNIKFVTPVPGPQGKEGKSKSKRSKSGKDTSKPTPGTSLFTPSEGAASKKEVQGRSGDGANAGGLVAAIAPKGSEKAAKASRSVAGSKKEKENSSSKSKKERSEGVGTCSEKDPGVLQPVPLGGRGGQYDGSAGVDTGAVEPLGSIAIEPGAALNPLGTKPEPEEGENECRLLKKVKSEKVRGGQIWLPTDCQSELPWTNCQILCVLCGRLISVWVMTNYKVRAAGNDNVVFFQIRGFPYRLIYSRPGHCGTGYLLLGAATL

SEQ ID NO: 100733 - protein, 462 aa, Homo sapiens
  Payload ID: 20070
  Gene Name: zinc finger protein 610
  Uniprot ID: Q8N9Z0
  ENSP ID: ENSP00000324441
MLCDEEAQKRKAKESGMALPQGRLTFMDVAIEFSQEEWKSLDPGQRALYRDVMLENYRNLVFLGICLPDLSIISMLKQRREPLILQSQVKIVKNTDGRECVRSVNTGRSCVLGSNAENKPIKNQLGLTLEAHLSELQLFQAGRKIYRSNQVEKFTNHRSSVSPLQKISSSFTTHIFNKYRNDLIDFPLLPQEEKAYIRGKSYEYECSEDGEVFRVRASLTNHQVIHTAEKPYKCTECGKVFSRNSHLVEHWRIHTGQKPYKCSECDKVFNRNSNLARHQRIHTGEKPHKCNECGKAFRECSGLTTHLVIHTGEKPYKCNECGKNFRHKFSLTNHQRSHTAEKPYKCNECGKVFSLLSYLARHQIIHSTEKPYKCNECGRAFHKRPGLMAHLLIHTGEKPYKCNECDKVFGRKLYLTNHQRIHTGERPYKCNACGKVFNQNPHLSRHRKIHAGENSLRTLQME

SEQ ID NO: 100734 - protein, 462 aa, Homo sapiens; identical to SEQ ID NO: 100733
  Payload ID: 20070
  Gene Name: zinc finger protein 610
  Uniprot ID: Q8N9Z0
  ENSP ID: ENSP00000327597

SEQ ID NO: 100735 - protein, 462 aa, Homo sapiens; identical to SEQ ID NO: 100733
  Payload ID: 20070
  Gene Name: zinc finger protein 610
  Uniprot ID: Q8N9Z0
  ENSP ID: ENSP00000383922

SEQ ID NO: 100736 - protein, 85 aa, Homo sapiens
  Payload ID: 20070
  Gene Name: zinc finger protein 610
  ENSP ID: ENSP00000469935
MLCDEEAQKRKAKESGMALPQGRLTFMDVAIEFSQEEWKSLDPGQRALYRDVMLENYRNLVFLGICLPDLSIISMLKQRREPLIL

SEQ ID NO: 100737 - protein, 419 aa, Homo sapiens
  Payload ID: 20070
  Gene Name: zinc finger protein 610
  Uniprot ID: Q8N9Z0
  ENSP ID: ENSP00000471021
MLCDEEAQKRKAKESGMALPQGRLTFMDVAIEFSQEEWKSLDPGQRALYRDVMLENYRNLVFLGRSCVLGSNAENKPIKNQLGLTLEAHLSELQLFQAGRKIYRSNQVEKFTNHRSSVSPLQKISSSFTTHIFNKYRNDLIDFPLLPQEEKAYIRGKSYEYECSEDGEVFRVRASLTNHQVIHTAEKPYKCTECGKVFSRNSHLVEHWRIHTGQKPYKCSECDKVFNRNSNLARHQRIHTGEKPHKCNECGKAFRECSGLTTHLVIHTGEKPYKCNECGKNFRHKFSLTNHQRSHTAEKPYKCNECGKVFSLLSYLARHQIIHSTEKPYKCNECGRAFHKRPGLMAHLLIHTGEKPYKCNECDKVFGRKLYLTNHQRIHTGERPYKCNACGKVFNQNPHLSRHRKIHAGENSLRTLQME

SEQ ID NO: 100738 - protein, 419 aa, Homo sapiens; identical to SEQ ID NO: 100737
  Payload ID: 20070
  Gene Name: zinc finger protein 610
  Uniprot ID: Q8N9Z0
  ENSP ID: ENSP00000477617

SEQ ID NO: 100739 - protein, 462 aa, Homo sapiens; identical to SEQ ID NO: 100733
  Payload ID: 20070
  Gene Name: zinc finger protein 610
  Uniprot ID: Q8N9Z0
  ENSP ID: ENSP00000485001

SEQ ID NO: 100740 - protein, 705 aa, Homo sapiens
  Payload ID: 20071
  Gene Name: zinc finger protein 611
  Uniprot ID: Q8N823
  ENSP ID: ENSP00000322427
MLREEAAQKRKGKEPGMALPQGRLTFRDVAIEFSLAEWKCLNPSQRALYREVMLENYRNLEAVDISSKCMMKEVLSTGQGNTEVIHTGTLQRHESHHIGDFCFQEIEKEIHDIEFQCQEDERNGLEAPMTKIKKLTGSTDQHDHRHAGNKPIKDQLGSSFYSHLPELHIFQIKGEIGNQLEKSTNDAPSVSTFQRISCRPQTQISNNYGNNPLNSSLLPQKQEVHMREKSFQCNKSGKAFNCSSLLRKHQIPHLGDKQYKCDVCGKLFNHEQYLACHDRCHTVEKPYKCKECGKTFSQESSLTCHRRLHTGVKRYNCNECGKIFGQNSALLIDKAIDTGENPYKCNECDKAFNQQSQLSHHRIHTGEKPYKCEECDKVFSRKSTIETHKRIHTGEKPYRCKVCDTAFTWHSQLARHRRIHTAKKTYKCNECGKTFSHKSSLVCHHRLHGGEKSYKCKVCDKAFVWSSQLAKHTRIDCGEKPYKCNECGKTFGQNSDLLIHKSIHTGEQPYKCDECEKVFSRKSSLETHKIGHTGEKPYKCKVCDKAFACHSYLAKHTRIHSGEKPYKCNECSKTFSHRSYLVCHHRVHSGEKPYKCNECSKTFSRRSSLHCHRRLHSGEKPYKCNECGNTFRHCSSLIYHRRLHTGEKSYKCTICDKAFVRNSLLSRHTRIHTAEKPYKCNECGKAFNQQSHLSRHHRIHTGEKP

SEQ ID NO: 100741 - protein, 705 aa, Homo sapiens; identical to SEQ ID NO: 100740
  Payload ID: 20071
  Gene Name: zinc finger protein 611
  Uniprot ID: Q8N823
  ENSP ID: ENSP00000437616

SEQ ID NO: 100742 - protein, 705 aa, Homo sapiens; identical to SEQ ID NO: 100740
  Payload ID: 20071
  Gene Name: zinc finger protein 611
  Uniprot ID: Q8N823
  ENSP ID: ENSP00000439211

SEQ ID NO: 100743 - protein, 636 aa, Homo sapiens
  Payload ID: 20071
  Gene Name: zinc finger protein 611
  Uniprot ID: Q8N823
  ENSP ID: ENSP00000443505
MMKEVLSTGQGNTEVIHTGTLQRHESHHIGDFCFQEIEKEIHDIEFQCQEDERNGLEAPMTKIKKLTGSTDQHDHRHAGNKPIKDQLGSSFYSHLPELHIFQIKGEIGNQLEKSTNDAPSVSTFQRISCRPQTQISNNYGNNPLNSSLLPQKQEVHMREKSFQCNKSGKAFNCSSLLRKHQIPHLGDKQYKCDVCGKLFNHEQYLACHDRCHTVEKPYKCKECGKTFSQESSLTCHRRLHTGVKRYNCNECGKIFGQNSALLIDKAIDTGENPYKCNECDKAFNQQSQLSHHRIHTGEKPYKCEECDKVFSRKSTIETHKRIHTGEKPYRCKVCDTAFTWHSQLARHRRIHTAKKTYKCNECGKTFSHKSSLVCHHRLHGGEKSYKCKVCDKAFVWSSQLAKHTRIDCGEKPYKCNECGKTFGQNSDLLIHKSIHTGEQPYKCDECEKVFSRKSSLETHKIGHTGEKPYKCKVCDKAFACHSYLAKHTRIHSGEKPYKCNECSKTFSHRSYLVCHHRVHSGEKPYKCNECSKTFSRRSSLHCHRRLHSGEKPYKCNECGNTFRHCSSLIYHRRLHTGEKSYKCTICDKAFVRNSLLSRHTRIHTAEKPYKCNECGKAFNQQSHLSRHHRIHTGEKP

SEQ ID NO: 100744 - protein, 48 aa, Homo sapiens
  Payload ID: 20071
  Gene Name: zinc finger protein 611
  ENSP ID: ENSP00000469110
MLREEAAQKRKGKEPGMALPQVESHFVTQAGVQWCDPGSLQPLPPRFK

SEQ ID NO: 100745 - protein, 75 aa, Homo sapiens
  Payload ID: 20071
  Gene Name: zinc finger protein 611
  ENSP ID: ENSP00000469314
MLREEAAQKRKGKEPGMALPQVESHFVTQAGVQWCDPGSLQPLPPRYLFQMHDEGGLVNRARQYRSDPHRDIAKT

SEQ ID NO: 100746 - protein, 636 aa, Homo sapiens; identical to SEQ ID NO: 100743
  Payload ID: 20071
  Gene Name: zinc finger protein 611
  Uniprot ID: Q8N823
  ENSP ID: ENSP00000469376

SEQ ID NO: 100747 - protein, 129 aa, Homo sapiens
  Payload ID: 20071
  Gene Name: zinc finger protein 611
  ENSP ID: ENSP00000470022
MMKEVLSTGQGNTEVIHTGTLQRHESHHIGDFCFQEIEKEIHDIEFQCQEDERNGLEAPMTKIKKLTGSTDQHDHRHAGNKPIKDQLGSSFYSHLPELHIFQIKGEIGNQLEKSTNDAPSVSTFQRISC

SEQ ID NO: 100748 - protein, 64 aa, Homo sapiens
  Payload ID: 20071
  Gene Name: zinc finger protein 611
  ENSP ID: ENSP00000470182
MLREEAAQKRKGKEPGMALPQGRLTFRDVAIEFSLAEWKCLNPSQRALYREVMLENYRNLEAVG

SEQ ID NO: 100749 - protein, 64 aa, Homo sapiens; identical to SEQ ID NO: 100748
  Payload ID: 20071
  Gene Name: zinc finger protein 611
  ENSP ID: ENSP00000471243

SEQ ID NO: 100750 - protein, 89 aa, Homo sapiens
  Payload ID: 20071
  Gene Name: zinc finger protein 611
  ENSP ID: ENSP00000472093
MLREEAAQKRKGKEPGMALPQGRLTFRDVAIEFSLAEWKCLNPSQRALYREVMLENYRNLEAVESHFVTQAGVQWCDPGSLQPLPPRFK

SEQ ID NO: 100751 - protein, 636 aa, Homo sapiens; identical to SEQ ID NO: 100743
  Payload ID: 20071
  Gene Name: zinc finger protein 611
  Uniprot ID: Q8N823
  ENSP ID: ENSP00000472648

SEQ ID NO: 100752 - protein, 80 aa, Homo sapiens
  Payload ID: 20071
  Gene Name: zinc finger protein 611
  ENSP ID: ENSP00000472849
MLREEAAQKRKGKEPGMALPQGRLTFRDVAIEFSLAEWKCLNPSQRALYREVMLENYRNLEAVETGFHCVSQDGLNLLTS

SEQ ID NO: 100753 - protein, 64 aa, Homo sapiens; identical to SEQ ID NO: 100748
  Payload ID: 20071
  Gene Name: zinc finger protein 611
  ENSP ID: ENSP00000472910

SEQ ID NO: 100754 - protein, 617 aa, Homo sapiens
  Payload ID: 20072
  Gene Name: zinc finger protein 613
  Uniprot ID: Q6PF04
  ENSP ID: ENSP00000293471
MIKSQESLTLEDVAVEFTWEEWQLLGPAQKDLYRDVMLENYSNLVSVGYQASKPDALFKLEQGEPWTVENEIHSQICPEIKKVDNHLQMHSQKQRCLKRVEQCHKHNAFGNIIHQRKSDFPLRQNHDTFDLHGKILKSNLSLVNQNKRYEIKNSVGVNGDGKSFLHAKHEQFHNEMNFPEGGNSVNTNSQFIKHQRTQNIDKPHVCTECGKAFLKKSRLIYHQRVHTGEKPHGCSICGKAFSRKSGLTEHQRNHTGEKPYECTECDKAFRWKSQLNAHQKIHTGEKSYICSDCGKGFIKKSRLINHQRVHTGEKPHGCSLCGKAFSKRSRLTEHQRTHTGEKPYECTECDKAFRWKSQLNAHQKAHTGEKSYICRDCGKGFIQKGNLIVHQRIHTGEKPYICNECGKGFIQKGNLLIHRRTHTGEKPYVCNECGKGFSQKTCLISHQRFHTGKTPFVCTECGKSCSHKSGLINHQRIHTGEKPYTCSDCGKAFRDKSCLNRHRRTHTGERPYGCSDCGKAFSHLSCLVYHKGMLHAREKCVGSVKLENPCSESHSLSHTRDLIQDKDSVNMVTLQMPSVAAQTSLTNSAFQAESKVAIVSQPVARSSVSADSRICTE

SEQ ID NO: 100755 - protein, 581 aa, Homo sapiens
  Payload ID: 20072
  Gene Name: zinc finger protein 613
  Uniprot ID: Q6PF04
  ENSP ID: ENSP00000375671
MLENYSNLVSVGYQASKPDALFKLEQGEPWTVENEIHSQICPEIKKVDNHLQMHSQKQRCLKRVEQCHKHNAFGNIIHQRKSDFPLRQNHDTFDLHGKILKSNLSLVNQNKRYEIKNSVGVNGDGKSFLHAKHEQFHNEMNFPEGGNSVNTNSQFIKHQRTQNIDKPHVCTECGKAFLKKSRLIYHQRVHTGEKPHGCSICGKAFSRKSGLTEHQRNHTGEKPYECTECDKAFRWKSQLNAHQKIHTGEKSYICSDCGKGFIKKSRLINHQRVHTGEKPHGCSLCGKAFSKRSRLTEHQRTHTGEKPYECTECDKAFRWKSQLNAHQKAHTGEKSYICRDCGKGFIQKGNLIVHQRIHTGEKPYICNECGKGFIQKGNLLIHRRTHTGEKPYVCNECGKGFSQKTCLISHQRFHTGKTPFVCTECGKSCSHKSGLINHQRIHTGEKPYTCSDCGKAFRDKSCLNRHRRTHTGERPYGCSDCGKAFSHLSCLVYHKGMLHAREKCVGSVKLENPCSESHSLSHTRDLIQDKDSVNMVTLQMPSVAAQTSLTNSAFQAESKVAIVSQPVARSSVSADSRICTE

SEQ ID NO: 100756 - protein, 94 aa, Homo sapiens
  Payload ID: 20072
  Gene Name: zinc finger protein 613
  ENSP ID: ENSP00000468850
MIKSQESLTLEDVAVEFTWEEWQLLGPAQKDLYRDVMLENYSNLVSVGYQASKPDALFKLEQGEPWTVENEIHSQICPEIKKVDNHLQMHSQKQ

SEQ ID NO: 100757 - protein, 85 aa, Homo sapiens
  Payload ID: 20072
  Gene Name: zinc finger protein 613
  ENSP ID: ENSP00000472455
MLENYSNLVSVGYQASKPDALFKLEQGEPWTVENEIHSQICPEIKKVDNHLQMHSQKQRCLKRVEQCHKHNAFGNIIHQRKSDFP

SEQ ID NO: 100758 - protein, 617 aa, Homo sapiens; identical to SEQ ID NO: 100754
  Payload ID: 20072
  Gene Name: zinc finger protein 613
  Uniprot ID: Q6PF04
  ENSP ID: ENSP00000478924

SEQ ID NO: 100759 - protein, 585 aa, Homo sapiens
  Payload ID: 20073
  Gene Name: zinc finger protein 614
  Uniprot ID: Q8N883
  ENSP ID: ENSP00000270649
MIKTQESLTLEDVAVEFSWEEWQLLDTAQKNLYRDVMVENYNHLVSLGYQTSKPDVLSKLAHGQEPWTTDAKIQNKNCPGIGKVDSHLQEHSPNQRLLKSVQQCNGQNTLRNIVHLSKTHFPIVQNHDTFDLYRKNLKSSLSLINQKRRHGINNPVEFIGGEKTLLHGKHERTHTKTRFSENAKCIHTKFQVFKHQRTQKIEKPHACIECEQTFLRKSQLIYHENICIQENPGSGQCEKLSRSVLFTKHLKTNTTDKICIPNEYRKGSTVKSSLITHQQTHTEEKSYMCSECGKGFTMKRYLIAHQRTHSGEKPYVCKECGKGFTVKSNLIVHQRTHTGEKPYICSECGKGFTMKRYLVVHQRTHTGEKPYMCSECGKGFTVKSNLIVHQRSHTGEKSYICSECGKGFTVKRTLVIHQRTHTGEKSYICNECGKGFTTKRTLIIHQRTHTGEKPYECNECGKAFSQKICLIQHERCHTGKTPFVCTECGKSYSHKYGLITHQRIHTGEKPYECNECGKAFTTKSVLNVHQRTHTGERPYGCSDCEKAFSHLSNLVKHKKMHTREMGRISQVENSCNGESQLLPYK

SEQ ID NO: 100760 - protein, 198 aa, Homo sapiens
  Payload ID: 20073
  Gene Name: zinc finger protein 614
  Uniprot ID: Q8N883
  ENSP ID: ENSP00000348674
MIKTQESLTLEDVAVEFSWEEWQLLDTAQKNLYRDVMVENYNHLVSLGYQTSKPDVLSKLAHGQEPWTTDAKIQNKNCPGIGKVDSHLQEHSPNQRLLKSVQQCNGQNTLRNIVHLSKTHFPIVQNHDTFDLYRKNLKSSLSLINQKRRHGINNPVEFIGETGSLERPRQADHLRSEVQDQPGQRGETLCLLKIHTKN

SEQ ID NO: 100761 - protein, 39 aa, Homo sapiens
  Payload ID: 20073
  Gene Name: zinc finger protein 614
  ENSP ID: ENSP00000469809
MIKTQESLTLEDVAVEFSWEEWQLLDTAQKNLYRDVMVE

SEQ ID NO: 100762 - protein, 80 aa, Homo sapiens
  Payload ID: 20073
  Gene Name: zinc finger protein 614
  ENSP ID: ENSP00000471869
MIKTQESLTLEDVAVEFSWEEWQLLDTAQKNLYRDVMVENYNHLVSLGYQTSKPDVLSKLAHGQEPWTTDAKIQNKNCPD

SEQ ID NO: 100763 - protein, 731 aa, Homo sapiens
  Payload ID: 20074
  Gene Name: zinc finger protein 615
  Uniprot ID: Q8N8J6
  ENSP ID: ENSP00000365906
MMQAQESLTLEDVAVDFTWEEWQFLSPAQKDLYRDVMLENYSNLVAVGYQASKPDALSKLERGEETCTTEDEIYSRICSEIRKIDDPLQHHLQNQSIQKSVKQCHEQNMFGNIVNQNKGHFLLKQDCDTFDLHEKPLKSNLSFENQKRSSGLKNSAEFNRDGKSLFHANHKQFYTEMKFPAIAKPINKSQFIKQQRTHNIENAHVCSECGKAFLKLSQFIDHQRVHTGEKPHVCSMCGKAFSRKSRLMDHQRTHTELKHYECTECDKTFLKKSQLNIHQKTHMGGKPYTCSQCGKAFIKKCRLIYHQRTHTGEKPHGCSVCGKAFSTKFSLTTHQKTHTGEKPYICSECGKGFIEKRRLTAHHRTHTGEKPFICNKCGKGFTLKNSLITHQQTHTGEKLYTCSECGKGFSMKHCLMVHQRTHTGEKPYKCNECGKGFALKSPLIRHQRTHTGEKPYVCTECRKGFTMKSDLIVHQRTHTAEKPYICNDCGKGFTVKSRLIVHQRTHTGEKPYVCGECGKGFPAKIRLMGHQRTHTGEKPYICNECGKGFTEKSHLNVHRRTHTGEKPYVCSECGKGLTGKSMLIAHQRTHTGEKPYICNECGKGFTMKSTLSIHQQTHTGEKPYKCNECDKTFRKKTCLIQHQRFHTGKTSFACTECGKFSLRKNDLITHQRIHTGEKPYKCSDCGKAFTTKSGLNVHQRKHTGERPYGCSDCGKAFAHLSILVKHRRIHR

SEQ ID NO: 100764 - protein, 736 aa, Homo sapiens
  Payload ID: 20074
  Gene Name: zinc finger protein 615
  ENSP ID: ENSP00000375672
MRPEPTKFWEESLTLEDVAVDFTWEEWQFLSPAQKDLYRDVMLENYSNLVAVGYQASKPDALSKLERGEETCTTEDEIYSRICSEIRKIDDPLQHHLQNQSIQKSVKQCHEQNMFGNIVNQNKGHFLLKQDCDTFDLHEKPLKSNLSFENQKRSSGLKNSAEFNRDGKSLFHANHKQFYTEMKFPAIAKPINKSQFIKQQRTHNIENAHVCSECGKAFLKLSQFIDHQRVHTGEKPHVCSMCGKAFSRKSRLMDHQRTHTELKHYECTECDKTFLKKSQLNIHQKTHMGGKPYTCSQCGKAFIKKCRLIYHQRTHTGEKPHGCSVCGKAFSTKFSLTTHQKTHTGEKPYICSECGKGFIEKRRLTAHHRTHTGEKPFICNKCGKGFTLKNSLITHQQTHTGEKLYTCSECGKGFSMKHCLMVHQRTHTGEKPYKCNECGKGFALKSPLIRHQRTHTGEKPYVCTECRKGFTMKSDLIVHQRTHTAEKPYICNDCGKGFTVKSRLIVHQRTHTGEKPYVCGECGKGFPAKIRLMGHQRTHTGEKPYICNECGKGFTEKSHLNVHRRTHTGEKPYVCSECGKGLTGKSMLIAHQRTHTGEKPYICNECGKGFTMKSTLSIHQQTHTGEKPYKCNECDKTFRKKTCLIQHQRFHTGKTSFACTECGKFSLRKNDLITHQRIHTGEKPYKCSDCGKAFTTKSGLNVHQRKHTGERPYGCSDCGKAFAHLSILVKHRRIHR

SEQ ID NO: 100765 - protein, 98 aa, Homo sapiens
  Payload ID: 20074
  Gene Name: zinc finger protein 615
  ENSP ID: ENSP00000470475
MMQAQESLTLEDVAVDFTWEEWQFLSPAQKDLYRDVMLENYSNLVAVGYQASKPDALSKLERGEETCTTEDEIYSRICSDSGGASGGAYAGLSHGYIA

SEQ ID NO: 100766 - protein, 98 aa, Homo sapiens; identical to SEQ ID NO: 100765
  Payload ID: 20074
  Gene Name: zinc finger protein 615
  ENSP ID: ENSP00000470709

SEQ ID NO: 100767 - protein, 103 aa, Homo sapiens
  Payload ID: 20074
  Gene Name: zinc finger protein 615
  ENSP ID: ENSP00000470880
MRPEPTKFWEESLTLEDVAVDFTWEEWQFLSPAQKDLYRDVMLENYSNLVAVGYQASKPDALSKLERGEETCTTEDEIYSRICSDSGGASGGAYAGLSHGYIA

SEQ ID NO: 100768 - protein, 742 aa, Homo sapiens
  Payload ID: 20074
  Gene Name: zinc finger protein 615
  Uniprot ID: Q8N8J6
  ENSP ID: ENSP00000471041
MMQAQESLTLEDVAVDFTWEEWQFLSPAQKDLYRDVMLENYSNLVAVGYQASKPDALSKLERGEETCTTEDEIYSRICSDSGGASGGAYAEIRKIDDPLQHHLQNQSIQKSVKQCHEQNMFGNIVNQNKGHFLLKQDCDTFDLHEKPLKSNLSFENQKRSSGLKNSAEFNRDGKSLFHANHKQFYTEMKFPAIAKPINKSQFIKQQRTHNIENAHVCSECGKAFLKLSQFIDHQRVHTGEKPHVCSMCGKAFSRKSRLMDHQRTHTELKHYECTECDKTFLKKSQLNIHQKTHMGGKPYTCSQCGKAFIKKCRLIYHQRTHTGEKPHGCSVCGKAFSTKFSLTTHQKTHTGEKPYICSECGKGFIEKRRLTAHHRTHTGEKPFICNKCGKGFTLKNSLITHQQTHTGEKLYTCSECGKGFSMKHCLMVHQRTHTGEKPYKCNECGKGFALKSPLIRHQRTHTGEKPYVCTECRKGFTMKSDLIVHQRTHTAEKPYICNDCGKGFTVKSRLIVHQRTHTGEKPYVCGECGKGFPAKIRLMGHQRTHTGEKPYICNECGKGFTEKSHLNVHRRTHTGEKPYVCSECGKGLTGKSMLIAHQRTHTGEKPYICNECGKGFTMKSTLSIHQQTHTGEKPYKCNECDKTFRKKTCLIQHQRFHTGKTSFACTECGKFSLRKNDLITHQRIHTGEKPYKCSDCGKAFTTKSGLNVHQRKHTGERPYGCSDCGKAFAHLSILVKHRRIHR

SEQ ID NO: 100769 - protein, 160 aa, Homo sapiens
  Payload ID: 20074
  Gene Name: zinc finger protein 615
  ENSP ID: ENSP00000471202
MESLTLEDVAVDFTWEEWQFLSPAQKDLYRDVMLENYSNLVAVGYQASKPDALSKLERGEETCTTEDEIYSRICSDSGGASGGAYAEIRKIDDPLQHHLQNQSIQKSVKQCHEQNMFGNIVNQNKGHFLLKQDCDTFDLHEKPLKSNLSFENQKRSSGLK

SEQ ID NO: 100770 - protein, 742 aa, Homo sapiens; identical to SEQ ID NO: 100768
  Payload ID: 20074
  Gene Name: zinc finger protein 615
  Uniprot ID: Q8N8J6
  ENSP ID: ENSP00000471549

SEQ ID NO: 100771 - protein, 96 aa, Homo sapiens
  Payload ID: 20074
  Gene Name: zinc finger protein 615
  ENSP ID: ENSP00000471608
MMQAQESLTLEDVAVDFTWEEWQFLSPAQKDLYRDVMLENYSNLVAVGYQASKPDALSKLERGEETCTTEDEIYSRICSDSGGASGEIRKIDDPLQ

SEQ ID NO: 100772 - protein, 8 aa, Homo sapiens
  Payload ID: 20074
  Gene Name: zinc finger protein 615
  ENSP ID: ENSP00000472341
MMQAQESL

SEQ ID NO: 100773 - protein, 731 aa, Homo sapiens; identical to SEQ ID NO: 100763
  Payload ID: 20074
  Gene Name: zinc finger protein 615
  Uniprot ID: Q8N8J6
  ENSP ID: ENSP00000473089

SEQ ID NO: 100774 - protein, 742 aa, Homo sapiens; identical to SEQ ID NO: 100768
  Payload ID: 20074
  Gene Name: zinc finger protein 615
  Uniprot ID: Q8N8J6
  ENSP ID: ENSP00000483676

SEQ ID NO: 100775 - protein, 740 aa, Homo sapiens [sequence omitted]

SEQ ID NO: 100776 - protein, 74 aa, Homo sapiens
  Payload ID: 20075
  Gene Name: zinc finger protein 616
  ENSP ID: ENSP00000328722
MATQGHLTFKDVAIEFSQEEWKCLEPVQKALYKDVMLENYRNLVFLGWRIMARSHLTATSVSQVQAILLPQPPE

SEQ ID NO: 100777 - protein, 39 aa, Homo sapiens
  Payload ID: 20075
  Gene Name: zinc finger protein 616
  ENSP ID: ENSP00000469126
MATQGHLTFKDVAIEFSQEEWKCLEPVQKALYKDVMLEN

SEQ ID NO: 100778 - protein, 69 aa, Homo sapiens
  Payload ID: 20075
  Gene Name: zinc finger protein 616
  ENSP ID: ENSP00000470077
MATQGHLTFKDVAIEFSQEEWKCLEPVQKALYKDVMLENYRNLVFLGWRIMARSHLTATSVSQVSLLNV

SEQ ID NO: 100779 - protein, 781 aa, Homo sapiens
  Payload ID: 20075
  Gene Name: zinc finger protein 616
  Uniprot ID: Q08AN1
  ENSP ID: ENSP00000471000
MATQGHLTFKDVAIEFSQEEWKCLEPVQKALYKDVMLENYRNLVFLGISPKCVIKELPPTENSNTGERFQTVALERHQSYDIENLYFREIQKHLHDLEFQWKDGETNDKEVPVPHENNLTGKRDQHSQGDVENNHIENQLTSNFESRLAELQKVQTEGRLYECNETEKTGNNGCLVSPHIREKTYVCNECGKAFKASSSLINHQRIHTTEKPYKCNECGKAFHRASLLTVHKVVHTRGKSYQCDVCGKIFRKNSYFVRHQRSHTGQKPYICNECGKSFSKSSHLAVHQRIHTGEKPYKCNLCGKSFSQRVHLRLHQTVHTGERPFKCNECGKTFKRSSNLTVHQVIHAGKKPYKCDVCGKAFRHRSNLVCHRRIHSGEKQYKCNECGKVFSKRSSLAVHRRIHTVEKPCKCNECGKVFSKRSSLAVHQRIHTGQKTYKCNKCGKVYSKHSHLAVHWRIHTGEKAYKCNECGKVFSIHSRLAAHQRIHTGEKPYKCNECGKVFSQHSRLAVHRRIHTGEKPYKCKECGKVFSDRSAFARHRRIHTGEKPYKCKECGKVFSQCSRLTVHRRIHSGEKPYKCNECGKVYSQYSHLVGHRRVHTGEKPYKCHECGKAFNQGSTLNRHQRIHTGEKPYKCNQCGNSFSQRVHLRLHQTVHTGDRPYKCNECGKTFKRSSNLTAHQIIHAGKKPYKCDECGKVFRHSSHLVSHQRIHTGEKRYKCIECGKAFGRLFSLSKHQRIHSGKKPYKCNECGKSFICRSGLTKHRIRHTGESLTTKLNVTRP

SEQ ID NO: 100780 - protein, 74 aa, Homo sapiens; identical to SEQ ID NO: 100776
  Payload ID: 20075
  Gene Name: zinc finger protein 616
  ENSP ID: ENSP00000471140

SEQ ID NO: 100781 - protein, 861 aa, Homo sapiens
  Payload ID: 20076
  Gene Name: zinc finger protein 618
  Uniprot ID: Q5T7W0
  ENSP ID: ENSP00000288466
MNQPGGAAAPQADGASAAGRKSTASRERLKRSQKSTKVEGPEPVPAEASLSAEQGTMTEVKVKTELPDDYIQEVIWQGEAKEEKKAVSKDGTSDVPAEICVVIGGVRNQQTLGSYECGICGKKYKYYNCFQTHVRAHRDTEATSGEGASQSNNFRYTCDICGKKYKYYSCFQEHRDLHAVDVFSVEGAPENRADPFDQGVVATDEVKEEPPEPFQKIGPMNNITSDIFKKKEVRQCQKRETGNYTCEFCGKQYKYYTPYQEHVALHAPIKSAFSRRVEGKAQNHFEETNSSSQNSSEPYTCGACGIQFQFYNNLLEHMQSHAADNENNIASNQSRSPPAVVEEKWKPQAQRNSANNTTTSGLTPNSMIPEKERQNIAERLLRVMCADLGALSVVSGKEFLKLAQTLVDSGARYGAFSVTEILGNFNTLALKHLPRMYNQVKVKVTCALGSNACLGIGVTCHSQSVGPDSCYILTAYQAEGNHIKSYVLGVKGADIRDSGDLVHHWVQNVLSEFVMSEIRTVYVTDCRVSTSAFSKAGMCLRCSACALNSVVQSVLSKRTLQARSMHEVIELLNVCEDLAGSTGLAKETFGSLEETSPPPCWNSVTDSLLLVHERYEQICEFYSRAKKMNLIQSLNKHLLSNLAAILTPVKQAVIELSNESQPTLQLVLPTYVRLEKLFTAKANDAGTVSKLCHLFLEALKENFKVHPAHKVAMILDPQQKLRPVPPYQHEEIIGKVCELINEVKESWAEEADFEPAAKKPRSAAVENPAAQEDDRLGKNEVYDYLQEPLFQATPDLFQYWSCVTQKHTKLAKLAFWLLAVPAVGARSGCVNMCEQALLIKRRRLLSPEDMNKLMFLKSNML

SEQ ID NO: 100782 - protein, 375 aa, Homo sapiens
  Payload ID: 20076
  Gene Name: zinc finger protein 618
  ENSP ID: ENSP00000363239
MNQPGGAAAPQADGASAAGRKSTASRERLKRSQKSTKVEGPEPVPAEASLSAEQGTMTEVKVKTELPDDYIQEVIWQGEAKEEKKAVSKDGTSDVPAEICVVIGGVRNQQTLGSYECGICGKKYKYYNCFQTHVRAHRDTEATSGEGASQSNNFRYTCDICGKKYKYYSCFQEHRDLHAVDVFSVEGAPENRADPFDQGVVATDEVKEEPPEPFQKIGPMNNITSDIFKKKEVRQCQKRETGNYTCEFCGKQYKYYTPYQEHVALHAPISTAPGWEPPDDPDTGSECSHPEVSPSPRFVAAKTQTNQSGKKAPASVVRCATLLHRTPPATQTQTFRTPNSGSPASKATAESAFSRRVEGKAQNHFEETNSSSQNS

SEQ ID NO: 100783 - protein, 954 aa, Homo sapiens
  Payload ID: 20076
  Gene Name: zinc finger protein 618
  Uniprot ID: Q5T7W0
  ENSP ID: ENSP00000363241
MNQPGGAAAPQADGASAAGRKSTASRERLKRSQKSTKVEGPEPVPAEASLSAEQGTMTEVKVKTELPDDYIQEVIWQGEAKEEKKAVSKDGTSDVPAEICVVIGGVRNQQTLDGKAPEGSPHGGSVRSRYSGTWIFDQALRYASGSYECGICGKKYKYYNCFQTHVRAHRDTEATSGEGASQSNNFRYTCDICGKKYKYYSCFQEHRDLHAVDVFSVEGAPENRADPFDQGVVATDEVKEEPPEPFQKIGPKTGNYTCEFCGKQYKYYTPYQEHVALHAPISTAPGWEPPDDPDTGSECSHPEVSPSPRFVAAKTQTNQSGKKAPASVVRCATLLHRTPPATQTQTFRTPNSGSPASKATAAESAFSRRVEGKAQNHFEETNSSSQNSSEPYTCGACGIQFQFYNNLLEHMQSHAADNENNIASNQSRSPPAVVEEKWKPQAQRNSANNTTTSGLTPNSMIPEKERQNIAERLLRVMCADLGALSVVSGKEFLKLAQTLVDSGARYGAFSVTEILGNFNTLALKHLPRMYNQVKVKVTCALGSNACLGIGVTCHSQSVGPDSCYILTAYQAEGNHIKSYVLGVKGADIRDSGDLVHHWVQNVLSEFVMSEIRTVYVTDCRVSTSAFSKAGMCLRCSACALNSVVQSVLSKRTLQARSMHEVIELLNVCEDLAGSTGLAKETFGSLEETSPPPCWNSVTDSLLLVHERYEQICEFYSRAKKMNLIQSLNKHLLSNLAAILTPVKQAVIELSNESQPTLQLVLPTYVRLEKLFTAKANDAGTVSKLCHLFLEALKENFKVHPAHKVAMILDPQQKLRPVPPYQHEEIIGKVCELINEVKESWAEEADFEPAAKKPRSAAVENPAAQEDDRLGKNEVYDYLQEPLFQATPDLFQYWSCVTQKHTKLAKLAFWLLAVPAVGARSGCVNMCEQALLIKRRRLLSPEDMNKLMFLKSNML

SEQ ID NO: 100784 - protein, 303 aa, Homo sapiens
  Payload ID: 20076
  Gene Name: zinc finger protein 618
  ENSP ID: ENSP00000395400
MNQPGGAAAPQADGASAAGRKSTASRERLKRSQKSTKVEGPEPVPAEASLSAEQGTMTEVKVKTELPDDYIQEVIWQGEAKEEKKAVSKDGTSDVPAEICVVIGGVRNQQTLGSYECGICGKKYKYYNCFQTHVRAHRDTEATSGEGASQSNNFRYTCDICGKKYKYYSCFQEHRDLHAVDDPFDQGVVATDEVKEEPPEPFQKIGPMNNITSDIFKKKEVRQCQKRETGNYTCEFCGKQYKYYTPYQEHVALHAPITTQTQTFRTPNSGSPASKATAESAFSRRVEGKAQNHFEETNSSSQN

SEQ ID NO: 100785 - protein, 921 aa, Homo sapiens
  Payload ID: 20076
  Gene Name: zinc finger protein 618
  Uniprot ID: Q5T7W0
  ENSP ID: ENSP00000483198
MNQPGGAAAPQADGASAAGRKSTASRERLKRSQKSTKVEGPEPVPAEASLSAEQGTMTEVKVKTELPDDYIQEVIWQGEAKEEKKAVSKDGTSDVPAEICVVIGGVRNQQTLGSYECGICGKKYKYYNCFQTHVRAHRDTEATSGEGASQSNNFRYTCDICGKKYKYYSCFQEHRDLHAVDVFSVEGAPENRADPFDQGVVATDEVKEEPPEPFQKIGPKTGNYTCEFCGKQYKYYTPYQEHVALHAPISTAPGWEPPDDPDTGSECSHPEVSPSPRFVAAKTQTNQSGKKAPASVVRCATLLHRTPPATQTQTFRTPNSGSPASKATAESAFSRRVEGKAQNHFEETNSSSQNSSEPYTCGACGIQFQFYNNLLEHMQSHAADNENNIASNQSRSPPAVVEEKWKPQAQRNSANNTTTSGLTPNSMIPEKERQNIAERLLRVMCADLGALSVVSGKEFLKLAQTLVDSGARYGAFSVTEILGNFNTLALKHLPRMYNQVKVKVTCALGSNACLGIGVTCHSQSVGPDSCYILTAYQAEGNHIKSYVLGVKGADIRDSGDLVHHWVQNVLSEFVMSEIRTVYVTDCRVSTSAFSKAGMCLRCSACALNSVVQSVLSKRTLQARSMHEVIELLNVCEDLAGSTGLAKETFGSLEETSPPPCWNSVTDSLLLVHERYEQICEFYSRAKKMNLIQSLNKHLLSNLAAILTPVKQAVIELSNESQPTLQLVLPTYVRLEKLFTAKANDAGTVSKLCHLFLEALKENFKVHPAHKVAMILDPQQKLRPVPPYQHEEIIGKVCELINEVKESWAEEADFEPAAKKPRSAAVENPAAQEDDRLGKNEVYDYLQEPLFQATPDLFQYWSCVTQKHTKLAKLAFWLLAVPAVGARSGCVNMCEQALLIKRRRLLSPEDMNKLMFLKSNML

SEQ ID NO: 100786 - protein, 560 aa, Homo sapiens
  Payload ID: 20077
  Gene Name: zinc finger protein 619
  Uniprot ID: Q8N2I2
  ENSP ID: ENSP00000322529
MGQPAPYAEGPIQGGDAGELCKCDFLVSISIPQTRSDIPAGARRSSMGPRSLDTCWGRGPERHVHRLECNGVIFTHRNLCLPGGKTKTENEEKTAQLNISKESESHRLIVEGLLMDVPQHPDFKDRLEKSQLHDTGNKTKIGDCTDLTVQDHESSTTEREEIARKLEESSVSTHLITKQGFAKEQVFYKCGECGSYYNPHSDFHLHQRVHTNEKPYTCKECGKTFRYNSKLSRHQKIHTGEKPYSCEECGQAFSQNSHLLQHQKLHGGQRPYECTDCGKTFSYNSKLIRHQRIHTGEKPFKCKECGKAFSCSYDCIIHERIHNGEKPYECKECGKSLSSNSVLIQHQRIHTGEKPYECKECGKAFHRSSVFLQHQRFHTGEQLYKCNECWKTFSCSSRFIVHQRIHNGEKPYECQECGKTFSQKITLVQHQRVHTGEKPYECKECGKAFRWNASFIQHQKWHTRKKLINGTGLSAVKPYCPCAILSPLPPQHTCSALAPPGPPLSSSHAVVLPPSVPFFLLLPSSEKANPSPVQIAHFFQDLAFPGKSSLQSPNPLSHSL

SEQ ID NO: 100787 - protein, 576 aa, Homo sapiens
  Payload ID: 20077
  Gene Name: zinc finger protein 619
  Uniprot ID: Q8N2I2
  ENSP ID: ENSP00000388710
MLQTVWFQGLGRNLLFQEPVTFEDVAVYFTQNEWASLHPTQRALYREVMLENYANVTSLSAFPFPKPDLIFQLEQGEAAWGPDPWTLAGGEALRGMCTGGKTKTENEEKTAQLNISKESESHRLIVEGLLMDVPQHPDFKDRLEKSQLHDTGNKTKIGDCTDLTVQDHESSTTEREEIARKLEESSVSTHLITKQGFAKEQVFYKCGECGSYYNPHSDFHLHQRVHTNEKPYTCKECGKTFRYNSKLSRHQKIHTGEKPYSCEECGQAFSQNSHLLQHQKLHGGQRPYECTDCGKTFSYNSKLIRHQRIHTGEKPFKCKECGKAFSCSYDCIIHERIHNGEKPYECKECGKSLSSNSVLIQHQRIHTGEKPYECKECGKAFHRSSVFLQHQRFHTGEQLYKCNECWKTFSCSSRFIVHQRIHNGEKPYECQECGKTFSQKITLVQHQRVHTGEKPYECKECGKAFRWNASFIQHQKWHTRKKLINGTGLSAVKPYCPCAILSPLPPQHTCSALAPPGPPLSSSHAVVLPPSVPFFLLLPSSEKANPSPVQIAHFFQDLAFPGKSSLQSPNPLSHSL

SEQ ID NO: 100788 - protein, 532 aa, Homo sapiens
  Payload ID: 20077
  Gene Name: zinc finger protein 619
  Uniprot ID: Q8N2I2
  ENSP ID: ENSP00000397232
MKPGVISHAPDSVVPAAFPFPKPDLIFQLEQGEAAWGPDPWTLAGGEALRGMCTGGKTKTENEEKTAQLNISKESESHRLIVEGLLMDVPQHPDFKDRLEKSQLHDTGNKTKIGDCTDLTVQDHESSTTEREEIARKLEESSVSTHLITKQGFAKEQVFYKCGECGSYYNPHSDFHLHQRVHTNEKPYTCKECGKTFRYNSKLSRHQKIHTGEKPYSCEECGQAFSQNSHLLQHQKLHGGQRPYECTDCGKTFSYNSKLIRHQRIHTGEKPFKCKECGKAFSCSYDCIIHERIHNGEKPYECKECGKSLSSNSVLIQHQRIHTGEKPYECKECGKAFHRSSVFLQHQRFHTGEQLYKCNECWKTFSCSSRFIVHQRIHNGEKPYECQECGKTFSQKITLVQHQRVHTGEKPYECKECGKAFRWNASFIQHQKWHTRKKLINGTGLSAVKPYCPCAILSPLPPQHTCSALAPPGPPLSSSHAVVLPPSVPFFLLLPSSEKANPSPVQIAHFFQDLAFPGKSSLQSPNPLSHSL

SEQ ID NO: 100789 - protein, 567 aa, Homo sapiens
  Payload ID: 20077
  Gene Name: zinc finger protein 619
  ENSP ID: ENSP00000398024
MGQPAPYAEGPIQGGDAGELCKCDFLVSISIPQTRSDIPAGARRSSMGPRSLDTCWGRGPERHVHRVSLLLPRLECNGVIFTHRNLCLPGGKTKTENEEKTAQLNISKESESHRLIVEGLLMDVPQHPDFKDRLEKSQLHDTGNKTKIGDCTDLTVQDHESSTTEREEIARKLEESSVSTHLITKQGFAKEQVFYKCGECGSYYNPHSDFHLHQRVHTNEKPYTCKECGKTFRYNSKLSRHQKIHTGEKPYSCEECGQAFSQNSHLLQHQKLHGGQRPYECTDCGKTFSYNSKLIRHQRIHTGEKPFKCKECGKAFSCSYDCIIHERIHNGEKPYECKECGKSLSSNSVLIQHQRIHTGEKPYECKECGKAFHRSSVFLQHQRFHTGEQLYKCNECWKTFSCSSRFIVHQRIHNGEKPYECQECGKTFSQKITLVQHQRVHTGEKPYECKECGKAFRWNASFIQHQKWHTRKKLINGTGLSAVKPYCPCAILSPLPPQHTCSALAPPGPPLSSSHAVVLPPSVPFFLLLPSSEKANPSPVQIAHFFQDLAFPGKSSLQSPNPLSHSL

SEQ ID NO: 100790 - protein, 616 aa, Homo sapiens
  Payload ID: 20077
  Gene Name: zinc finger protein 619
  Uniprot ID: Q8N2I2
  ENSP ID: ENSP00000411132
MLQTVWFQGLGRNLLFQEPVTFEDVAVYFTQNEWASLHPTQRALYREVMLENYANVTSLYPTAGGFPLDTERTEKVPGALSSFLPSSSSLELILALLPMSAFPFPKPDLIFQLEQGEAAWGPDPWTLAGGEALRGMCTGGKTKTENEEKTAQLNISKESESHRLIVEGLLMDVPQHPDFKDRLEKSQLHDTGNKTKIGDCTDLTVQDHESSTTEREEIARKLEESSVSTHLITKQGFAKEQVFYKCGECGSYYNPHSDFHLHQRVHTNEKPYTCKECGKTFRYNSKLSRHQKIHTGEKPYSCEECGQAFSQNSHLLQHQKLHGGQRPYECTDCGKTFSYNSKLIRHQRIHTGEKPFKCKECGKAFSCSYDCIIHERIHNGEKPYECKECGKSLSSNSVLIQHQRIHTGEKPYECKECGKAFHRSSVFLQHQRFHTGEQLYKCNECWKTFSCSSRFIVHQRIHNGEKPYECQECGKTFSQKITLVQHQRVHTGEKPYECKECGKAFRWNASFIQHQKWHTRKKLINGTGLSAVKPYCPCAILSPLPPQHTCSALAPPGPPLSSSHAVVLPPSVPFFLLLPSSEKANPSPVQIAHFFQDLAFPGKSSLQSPNPLSHSL

SEQ ID NO: 100791 - protein, 567 aa, Homo sapiens; identical to SEQ ID NO: 100789
  Payload ID: 20077
  Gene Name: zinc finger protein 619
  ENSP ID: ENSP00000428004

SEQ ID NO: 100792 - protein, 59 aa, Homo sapiens
  Payload ID: 20077
  Gene Name: zinc finger protein 619
  ENSP ID: ENSP00000430574
MLQTVWFQGLGRNLLFQEPVTFEDVAVYFTQNEWASLHPTQRALYREVMLENYANVTSL

SEQ ID NO: 100793 - protein, 616 aa, Homo sapiens; identical to SEQ ID NO: 100790
  Payload ID: 20077
  Gene Name: zinc finger protein 619
  Uniprot ID: Q8N2I2
  ENSP ID: ENSP00000430705

SEQ ID NO: 100794 - protein, 422 aa, Homo sapiens
  Payload ID: 20078
  Gene Name: zinc finger protein 620
  Uniprot ID: Q6ZNG0
  ENSP ID: ENSP00000322265
MFQTAWRQEPVTFEDVAVYFTQNEWASLDSVQRALYREVMLENYANVASLAFPFTTPVLVSQLEQGELPWGLDPWEPMGREALRGICPGDEARTEKEGLTPKDHVSKETESFRLMVGGLPGNVSQHLDFGSSLEQPQGHWIIKTKSKRRHFTDTSARHHEAYEVKNGEKFEKLGKNISVSTQLTTNQTNPSGQISYECGQCGRYFIQMADFHRHEKCHTGEKSFECKECGKYFRYNSLLIRHQIIHTGKKPFKCKECGKGLSSDTALIQHQRIHTGEKPYECKECGKAFSSSSVFLQHQRFHTGEKLYECNECWKTFSCSSSFTVHQRMHTGEKPYECKECGKRLSSNTALTQHQRIHTGEKPFECKECGKAFNQKITLIQHQRVHTGEKPYECKVCGKTFSWCGRFILHQKLHTQKTPVQA

SEQ ID NO: 100795 - protein, 308 aa, Homo sapiens
  Payload ID: 20078
  Gene Name: zinc finger protein 620
  Uniprot ID: Q6ZNG0
  ENSP ID: ENSP00000391472
MVGGLPGNVSQHLDFGSSLEQPQGHWIIKTKSKRRHFTDTSARHHEAYEVKNGEKFEKLGKNISVSTQLTTNQTNPSGQISYECGQCGRYFIQMADFHRHEKCHTGEKSFECKECGKYFRYNSLLIRHQIIHTGKKPFKCKECGKGLSSDTALIQHQRIHTGEKPYECKECGKAFSSSSVFLQHQRFHTGEKLYECNECWKTFSCSSSFTVHQRMHTGEKPYECKECGKRLSSNTALTQHQRIHTGEKPFECKECGKAFNQKITLIQHQRVHTGEKPYECKVCGKTFSWCGRFILHQKLHTQKTPVQA

SEQ ID NO: 100796 - protein, 116 aa, Homo sapiens
  Payload ID: 20078
  Gene Name: zinc finger protein 620
  ENSP ID: ENSP00000406156
MFQTAWRQEPVTFEDVAVYFTQNEWASLDSVQRALYREVMLENYANVASLAFPFTTPVLVSQLEQGELPWGLDPWEPMGREALRGICPGDEARTEKEGLTPKDHVSKETESFRLMV

SEQ ID NO: 100797 - protein, 44 aa, Homo sapiens
  Payload ID: 20078
  Gene Name: zinc finger protein 620
  ENSP ID: ENSP00000406967
MFQTAWRQRQSYSVSQAECSGAITAHCSLHLPGLSDPPKELRLS

SEQ ID NO: 100798 - protein, 157 aa, Homo sapiens
  Payload ID: 20079
  Gene Name: zinc finger protein 621
  Uniprot ID: Q6ZSS3
  ENSP ID: ENSP00000312144
MLQTTWPQESVTFEDVAVYFTQNQWASLDPAQRALYGEVMLENYANVASLVAFPFPKPALISHLERGEAPWGPDPWDTEILRGISQGGESWIKNEGLVIKQEASEETELHRMPVGGLLRNVSQHFDFKRKALKQTFNLNPNLILRGGSVEVRSLRPA

SEQ ID NO: 100799 - protein, 439 aa, Homo sapiens
  Payload ID: 20079
  Gene Name: zinc finger protein 621
  Uniprot ID: Q6ZSS3
  ENSP ID: ENSP00000340841
MLQTTWPQESVTFEDVAVYFTQNQWASLDPAQRALYGEVMLENYANVASLVAFPFPKPALISHLERGEAPWGPDPWDTEILRGISQGGESWIKNEGLVIKQEASEETELHRMPVGGLLRNVSQHFDFKRKALKQTFNLNPNLILRGGMKFYECKECGKIFRYNSKLIRHQMSHTGEKPFKCKECGKAFKSSYDCIVHEKNHIGEGPYECKECGKGLSSNTALTQHQRIHTGEKPYECKECGKAFRRSAAYLQHQRLHTGEKLYKCKECWKAFGCRSLFIVHQRIHTGEKPYQCKECGKAFTQKIASIQHQRVHTGEKPYECKVCGKAFKWYGSFVQHQKLHPVEKKPVKVLGPSLVSPQCSSPAIPPVLLQGSCSASAVAVPSLTFPHAVLIPTSGNFFMLLPTSGIPSSSAQIVRVFQGLTPTVKPSPVILTPSSHSS

SEQ ID NO: 100800 - protein, 439 aa, Homo sapiens; identical to SEQ ID NO: 100799
  Payload ID: 20079
  Gene Name: zinc finger protein 621
  Uniprot ID: Q6ZSS3
  ENSP ID: ENSP00000386051

SEQ ID NO: 100801 - protein, 152 aa, Homo sapiens
  Payload ID: 20079
  Gene Name: zinc finger protein 621
  ENSP ID: ENSP00000408779
MLQTTWPQESVTFEDVAVYFTQNQWASLDPAQRALYGEVMLENYANVASLVAFPFPKPALISHLERGEAPWGPDPWDTEILRGISQGGESWIKNEGLVIKQEASEETELHRMPVGGLLRNVSQHFDFKRKALKQTFNLNPNLILRGGMKFYE

SEQ ID NO: 100802 - protein, 328 aa, Homo sapiens
  Payload ID: 20079
  Gene Name: zinc finger protein 621
  ENSP ID: ENSP00000413236
MPVGGLLRNVSQHFDFKRKALKQTFNLNPNLILRGGMKFYECKECGKIFRYNSKLIRHQMSHTGEKPFKCKECGKAFKSSYDCIVHEKNHIGEGPYECKECGKGLSSNTALTQHQRIHTGEKPYECKECGKAFRRSAAYLQHQRLHTGEKLYKCKECWKAFGCRSLFIVHQRIHTGEKPYQCKECGKAFTQKIASIQHQRVHTGEKPYECKVCGKAFKWYGSFVQHQKLHPVEKKPVKVLGPSLVSPQCSSPAIPPVLLQGSCSASAVAVPSLTFPHAVLIPTSGNFFMLLPTSGIPSSSAQIVRVFQGLTPTVKPSPVILTPSSHSS

SEQ ID NO: 100803 - protein, 477 aa, Homo sapiens
  Payload ID: 20080
  Gene Name: zinc finger protein 622
  Uniprot ID: Q969S3
  ENSP ID: ENSP00000310042
MATYTCITCRVAFRDADMQRAHYKTDWHRYNLRRKVASMAPVTAEGFQERVRAQRAVAEEESKGSATYCTVCSKKFASFNAYENHLKSRRHVELEKKAVQAVNRKVEMMNEKNLEKGLGVDSVDKDAMNAAIQQAIKAQPSMSPKKAPPAPAKEARNVVAVGTGGRGTHDRDPSEKPPRLQWFEQQAKKLAKQQEEDSEEEEEDLDGDDWEDIDSDEELECEDTEAMDDVVEQDAEEEEAEEGPPLGAIPITDCLFCSHHSSSLMKNVAHMTKDHSFFIPDIEYLSDIKGLIKYLGEKVGVGKICLWCNEKGKSFYSTEAVQAHMNDKSHCKLFTDGDAALEFADFYDFRSSYPDHKEGEDPNKAEELPSEKNLEYDDETMELILPSGARVGHRSLMRYYKQRFGLSRAVAVAKNRKAVGRVLQQYRALGWTGSTGAALMRERDMQYVQRMKSKWMLKTGMKNNATKQMHFRVQVRF

SEQ ID NO: 100804 - protein, 496 aa, Homo sapiens
  Payload ID: 20081
  Gene Name: zinc finger protein 623
  ENSP ID: ENSP00000411139
MELPSPESEEVHEPRLGELLGNPEGQSLGSSPSQDRGCKQVTVTHWKIQTGETAQVCTKSGRNHILNSDLLLLQRELIEGEANPCDICGKTFTFNSDLVRHRISHAGEKPYTCDQCGKGFGQSSHLMEHQRIHTGERLYVCNVCGKDFIHYSGLIEHQRVHSGEKPFKCAQCGKAFCHSSDLIRHQRVHTRERPFECKECGKGFSQSSLLIRHQRIHTGERPYECNECGKSFIRSSSLIRHYQIHTEVKQYECKECGKAFRHRSDLIEHQRIHTGERPFECNECGKAFIRSSKLIQHQRIHTGERPYVCNECGKRFSQTSNFTQHQRIHTGEKLYECNECGKAFFLSSYLIRHQKIHTGERVYECKECGKAFLQKAHLTEHQKIHSGDRPFECKDCGKAFIQSSKLLLHQIIHTGEKPYVCSYCGKGFIQRSNFLQHQKIHTEEKLYECSQYGRDFNSTTNVKNNQRVHQEGLSLSKAPIHLGERSVDKGEHTGNL

SEQ ID NO: 100805 - protein, 496 aa, Homo sapiens; identical to SEQ ID NO: 100804
  Payload ID: 20081
  Gene Name: zinc finger protein 623
  ENSP ID: ENSP00000435232

SEQ ID NO: 100806 - protein, 536 aa, Homo sapiens
  Payload ID: 20081
  Gene Name: zinc finger protein 623
  Uniprot ID: O75123
  ENSP ID: ENSP00000445979
MILLSFVSDSNVGTGEKKVTEAWISEDENSHRTTSDRLTVMELPSPESEEVHEPRLGELLGNPEGQSLGSSPSQDRGCKQVTVTHWKIQTGETAQVCTKSGRNHILNSDLLLLQRELIEGEANPCDICGKTFTFNSDLVRHRISHAGEKPYTCDQCGKGFGQSSHLMEHQRIHTGERLYVCNVCGKDFIHYSGLIEHQRVHSGEKPFKCAQCGKAFCHSSDLIRHQRVHTRERPFECKECGKGFSQSSLLIRHQRIHTGERPYECNECGKSFIRSSSLIRHYQIHTEVKQYECKECGKAFRHRSDLIEHQRIHTGERPFECNECGKAFIRSSKLIQHQRIHTGERPYVCNECGKRFSQTSNFTQHQRIHTGEKLYECNECGKAFFLSSYLIRHQKIHTGERVYECKECGKAFLQKAHLTEHQKIHSGDRPFECKDCGKAFIQSSKLLLHQIIHTGEKPYVCSYCGKGFIQRSNFLQHQKIHTEEKLYECSQYGRDFNSTTNVKNNQRVHQEGLSLSKAPIHLGERSVDKGEHTGNL

SEQ ID NO: 100807 - protein, 496 aa, Homo sapiens; identical to SEQ ID NO: 100804
  Payload ID: 20081
  Gene Name: zinc finger protein 623
  ENSP ID: ENSP00000481049

SEQ ID NO: 100808 - protein, 496 aa, Homo sapiens; identical to SEQ ID NO: 100804
  Payload ID: 20081
  Gene Name: zinc finger protein 623
  ENSP ID: ENSP00000484164

SEQ ID NO: 100809 - protein, 536 aa, Homo sapiens; identical to SEQ ID NO: 100806
  Payload ID: 20081
  Gene Name: zinc finger protein 623
  ENSP ID: ENSP00000487869

SEQ ID NO: 100810 - protein, 865 aa, Homo sapiens
  Payload ID: 20082
  Gene Name: zinc finger protein 624
  Uniprot ID: Q9P2J8
  ENSP ID: ENSP00000310472
MSLQDSTLSREGKPEGEIMAAVFFSVGRLSPEVTQPDEDLHLQAEETQLVKESVTFKDVAIDFTLEEWRLMDPTQRNLHKDVMLENYRNLVSLGLAVSKPDMISHLENGKGPWVTVREISRIPYPDMEPKPATKKATRTKAISEDLSQEAILEKLTENGLWDSRMEGLWKWNDRILRLQNNQENHLSQRIIPLKKTPTSQRGFRFESILIPEPGIATEELHSRCQTQEENFTENLNLITDTHLGKIICKEMKGSKAIRQTSELTLGKKSNNKEKPYKCSTCEKAFHYRSLLIQHQRTHTKEKPYECNECGKTFSQPSYLSQHKKIHTGEKPYKCNECGKAFIASSSLMVHQRIHTKEKPYQCNVCGKSFSQCARLNQHQRIQTGEKPYKCSECGKAFSDKSKLARHQETHNGEKPYKCDDCGKAFRNKSYLSVHQKTHTEEKPYQCNECGKSFKNTTIFNVHQRIHTGEKPFRCNECGKAYRSNSSLIVHIRTHTGEKPYECNECGKAFNRIANFTEHQRIHTGEKPYKCNECGKAFINYSCLTVHHRMHTGEKPYKCTECGKAFMRSSSLIIHQRIHTEEKPYLCNECGESFRIKSHLTVHQRIHTGEKPYKCTDCERAFTKMVNLKEHQKIHTGVKPYKCYDCGKSFRTKSYLIVHQRTHTGEKPYKCNECEKAFTNTSQLTVHQRRHTGEKPYKCNECGKVFTSNSGFNTHQRTHTGEKPFKCNDCGKAFSQMVHVTEHQKIHSGEKPYKCDVCGKAFRRGSYLTVHWRTHTGEKPYTCKECGKGCITLSQLTLHQRIHTGERPYKCEECGKAFRTNSDFTVHLRMHTGEKPYKCNECGKAFRSSSSLTVHQRIHQRETQLI

SEQ ID NO: 100811 - protein, 110 aa, Homo sapiens
  Payload ID: 20082
  Gene Name: zinc finger protein 624
  ENSP ID: ENSP00000406525
MSLQDSTLSREGKPEGEIMAAVFFSVGRLSPEVTQPDEDLHLQAEETQLVKESVTFKDVAIDFTLEEWRLMDPTQRNLHKDVMLENYRNLVSLGLAVSKPDMISHLENGK

SEQ ID NO: 100812 - protein, 125 aa, Homo sapiens
  Payload ID: 20082
  Gene Name: zinc finger protein 624
  ENSP ID: ENSP00000463295
MSLQDSTLSREGKPEGEIMAAVFFSVGRLSPEVTQPDEDLHLQAEETQLVKESVTFKDVAIDFTLEEWRLMDPTQRNLHKDVMLENYRNLVSLGLAVSKPDMISHLENGKGPWVTVREISRIPYP

SEQ ID NO: 100813 - protein, 372 aa, Homo sapiens
  Payload ID: 20083
  Gene Name: zinc finger protein 625
  Uniprot ID: Q96I27
  ENSP ID: ENSP00000394380
MDSVVFEDVDVNFTQEEWALLDPSQKNLYRDVMQETFRNLASVGKKWKDQKIEDEYKNPRRNLRGLMGERLLESKKDHQHGEILTQVPDDMLKKKTPRVKSCGEVSVGHASLNRHHRADTGHKPYEYQEYGQKPYKCTYCKKAFSDLPYFRTHEWAHTGGKPYDCEECGKSFISRSSIRRHRIMHSGDGPYKCNFCGKALMCLSLYLIHKRTHTGEKPYECKQCGKAFSHSGSLRIHERTHTGEKPYECSECGKAFHSSTCLHAHKITHTGEKPYECKQCGKAFVSFNSVRYHERTHTGEKPYECKQCGKAFRSASHLRTHGRTHTGEKPYECKQCGKAFGCASSVKIHERTHTGEKPCSSNTSKGQGEKIA

SEQ ID NO: 100814 - protein, 61 aa, Homo sapiens
  Payload ID: 20083
  Gene Name: zinc finger protein 625
  ENSP ID: ENSP00000398518
MDSVVFEDVDVNFTQEEWALLDPSQKNLYRDVMQETFRNLASEKNGKIRKLKMSTKIPGET

SEQ ID NO: 100815 - protein, 104 aa, Homo sapiens
  Payload ID: 20083
  Gene Name: zinc finger protein 625
  ENSP ID: ENSP00000405156
DSVVFEDVDVNFTQEEWALLDPSQKNLYRDVMQETFRNLASVGKKWKDQKIEDEYKNPRRNLSLRKWSWSLYARQTLGLDSPSVAPKRTHGQMNPSTNSPATSR

SEQ ID NO: 100816 - protein, 92 aa, Homo sapiens
  Payload ID: 20084
  Gene Name: zinc finger protein 626
  Uniprot ID: Q68DY1
  ENSP ID: ENSP00000291750
MGPLQFRDVAIEFSLEEWHCLDTAQRNLYRNVMLENYSNLVFLGITVSKPDLITCLEQGRKPLTMKRNEMIAKPSVSFLQVHSESQSPLHDI

SEQ ID NO: 100817 - protein, 135 aa, Homo sapiens
  Payload ID: 20084
  Gene Name: zinc finger protein 626
  ENSP ID: ENSP00000469566
MCSHFAQDLWPEQSMKDSFQKVVLRRYEKCEHDNLQLKKGCISVDECKVHKEGYNELNQCLTTTPRKICQCDKYVKVLHQFPNSNGQKRGHTGKKPFKYIECGKAFKQFSTLTTHKKIHTGGKPYKCEECGKAFN

SEQ ID NO: 100818 - protein, 528 aa, Homo sapiens
  Payload ID: 20084
  Gene Name: zinc finger protein 626
  Uniprot ID: Q68DY1
  ENSP ID: ENSP00000469958
MGPLQFRDVAIEFSLEEWHCLDTAQRNLYRNVMLENYSNLVFLGITVSKPDLITCLEQGRKPLTMKRNEMIAKPSVMCSHFAQDLWPEQSMKDSFQKVVLRRYEKCEHDNLQLKKGCISVDECKVHKEGYNELNQCLTTTPRKICQCDKYVKVLHQFPNSNGQKRGHTGKKPFKYIECGKAFKQFSTLTTHKKIHTGGKPYKCEECGKAFNHSCSLTRHKKIHTGEKPYKCEECGKAFKHSSTLTTHKRNHTGEKPYKCDKCGKAFMSSSTLSKHEIIHTEKKPYKCEECGKAFNRSSTLTTHKIIHTGEKPYKCEECDKAFKYSYTLTTHKRIHTEDKPYKCEECGKAFKYSSTLTTHKRIHTGEKPYKCEECGKAFKRSSDLTTHKIIHTGEKPYKCEECGKAFKYSSNLTTHKKIHTGERPYKCEECGKAFNQSSILTTHRRIHTGEKFYKCEECGKAFKCSSNLTTHKKIHTGERPYKCEECGKAFNQSSILTTHERIILERNSTNVKNVAKPSSGPHTLLHIR

SEQ ID NO: 100819 - protein, 540 aa, Homo sapiens
  Payload ID: 20084
  Gene Name: zinc finger protein 626
  ENSP ID: ENSP00000484232
MGPLQFRDVAIEFSLEEWHCLDTAQRNLYRNVMLENYSNLVFLGITVSKPDLITCLEQGRKPLTMKRNEMIAKPSVMCSHFAQDLWPEQSMKDSFQKVVLRRYEKCEHDNLQLKKGCISVDECKVHKEGYNELNQCLTTTPRKICQCDKYVKVLHQFPNSNGQKRGHTGKKPFKYIECGKAFKQFSTLTTHKKIHTGGKPYKCEECGKAFNHSCSLTRHKKIHTGEKPYKCEECGKAFKHSSTLTTHKRNHTGEKPYKCDKCGKAFMSSSTLSKHEIIHTEKKPYKCEECGKAFNRSSTLTTHKIIHTGEKPYKCEECDKAFKYSYTLTTHKRIHTEDKPYKCEECGKAFKYSSTLTTHKRIHTGEKPYKCEECGKAFKRSSDLTTHKIIHTGEKPYKCEECGKAFKYSSNLTTHKKIHTGERPYKCEECGKAFNQSSILTTHRRIHTGEKFYKCEECGKAFKRSSHLTTHKIIHTGEKFYKCEECDKAFKHFSNLTTHKKIHTGKKPYRCEECGKAFKHSSKLTTHKRFHTGEKPYRCE

SEQ ID NO: 100820 - protein, 461 aa, Homo sapiens
  Payload ID: 20085
  Gene Name: zinc finger protein 627
  Uniprot ID: Q7L945
  ENSP ID: ENSP00000354414
MDSVAFEDVAVNFTLEEWALLDPSQKNLYRDVMRETFRNLASVGKQWEDQNIEDPFKIPRRNISHIPERLCESKEGGQGEETFSQIPDGILNKKTPGVKPCESSVCGEVGMGPSSLNRHIRDHTGREPNEYQEYGKKSYTRNQCGRALSYHRSFPVRERTHPGGKPYDCKECGETFISLVSIRRHMLTHRGGVPYKCKVCGKAFDYPSLFRIHERSHTGEKPYECKQCGKAFSCSSYIRIHERTHTGDKPYECKQCGKAFSCSKYIRIHERTHTGEKPYECKQCGKAFRCASSVRSHERTHTGEKLFECKECGKALTCLASVRRHMIKHTGNGPYKCKVCGKAFDFPSSFRIHERTHTGEKPYDCKQCGKAFSCSSSFRKHERIHTGEKPYKCTKCGKAFSRSSYFRIHERTHTGEKPYECKQCGKAFSRSTYFRVHEKIHTGEKPYENPNPNASVVPVLS

SEQ ID NO: 100821 - protein, 17 aa, Homo sapiens
  Payload ID: 20085
  Gene Name: zinc finger protein 627
  ENSP ID: ENSP00000464997
MRETFRNLASVGKQWED

SEQ ID NO: 100822 - protein, 67 aa, Homo sapiens
  Payload ID: 20085
  Gene Name: zinc finger protein 627
  ENSP ID: ENSP00000465841
MDSVAFEDVAVNFTLEEWALLDPSQKNLYRDVMRETFRNLASVGKQWEDQNIEDPFKIPRRNIRETL

SEQ ID NO: 100823 - protein, 58 aa, Homo sapiens
  Payload ID: 20085
  Gene Name: zinc finger protein 627
  ENSP ID: ENSP00000466068
MRETFRNLASVGKQWEDQNIEDPFKIPRRNISHIPERLCESKEGGQGEETFSQIPDGI

SEQ ID NO: 100824 - protein, 1058 aa, Homo sapiens [sequence omitted]

SEQ ID NO: 100825 - protein, 101 aa, Homo sapiens
  Payload ID: 20086
  Gene Name: zinc finger protein 628
  ENSP ID: ENSP00000465905
MVGSHADMAPASTAEGAGEKPGPAAPAPAAQYECGECGKSFRWSSRLLHHQRTHTGERPYKCPDCPKAFKGSSALLYHQRGHTGERPYQCPDCPKAFKRSS

SEQ ID NO: 100826 - protein, 1059 aa, Homo sapiens
  Payload ID: 20086
  Gene Name: zinc finger protein 628
  Uniprot ID: Q5EBL2
  ENSP ID: ENSP00000469591
MSGVMVGSHADMAPASTAEGAGEKPGPAAPAPAAQYECGECGKSFRWSSRLLHHQRTHTGERPYKCPDCPKAFKGSSALLYHQRGHTGERPYQCPDCPKAFKRSSLLQIHRSVHTGLRAFICGQCGLAFKWSSHYQYHLRQHTGERPYPCPDCPKAFKNSSSLRRHRHVHTGERPYTCGVCGKSFTQSTNLRQHQRVHTGERPFRCPLCPKTFTHSSNLLLHQRTHGAAPAPGTASAAPPPQSREPGKVFVCDAYLQRHLQPHSPPAPPAPPPPPPPVVPELFLAAAETTVELVYRCDGCEQGFSSEELLLEHQPCPGPDAAPQPQEAPAEAPKADQPPSPLPQPPPPAAAPAPGFACLPCGKSFRTVAGLSRHQHSHGAAGGQAFRCGSCDGSFPQLASLLAHQQCHVEEAAAGRPPPQAEAAEVTCPQEPLAPAAPVPPPPPSAPASAERPYKCAECGKSFKGSSGLRYHLRDHTGERPYQCGECGKAFKRSSLLAIHQRVHTGLRAFTCGQCGLTFKWSSHYQYHLRLHSGERPYACGECGKAFRNTSCLRRHRHVHTGERPHACGVCGKSFAQTSNLRQHQRVHTGERPFRCPLCPKTFTHSSNLLLHQRTHSAERPFTCPICGRGFVMAAYLQRHLRTHAPANTPPSTTAPAAGPQPPAPLAAARAPPATQDVHVLPHLQATLSLEVAGGTAQAPSLGPAAPNSQTFLLVQTAQGLQLIPSSVQPPTPPPPPAPPKLILLPSSSAGAGGGRARQGPRAVGKAGQGAGVVWLPGPGGLGVQGAASAGASGTGQSLIVLQNVGGGEAGPQEMSGVQLQPLRPAPEVTTVQLQPAQEVTTVQLQPAQEVTTVQLQPAQEVTTVQLQPVAGQLSNSSGGAVATEAPNLLVVQSGAAEELLTGPGPGEAGDGEASTGVVQDVLFETLQTDEGLQSVLVLSGADGEQTRLCVQEVETLPPGLTEPPATGPPGQKLLIIRSAPATELLDSSNTGGGTATLQLLAPPPSGPASGPAGLPGAPASQMVQVVPAGAGPGVMTPQGLPSIQIVQTLPAVQLVHTF

SEQ ID NO: 100827 - protein, 869 aa, Homo sapiens
  Payload ID: 20087
  Gene Name: zinc finger protein 629
  Uniprot ID: Q9UEG4
  ENSP ID: ENSP00000262525
MEPETALWGPDLQGPEQSPNDAHRGAESENEEESPRQESSGEEIIMGDPAQSPESKDSTEMSLERSSQDPSVPQNPPTPLGHSNPLDHQIPLDPPAPEVVPTPSDWTKACEASWQWGALTTWNSPPVVPANEPSLRELVQGRPAGAEKPYICNECGKSFSQWSKLLRHQRIHTGERPNTCSECGKSFTQSSHLVQHQRTHTGEKPYKCPDCGKCFSWSSNLVQHQRTHTGEKPYKCTECEKAFTQSTNLIKHQRSHTGEKPYKCGECRRAFYRSSDLIQHQATHTGEKPYKCPECGKRFGQNHNLLKHQKIHAGEKPYRCTECGKSFIQSSELTQHQRTHTGEKPYECLECGKSFGHSSTLIKHQRTHLREDPFKCPVCGKTFTLSATLLRHQRTHTGERPYKCPECGKSFSVSSNLINHQRIHRGERPYICADCGKSFIMSSTLIRHQRIHTGEKPYKCSDCGKSFIRSSHLIQHRRTHTGEKPYKCPECGKSFSQSSNLITHVRTHMDENLFVCSDCGKAFLEAHELEQHRVIHERGKTPARRAQGDSLLGLGDPSLLTPPPGAKPHKCLVCGKGFNDEGIFMQHQRIHIGENPYKNADGLIAHAAPKPPQLRSPRLPFRGNSYPGAAEGRAEAPGQPLKPPEGQEGFSQRRGLLSSKTYICSHCGESFLDRSVLLQHQLTHGNEKPFLFPDYRIGLGEGAGPSPFLSGKPFKCPECKQSFGLSSELLLHQKVHAGGKSSQKSPELGKSSSVLLEHLRSPLGARPYRCSDCRASFLDRVALTRHQETHTQEKPPNPEDPPPEAVTLSTDQEGEGETPTPTESSSHGEGQNPKTLVEEKPYLCPECGAGFTEVAALLLHRSCHPGVSL

SEQ ID NO: 100828 - protein, 533 aa, Homo sapiens
  Payload ID: 20088
  Gene Name: zinc finger protein 630
  ENSP ID: ENSP00000354683
MDRYQGNQDRVLRQVTVISRETLTDEMGSKYSAFGKMFNRCTDLAPLSQKFHKFDSCENSLKSNSDLLNYNRSYARKNPTKRFRCGRPPKYNASCSVPEKEGFIHTGMEPYGDSQCEKVLSHKQAHVQYKKFQAREKPNVCSMCGKAFIKKSQLIIHQRIHTGEKPYVCGDCRKAFSEKSHLIVHQRIHTGEKPYECTKYGRAFSRKSPFTVHQRVHTGEKPYECFECPKAFSQKSHLIIHQRVHTREKPFECSECRKAFCEMSHLFIHQITHTGKKPYECTECGKTFPRKTQLIIHQRTHTGEKPYKCGECGKTFCQQSHLIGHQRIHTGEKPYVCTDCGKAFSQKSHLTGHQRLHTGEKPYMCTECGKSFSQKSPLIIHQRIHTGEKPYQCGECGKTFSQKSLLIIHLRVHTGEKPYECTECGRAFSLKSHLILHQRGHTGEKPYECSECGKAFCGKSPLIIHQKTHPREKTPECAESGMTFFWKSQMITYQRRHTGEKPSRCSDCGKAFCQHVYFTGHQNPYRKDTLYIC

SEQ ID NO: 100829 - protein, 657 aa, Homo sapiens
  Payload ID: 20088
  Gene Name: zinc finger protein 630
  Uniprot ID: Q2M218
  ENSP ID: ENSP00000386393
MIESQEPVTFEDVAVDFTQEEWQQLNPAQKTLHRDVMLETYNHLVSVGCSGIKPDVIFKLEHGKDPWIIESELSRWIYPDRVKGLESSQQIISGELLFQREILERAPKDNSLYSVLKIWHIDNQMDRYQGNQDRVLRQVTVISRETLTDEMGSKYSAFGKMFNRCTDLAPLSQKFHKFDSCENSLKSNSDLLNYNRSYARKNPTKRFRCGRPPKYNASCSVPEKEGFIHTGMEPYGDSQCEKVLSHKQAHVQYKKFQAREKPNVCSMCGKAFIKKSQLIIHQRIHTGEKPYVCGDCRKAFSEKSHLIVHQRIHTGEKPYECTKYGRAFSRKSPFTVHQRVHTGEKPYECFECPKAFSQKSHLIIHQRVHTREKPFECSECRKAFCEMSHLFIHQITHTGKKPYECTECGKTFPRKTQLIIHQRTHTGEKPYKCGECGKTFCQQSHLIGHQRIHTGEKPYVCTDCGKAFSQKSHLTGHQRLHTGEKPYMCTECGKSFSQKSPLIIHQRIHTGEKPYQCGECGKTFSQKSLLIIHLRVHTGEKPYECTECGRAFSLKSHLILHQRGHTGEKPYECSECGKAFCGKSPLIIHQKTHPREKTPECAESGMTFFWKSQMITYQRRHTGEKPSRCSDCGKAFCQHVYFTGHQNPYRKDTLYIC

SEQ ID NO: 100830 - protein, 657 aa, Homo sapiens; identical to SEQ ID NO: 100829
  Payload ID: 20088
  Gene Name: zinc finger protein 630
  Uniprot ID: Q2M218
  ENSP ID: ENSP00000393163

SEQ ID NO: 100831 - protein, 88 aa, Homo sapiens
  Payload ID: 20088
  Gene Name: zinc finger protein 630
  ENSP ID: ENSP00000400030
MIESQEPVTFEDVAVDFTQEEWQQLNPAQKTLHRDVMLETYNHLVSVGCSGIKPDVIFKLEHGKDPWIIESELSRWIYPGIFGLCILI

SEQ ID NO: 100832 - protein, 214 aa, Homo sapiens
  Payload ID: 20088
  Gene Name: zinc finger protein 630
  ENSP ID: ENSP00000407278
MIESQEPVTFEDVAVDFTQEEWQQLNPAQKTLHRDVMLETYNHLVSVGCSGIKPDVIFKLEHGKDPWIIESELSRWIYPDRVKGLESSQQIISGELLFQREILERAPKDNSLYSVLKIWHIDNQMDRYQGNQDRVLRQVTVISRETLTDEMGSKYSAFGKMFNRCTDLAPLSQKFHKFDSCENSLKSNSDLLNYNRSYARKNPTKRFRCGRPPK

SEQ ID NO: 100833 - protein, 40 aa, Homo sapiens
  Payload ID: 20088
  Gene Name: zinc finger protein 630
  ENSP ID: ENSP00000408054
MDRYQGNQDRVLRQVTVISRETLTDEMGSKYSAFGKMFNR

SEQ ID NO: 100834 - protein, 643 aa, Homo sapiens
  Payload ID: 20088
  Gene Name: zinc finger protein 630
  ENSP ID: ENSP00000480858
MVEGEEEWQQLNPAQKTLHRDVMLETYNHLVSVGCSGIKPDVIFKLEHGKDPWIIESELSRWIYPDRVKGLESSQQIISGELLFQREILERAPKDNSLYSVLKIWHIDNQMDRYQGNQDRVLRQVTVISRETLTDEMGSKYSAFGKMFNRCTDLAPLSQKFHKFDSCENSLKSNSDLLNYNRSYARKNPTKRFRCGRPPKYNASCSVPEKEGFIHTGMEPYGDSQCEKVLSHKQAHVQYKKFQAREKPNVCSMCGKAFIKKSQLIIHQRIHTGEKPYVCGDCRKAFSEKSHLIVHQRIHTGEKPYECTKYGRAFSRKSPFTVHQRVHTGEKPYECFECPKAFSQKSHLIIHQRVHTREKPFECSECRKAFCEMSHLFIHQITHTGKKPYECTECGKTFPRKTQLIIHQRTHTGEKPYKCGECGKTFCQQSHLIGHQRIHTGEKPYVCTDCGKAFSQKSHLTGHQRLHTGEKPYMCTECGKSFSQKSPLIIHQRIHTGEKPYQCGECGKTFSQKSLLIIHLRVHTGEKPYECTECGRAFSLKSHLILHQRGHTGEKPYECSECGKAFCGKSPLIIHQKTHPREKTPECAESGMTFFWKSQMITYQRRHTGEKPSRCSDCGKAFCQHVYFTGHQNPYRKDTLYIC

SEQ ID NO: 100835 - protein, 200 aa, Homo sapiens
  Payload ID: 20088
  Gene Name: zinc finger protein 630
  ENSP ID: ENSP00000485938
MIESQEEWQQLNPAQKTLHRDVMLETYNHLVSVGCSGIKPDVIFKLEHGKDPWIIESELSRWIYPDRVKGLESSQQIISGELLFQREILERAPKDNSLYSVLKIWHIDNQMDRYQGNQDRVLRQVTVISRETLTDEMGSKYSAFGKMFNRCTDLAPLSQKFHKFDSCENSLKSNSDLLNYNRSYARKNPTKRFRCGRPPK

SEQ ID NO: 100836 - protein, 1978 aa, Homo sapiens
  Payload ID: 20089
  Gene Name: zinc finger protein 638
  Uniprot ID: Q14966
  ENSP ID: ENSP00000264447
MSRPRFNPRGDFPLQRPRAPNPSGMRPPGPFMRPGSMGLPRFYPAGRARGIPHRFAGHESYQNMGPQRMNVQVTQHRTDPRLTKEKLDFHEAQQKKGKPHGSRWDDEPHISASVAVKQSSVTQVTEQSPKVQSRYTKESASSILASFGLSNEDLEELSRYPDEQLTPENMPLILRDIRMRKMGRRLPNLPSQSRNKETLGSEAVSSNVIDYGHASKYGYTEDPLEVRIYDPEIPTDEVENEFQSQQNISASVPNPNVICNSMFPVEDVFRQMDFPGESSNNRSFFSVESGTKMSGLHISGGQSVLEPIKSVNQSINQTVSQTMSQSLIPPSMNQQPFSSELISSVSQQERIPHEPVINSSNVHVGSRGSKKNYQSQADIPIRSPFGIVKASWLPKFSHADAQKMKRLPTPSMMNDYYAASPRIFPHLCSLCNVECSHLKDWIQHQNTSTHIESCRQLRQQYPDWNPEILPSRRNEGNRKENETPRRRSHSPSPRRSRRSSSSHRFRRSRSPMHYMYRPRSRSPRICHRFISRYRSRSRSRSPYRIRNPFRGSPKCFRSVSPERMSRRSVRSSDRKKALEDVVQRSGHGTEFNKQKHLEAADKGHSPAQKPKTSSGTKPSVKPTSATKSDSNLGGHSIRCKSKNLEDDTLSECKQVSDKAVSLQRKLRKEQSLHYGSVLLITELPEDGCTEEDVRKLFQPFGKVNDVLIVPYRKEAYLEMEFKEAITAIMKYIETTPLTIKGKSVKICVPGKKKAQNKEVKKKTLESKKVSASTLKRDADASKAVEIVTSTSAAKTGQAKASVAKVNKSTGKSASSVKSVVTVAVKGNKASIKTAKSGGKKSLEAKKTGNVKNKDSNKPVTIPENSEIKTSIEVKATENCAKEAISDAALEATENEPLNKETEEMCVMLVSNLPNKGYSVEEVYDLAKPFGGLKDILILSSHKKAYIEINRKAAESMVKFYTCFPVLMDGNQLSISMAPENMNIKDEEAIFITLVKENDPEANIDTIYDRFVHLDNLPEDGLQCVLCVGLQFGKVDHHVFISNRNKAILQLDSPESAQSMYSFLKQNPQNIGDHMLTCSLSPKIDLPEVQIEHDPELEKESPGLKNSPIDESEVQTATDSPSVKPNELEEESTPSIQTETLVQQEEPCEEEAEKATCDSDFAVETLELETQGEEVKEEIPLVASASVSIEQFTENAEECALNQQMFNSDLEKKGAEIINPKTALLPSDSVFAEERNLKGILEESPSEAEDFISGITQTMVEAVAEVEKNETVSEILPSTCIVTLVPGIPTGDEKTVDKKNISEKKGNMDEKEEKEFNTKETRMDLQIGTEKAEKNEGRMDAEKVEKMAAMKEKPAENTLFKAYPNKGVGQANKPDETSKTSILAVSDVSSSKPSIKAVIVSSPKAKATVSKTENQKSFPKSVPRDQINAEKKLSAKEFGLLKPTSARSGLAESSSKFKPTQSSLTRGGSGRISALQGKLSKLDYRDITKQSQETEARPSIMKRDDSNNKTLAEQNTKNPKSTTGRSSKSKEEPLFPFNLDEFVTVDEVIEEVNPSQAKQNPLKGKRKETLKNVPFSELNLKKKKGKTSTPRGVEGELSFVTLDEIGEEEDAAAHLAQALVTVDEVIDEEELNMEEMVKNSNSLFTLDELIDQDDCISHSEPKDVTVLSVAEEQDLLKQERLVTVDEIGEVEELPLNESADITFATLNTKGNEGDTVRDSIGFISSQVPEDPSTLVTVDEIQDDSSDLHLVTLDEVTEEDEDSLADFNNLKEELNFVTVDEVGEEEDGDNDLKVELAQSKNDHPTDKKGNRKKRAVDTKKTKLESLSQVGPVNENVMEEDLKTMIERHLTAKTPTKRVRIGKTLPSEKAVVTEPAKGEEAFQMSEVDEESGLKDSEPERKRKKTEDSSSGKSVASDVPEELDFLVPKAGFFCPICSLFYSGEKAMTNHCKSTRHKQNTEKFMAKQRKEKEQNEAEERSSR

SEQ ID NO: 100837 - protein, 1978 aa, Homo sapiens; identical to SEQ ID NO: 100836
  Payload ID: 20089
  Gene Name: zinc finger protein 638
  Uniprot ID: Q14966
  ENSP ID: ENSP00000386433

SEQ ID NO: 100838 - protein, 197 aa, Homo sapiens
  Payload ID: 20089
  Gene Name: zinc finger protein 638
  ENSP ID: ENSP00000388164
MSRPRFNPRGDFPLQRPRAPNPSGMRPPGPFMRPGSMGLPRFYPAGRARGIPHRFAGHESYQNMGPQRMNVQVTQHRTDPRLTKEKLDFHEAQQKKGKPHGSRWDDEPHISASVAVKQSSVTQVTEQSPKVQSRYTKESASSILASFGLSNEDLEELSRYPDEQLTPENMPLILRDIRMRKMGRRLPNLPSQSRNKE

SEQ ID NO: 100839 - protein, 29 aa, Homo sapiens
  Payload ID: 20089
  Gene Name: zinc finger protein 638
  ENSP ID: ENSP00000396909
MSRPRFNPRGDFPLQRPRAPNPSGMRPPG

SEQ ID NO: 100840 - protein, 62 aa, Homo sapiens
  Payload ID: 20089
  Gene Name: zinc finger protein 638
  ENSP ID: ENSP00000402875
MSRPRFNPRGDFPLQRPRAPNPSGMRPPGPFMRPGSMGLPRFYPAGRARGIPHRFAGHESYQ

SEQ ID NO: 100841 - protein, 62 aa, Homo sapiens; identical to SEQ ID NO: 100840
  Payload ID: 20089
  Gene Name: zinc finger protein 638
  ENSP ID: ENSP00000408557

SEQ ID NO: 100842 - protein, 36 aa, Homo sapiens
  Payload ID: 20089
  Gene Name: zinc finger protein 638
  ENSP ID: ENSP00000409647
MSRPRFNPRGDFPLQRPRAPNPSGMRPPGPFMRPGS

SEQ ID NO: 100843 - protein, 171 aa, Homo sapiens
  Payload ID: 20089
  Gene Name: zinc finger protein 638
  ENSP ID: ENSP00000485154
MPRDGVPAGNTTPAAAQAAAQSPDSATAGAPQVLDSLKRYPDWNPEILPSRRNEGNRKENETPRRRSHSPSPRRSRRSSSSHRFRRSRSPMHYMYRPRSRSPRICHRFISRYRSRSRSRSPYRIRNPFRGSPKCFRSVSPERMSRRSVRSSDRKKALEDVVQRSGHGTEFN

SEQ ID NO: 100844 - protein, 90 aa, Homo sapiens
  Payload ID: 20089
  Gene Name: zinc finger protein 638
  ENSP ID: ENSP00000485169
MHYMYRPRSRSPRICHRFISRYRSRSRSRSPYRIRNPFRGSPKCFRSVSPERMSRRSVRSSDRKKALEDVVQRSGHGTEFNKQKHLEAAD

SEQ ID NO: 100845 - protein, 158 aa, Homo sapiens
  Payload ID: 20089
  Gene Name: zinc finger protein 638
  ENSP ID: ENSP00000485192
  MOD_RES (1)..(1): Any amino acid
XKGNRKKRAVDTKKTKLESLSQVGPVNENVMEEDLKTMIERHLTAKTPTKRVRIGKTLPSEKAVVTEPAKGEEAFQMSEVDEESGLKDSEPERKRKKTEDSSSGKSVASDVPEELDFLVPKAGFFCPICSLFYSGEKAMTNHCKSTRHKQNTEQHLPE

SEQ ID NO: 100846 - protein, 98 aa, Homo sapiens
  Payload ID: 20089
  Gene Name: zinc finger protein 638
  ENSP ID: ENSP00000485266
MHYMYRPRSRSPRICHRFISRYRSRSRSRSPYRIRNPFRGSPKCFRSVSPERMSRRSVRSSDRKKALEDVVQRSGHGTEFNKQKHLEAADKGHSPAQK

SEQ ID NO: 100847 - protein, 184 aa, Homo sapiens
  Payload ID: 20089
  Gene Name: zinc finger protein 638
  ENSP ID: ENSP00000485494
MLQTIYLFSKYPDWNPEILPSRRNEGNRKENETPRRRSHSPSPRRSRRSSSSHRFRRSRSPMHYMYRPRSRSPRICHRFISRYRSRSRSRSPYRIRNPFRGSPKCFRSVSPERMSRRSVRSSDRKKALEDVVQRSGHGTEFNKQKHLEAADKGHSPAQKPKTSSGTKPSVKPTSATKSDSNLGG

SEQ ID NO: 100848 - protein, 918 aa, Homo sapiens
  Payload ID: 20089
  Gene Name: zinc finger protein 638
  ENSP ID: ENSP00000485608
MSRPRFNPRGDFPLQRPRAPNPSGMRPPGPFMRPGSMGLPRFYPAGRARGIPHRFAGHESYQNMGPQRMNVQVTQHRTDPRLTKEKLDFHEAQQKKGKPHGSRWDDEPHISASVAVKQSSVTQVTEQSPKVQSRYTKESASSILASFGLSNEDLEELSRYPDEQLTPENMPLILRDIRMRKMGRRLPNLPSQSRNKETLGSEAVSSNVIDYGHASKYGYTEDPLEVRIYDPEIPTDEVENEFQSQQNISASVPNPNVICNSMFPVEDVFRQMDFPGESSNNRSFFSVESGTKMSGLHISGGQSVLEPIKSVNQSINQTVSQTMSQSLIPPSMNQQPFSSELISSVSQQERIPHEPVINSSNVHVGSRGSKKNYQSQADIPIRSPFGIVKASWLPKFSHADAQKMKRLPTPSMMNDYYAASPRIFPHLCSLCNVECSHLKDWIQHQNTSTHIESCRQLRQQYPDWNPEILPSRRNEGNRKENETPRRRSHSPSPRRSRRSSSSHRFRRSRSPMHYMYRPRSRSPRICHRFISRYRSRSRSRSPYRIRNPFRGSPKCFRSVSPERMSRRSVRSSDRKKALEDVVQRSGHGTEFNKQKHLEAADKGHSPAQKPKTSSGTKPSVKPTSATKSDSNLGGHSIRCKSKNLEDDTLSECKQVSDKAVSLQRKLRKEQSLHYGSVLLITELPEDGCTEEDVRKLFQPFGKVNDVLIVPYRKEAYLEMEFKEAITAIMKYIETTPLTIKGKSVKICVPGKKKAQNKEVKKKTLESKKVSASTLKRDADASKAVEIVTSTSAESVDQTQQLVPLVRNTARDHDGTPENEGEETVQSALFGFQYDASDHTMAWLGPNTVPEVKEMILQDPQLQTTQLPQTTQAPDITWGMLKKTTYKAEQILLQTQKPFTPDNLFLALLSGDAKPEYEQ

SEQ ID NO: 100849 - protein, 153 aa, Homo sapiens
  Payload ID: 20089
  Gene Name: zinc finger protein 638
  ENSP ID: ENSP00000485618
MHYMYRPRSRSPRICHRFISRYRSRSRSRSPYRIRNPFRGSPKCFRSVSPERMSRRSVRSSDRKKALEDVVQRSGHGTEFNKQKHLEAADKGHSPAQKPKTSSGTKPSVKPTSATKSDSNLGGHSIRCKSKNLEDDTLSECKQVSDKAVSLQR

SEQ ID NO: 100850 - protein, 285 aa, Homo sapiens
  Payload ID: 20089
  Gene Name: zinc finger protein 638
  ENSP ID: ENSP00000485667
  MOD_RES (1)..(1): Any amino acid
XPKDVTVLSVAEEQDLLKQERLVTVDEIGEVEELPLNESADITFATLNTKGNEGDTVRDSIGFISSQVPEDPSTLVTVDEIQDDSSDLHLVTLDEVTEEDEDSLADFNNLKEELNFVTVDEVGEEEDGDNDLKVELAQSKNDHPTDKKGNRKKRAVDTKKTKLESLSQVGPVNENVMEEDLKTMIERHLTVDEESGLKDSEPERKRKKTEDSSSGKSVASDVPEELDFLVPKAGFFCPICSLFYSGEKAMTNHCKSTRHKQNTEKFMAKQRKEKEQNEAEERSSR

SEQ ID NO: 100851 - protein, 485 aa, Homo sapiens
  Payload ID: 20090
  Gene Name: zinc finger protein 639
  Uniprot ID: Q9UID6
  ENSP ID: ENSP00000325634
MNEYPKKRKRKTLHPSRYSDSSGISRIADGFNGIFSDHCYSVCSMRQPDLKYFDNKDDDSDTETSNDLPKFADGIKARNRNQNYLVPSPVLRILDHTAFSTEKSADIVICDEECDSPESVNQQTQEESPIEVHTAEDVPIAVEVHAISEDYDIETENNSSESLQDQTDEEPPAKLCKILDKSQALNVTAQQKWPLLRANSSGLYKCELCEFNSKYFSDLKQHMILKHKRTDSNVCRVCKESFSTNMLLIEHAKLHEEDPYICKYCDYKTVIFENLSQHIADTHFSDHLYWCEQCDVQFSSSSELYLHFQEHSCDEQYLCQFCEHETNDPEDLHSHVVNEHACKLIELSDKYNNGEHGQYSLLSKITFDKCKNFFVCQVCGFRSRLHTNVNRHVAIEHTKIFPHVCDDCGKGFSSMLEYCKHLNSHLSEGIYLCQYCEYSTGQIEDLKIHLDFKHSADLPHKCSDCLMRFGNERELISHLPVHETT

SEQ ID NO: 100852 - protein, 130 aa, Homo sapiens
  Payload ID: 20090
  Gene Name: zinc finger protein 639
  ENSP ID: ENSP00000417232
MNEYPKKRKRKTLHPSRYSDSSGISRIADGFNGIFSDHCYSVCSMRQPDLKYFDNKDDDSDTETSNDLPKFADGIKARNRNQNYLVPSPVLRILDHTAFSTEKSADIVICDEECDSPESVNQQTQEESPI

SEQ ID NO: 100853 - protein, 485 aa, Homo sapiens; identical to SEQ ID NO: 100851
  Payload ID: 20090
  Gene Name: zinc finger protein 639
  Uniprot ID: Q9UID6
  ENSP ID: ENSP00000417740

SEQ ID NO: 100854 - protein, 137 aa, Homo sapiens
  Payload ID: 20090
  Gene Name: zinc finger protein 639
  ENSP ID: ENSP00000418628
MNEYPKKRKRKTLHPSRYSDSSGISRIADGFNGIFSDHCYSVCSMRQPDLKYFDNKDDDSDTETSNDLPKFADGIKARNRNQNYLVPSPVLRILDHTAFSTEKSADIVICDEECDSPESVNQQTQEESPIEVHTAED

SEQ ID NO: 100855 - protein, 485 aa, Homo sapiens; identical to SEQ ID NO: 100851
  Payload ID: 20090
  Gene Name: zinc finger protein 639
  Uniprot ID: Q9UID6
  ENSP ID: ENSP00000418766

SEQ ID NO: 100856 - protein, 216 aa, Homo sapiens
  Payload ID: 20090
  Gene Name: zinc finger protein 639
  ENSP ID: ENSP00000418870
MNEYPKKRKRKTLHPSRYSDSSGISRIADGFNGIFSDHCYSVCSMRQPDLKYFDNKDDDSDTETSNDLPKFADGIKARNRNQNYLVPSPVLRILDHTAFSTEKSADIVICDEECDSPESVNQQTQEESPIEVHTAEDVPIAVEVHAISEDYDIETENNSSESLQDQTDEEPPAKLCKILDKSQALNVTAQQKWPLLRANSSGLYKCELCEFNSKYF

SEQ ID NO: 100857 - protein, 288 aa, Homo sapiens
  Payload ID: 20090
  Gene Name: zinc finger protein 639
  ENSP ID: ENSP00000419650
MNEYPKKRKRKTLHPSRYSDSSGISRIADGFNGIFSDHCYSVCSMRQPDLKYFDNKDDDSDTETSNDLPKFADGIKARNRNQNYLVPSPVLRILDHTAFSTEKSADIVICDEECDSPESVNQQTQEESPIEVHTAEDVPIAVEVHAISEDYDIETENNSSESLQDQTDEEPPAKLCKILDKSQALNVTAQQKWPLLRANSSGLYKCELCEFNSKYFSDLKQHMILKHKRTDSNVCRVCKESFSTNMLLIEHAKLHEEDPYICKYCDYKTVIFENLSQHIADTHFSDHL

SEQ ID NO: 100858 - protein, 485 aa, Homo sapiens; identical to SEQ ID NO: 100851
  Payload ID: 20090
  Gene Name: zinc finger protein 639
  Uniprot ID: Q9UID6
  ENSP ID: ENSP00000477626

SEQ ID NO: 100859 - protein, 438 aa, Homo sapiens
  Payload ID: 20091
  Gene Name: zinc finger protein 641
  Uniprot ID: Q96N77
  ENSP ID: ENSP00000301042
MQAEDRSQFGSAAEMLSEQTAALGTGWESMNVQLDGAEPQVERGSQEERPWRTVPGPLEHLCCDLEEEPQSLQEKAQSAPWVPAIPQEGNTGDWEMAAALLAAGSQGLVTIKDVSLCFSQEEWRSLDPSQTDFYGEYVMQENCGIVVSLRFPIPKLDMLSQLEGGEEQWVPDPQDLEERDILRVTYTGDGSEHEGDTPELEAEPPRMLSSVSEDTVLWNPEHDESWDSMPSSSRGMLLGPPFLQEDSFSNLLCSTEMDSLLRPHTCPQCGKQFVWGSHLARHQQTHTGERPYSCLKCEKTFGRRHHLIRHQKTHLHDKTSRCSECGKNFRCNSHLASHQRVHAEGKSCKGQEVGESPGTRKRQRAPPVPKCHVCTECGKSFGRRHHLVRHWLTHTGEKPFQCPRCEKSFGRKHHLDRHLLTHQGQSPRNSWDRGTSVF

SEQ ID NO: 100860 - protein, 415 aa, Homo sapiens
  Payload ID: 20091
  Gene Name: zinc finger protein 641
  Uniprot ID: Q96N77
  ENSP ID: ENSP00000394627
MLSEQTAALGTGWESMNVQLDGAEPQVERGSQEERPWRTVPGPLEHLCCDLEEEPQSLQEKAQSAPWVPAIPQEGNTGDWEMAAALLAAGSQVSSASLGVSCGPITAAFVLLSHQPIDELAHMIINGFPIPKLDMLSQLEGGEEQWVPDPQDLEERDILRVTYTGDGSEHEGDTPELEAEPPRMLSSVSEDTVLWNPEHDESWDSMPSSSRGMLLGPPFLQEDSFSNLLCSTEMDSLLRPHTCPQCGKQFVWGSHLARHQQTHTGERPYSCLKCEKTFGRRHHLIRHQKTHLHDKTSRCSECGKNFRCNSHLASHQRVHAEGKSCKGQEVGESPGTRKRQRAPPVPKCHVCTECGKSFGRRHHLVRHWLTHTGEKPFQCPRCEKSFGRKHHLDRHLLTHQGQSPRNSWDRGTSVF

SEQ ID NO: 100861 - protein, 438 aa, Homo sapiens; identical to SEQ ID NO: 100859
  Payload ID: 20091
  Gene Name: zinc finger protein 641
  Uniprot ID: Q96N77
  ENSP ID: ENSP00000437832

SEQ ID NO: 100862 - protein, 77 aa, Homo sapiens
  Payload ID: 20091
  Gene Name: zinc finger protein 641
  ENSP ID: ENSP00000446625
MLSEQTAALGTGWESMNVQLDGAEPQVERGSQEERPWRTVPGPLEHLCCDLEEEPQSLQEKAQSAPWVPAIPQEGNT

SEQ ID NO: 100863 - protein, 107 aa, Homo sapiens
  Payload ID: 20091
  Gene Name: zinc finger protein 641
  ENSP ID: ENSP00000447381
MLSEQTAALGTGWESMNVQLDGAEPQVERGSQEERPWRTVPGPLEHLCCDLEEEPQSLQEKAQSAPWVPAIPQEGNTGDWEMAAALLAAGSQGLVTIKDVSLCFSQE

SEQ ID NO: 100864 - protein, 51 aa, Homo sapiens
  Payload ID: 20091
  Gene Name: zinc finger protein 641
  ENSP ID: ENSP00000448025
  MOD_RES (1)..(1): Any amino acid
XCGIVVSLRFPIPKLDMLSQLEGGEEQWVPDPQDLEERDILRVTYTGKNLE

SEQ ID NO: 100865 - protein, 82 aa, Homo sapiens
  Payload ID: 20091
  Gene Name: zinc finger protein 641
  ENSP ID: ENSP00000448140
MLSEQTAALGTGWESMNVQLDGAEPQVERGSQEERPWRTVPGPLEHLCCDLEEEPQSLQEKGFPIPKLDMLSQLEGGEEQWV

SEQ ID NO: 100866 - protein, 136 aa, Homo sapiens
  Payload ID: 20091
  Gene Name: zinc finger protein 641
  ENSP ID: ENSP00000448810
MQAEDRSQFGSAAEMLSEQTAALGTGWESMNVQLDGAEPQVERGSQEERPWRTVPGPLEHLCCDLEEEPQSLQEKAQSAPWVPAIPQEGNTGDWEMAAALLAAGSQGLVTIKDVSLCFSQEEWRSLDPSQTDFYGE

SEQ ID NO: 100867 - protein, 424 aa, Homo sapiens
  Payload ID: 20091
  Gene Name: zinc finger protein 641
  Uniprot ID: Q96N77
  ENSP ID: ENSP00000449974
MLSEQTAALGTGWESMNVQLDGAEPQVERGSQEERPWRTVPGPLEHLCCDLEEEPQSLQEKAQSAPWVPAIPQEGNTGDWEMAAALLAAGSQGLVTIKDVSLCFSQEEWRSLDPSQTDFYGEYVMQENCGIVVSLRFPIPKLDMLSQLEGGEEQWVPDPQDLEERDILRVTYTGDGSEHEGDTPELEAEPPRMLSSVSEDTVLWNPEHDESWDSMPSSSRGMLLGPPFLQEDSFSNLLCSTEMDSLLRPHTCPQCGKQFVWGSHLARHQQTHTGERPYSCLKCEKTFGRRHHLIRHQKTHLHDKTSRCSECGKNFRCNSHLASHQRVHAEGKSCKGQEVGESPGTRKRQRAPPVPKCHVCTECGKSFGRRHHLVRHWLTHTGEKPFQCPRCEKSFGRKHHLDRHLLTHQGQSPRNSWDRGTSVF

SEQ ID NO: 100868 - protein, 1327 aa, Homo sapiens
  Payload ID: 20092
  Gene Name: zinc finger protein 644
  Uniprot ID: Q9H582
  ENSP ID: ENSP00000337008
MRSFLQQDVNKTKSRLNVLNGLANNMDDLKINTDITGAKEELLDDNNFISDKESGVHKPKDCQTSFQKNNTLTLPEELSKDKSENALSGGQSSLFIHAGAPTVSSENFILPKGAAVNGPVSHSSLTKTSNMNKGSVSLTTGQPVDQPTTESCSTLKVAADLQLSTPQKASQHQVLFLLSDVAHAKNPTHSNKKLPTSASVGCDIQNSVGSNIKSDGTLINQVEVGEDGEDLLVKDDCVNTVTGISSGTDGFRSENDTNWDPQKEFIQFLMTNEETVDKAPPHSKIGLEKKRKRKMDVSKITRYTEDCFSDSNCVPNKSKMQEVDFLEQNEELQAVDSQKYALSKVKPESTDEDLESVDAFQHLIYNPDKCGEESSPVHTSTFLSNTLKKKCEESDSESPATFSTEEPSFYPCTKCNVNFREKKHLHRHMMYHLDGNSHFRHLNVPRPYACRECGRTFRDRNSLLKHMIIHQERRQKLMEEIRELKELQDEGRSARLQCPQCVFGTNCPKTFVQHAKTHEKDKRYYCCEECNFMAVTENELECHRGIAHGAVVKCPMVTSDIAQRKTQKKTFMKDSVVGSSKKSATYICKMCPFTTSAKSVLKKHTEYLHSSSCVDSFGSPLGLDKRKNDILEEPVDSDSTKTLTKQQSTTFPKNSALKQDVKRTFGSTSQSSSFSKIHKRPHRIQKARKSIAQSGVNMCNQNSSPHKNVTIKSSVDQKPKYFHQAAKEKSNAKANSHYLYRHKYENYRMIKKSGESYPVHFKKEEASSLNSLHLFSSSSNSHNNFISDPHKPDAKRPESFKDHRRVAVKRVIKESKKESSVGGEDLDSYPDFLHKMTVVVLQKLNSAEKKDSYETEDESSWDNVELGDYTTQAIEDETYSDINQEHVNLFPLFKSKVEGQEPGENATLSYDQNDGFYFEYYEDTGSNNFLHEIHDPQHLETADASLSKHSSVFHWTDLSLEKKSCPYCPATFETGVGLSNHVRGHLHRAGLSYEARHVVSPEQIATSDKMQHFKRTGTGTPVKRVRKAIEKSETTSEHTCQLCGGWFDTKIGLSNHVRGHLKRLGKTKWDAHKSPICVLNEMMQNEEKYEKILKALNSRRIIPRPFVAQKLASSDDFISQNVIPLEAYRNGLKTEALSVSASEEEGLNFLNEYDETKPELPSGKKNQSLTLIELLKNKRMGEERNSAISPQKIHNQTARKRFVQKCVLPLNEDSPLMYQPQKMDLTMHSALDCKQKKSRSRSGSKKKMLTLPHGADEVYILRCRFCGLVFRGPLSVQEDWIKHLQRHIVNANLPRTGAGMVEVTSLLKKPASITETSFSLLMAEAAS

SEQ ID NO: 100869 - protein, 105 aa, Homo sapiens
  Payload ID: 20092
  Gene Name: zinc finger protein 644
  Uniprot ID: Q9H582
  ENSP ID: ENSP00000340828
MLIRQNLALDCKQKKSRSRSGSKKKMLTLPHGADEVYILRCRFCGLVFRGPLSVQEDWIKHLQRHIVNANLPRTGAGMVEVTSLLKKPASITETSFSLLMAEAAS

SEQ ID NO: 100870 - protein, 105 aa, Homo sapiens; identical to SEQ ID NO: 100869
  Payload ID: 20092
  Gene Name: zinc finger protein 644
  Uniprot ID: Q9H582
  ENSP ID: ENSP00000354659

SEQ ID NO: 100871 - protein, 1327 aa, Homo sapiens; identical to SEQ ID NO: 100868
  Payload ID: 20092
  Gene Name: zinc finger protein 644
  Uniprot ID: Q9H582
  ENSP ID: ENSP00000359469

SEQ ID NO: 100872 - protein, 650 aa, Homo sapiens
  Payload ID: 20092
  Gene Name: zinc finger protein 644
  ENSP ID: ENSP00000482748
MMYHLDGNSHFRHLNVPRPYACRECGRTFRDRNSLLKHMIIHQERRQKLMEEIRELKELQDEGRSARLQCPQCVFGTNCPKTFVQHAKTHEKDKRYYCCEECNFMAVTENELECHRGIAHGAVVKCPMVTSDIAQRKTQKKTFMKDSVVGSSKKSATYICKMCPFTTSAKSVLKKHTEYLHSSSCVDSFGSPLGLDKRKNDILEEPVDSDSTKTLTKQQSTTFPKNSALKQDVKRTFGSTSQSSSFSKIHKRPHRIQKARKSIAQSGVNMCNQNSSPHKNVTIKSSVDQKPKYFHQAAKEKSNAKANSHYLYRHKYENYRMIKKSGESYPVHFKKEEASSLNSLHLFSSSSNSHNNFISDPHKPDAKRPESFKDHRRVAVKRVIKESKKESSVGGEDLDSYPDFLHKMTVVVLQKLNSAEKKDSYETEDESSWDNVELGDYTTQAIEDETYSDINQEHVNLFPLFKSKVEGQEPGENATLSYDQNDGFYFEYYEDTGSNNFLHEIHDPQHLETADASLSKHSSVFHWTDLSLEKKSCPYCPATFETGVGLSNHVRGHLHRAGLSYEARHVVSPEQIATSDKMQHFKRTGTGTPVKRVRKAIEKSETTSEHTCQLCGGWFDTKIGLSNHVRGHLKRLGKTKWDAHKSPICV

SEQ ID NO: 100873 - protein, 425 aa, Homo sapiens
  Payload ID: 20093
  Gene Name: zinc finger protein 645
  Uniprot ID: Q8N7E2
  ENSP ID: ENSP00000323348
MNKMPAGEQECEYNKEGKYYSKGVKLVRKKKKIPGYRWGDIKINIIGEKDDLPIHFCDKCDLPIKIYGRIIPCKHAFCYHCANLYDKVGYKVCPRCRYPVLRIEAHKRGSVFMCSIVQQCKRTYLSQKSLQAHIKRRHKRARKQVTSASLEKVRPHIAPPQTEISDIPKRLQDRDHLSYIPPEQHTMVSLPSVQHMLQEQHNQPHKDIQAPPPELSLSLPFPIQWETVSIFTRKHGNLTVDHIQNNSDSGAKKPTPPDYYPECQSQPAVSSPHHIIPQKQHYAPPPSPSSPVNHQMPYPPQDVVTPNSVRSQVPALTTTYDPSSGYIIVKVPPDMNSPPLRAPQSQNGNPSASEFASHHYNLNILPQFTENQETLSPQFTQTDAMDHRRWPAWKRLSPCPPTRSPPPSTLHGRSHHSHQRRHRRY

SEQ ID NO: 100874 - protein, 1832 aa, Homo sapiens
  Payload ID: 20094
  Gene Name: zinc finger protein 646
  Uniprot ID: O15015
  ENSP ID: ENSP00000300850
MEDTPPSLSCSDCQRHFPSLPELSRHRELLHPSPNQDSEEADSIPRPYRCQQCGRGYRHPGSLVNHRRTHETGLFPCTTCGKDFSNPMALKSHMRTHAPEGRRRHRPPRPKEATPHLQGETVSTDSWGQRLGSSEGWENQTKHTEETPDCESVPDPRAASGTWEDLPTRQREGLASHPGPEDGADGWGPSTNSARAPPLPIPASSLLSNLEQYLAESVVNFTGGQEPTQSPPAEEERRYKCSQCGKTYKHAGSLTNHRQSHTLGIYPCAICFKEFSNLMALKNHSRLHAQYRPYHCPHCPRVFRLPRELLEHQQSHEGERQEPRWEEKGMPTTNGHTDESSQDQLPSAQMLNGSAELSTSGELEDSGLEEYRPFRCGDCGRTYRHAGSLINHRKSHQTGVYPCSLCSKQLFNAAALKNHVRAHHRPRQGVGENGQPSVPPAPLLLAETTHKEEEDPTTTLDHRPYKCSECGRAYRHRGSLVNHRHSHRTGEYQCSLCPRKYPNLMALRNHVRVHCKAARRSADIGAEGAPSHLKVELPPDPVEAEAAPHTDQDHVCKHEEEATDITPAADKTAAHICSICGLLFEDAESLERHGLTHGAGEKENSRTETTMSPPRAFACRDCGKSYRHSGSLINHRQTHQTGDFSCGACAKHFHTMAAMKNHLRRHSRRRSRRHRKRAGGASGGREAKLLAAESWTRELEDNEGLESPQDPSGESPHGAEGNLESDGDCLQAESEGDKCGLERDETHFQGDKESGGTGEGLERKDASLLDNLDIPGEEGGGTHFCDSLTGVDEDQKPATGQPNSSSHSANAVTGWQAGAAHTCSDCGHSFPHATGLLSHRPCHPPGIYQCSLCPKEFDSLPALRSHFQNHRPGEATSAQPFLCCLCGMIFPGRAGYRLHRRQAHSSSGMTEGSEEEGEEEGVAEAAPARSPPLQLSEAELLNQLQREVEALDSAGYGHICGCCGQTYDDLGSLERHHQSQSSGTTADKAPSPLGVAGDAMEMVVDSVLEDIVNSVSGEGGDAKSQEGAGTPLGDSLCIQGGESLLEAQPRPFRCNQCGKTYRHGGSLVNHRKIHQTGDFLCPVCSRCYPNLAAYRNHLRNHPRCKGSEPQVGPIPEAAGSSELQVGPIPEGGSNKPQHMAEEGPGQAEVEKLQEELKVEPLEEVARVKEEVWEETTVKGEEIEPRLETAEKGCQTEASSERPFSCEVCGRSYKHAGSLINHRQSHQTGHFGCQACSKGFSNLMSLKNHRRIHADPRRFRCSECGKAFRLRKQLASHQRVHMERRGGGGTRKATREDRPFRCGQCGRTYRHAGSLLNHRRSHETGQYSCPTCPKTYSNRMALKDHQRLHSENRRRRAGRSRRTAVRCALCGRSFPGRGSLERHLREHEETEREPANGQGGLDGTAASEANLTGSQGLETQLGGAEPVPHLEDGVPRPGERSQSPIRAASSEAPEPLSWGAGKAGGWPVGGGLGNHSGGWVPQFLTRSEEPEDSVHRSPCHAGDCQLNGPTLSHMDSWDNRDNSSQLQPGSHSSCSQCGKTYCQSGSLLNHNTNKTDRHYCLLCSKEFLNPVATKSHSHNHIDAQTFACPDCGKAFESHQELASHLQAHARGHSQVPAQMEEARDPKAGTGEDQVVLPGQGKAQEAPSETPRGPGESVERARGGQAVTSMAAEDKERPFRCTQCGRSYRHAGSLLNHQKAHTTGLYPCSLCPKLLPNLLSLKNHSRTHTDPKRHCCSICGKAFRTAARLEGHGRVHAPREGPFTCPHCPRHFRRRISFVQHQQQHQEEWTVAGSGAPVAPVTGRGDLPLPPPPTPTTPLLDPSPQWPADLSFSL

SEQ ID NO: 100875 - protein, 1829 aa, Homo sapiens
  Payload ID: 20094
  Gene Name: zinc finger protein 646
  Uniprot ID: O15015
  ENSP ID: ENSP00000378429
MEDTPPSLSCSDCQRHFPSLPELSRHRELLHPSPNQDSEEADSIPRPYRCQQCGRGYRHPGSLVNHRRTHETGLFPCTTCGKDFSNPMALKSHMRTHAPEGRRRHRPPRPKEATPHLQGETVSTDSWGQRLGSSEGWENQTKHTEETPDCESVPDPRAASGTWEDLPTRQREGLASHPGPEDGADGWGPSTNSARAPPLPIPASSLLSNLEQYLAESVVNFTGGQEPTQSPPAEEERRYKCSQCGKTYKHAGSLTNHRQSHTLGIYPCAICFKEFSNLMALKNHSRLHAQYRPYHCPHCPRVFRLPRELLEHQQSHEGERQEPRWEEKGMPTTNGHTDESSQDQLPSAQMLNGSAELSTSGELEDSGLEEYRPFRCGDCGRTYRHAGSLINHRKSHQTGVYPCSLCSKQLFNAAALKNHVRAHHRPRQGVGENGQPSVPPAPLLLAETTHKEEEDPTTTLDHRPYKCSECGRAYRHRGSLVNHRHSHRTGEYQCSLCPRKYPNLMALRNHVRVHCKAARRSADIGAEGAPSHLKVELPPDPVEAEAAPHTDQDHVCKHEEEATDITPAADKTAAHICSICGLLFEDAESLERHGLTHGAGEKENSRTETTMSPPRAFACRDCGKSYRHSGSLINHRQTHQTGDFSCGACAKHFHTMAAMKNHLRRHSRRRSRRHRKRAGGASGGREAKLLAAESWTRELEDNEGLESPQDPSGESPHGAEGNLESDGDCLQAESEGDKCGLERDETHFQGDKESGGTGEGLERKDASLLDNLDIPGEEGGGTHFCDSLTGVDEDQKPATGQPNSSSHSANAVTGWQAGAAHTCSDCGHSFPHATGLLSHRPCHPPGIYQCSLCPKEFDSLPALRSHFQNHRPGEATSAQPFLCCLCGMIFPGRAGYRLHRRQAHSSSGMTEGSEEEGEEEGVAEAAPARSPPLQLSEAELLNQLQREVEALDSAGYGHICGCCGQTYDDLGSLERHHQSQSSGTTADKAPSPLGVAGDAMEMVVDSVLEDIVNSVSGEGGDAKSQEGAGTPLGDSLCIQGGESLLEAQPRPFRCNQCGKTYRHGGSLVNHRKIHQTGDFLCPVCSRCYPNLAAYRNHLRNHPRCKGSEPQVGPIPEAAGSSELQVGPIPEGGSNKPQHMAEEGPGQAEVEKLQEELKVEPLEEVARVKEEVWEETTVKGEEIEPRLETAEKGCQTEASSERPFSCEVCGRSYKHAGSLINHRQSHQTGHFGCQACSKGFSNLMSLKNHRRIHADPRRFRCSECGKAFRLRKQLASHQRVHMERRGGGGTRKATREDRPFRCGQCGRTYRHAGSLLNHRRSHETGQYSCPTCPKTYSNRMALKDHQRLHSENRRRRAGRSRRTAVRCALCGRSFPGRGSLERHLREHEETEREPANGQGGLDGTAASEANLTGSQGLETQLGGAEPVPHLEDGVPRPGERSQSPIRAASSEAPEPLSWGAGKAGGWPVGGGLGNHSGGWVPQFLTRSEEPEDSVHRSPCHAGDCQLNGPTLSHMDSWDNRDNSSQLQPGSHSSCSQCGKTYCQSGSLLNHNTNKTDRHYCLLCSKEFLNPVATKSHSHNHIDAQTFACPDCGKAFESHQELASHLQAHARGHSQVPAQMEEARDPKAGTGEDQVVLPGQGKAQEAPSETPRGPGESVERARGGQAVTSMAAEDKERPFRCTQCGRSYRHAGSLLNHQKAHTTGLYPCSLCPKLLPNLLSLKNHSRTHTDPKRHCCSICGKAFRTAARLEGHGRVHAPREGPFTCPHCPRHFRRRISFVQHQQQHQEEWTVAGSGRGHEGSQEEVGTQWRGKSSPKVGGGARSERREPRGF

SEQ ID NO: 100876 - protein, 240 aa, Homo sapiens
  Payload ID: 20094
  Gene Name: zinc finger protein 646
  ENSP ID: ENSP00000391271
MEDTPPSLSCSDCQRHFPSLPELSRHRELLHPSPNQDSEEADSIPRPYRCQQCGRGYRHPGSLVNHRRTHETGLFPCTTCGKDFSNPMALKSHMRTHAPEGRRRHRPPRPKEATPHLQGETVSTDSWGQRLGSSEGWENQTKHTEETPDCESVPDPRAASGTWEDLPTRQREGLASHPGPEDGADGWGPSTNSARAPPLPIPASSLLSNLEQYLAESVVNFTGGQEPTQSPPAEEERRYK

SEQ ID NO: 100877 - protein, 54 aa, Homo sapiens
  Payload ID: 20094
  Gene Name: zinc finger protein 646
  ENSP ID: ENSP00000456651
MEDTPPSLSCSDCQRHFPSLPELSRHRELLHPSPNQDSEEADSIPRPYRCQQCG

SEQ ID NO: 100878 - protein, 568 aa, Homo sapiens
  Payload ID: 20095
  Gene Name: zinc finger protein 648
  Uniprot ID: Q5T619
  ENSP ID: ENSP00000344129
MAQVDSQDRWGEASPLSSLTEEAHDTQMLSMNLESDDEDGGEAEKEGTADPVACPRGSSPVTHENPDLPWPHPLGKEEEKFSDSSSAGGMGQKPVEMSGKASWSRDVTKINETQGSPGASRALGSLPSGLAHKLLGQMQPLGDRLPAGDDGYSGANQDAVLDVPPSFPSNGKYLCAHKSVDTSAGNSSLLCFPRPGSNWDLPTQETHTPAQASATPASLAAAVLAKARNSRKVQNQAGRREGGEAEARPYRCLRGGRAFQKPSKPLSPAETRGGAAKRYACELCGKAYSHRGTLQQHRRLHTGERPYQCSFCDKAYTWSSDHRKHIRTHTGEKPYPCPDCGKAFVRSSDLRKHQRNMHSNNKPFPCSECGLTFNKPLSLLRHQRTHLGAKPFRCPACDREFAVASRMVEHQRVHSGERPFPCPTCGKCFTKSSNLSEHQTLHTGQRPFKCADCGVAFAQPSRLVRHQRIHTGERPFPCTQCGQAFARSSTLKRHQQIHSGEKGFLCAECGRAFRIASELAQHIRMHNGERPYQCEDCGQAFTRSNHLQRHRAKHGTCKKEPIPSSSDE

SEQ ID NO: 100879 - protein, 505 aa, Homo sapiens
  Payload ID: 20096
  Gene Name: zinc finger protein 649
  Uniprot ID: Q9BS31
  ENSP ID: ENSP00000347043
MTKAQESLTLEDVAVDFTWEEWQFLSPAQKDLYRDVMLENYSNLVSVGYQAGKPDALTKLEQGEPLWTLEDEIHSPAHPEIEKADDHLQQPLQNQKILKRTGQRYEHGRTLKSYLGLTNQSRRYNRKEPAEFNGDGAFLHDNHEQMPTEIEFPESRKPISTKSQFLKHQQTHNIEKAHECTDCGKAFLKKSQLTEHKRIHTGKKPHVCSLCGKAFYKKYRLTEHERAHRGEKPHGCSLCGKAFYKRYRLTEHERAHKGEKPYGCSECGKAFPRKSELTEHQRIHTGIKPHQCSECGRAFSRKSLLVVHQRTHTGEKPHTCSECGKGFIQKGNLNIHQRTHTGEKPYGCIDCGKAFSQKSCLVAHQRYHTGKTPFVCPECGQPCSQKSGLIRHQKIHSGEKPYKCSDCGKAFLTKTMLIVHHRTHTGERPYGCDECEKAYFYMSCLVKHKRIHSREKRGDSVKVENPSTASHSLSPSEHVQGKSPVNMVTVAMVAGQCEFAHILHS

SEQ ID NO: 100880 - protein, 477 aa, Homo sapiens
  Payload ID: 20096
  Gene Name: zinc finger protein 649
  ENSP ID: ENSP00000468983
MTKAQESLTLEDVAVDFTWEEWQFLSPAQKDLYRDVMLENYSNLVSVGYQAGKPDALTKLEQGEPLWTLEDEIHSPAHPEIEKADDHLQQPLQNQKILKRTGQRYEHGRTLKSYLGLTNQSRRYNRKEPAEFNGDGAFLHDNHEQMPTEIEFPESRKPISTKSQFLKHQQTHNIEKAHECTDCGKAFLKKSQLTEHKRIHTGKKPHVCSLCGKAFYKKYRLTEHERAHKGEKPYGCSECGKAFPRKSELTEHQRIHTGIKPHQCSECGRAFSRKSLLVVHQRTHTGEKPHTCSECGKGFIQKGNLNIHQRTHTGEKPYGCIDCGKAFSQKSCLVAHQRYHTGKTPFVCPECGQPCSQKSGLIRHQKIHSGEKPYKCSDCGKAFLTKTMLIVHHRTHTGERPYGCDECEKAYFYMSCLVKHKRIHSREKRGDSVKVENPSTASHSLSPSEHVQGKSPVNMVTVAMVAGQCEFAHILHS

SEQ ID NO: 100881 - protein, 41 aa, Homo sapiens
  Payload ID: 20096
  Gene Name: zinc finger protein 649
  ENSP ID: ENSP00000469690
MESLTLEDVAVDFTWEEWQFLSPAQKDLYRDVMLENYSNLV

SEQ ID NO: 100882 - protein, 47 aa, Homo sapiens
  Payload ID: 20096
  Gene Name: zinc finger protein 649
  ENSP ID: ENSP00000471098
MTKAQESLTLEDVAVDFTWEEWQFLSPAQKDLYRDVMLENYSNLVSV

SEQ ID NO: 100883 - protein, 43 aa, Homo sapiens
  Payload ID: 20096
  Gene Name: zinc finger protein 649
  ENSP ID: ENSP00000471756
MESLTLEDVAVDFTWEEWQFLSPAQKDLYRDVMLENYSNLVSV

SEQ ID NO: 100884 - protein, 606 aa, Homo sapiens
  Payload ID: 20097
  Gene Name: zinc finger protein 652
  Uniprot ID: Q9Y2D9
  ENSP ID: ENSP00000354686
MSHTASSCQELVENCAVHVAGMAQEDSRRGQVPSSFYHGANQELDLSTKVYKRESGSPYSVLVDTKMSKPHLHETEEQPYFRETRAVSDVHAVKEDRENSDDTEEEEEEVSYKREQIIVEVNLNNQTLNVSKGEKGVSSQSKETPVLKTSSEEEEEESEEEATDDSNDYGENEKQKKKEKIVEKVSVTQRRTRRAASVAAATTSPTPRTTRGRRKSVEPPKRKKRATKEPKAPVQKAKCEEKETLTCEKCPRVFNTRWYLEKHMNVTHRRMQICDKCGKKFVLESELSLHQQTDCEKNIQCVSCNKSFKKLWSLHEHIKIVHGYAEKKFSCEICEKKFYTMAHVRKHMVAHTKDMPFTCETCGKSFKRSMSLKVHSLQHSGEKPFRCENCDERFQYKYQLRSHMSIHIGHKQFMCQWCGKDFNMKQYFDEHMKTHTGEKPFICEICGKSFTSRPNMKRHRRTHTGEKPYPCDVCGQRFRFSNMLKAHKEKCFRVTSPVNVPPAVQIPLTTSPATPVPSVVNTATTPTPPINMNPVSTLPPRPIPHPFSHLHIHPHPHHPHHLPIPPVPHLPPPPALFKSEPLNHRGQSEDNFLRHLAEKNSSAQHH

SEQ ID NO: 100885 - protein, 606 aa, Homo sapiens; identical to SEQ ID NO: 100884
  Payload ID: 20097
  Gene Name: zinc finger protein 652
  Uniprot ID: Q9Y2D9
  ENSP ID: ENSP00000416305

SEQ ID NO: 100886 - protein, 426 aa, Homo sapiens
  Payload ID: 20097
  Gene Name: zinc finger protein 652
  ENSP ID: ENSP00000424848
MSHTASSCQELVENCAVHVAGMAQEDSRRGQVPSSFYHGANQELDLSTKVYKRESGSPYSVLVDTKMSKPHLHETEEQPYFRETRAVSDVHAVKEDRENSDDTEEEEEEVSYKREQIIVECVSCNKSFKKLWSLHEHIKIVHGYAEKKFSCEICEKKFYTMAHVRKHMVAHTKDMPFTCETCGKSFKRSMSLKVHSLQHSGEKPFRCENCDERFQYKYQLRSHMSIHIGHKQFMCQWCGKDFNMKQYFDEHMKTHTGEKPFICEICGKSFTSRPNMKRHRRTHTGEKPYPCDVCGQRFRFSNMLKAHKEKCFRVTSPVNVPPAVQIPLTTSPATPVPSVVNTATTPTPPINMNPVSTLPPRPIPHPFSHLHIHPHPHHPHHLPIPPVPHLPPPPALFKSEPLNHRGQSEDNFLRHLAEKNSSAQHH

SEQ ID NO: 100887 - protein, 615 aa, Homo sapiens
  Payload ID: 20098
  Gene Name: zinc finger protein 653
  Uniprot ID: Q96CK0
  ENSP ID: ENSP00000293771
MAERALEPEAEAEAEAGAGGEAAAEEGAAGRKARGRPRLTESDRARRRLESRKKYDVRRVYLGEAHGPWVDLRRRSGWSDAKLAAYLISLERGQRSGRHGKPWEQVPKKPKRKKRRRRNVNCLKNVVIWYEDHKHRCPYEPHLAELDPTFGLYTTAVWQCEAGHRYFQDLHSPLKPLSDSDPDSDKVGNGLVAGSSDSSSSGSASDSEESPEGQPVKAAAAAAAATPTSPVGSSGLITQEGVHIPFDVHHVESLAEQGTPLCSNPAGNGPEALETVVCVPVPVQVGAGPSALFENVPQEALGEVVASCPMPGMVPGSQVIIIAGPGYDALTAEGIHLNMAAGSGVPGSGLGEEVPCAMMEGVAAYTQTEPEGSQPSTMDATAVAGIETKKEKEDLCLLKKEEKEEPVAPELATTVPESAEPEAEADGEELDGSDMSAIIYEIPKEPEKRRRSKRSRVMDADGLLEMFHCPYEGCSQVYVALSSFQNHVNLVHRKGKTKVCPHPGCGKKFYLSNHLRRHMIIHSGVREFTCETCGKSFKRKNHLEVHRRTHTGETPLQCEICGYQCRQRASLNWHMKKHTAEVQYNFTCDRCGKRFEKLDSVKFHTLKSHPDHKPT

SEQ ID NO: 100888 - protein, 217 aa, Homo sapiens
  Payload ID: 20098
  Gene Name: zinc finger protein 653
  ENSP ID: ENSP00000465166
  MOD_RES (1)..(1): Any amino acid
XEMFHCPYEGCSQVYVALSSFQNHVNLVHRKGKTKVCPHPGCGKKFYLSNHLRRHMIIHSGVREFTCETCGKSFKRKNHLEVRDLWLPVPAARVAQLAHEEAHCGGAVQLHVRSLREALREAGQRQVPHAQKPPGSQAHLTHLTTDRPYLFVRSDTTPGLAGAWTAARAARTAGRKEAPPPRPRAGPPGQVPHPAPPHPSRSWCLGLHCWNCVKRAE

SEQ ID NO: 100889 - protein, 34 aa, Homo sapiens
  Payload ID: 20098
  Gene Name: zinc finger protein 653
  ENSP ID: ENSP00000465674
  MOD_RES (1)..(1): Any amino acid
XGRHGRRLRLRGDKTCLRSHRQLRAELSLELGSG

SEQ ID NO: 100890 - protein, 72 aa, Homo sapiens
  Payload ID: 20098
  Gene Name: zinc finger protein 653
  ENSP ID: ENSP00000465955
  MOD_RES (1)..(1): Any amino acid
XMFHCPYEGCSQVYVALSSFQVSVNSPARPAASPSRGRTTWRYIGAPTPARPPCSARSVATSAGSARRSTGT

SEQ ID NO: 100891 - protein, 169 aa, Homo sapiens
  Payload ID: 20098
  Gene Name: zinc finger protein 653
  ENSP ID: ENSP00000467069
  MOD_RES (1)..(1): Any amino acid
XKEKEDLCLLKKEEKEEPVAPELATTVPESAEPEAEADGEELDGSDMSAIIYEIPKEPEKRRRSKRSRVMDADGLLEMFHCPYEGCSQVYVALSSFQNHVNLVHRKGKTKVCPHPGCGKKFYLSNHLRRHMIIHSGVREFTCETCGKSFKRKNHLEVHRRTHTGETPLQ

SEQ ID NO: 100892 - protein, 581 aa, Homo sapiens
  Payload ID: 20099
  Gene Name: zinc finger protein 654
  Uniprot ID: Q8IZM8
  ENSP ID: ENSP00000312141
MLCNKEFLGGHIVRHAQAHQKKGSFACVICGRKFRNRGLMQKHLKNHVKKIQRQQIAAAQQDDQEVTALEEINCSSSSISFENGNSDSKDLEVETLTASSEGNKEVIPEHVAEFIEIPISVPEDVIENVIENGSPNNSLNNVFKPLTECGDDYEEEEDEEGDYEEDDYDLNQETSVIHKINGTVCHPKDIYATDQEGNFKCPALGCVRIFKRIGFLNKHAMTVHPTDLNVRQTVMKWSKGKCKFCQRQFEDSQHFIDHLNRHSYPNVYFCLHFNCNESFKLPFQLAQHTKSHRIFQAQCSFPECHELFEDLPLLYEHEAQHYLSKTPESSAQPSETILWDVQTDSNPNQEKDSSSNEKQTISLPVSTSKSRKESTEPKTCIESMEKKTDSLVQNGNERSDDTVSNISLIDQKMPDIEPNSENNCSSSDIVNGHSEIEQTPLVSSDPALKIDTNRIRTENGSILPSVVPQEHNTLPVSQAPSKPNLTSEHTSYGLILTKPYVRPLPPSYLDERYLSMPKRRKFLTDRVDACSDQDNVYKKSVKRLRCGKCLTTYCNAEALEAHLAQKKCQTLFGFDSDDESA

SEQ ID NO: 100893 - protein, 491 aa, Homo sapiens
  Payload ID: 20100
  Gene Name: zinc finger protein 655
  Uniprot ID: Q8N720
  ENSP ID: ENSP00000252713
MEEIPAQEAAGSPRVQFQSLETQSECLSPEPQFVQDTDMEQGLTGDGETREENKLLIPKQKISEEVHSYKVRVGRLKHDITQVPETREVYKSEDRLERLQEILRKFLYLEREFRQITISKETFTSEKNNECHEPEKSFSLDSTIDADQRVLRIQNTDDNDKYDMSFNQNSASGKHEHLNLTEDFQSSECKESLMDLSHLNKWESIPNTEKSYKCDVCGKIFHQSSALTRHQRIHTREKPYKCKECEKSFSQSSSLSRHKRIHTREKPYKCEASDKSCEASDKSCSPSSGIIQHKKIHTRAKSYKCSSCERVFSRSVHLTQHQKIHKEMPCKCTVCGSDFCHTSYLLEHQRVHHEEKAYEYDEYGLAYIKQQGIHFREKPYTCSECGKDFRLNSHLIQHQRIHTGEKAHECNECGKAFSQTSCLIQHHKMHRKEKSYECNEYEGSFSHSSDLILQQEVLTRQKAFDCDVWEKNSSQRAHLVQHQSIHTKENS

SEQ ID NO: 100894 - protein, 181 aa, Homo sapiens
  Payload ID: 20100
  Gene Name: zinc finger protein 655
  Uniprot ID: Q8N720
  ENSP ID: ENSP00000322363
MEEIPAQEAAGSPRVQFQSLETQSECLSPEPQFVQDTDMEQGLTGAPPVPQVPALPREGSPGDQAAALLTARYQEFVTFEDVAVHLTREEWGYLDPVQRDLYREVMLENYGNVVSLGILLRLPTTRIHSVNSCPALSHTQASAFSGETLAVLTAGISKRWPKYRLPIDIARPCSETPFPRL

SEQ ID NO: 100895 - protein, 110 aa, Homo sapiens
  Payload ID: 20100
  Gene Name: zinc finger protein 655
  Uniprot ID: Q8N720
  ENSP ID: ENSP00000350530
MEEIPAQEAAGSPRVQFQSLETQSECLSPEPQFVQDTDMEQGLTGGILLRLPTTRIHSVNSCPALSHTQASAFSGETLAVLTAGISKRWPKYRLPIDIARPCSETPFPRL

SEQ ID NO: 100896 - protein, 491 aa, Homo sapiens; identical to SEQ ID NO: 100893
  Payload ID: 20100
  Gene Name: zinc finger protein 655
  Uniprot ID: Q8N720
  ENSP ID: ENSP00000377718

SEQ ID NO: 100897 - protein, 182 aa, Homo sapiens
  Payload ID: 20100
  Gene Name: zinc finger protein 655
  ENSP ID: ENSP00000389260
MEEIPAQEAAGSPRVQFQSLETQSECLSPEPQFVQDTDMEQGLTGGFPISKPDGISQLEQDLQVFDLETKTREVLRDDCSDGETREENKLLIPKQKISEEVHSYKVRVGRLKHDITQVPETREVYKSEDRLERLQEILRKFLYLEREFRQITISKETFTSEKNNECHEPEKSFSLDSTIDAD

SEQ ID NO: 100898 - protein, 50 aa, Homo sapiens
  Payload ID: 20100
  Gene Name: zinc finger protein 655
  ENSP ID: ENSP00000390295
MEEIPAQEAAGSPRVQFQSLETQSECLSPEPQFVQDTDMEQGLTGVGSWD

SEQ ID NO: 100899 - protein, 112 aa, Homo sapiens
  Payload ID: 20100
  Gene Name: zinc finger protein 655
  ENSP ID: ENSP00000392244
MEEIPAQEAAGSPRVQFQSLETQSECLSPEPQFVQDTDMEQGLTGGFPISKPDGISQLEQDLQVFDLETKTREVLRDDCSDGETREENKLLIPKQKISEEVHSYKVRVGRLK

SEQ ID NO: 100900 - protein, 103 aa, Homo sapiens
  Payload ID: 20100
  Gene Name: zinc finger protein 655
  ENSP ID: ENSP00000392980
MEEIPAQEAAGSPRVQFQSLETQSECLSPEPQFVQDTDMEQGLTGAPPVPQVPALPREGSPGDQAAALLTARYQDFQFPSLMGSPSWNRIYRSLIWKLRLEKS

SEQ ID NO: 100901 - protein, 109 aa, Homo sapiens
  Payload ID: 20100
  Gene Name: zinc finger protein 655
  ENSP ID: ENSP00000393750
MEEIPAQEAAGSPRVQFQSLETQSECLSPEPQFVQDTDMEQGLTGGFPISKPDGISQLEQDLQVFDLETKTREVLRDDCSDGETREENKLLIPKQKISEEVHSYKVRVG

SEQ ID NO: 100902 - protein, 526 aa, Homo sapiens
  Payload ID: 20100
  Gene Name: zinc finger protein 655
  Uniprot ID: Q8N720
  ENSP ID: ENSP00000393876
MEEIPAQEAAGSPRVQFQSLETQSECLSPEPQFVQDTDMEQGLTGGFPISKPDGISQLEQDLQVFDLETKTREVLRDDCSDGETREENKLLIPKQKISEEVHSYKVRVGRLKHDITQVPETREVYKSEDRLERLQEILRKFLYLEREFRQITISKETFTSEKNNECHEPEKSFSLDSTIDADQRVLRIQNTDDNDKYDMSFNQNSASGKHEHLNLTEDFQSSECKESLMDLSHLNKWESIPNTEKSYKCDVCGKIFHQSSALTRHQRIHTREKPYKCKECEKSFSQSSSLSRHKRIHTREKPYKCEASDKSCEASDKSCSPSSGIIQHKKIHTRAKSYKCSSCERVFSRSVHLTQHQKIHKEMPCKCTVCGSDFCHTSYLLEHQRVHHEEKAYEYDEYGLAYIKQQGIHFREKPYTCSECGKDFRLNSHLIQHQRIHTGEKAHECNECGKAFSQTSCLIQHHKMHRKEKSYECNEYEGSFSHSSDLILQQEVLTRQKAFDCDVWEKNSSQRAHLVQHQSIHTKENS

SEQ ID NO: 100903 - protein, 131 aa, Homo sapiens
  Payload ID: 20100
  Gene Name: zinc finger protein 655
  ENSP ID: ENSP00000395799
MEEIPAQEAAGSPRVQFQSLETQSECLSPEPQFVQDTDMEQGLTGAPPVPQVPALPREGSPGDQAAALLTARYQSSQDVLFQEFVTFEDVAVHLTREEWGYLDPVQRDLYREVMLENYGNVVSLGTVGSWD

SEQ ID NO: 100904 - protein, 110 aa, Homo sapiens; identical to SEQ ID NO: 100895
  Payload ID: 20100
  Gene Name: zinc finger protein 655
  Uniprot ID: Q8N720
  ENSP ID: ENSP00000396396

SEQ ID NO: 100905 - protein, 99 aa, Homo sapiens
  Payload ID: 20100
  Gene Name: zinc finger protein 655
  ENSP ID: ENSP00000398872
MEEIPAQEAAGSPRVQFQSLETQSECLSPEPQFVQDTDMEQGLTGGILLRLPTTRIHSVNSCPALSHTQASAFSGETLAVLTAGISKRWPKYRLPIDIA

SEQ ID NO: 100906 - protein, 103 aa, Homo sapiens; identical to SEQ ID NO: 100900
  Payload ID: 20100
  Gene Name: zinc finger protein 655
  ENSP ID: ENSP00000403500

SEQ ID NO: 100907 - protein, 46 aa, Homo sapiens
  Payload ID: 20100
  Gene Name: zinc finger protein 655
  ENSP ID: ENSP00000408555
MEEIPAQEAAGSPRVQFQSLETQSECLSPEPQFVQDTDMEQGLTGG

SEQ ID NO: 100908 - protein, 123 aa, Homo sapiens
  Payload ID: 20100
  Gene Name: zinc finger protein 655
  ENSP ID: ENSP00000414007
MEEIPAQEAAGSPRVQFQSLETQSECLSPEPQFVQDTDMEQGLTGAPPVPQVPALPREGSPGDQAAALLTARYQEFVTFEDVAVHLTREEWGYLDPVQRDLYREVMLENYGNVVSLGTVGSWD

SEQ ID NO: 100909 - protein, 129 aa, Homo sapiens
  Payload ID: 20100
  Gene Name: zinc finger protein 655
  ENSP ID: ENSP00000414969
MEEIPAQEAAGSPRVQFQSLETQSECLSPEPQFVQDTDMEQGLTGAPPVPQVPALPREGSPGDQAAALLTARYQPGCVISGVCDIRGCGCAPYSRGMGIPGPCSEGPLQRSDVRELWERGLTGISNFQA

SEQ ID NO: 100910 - protein, 526 aa, Homo sapiens; identical to SEQ ID NO: 100902
  Payload ID: 20100
  Gene Name: zinc finger protein 655
  Uniprot ID: Q8N720
  ENSP ID: ENSP00000419135

SEQ ID NO: 100911 - protein, 103 aa, Homo sapiens; identical to SEQ ID NO: 100900
  Payload ID: 20100
  Gene Name: zinc finger protein 655
  ENSP ID: ENSP00000486262

SEQ ID NO: 100912 - protein, 597 aa, Homo sapiens
  Payload ID: 20101
  Gene Name: zinc finger protein 658
  ENSP ID: ENSP00000479295
MNMSQASVSFQDVTVEFTREEWQHLGPVERTLYRDVMLENYSHLISVGYCITKPKVISKLEKGEEPWSLEDEFLNQRYPGYFKVDHIKGIREKQEKPLWQEIFISDADKTLSKEGQKVLEKPFNLEIAPELSEKISCKCDSHRMNLPVASQLIISERKYSRKKTEYMNVCEKLQLDIKHEKAHAEEKSYEHGENAKAFSYKKDQHWKFQTLEESFECDGSGQGLYDKTICITPQSFLTGEKSCKDDEFRKNFDKITLFNHMRTDTRGKCSDLNEYGTSCDKTTAVEYNKVHMAMTHYECNERGINFSRKSPLTQSQRTITGWSAFESNKCEENFSQSSAHIVHQKTQAGDKFGEHNECTDALYQKLDFTAHQRIHTEDKFYLSDEHGKCRKSFYRKAHLIQHQRPHSGEKTYQYEECAKSFCSSSHPIQHPGTYVGFKLYECNECGKAFCQNSNLSKHLRIHTKEKPCDNNGCGRSYKSPLIGHQKTDAEMELCGGSEYGKTSHLKGHQRILMGEKPYECIECGKTFSKTSHLRAHQRIHTGEKPYECVECEKTFSHKTHLSVHQRVHTGEKPYECNDCGKSFTYNSALRAHQRIHT

SEQ ID NO: 100913 - protein, 617 aa, Homo sapiens
  Payload ID: 20101
  Gene Name: zinc finger protein 658
  Uniprot ID: Q5TYW1
  ENSP ID: ENSP00000480919
MNMSQASVSFQDVTVEFTREEWQHLGPVERTLYRDVMLENYSHLISVGYCITKPKVISKLEKGEEPWSLEDEFLNQRYPGYFKVDHIKGIREKQEKPLWQEIFISDADKTLSKEGQKVLEKPFNLEIAPELSEKISCKCDSHRMNLPVASQLIISERKYSRKKTEYMNVCEKLQLDIKHEKAHAEEKSYEHGENAKAFSYKKDQHWKFQTLEESFECDGSGQGLYDKTICITPQSFLTGEKSCKDDEFRKNFDKITLFNHMRTDTRGKCSDLNEYGTSCDKTTAVEYNKVHMAMTHYECNERGINFSRKSPLTQSQRTITGWSAFESNKCEENFSQSSAHIVHQKTQAGDKFGEHNECTDALYQKLDFTAHQRIHTEDKFYLSDEHGKCRKSFYRKAHLIQHQRPHSGEKTYQYEECAKSFCSSSHPIQHPGTYVGFKLYECNECGKAFCQNSNLSKHLRIHTKEKPCDNNGCGRSYKSPLIGHQKTDAEMELCGGSEYGKTSHLKGHQRILMGEKPYECIECGKTFSKTSHLRAHQRIHTGEKPYECVECEKTFSHKTHLSVHQRVHTGEKPYECNDCGKSFTYNSALRAHQRIHTGLAVCHVGILMATKSLFHQS

SEQ ID NO: 100914 - protein, 97 aa, Homo sapiens
  Payload ID: 20101
  Gene Name: zinc finger protein 658
  ENSP ID: ENSP00000482328
MNMSQASVSFQDVTVEFTREEWQHLGPVERTLYRDVMLENYSHLISVGYCITKPKVISKLEKGEEPWSLEDEFLNQRYPGYFKVDHIKGIREKQEKP

SEQ ID NO: 100915 - protein, 1059 aa, Homo sapiens
  Payload ID: 20101
  Gene Name: zinc finger protein 658
  Uniprot ID: Q5TYW1
  ENSP ID: ENSP00000482447
MNMSQASVSFQDVTVEFTREEWQHLGPVERTLYRDVMLENYSHLISVGYCITKPKVISKLEKGEEPWSLEDEFLNQRYPGYFKVDHIKGIREKQEKPLWQEIFISDADKTLSKEGQKVLEKPFNLEIAPELSEKISCKCDSHRMNLPVASQLIISERKYSRKKTEYMNVCEKLQLDIKHEKAHAEEKSYEHGENAKAFSYKKDQHWKFQTLEESFECDGSGQGLYDKTICITPQSFLTGEKSCKDDEFRKNFDKITLFNHMRTDTRGKCSDLNEYGTSCDKTTAVEYNKVHMAMTHYECNERGINFSRKSPLTQSQRTITGWSAFESNKCEENFSQSSAHIVHQKTQAGDKFGEHNECTDALYQKLDFTAHQRIHTEDKFYLSDEHGKCRKSFYRKAHLIQHQRPHSGEKTYQYEECAKSFCSSSHPIQHPGTYVGFKLYECNECGKAFCQNSNLSKHLRIHTKEKPCDNNGCGRSYKSPLIGHQKTDAEMELCGGSEYGKTSHLKGHQRILMGEKPYECIECGKTFSKTSHLRAHQRIHTGEKPYECVECEKTFSHKTHLSVHQRVHTGEKPYECNDCGKSFTYNSALRAHQRIHTGEKPYECSDCEKTFAHNSALRAHHRIHTGEKPYECNECGRSFAHISVLKAHQRIHTGEKPYECNECGRSFTYNSALRAHQRIHTGRKPYECSDCEKTFAHNSALKIHQRIHTGEKPYECNECEKTFAHNSALRAHQNIHTGEKLYECSECGKTFFQKTRLSTHRRIHTGEKPYECSKCGKTFSQKSYLSGHERIHTGEKPYECNVCGKTFVYKAALIVHQRIHTGEKPYECNQCGKTFSQRTHLCAHQRIHTGEKPYECNECGKTFADNSALRAHHRIHTGEKPYECNDCGKTFSKTSHLRAHLRTRSGEKPYECSECGKTFSEKSYVSAHQRVHTGEKPYECNVCGKPFAHNSTLRVHQRIHTGEKSYECNDCGKTFSQKSHLSAHQRIHTGEKPYECNECGKAFAQNSTLRVHQRIHTGEKPYECDECGKTFVRKAALRVHHTRMHTREKTLACNGFGKS

SEQ ID NO: 100916 - protein, 1059 aa, Homo sapiens; identical to SEQ ID NO: 100915
  Payload ID: 20101
  Gene Name: zinc finger protein 658
  Uniprot ID: Q5TYW1
  ENSP ID: ENSP00000482540

SEQ ID NO: 100917 - protein, 79 aa, Homo sapiens
  Payload ID: 20101
  Gene Name: zinc finger protein 658
  ENSP ID: ENSP00000483395
MNMSQASVSFQDVTVEFTREEWQHLGPVERTLYRDVMLENYSHLISVGYCITKPKVISKLEKGEEPWSLEDEFLNQRYP

SEQ ID NO: 100918 - protein, 155 aa, Homo sapiens
  Payload ID: 20101
  Gene Name: zinc finger protein 658
  ENSP ID: ENSP00000483979
MLENYSHLISVGYCITKPKVISKLEKGEEPWSLEDEFLNQRYPGYFKVDHIKGIREKQEKPLWQEIFISDADKTLSKEGQKVLEKPFNLEIAPELSEKISCKCDSHRMNLPVASQLIISERKYSRKKTEYMNVCEKLQLDIKHEKAHAEEKSYEH

SEQ ID NO: 100919 - protein, 57 aa, Homo sapiens
  Payload ID: 20102
  Gene Name: zinc finger protein 66
  ENSP ID: ENSP00000459415
MAQRNLYRDVMLENYRNLVFLGIVVSKPDLITHLEQGKKPSTMQRHEMVANPSGRCE

SEQ ID NO: 100920 - protein, 573 aa, Homo sapiens
  Payload ID: 20102
  Gene Name: zinc finger protein 66
  Uniprot ID: Q6ZN08
  ENSP ID: ENSP00000461425
MGPLQFRDVAIEFSLEEWHCLDMAQRNLYRDVMLENYRNLVFLGIVVSKPDLITHLEQGKKPSTMQRHEMVANPSVLCSHFNQDLWPEQSIKDSFQKLILRRHKKCGHDNLQLKKGCESVDKCKVHKRGYNGLNQCLTTTQSKMFQCDKHGKVFHQFSNTNRHKIRHTGKNPCKFTECGKAFNRSSTFTTHKKIHTGEKPYKCIECGKAFNRSSHLTTHKIIHTGEKRYKCEDCGKAFNRSSNLTTHKKIHTGEKPYKCEECGKAFKRSSILTTHKRIHTGEKPYKCEECGKVFKYLSSLSTHKIIHTGEKPYKCEECGKAFNWSSHLTTHKRIHTGEKPYKCEECGKGFKYSSTLTKHKIIHTGEKPYKCEECGEAFKYSCSLTAHKIIHTGKKPYKCEECGKVFKHSSPLSKHKRIHTGEKPYKCEECGKAFSRSSILTTHKIIHTGEKPYECEDCGKAFNRSSNLTKHKKIHTGEKPYKCEECGKAFKCSSILTTHKRIHTADKPYKCEECGKDFKYSSTLTRHKKIHTGGKPHKCNKCGKAFISSSNLSRHEIIHMGGNPYKCENVAKP

SEQ ID NO: 100921 - protein, 205 aa, Homo sapiens
  Payload ID: 20102
  Gene Name: zinc finger protein 66
  ENSP ID: ENSP00000469543
MGPLQFRDVAIEFSLEEWHCLDMAQRNLYRDVMLENYRNLVFLGIVVSKPDLITHLEQGKKPSTMQRHEMVANPSGPVLHILFFCCCFLSFFLFLSFFFFFLRWNLALLPRLKCSGAISAHCKLCLLGSSDSPTSASQVAGITGARHIAKVIFVFLVEMVFHHVGQARLKLLTSGYLPTSTSQSARITGLSYCTWPVLHILDIDL

SEQ ID NO: 100922 - protein, 601 aa, Homo sapiens
  Payload ID: 20102
  Gene Name: zinc finger protein 66
  ENSP ID: ENSP00000479221
MGPLQFRDVAIEFSLEEWHCLDMAQRNLYRDVMLENYRNLVFLGIVVSKPDLITHLEQGKKPSTMQRHEMVANPSVLCSHFNQDLWPEQSIKDSFQKLILRRHKKCGHDNLQLKKGCESVDKCKVHKRGYNGLNQCLTTTQSKMFQCDKHGKVFHQFSNTNRHKIRHTGKNPFKFTECGKAFNRSSTLTTHKKIHTGEKPYKCIECGKAFNRSSHLTTHKIIHTGEKRYKCEDCGKAFNRSSNLTTHKKIHTGEKPYKCEECGKAFKRSSILTTHKRIHTGEKPYKCEECGKVFKYLSSLSTHKIIHTGEKPYKCEECGKAFNWSSHLTTHKRIHTGEKPYKCEECGKGFKYSSTLTKHKIIHTGEKPYKCEECGEAFKYSCSLTAHKIIHTGKKPYKCEECGKVFKHSSPLSKHKRIHAGEKPYKCEECGKAFSRSSILTTHKIIHTGEKPYECEDCGKAFNRSSNLTKHKKIHTGEKPYKCEECGKAFKCSSILTTHKRIHTADKPYKCEECGKDFKYSSTLTRHKRIHTGEKPYKCEECGKAFNHPATLFSHKKIHTGGKPHKCNKCGKAFISSSNLSRHEIIHMGGNPYKCENVAKP

SEQ ID NO: 100923 - protein, 57 aa, Homo sapiens; identical to SEQ ID NO: 100919
  Payload ID: 20102
  Gene Name: zinc finger protein 66
  ENSP ID: ENSP00000482322

SEQ ID NO: 100924 - protein, 107 aa, Homo sapiens
  Payload ID: 20102
  Gene Name: zinc finger protein 66
  ENSP ID: ENSP00000485153
MGPLQFRDVAIEFSLEEWHCLDMAQRNLYRDVMLENYRNLVFLGIVVSKPDLITHLEQGKKPSTMQRHEMVANPSGPVLHILFFCCCFLSFFLSFSFSFFFFFFFFF

SEQ ID NO: 100925 - protein, 331 aa, Homo sapiens
  Payload ID: 20103
  Gene Name: zinc finger protein 660
  Uniprot ID: Q6AZW8
  ENSP ID: ENSP00000324605
MRRKTRNFKHKTVKDNKVLTEGSDQESEKDNSQCCDPATNERVQAEKRQYVCTECGKAFSQSANLTVHERIHTGEKPYKCKECGKAFSHSSNLVVHRRIHTGLKPYTCSECGKSFSGKSHLIRHQGIHSGEKTYECKECGKAFSRSSGLISHHRVHTGEKPYSCIECGKAFSRSSNLTQHQRMHRGKKVYKCKECGKTCGSNTKIMDHQRIHTGEKPYECDECGKTFILRKTLNEHQRLHRREKPYKCNECGKAFTSNRNLVDHQRVHTGEKPYKCNECGKTFRQTSQVILHLRTHTKEKPYKCSECGKAYRYSSQLIQHQRKHNEEKETS

SEQ ID NO: 100926 - protein, 39 aa, Homo sapiens
  Payload ID: 20103
  Gene Name: zinc finger protein 660
  ENSP ID: ENSP00000405284
MRRKTRNFKHKTVKDNKVLTEGSDQESEKDNSQCCDPAT

SEQ ID NO: 100927 - protein, 34 aa, Homo sapiens
  Payload ID: 20103
  Gene Name: zinc finger protein 660
  ENSP ID: ENSP00000411996
MRRKTRNFKHKTVKDNKVLTEGSDQESEKDNSQC

SEQ ID NO: 100928 - protein, 39 aa, Homo sapiens; identical to SEQ ID NO: 100926
  Payload ID: 20103
  Gene Name: zinc finger protein 660
  ENSP ID: ENSP00000485799

SEQ ID NO: 100929 - protein, 34 aa, Homo sapiens; identical to SEQ ID NO: 100927
  Payload ID: 20103
  Gene Name: zinc finger protein 660
  ENSP ID: ENSP00000486280

SEQ ID NO: 100930 - protein, 331 aa, Homo sapiens; identical to SEQ ID NO: 100925
  Payload ID: 20103
  Gene Name: zinc finger protein 660
  Uniprot ID: Q6AZW8
  ENSP ID: ENSP00000487319

SEQ ID NO: 100931 - protein, 452 aa, Homo sapiens
  Payload ID: 20104
  Gene Name: zinc finger protein 662
  Uniprot ID: Q6ZS27
  ENSP ID: ENSP00000329264
MAAVALASGTRLGLVLELLPGQPALPRARRESVTFEDVAVYFSENEWIGLGPAQRALYRDVMLENYGAVASLAFPFPKPALISQLERGETPWCSVPRGALDGEAPRGISSEGVLKRKKEDFILKEEIIEEAQDLMVLSSGPQWCGSQELWFGKTCEEKSRLGRWPGYLNGGRMESSTNDIIEVIVKDEMISVEESSGNTDVNNLLGIHHKILNEQIFYICEECGKCFDQNEDFDQHQKTHNGEKVYGCKECGKAFSFRSHCIAHQRIHSGVKPYECQECAKAFVWKSNLIRHQRIHTGEKPFECKECGKGFSQNTSLTQHQRIHTGEKPYTCKECGKSFTRNPALLRHQRMHTGEKPYECKDCGKGFMWNSDLSQHQRVHTGDKPHECTDCGKSFFCKAHLIRHQRIHTGERPYKCNDCGKAFSQNSVLIKHQRRHARDKPYNCQISHLLEH

SEQ ID NO: 100932 - protein, 426 aa, Homo sapiens
  Payload ID: 20104
  Gene Name: zinc finger protein 662
  Uniprot ID: Q6ZS27
  ENSP ID: ENSP00000405047
MLENYGAVASLAAFPFPKPALISQLERGETPWCSVPRGALDGEAPRGISSGYPFLKPAGISHPEQVEEPLNLKLQGEGPSLICPEGVLKRKKEDFILKEEIIEEAQDLMVLSSGPQWCGSQELWFGKTCEEKSRLGRWPGYLNGGRMESSTNDIIEVIVKDEMISVEESSGNTDVNNLLGIHHKILNEQIFYICEECGKCFDQNEDFDQHQKTHNGEKVYGCKECGKAFSFRSHCIAHQRIHSGVKPYECQECAKAFVWKSNLIRHQRIHTGEKPFECKECGKGFSQNTSLTQHQRIHTGEKPYTCKECGKSFTRNPALLRHQRMHTGEKPYECKDCGKGFMWNSDLSQHQRVHTGDKPHECTDCGKSFFCKAHLIRHQRIHTGERPYKCNDCGKAFSQNSVLIKHQRRHARDKPYNCQISHLLEH

SEQ ID NO: 100933 - protein, 106 aa, Homo sapiens
  Payload ID: 20104
  Gene Name: zinc finger protein 662
  ENSP ID: ENSP00000408945
MLENYGAVASLAAFPFPKPALISQLERGETPWCSVPRGALDGEAPRGISSGEILKLPGATIWSLRIKPIPKKTVTKQRETRSLVTSFEPLDQALPEAELPQNFSAM

SEQ ID NO: 100934 - protein, 261 aa, Homo sapiens
  Payload ID: 20105
  Gene Name: zinc finger protein 664
  Uniprot ID: Q8N3J9
  ENSP ID: ENSP00000337320
MIYKCPMCREFFSERADLFMHQKIHTAEKPHKCDKCDKGFFHISELHIHWRDHTGEKVYKCDDCGKDFSTTTKLNRHKKIHTVEKPYKCYECGKAFNWSSHLQIHMRVHTGEKPYVCSECGRGFSNSSNLCMHQRVHTGEKPFKCEECGKAFRHTSSLCMHQRVHTGEKPYKCYECGKAFSQSSSLCIHQRVHTGEKPYRCCGCGKAFSQSSSLCIHQRVHTGEKPFKCDECGKAFSQSTSLCIHQRVHTKERNHLKISVI

SEQ ID NO: 100935 - protein, 261 aa, Homo sapiens; identical to SEQ ID NO: 100934
  Payload ID: 20105
  Gene Name: zinc finger protein 664
  Uniprot ID: Q8N3J9
  ENSP ID: ENSP00000376205

SEQ ID NO: 100936 - protein, 261 aa, Homo sapiens; identical to SEQ ID NO: 100934
  Payload ID: 20105
  Gene Name: zinc finger protein 664
  Uniprot ID: Q8N3J9
  ENSP ID: ENSP00000440645

SEQ ID NO: 100937 - protein, 261 aa, Homo sapiens; identical to SEQ ID NO: 100934
  Payload ID: 20105
  Gene Name: zinc finger protein 664
  Uniprot ID: Q8N3J9
  ENSP ID: ENSP00000441405

SEQ ID NO: 100938 - protein, 678 aa, Homo sapiens
  Payload ID: 20106
  Gene Name: zinc finger protein 665
  Uniprot ID: Q9H7R5
  ENSP ID: ENSP00000379702
MALPQGQLTFKDVAIEFSQEEWTCLDPAQKTLYRDVMLENYRNLVSLDISCKCVNTDLPPKGKNNMGEAFYTVKLERLESCDTVGLSFQEVQKNTYDFECQWKDDEGNYKTVLMLQKENLPGRRAQRDRRAAGNRHIENQLGVSFQSHLPELQQFQHEGKIYEYNQVEKSPNNRGKHYKCDECGKVFSQNSRLTSHKRIHTGEKPYQCNKCGKAFTVRSNLTIHQVIHTGEKPYKCNECGKVFSQPSNLAGHQRIHTGEKPYKCNECGKAFRAHSKLTTHQVIHTGEKPYKCKECGKCFTQNSHLASHRRIHTGEKPYKCNECGKAFSVRSSLTTHQTIHTGEKPYKCNECGKVFRHNSYLAKHRRIHTGEKPYKCNECGKAFSMHSNLTKHQIIHTGEKPFKCNECVKVFTQYSHLANHRRIHTGEKPYRCDECGKAFSVRSSLTTHQAIHTGEKPYKCNDCGKVFTQNSHLASHRGIHSGEKPYKCDECGKAFSQTSQLARHWRVHTGEKPYKCNECGKAFSVHSSLTIHQTIHTGQKPYKCNDCGKVFRHNSYLAIHQRIHTGEKPYKCNECGKAFSVHSNLATHQVIHTGEKPYKCNECGKVFTQNSHLANHRRIHTGEKPYRCNECGKAFSVRSTLTTHMAVHTGDKPYKCNQCGKVFTQNSNLAKHRRIHSG

SEQ ID NO: 100939 - protein, 613 aa, Homo sapiens
  Payload ID: 20106
  Gene Name: zinc finger protein 665
  Uniprot ID: Q9H7R5
  ENSP ID: ENSP00000469154
MGEAFYTVKLERLESCDTVGLSFQEVQKNTYDFECQWKDDEGNYKTVLMLQKENLPGRRAQRDRRAAGNRHIENQLGVSFQSHLPELQQFQHEGKIYEYNQVEKSPNNRGKHYKCDECGKVFSQNSRLTSHKRIHTGEKPYQCNKCGKAFTVRSNLTIHQVIHTGEKPYKCNECGKVFSQPSNLAGHQRIHTGEKPYKCNECGKAFRAHSKLTTHQVIHTGEKPYKCKECGKCFTQNSHLASHRRIHTGEKPYKCNECGKAFSVRSSLTTHQTIHTGEKPYKCNECGKVFRHNSYLAKHRRIHTGEKPYKCNECGKAFSMHSNLTKHQIIHTGEKPFKCNECVKVFTQYSHLANHRRIHTGEKPYRCDECGKAFSVRSSLTTHQAIHTGEKPYKCNDCGKVFTQNSHLASHRGIHSGEKPYKCDECGKAFSQTSQLARHWRVHTGEKPYKCNECGKAFSVHSSLTIHQTIHTGQKPYKCNDCGKVFRHNSYLAIHQRIHTGEKPYKCNECGKAFSVHSNLATHQVIHTGEKPYKCNECGKVFTQNSHLANHRRIHTGEKPYRCNECGKAFSVRSTLTTHMAVHTGDKPYKCNQCGKVFTQNSNLAKHRRIHSG

SEQ ID NO: 100940 - protein, 610 aa, Homo sapiens
  Payload ID: 20107
  Gene Name: zinc finger protein 667
  Uniprot ID: Q5HYK9
  ENSP ID: ENSP00000292069
MPSARGKSKSKAPITFGDLAIYFSQEEWEWLSPIQKDLYEDVMLENYRNLVSLGLSFRRPNVITLLEKGKAPWMVEPVRRRRAPDSGSKCETKKLPPNQCNKSGQSICQKLVSAQQKAPTRKSGCNKNSVLVKPKKGHSGKKPLKCNDCGKTFSRSFSLKLHQNIHTGEKPFECSNCRKAFRQISSILLHQRIHSGKKSHECNKCGESFNQRTTLILHMRIHDGKEILDCGKALSQCQSFNIHQKIHVVGNVCQCRKCGKAFNQMSSLLLHKKIHNGKKTHKYNKCGRGFKKKSVFVVHKRIHAGEKIPENAKALSQSLQQRSHHLENPFKCRKCGKLFNRISPLMLHQRIHTSEKPYKCDKCDKFFRRLSTLILHLRIHNGEKLYRCNKCEKVCNRHSSLIQHQKVHTKKKKLFECKECGKMFSGTANLKIHQNIHSEEKPFKCNKCSKVFGRQSFLIEHQRIHTGEKPYQCEECGKAFSHRISLTRHKRIHTEDRPYECDQCGKAFSQSAHLAQHERIHTGEKPYTCKTCGKAFSQRTSLILHERSHTGEKPYECNECGKAFSSGSDLIRHQRSHSSEKPYECSKCGKAYSRSSSLIRHQNTHSEEKA

SEQ ID NO: 100941 - protein, 610 aa, Homo sapiens; identical to SEQ ID NO: 100940
  Payload ID: 20107
  Gene Name: zinc finger protein 667
  Uniprot ID: Q5HYK9
  ENSP ID: ENSP00000439402

SEQ ID NO: 100942 - protein, 84 aa, Homo sapiens
  Payload ID: 20107
  Gene Name: zinc finger protein 667
  ENSP ID: ENSP00000464708
MPSARGKSKSKAPITFGDLAIYFSQEEWEWLSPIQKDLYEDVMLENYRNLVSLGLSFRRPNVITLLEKGKAPWMVEPVRRRRAP

SEQ ID NO: 100943 - protein, 91 aa, Homo sapiens
  Payload ID: 20107
  Gene Name: zinc finger protein 667
  ENSP ID: ENSP00000467627
MPSARGKSKSKAPITFGDLAIYFSQEEWEWLSPIQKDLYEDVMLENYRNLVSLGLSFRRPNVITLLEKGKAPWMVEPVRRRRAPGWTTMMA

SEQ ID NO: 100944 - protein, 158 aa, Homo sapiens
  Payload ID: 20107
  Gene Name: zinc finger protein 667
  ENSP ID: ENSP00000468466
MPSARGKSKSKAPITFGDLAIYFSQEEWEWLSPIQKDLYEDVMLENYRNLVSLGLSFRRPNVITLLEKGKAPWMVEPVRRRRAPDSGSKCETKKLPPNQCNKSGQSICQKLVSAQQKAPTRKSGCNKNSVLVKPKKGHSGKKPLKCNDCGKTFSRSFS

SEQ ID NO: 100945 - protein, 127 aa, Homo sapiens
  Payload ID: 20107
  Gene Name: zinc finger protein 667
  ENSP ID: ENSP00000468550
MPSARGKSKSKAPITFGDLAIYFSQEEWEWLSPIQKDLYEDVMLENYRNLVSLGLSFRRPNVITLLEKGKAPWMVEPVRRRRAPELTEASPEAKEVPAPCLYSLLNQEPIEPLLFINYPLKYLFIAI

SEQ ID NO: 100946 - protein, 392 aa, Homo sapiens [sequence omitted]

SEQ ID NO: 100947 - protein, 619 aa, Homo sapiens
  Payload ID: 20108
  Gene Name: zinc finger protein 668
  Uniprot ID: Q96K58
  ENSP ID: ENSP00000300849
MEVEAAEARSPAPGYKRSGRRYKCLSCTKTFPNAPRAARHAATHGPADCSEEVAEVKPKPETEAKAEEASGEKVSGSAAKPRPYACPLCPKAYKTAPELRSHGRSHTGEKPFPCPECGRRFMQPVCLRVHLASHAGELPFRCAHCPKAYGALSKLKIHQRGHTGERPYACADCGKSFADPSVFRKHRRTHAGLRPYSCERCGKAYAELKDLRNHERSHTGERPFLCSECGKSFSRSSSLTCHQRIHAAQKPYRCPACGKGFTQLSSYQSHERTHSGEKPFLCPRCGRMFSDPSSFRRHQRAHEGVKPYHCEKCGKDFRQPADLAMHRRVHTGDRPFKCLQCDKTFVASWDLKRHALVHSGQRPFRCEECGRAFAERASLTKHSRVHSGERPFHCNACGKSFVVSSSLRKHERTHRSSEAAGVPPAQELVVGLALPVGVAGESSAAPAAGAGLGDPPAGLLGLPPESGGVMATQWQVVGMTVEHVECQDAGVREAPGPLEGAGEAGGEEADEKPPQFVCRECKETFSTMTLLRRHERSHPELRPFPCTQCGKSFSDRAGLRKHSRTHSSVRPYTCPHCPKAFLSASDLRKHERTHPVPMGTPTPLEPLVALLGMPEEGPA

SEQ ID NO: 100948 - protein, 619 aa, Homo sapiens; identical to SEQ ID NO: 100947
  Payload ID: 20108
  Gene Name: zinc finger protein 668
  Uniprot ID: Q96K58
  ENSP ID: ENSP00000378434

SEQ ID NO: 100949 - protein, 92 aa, Homo sapiens
  Payload ID: 20108
  Gene Name: zinc finger protein 668
  ENSP ID: ENSP00000390671
MEVEAAEARSPAPGYKRSGRRYKCLSCTKTFPNAPRAARHAATHGPADCSEEVAEVKPKPETEAKAEEASGEKVSGSAAKPRPYACPLCPKA

SEQ ID NO: 100950 - protein, 642 aa, Homo sapiens
  Payload ID: 20108
  Gene Name: zinc finger protein 668
  Uniprot ID: Q96K58
  ENSP ID: ENSP00000403975
MSEPGMLGRKDVWVPRETPFTKAMEVEAAEARSPAPGYKRSGRRYKCLSCTKTFPNAPRAARHAATHGPADCSEEVAEVKPKPETEAKAEEASGEKVSGSAAKPRPYACPLCPKAYKTAPELRSHGRSHTGEKPFPCPECGRRFMQPVCLRVHLASHAGELPFRCAHCPKAYGALSKLKIHQRGHTGERPYACADCGKSFADPSVFRKHRRTHAGLRPYSCERCGKAYAELKDLRNHERSHTGERPFLCSECGKSFSRSSSLTCHQRIHAAQKPYRCPACGKGFTQLSSYQSHERTHSGEKPFLCPRCGRMFSDPSSFRRHQRAHEGVKPYHCEKCGKDFRQPADLAMHRRVHTGDRPFKCLQCDKTFVASWDLKRHALVHSGQRPFRCEECGRAFAERASLTKHSRVHSGERPFHCNACGKSFVVSSSLRKHERTHRSSEAAGVPPAQELVVGLALPVGVAGESSAAPAAGAGLGDPPAGLLGLPPESGGVMATQWQVVGMTVEHVECQDAGVREAPGPLEGAGEAGGEEADEKPPQFVCRECKETFSTMTLLRRHERSHPELRPFPCTQCGKSFSDRAGLRKHSRTHSSVRPYTCPHCPKAFLSASDLRKHERTHPVPMGTPTPLEPLVALLGMPEEGPA

SEQ ID NO: 100951 - protein, 108 aa, Homo sapiens
  Payload ID: 20108
  Gene Name: zinc finger protein 668
  ENSP ID: ENSP00000412340
MEVEAAEARSPAPGYKRSGRRYKCLSCTKTFPNAPRAARHAATHGPADCSEEVAEVPHRRAPLPLLRVREELLPLILAHVPPAHPRGTEALPLPGLRQGLHAAQFLPE

SEQ ID NO: 100952 - protein, 163 aa, Homo sapiens
  Payload ID: 20108
  Gene Name: zinc finger protein 668
  ENSP ID: ENSP00000416853
MEVEAAEARSPAPGYKRSGRRYKCLSCTKTFPNAPRAARHAATHGPADCSEEVAEVKPKPETEAKAEEASGEKVSGSAAKPRPYACPLCPKAYKTAPELRSHGRSHTGEKPFPCPECGRRFMQPVCLRVHLASHAGELPFRCAHCPKAYGALSKLKIHQRGHT

SEQ ID NO: 100953 - protein, 619 aa, Homo sapiens; identical to SEQ ID NO: 100947
  Payload ID: 20108
  Gene Name: zinc finger protein 668
  Uniprot ID: Q96K58
  ENSP ID: ENSP00000440149

SEQ ID NO: 100954 - protein, 619 aa, Homo sapiens; identical to SEQ ID NO: 100947
  Payload ID: 20108
  Gene Name: zinc finger protein 668
  Uniprot ID: Q96K58
  ENSP ID: ENSP00000441349

SEQ ID NO: 100955 - protein, 642 aa, Homo sapiens; identical to SEQ ID NO: 100950
  Payload ID: 20108
  Gene Name: zinc finger protein 668
  Uniprot ID: Q96K58
  ENSP ID: ENSP00000442573

SEQ ID NO: 100956 - protein, 464 aa, Homo sapiens
  Payload ID: 20109
  Gene Name: zinc finger protein 669
  Uniprot ID: Q96BR6
  ENSP ID: ENSP00000342818
MVSGLRLASRSGEEGWLKPAVARLGPPRHRLRNLRTESPWRSRGSVLFCSGPGRAGRAAEPLHPVCTCGRHFRRPEPCREPLASPIQDSVAFEDVAVNFTQEEWALLDSSQKNLYREVMQETCRNLASVGSQWKDQNIEDHFEKPGKDIRNHIVQRLCESKEDGQYGEVVSQIPNLDLNENISTGLKPCECSICGKVFVRHSLLNRHILAHSGYKPYGEKQYKCEQCGKFFVSVPGVRRHMIMHSGNPAYKCTICGKAFYFLNSVERHQRTHTGEKPYKCKQCGKAFTVSGSCLIHERTHTGEKPYECKECGKTFRFSCSFKTHERTHTGERPYKCTKCDKAFSCSTSLRYHGSIHTGERPYECKQCGKAFSRLSSLCNHRSTHTGEKPYECKQCDQAFSRLSSLHLHERIHTGEKPYECKKCGKAYTRSSHLTRHERSHDIEAGCSDSAYNPSTLGGQGVWIA

SEQ ID NO: 100957 - protein, 71 aa, Homo sapiens
  Payload ID: 20109
  Gene Name: zinc finger protein 669
  ENSP ID: ENSP00000355456
MDSVAFEDVAVNFTQEEWALLDSSQKNLYREVMQETCRNLASVEIISYRDCVKVKKMVSMEKLSAKFQILI

SEQ ID NO: 100958 - protein, 61 aa, Homo sapiens
  Payload ID: 20109
  Gene Name: zinc finger protein 669
  ENSP ID: ENSP00000355457
MDSVAFEDVAVNFTQEEWALLDSSQKNLYREVMQETCRNLASEANGKTRILKITSKNLGKI

SEQ ID NO: 100959 - protein, 378 aa, Homo sapiens
  Payload ID: 20109
  Gene Name: zinc finger protein 669
  Uniprot ID: Q96BR6
  ENSP ID: ENSP00000404370
MDSVAFEDVAVNFTQEEWALLDSSQKNLYREVMQETCRNLASVGSQWKDQNIEDHFEKPGKDIRNHIVQRLCESKEDGQYGEVVSQIPNLDLNENISTGLKPCECSICGKVFVRHSLLNRHILAHSGYKPYGEKQYKCEQCGKFFVSVPGVRRHMIMHSGNPAYKCTICGKAFYFLNSVERHQRTHTGEKPYKCKQCGKAFTVSGSCLIHERTHTGEKPYECKECGKTFRFSCSFKTHERTHTGERPYKCTKCDKAFSCSTSLRYHGSIHTGERPYECKQCGKAFSRLSSLCNHRSTHTGEKPYECKQCDQAFSRLSSLHLHERIHTGEKPYECKKCGKAYTRSSHLTRHERSHDIEAGCSDSAYNPSTLGGQGVWIA

SEQ ID NO: 100960 - protein, 139 aa, Homo sapiens
  Payload ID: 20109
  Gene Name: zinc finger protein 669
  ENSP ID: ENSP00000429550
MVSGLRLASRSGEEGWLKPAVARLGPPRHRLRNLRTESPWRSRGSVLFCSGPGRAGRAAEPLHPVCTCGRHFRRPEPCREPLASPIQDSVAFEDVAVNFTQEEWALLDSSQKNLYREVMQETCRNLASVEIISYRDCVK

SEQ ID NO: 100961 - protein, 389 aa, Homo sapiens
  Payload ID: 20110
  Gene Name: zinc finger protein 670
  Uniprot ID: Q9BS34
  ENSP ID: ENSP00000355459
MDSVSFEDVAVAFTQEEWALLDPSQKNLYRDVMQEIFRNLASVGNKSEDQNIQDDFKNPGRNLSSHVVERLFEIKEGSQYGETFSQDSNLNLNKKVSTGVKPCECSVCGKVFICHSALHRHILSHIGNKLFECEECPEKLYHCKQCGKAFISLTSVDRHMVTHTSNGPYKGPVYEKPFDFPSVFQMPQSTYTGEKTYKCKHCDKAFNYSSYLREHERTHTGEKPYACKKCGKSFTFSSSLRQHERSHTGEKPYECKECGKAFSRSTYLGIHERTHTGEKPYECIKCGKAFRCSRVLRVHERTHSGEKPYECKQCGKAFKYSSNLCEHERTHTGVKPYGCKECGKSFTSSSALRSHERTHTGEKPYECKKCGKAFSCSSSLRKHERAYMW

SEQ ID NO: 100962 - protein, 534 aa, Homo sapiens
  Payload ID: 20111
  Gene Name: zinc finger protein 671
  Uniprot ID: Q8TAW3
  ENSP ID: ENSP00000321848
MLSPVSRDASDALQGRKCLRPRSRRLPLPAAVRAHGPMAELTDSARGCVVFEDVFVYFSREEWELLDDAQRLLYHDVMLENFALLASLGIAFSRSRAVMKLERGEEPWVYDQVDMTSATEREAQRGLRPGCWHGVEDEEVSSEQSIFVAGVSEVRTLMAELESHPCDICGPILKDTLHLAKYHGGKARQKPYLCGACGKQFWFSTDFDQHQNQPNGGKLFPRKEGRDSVKSCRVHVPEKTLTCGKGRRDFSATSGLLQHQASLSSMKPHKSTKLVSGFLMGQRYHRCGECGKAFTRKDTLARHQRIHTGERPYECNECGKFFSQSYDLFKHQTVHTGERPYECSECGKFFRQISGLIEHRRVHTGERLYQCGKCGKFFSSKSNLIRHQEVHTGARPYVCSECGKEFSRKHTLVLHQRTHTGERPYECSECGKAFSQSSHLNVHWRIHSSDYECSRCGKAFSCISKLIQHQKVHSGEKPYECSKCGKAFTQRPNLIRHWKVHTGERPYVCSECGREFIRKQTLVLHQRVHAGEKL

SEQ ID NO: 100963 - protein, 556 aa, Homo sapiens
  Payload ID: 20111
  Gene Name: zinc finger protein 671
  ENSP ID: ENSP00000338670
MLSPVSRDASDALQGRKCLRPRSRRLPLPAAVRAHGPMAELTDSARGCVVFEDVFVYFSREEWELLDDAQRLLYHDVMLENFALLASLGIAFSRSRAVMKLERGEEPWVYDQVDMTSATEREAQRGLRPGCWHGVEDEEVSSEQSIFVAGVSEVRTLMAELESHPCDICGPILKDTLHLAKYHGGKARQKPYLCGACGKQFWFSTDFDQHQNQPNGGKLFPRKEGRDSVKSCRVHVPEKTLTCGKGRRDFSATSGLLQHQASLSSMKPHKSTKLVSGFLMGQRYHRCGECGKAFTRKDTLARHQRIHTGERPYECNECGKFFSQSYDLFKHQTVHTGERPYECSECGKFFRQISGLIEHRRVHTGERLYQCGKCGKFFSSKSNLIRHQEVHTGARPYVCSECGKEFSRKHTLVLHQRTHTGERPYECSECGKAFSQSSHLNVHWRIHSSDYECSRCGKAFSCISKLIQHQKVHSGEKPYECSKCGKAFTQRPNLIRHWKVHTGERPYVCSECGREFIRKQTLVLHQRVHAGEKLKSVANVGESLRPMPLTYYMVGN

SEQ ID NO: 100964 - protein, 56 aa, Homo sapiens
  Payload ID: 20111
  Gene Name: zinc finger protein 671
  ENSP ID: ENSP00000468976
MLSPVSRDASDALQGRKCLRPRSRRLPLPAAVRAHGPMAELTDSARELHFPDHVQS

SEQ ID NO: 100965 - protein, 56 aa, Homo sapiens; identical to SEQ ID NO: 100964
  Payload ID: 20111
  Gene Name: zinc finger protein 671
  ENSP ID: ENSP00000470742

SEQ ID NO: 100966 - protein, 107 aa, Homo sapiens
  Payload ID: 20111
  Gene Name: zinc finger protein 671
  ENSP ID: ENSP00000471087
MLSPVSRDASDALQGRKCLRPRSRRLPLPAAVRAHGPMAELTDSARVGAASSGPSVTLSPTPNRKVPAAPVSQDSDALLGRGPISVWVGVGELRAEGTAQVKARGCC

SEQ ID NO: 100967 - protein, 452 aa, Homo sapiens
  Payload ID: 20112
  Gene Name: zinc finger protein 672
  Uniprot ID: Q499Z4
  ENSP ID: ENSP00000421915
MFATSGAVAAGKPYSCSECGKSFCYSSVLLRHERAHGGDGRFRCLECGERCARAADLRAHRRTHAGQTLYICSECGQSFRHSGRLDLHLGAHRQRCRTCPCRTCGRRFPHLPALLLHRRRQHLPERPRRCPLCARTFRQSALLFHQARAHPLGTTSDPAAPPHRCAQCPRAFRSGAGLRSHARIHVSRSPTRPRVSDAHQCGVCGKCFGKSSTLTRHLQTHSGEKPFKCPECGKGFLESATLVRHQRTHTGEKPYACGDCGRCFSESSTLLRHRRSHQGERPHACATCGKGFGQRSDLVVHQRIHTGEKPFACPECGRRFSDRSDLTKHRRTHTGEKPYRCELCGKRFTCVSNLNVHRRNHAGHKPHKCPECSKAFSVASKLALHRKTHLGERPAECAECGKCFSHSRSLSQHQRAHTRARTAAAVAIQSAVGTALVFEGPAEQEKPGFSVS

SEQ ID NO: 100968 - protein, 3 aa, Homo sapiens
  Payload ID: 20112
  Gene Name: zinc finger protein 672
  ENSP ID: ENSP00000422534
MFA

SEQ ID NO: 100969 - protein, 37 aa, Homo sapiens
  Payload ID: 20112
  Gene Name: zinc finger protein 672
  ENSP ID: ENSP00000426199
MFATSGAVAAGKPYSCSECGKSFCYSSVLLRHERAHG

SEQ ID NO: 100970 - protein, 69 aa, Homo sapiens
  Payload ID: 20112
  Gene Name: zinc finger protein 672
  ENSP ID: ENSP00000427021
MFATSGAVAAGKPYSCSECGKSFCYSSVLLRHERAHGGDGRFRCLECGERCARAADLRAHRRTHAGQTL

SEQ ID NO: 100971 - protein, 575 aa, Homo sapiens
  Payload ID: 20113
  Gene Name: zinc finger protein 674
  Uniprot ID: Q2M3X9
  ENSP ID: ENSP00000428248
MAMSQESLTFKDVFVDFTLEEWQQLDSAQKNLYRDVMLENYSHLVSVGHLVGKPDVIFRLGPGDESWMADGGTPVRTCAVWEVDEQIDHYKESQDKFLWQAAFIGKETLKDESGQECKICRKIIYLNTDFVSVKQRLPKYYSWERCSKHHLNFLGQNRSYVRKKDDGCKAYWKVCLHYNLHKAQPAERFFDPNQRGKALHQKQALRKSQRSQTGEKLYKCTECGKVFIQKANLVVHQRTHTGEKPYECCECAKAFSQKSTLIAHQRTHTGEKPYECSECGKTFIQKSTLIKHQRTHTGEKPFVCDKCPKAFKSSYHLIRHEKTHIRQAFYKGIKCTTSSLIYQRIHTSEKPQCSEHGKASDEKPSPTKHWRTHTKENIYECSKCGKSFRGKSHLSVHQRIHTGEKPYECSICGKTFSGKSHLSVHHRTHTGEKPYECRRCGKAFGEKSTLIVHQRMHTGEKPYKCNECGKAFSEKSPLIKHQRIHTGERPYECTDCKKAFSRKSTLIKHQRIHTGEKPYKCSECGKAFSVKSTLIVHHRTHTGEKPYECRDCGKAFSGKSTLIKHQRSHTGDKNL

SEQ ID NO: 100972 - protein, 581 aa, Homo sapiens
  Payload ID: 20113
  Gene Name: zinc finger protein 674
  Uniprot ID: Q2M3X9
  ENSP ID: ENSP00000429148
MAMSQESLTFKDVFVDFTLEEWQQLDSAQKNLYRDVMLENYSHLVSVGHLVGKPDVIFRLGPGDESWMADGGTPVRTCAGEDRPEVWEVDEQIDHYKESQDKFLWQAAFIGKETLKDESGQECKICRKIIYLNTDFVSVKQRLPKYYSWERCSKHHLNFLGQNRSYVRKKDDGCKAYWKVCLHYNLHKAQPAERFFDPNQRGKALHQKQALRKSQRSQTGEKLYKCTECGKVFIQKANLVVHQRTHTGEKPYECCECAKAFSQKSTLIAHQRTHTGEKPYECSECGKTFIQKSTLIKHQRTHTGEKPFVCDKCPKAFKSSYHLIRHEKTHIRQAFYKGIKCTTSSLIYQRIHTSEKPQCSEHGKASDEKPSPTKHWRTHTKENIYECSKCGKSFRGKSHLSVHQRIHTGEKPYECSICGKTFSGKSHLSVHHRTHTGEKPYECRRCGKAFGEKSTLIVHQRMHTGEKPYKCNECGKAFSEKSPLIKHQRIHTGERPYECTDCKKAFSRKSTLIKHQRIHTGEKPYKCSECGKAFSVKSTLIVHHRTHTGEKPYECRDCGKAFSGKSTLIKHQRSHTGDKNL

SEQ ID NO: 100973 - protein, 99 aa, Homo sapiens
  Payload ID: 20113
  Gene Name: zinc finger protein 674
  ENSP ID: ENSP00000429646
MAMSQESLTFKDVFVDFTLEEWQQLDSAQKNLYRDVMLENYSHLVSVGHLVGKPDVIFRLGPGDESWMADGGTPVRTCAVEMGFLHVHQAGLELPASGD

SEQ ID NO: 100974 - protein, 568 aa, Homo sapiens
  Payload ID: 20114
  Gene Name: zinc finger protein 675
  Uniprot ID: Q8TD23
  ENSP ID: ENSP00000352836
MGLLTFRDVAIEFSLEEWQCLDTAQRNLYKNVILENYRNLVFLGIAVSKQDLITCLEQEKEPLTVKRHEMVNEPPVMCSHFAQEFWPEQNIKDSFEKVTLRRYEKCGNDNFQLKGCKSVDECKLHKGGYNGLNQCLPTMQSKMFQCDKYVKVFNKFSHSDRHKIKHMENKPFKCKECGRSFCMLSHLTRHERNYTKVNFCKCEECEKAVNQSSKLTKHKRIYTCEKLYKCQECDRTFNQFSNLTEYKKDYAREKPYKCEECGKAFNQSSHLTTHKIIHTGEKPYKCEECGKAFNQFSNLTTHKKIHTGEQPYICEECGKAFTQSSTLTTHKRIHTGEKPYKCEECGKAFNRSSKLTEHKNIHTGEQPYKCEECGKAFNRSSNLTEHRKIHTEEKPYKCKECGKAFKHSSALTTHKRIHTGEKPYKCEECGKAFNRSSKLTEHKKLHTGKKPYKCEECGKAFIQSSKLTEHKKIHSGEIPYKCEECGKAFKHSSSLTTHKRIHTGEKPYKCEECGKAFSRSSKLTEHKIIHTGEKPYKCERCDKAFNQSANLTKHKKIHTGEKLQNWNV

SEQ ID NO: 100975 - protein, 77 aa, Homo sapiens
  Payload ID: 20114
  Gene Name: zinc finger protein 675
  ENSP ID: ENSP00000469271
MGLLTFRDVAIEFSLEEWQCLDTAQRNLYKNVILENYRNLVFLGIAVSKQDLITCLEQEKEPLTVKRHEMVNEPPGK

SEQ ID NO: 100976 - protein, 117 aa, Homo sapiens
  Payload ID: 20114
  Gene Name: zinc finger protein 675
  ENSP ID: ENSP00000469379
MGLLTFRDVAIEFSLEEWQCLDTAQRNLYKNVILENYRNLVFLGIAVSKQDLITCLEQEKEPLTVKRHEMVNEPPGSVGQTQQVVPHVRSNEMHHDGTLKNESEVTAHPLGPLWIPA

SEQ ID NO: 100977 - protein, 88 aa, Homo sapiens
  Payload ID: 20114
  Gene Name: zinc finger protein 675
  ENSP ID: ENSP00000472142
MGLLTFRDVAIEFSLEEWQCLDTAQRNLYKNVILENYRNLVFLGIAVSKQDLITCLEQEKEPLTVKRHEMVNEPPAVDKHPCTFYECD

SEQ ID NO: 100978 - protein, 118 aa, Homo sapiens
  Payload ID: 20114
  Gene Name: zinc finger protein 675
  ENSP ID: ENSP00000472170
MGLLTFRDVAIEFSLEEWQCLDTAQRNLYKNVILENYRNLVFLGIAVSKQDLITCLEQEKEPLTVKRHEMVNEPPGLPLMPSRSWTVLLPSLLTATSLPDSPASACRVPAIAGARSHA

SEQ ID NO: 100979 - protein, 104 aa, Homo sapiens
  Payload ID: 20114
  Gene Name: zinc finger protein 675
  ENSP ID: ENSP00000473035
MVNEPPVMCSHFAQEFWPEQNIKDSFEKVTLRRYEKCGNDNFQLKGCKSVDECKLHKGGYNGLNQCLPTMQSKMFQCDKYVKVFNKFSHSDRHKIKHMENKPFK

SEQ ID NO: 100980 - protein, 101 aa, Homo sapiens
  Payload ID: 20114
  Gene Name: zinc finger protein 675
  ENSP ID: ENSP00000473168
MGLLTFRDVAIEFSLEEWQCLDTAQRNLYKNVILENYRNLVFLGIAVSKQDLITCLEQEKEPLTVKRHEMVNEPPESRPVVQPEVQWYNLCLLQPPPPRFK

SEQ ID NO: 100981 - protein, 79 aa, Homo sapiens
  Payload ID: 20114
  Gene Name: zinc finger protein 675
  ENSP ID: ENSP00000473217
MGLLTFRDVAIEFSLEEWQCLDTAQRNLYKNVILENYRNLVFLGIAVSKQDLITCLEQEKEPLTVKRHEMVNEPPGQKQ

SEQ ID NO: 100982 - protein, 588 aa, Homo sapiens
  Payload ID: 20115
  Gene Name: zinc finger protein 676
  Uniprot ID: Q8N7Q3
  ENSP ID: ENSP00000378783
MLENYRNLVFLGIAAFKPDLIIFLEQGKEPWNMKRHEMVEEPPVICSHFSQEFWPEQGIEDSFQKMILRRYDKCGHENLHLKISCTNVDECNVHKEGYNKLNQSLTTTQSKVFQCGKYANVFHKCSNSNRHKIRHTGEKGLKCKEYVRSFCMLSHLSQHERIYTRENSYKCEENGKAFNWSSTLTYYKSIHTGEKPYKCEECGKAFSKFSILTKHKVIHTGEKPYKCEECGKAFNRSSILTKHKIIHTGEKPYKCEECGKGFSSVSTLNTHKAIHAEEKPYKCEECGKASNSSSKLMEHKRIHTGEKPYKCEECGKAFSWSSSLTEHKRIHAGEKPYKCEECGKAFNRSSILTKHKIIHTGEKPYKCEGCGKAFSKVSTLNTHKAIHAEEKPYKCEECGKASNSSSKLMEHKRIHTGEKPYKCEECGKAFSWSSSLTEHKRIHAGEKPYKCEECGKAFTWSSSFTKHKRIHAAEKPYKCEECGKGFSTFSILTKHKIIHTGEKRYKCEECGKAFSWSSILTEHKIIHTGEKPYKCEECGKAFSRSSSLTRHKRIHTGEKPYKCEECGKAFKSSSTVSYHKKIHTGENP

SEQ ID NO: 100983 - protein, 588 aa, Homo sapiens; identical to SEQ ID NO: 100982
  Payload ID: 20115
  Gene Name: zinc finger protein 676
  Uniprot ID: Q8N7Q3
  ENSP ID: ENSP00000380310

SEQ ID NO: 100984 - protein, 568 aa, Homo sapiens
  Payload ID: 20115
  Gene Name: zinc finger protein 676
  ENSP ID: ENSP00000483094
MDNPRYGMPFRRAGECPGAERHLLVPCFFGKGALTFRDVAIEFSLEEWQCLDSTQQNLYRNVMLENYRNLVFLGIAAFKPDLIIFLEQGKEPWNMKRHEMVEEPPVICSHFSQEFWPEQGIEDSFQKMILRRYDKCGHENLHLKISCTNVDECNVHKEGYNKLNQSLTTTQSKVFQCGKYANVFHKCSNSNRHKIRHTGEKGLKCKEYVRSFCMLSHLSQHERIYTRENSYKCEENGKAFNWSSTLTYYKSIHTGEKPYKCEECGKAFSKFSILTKHKVIHTGEKPYKCEECGKAFNRSSILTKHKIIHTGEKPYKCEECGKGFSSVSTLNTHKRIHTGEKPYKCEECGKAFSWSSSLTEHKRIHAGEKPYKCEECGKAFNRSSILTKHKIIHTGEKPYKCEGCGKAFSKVSTLNTHKRIHTGEKPYKCEECGKAFSWSSSLTEHKRIHAGEKPYKCEECGKAFTWSSSFTKHKRIHAAEKPYKCEECGKGFSTFSILTKHKIIHTGEKRYKCEECGKAFSWSSILTEHKIIHTGEKPYKCEECGKAFSRSSSLTTQENSYWRETLQM

SEQ ID NO: 100985 - protein, 584 aa, Homo sapiens
  Payload ID: 20116
  Gene Name: zinc finger protein 677
  Uniprot ID: Q86XU0
  ENSP ID: ENSP00000334394
MALSQGLFTFKDVAIEFSQEEWECLDPAQRALYRDVMLENYRNLLSLDEDNIPPEDDISVGFTSKGLSPKENNKEELYHLVILERKESHGINNFDLKEVWENMPKFDSLWDYDVKNYKGMPLTCNKNLTHRKDQQHNKSSIHFSLKQSVSIRDSAHQYFIHDKPFIRNLLKLKNNIRYAGNKYVKCFENKIGLSLQAQLAELQRFQTGEKMYECNPVEKSINSSSVSPLPPCVKNICNKYRKILKYPLLHTQYGRTHIREKSYKCNDCGKAFSKSSNLTNHQRIHSGQRPYKCNECGKAFNQCSNLTRHQRVHTGEKPYQCNICGKVCSQNSNLASHQRMHTGEKPYKCNECGKAFIQRSHLWGHERIHTGEKPYKCNECDKAFAERSSLTQHKRIHTGEKPYICNECGKAFKQCSHLTRHQNIHPGEKPHKCNVCGRAFIQSSSLVEHQRIHTGEKPYKCNKCDKAFIKRSHLWGHQRTHTGEKPYKCTECGKAFTERSNLTQHKKIHTGEKPYKCTECGKAFTQFANLTRHQKIHIEKKHCKHNIHGNALFQSSNLGDHQKSYNREKHIKYNETKIKYSSCT

SEQ ID NO: 100986 - protein, 584 aa, Homo sapiens; identical to SEQ ID NO: 100985
  Payload ID: 20116
  Gene Name: zinc finger protein 677
  Uniprot ID: Q86XU0
  ENSP ID: ENSP00000469391

SEQ ID NO: 100987 - protein, 77 aa, Homo sapiens
  Payload ID: 20116
  Gene Name: zinc finger protein 677
  ENSP ID: ENSP00000469701
MALSQGLFTFKDVAIEFSQEEWECLDPAQRALYRDVMLENYRNLLSLDEDNIPPEDGDGQLLVDSPMEEVSLVTEHS

SEQ ID NO: 100988 - protein, 71 aa, Homo sapiens
  Payload ID: 20116
  Gene Name: zinc finger protein 677
  ENSP ID: ENSP00000471071
MALSQGLFTFKDVAIEFSQEEWECLDPAQRALYRDVMLENYRNLLSLDEDNIPPEDGSHLAACGQSTLPLP

SEQ ID NO: 100989 - protein, 68 aa, Homo sapiens
  Payload ID: 20116
  Gene Name: zinc finger protein 677
  ENSP ID: ENSP00000471266
MALSQGLFTFKDVAIEFSQEEWECLDPAQRALYRDVMLENYRNLLSLDEDNIPPEDGNHPCTSLHFSL

SEQ ID NO: 100990 - protein, 80 aa, Homo sapiens
  Payload ID: 20116
  Gene Name: zinc finger protein 677
  ENSP ID: ENSP00000472132
MALSQGLFTFKDVAIEFSQEEWECLDPAQRALYRDVMLENYRNLLSLDEDNIPPEDAFYSIRELRETLVFLIPYSSKICL

SEQ ID NO: 100991 - protein, 145 aa, Homo sapiens
  Payload ID: 20116
  Gene Name: zinc finger protein 677
  ENSP ID: ENSP00000472416
MALSQGLFTFKDVAIEFSQEEWECLDPAQRALYRDVMLENYRNLLSLDEDNIPPEDDISVGFTSKGLSPKENNKEELYHLVILERKESHGINNFDLKEVWENMPKFDSLWDYDVKNYKGMPLTCNKNLTHRKDQQHNKSSIHFSL

SEQ ID NO: 100992 - protein, 68 aa, Homo sapiens; identical to SEQ ID NO: 100989
  Payload ID: 20116
  Gene Name: zinc finger protein 677
  ENSP ID: ENSP00000472783

SEQ ID NO: 100993 - protein, 525 aa, Homo sapiens
  Payload ID: 20117
  Gene Name: zinc finger protein 678
  Uniprot ID: Q5SXM1
  ENSP ID: ENSP00000344828
MGTISLCIGVCAFEGANTSTSFYKLVYTAILSYSIQDLLPEQDMKDLCQKVTLTRHRSWGLDNLHLVKDWRTVNEGKGQKEYCNRLTQCSSTKSKIFQCIECGRNFSWRSILTEHKRIHTGEKPYKCEECGKVFNRCSNLTKHKRIHTGEKPYKCDECGKVFNWWSQLTNHKKIHTGEKPYKCDECDKVFNWWSQLTSHKKIHSGEKPYPCEECGKAFTQFSNLTQHKRIHTGEKPYKCKECCKAFNKFSNLTQHKRIHTGEKPYKCEECGNVFNECSHLTRHRRIHTGEKPYKCEECGKAFTQFASLTRHKRIHTGEKPYQCEECGKTFNRCSHLSSHKRIHTGEKPYKCEECGRTFTQFSNLTQHKRIHTGEKPYKCKECGKAFNKFSSLTQHRRIHTGVKPYKCEECGKVFKQCSHLTSHKRIHTGEKPYKCKECGKAFYQSSILSKHKRIHTEEKPYKCEECGKAFNQFSSLTRHKRIHTGEKRYKCKECGKGFYQSSIHSKYKRIYTGEEPDKCKKCGSL

SEQ ID NO: 100994 - protein, 227 aa, Homo sapiens
  Payload ID: 20117
  Gene Name: zinc finger protein 678
  ENSP ID: ENSP00000394651
MPGHPESRKTRRILTMLPRLVLNSFPQVILLPNPPKVLRLQGLLAFSDVVIEFSPEEWACLDPAQRNLYRDVMFENYRNLVSLAILSYSIQDLLPEQDMKDLCQKVTLTRHRSWGLDNLHLVKDWRTVNEGKGQKEYCNRLTQCSSTKSKIFQCIECGRNFSWRSILTEHKRIHTGEKPYKCEECGKVFNRCSNLTKHKRIHTGEKPYKCDECGKVFNWWSQLTNHK

SEQ ID NO: 100995 - protein, 525 aa, Homo sapiens; identical to SEQ ID NO: 100993
  Payload ID: 20117
  Gene Name: zinc finger protein 678
  Uniprot ID: Q5SXM1
  ENSP ID: ENSP00000440403

SEQ ID NO: 100996 - protein, 76 aa, Homo sapiens
  Payload ID: 20117
  Gene Name: zinc finger protein 678
  ENSP ID: ENSP00000477097
MGTISLCIGVCAFEGANTSTSFYKLVYTAILSYSIQDLLPEQDMKDLCQKVTLTRHRSWGLDNLHLVKDWRTVNEG

SEQ ID NO: 100997 - protein, 411 aa, Homo sapiens
  Payload ID: 20118
  Gene Name: zinc finger protein 679
  Uniprot ID: Q8IYX0
  ENSP ID: ENSP00000255746
MAKRPGSPGSREMGLLTFRDVVIEFSLEEWQCLDHAQQNLYRDVMLENYRNLVSLGIAVSKPDLITCLEQNKEPWNIKRNEMVTKHPVMCSHFTQDLPPELGIKDSLQKVIPRRYGKSGHDNLQVKTCKSMGECEVQKGGCNEVNQCLSTTQNKIFQTHKCVKVFGKFSNSNRHKTRHTGKKHFKCKKYGKSFCMVSQLHQHQIIHTRENSYQCEECGKPFNCSSTLSKHKRIHTGEKPYRCEECGKAFTWSSTLTKHRRIHTGEKPYTCEECGQAFSRSSTLANHKRIHTGEKPYTCEECGKAFSLSSSLTYHKRIHTGEKPYTCEECGKAFNCSSTLKKHKIIHTGEKPYKCKECGKAFAFSSTLNTHKRIHTGEEPYKCEECDKAFKWSSSLANHKSMHTGEKPYKCE

SEQ ID NO: 100998 - protein, 411 aa, Homo sapiens; identical to SEQ ID NO: 100997
  Payload ID: 20118
  Gene Name: zinc finger protein 679
  Uniprot ID: Q8IYX0
  ENSP ID: ENSP00000416809

SEQ ID NO: 100999 - protein, 530 aa, Homo sapiens
  Payload ID: 20119
  Gene Name: zinc finger protein 680
  Uniprot ID: Q8NEM1
  ENSP ID: ENSP00000309330
MPGPPGSLEMGPLTFRDVAIEFSLEEWQCLDTAQRNLYRKVMFENYRNLVFLGIAVSKPHLITCLEQGKEPWNRKRQEMVAKPPVIYSHFTEDLWPEHSIKDSFQKVILRGYGKCGHENLQLRISCKSVDESKVFKEGYNELNQCLRTTQSKIFQCDKYVKVFHKFSNSNSHKKRNTGKKVFKCKECGKSFCMLSHLTQHIRIHTRENSYKCEECGKVLNWFSELIKHKGIHMGEKPYKCEECGKAFNQSSTLIKHKKIHIEEKPFKCEECGKAFSLFSILSKHKIIHTGDKPYKCDECHKAFNWFATLTNHKRIHTGEKPFKCEECGKDFNQFSNLTKHKKIHTGEKPYKCEECGKAFNQFANLTRHKKIHTGEKSYKCEECGKAFIQSSNLTEHMRIHTGEKPYKCEECGKAFNGCSSLTRHKRIHTRENTYKCEECGKGFTLFSTLTNHKVIHTGEKSYKCDECGNVFNWPATLANHKRIHAREKPYKCEECGKAFNRSSHLTRHKKIHTGEKLYKPEKCDNNFDNT

SEQ ID NO: 101000 - protein, 123 aa, Homo sapiens
  Payload ID: 20119
  Gene Name: zinc finger protein 680
  Uniprot ID: Q8NEM1
  ENSP ID: ENSP00000393506
MPGPPGSLEMGPLTFRDVAIEFSLEEWQCLDTAQRNLYRKVMFENYRNLVFLGIAVSKPHLITCLEQGKEPWNRKRQEMVAKPPESYCVAQADLELLVSSYLTALASLKMWDYRNNPLCQATM

SEQ ID NO: 101001 - protein, 645 aa, Homo sapiens
  Payload ID: 20120
  Gene Name: zinc finger protein 681
  Uniprot ID: Q96N22
  ENSP ID: ENSP00000384000
MEPLKFRDVAIEFSLEEWQCLDTIQQNLYRNVMLENYRNLVFLGIVVSKPDLITCLEQEKEPWTRKRHRMVAEPPVICSHFAQDFSPEQNIKDSFQKVTPRRYGKCEHENLQLSKSVDECKVQKGGYNGLNQCLPTTQSKIFQCDKYMKIFHKFSNLNGHKVRHTRKKPFKYKEFGKSFCIFSNLTQHKIICTRVNFYKCEDCGKAFNGSSIFTKHKRIHIGEKSYICEECGKACNQFTNLTTHKIIYTRDKLYKREECSKAFNLSSHITTHTIIHTGENPYKREECDKAFNQSLTLTTHKIIHTREKLNEYKECGKAFNQSSHLTRHKIIHTGEKPYKCEECGKAFNQSSHLTRHKIIHTGEKPYRCEECGKAFRQSSHLTTHKIIHTGEKPYKCEECGKAFNKSSHLTRHKSIHTGEKPYQCEKCGKASNQSSNLTEHKNIHTEEKPYKCEECGKAFNQFSNLTTHKRIHTGEKPYKCEECGKAFNQSSILTTHKRIHTGEKSYKCEECGKAFYRSSKLTEHKKIHTGEKPYTCEECGKAFNHSSHLATHKVIHTGEKPYQCEECGKAFNQSSHLTRHKRIHTGEKPYQCEKCGKAFNQSSNLTGHKKIHTGEKLYKPKRCNSDFENTSKFSKHKRNYAGEKS

SEQ ID NO: 101002 - protein, 152 aa, Homo sapiens
  Payload ID: 20120
  Gene Name: zinc finger protein 681
  ENSP ID: ENSP00000433806
MVAEPPVICSHFAQDFSPEQNIKDSFQKVTPRRYGKCEHENLQLSKSVDECKVQKGGYNGLNQCLPTTQSKIFQCDKYMKIFHKFSNLNGHKVRHTRKKPFKYKEFGKSFCIFSNLTQHKIICTRVNFYKCEDCGKAFNGSSIFTKHKRIHI

SEQ ID NO: 101003 - protein, 126 aa, Homo sapiens
  Payload ID: 20120
  Gene Name: zinc finger protein 681
  ENSP ID: ENSP00000435824
MVAEPPVICSHFAQDFSPEQNIKDSFQKVTPRRYGKCEHENLQLSKSVDECKVQKGGYNGLNQCLPTTQSKIFQCDKYMKIFHKFSNLNGHKVRHTRKKPFKYKEFGKSFCIFSNLTQHKIICTRV

SEQ ID NO: 101004 - protein, 466 aa, Homo sapiens
  Payload ID: 20121
  Gene Name: zinc finger protein 682
  Uniprot ID: O95780
  ENSP ID: ENSP00000351324
MLENYRNLVSLGLTVSKPELISRLEQRQEPWNVKRHETIAKPPAMSSHYTEDLLPEQCMQDSFQKVILRRYGSCGLEDLHLRKDGENVGECKDQKEIYNGLNQCLSTLPSKIFPYNKCVKVFSKSSNLNRENIRHTTEKLFKCMQCGKVFKSHSGLSYHKIIHTEEKLCICEECGKTFKWFSYLTKHKRIHTGEKPYKCEECGKAFNWCSSLTKHKRIHTGEKPYKCEECGKAFHWCSPFVRHKKIHTGEKPYTCEDCGRAFNRHSHLTKHKTIHTGKKPYKCKECGKAFNHCSLLTIHERTHTGEKPYKCEECGKAFNSSSILTEHKVIHSGEKPYKCEKCDKVFKRFSYLTKHKRIHTGEKPYKCEECGKAFNWSSILTEHKRIHTGEKPYNCEECGKAFNRCSHLTRHKKIHTAVKRYKCEECGKAFKRCSHLNEHKRVQRGEKSCKYKKCGEAFNHCSNLTT

SEQ ID NO: 101005 - protein, 466 aa, Homo sapiens; identical to SEQ ID NO: 101004
  Payload ID: 20121
  Gene Name: zinc finger protein 682
  Uniprot ID: O95780
  ENSP ID: ENSP00000380348

SEQ ID NO: 101006 - protein, 498 aa, Homo sapiens
  Payload ID: 20121
  Gene Name: zinc finger protein 682
  Uniprot ID: O95780
  ENSP ID: ENSP00000380351
MELLTFRDVTIEFSLEEWEFLNPAQQSLYRKVMLENYRNLVSLGLTVSKPELISRLEQRQEPWNVKRHETIAKPPAMSSHYTEDLLPEQCMQDSFQKVILRRYGSCGLEDLHLRKDGENVGECKDQKEIYNGLNQCLSTLPSKIFPYNKCVKVFSKSSNLNRENIRHTTEKLFKCMQCGKVFKSHSGLSYHKIIHTEEKLCICEECGKTFKWFSYLTKHKRIHTGEKPYKCEECGKAFNWCSSLTKHKRIHTGEKPYKCEECGKAFHWCSPFVRHKKIHTGEKPYTCEDCGRAFNRHSHLTKHKTIHTGKKPYKCKECGKAFNHCSLLTIHERTHTGEKPYKCEECGKAFNSSSILTEHKVIHSGEKPYKCEKCDKVFKRFSYLTKHKRIHTGEKPYKCEECGKAFNWSSILTEHKRIHTGEKPYNCEECGKAFNRCSHLTRHKKIHTAVKRYKCEECGKAFKRCSHLNEHKRVQRGEKSCKYKKCGEAFNHCSNLTT

SEQ ID NO: 101007 - protein, 103 aa, Homo sapiens
  Payload ID: 20121
  Gene Name: zinc finger protein 682
  ENSP ID: ENSP00000469042
MELLTFRDVTIEFSLEEWEFLNPAQQSLYRKVMLENYRNLVSLGLTVSKPELISRLEQRQEPWNVKRHETIAKPPDYSLTILCKKKSNILISFPSIIYVFSLH

SEQ ID NO: 101008 - protein, 52 aa, Homo sapiens
  Payload ID: 20121
  Gene Name: zinc finger protein 682
  ENSP ID: ENSP00000469870
  MOD_RES (1)..(1): Any amino acid
XLYRKVMLENYRNLVSLGLTVSKPELISRLEQRQEPWNVKRHETIAKPPVSV

SEQ ID NO: 101009 - protein, 76 aa, Homo sapiens
  Payload ID: 20121
  Gene Name: zinc finger protein 682
  ENSP ID: ENSP00000470315
MELLTFRDVTIEFSLEEWEFLNPAQQSLYRKVMLENYRNLVSLGLTVSKPELISRLEQRQEPWNVKRHETIAKPPG

SEQ ID NO: 101010 - protein, 504 aa, Homo sapiens
  Payload ID: 20121
  Gene Name: zinc finger protein 682
  ENSP ID: ENSP00000470718
MFCFVFQELLTFRDVTIEFSLEEWEFLNPAQQSLYRKVMLENYRNLVSLGLTVSKPELISRLEQRQEPWNVKRHETIAKPPAMSSHYTEDLLPEQCMQDSFQKVILRRYGSCGLEDLHLRKDGENVGECKDQKEIYNGLNQCLSTLPSKIFPYNKCVKVFSKSSNLNRENIRHTTEKLFKCMQCGKVFKSHSGLSYHKIIHTEEKLCICEECGKTFKWFSYLTKHKRIHTGEKPYKCEECGKAFNWCSSLTKHKRIHTGEKPYKCEECGKAFHWCSPFVRHKKIHTGEKPYTCEDCGRAFNRHSHLTKHKTIHTGKKPYKCKECGKAFNHCSLLTIHERTHTGEKPYKCEECGKAFNSSSILTEHKVIHSGEKPYKCEKCDKVFKRFSYLTKHKRIHTGEKPYKCEECGKAFNWSSILTEHKRIHTGEKPYNCEECGKAFNRCSHLTRHKKIHTAVKRYKCEECGKAFKRCSHLNEHKRVQRGEKSCKYKKCGEAFNHCSNLTT

SEQ ID NO: 101011 - protein, 137 aa, Homo sapiens
  Payload ID: 20121
  Gene Name: zinc finger protein 682
  ENSP ID: ENSP00000471048
MLENYRNLVSLGLTVSKPELISRLEQRQEPWNVKRHETIAKPPAMSSHYTEDLLPEQCMQDSFQKVILRRYGSCGLEDLHLRKDGENVGECKDQKEIYNGLNQCLSTLPSKIFPYNKCVKVFSKSSNLNRENIRHTT

SEQ ID NO: 101012 - protein, 422 aa, Homo sapiens
  Payload ID: 20121
  Gene Name: zinc finger protein 682
  Uniprot ID: O95780
  ENSP ID: ENSP00000471717
MSSHYTEDLLPEQCMQDSFQKVILRRYGSCGLEDLHLRKDGENVGECKDQKEIYNGLNQCLSTLPSKIFPYNKCVKVFSKSSNLNRENIRHTTEKLFKCMQCGKVFKSHSGLSYHKIIHTEEKLCICEECGKTFKWFSYLTKHKRIHTGEKPYKCEECGKAFNWCSSLTKHKRIHTGEKPYKCEECGKAFHWCSPFVRHKKIHTGEKPYTCEDCGRAFNRHSHLTKHKTIHTGKKPYKCKECGKAFNHCSLLTIHERTHTGEKPYKCEECGKAFNSSSILTEHKVIHSGEKPYKCEKCDKVFKRFSYLTKHKRIHTGEKPYKCEECGKAFNWSSILTEHKRIHTGEKPYNCEECGKAFNRCSHLTRHKKIHTAVKRYKCEECGKAFKRCSHLNEHKRVQRGEKSCKYKKCGEAFNHCSNLTT

SEQ ID NO: 101013 - protein, 44 aa, Homo sapiens
  Payload ID: 20121
  Gene Name: zinc finger protein 682
  ENSP ID: ENSP00000471745
  MOD_RES (1)..(1): Any amino acid
XYTEDLLPEQCMQDSFQKVILRRYGSCGLEDLHLRKDGENVVSV

SEQ ID NO: 101014 - protein, 82 aa, Homo sapiens
  Payload ID: 20121
  Gene Name: zinc finger protein 682
  ENSP ID: ENSP00000472444
MELLTFRDVTIEFSLEEWEFLNPAQQSLYRKVMLENYRNLVSLGLTVSKPELISRLEQRQEPWNVKRHETIAKPPGTYRVGQ

SEQ ID NO: 101015 - protein, 504 aa, Homo sapiens
  Payload ID: 20122
  Gene Name: zinc finger protein 683
  Uniprot ID: Q8IZ20
  ENSP ID: ENSP00000344095
MKEESAAQLGCCHRPMALGGTGGSLSPSLDFQLFRGDQVFSACRPLPDMVDAHGPSCASWLCPLPLAPGRSALLACLQDLDLNLCTPQPAPLGTDLQGLQEDALSMKHEPPGLQASSTDDKKFTVKYPQNKDKLGKQPERAGEGAPCPAFSSHNSSSPPPLQNRKSPSPLAFCPCPPVNSISKELPFLLHAFYPGYPLLLPPPHLFTYGALPSDQCPHLLMLPQDPSYPTMAMPSLLMMVNELGHPSARWETLLPYPGAFQASGQALPSQARNPGAGAAPTDSPGLERGGMASPAKRVPLSSQTGTAALPYPLKKKNGKILYECNICGKSFGQLSNLKVHLRVHSGERPFQCALCQKSFTQLAHLQKHHLVHTGERPHKCSVCHKRFSSSSNLKTHLRLHSGARPFQCSVCRSRFTQHIHLKLHHRLHAPQPCGLVHTQLPLASLACLAQWHQGALDLMAVASEKHMGYDIDEVKVSSTSQGKARAVSLSSAGTPLVMGQDQNN

SEQ ID NO: 101016 - protein, 524 aa, Homo sapiens
  Payload ID: 20122
  Gene Name: zinc finger protein 683
  Uniprot ID: Q8IZ20
  ENSP ID: ENSP00000384782
MKEESAAQLGCCHRPMALGGTGGSLSPSLDFQLFRGDQVFSACRPLPDMVDAHGPSCASWLCPLPLAPGRSALLACLQDLDLNLCTPQPAPLGTDLQGLQEDALSMKHEPPGLQASSTDDKKFTVKYPQNKDKLGKQPERAGEGAPCPAFSSHNSSSPPPLQNRKSPSPLAFCPCPPVNSISKELPFLLHAFYPGYPLLLPPPHLFTYGALPSDQCPHLLMLPQDPSYPTMAMPSLLMMVNELGHPSARWETLLPYPGAFQASGQALPSQARNPGAGAAPTDSPGLERGGMASPAKRVPLSSQTGTAALPYPLKKKNGKILYECNICGKSFGQLSNLKVHLRVHSGERPFQCALCQKSFTQLAHLQKHHLVHTGERPHKCSIPWVPGRNHWKSFQAWREREVCHKRFSSSSNLKTHLRLHSGARPFQCSVCRSRFTQHIHLKLHHRLHAPQPCGLVHTQLPLASLACLAQWHQGALDLMAVASEKHMGYDIDEVKVSSTSQGKARAVSLSSAGTPLVMGQDQNN

SEQ ID NO: 101017 - protein, 524 aa, Homo sapiens; identical to SEQ ID NO: 101016
  Payload ID: 20122
  Gene Name: zinc finger protein 683
  Uniprot ID: Q8IZ20
  ENSP ID: ENSP00000388792

SEQ ID NO: 101018 - protein, 197 aa, Homo sapiens
  Payload ID: 20122
  Gene Name: zinc finger protein 683
  ENSP ID: ENSP00000391584
MEAKGNGDMKEESAAQLGCCHRPMALGGTGGSLSPSLDFQLFRGDQVFSACRPLPDMVDAHGPSCASWLCPLPLAPGRSALLACLQDLDLNLCTPQPAPLGTDLQGLQEDALSMKHEPPGLQASSTDDKKFTVKYPQNKDKLGKQPERAGEGAPCPAFSSHNSSSPPPLQNRKSPSPLAFCPCPPVNSISKELPFLL

SEQ ID NO: 101019 - protein, 188 aa, Homo sapiens
  Payload ID: 20122
  Gene Name: zinc finger protein 683
  ENSP ID: ENSP00000401961
MKEESAAQLGCCHRPMALGGTGGSLSPSLDFQLFRGDQVFSACRPLPDMVDAHGPSCASWLCPLPLAPGRSALLACLQDLDLNLCTPQPAPLGTDLQGLQEDALSMKHEPPGLQASSTDDKKFTVKYPQNKDKLGKQPERAGEGAPCPAFSSHNSSSPPPLQNRKSPSPLAFCPCPPVNSISKELPFL

SEQ ID NO: 101020 - protein, 122 aa, Homo sapiens
  Payload ID: 20122
  Gene Name: zinc finger protein 683
  ENSP ID: ENSP00000406734
MKEESAAQLGCCHRPMALGGTGGSLSPSLDFQLFRGDQSTSHQGCRPAPPMTRNSQSSTHRTRTSWENSQKELARGPPAQPSPLITALPHHRCRTERAPAPWLSAPVPLSTPSPRSSHFSST

SEQ ID NO: 101021 - protein, 282 aa, Homo sapiens
  Payload ID: 20122
  Gene Name: zinc finger protein 683
  ENSP ID: ENSP00000411289
MEAKGNGDMKEESAAQLGCCHRPMALGGTGGSLSPSLDFQLFRGDQVFSACRPLPDMVDAHGPSCASWLCPLPLAPGRSALLACLQDLDLNLCTPQPAPLGTDLQGLQEDALSMKHEPPGLQASSTDDKKFTVKYPQNKDKLGKQPERAGEGAPCPAFSSHNSSSPPPLQNRKSPSPLAFCPCPPVNSISKELPFLLHAFYPGYPLLLPPPHLFTYGALPSDQCPHLLMLPQDPSYPTMAMPSLLMMVNELGHPSARWETLLPYPGAFQASGQALPSQARNP

SEQ ID NO: 101022 - protein, 269 aa, Homo sapiens
  Payload ID: 20122
  Gene Name: zinc finger protein 683
  ENSP ID: ENSP00000411290
MKEESAAQLGCCHRPMALGGTGGSLSPSLDFQLFRGDQVFSACRPLPDMVDAHGPSCASWLCPLPLAPGRSALLACLQDLDLNLCTPQPAPLGTDLQGLQEDALSMKHEPPGLQASSTDDKKFTVKYPQNKDKLGKQPERAGEGAPCPAFSSHNSSSPPPLQNRKSPSPLAFCPCPPVNSISKELPFLLHAFYPGYPLLLPPPHLFTYGALPSDQCPHLLMLPQDPSYPTMAMPSLLMMVNELGHPSARWETLLPYPGAFQASGQALPS

SEQ ID NO: 101023 - protein, 154 aa, Homo sapiens
  Payload ID: 20122
  Gene Name: zinc finger protein 683
  ENSP ID: ENSP00000412881
MKEESAAQLGCCHRPMALGGTGGSLSPSLDFQLFRGDQPAPLGTDLQGLQEDALSMKHEPPGLQASSTDDKKFTVKYPQNKDKLGKQPERAGEGAPCPAFSSHNSSSPPPLQNRKSPSPLAFCPCPPVNSISKELPFLLHAFYPGYPLLLPPPH

SEQ ID NO: 101024 - protein, 92 aa, Homo sapiens
  Payload ID: 20123
  Gene Name: zinc finger protein 684
  ENSP ID: ENSP00000361781
MISFQESVTFQDVAVDFTAEEWQLLDCAERTLYWDVMLENYRNLISVGCPITKTKVILKVEQGQEPWMVEGANPHESSPGWSAVAQSQLGFK

SEQ ID NO: 101025 - protein, 119 aa, Homo sapiens
  Payload ID: 20123
  Gene Name: zinc finger protein 684
  ENSP ID: ENSP00000361782
MISFQESVTFQDVAVDFTAEEWQLLDCAERTLYWDVMLENYRNLISVGCPITKTKVILKVEQGQEPWMVEGANPHESSPESRSVARLECSGAISARVQVILLPQPPEELELQAPATMPG

SEQ ID NO: 101026 - protein, 378 aa, Homo sapiens
  Payload ID: 20123
  Gene Name: zinc finger protein 684
  Uniprot ID: Q5T5D7
  ENSP ID: ENSP00000361784
MISFQESVTFQDVAVDFTAEEWQLLDCAERTLYWDVMLENYRNLISVGCPITKTKVILKVEQGQEPWMVEGANPHESSPESDYPLVDEPGKHRESKDNFLKSVLLTFNKILTMERIHHYNMSTSLNPMRKKSYKSFEKCLPPNLDLLKYNRSYTVENAYECSECGKAFKKKFHFIRHEKNHTRKKPFECNDCGKAYSRKAHLATHQKIHNGERPFVCNDCGKAFMHKAQLVVHQRLHTGEKPYECSQCGKTFTWNSSFNQHVKSHTLEKSFECKECGKTFRYSSSLYKHSRFHTGEKPYQCIICGKAFGNTSVLVTHQRIHTGEKPYSCIECGKAFIKKSHLLRHQITHTGEKPYECNRCGKAFSQKSNLIVHQKIHT

SEQ ID NO: 101027 - protein, 1237 aa, Homo sapiens
  Payload ID: 20124
  Gene Name: zinc finger protein 687
  Uniprot ID: Q8N1G0
  ENSP ID: ENSP00000319829
MGDMKTPDFDDLLAAFDIPDIDANEAIHSGPEENEGPGGPGKPEPGVGSESEDTAAASAGDGPGVPAQASDHGLPPPDISVVSVIVKNTVCPEQSEALAGGSAGDGAQAAGVTKEGPVGPHRMQNGFGSPEPSLPGTPHSPAPPSGGTWKEKGMEGKTPLDLFAHFGPEPGDHSDPLPPSAPSPTREGALTPPPFPSSFELAQENGPGMQPPVSSPPLGALKQESCSPHHPQVLAQQGSGSSPKATDIPASASPPPVAGVPFFKQSPGHQSPLASPKVPVCQPLKEEDDDEGPVDKSSPGSPQSPSSGAEAADEDSNDSPASSSSRPLKVRIKTIKTSCGNITRTVTQVPSDPDPPAPLAEGAFLAEASLLKLSPATPTSEGPKVVSVQLGDGTRLKGTVLPVATIQNASTAMLMAASVARKAVVLPGGTATSPKMIAKNVLGLVPQALPKADGRAGLGTGGQKVNGASVVMVQPSKTATGPSTGGGTVISRTQSSLVEAFNKILNSKNLLPAYRPNLSPPAEAGLALPPTGYRCLECGDAFSLEKSLARHYDRRSMRIEVTCNHCARRLVFFNKCSLLLHAREHKDKGLVMQCSHLVMRPVALDQMVGQPDITPLLPVAVPPVSGPLALPALGKGEGAITSSAITTVAAEAPVLPLSTEPPAAPATSAYTCFRCLECKEQCRDKAGMAAHFQQLGPPAPGATSNVCPTCPMMLPNRCSFSAHQRMHKNRPPHVCPECGGNFLQANFQTHLREACLHVSRRVGYRCPSCSVVFGGVNSIKSHIQTSHCEVFHKCPICPMAFKSGPSAHAHLYSQHPSFQTQQAKLIYKCAMCDTVFTHKPLLSSHFDQHLLPQRVSVFKCPSCPLLFAQKRTMLEHLKNTHQSGRLEETAGKGAGGALLTPKTEPEELAVSQGGAAPATEESSSSSEEEEVPSSPEPPRPAKRPRRELGSKGLKGGGGGPGGWTCGLCHSWFPERDEYVAHMKKEHGKSVKKFPCRLCERSFCSAPSLRRHVRVNHEGIKRVYPCRYCTEGKRTFSSRLILEKHVQVRHGLQLGAQSPGRGTTLARGSSARAQGPGRKRRQSSDSCSEEPDSTTPPAKSPRGGPGSGGHGPLRYRSSSSTEQSLMMGLRVEDGAQQCLDCGLCFASPGSLSRHRFISHKKRRGVGKASALGLGDGEEEAPPSRSDPDGGDSPLPASGGPLTCKVCGKSCDSPLNLKTHFRTHGMAFIRARQGAVGDN

SEQ ID NO: 101028 - protein, 1237 aa, Homo sapiens; identical to SEQ ID NO: 101027
  Payload ID: 20124
  Gene Name: zinc finger protein 687
  Uniprot ID: Q8N1G0
  ENSP ID: ENSP00000336620

SEQ ID NO: 101029 - protein, 147 aa, Homo sapiens
  Payload ID: 20124
  Gene Name: zinc finger protein 687
  ENSP ID: ENSP00000395261
MGRGLGSADMGDMKTPDFDDLLAAFDIPDIDANEAIHSGPEENEGPGGPGKPEPGVGSESEDTAAASAGDGPGVPAQASDHGLPPPDISVVSVIVKNTVCPEQSEALAGGSAGDGAQAAGVTKEGPVGPHRMQNGFGSPEPSLPGTP

SEQ ID NO: 101030 - protein, 706 aa, Homo sapiens
  Payload ID: 20124
  Gene Name: zinc finger protein 687
  ENSP ID: ENSP00000398821
  MOD_RES (1)..(1): Any amino acid
XTVLPVATIQNASTAMLMAASVARKAVVLPGGTATSPKMIAKNVLGLVPQALPKADGRAGLGTGGQKVNGASVVMVQPSKTATGPSTGGGTVISRTQSSLVEAFNKILNSKNLLPAYRPNLSPPAEAGLALPPTGYRCLECGDAFSLEKSLARHYDRRSMRIEVTCNHCARRLVFFNKCSLLLHAREHKDKGLVMQCSHLVMRPVALDQMVGQPDITPLLPVAVPPVSGPLALPALGKGEGAITSSAITTVAAEAPVLPLSTEPPAAPATSAYTCFRCLECKEQCRDKAGMAAHFQQLGPPAPGATSNVCPTCPMMLPNRCSFSAHQRMHKNRPPHVCPECGGNFLQANFQTHLREACLHVSRRVGYRCPSCSVVFGGVNSIKSHIQTSHCEVFHKCPICPMAFKSGPSAHAHLYSQHPSFQTQQAKLIYKCAMCDTVFTHKPLLSSHFDQHLLPQRVSVFKCPSCPLLFAQKRTMLEHLKNTHQSGRLEETAGKGAGGALLTPKTEPEELAVSQGGAAPATEESSSSSEEEEVPSSPEPPRPAKRPRRELGSKGLKGGGGGPGGWTCGLCHSWFPERDEYVAHMKKEHGKSVKKFPCRLCERSFCSAPSLRRHVRVNHEGIKRVYPCRSKGPGLRAVPLLPSCPLPFQVLHRGKTHLQQPPDPRETCPGPARLAAWGPVPWPGDHLGSGFQCQSPGARSETPPVF

SEQ ID NO: 101031 - protein, 785 aa, Homo sapiens
  Payload ID: 20124
  Gene Name: zinc finger protein 687
  ENSP ID: ENSP00000415286
MGDMKTPDFDDLLAAFDIPDIDANEAIHSGPEENEGPGGPGKPEPGVGSESEDTAAASAGDGPGVPAQASDHGLPPPDISVVSVIVKNTVCPEQSEALAGGSAGDGAQAAGVTKEGPVGPHRMQNGFGSPEPSLPGTPHSPAPPSGGTWKEKGMEGKTPLDLFAHFGPEPGDHSDPLPPSAPSPTREGALTPPPFPSSFELAQENGPGMQPPVSSPPLGALKQESCSPHHPQVLAQQGSGSSPKATDIPASASPPPVAGVPFFKQSPGHQSPLASPKVPVCQPLKEEDDDEGPVDKSSPGSPQSPSSGAEAADEDSNDSPASSSSRPLKVRIKTIKTSCGNITRTVTQVPSDPDPPAPLAEGAFLAEASLLKLSPATPTSEGPKVVSVQLGDGTRLKGTVLPVATIQNASTAMLMAASVARKAVVLPGGTATSPKMIAKNVLGLVPQALPKADGRAGLGTGGQKVNGASVVMVQPSKTATGPSTGGGTVISRTQSSLVEAFNKILNSKNLLPAYRPNLSPPAEAGLALPPTGYRCLECGDAFSLEKSLARHYDRRSMRIEVTCNHCARRLVFFNKCSLLLHAREHKDKGLVMQCSHLVMRPVALDQMVGQPDITPLLPVAVPPVSGPLALPALGKGEGAITSSAITTVAAEAPVLPLSTEPPAAPATSAYTCFRCLECKEQCRDKAGMAAHFQQLGPPAPGATSNVCPTCPMMLPNRCSFSAHQRMHKNRPPHVCPECGGNFLQANFQTHLREACLHVSRRVGYRTPISLGAWRRLLGKGPGVPC

SEQ ID NO: 101032 - protein, 99 aa, Homo sapiens
  Payload ID: 20124
  Gene Name: zinc finger protein 687
  ENSP ID: ENSP00000416942
RTFSSRLILEKHVQVRHGLQLGAQSPGRGTTLARGSSARAQFLPLFFRGQVGNAASLLTLAVRSLTARHRQPSPPGADLDLEAMALCATGAAAPQNRAS

SEQ ID NO: 101033 - protein, 276 aa, Homo sapiens
  Payload ID: 20125
  Gene Name: zinc finger protein 688
  Uniprot ID: P0C7X2
  ENSP ID: ENSP00000223459
MAPPPAPLLAPRPGETRPGCRKPGTVSFADVAVYFSPEEWGCLRPAQRALYRDVMQETYGHLGALGFPGPKPALISWMEQESEAWSPAAQDPEKGERLGGARRGDVPNRKEEEPEEVPRAKGPRKAPVKESPEVLVERNPDPAISVAPARAQPPKNAAWDPTTGAQPPAPIPSMDAQAGQRRHVCTDCGRRFTYPSLLVSHRRMHSGERPFPCPECGMRFKRKFAVEAHQWIHRSCSGGRRGRRPGIRAVPRAPVRGDRDPPVLFRHYPDIFEECG

SEQ ID NO: 101034 - protein, 262 aa, Homo sapiens
  Payload ID: 20125
  Gene Name: zinc finger protein 688
  Uniprot ID: P0C7X2
  ENSP ID: ENSP00000455227
MPRSPLRSSLSTEASGPRGPFKCPASPRPITAQLLPGSSPIIGRCVLRVQRGFPGPKPALISWMEQESEAWSPAAQDPEKGERLGGARRGDVPNRKEEEPEEVPRAKGPRKAPVKESPEVLVERNPDPAISVAPARAQPPKNAAWDPTTGAQPPAPIPSMDAQAGQRRHVCTDCGRRFTYPSLLVSHRRMHSGERPFPCPECGMRFKRKFAVEAHQWIHRSCSGGRRGRRPGIRAVPRAPVRGDRDPPVLFRHYPDIFEECG

SEQ ID NO: 101035 - protein, 142 aa, Homo sapiens
  Payload ID: 20125
  Gene Name: zinc finger protein 688
  ENSP ID: ENSP00000456047
  MOD_RES (1)..(1): Any amino acid
XATSRSQGFRYPLGSVFTRIHFIQAAALQPLPGFPGPKPALISWMEQESEAWSPAAQDPEKGERLGGARRGDVPNRKEEEPEEVPRAKGPRKAPVKESPEVLVERNPDPAISVAPARAQPPKNAAWDPTTGAQPPAPIPSMD

SEQ ID NO: 101036 - protein, 72 aa, Homo sapiens
  Payload ID: 20125
  Gene Name: zinc finger protein 688
  ENSP ID: ENSP00000456070
MAPPPAPLLAPRPGETRPGCRKPGTVSFADVAVYFSPEEWGCLRPAQRALYRDVMQETYGHLGALGPHFQHP

SEQ ID NO: 101037 - protein, 110 aa, Homo sapiens
  Payload ID: 20125
  Gene Name: zinc finger protein 688
  ENSP ID: ENSP00000457222
MAPPPAPLLAPRPGETRPGCRKPGTVSFADVAVYFSPEEWGCLRPAQRALYRDVMQETYGHLGALGFPGPKPALISWMEQESEAWSPAAQDPEKGERLGGARRGPHFQHP

SEQ ID NO: 101038 - protein, 500 aa, Homo sapiens
  Payload ID: 20126
  Gene Name: zinc finger protein 689
  Uniprot ID: Q96CS4
  ENSP ID: ENSP00000287461
MAPPSAPLPAQGPGKARPSRKRGRRPRALKFVDVAVYFSPEEWGCLRPAQRALYRDVMRETYGHLGALGCAGPKPALISWLERNTDDWEPAALDPQEYPRGLTVQRKSRTRKKNGEKEVFPPKEAPRKGKRGRRPSKPRLIPRQTSGGPICPDCGCTFPDHQALESHKCAQNLKKPYPCPDCGRRFSYPSLLVSHRRAHSGECPYVCDQCGKRFSQRKNLSQHQVIHTGEKPYHCPDCGRCFRRSRSLANHRTTHTGEKPHQCPSCGRRFAYPSLLAIHQRTHTGEKPYTCLECNRRFRQRTALVIHQRIHTGEKPYPCPDCERRFSSSSRLVSHRRVHSGERPYACEHCEARFSQRSTLLQHQLLHTGEKPYPCPDCGRAFRRSGSLAIHRSTHTEEKLHACDDCGRRFAYPSLLASHRRVHSGERPYACDLCSKRFAQWSHLAQHQLLHTGEKPFPCLECGRCFRQRWSLAVHKCSPKAPNCSPRSAIGGSSQRGNAH

SEQ ID NO: 101039 - protein, 498 aa, Homo sapiens
  Payload ID: 20126
  Gene Name: zinc finger protein 689
  ENSP ID: ENSP00000482634
MAPPSAPLPAQGPGKARPSRKRGRRPRALKFVDVAVYFSPEEWGCLRPAQRALYRDVMRETYGHLGALGCAGPKPALISWLERNTDDWEPAALDPQEYPRGLTVQRKSRTRKKNGEKEVFPPKEAPRKGKRGRRPSKPRLIPRQTSGGPICPDCGCTFPDHQALESHKCAQNLKKPYPCPDCGRRFSYPSLLVSHRRAHSGECPYVCDQCGKRFSQRKNLSQHQVIHTGEKPYHCPDCGRCFRRSRSLANHRTTHTGEKPHQCPSCGRRFAYPSLLAIHQRTHTGEKPYTCLECNRRFRQRTALVIHQRIHTGEKPYPCPDCERRFSSSSRLVSHRRVHSGERPYACEHCEARFSQRSTLLQHQLLHTGEKPYPCPDCGRAFRRSGSLAIHRSTHTEEKLHACDDCGRRFAYPSLLASHRRVHSGERPYACDLCSKRFAQWSHLAQHQLLHTGEKPFPCLEPVLPPEVVSAVHKCSPKAPNCSPRSAIGGSSQRGNAH

SEQ ID NO: 101040 - protein, 149 aa, Homo sapiens
  Payload ID: 20127
  Gene Name: zinc finger protein 69
  Uniprot ID: Q9UC07
  ENSP ID: ENSP00000345333
MPCCSHRRCREDPGTSESQEMEEWALLDISQRKLYKEVMLETFRNLTSVGKSWKDQNIEYEYQNPRRNFRSLIEKKVNEIKDDSHCGETFTQVPDDRLNFQEKKASPEIKSCDSFVCGEVGLGNSSFNMNIRGDIGHKAYEYQEYGPKP

SEQ ID NO: 101041 - protein, 154 aa, Homo sapiens
  Payload ID: 20127
  Gene Name: zinc finger protein 69
  ENSP ID: ENSP00000388784
MPCCSHRRCREDPGTSESQEMEEWALLDISQRKLYKEVMLETFRNLTSVGKSWKDQNIEYEYQNPRRNFRSLIEKKVNEIKDDSHCGETFTQVPDDRLNFQEKKASPEIKSCDSFVCGEVGLGNSSFNMNIRGDIGHKAYEYQEYGPKPCKCQQ

SEQ ID NO: 101042 - protein, 566 aa, Homo sapiens
  Payload ID: 20127
  Gene Name: zinc finger protein 69
  Uniprot ID: Q9UC07
  ENSP ID: ENSP00000402985
MPCCSHRRCREDPGTSESQEMDPVAFDDVAVNFTQEEWALLDISQRKLYKEVMLETFRNLTSVGKSWKDQNIEYEYQNPRRNFRSLIEKKVNEIKDDSHCGETFTQVPDDRLNFQEKKASPEIKSCDSFVCGEVGLGNSSFNMNIRGDIGHKAYEYQEYGPKPCKCQQPKKAFRYHPSFRTPQRDHTGEKPYACKECGKTFISHSSIQRHVVMHSGDGPYKCKFCGKAFHCLSLYLIHERIHTGEKPYECKQCGKSFSYSATLRIHERTHTGEKPYECQQCGKAFHSPRCYRRHERIHTGEKAYQCKECGKAFTCPQYVRIHERTHSRKKPYECTQCGKALSSLTSFQTHIRMHSGERPYECKICGKGFCSANSFQRHEKTHSGEKPYKCKQCGKAFIHSSSLRYHERIHTGEKPYECKQCGKAFRSSSHLQLHGRTHTGEKPYECQECGKAFRSMKNLQSHERTQTHVRIHSGERPYKCKLCGKGFYCPKSLQRHEKTHTGEKLYECKQCGEAFSSSSSFRYHERTHTGEKPYKCKQCGKAFRAASVLRMHGRTHPEDKPYECKQ

SEQ ID NO: 101043 - protein, 315 aa, Homo sapiens
  Payload ID: 20128
  Gene Name: zinc finger protein 691
  Uniprot ID: Q5VV52
  ENSP ID: ENSP00000361580
MSLCSPTHSAEMSLFLQGPEEMLPLSSEGSEMGSEKEQSPEPHLPEEGEGGKPWRVDDSEGSWIPPGEKEHGQESLSDELQETHPKKPWQKVTVRARELGDPIAHPRHEADEKPFICAQCGKTFNNTSNLRTHQRIHTGEKPYKCSECGKSFSRSSNRIRHERIHLEEKHYKCPKCQESFRRRSDLTTHQQDHLGKRPYRCDICGKSFSQSATLAVHHRTHLEPAPYICCECGKSFSNSSSFGVHHRTHTGERPYECTECGRTFSDISNFGAHQRTHRGEKPYRCTVCGKHFSRSSNLIRHQKTHLGEQAGKDSS

SEQ ID NO: 101044 - protein, 296 aa, Homo sapiens
  Payload ID: 20128
  Gene Name: zinc finger protein 691
  ENSP ID: ENSP00000361581
MSLCSPTHSAEMSLFLQGPEEMLPLSSEGSEMGSEKEQSPEPHLPEEGEGGKPWRVDDSEGSWIPPGEKEHGQESLSDELQETHPKKPWQKVTVRARELGDPIAHPRHEADEKPFICAQCGKTFNNTSNLRTHQRIHTGEKPYKCSECGKSFSRSSNRIRHERIHLEEKHYKCPKCQESFRRRSDLTTHQQDHLGKRPYRCDICGKSFSQSATLAVHHRTHLEPAPYICCECGKSFSNSSSFGVHHRTHTGERPYECTECGRTFSDISNFGAHQRTHRGEKPYRCTVCGKHFSRSS

SEQ ID NO: 101045 - protein, 306 aa, Homo sapiens
  Payload ID: 20128
  Gene Name: zinc finger protein 691
  ENSP ID: ENSP00000361582
MAQISSGGGGQSRCLLFALGSEMGSEKEQSPEPHLPEEGEGGKPWRVDDSEGSWIPPGEKEHGQESLSDELQETHPKKPWQKVTVRARELGDPIAHPRHEADEKPFICAQCGKTFNNTSNLRTHQRIHTGEKPYKCSECGKSFSRSSNRIRHERIHLEEKHYKCPKCQESFRRRSDLTTHQQDHLGKRPYRCDICGKSFSQSATLAVHHRTHLEPAPYICCECGKSFSNSSSFGVHHRTHTGERPYECTECGRTFSDISNFGAHQRTHRGEKPYRCTVCGKHFSRSSNLIRHQKTHLGEQAGKDSS

SEQ ID NO: 101046 - protein, 284 aa, Homo sapiens
  Payload ID: 20128
  Gene Name: zinc finger protein 691
  Uniprot ID: Q5VV52
  ENSP ID: ENSP00000361584
MGSEKEQSPEPHLPEEGEGGKPWRVDDSEGSWIPPGEKEHGQESLSDELQETHPKKPWQKVTVRARELGDPIAHPRHEADEKPFICAQCGKTFNNTSNLRTHQRIHTGEKPYKCSECGKSFSRSSNRIRHERIHLEEKHYKCPKCQESFRRRSDLTTHQQDHLGKRPYRCDICGKSFSQSATLAVHHRTHLEPAPYICCECGKSFSNSSSFGVHHRTHTGERPYECTECGRTFSDISNFGAHQRTHRGEKPYRCTVCGKHFSRSSNLIRHQKTHLGEQAGKDSS

SEQ ID NO: 101047 - protein, 284 aa, Homo sapiens; identical to SEQ ID NO: 101046
  Payload ID: 20128
  Gene Name: zinc finger protein 691
  Uniprot ID: Q5VV52
  ENSP ID: ENSP00000361585

SEQ ID NO: 101048 - protein, 284 aa, Homo sapiens; identical to SEQ ID NO: 101046
  Payload ID: 20128
  Gene Name: zinc finger protein 691
  Uniprot ID: Q5VV52
  ENSP ID: ENSP00000361586

SEQ ID NO: 101049 - protein, 133 aa, Homo sapiens
  Payload ID: 20128
  Gene Name: zinc finger protein 691
  ENSP ID: ENSP00000380228
MAQISSGGGGQSRCLLFALVLAICVHSQGSEMGSEKEQSPEPHLPEEGEGGKPWRVDDSEGSWIPPGEKEHGQESLSDELQETHPKKPWQKVTVRARELGDPIAHPRHEADEKPFICAQCGKTFNNTSNLRTH

SEQ ID NO: 101050 - protein, 306 aa, Homo sapiens; identical to SEQ ID NO: 101045
  Payload ID: 20128
  Gene Name: zinc finger protein 691
  ENSP ID: ENSP00000486871

SEQ ID NO: 101051 - protein, 519 aa, Homo sapiens
  Payload ID: 20129
  Gene Name: zinc finger protein 692
  Uniprot ID: Q9BU19
  ENSP ID: ENSP00000305483
MASSPAVDVSCRRREKRRQLDARRSKCRIRLGGHMEQWCLLKERLGFSLHSQLAKFLLDRYTSSGCVLCAGPEPLPPKGLQYLVLLSHAHSRECSLVPGLRGPGGQDGGLVWECSAGHTFSWGPSLSPTPSEAPKPASLPHTTRRSWCSEATSGQELADLESEHDERTQEARLPRRVGPPPETFPPPGEEEGEEEEDNDEDEEEMLSDASLWTYSSSPDDSEPDAPRLLPSPVTCTPKEGETPPAPAALSSPLAVPALSASSLSSRAPPPAEVRVQPQLSRTPQAAQQTEALASTGSQAQSAPTPAWDEDTAQIGPKRIRKAAKRELMPCDFPGCGRIFSNRQYLNHHKKYQHIHQKSFSCPEPACGKSFNFKKHLKEHMKLHSDTRDYICEFCARSFRTSSNLVIHRRIHTGEKPLQCEICGFTCRQKASLNWHQRKHAETVAALRFPCEFCGKRFEKPDSVAAHRSKSHPALLLAPQESPSGPLEPCPSISAPGPLGSSEGSRPSASPQAPTLLPQQ

SEQ ID NO: 101052 - protein, 474 aa, Homo sapiens
  Payload ID: 20129
  Gene Name: zinc finger protein 692
  Uniprot ID: Q9BU19
  ENSP ID: ENSP00000355427
MASSPAVDVSCRRREKRRQLDARRSKCRIRLGGHMEQWCLLKERLGFSLHSQLAKFLLDRYTSSGCVLCAGPEPLPPKGLQYLVLLSHAHSRECSLVPGLRGPGGQDGGLVWECSAGHTFSWGPSLSPTPSEAPKPASLPHTTRRSWCSEATSGQELADLESEHDERTQEARLPSSEPDAPRLLPSPVTCTPKEGETPPAPAALSSPLAVPALSASSLSSRAPPPAEVRVQPQLSRTPQAAQQTEALASTGSQAQSAPTPAWDEDTAQIGPKRIRKAAKRELMPCDFPGCGRIFSNRQYLNHHKKYQHIHQKSFSCPEPACGKSFNFKKHLKEHMKLHSDTRDYICEFCARSFRTSSNLVIHRRIHTGEKPLQCEICGFTCRQKASLNWHQRKHAETVAALRFPCEFCGKRFEKPDSVAAHRSKSHPALLLAPQESPSGPLEPCPSISAPGPLGSSEGSRPSASPQAPTLLPQQ

SEQ ID NO: 101053 - protein, 524 aa, Homo sapiens
  Payload ID: 20129
  Gene Name: zinc finger protein 692
  Uniprot ID: Q9BU19
  ENSP ID: ENSP00000391200
MPLVHMASSPAVDVSCRRREKRRQLDARRSKCRIRLGGHMEQWCLLKERLGFSLHSQLAKFLLDRYTSSGCVLCAGPEPLPPKGLQYLVLLSHAHSRECSLVPGLRGPGGQDGGLVWECSAGHTFSWGPSLSPTPSEAPKPASLPHTTRRSWCSEATSGQELADLESEHDERTQEARLPRRVGPPPETFPPPGEEEGEEEEDNDEDEEEMLSDASLWTYSSSPDDSEPDAPRLLPSPVTCTPKEGETPPAPAALSSPLAVPALSASSLSSRAPPPAEVRVQPQLSRTPQAAQQTEALASTGSQAQSAPTPAWDEDTAQIGPKRIRKAAKRELMPCDFPGCGRIFSNRQYLNHHKKYQHIHQKSFSCPEPACGKSFNFKKHLKEHMKLHSDTRDYICEFCARSFRTSSNLVIHRRIHTGEKPLQCEICGFTCRQKASLNWHQRKHAETVAALRFPCEFCGKRFEKPDSVAAHRSKSHPALLLAPQESPSGPLEPCPSISAPGPLGSSEGSRPSASPQAPTLLPQQ

SEQ ID NO: 101054 - protein, 105 aa, Homo sapiens
  Payload ID: 20129
  Gene Name: zinc finger protein 692
  ENSP ID: ENSP00000393552
MASSPAVDVSCRRREKRRQLDARRSKCRIRLGGHMEQWCLLKERLGFSLHSQLAKFLLDRYTSSGCVLCAAESAAWCPGFGGLAAKMGGLCGSAQQAIPSPGDPL

SEQ ID NO: 101055 - protein, 69 aa, Homo sapiens
  Payload ID: 20129
  Gene Name: zinc finger protein 692
  ENSP ID: ENSP00000431338
MASSPAVDVSCRRREKRRQLDARRSKCRIRLGGHMEQWCLLKERLGFSLHSQLAKFLLDRFLTLPGRPV

SEQ ID NO: 101056 - protein, 80 aa, Homo sapiens
  Payload ID: 20129
  Gene Name: zinc finger protein 692
  ENSP ID: ENSP00000431343
MASSPAVDVSCRRREKRRQLDARRSKCRIRLGGHMEQWCLLKERLGFSLHSQLAKFLLDRTACVTCGLRGSCSPPHGLSE

SEQ ID NO: 101057 - protein, 273 aa, Homo sapiens
  Payload ID: 20129
  Gene Name: zinc finger protein 692
  ENSP ID: ENSP00000431582
  MOD_RES (1)..(1): Any amino acid
XEPDAPRLLPSPVTCTPKEGETPPAPAALSSPLAVPALSASSLSSRAPPPAEVRVQPQLSRTPQAAQQTEALARKAAKRELMPCDFPGCGRIFSNRQYLNHHKKYQHIHQKSFSCPEPACGKSFNFKKHLKEHMKLHSDTRDYICEFCARSFRTSSNLVIHRRIHTGEKPLQCEICGFTCRQKASLNWHQRKHAETVAALRFPCEFCGKRFEKPDSVAAHRSKSHPALLLAPQESPSGPLEPCPSISAPGPLGSSEGSRPSASPQAPTLLPQQ

SEQ ID NO: 101058 - protein, 132 aa, Homo sapiens
  Payload ID: 20129
  Gene Name: zinc finger protein 692
  ENSP ID: ENSP00000432300
MASSPAVDVSCRRREKRRQLDARRSKCRIRLGGHMEQWCLLKERLGFSLHSQLAKFLLDRYTSSGCVLCAGPEPLPPKGLQYLVLLSHAHSRECSLVPGLRGPGGQDGGLVWECSAGHTFSWGPSLSPTPSE

SEQ ID NO: 101059 - protein, 79 aa, Homo sapiens
  Payload ID: 20129
  Gene Name: zinc finger protein 692
  ENSP ID: ENSP00000433522
  MOD_RES (1)..(1): Any amino acid
XKAAKRELMPCDFPGCGRIFSNRQYLNHHKKYQHIHQKSFSCPEPACGKSFNFKKHLKEHMKLHSGKGGPDGLHDLDNN

SEQ ID NO: 101060 - protein, 69 aa, Homo sapiens; identical to SEQ ID NO: 101055
  Payload ID: 20129
  Gene Name: zinc finger protein 692
  ENSP ID: ENSP00000434221

SEQ ID NO: 101061 - protein, 80 aa, Homo sapiens; identical to SEQ ID NO: 101056
  Payload ID: 20129
  Gene Name: zinc finger protein 692
  ENSP ID: ENSP00000434484

SEQ ID NO: 101062 - protein, 96 aa, Homo sapiens
  Payload ID: 20129
  Gene Name: zinc finger protein 692
  Uniprot ID: Q9BU19
  ENSP ID: ENSP00000436308
MASSPAVDVSCRRREKRRQLDARRSKCRIRLGGHMEQWCLLKERLGFSLHSQLAKFLLDRACPAALFHPQVSHFTRTACVTCGLRGSCSPPHGLSE

SEQ ID NO: 101063 - protein, 164 aa, Homo sapiens
  Payload ID: 20129
  Gene Name: zinc finger protein 692
  ENSP ID: ENSP00000436814
  MOD_RES (1)..(1): Any amino acid
XPEPLPPKGLQYLVLLSHAHSRECSLVPGLRGPGGQDGGLVWECSAGHTFSWGPSLSPTPSEAPKPASLPHTTRRSWCSEATSGQELADLESEHDERTQEARLPRRVGPPPETFPPPGEEEVVSLMPPDYCLPLSPAHLKRGRHHQPLQHSPVLLLCRPCQHPH

SEQ ID NO: 101064 - protein, 80 aa, Homo sapiens; identical to SEQ ID NO: 101056
  Payload ID: 20129
  Gene Name: zinc finger protein 692
  ENSP ID: ENSP00000437104

SEQ ID NO: 101065 - protein, 515 aa, Homo sapiens
  Payload ID: 20130
  Gene Name: zinc finger protein 695
  Uniprot ID: Q8IW36
  ENSP ID: ENSP00000341236
MGLLAFRDVALEFSPEEWECLDPAQRSLYRDVMLENYRNLISLGEDSFNMQFLFHSLAMSKPELIICLEARKEPWNVNTEKTARHSVLSSYLTEDILPEQGLQVSFQKVMLRRYERCCLEKLRLRNDWEIVGEWKGQKASYNGLDLCSATTHSKNFQCNKCVKGFSKFANLNKCKISHTGEKPFKCKECGNVSCMSLIMTQQQRIHIGENPYQCKKCGKAFNECSCFTDCKRIHVGEKHCKCEECNNIFKSCSSLAVVEKNHTEKKTYRCEECGKAFNLCSVLTKHKKIHTGEKPYKCEECGKSFKLFPYLTQHKRIHSREKPYKCEECGKVFKLLSYLTQHRRIHTGEKTFRCEECGKAFNQSSHLTEHRRIHTGEKPYKCEECGKAFTWFSYLIQHKRIHTGQKPYKCEECGKAFTWFSYLTQHKRIHTGEKPYKCDECGKAFNWFSYLTNHKRIHTGEKPYKCEECGKAFGQSSHLSKHKTIHTREKPYKCEECGKAFNHSAQLAVHEKTHT

SEQ ID NO: 101066 - protein, 133 aa, Homo sapiens
  Payload ID: 20130
  Gene Name: zinc finger protein 695
  Uniprot ID: Q8IW36
  ENSP ID: ENSP00000355460
MGLLAFRDVALEFSPEEWECLDPAQRSLYRDVMLENYRNLISLGEDSFNMQFLFHSLAMSKPELIICLEARKEPWNVNTEKTARHSVLSSYLTEDILPEQGLQVSFQKVMLRRYERCCLEKLRLRNDWEIVAM

SEQ ID NO: 101067 - protein, 88 aa, Homo sapiens
  Payload ID: 20130
  Gene Name: zinc finger protein 695
  ENSP ID: ENSP00000429540
MGLLAFRDVALEFSPEEWECLDPAQRSLYRDVMLENYRNLISLGEDSFNMQFLFHSLAMSKPELIICLEARKEPWNVNTEKTARHSAM

SEQ ID NO: 101068 - protein, 172 aa, Homo sapiens
  Payload ID: 20130
  Gene Name: zinc finger protein 695
  Uniprot ID: Q8IW36
  ENSP ID: ENSP00000429736
MGLLAFRDVALEFSPEEWECLDPAQRSLYRDVMLENYRNLISLGEDSFNMQFLFHSLAMSKPELIICLEARKEPWNVNTEKTARHSVLSSYLTEDILPEQGLQVSFQKVMLRRYERCCLEKLRLRNDWEIPCEDVLASPLPSAMILSFLRPPQKQKHVKPTEPVQSSTIELL

SEQ ID NO: 101069 - protein, 121 aa, Homo sapiens
  Payload ID: 20130
  Gene Name: zinc finger protein 695
  ENSP ID: ENSP00000430580
MGLLAFRDVALEFSPEEWECLDPAQRSLYRDVMLENYRNLISLGLAMSKPELIICLEARKEPWNVNTEKTARHSVLSSYLTEDILPEQGLQVSFQKVMLRRYERCCLEKLRLRNDWEIVAM

SEQ ID NO: 101070 - protein, 374 aa, Homo sapiens
  Payload ID: 20131
  Gene Name: zinc finger protein 696
  Uniprot ID: Q9H7X3
  ENSP ID: ENSP00000328515
MEPGGEPTGAKESSTLMESLAAVKAAFLAQAPSGSRSAEVQAAQSTEPAAEAGAPEGEGHRGGPPRALGSLGLCENQEARERPGGSPRGPVTSEKTGGQSGLESDVPPNAGPGAEGGGSWKGRPFPCGACGRSFKCSSDAAKHRSIHSGEKPYECSDCGKAFIHSSHVVRHQRAHSGERPYACAECGKAFGQSFNLLRHQRVHTGEKPYACADCGKAFGQRSDAAKHRRTHTGERLYACGECGKRFLHSSNVVRHRRTHHGENPYECRECGQAFSQSSNLLQHQRVHTGERPFACQDCGRAFSRSSFLREHRRIHTGEKPHQCGHCGRAFRALSGFFRHQRLHTGEKPFRCTECGRAFRLSFHLIQHRRVHGAE

SEQ ID NO: 101071 - protein, 204 aa, Homo sapiens
  Payload ID: 20131
  Gene Name: zinc finger protein 696
  ENSP ID: ENSP00000427857
MEPGGEPTGAKESSTLMESLAAVKAAFLAQAPSGSRSAEVQAAQSTEPAAEAGAPEGEGHRGGPPRALGSLGLCENQEARERPGGSPRGPVTSEKTGGQSGLESDVPPNAGPGAEGGGSWKGRPFPCGACGRSFKCSSDAAKHRSIHSGEKPYECSDCGKAFIHSSHVVRHQRAHSGERPYACAECGKAFGQSFNLLRHQRVHT

SEQ ID NO: 101072 - protein, 112 aa, Homo sapiens
  Payload ID: 20131
  Gene Name: zinc finger protein 696
  ENSP ID: ENSP00000428163
MRARSLKLFQLLVFCKMEPGGEPTGAKESSTLMESLAAVKAAFLAQAPSGSRSAEVQAAQSTEPAAEAGAPEGEGHRGGPPRALGSLGLCENQEARERPGGSPRGPVTSEKT

SEQ ID NO: 101073 - protein, 107 aa, Homo sapiens
  Payload ID: 20131
  Gene Name: zinc finger protein 696
  ENSP ID: ENSP00000428856
MEPGGEPTGAKESSTLMESLAAVKAAFLAQAPSGSRSAEVQAAQSTEPAAEAGAPEGEGHRGGPPRALGSLGLCENQEARERPGGSPRGPVTSEKTGGQSGLESDVP

SEQ ID NO: 101074 - protein, 37 aa, Homo sapiens
  Payload ID: 20131
  Gene Name: zinc finger protein 696
  ENSP ID: ENSP00000429859
MEPGGEPTGAKESSTLMESLAGEGTCPQSGPEFQGRN

SEQ ID NO: 101075 - protein, 53 aa, Homo sapiens
  Payload ID: 20131
  Gene Name: zinc finger protein 696
  ENSP ID: ENSP00000430952
MEPGGEPTGAKESSTLMESLAETGSHYVGQAGLELQVSSGPPASASESAEIQL

SEQ ID NO: 101076 - protein, 545 aa, Homo sapiens
  Payload ID: 20132
  Gene Name: zinc finger protein 697
  Uniprot ID: Q5TEC3
  ENSP ID: ENSP00000396857
MKQEDNQGVCAHQDSEDKGMGSDFEDSEDREGDPEEREMGSNPHDTNKREGHPEPEMGSNPQDSRHREAVPDICTEGQLSEEEGVSVRGEEDDQSGVADMAMFPGLSESDSISRSLREDDDESAGENRLEEEEEQPAPPVLPWRRHLSLGSRHRGDKPAHRRFHRLHHPMAVDLGELDSLVASIMDAPTICPDCGESFSPGAAFLQHQRIHRLAEAAAAASLEPFGLAGECDAMVGMMGVGVAGGFGAGPPLARPPREKPFRCGECGKGFSRNTYLTNHLRLHTGERPNLCADCGKSFSWRADLLKHRRLHTGEKPYPCPECGEAFSLSSHLLSHRRAHAAASGAGAAALRPFACGECGKGFVRRSHLANHQRIHTGEKPHGCGECGKRFSWRSDLVKHQRVHTGEKPYMCSECGETFSVSSHLFTHKRTHSGERPYVCRECGKGFGRNSHLVNHLRVHTGEKPFRCGQCEKRFSDFSTLTQHQRTHTGEKPYTCIECGKSFIQSSHLIRHRRIHTGNKPHKCAGCGKGFRYKTHLAQHQKLHLC

SEQ ID NO: 101077 - protein, 642 aa, Homo sapiens
  Payload ID: 20133
  Gene Name: zinc finger protein 699
  Uniprot ID: Q32M78
  ENSP ID: ENSP00000311596
MEEERKTAELQKNRIQDSVVFEDVAVDFTQEEWALLDLAQRNLYRDVMLENFQNLASLGYPLHTPHLISQWEQEEDLQTVKRELIQGIFMGEHREGFETQLKTNESVASQDICGEKISNEQKIVRFKRNDSWFSSLHENQESCGIDYQNKSHERHLRNHMVENIYECYEENQDGQTFSQVPNLDSLKRNTEVKSCECHECGKAFVDHSSLKSHIRSHTGSKPYQCKECGKAFHFLACFKKHMKTPTEEKPYECKECTKAFSCSSFFRAHMKIHIGKTNYECKECGKGFSCSSSLTEHKRIHSGDKPYECKECGKAFSCSSSLSKHKRIHSGDKPYECKECGKAFSSSSHLIIHIRIHTGEKPYECKECGKAFSESSKLTVHGRTHTGEKPYKCKECGKAYNCPSSLSIHMRKHTGEKPYECLECGKAFYLPTSLNTHVKNQSREKPYECKECGKAFSCPSSFRAHVRDHTGKIQYECKECGKTFSRSSSLTEHLRTHSGEKPYECKECGKAFISSSHLTVHIRTHTGEKPYECKKCGKAFIYPSALRIHMRTHTGEKPYECKECGKAFRHSSYLTVHARMHTGEKPFECLECGKAFSCPSSFRRHVRSHTGEKPYECKECGKAFVCPAYFRRHVKTHTRENI

SEQ ID NO: 101078 - protein, 642 aa, Homo sapiens; identical to SEQ ID NO: 101077
  Payload ID: 20133
  Gene Name: zinc finger protein 699
  Uniprot ID: Q32M78
  ENSP ID: ENSP00000467723

SEQ ID NO: 101079 - protein, 159 aa, Homo sapiens
  Payload ID: 20134
  Gene Name: zinc finger protein 7
  ENSP ID: ENSP00000318848
MGFLGCWCVSFQEVVTFGDVAVHFSREEWQCLDPGQRALYREVMLENHSSVAGLAGFLVFKPELISRLEQGEEPWVLDLQGAEGTEAPRTSKTGFLGRPTMGQEPRHPHAPPATPVPGLPKHCSQRLTLPPPGLSSSPLGHFLVHDQDRRRGTSAIWMV

SEQ ID NO: 101080 - protein, 697 aa, Homo sapiens
  Payload ID: 20134
  Gene Name: zinc finger protein 7
  Uniprot ID: P17097
  ENSP ID: ENSP00000393260
MGFLGCWCVSFQEVVTFGDVAVHFSREEWQCLDPGQRALYREVMLENHSSVAGLAGFLVFKPELISRLEQGEEPWVLDLQGAEGTEAPRTSKTDSTIRTENEQACEDMDILKSESYGTVVRISPQDFPQNPGFGDVSDSEVWLDSHLGSPGLKVTGFTFQNNCLNEETVVPKTFTKDAPQGCKELGSSGLDCQPLESQGESAEGMSQRCEECGKGIRATSDIALHWEINTQKISRCQECQKKLSDCLQGKHTNNCHGEKPYECAECGKVFRLCSQLNQHQRIHTGEKPFKCTECGKAFRLSSKLIQHQRIHTGEKPYRCEECGKAFGQSSSLIHHQRIHTGERPYGCRECGKAFSQQSQLVRHQRTHTGERPYPCKECGKAFSQSSTLAQHQRMHTGEKAQILKASDSPSLVAHQRIHAVEKPFKCDECGKAFRWISRLSQHQLIHTGEKPYKCNKCTKAFGCSSRLIRHQRTHTGEKPFKCDECGKGFVQGSHLIQHQRIHTGEKPYVCNDCGKAFSQSSSLIYHQRIHKGEKPYECLQCGKAFSMSTQLTIHQRVHTGERPYKCNECGKAFSQNSTLFQHQIIHAGVKPYECSECGKAFSRSSYLIEHQRIHTRAQWFYEYGNALEGSTFVSRKKVNTIKKLHQCEDCEKIFRWRSHLIIHQRIHTGEKPYKCNDCGKAFNRSSRLTQHQKIHMG

SEQ ID NO: 101081 - protein, 241 aa, Homo sapiens
  Payload ID: 20134
  Gene Name: zinc finger protein 7
  ENSP ID: ENSP00000432641
MEVVTFGDVAVHFSREEWQCLDPGQRALYREVMLENHSSVAGLAGFLVFKPELISRLEQGEEPWVLDLQGAEGTEAPRTSKTDSTIRTENEQACEDMDILKSESYGTVVRISPQDFPQNPGFGDVSDSEVWLDSHLGSPGLKVTGFTFQNNCLNEETVVPKTFTKDAPQGCKELGSSGLDCQPLESQGESAEGMSQRCEECGKGIRATSDIALHWEINTQKISRCQECQKKLSDCLQGKHT

SEQ ID NO: 101082 - protein, 686 aa, Homo sapiens
  Payload ID: 20134
  Gene Name: zinc finger protein 7
  Uniprot ID: P17097
  ENSP ID: ENSP00000432724
MEVVTFGDVAVHFSREEWQCLDPGQRALYREVMLENHSSVAGLAGFLVFKPELISRLEQGEEPWVLDLQGAEGTEAPRTSKTDSTIRTENEQACEDMDILKSESYGTVVRISPQDFPQNPGFGDVSDSEVWLDSHLGSPGLKVTGFTFQNNCLNEETVVPKTFTKDAPQGCKELGSSGLDCQPLESQGESAEGMSQRCEECGKGIRATSDIALHWEINTQKISRCQECQKKLSDCLQGKHTNNCHGEKPYECAECGKVFRLCSQLNQHQRIHTGEKPFKCTECGKAFRLSSKLIQHQRIHTGEKPYRCEECGKAFGQSSSLIHHQRIHTGERPYGCRECGKAFSQQSQLVRHQRTHTGERPYPCKECGKAFSQSSTLAQHQRMHTGEKAQILKASDSPSLVAHQRIHAVEKPFKCDECGKAFRWISRLSQHQLIHTGEKPYKCNKCTKAFGCSSRLIRHQRTHTGEKPFKCDECGKGFVQGSHLIQHQRIHTGEKPYVCNDCGKAFSQSSSLIYHQRIHKGEKPYECLQCGKAFSMSTQLTIHQRVHTGERPYKCNECGKAFSQNSTLFQHQIIHAGVKPYECSECGKAFSRSSYLIEHQRIHTRAQWFYEYGNALEGSTFVSRKKVNTIKKLHQCEDCEKIFRWRSHLIIHQRIHTGEKPYKCNDCGKAFNRSSRLTQHQKIHMG

SEQ ID NO: 101083 - protein, 134 aa, Homo sapiens
  Payload ID: 20134
  Gene Name: zinc finger protein 7
  ENSP ID: ENSP00000433218
MEVVTFGDVAVHFSREEWQCLDPGQRALYREVMLENHSSVAGLAGFLVFKPELISRLEQGEEPWVLDLQGAEGTEAPRTSKTAVEAGNLKPGGQQAGPCPPVKALGKDPVLPLRAAGGFLAVLGFLGLWMRPSL

SEQ ID NO: 101084 - protein, 146 aa, Homo sapiens
  Payload ID: 20134
  Gene Name: zinc finger protein 7
  ENSP ID: ENSP00000433630
MEVVTFGDVAVHFSREEWQCLDPGQRALYREVMLENHSSVAGLAFSDPTLWFGYLCPCFPRDGNLWAWPSRGAAAFPGFLVFKPELISRLEQGEEPWVLDLQGAEGTEAPRTSKTDSTIRTENEQACEDMDILKSESYGTVVRISP

SEQ ID NO: 101085 - protein, 156 aa, Homo sapiens
  Payload ID: 20134
  Gene Name: zinc finger protein 7
  ENSP ID: ENSP00000433656
MEVVTFGDVAVHFSREEWQCLDPGQRALYREVMLENHSSVAGLGFLVFKPELISRLEQGEEPWVLDLQGAEGTEAPRTSKTDSTIRTENEQACEDMDILKSESYGTVVRISPQDFPQNPGFGDVSDSEVWLDSHLGSPGLKVTGFTFQNNCLNEET

SEQ ID NO: 101086 - protein, 148 aa, Homo sapiens
  Payload ID: 20134
  Gene Name: zinc finger protein 7
  Uniprot ID: P17097
  ENSP ID: ENSP00000435252
MEVVTFGDVAVHFSREEWQCLDPGQRALYREVMLENHSSVAGLAGFLVFKPELISRLEQGEEPWVLDLQGAEGTEAPRTSKTGFLGRPTMGQEPRHPHAPPATPVPGLPKHCSQRLTLPPPGLSSSPLGHFLVHDQDRRRGTSAIWMV

SEQ ID NO: 101087 - protein, 86 aa, Homo sapiens
  Payload ID: 20134
  Gene Name: zinc finger protein 7
  ENSP ID: ENSP00000436231
MEVVTFGDVAVHFSREEWQCLDPGQRALYREVMLENHSSVAGLGFLVFKPELISRLEQGEEPWVLDLQGAEGTEAPRTSKTGETYK

SEQ ID NO: 101088 - protein, 590 aa, Homo sapiens
  Payload ID: 20134
  Gene Name: zinc finger protein 7
  ENSP ID: ENSP00000439424
MDILKSESYGTVVRISPQDFPQNPGFGDVSDSEVWLDSHLGSPGLKVTGFTFQNNCLNEETVVPKTFTKDAPQGCKELGSSGLDCQPLESQGESAEGMSQRCEECGKGIRATSDIALHWEINTQKISRCQECQKKLSDCLQGKHTNNCHGEKPYECAECGKVFRLCSQLNQHQRIHTGEKPFKCTECGKAFRLSSKLIQHQRIHTGEKPYRCEECGKAFGQSSSLIHHQRIHTGERPYGCRECGKAFSQQSQLVRHQRTHTGERPYPCKECGKAFSQSSTLAQHQRMHTGEKAQILKASDSPSLVAHQRIHAVEKPFKCDECGKAFRWISRLSQHQLIHTGEKPYKCNKCTKAFGCSSRLIRHQRTHTGEKPFKCDECGKGFVQGSHLIQHQRIHTGEKPYVCNDCGKAFSQSSSLIYHQRIHKGEKPYECLQCGKAFSMSTQLTIHQRVHTGERPYKCNECGKAFSQNSTLFQHQIIHAGVKPYECSECGKAFSRSSYLIEHQRIHTRAQWFYEYGNALEGSTFVSRKKVNTIKKLHQCEDCEKIFRWRSHLIIHQRIHTGEKPYKCNDCGKAFNRSSRLTQHQKIHMG

SEQ ID NO: 101089 - protein, 446 aa, Homo sapiens
  Payload ID: 20135
  Gene Name: zinc finger protein 70
  Uniprot ID: Q9UC06
  ENSP ID: ENSP00000339314
MEVPPATKFGETFAFENRLESQQGLFPGEDLGDPFLQERGLEQMAVIYKEIPLGEQDEENDDYEGNFSLCSSPVQHQSIPPGTRPQDDELFGQTFLQKSDLSMCQIIHSEEPSPCDCAETDRGDSGPNAPHRTPQPAKPYACRECGKAFSQSSHLLRHLVIHTGEKPYECCECGKAFSQSSHLLRHQIIHTGEKPYECRECGKAFRQSSALTQHQKIHTGKRPYECRECGKDFSRSSSLRKHERIHTGERPYQCKECGKSFNQSSGLSQHRKIHTLKKPHECDLCGKAFCHRSHLIRHQRIHTGKKPYKCDECGKAFSQSSNLIEHRKTHTGEKPYKCQKCGKAFSQSSSLIEHQRIHTGEKPYECCQCGKAFCHSSALIQHQRIHTGKKPYTCECGKAFRHRSALIEHYKTHTREKPYVCNLCGKSFRGSSHLIRHQKIHSGEKL

SEQ ID NO: 101090 - protein, 742 aa, Homo sapiens
  Payload ID: 20136
  Gene Name: zinc finger protein 700
  Uniprot ID: Q9H0M5
  ENSP ID: ENSP00000254321
MPCCSHRSCREDPGTSESREMDPVAFEDVAVNFTQEEWTLLDISQKNLFREVMLETFRNLTSIGKKWSDQNIEYEYQNPRRSFRSLIEEKVNEIKEDSHCGETFTQVPDDRLNFQEKKASPEVKSCDSFVCAEVGIGNSSFNMSIRGDTGHKAYEYQEYGPKPYKCQQPKNKKAFRYRPSIRTQERDHTGEKPYACKVCGKTFIFHSSIRRHMVMHSGDGTYKCKFCGKAFHSFSLYLIHERTHTGEKPYECKQCGKSFTYSATLQIHERTHTGEKPYECSKCDKAFHSSSSYHRHERSHMGEKPYQCKECGKAFAYTSSLRRHERTHSGKKPYECKQYGEGLSYLISFQTHIRMNSGERPYKCKICGKGFYSAKSFQTHEKTHTGEKRYKCKQCGKAFNLSSSFRYHERIHTGEKPYECKQCGKAFRSASQLRVHGGTHTGEKPYECKECGKAFRSTSHLRVHGRTHTGEKPYECKECGKAFRYVKHLQIHERTEKHIRMPSGERPYKCSICEKGFYSAKSFQTHEKTHTGEKPYECNQCGKAFRCCNSLRYHERTHTGEKPYECKQCGKAFRSASHLRMHERTHTGEKPYECKQCGKAFSCASNLRKHGRTHTGEKPYECKQCGKAFRSASNLQMHERTHTGEKPYECKECEKAFCKFSSFQIHERKHRGEKPYECKHCGNGFTSAKILQIHARTHIGEKHYECKECGKAFNYFSSLHIHARTHMGEKPYECKDCGKAFS

SEQ ID NO: 101091 - protein, 724 aa, Homo sapiens
  Payload ID: 20136
  Gene Name: zinc finger protein 700
  ENSP ID: ENSP00000467996
MFQDPVAFEDVAVNFTQEEWTLLDISQKNLFREVMLETFRNLTSIGKKWSDQNIEYEYQNPRRSFRSLIEEKVNEIKEDSHCGETFTQVPDDRLNFQEKKASPEVKSCDSFVCAEVGIGNSSFNMSIRGDTGHKAYEYQEYGPKPYKCQQPKNKKAFRYRPSIRTQERDHTGEKPYACKVCGKTFIFHSSIRRHMVMHSGDGTYKCKFCGKAFHSFSLYLIHERTHTGEKPYECKQCGKSFTYSATLQIHERTHTGEKPYECSKCDKAFHSSSSYHRHERSHMGEKPYQCKECGKAFAYTSSLRRHERTHSGKKPYECKQYGEGLSYLISFQTHIRMNSGERPYKCKICGKGFYSAKSFQTHEKTHTGEKRYKCKQCGKAFNLSSSFRYHERIHTGEKPYECKQCGKAFRSASQLRVHGGTHTGEKPYECKECGKAFRSTSHLRVHGRTHTGEKPYECKECGKAFRYVKHLQIHERTEKHIRMPSGERPYKCSICEKGFYSAKSFQTHEKTHTGEKPYECNQCGKAFRCCNSLRYHERTHTGEKPYECKQCGKAFRSASHLRMHERTHTGEKPYECKQCGKAFSCASNLRKHGRTHTGEKPYECKQCGKAFRSASNLQMHERTHTGEKPYECKECEKAFCKFSSFQIHERKHRGEKPYECKHCGNGFTSAKILQIHARTHIGEKHYECKECGKAFNYFSSLHIHARTHMGEKPYECKDCGKAFS

SEQ ID NO: 101092 - protein, 745 aa, Homo sapiens
  Payload ID: 20136
  Gene Name: zinc finger protein 700
  ENSP ID: ENSP00000479449
MPCCSHRSCREDPGTSESREMMFQDPVAFEDVAVNFTQEEWTLLDISQKNLFREVMLETFRNLTSIGKKWSDQNIEYEYQNPRRSFRSLIEEKVNEIKEDSHCGETFTQVPDDRLNFQEKKASPEVKSCDSFVCAEVGIGNSSFNMSIRGDTGHKAYEYQEYGPKPYKCQQPKNKKAFRYRPSIRTQERDHTGEKPYACKVCGKTFIFHSSIRRHMVMHSGDGTYKCKFCGKAFHSFSLYLIHERTHTGEKPYECKQCGKSFTYSATLQIHERTHTGEKPYECSKCDKAFHSSSSYHRHERSHMGEKPYQCKECGKAFAYTSSLRRHERTHSGKKPYECKQYGEGLSYLISFQTHIRMNSGERPYKCKICGKGFYSAKSFQTHEKTHTGEKRYKCKQCGKAFNLSSSFRYHERIHTGEKPYECKQCGKAFRSASQLRVHGGTHTGEKPYECKECGKAFRSTSHLRVHGRTHTGEKPYECKECGKAFRYVKHLQIHERTEKHIRMPSGERPYKCSICEKGFYSAKSFQTHEKTHTGEKPYECNQCGKAFRCCNSLRYHERTHTGEKPYECKQCGKAFRSASHLRMHERTHTGEKPYECKQCGKAFSCASNLRKHGRTHTGEKPYECKQCGKAFRSASNLQMHERTHTGEKPYECKECEKAFCKFSSFQIHERKHRGEKPYECKHCGNGFTSAKILQIHARTHIGEKHYECKECGKAFNYFSSLHIHARTHMGEKPYECKDCGKAFS

SEQ ID NO: 101093 - protein, 531 aa, Homo sapiens
  Payload ID: 20137
  Gene Name: zinc finger protein 701
  Uniprot ID: Q9NV72
  ENSP ID: ENSP00000301093
MGFLHVGQDGLELPTSGDPPASASQSAGITGVSHRTQPPCFEGLTSKDLVREEKTRKRKRKAKESGMALLQGLLTFRDVAIEFSQEEWKCLDPAQRTLYRDVMLENYRNLVSLDTSSKCMMKMFSSTGQGNTEVVHTGTLQIHASHHIGDTCFQEIEKDIHDFVFQWQENETNGHEALMTKTKKLMSSTERHDQRHAGNKPIKNELGSSFHSHLPEVHIFHPEGKIGNQVEKAINDAFSVSASQRISCRPKTRISNKYRNNFLQSSLLTQKREVHTREKSFQRNESGKAFNGSSLLKKHQIIHLGDKQYKCDVCGKDFHQKRYLACHRCHTGENPYTCNECGKTFSHNSALLVHKAIHTGEKPYKCNECGKVFNQQSNLARHHRVHTGEKPYKCEECDKVFSRKSHLERHRRIHTGEKPYKCKVCDKAFRRDSHLAQHTVIHTGEKPYKCNECGKTFVQNSSLVMHKVIHTGEKRYKCNECGKVFNHKSNLACHRRLHTGEKPYKCNECGKVFNRKSNLERHHRLHTGKKS

SEQ ID NO: 101094 - protein, 465 aa, Homo sapiens
  Payload ID: 20137
  Gene Name: zinc finger protein 701
  Uniprot ID: Q9NV72
  ENSP ID: ENSP00000375662
MALLQGLLTFRDVAIEFSQEEWKCLDPAQRTLYRDVMLENYRNLVSLDTSSKCMMKMFSSTGQGNTEVVHTGTLQIHASHHIGDTCFQEIEKDIHDFVFQWQENETNGHEALMTKTKKLMSSTERHDQRHAGNKPIKNELGSSFHSHLPEVHIFHPEGKIGNQVEKAINDAFSVSASQRISCRPKTRISNKYRNNFLQSSLLTQKREVHTREKSFQRNESGKAFNGSSLLKKHQIIHLGDKQYKCDVCGKDFHQKRYLACHRCHTGENPYTCNECGKTFSHNSALLVHKAIHTGEKPYKCNECGKVFNQQSNLARHHRVHTGEKPYKCEECDKVFSRKSHLERHRRIHTGEKPYKCKVCDKAFRRDSHLAQHTVIHTGEKPYKCNECGKTFVQNSSLVMHKVIHTGEKRYKCNECGKVFNHKSNLACHRRLHTGEKPYKCNECGKVFNRKSNLERHHRLHTGKKS

SEQ ID NO: 101095 - protein, 531 aa, Homo sapiens; identical to SEQ ID NO: 101093
  Payload ID: 20137
  Gene Name: zinc finger protein 701
  Uniprot ID: Q9NV72
  ENSP ID: ENSP00000444339

SEQ ID NO: 101096 - protein, 212 aa, Homo sapiens
  Payload ID: 20137
  Gene Name: zinc finger protein 701
  ENSP ID: ENSP00000471080
MGFLHVGQDGLELPTSGDPPASASQSAGITGVSHRTQPPCFEGLTSKDLVREEKTRKRKRKAKESGMALLQGLLTFRDVAIEFSQEEWKCLDPAQRTLYRDVMLENYRNLVSLDTSSKCMMKMFSSTGQGNTEVVHTGTLQIHASHHIGDTCFQEIEKDIHDFVFQWQENETNGHEALMTKTKKLMSSTERHDQRHAGNKPIKNELGSSFHS

SEQ ID NO: 101097 - protein, 145 aa, Homo sapiens
  Payload ID: 20137
  Gene Name: zinc finger protein 701
  ENSP ID: ENSP00000472955
MSQLNLKQIIVSLCPPGCECSLVILAHCNLCLLSSSNSCALVSQVAEITGLTSKDLVREEKTRKRKRKAKESGMALLQGLLTFRDVAIEFSQEEWKCLDPAQRTLYRDVMLENYRNLVSLDTSSKCMMKMFSSTGQGNTEVVHTG

SEQ ID NO: 101098 - protein, 590 aa, Homo sapiens
  Payload ID: 20138
  Gene Name: zinc finger protein 703
  Uniprot ID: Q9H7S9
  ENSP ID: ENSP00000332325
MSDSPAGSNPRTPESSGSGSGGGGKRPAVPAAVSLLPPADPLRQANRLPIRVLKMLSAHTGHLLHPEYLQPLSSTPVSPIELDAKKSPLALLAQTCSQIGKPDPPPSSKLNSVAAAANGLGAEKDPGRSAPGAASAAAALKQLGDSPAEDKSSFKPYSKGSGGGDSRKDSGSSSVSSTSSSSSSSPGDKAGFRVPSAACPPFPPHGAPVSASSSSSSPGGSRGGSPHHSDCKNGGGVGGGELDKKDQEPKPSPEPAAVSRGGGGEPGAHGGAESGASGRKSEPPSALVGAGHVAPVSPYKPGHSVFPLPPSSIGYHGSIVGAYAGYPSQFVPGLDPSKSGLVGGQLSGGLGLPPGKPPSSSPLTGASPPSFLQGLCRDPYCLGGYHGASHLGGSSCSTCSAHDPAGPSLKAGGYPLVYPGHPLQPAALSSSAAQAALPGHPLYTYGFMLQNEPLPHSCNWVAASGPCDKRFATSEELLSHLRTHTALPGAEKLLAAYPGASGLGSAAAAAAAAASCHLHLPPPAAPGSPGSLSLRNPHTLGLSRYHPYGKSHLSTAGGLAVPSLPTAGPYYSPYALYGQRLASASALGYQ

SEQ ID NO: 101099 - protein, 412 aa, Homo sapiens
  Payload ID: 20139
  Gene Name: zinc finger protein 704
  Uniprot ID: Q6ZNC4
  ENSP ID: ENSP00000331462
MTFTFQSEDLKRDCGKKMSHQHVFSLAMEEDVKTADTKKASRILDHEKENTRSICLLEQKRKVVSSNIDVPPARKSSEELDMDKVTAAMVLTSLSTSPLVRSPPVRPNESLSGSWKEGGCVPSSTSSSGYWSWSAPSDQSNPSTPSPPLSADSFKPFRSPAQPDDGIDEAEASNLLFDEPIPRKRKNSMKVMFKCLWKNCGKVLSTAAGIQKHIRTIHLGRVGDSDYSDGEEDFYYTEIKLNTDSVADGLSSLAPVSPSQSLASPPTFPIPDSSRTETPCAKTETKLMTPLSRSAPTTLYLVHTDHAYQATPPVTIPGSAKFTPNGSSFSISWQSPPVTFTGIPVSPTHHPVGTGEQRQHAHTVLSSPPRGTVSLRKPRGEGKKCRKVYGMENRDMWCTACRWKKACQRFLD

SEQ ID NO: 101100 - protein, 189 aa, Homo sapiens
  Payload ID: 20139
  Gene Name: zinc finger protein 704
  ENSP ID: ENSP00000427715
MTFTFQSEDLKRDCGKKMSHQHVFSLAMEEDVKTADTKKASRILDHEKENTRSICLLEQKRKVVSSNIDVPPARKSSEELDMDKVTAAMVLTSLSTSPLVRSPPVRPNESLSGSWKEGGCVPSSTSSSGYWSWSAPSDQSNPSTPSPPLSADSFKPFRSPAQPDDGIDEAEASNLLFDEPIPRKRKNSM

SEQ ID NO: 101101 - protein, 300 aa, Homo sapiens
  Payload ID: 20140
  Gene Name: zinc finger protein 705A
  Uniprot ID: Q6ZN79
  ENSP ID: ENSP00000352233
MHSLKKVTFEDVAIDFTQEEWAMMDTSKRKLYRDVMLENISHLVSLGYQISKSYIILQLEQGKELWREGREFLQDQNPDRESALKKKHMISMHPITRKDASTSMTMENSLILEDPFECNDSGEDCTHSSTITQRLLTHSGKKPYVSKQCGKSLRNLFSPKPHKQIHTKGKSYQCNLCEKAYTNCFRLRRHKMTHTGERPYACHLCGKAFTQCSHLRRHEKTHTGERPYKCHQCGKAFIQSFNLRRHERTHLGKKCYECDKSGKAFSQSSGFRGNKIIHTGEKPHACLLCGKAFSLSSDLR

SEQ ID NO: 101102 - protein, 207 aa, Homo sapiens
  Payload ID: 20140
  Gene Name: zinc finger protein 705A
  ENSP ID: ENSP00000379816
MHSLKKVTFEDVAIDFTQEEWAMMDTSKRKLYRDVMLENISHLVSLGYQISKSYIILQLEQGKELWREGREFLQDQNPDRESALKKKHMISMHPITRKDASTSMTMENSLILEDPFECNDSGEDCTHSSTITQRLLTHSGKKPYVSKQCGKSLRNLFSPKPHKQIHTKGKSYQCNLCEKAYTNCFRLRRHKMTHTGERPYACHLCGK

SEQ ID NO: 101103 - protein, 77 aa, Homo sapiens
  Payload ID: 20140
  Gene Name: zinc finger protein 705A
  ENSP ID: ENSP00000384896
MHSLKKVTFEDVAIDFTQEEWAMMDTSKRKLYRDVMLENISHLVSLGYQISKSYIILQLEQGKELWREGREFLQDQN

SEQ ID NO: 101104 - protein, 101 aa, Homo sapiens
  Payload ID: 20140
  Gene Name: zinc finger protein 705A
  ENSP ID: ENSP00000475525
  MOD_RES (1)..(1): Any amino acid
XDRESALKKKHMISMHPITRKDASTSMTMENSLILEDPFECNDSGEDCTHSSTITQRLLTHSGKKPYVSKQCGKSLRNLFSPKPHKQIHTKGNPTSSWMSG

SEQ ID NO: 101105 - protein, 300 aa, Homo sapiens; identical to SEQ ID NO: 101101
  Payload ID: 20140
  Gene Name: zinc finger protein 705A
  Uniprot ID: Q6ZN79
  ENSP ID: ENSP00000481663

SEQ ID NO: 101106 - protein, 300 aa, Homo sapiens
  Payload ID: 20141
  Gene Name: zinc finger protein 705B
  Uniprot ID: P0CI00
  ENSP ID: ENSP00000382987
MHSLEKVTFEDVAIDFTQEEWDMMDTSKRKLYRDVMLENISHLVSLGYQISKSYIILQLEQGKELWWEGRVFLQDQNPDRESALKKKHMISMHPIIRKDTSTSMTMENSLILEDPFEYNDSGEDCTHSSTITQCLLTHSGKKPCVSKQCGKSLRNLLSPKPRKQIHTKGKSYQCNLCEKAYTNCFYLRRHKMTHTGERPYACHLCGKAFTQCSHLRRHEKTHTGERPYKCHQCGKAFIQSFNLRRHERTHLGQKCYECDKSGKAFSQSSGFRGNKIIHIGEKPPACLLCGKAFSLSSDLR

SEQ ID NO: 101107 - protein, 300 aa, Homo sapiens
  Payload ID: 20142
  Gene Name: zinc finger protein 705D
  Uniprot ID: P0CH99
  ENSP ID: ENSP00000382957
MHSLEKVTFEDVAIDFTQEEWDMMDTSKRKLYRDVMLENISHLVSLGYQISKSYIILQLEQGKELWREGRVFLQDQNPDRESALKKKHMISMHPIIRKDASTSMTMENSLILEDPFEYNDSGEDCTHSSTITQCLLTHSGKKPCVSKQCGKSLRNLLSPKPRKQIHTKGKSYQCNLCEKAYTNCFYLRRHKMTHTGERPYACHLCGKAFTQCSHLRRHEKTHTGERPYKCHQCGKAFIQSFNLRRHERTHLGQKCYECDKSGKAFSQSSGFRGNKIIHIGEKPHACLLCGKAFSLSSDLR

SEQ ID NO: 101108 - protein, 300 aa, Homo sapiens; identical to SEQ ID NO: 101107
  Payload ID: 20142
  Gene Name: zinc finger protein 705D
  Uniprot ID: P0CH99
  ENSP ID: ENSP00000445477

SEQ ID NO: 101109 - protein, 300 aa, Homo sapiens
  Payload ID: 20143
  Gene Name: zinc finger protein 705G
  Uniprot ID: A8MUZ8
  ENSP ID: ENSP00000383020
MHSLKKLTFEDVAIDFTQEEWAMMDTSKRKLYRDVMLENISHLVSLGYQISKSYIILQLEQGKELWREGRVFLQDQNPNRESALKKTHMISMHPITRKDASTSMTMENSLILEDPFECNDSGEDCTRSSTITQCLLTHSGKKPYVSKQCGKSLRNLLSTEPHKQIHTKGKSYQCNLCEKAYTNCFHLRRHKMTHTGERPYACHLCRKAFTQCSHLRRHEKTHTGQRPYKCHQYGKVFIQSFNLQRHERTHLGKKCYECDKSGKAFSQSSGFRGNKIIHTGEKPHACLLCGKAFSLSSNLR

SEQ ID NO: 101110 - protein, 300 aa, Homo sapiens
  Payload ID: 20143
  Gene Name: zinc finger protein 705G
  ENSP ID: ENSP00000479140
MHSLEKVTFEDVAIDFTQEEWDMMDTSKRKLYRDVMLENISHLVSLGYQISKSYIILQLEQGKELWWEGRVFLQDQNPDRESALKKKHMISMHPIIRKDTSTSMTMENSLILEDPFEYNDSGEDCTHSSTITQCLLTHSGKKPCVSKQCGKSLRNLLSPKPRKQIHTKGKSYQCNLCEKAYTNCFYLRRHKMTHTGERPYACHLCGKAFTQCSHLRRHEKTHTGERPYKCHQCGKAFIQSFNLRRHERTHLGQKCYECDKSGKAFSQSSGFRGNKIIHIGEKPHACLLCGKAFSLSSDLR

SEQ ID NO: 101111 - protein, 76 aa, Homo sapiens
  Payload ID: 20144
  Gene Name: zinc finger protein 706
  Uniprot ID: Q9Y5V0
  ENSP ID: ENSP00000311768
MARGQQKIQSQQKNAKKQAGQKKKQGHDQKAAAKAALIYTCTVCRTQMPDPKTFKQHFESKHPKTPLPPELADVQA

SEQ ID NO: 101112 - protein, 76 aa, Homo sapiens; identical to SEQ ID NO: 101111
  Payload ID: 20144
  Gene Name: zinc finger protein 706
  Uniprot ID: Q9Y5V0
  ENSP ID: ENSP00000427761

SEQ ID NO: 101113 - protein, 51 aa, Homo sapiens
  Payload ID: 20144
  Gene Name: zinc finger protein 706
  ENSP ID: ENSP00000427803
QKAAAKAALIYTCTVCRLSFAQFFVRHKCQTLRPSSSTLRASILRLHFLQN

SEQ ID NO: 101114 - protein, 76 aa, Homo sapiens; identical to SEQ ID NO: 101111
  Payload ID: 20144
  Gene Name: zinc finger protein 706
  Uniprot ID: Q9Y5V0
  ENSP ID: ENSP00000428227

SEQ ID NO: 101115 - protein, 76 aa, Homo sapiens; identical to SEQ ID NO: 101111
  Payload ID: 20144
  Gene Name: zinc finger protein 706
  Uniprot ID: Q9Y5V0
  ENSP ID: ENSP00000428696

SEQ ID NO: 101116 - protein, 76 aa, Homo sapiens; identical to SEQ ID NO: 101111
  Payload ID: 20144
  Gene Name: zinc finger protein 706
  Uniprot ID: Q9Y5V0
  ENSP ID: ENSP00000428985

SEQ ID NO: 101117 - protein, 42 aa, Homo sapiens
  Payload ID: 20144
  Gene Name: zinc finger protein 706
  ENSP ID: ENSP00000429260
MARGQQKIQSQQKNAKKQAGQKKKQGHDQKAAAKAALIYTCT

SEQ ID NO: 101118 - protein, 48 aa, Homo sapiens
  Payload ID: 20144
  Gene Name: zinc finger protein 706
  ENSP ID: ENSP00000429645
MARGQQKIQSQQKNAKKQAGQKKKQGHDQKAAAKAALIYTCTVCRVNS

SEQ ID NO: 101119 - protein, 8 aa, Homo sapiens
  Payload ID: 20144
  Gene Name: zinc finger protein 706
  ENSP ID: ENSP00000430090
MARGQQKI

SEQ ID NO: 101120 - protein, 76 aa, Homo sapiens; identical to SEQ ID NO: 101111
  Payload ID: 20144
  Gene Name: zinc finger protein 706
  Uniprot ID: Q9Y5V0
  ENSP ID: ENSP00000430165

SEQ ID NO: 101121 - protein, 76 aa, Homo sapiens; identical to SEQ ID NO: 101111
  Payload ID: 20144
  Gene Name: zinc finger protein 706
  Uniprot ID: Q9Y5V0
  ENSP ID: ENSP00000430823

SEQ ID NO: 101122 - protein, 53 aa, Homo sapiens
  Payload ID: 20144
  Gene Name: zinc finger protein 706
  ENSP ID: ENSP00000430845
MARGQQKIQSQQKNAKKQAGQKKKQGHDQKAAAKAALIYTCTVCRKSKLTNGN

SEQ ID NO: 101123 - protein, 30 aa, Homo sapiens
  Payload ID: 20144
  Gene Name: zinc finger protein 706
  ENSP ID: ENSP00000431059
  MOD_RES (1)..(1): Any amino acid
XMPDPKTFKQHFESKHPKTPLPPELADVQA

SEQ ID NO: 101124 - protein, 371 aa, Homo sapiens
  Payload ID: 20145
  Gene Name: zinc finger protein 707
  Uniprot ID: Q96C28
  ENSP ID: ENSP00000351482
MDMAQEPVTFRDVAIYFSREEWACLEPSQRALYRDVMLDNFSSVAALGFCSPRPDLVSRLEQWEEPWVEDRERPEFQAVQRGPRPGARKSADPKRPCDHPAWAHKKTHVRRERAREGSSFRKGFRLDTDDGQLPRAAPERTDAKPTAFPCQVLTQRCGRRPGRRERRKQRAVELSFICGTCGKALSCHSRLLAHQTVHTGTKAFECPECGQTFRWASNLQRHQKNHTREKPFCCEACGQAFSLKDRLAQHRKVHTEHRPYSCGDCGKAFKQKSNLLRHQLVHTGERPFYCADCGKAFRTKENLSHHQRVHSGEKPYTCAECGKSFRWPKGFSIHRRLHLTKRFYECGHCGKGFRHLGFFTRHQRTHRHGEV

SEQ ID NO: 101125 - protein, 55 aa, Homo sapiens
  Payload ID: 20145
  Gene Name: zinc finger protein 707
  ENSP ID: ENSP00000393748
MDMAQEPVTFRDVAIYFSREEWACLEPSQRALYRDVMLDNFSSVAALGEHGLSAA

SEQ ID NO: 101126 - protein, 371 aa, Homo sapiens; identical to SEQ ID NO: 101124
  Payload ID: 20145
  Gene Name: zinc finger protein 707
  Uniprot ID: Q96C28
  ENSP ID: ENSP00000413215

SEQ ID NO: 101127 - protein, 55 aa, Homo sapiens; identical to SEQ ID NO: 101125
  Payload ID: 20145
  Gene Name: zinc finger protein 707
  ENSP ID: ENSP00000434215

SEQ ID NO: 101128 - protein, 55 aa, Homo sapiens; identical to SEQ ID NO: 101125
  Payload ID: 20145
  Gene Name: zinc finger protein 707
  ENSP ID: ENSP00000434322

SEQ ID NO: 101129 - protein, 79 aa, Homo sapiens
  Payload ID: 20145
  Gene Name: zinc finger protein 707
  ENSP ID: ENSP00000434503
MDMAQEPVTFRDVAIYFSREEWACLEPSQRALYRDVMLDNFSSVAALGFCSPRPDLVSRLEQWEEPWVEDRERPEFQAV

SEQ ID NO: 101130 - protein, 55 aa, Homo sapiens; identical to SEQ ID NO: 101125
  Payload ID: 20145
  Gene Name: zinc finger protein 707
  ENSP ID: ENSP00000434791

SEQ ID NO: 101131 - protein, 92 aa, Homo sapiens
  Payload ID: 20145
  Gene Name: zinc finger protein 707
  ENSP ID: ENSP00000435251
MDMAQEPVTFRDVAIYFSREEWACLEPSQRALYRDVMLDNFSSVAALGFCSPRPDLVSRLEQWEEPWVEDRERPEFQAVQRGPRPEWDGAAM

SEQ ID NO: 101132 - protein, 55 aa, Homo sapiens; identical to SEQ ID NO: 101125
  Payload ID: 20145
  Gene Name: zinc finger protein 707
  ENSP ID: ENSP00000435679

SEQ ID NO: 101133 - protein, 145 aa, Homo sapiens
  Payload ID: 20145
  Gene Name: zinc finger protein 707
  ENSP ID: ENSP00000435906
MLDNFSSVAALGFCSPRPDLVSRLEQWEEPWVEDRERPEFQAVQRGPRPGARKSADPKRPCDHPAWAHKKTHVRRERAREGSSFRKGFRLDTDDGQLPRAAPERTDAKPTAFPCQVLTQRCGRRPGRRERRKQRAVELSFICGTC

SEQ ID NO: 101134 - protein, 371 aa, Homo sapiens; identical to SEQ ID NO: 101124
  Payload ID: 20145
  Gene Name: zinc finger protein 707
  Uniprot ID: Q96C28
  ENSP ID: ENSP00000436212

SEQ ID NO: 101135 - protein, 371 aa, Homo sapiens; identical to SEQ ID NO: 101124
  Payload ID: 20145
  Gene Name: zinc finger protein 707
  Uniprot ID: Q96C28
  ENSP ID: ENSP00000436250

SEQ ID NO: 101136 - protein, 134 aa, Homo sapiens
  Payload ID: 20145
  Gene Name: zinc finger protein 707
  ENSP ID: ENSP00000436362
MDMAQEPVTFRDVAIYFSREEWACLEPSQRALYRDVMLDNFSSVAALAPDQTSSLAWNSGRSRGLKTGRDLSSRQCRGDPGQGQGSLQTPRDLVIIQLGLTRKPTCGEKEPGKEAALGRASGWTRMTGSFPELL

SEQ ID NO: 101137 - protein, 103 aa, Homo sapiens
  Payload ID: 20145
  Gene Name: zinc finger protein 707
  ENSP ID: ENSP00000436394
MDMAQEPVTFRDVAIYFSREEWACLEPSQRALYRDVMLDNFSSVAALGFCSPRPDLVSRLEQWEEPWVEDRERPEFQAVQRGPRPATQVLSGGGHWCGCLTSL

SEQ ID NO: 101138 - protein, 47 aa, Homo sapiens
  Payload ID: 20145
  Gene Name: zinc finger protein 707
  ENSP ID: ENSP00000436634
MDMAQEPVTFRDVAIYFSREEWACLEPSQRALYRDVMLDNFSSVAAL

SEQ ID NO: 101139 - protein, 141 aa, Homo sapiens
  Payload ID: 20145
  Gene Name: zinc finger protein 707
  ENSP ID: ENSP00000437134
MDMAQEPVTFRDVAIYFSREEWACLEPSQRALYRDVMLDNFSSVAALGFCSPRPDLVSRLEQWEEPWVEDRERPEFQAVQRGPRPGARKSADPKRPCDHPAWAHKKTHVRRERAREGSSFRKGFRLDTDDGQLPRAAPERT

SEQ ID NO: 101140 - protein, 371 aa, Homo sapiens; identical to SEQ ID NO: 101124
  Payload ID: 20145
  Gene Name: zinc finger protein 707
  Uniprot ID: Q96C28
  ENSP ID: ENSP00000481033

SEQ ID NO: 101141 - protein, 371 aa, Homo sapiens; identical to SEQ ID NO: 101124
  Payload ID: 20145
  Gene Name: zinc finger protein 707
  Uniprot ID: Q96C28
  ENSP ID: ENSP00000481069

SEQ ID NO: 101142 - protein, 371 aa, Homo sapiens; identical to SEQ ID NO: 101124
  Payload ID: 20145
  Gene Name: zinc finger protein 707
  Uniprot ID: Q96C28
  ENSP ID: ENSP00000484032

SEQ ID NO: 101143 - protein, 371 aa, Homo sapiens; identical to SEQ ID NO: 101124
  Payload ID: 20145
  Gene Name: zinc finger protein 707
  Uniprot ID: Q96C28
  ENSP ID: ENSP00000484744

SEQ ID NO: 101144 - protein, 145 aa, Homo sapiens; identical to SEQ ID NO: 101133
  Payload ID: 20145
  Gene Name: zinc finger protein 707
  ENSP ID: ENSP00000487682

SEQ ID NO: 101145 - protein, 92 aa, Homo sapiens; identical to SEQ ID NO: 101131
  Payload ID: 20145
  Gene Name: zinc finger protein 707
  ENSP ID: ENSP00000487846

SEQ ID NO: 101146 - protein, 55 aa, Homo sapiens; identical to SEQ ID NO: 101125
  Payload ID: 20145
  Gene Name: zinc finger protein 707
  ENSP ID: ENSP00000487900

SEQ ID NO: 101147 - protein, 141 aa, Homo sapiens; identical to SEQ ID NO: 101139
  Payload ID: 20145
  Gene Name: zinc finger protein 707
  ENSP ID: ENSP00000488006

SEQ ID NO: 101148 - protein, 55 aa, Homo sapiens; identical to SEQ ID NO: 101125
  Payload ID: 20145
  Gene Name: zinc finger protein 707
  ENSP ID: ENSP00000488098

SEQ ID NO: 101149 - protein, 55 aa, Homo sapiens; identical to SEQ ID NO: 101125
  Payload ID: 20145
  Gene Name: zinc finger protein 707
  ENSP ID: ENSP00000488157

SEQ ID NO: 101150 - protein, 55 aa, Homo sapiens; identical to SEQ ID NO: 101125
  Payload ID: 20145
  Gene Name: zinc finger protein 707
  ENSP ID: ENSP00000488184

SEQ ID NO: 101151 - protein, 55 aa, Homo sapiens; identical to SEQ ID NO: 101125
  Payload ID: 20145
  Gene Name: zinc finger protein 707
  ENSP ID: ENSP00000488529

SEQ ID NO: 101152 - protein, 103 aa, Homo sapiens; identical to SEQ ID NO: 101137
  Payload ID: 20145
  Gene Name: zinc finger protein 707
  ENSP ID: ENSP00000488596

SEQ ID NO: 101153 - protein, 134 aa, Homo sapiens; identical to SEQ ID NO: 101136
  Payload ID: 20145
  Gene Name: zinc finger protein 707
  ENSP ID: ENSP00000488654

SEQ ID NO: 101154 - protein, 79 aa, Homo sapiens; identical to SEQ ID NO: 101129
  Payload ID: 20145
  Gene Name: zinc finger protein 707
  ENSP ID: ENSP00000488675

SEQ ID NO: 101155 - protein, 47 aa, Homo sapiens; identical to SEQ ID NO: 101138
  Payload ID: 20145
  Gene Name: zinc finger protein 707
  ENSP ID: ENSP00000488790

SEQ ID NO: 101156 - protein, 563 aa, Homo sapiens
  Payload ID: 20146
  Gene Name: zinc finger protein 708
  Uniprot ID: P17019
  ENSP ID: ENSP00000349401
MGPLTFMDVAIEFSLEEWQCLDTAQQNLYRNVMLENYRNLVFLGIAVSNLDLITCLEQGKEPWNMKRHEMAAKPPAMCSHFAKDLRPEQYIKNSFQQVILRRYGKCGYQKGCKSVDEHKLHKGGHKGLNRCVTTTQSKIVQCDKYVKVFHKYSNAKRHKIRHTGKNPFKCKECGKSFCMLSQLTQHEIIHTGEKPYKCEECGKAFKKSSNLTNHKIIHTGEKPYKCEECGKAFNQSSTLTRHKIIHTGEKLYKCEECGKAFNRSSNLTKHKIVHTGEKPYKCEECGKAFKQSSNLTNHKKIHTGEKPYKCGECGKAFTLSSHLTTHKRIHTGEKPYKCEECGKAFSVFSTLTKHKIIHTEEKPYKCEECGKAFNRSSHLTNHKVIHTGEKPYKCEECGKAFTKSSTLTYHKVIHTGKKPYKCEECGKAFSIFSILTKHKVIHTEDKPYKCEECGKTFNYSSNFTNHKKIHTGEKPYKCEECGKSFILSSHLTTHKIIHTGEKPYKCKECGKAFNQSSTLMKHKIIHTGEKPYKCEECGKAFNQSPNLTKHKRIHTKEKPYKCK

SEQ ID NO: 101157 - protein, 126 aa, Homo sapiens
  Payload ID: 20146
  Gene Name: zinc finger protein 708
  ENSP ID: ENSP00000469961
MKRHEMAAKPPAMCSHFAKDLRPEQYIKNSFQQVILRRYGKCGYQKGCKSVDEHKLHKGGHKGLNRCVTTTQSKIVQCDKYVKVFHKYSNAKRHKIRHTGKNPFKCKECGKSFCMLSQLTQHEIIH

SEQ ID NO: 101158 - protein, 65 aa, Homo sapiens
  Payload ID: 20146
  Gene Name: zinc finger protein 708
  ENSP ID: ENSP00000471855
MCSHFAKDLRPEQYIKNSFQQVILRRYGKCGYQKGCKSVDEHKLHKGGHKGLNRCVTTTQSKIVQ

SEQ ID NO: 101159 - protein, 38 aa, Homo sapiens
  Payload ID: 20146
  Gene Name: zinc finger protein 708
  ENSP ID: ENSP00000472827
MVKVFLWKLYGVMCLQPPFSFFLVLGFSTVWSKPRYTS

SEQ ID NO: 101160 - protein, 528 aa, Homo sapiens
  Payload ID: 20146
  Gene Name: zinc finger protein 708
  ENSP ID: ENSP00000478939
MGPLTFMDVAIEFSLEEWQCLDTAQQNLYRNVMLENYRNLVFLGIAVSNLDLITCLEQGKEPWNMKRHEMAAKPPAMCSHFAKDLRPEQYIKNSFQQVILRRYGKCGYQKVKVWMSCDKYVKVFHKYSNAKRHKITYWKKSFQCKECGKSFCMLSQLTQHEIIHTGEKPYKCEECGKAFKKSSNLTNHKIIHTGEKPYKCEECGKAFNQSSTLTRHKIIHTGEKLYKCEECGKAFNRSSNLTKHKIVHTGEKPYKCEECGKAFKQSSNLTNHKKIHTGEKPYKCGECGKAFTLSSHLTTHKRIHTGEKPYKCEECGKAFSVFSTLTKHKIIHTEEKPYKCEECGKAFNRSSHLTNHKVIHTGEKPYKCEECGKAFTKSSTLTFTNHKKIHTGEKPYKCEECGKSFILSSHLTTHKIIHTGEKPYKCKECGKAFNQSSTLMKHKIIHTGEKPYKCEECGKAFNQSPNLTKHKIIHTGEKSYKCEECGKAFKRYLNLTTHKIIPAGEKPYKCEECGKAFNHFSNLTKHNS

SEQ ID NO: 101161 - protein, 641 aa, Homo sapiens; identical to SEQ ID NO: 20438
  Payload ID: 20147
  Gene Name: zinc finger protein 709
  Uniprot ID: Q8N972
  ENSP ID: ENSP00000380840

SEQ ID NO: 101162 - protein, 133 aa, Homo sapiens
  Payload ID: 20147
  Gene Name: zinc finger protein 709
  ENSP ID: ENSP00000398085
VAPLQSLSAVTSSDQRRRSKEARTPGTRDTDSVVFEDVAVNFTQEEWALLGPSQKKLYRDVMQETFVNLASIGENWEEKNIEDHKNQGRKLRSHMVERLCERKEGSQFGETISQTPNPKPNKKTFTRVKPYEC

SEQ ID NO: 101163 - protein, 489 aa, Homo sapiens
  Payload ID: 20148
  Gene Name: zinc finger protein 71
  Uniprot ID: Q9NQZ8
  ENSP ID: ENSP00000328245
MKELDPKNDISEDKLSVVGEATGGPTRNGARGPGSEGVWEPGSWPERPRGDAGAEWEPLGIPQGNKLLGGSVPACHELKAFANQGCVLVPPRLDDPTEKGACPPVRRGKNFSSTSDLSKPPMPCEEKKTYDCSECGKAFSRSSSLIKHQRIHTGEKPFECDTCGKHFIERSSLTIHQRVHTGEKPYACGDCGKAFSQRMNLTVHQRTHTGEKPYVCDVCGKAFRKTSSLTQHERIHTGEKPYACGDCGKAFSQNMHLIVHQRTHTGEKPYVCPECGRAFSQNMHLTEHQRTHTGEKPYACKECGKAFNKSSSLTLHQRNHTGEKPYVCGECGKAFSQSSYLIQHQRFHIGVKPFECSECGKAFSKNSSLTQHQRIHTGEKPYECYICKKHFTGRSSLIVHQIVHTGEKPYVCGECGKAFSQSAYLIEHQRIHTGEKPYRCGQCGKSFIKNSSLTVHQRIHTGEKPYRCGECGKTFSRNTNLTRHLRIHT

SEQ ID NO: 101164 - protein, 128 aa, Homo sapiens
  Payload ID: 20148
  Gene Name: zinc finger protein 71
  ENSP ID: ENSP00000471138
MKELDPKNDISEDKLSVVGEATGGPTRNGARGPGSEGVWEPGSWPERPRGDAGAEWEPLGIPQGNKLLGGSVPACHELKAFANQGCVLVPPRLDDPTEKGACPPVRRGKNFSSTSDLSKPPMPCEEKK

SEQ ID NO: 101165 - protein, 664 aa, Homo sapiens
  Payload ID: 20149
  Gene Name: zinc finger protein 710
  Uniprot ID: Q8N1W2
  ENSP ID: ENSP00000268154
MEGFMDSGTQTDAVVVLSLAQAAVLGLVSENELFGATISAEAFYPDLGPELSGAAMGEPEPPGPDVYQLACNGRALEEPAEEEVLEVEAACEKHTRRKTRPPVRLVPKVKFEKVEEEEQEVYEVSVPGDDKDAGPAEAPAEAASGGCDALVQSSAVKMIDLSAFSRKPRTLRHLPRTPRPELNVAPYDPHFPAPARDGFPEPSMALPGPEALPTECGFEPPHLAPLSDPEAPSMESPEPVKPEQGFVWQEASEFEADTAGSTVERHKKAQLDRLDINVQIDDSYLVEAGDRQKRWQCRMCEKSYTSKYNLVTHILGHNGIKPHSCPHCSKLFKQPSHLQTHLLTHQGTRPHKCQVCHKAFTQTSHLKRHMLLHSEVKPYSCHFCGRGFAYPSELKAHEVKHESGRCHVCVECGLDFSTLTQLKRHLASHQGPTLYQCLECDKSFHYRSQLQNHMLKHQNVRPFVCTECGMEFSQIHHLKQHSLTHKGVKEFKCEVCGREFTLQANMKRHMLIHTSVRPYQCHICFKTFVQKQTLKTHMIVHSPVKPFKCKVCGKSFNRMYNLLGHMHLHAGSKPFKCPYCSSKFNLKGNLSRHMKVKHGVMDIGLDSQDPMMELTGTDPSELDGQQEMEDFEENAYSYASVDSSAEASVLTEQAMKEMAYYNVL

SEQ ID NO: 101166 - protein, 79 aa, Homo sapiens
  Payload ID: 20149
  Gene Name: zinc finger protein 710
  ENSP ID: ENSP00000452993
MEGFMDSGTQTDAVVVLSLAQAAVLGLVSENELFGATISAEAFYPDLGPELSGAAMGEPEPPGPDVYQLACNGRALEEP

SEQ ID NO: 101167 - protein, 160 aa, Homo sapiens
  Payload ID: 20149
  Gene Name: zinc finger protein 710
  ENSP ID: ENSP00000453147
  MOD_RES (1)..(1): Any amino acid
XPSELKAHEVKHESGRCHVCVECGLDFSTLTQLKRHLASHQGPTLYQCLECDKSFHYRSQLQNHMLKHQNVRPFVCTECGMEFSQIHHLKQHSLTHKGVKEFKCEVCGREFTLQANMKRLAKAETSLGWAQVWKGGTLEGHDDNNDGIFMSSSKDLNEIT

SEQ ID NO: 101168 - protein, 387 aa, Homo sapiens
  Payload ID: 20149
  Gene Name: zinc finger protein 710
  ENSP ID: ENSP00000453404
KRWQCRMCEKSYTSKYNLVTHILGHNGIKPHSCPHCSKLFKQPSHLQTHLLTHQGTRPHKCQVCHKAFTQTSHLKRHMLLHSEVKPYSCHFCGRGFAYPSELKAHEVKHESGRCHVCVECGLDFSTLTQLKRHLASHQGPTLYQCLECDKSFHYRSQLQNHMLKHQNVRPFVCTECGMEFSQIHHLKQHSLTHKGVKEFKCEVCGREFTLQANMKRHMLIHTSVRPYQCHICFKTFVQKQTLKTHMIVHSPVKPFKCKVCGKSFNRMYNLLGHMHLHAGSKPFKCPYCSSKFNLKGNLSRHMKVKHGVMDIGLDSQGGWAKRNGQSRNDTNMTHSGASCPVRGVGRLAKAETSLGWAQVWKGGTLEGHDDNNDGIFMSSSKDLNEIT

SEQ ID NO: 101169 - protein, 761 aa, Homo sapiens
  Payload ID: 20150
  Gene Name: zinc finger protein 711
  Uniprot ID: Q9Y462
  ENSP ID: ENSP00000276123
MDSGGGSLGLHTPDSRMAHTMIMQDFVAGMAGTAHIDGDHIVVSVPEAVLVSDVVTDDGITLDHGLAAEVVHGPDIITETDVVTEGVIVPEAVLEADVAIEEDLEEDDGDHILTSELITETVRVPEQVFVADLVTGPNGHLEHVVQDCVSGVDSPTMVSEEVLVTNSDTETVIQAAGGVPGSTVTIKTEDDDDDDVKSTSEDYLMISLDDVGEKLEHMGNTPLKIGSDGSQEDAKEDGFGSEVIKVYIFKAEAEDDVEIGGTEIVTESEYTSGHSVAGVLDQSRMQREKMVYMAVKDSSQEEDDIRDERRVSRRYEDCQASGNTLDSALESRSSTAAQYLQICDGINTNKVLKQKAKKRRRGETRQWQTAVIIGPDGQPLTVYPCHICTKKFKSRGFLKRHMKNHPDHLMRKKYQCTDCDFTTNKKVSFHNHLESHKLINKVDKTHEFTEYTRRYREASPLSSNKLILRDKEPKMHKCKYCDYETAEQGLLNRHLLAVHSKNFPHVCVECGKGFRHPSELKKHMRTHTGEKPYQCQYCIFRCADQSNLKTHIKSKHGNNLPYKCEHCPQAFGDERELQRHLDLFQGHKTHQCPHCDHKSTNSSDLKRHIISVHTKDFPHKCEVCDKGFHRPSELKKHSDIHKGRKIHQCRHCDFKTSDPFILSGHILSVHTKDQPLKCKRCKRGFRQQNELKKHMKTHTGRKIYQCEYCEYSTTDASGFKRHVISIHTKDYPHRCEFCKKGFRRPSEKNQHIMRHHKEALM

SEQ ID NO: 101170 - protein, 807 aa, Homo sapiens
  Payload ID: 20150
  Gene Name: zinc finger protein 711
  Uniprot ID: Q9Y462
  ENSP ID: ENSP00000353922
MDSGGGSLGLHTPDSRMAHTMIMQDFVAGMAGTAHIDGDHIVVSVPEAVLVSDVVTDDGITLDHGLAAEVVHGPDIITETDVVTEGVIVPEAVLEADVAIEEDLEEDDGDHILTSELITETVRVPEQVFVADLVTGPNGHLEHVVQDCVSGVDSPTMVSEEVLVTNSDTETVIQAAGGVPGSTVTIKTEDDDDDDVKSTSEDYLMISLDDVGEKLEHMGNTPLKIGSDGSQEDAKEDGFGSEVIKVYIFKAEAEDDVEIGGTEIVTESEYTSGHSVAGVLDQSRMQREKMVYMAVKDSSQEEDDISCAEIADEVYMEVIVGEEEGTSLPEIQLEDSDVNKTVVPVVWAAAYGDERRVSRRYEDCQASGNTLDSALESRSSTAAQYLQICDGINTNKVLKQKAKKRRRGETRQWQTAVIIGPDGQPLTVYPCHICTKKFKSRGFLKRHMKNHPDHLMRKKYQCTDCDFTTNKKVSFHNHLESHKLINKVDKTHEFTEYTRRYREASPLSSNKLILRDKEPKMHKCKYCDYETAEQGLLNRHLLAVHSKNFPHVCVECGKGFRHPSELKKHMRTHTGEKPYQCQYCIFRCADQSNLKTHIKSKHGNNLPYKCEHCPQAFGDERELQRHLDLFQGHKTHQCPHCDHKSTNSSDLKRHIISVHTKDFPHKCEVCDKGFHRPSELKKHSDIHKGRKIHQCRHCDFKTSDPFILSGHILSVHTKDQPLKCKRCKRGFRQQNELKKHMKTHTGRKIYQCEYCEYSTTDASGFKRHVISIHTKDYPHRCEFCKKGFRRPSEKNQHIMRHHKEALM

SEQ ID NO: 101171 - protein, 761 aa, Homo sapiens; identical to SEQ ID NO: 101169
  Payload ID: 20150
  Gene Name: zinc finger protein 711
  Uniprot ID: Q9Y462
  ENSP ID: ENSP00000362260

SEQ ID NO: 101172 - protein, 443 aa, Homo sapiens
  Payload ID: 20151
  Gene Name: zinc finger protein 713
  ENSP ID: ENSP00000416662
MPSQNAVFSQEGNMEEEEMNDGSQMVRSQESLTFQDVAVDFTREEWDQLYPAQKNLYRDVMLENYRNLVALGYQLCKPEVIAQLELEEEWVIERDSLLDTHPDGENRPEIKKSTTSQNISDENQTHEMIMERLAGDSFWYSILGGLWDFDYHPEFNQENHKRYLGQVTLTHKKITQERSLECNKFAENCNLNSNLMQQRIPSIKIPLNSDTQGNSIKHNSDLIYYQGNYVRETPYEYSECGKIFNQHILLTDHIHTAEKPSECGKAFSHTSSLSQPQMLLTGEKPYKCDECGKRFSQRIHLIQHQRIHTGEKPFICNGCGKAFRQHSSFTQHLRIHTGEKPYKCNQCGKAFSRITSLTEHHRLHTGEKPYECGFCGKAFSQRTHLNQHERTHTGEKPYKCNECGKAFSQSAHLNQHRKIHTREKLCEYKCEQTVRHSPSFSST

SEQ ID NO: 101173 - protein, 51 aa, Homo sapiens
  Payload ID: 20151
  Gene Name: zinc finger protein 713
  ENSP ID: ENSP00000416974
MPSQNAVFSQEGNMEEEEMNDGSQMVRSQMWRSVCSPLDLGKAVTGGCKAL

SEQ ID NO: 101174 - protein, 430 aa, Homo sapiens
  Payload ID: 20151
  Gene Name: zinc finger protein 713
  Uniprot ID: Q8N859
  ENSP ID: ENSP00000487818
MEEEEMNDGSQMVRSQESLTFQDVAVDFTREEWDQLYPAQKNLYRDVMLENYRNLVALGYQLCKPEVIAQLELEEEWVIERDSLLDTHPDGENRPEIKKSTTSQNISDENQTHEMIMERLAGDSFWYSILGGLWDFDYHPEFNQENHKRYLGQVTLTHKKITQERSLECNKFAENCNLNSNLMQQRIPSIKIPLNSDTQGNSIKHNSDLIYYQGNYVRETPYEYSECGKIFNQHILLTDHIHTAEKPSECGKAFSHTSSLSQPQMLLTGEKPYKCDECGKRFSQRIHLIQHQRIHTGEKPFICNGCGKAFRQHSSFTQHLRIHTGEKPYKCNQCGKAFSRITSLTEHHRLHTGEKPYECGFCGKAFSQRTHLNQHERTHTGEKPYKCNECGKAFSQSAHLNQHRKIHTREKLCEYKCEQTVRHSPSFSST

SEQ ID NO: 101175 - protein, 84 aa, Homo sapiens
  Payload ID: 20152
  Gene Name: zinc finger protein 714
  ENSP ID: ENSP00000459573
MNVMLENYKNLVFLGIAVSKQDPITSLEQEKEPWNMKICEMVDESPGYMCRMCSYVFFFYQRPLARARHKRFFSTSDTEKTWQM

SEQ ID NO: 101176 - protein, 110 aa, Homo sapiens
  Payload ID: 20152
  Gene Name: zinc finger protein 714
  ENSP ID: ENSP00000469616
MNVMLENYKNLVFLGIAVSKQDPITSLEQEKEPWNMKICEMVDESPGQVWCLTPVIPALWEARAGGLLEPRSLRPAWSTWKIPVSTKKKKKSQLGMGMVVHACNPSYSRG

SEQ ID NO: 101177 - protein, 555 aa, Homo sapiens
  Payload ID: 20152
  Gene Name: zinc finger protein 714
  ENSP ID: ENSP00000477828
MNVMLENYKNLVFLAGIAVSKQDPITSLEQEKEPWNMKICEMVDESPAMCSSFTRDLWPEQDIKDSFQQVILRRHGKCEHENLQLRKGSANVVECKVYKKGYNELNQCLTTTQSKIFPCDKYIKVFHKIFNSNRHKTRHTGEKPFKCKKCDESFCMLLHLHQHKRIHIRENSYQCEECDKVFKRFSTLTRHKRVHTGEKPFKCEECGKAFKHSSTLTTHKMIHTGEKPYRCEECGKAFYHSSHLTTHKVIHTGEKPFKCEECGKAFNHPSALTTHKFIHVKEKPYKCEECDKAFNRFSYLTKHKIIHSGEKSYKCEQCGKGFNWSSTLTKHKRIHTGEKPYKCEECGKAFNVSSHLTTHKMIHTGEKPYKCEECGKAFNHSSKLTIHKIIHTGEKPYKCEECGKAFNQSSNLTKHKIIHTGEKLYKCEECGKAFNRSSNLTTHKRIHTGEKPYKCEECGKAFNRSSNLTKHNIIHTGEKSYKCEECGKAFNQSSTLTKHRKIQQGMVAHACNPNTLRGLGEQIARSGVQDQPGQHGKTPSLLKIQKFAGCGGRRL

SEQ ID NO: 101178 - protein, 555 aa, Homo sapiens; identical to SEQ ID NO: 101177
  Payload ID: 20152
  Gene Name: zinc finger protein 714
  ENSP ID: ENSP00000478345

SEQ ID NO: 101179 - protein, 28 aa, Homo sapiens
  Payload ID: 20152
  Gene Name: zinc finger protein 714
  ENSP ID: ENSP00000479085
MLLHLHQHKRIHIRENSYQCEECDKVFK

SEQ ID NO: 101180 - protein, 55 aa, Homo sapiens
  Payload ID: 20152
  Gene Name: zinc finger protein 714
  ENSP ID: ENSP00000480816
MNVMLENYKNLVFLAGIAVSKQDPITSLEQEKEPWNMKICEMVDESPETFGQSKT

SEQ ID NO: 101181 - protein, 84 aa, Homo sapiens; identical to SEQ ID NO: 101175
  Payload ID: 20152
  Gene Name: zinc finger protein 714
  ENSP ID: ENSP00000482783

SEQ ID NO: 101182 - protein, 148 aa, Homo sapiens
  Payload ID: 20152
  Gene Name: zinc finger protein 714
  ENSP ID: ENSP00000484530
MPEPCSAEFIYECDVRELQKPGLLGDLWPEQDIKDSFQQVILRRHGKCEHENLQLRKGSANVVECKVYKKGYNELNQCLTTTQSKIFPCDKYIKVFHKIFNSNRHKTRHTGEKPFKCKKCDESFCMLLHLHQHKRIHIRENSYQCEEC

SEQ ID NO: 101183 - protein, 139 aa, Homo sapiens
  Payload ID: 20152
  Gene Name: zinc finger protein 714
  ENSP ID: ENSP00000484576
MNVMLENYKNLVFLGIAVSKQDPITSLEQEKEPWNMKICEMVDESPAMCSSFTRDLWPEQDIKDSFQQVILRRHGKCEHENLQLRKGSANVVECKVYKKGYNELNQCLTTTQSKIFPCDKYIKVFHKIFNSNRHKTRHT

SEQ ID NO: 101184 - protein, 495 aa, Homo sapiens
  Payload ID: 20153
  Gene Name: zinc finger protein 716
  Uniprot ID: A6NP11
  ENSP ID: ENSP00000394248
MAKRPGPPGSREMGLLTFRDIAIEFSLAEWQCLDHAQQNLYRDVMLENYRNLVSLGIAVSKPDLITCLEQNKEPQNIKRNEMVAKHPVTCSHFTQDLQSEQGIKDSLQKVILRRYGKCGQEDLQVKKCCKSVGECEVHKGGYNYVNQCLSATQNKTFQTHKCVKVFGKFSNSNRHKTRHTGKKHFKCKNDGKSFCMLSRLNQHQIIHTREKSYKCEECGKSFNCSSTLTRHKRIHTGEKPYRCEECGKAFSWSASLTKHKRIHTGEKPYTCEERGKVFSRSTLTNYKRIHTGEKPYTCEECGKAFSRSSTLTNHKRIHTGERPYKCEECGKAFSLSSTLKKHKIVHTGEKLYTCEECGKAFTFSSTLNTHKRIHTGEKPYTCEECGKAFSLPSTFTYHKRTHTGEKPYKCEECGKAFNCSSTLKKHKIIHTGEKLYKCKECGKAFTFSSTLNTHKRIHTGEKPYKCEECDQTFKWHSSLANHKNMHTGEKPYKYE

SEQ ID NO: 101185 - protein, 114 aa, Homo sapiens
  Payload ID: 20154
  Gene Name: zinc finger protein 717
  ENSP ID: ENSP00000417902
MFPVFSGCFQELQEKNKSLELVSFEEVAVHFTWEEWQDLDDAQRTLYRDVMLETYSSLVSLGHYITKPEMIFKLEQGAEPWIVEETPNLRLSGGSKKQVFSGICHRSLVELQEV

SEQ ID NO: 101186 - protein, 110 aa, Homo sapiens
  Payload ID: 20154
  Gene Name: zinc finger protein 717
  ENSP ID: ENSP00000418187
MFPVFSGCFQELQEKNKSLELVSFEEVAVHFTWEEWQDLDDAQRTLYRDVMLETYSSLVSLGHYITKPEMIFKLEQGAEPWIVEETPNLRLSAVQIIDDLIERSHESHDR

SEQ ID NO: 101187 - protein, 864 aa, Homo sapiens
  Payload ID: 20154
  Gene Name: zinc finger protein 717
  ENSP ID: ENSP00000419377
MLETYSSLVSLGHYITKPEMIFKLEQGAEPWIVEETPNLRLSAVQIIDDLIERSHESHDRFFWQIVITNSNTSTQERVELGKTFNLNSNHVLNLIINNGNSSGMKPGQFNDCQNMLFPIKPGETQSGEKPHVCDITRRSHRHHEHLTQHHKIQTLLQTFQCNEQGKTFNTEAMFFIHKRVHIVQTFGKYNEYEKACNNSAVIVQVITQVGQPTCCRKSDFTKHQQTHTGEKPYECVECEKPSISKSDLMLQCKMPTEEKPYACNWCEKLFSYKSSLIIHQRIHTGEKPYGCNECGKTFRRKSFLTLHERTHTGDKPYKCIECGKTFHCKSLLTLHHRTHSGEKPYQCSECGKTFSQKSYLTIHHRTHTGEKPYACDHCEEAFSHKSRLTVHQRTHTGEKPYECNECGKPFINKSNLRLHQRTHTGEKPYECNECGKTFHRKSFLTIHQWTHTGEKPYECNECGKTFRCKSFLTVHQRTHAGEKPYACNECGKTYSHKSYLTVHHRTHTGEKPYECNECGKSFHCKSFLTIHQRTHAGKKPYECNECEKTFINKLNLGIHKRTHTGERPYECNECGKTFRQKSNLSTHQGTHTGEKPYVCNECGKTFHRKSFLTIHQRTHTGKNRMDVMNVEKLFVRNHTLLYIRELTPGKSPMNVMNVENPFIRRQIFRSIKVFTRGRNPMNVANVEKPCQKSVLTVHHRTHTGEKPYECNECGKTFCHKSNLSTHQGTHSGEKPYECDECRKTFYDKTVLTIHQRTHTGEKPFECKECRKTFSQKSKLFVHHRTHTGEKPFRCNECRKTFSQKSGLSIHQRTHTGEKPYECKECGKTFCQKSHLSRHQQTHIGEKSDVAEAGYVFPQNHSFFP

SEQ ID NO: 101188 - protein, 60 aa, Homo sapiens
  Payload ID: 20154
  Gene Name: zinc finger protein 717
  ENSP ID: ENSP00000420241
MLETYSSLVSLGHYITKPEMIFKLEQGAEPWIVEETPNLRLSAVQIIDDLIERSHESHDR

SEQ ID NO: 101189 - protein, 446 aa, Homo sapiens
  Payload ID: 20155
  Gene Name: zinc finger protein 718
  ENSP ID: ENSP00000476435
MLENYRNLVSLGVSISNPDLVTSLEQRKEPYNLKIHETAARPPAVCSHFTQNLWTVQGIEDSFHKLIPKGHEKRGHENLRKTCKSINECKVQKGGYNRINQCLLTTQKKTIQSNICVKVFHKFSNSNKDKIRYTGDKTFKCKECGKSFHVLSRLTQHKRIHTGENPYTCEECGKAFNWSSILTKHKRIHAREKFYKCEECGKGFTRSSHLTKHKRIHTGEKPYICEKCGKAFNQSSTLNLHKRIHSAQKYYKCEECGKAFKWSSSLNEHKRIHAGEKPFSCEECGNVFTTSSDFAKHKRIHTGEKPYKCEECGKSFNRSTTLTTHKRIHTGEKPYTCEECGKAFNWSSTLNVHKRIHSGKNPYKCEDCGKAFKVFANLHNHKKIHTGEKPYICKQCGKAFKQSSHLNKHKKIHTVDKPYKCKECGKAFKQYSNLPQHKRTHTGGKF

SEQ ID NO: 101190 - protein, 478 aa, Homo sapiens
  Payload ID: 20155
  Gene Name: zinc finger protein 718
  ENSP ID: ENSP00000480556
MELLTFKDVAIEFSPEEWKCLDTSQQNLYRDVMLENYRNLVSLGVSISNPDLVTSLEQRKEPYNLKIHETAARPPAVCSHFTQNLWTVQGIEDSFHKLIPKGHEKRGHENLRKTCKSINECKVQKGGYNRINQCLLTTQKKTIQSNICVKVFHKFSNSNKDKIRYTGDKTFKCKECGKSFHVLSRLTQHKRIHTGENPYTCEECGKAFNWSSILTKHKRIHAREKFYKCEECGKGFTRSSHLTKHKRIHTGEKPYICEKCGKAFNQSSTLNLHKRIHSAQKYYKCEECGKAFKWSSSLNEHKRIHAGEKPFSCEECGNVFTTSSDFAKHKRIHTGEKPYKCEECGKSFNRSTTLTTHKRIHTGEKPYTCEECGKAFNWSSTLNVHKRIHSGKNPYKCEDCGKAFKVFANLHNHKKIHTGEKPYICKQCGKAFKQSSHLNKHKKIHTVDKPYKCKECGKAFKQYSNLPQHKRTHTGGKF

SEQ ID NO: 101191 - protein, 126 aa, Homo sapiens
  Payload ID: 20156
  Gene Name: zinc finger protein 720
  Uniprot ID: Q7Z2F6
  ENSP ID: ENSP00000319222
MGLLTFRDVAIEFSREEWEHLDSDQKLLYGDVMLENYGNLVSLGLAVSKPDLITFLEQRKEPWNVKSAETVAIQPDIFSHDTQGLLRKKLIEASFQKVILDGYGSCGPQNLNLRKEWESEGKIILW

SEQ ID NO: 101192 - protein, 82 aa, Homo sapiens
  Payload ID: 20156
  Gene Name: zinc finger protein 720
  ENSP ID: ENSP00000381694
MGLLTFRDVAIEFSREEWEHLDSDQKLLYGDVMLENYGNLVSLGLAVSKPDLITFLEQRKEPWNVKSAETVAIQPEVKVNTH

SEQ ID NO: 101193 - protein, 118 aa, Homo sapiens
  Payload ID: 20156
  Gene Name: zinc finger protein 720
  ENSP ID: ENSP00000431546
MVSFTERGLDKEERPSEEKIRHSLLIPVRATCKARIRVQLRWGNSRKREIHSMDSCQDRAGQHQGHEPKVQKDCLTLEKKPKASDTVHISEMRRPMMPAVGDPQRPTPGTASGPDLSL

SEQ ID NO: 101194 - protein, 52 aa, Homo sapiens
  Payload ID: 20156
  Gene Name: zinc finger protein 720
  ENSP ID: ENSP00000434091
MVNVPGTVDIQGCGHRILSGGVGTPGLRSEAFIWGCDVRELRKPGLSGSRCL

SEQ ID NO: 101195 - protein, 146 aa, Homo sapiens
  Payload ID: 20156
  Gene Name: zinc finger protein 720
  ENSP ID: ENSP00000435171
MVNVPGRGSPEEGEGRSEAAGTLFEVTEHLTGWAPAPVPSVEGLLTFRDVAIEFSREEWEHLDSDQKLLYGDVMLENYGNLVSLGLAVSKPDLITFLEQRKEPWNVKSAETVAIQPDIFSHDTQGLLRKKLIEASFQKVILDGYGS

SEQ ID NO: 101196 - protein, 130 aa, Homo sapiens
  Payload ID: 20156
  Gene Name: zinc finger protein 720
  ENSP ID: ENSP00000437310
MGLLTFRDVAIEFSREEWEHLDSDQKLLYGDVMLENYGNLVSLGLAVSKPDLITFLEQRKEPWNVKSAETVAIQPDIFSHDTQGLLRKKLIEASFQKVILDGYGSCGPQNLNLRKEWESEEKNQYNKSDT

SEQ ID NO: 101197 - protein, 56 aa, Homo sapiens
  Payload ID: 20156
  Gene Name: zinc finger protein 720
  ENSP ID: ENSP00000441893
MVNVPDIFSHDTQGLLRKKLIEASFQKVILDGYGSCGPQNLNLRKEWESEGKIILW

SEQ ID NO: 101198 - protein, 178 aa, Homo sapiens
  Payload ID: 20156
  Gene Name: zinc finger protein 720
  Uniprot ID: Q7Z2F6
  ENSP ID: ENSP00000443758
MVNVPDIFSHDTQGLLRKKLIEASFQKVILDGYGSCGPQNLNLRKEWESEGKCEGHNGYYDGHTKCKTTTYNKNLTVTGGQKHEKTQFMSVAFSKPCVSVSKCQHQFLKLTFSFKGNLDNPNSDLVHVSNNHLNQLKYRTGVNVQSNISEKERFKNEEVISKYDQFDGSLLKVCFTNK

SEQ ID NO: 101199 - protein, 52 aa, Homo sapiens; identical to SEQ ID NO: 101194
  Payload ID: 20156
  Gene Name: zinc finger protein 720
  ENSP ID: ENSP00000445614

SEQ ID NO: 101200 - protein, 911 aa, Homo sapiens
  Payload ID: 20157
  Gene Name: zinc finger protein 721
  Uniprot ID: Q8TF20
  ENSP ID: ENSP00000340524
MCSHFTQDFLPVQGIEDSFHKLILRRYEKCGHDNLQLRKGCKSMNVCKVQKGVYNGINKCLSNTQSKIFQCNARVKVFSKFANSNKDKTRHTGEKHFKCNECGKSFQKFSDLTQHKGIHAGEKPYTCEERGKDFGWYTDLNQHKKIHTGEKPYKCEECGKAFNRSTNLTAHKRIHNREKAYTGEDRDRAFGWSTNLNEYKKIHTGDKPYKCKECGKAFMHSSHLNKHEKIHTGEKPYKCKECGKVISSSSSFAKHKRIHTGEKPFKCLECGKAFNISTTLTKHRRIHTGEKPYTCEVCGKAFRQSANLYVHRRIHTGEKPYTCGECGKTFRQSANLYVHRRIHTGEKPYKCEDCGKAFGRYTALNQHKKIHTGEKPYKCEECGKAFNSSTNLTAHKRIHTREKPYTCEDRGRAFGLSTNLNEYKKIHTGDKPYKCKECGKAFIHSLHLNKHEKIHTGKKPYKCKQCGKVITSSSSFAKHKRIHTGEKPFECLECGKAFTSSTTLTKHRRIHTGEKPYTCEVCGKAFRQSAILYVHRRIHTGEKPYTCEECGKTFRQSANLYVHRRIHTGEKPYKCEECGKAFGRYTDLNQHKKIHTGEKLYKCEECGKDFVWYTDLNQQKKIYTGEKPYKCEECGKAFAPSTDLNQHTKILTGEQSYKCEECGKAFGWSIALNQHKKIHTGEKPYKCEECGKAFSRSRNLTTHRRVHTREKPYKCEDRGRSFGWSTNLNEYKKIHTGDKLYKCKECGKVFKQSSHLNRHEKIHTGKKPYKCKECGKVITSSSSFAKHKRIHTGEKPFKCLECGKAFTSSTTLTKHRRIHTGEKPYTCEECGKAFRQSAILYVHRRIHTGEKPYTCGECGKTFRQSANLYAHKKIHTGEKPYTCGDCGKTFRQSANLYAHKKIHTGDKTIQV

SEQ ID NO: 101201 - protein, 160 aa, Homo sapiens
  Payload ID: 20157
  Gene Name: zinc finger protein 721
  ENSP ID: ENSP00000421325
MEPLTFRDVAIEFSPEEWKCLDPAQQNLYRDVMLENYRNLVSLAMCSHFTQDFLPVQGIEDSFHKLILRRYEKCGHDNLQLRKGCKSMNVCKVQKGVYNGINKCLSNTQSKIFQCNARVKVFSKFANSNKDKTRHTGEKHFKCNECGKSFQKFSDLTQHK

SEQ ID NO: 101202 - protein, 132 aa, Homo sapiens
  Payload ID: 20157
  Gene Name: zinc finger protein 721
  ENSP ID: ENSP00000423586
MEPLTFRDVAIEFSPEEWKCLDPAQQNLYRDVMLENYRNLVSLAMCSHFTQDFLPVQGIEDSFHKLILRRYEKFSSLISSCRVISHGLSRGRNRATEKNDLLTTEEPVVKHRFDLQYPEEMWRNTVVQKGRK

SEQ ID NO: 101203 - protein, 923 aa, Homo sapiens
  Payload ID: 20157
  Gene Name: zinc finger protein 721
  Uniprot ID: Q8TF20
  ENSP ID: ENSP00000428878
MLENYRNLVSLAMCSHFTQDFLPVQGIEDSFHKLILRRYEKCGHDNLQLRKGCKSMNVCKVQKGVYNGINKCLSNTQSKIFQCNARVKVFSKFANSNKDKTRHTGEKHFKCNECGKSFQKFSDLTQHKGIHAGEKPYTCEERGKDFGWYTDLNQHKKIHTGEKPYKCEECGKAFNRSTNLTAHKRIHNREKAYTGEDRDRAFGWSTNLNEYKKIHTGDKPYKCKECGKAFMHSSHLNKHEKIHTGEKPYKCKECGKVISSSSSFAKHKRIHTGEKPFKCLECGKAFNISTTLTKHRRIHTGEKPYTCEVCGKAFRQSANLYVHRRIHTGEKPYTCGECGKTFRQSANLYVHRRIHTGEKPYKCEDCGKAFGRYTALNQHKKIHTGEKPYKCEECGKAFNSSTNLTAHKRIHTREKPYTCEDRGRAFGLSTNLNEYKKIHTGDKPYKCKECGKAFIHSLHLNKHEKIHTGKKPYKCKQCGKVITSSSSFAKHKRIHTGEKPFECLECGKAFTSSTTLTKHRRIHTGEKPYTCEVCGKAFRQSAILYVHRRIHTGEKPYTCEECGKTFRQSANLYVHRRIHTGEKPYKCEECGKAFGRYTDLNQHKKIHTGEKLYKCEECGKDFVWYTDLNQQKKIYTGEKPYKCEECGKAFAPSTDLNQHTKILTGEQSYKCEECGKAFGWSIALNQHKKIHTGEKPYKCEECGKAFSRSRNLTTHRRVHTREKPYKCEDRGRSFGWSTNLNEYKKIHTGDKLYKCKECGKVFKQSSHLNRHEKIHTGKKPYKCKECGKVITSSSSFAKHKRIHTGEKPFKCLECGKAFTSSTTLTKHRRIHTGEKPYTCEECGKAFRQSAILYVHRRIHTGEKPYTCGECGKTFRQSANLYAHKKIHTGEKPYTCGDCGKTFRQSANLYAHKKIHTGDKTIQV

SEQ ID NO: 101204 - protein, 61 aa, Homo sapiens
  Payload ID: 20157
  Gene Name: zinc finger protein 721
  ENSP ID: ENSP00000430163
MEPLTFRDVAIEFSPEEWKCLDPAQQNLYRDVMLENYRNLVSLEEGTEPQRKMTCSQQKSQ

SEQ ID NO: 101205 - protein, 619 aa, Homo sapiens
  Payload ID: 20158
  Gene Name: zinc finger protein 724, pseudogene
  Uniprot ID: A8MTY0
  ENSP ID: ENSP00000413411
MGPLTFMDVAIEFSVEEWQCLDTAQQNLYRNVMLENYRNLVFLGIAVSKPDLITCLEQGKEPWNMERHEMVAKPPGMCCYFAQDLRPEQSIKASLQRIILRKYEKCGHHNLQLKKGYKSVDEYKVHKGSYNGFNQCLTTTQSKIFQCDKYVKDFHKFSNSNRHKTEKNPFKCKECGKSFCVLSHLTQHKRIHTTVNSYKLEECGKAFNVSSTLSQHKRIHTGQKHYKCEECGIAFNKSSHLNTHKIIHTGEKSYKREECGKAFNISSHLTTHKIIHTGENAYKCKECGKAFNQSSTLTRHKIIHAGEKPYICEHCGRAFNQSSNLTKHKRIHTGDKPYKCEECGKAFNVSSTLTQHKRIHTGEKPYKCEECGKAFNVSSTLTQHKRIHTGEKPYKCEECGKAFNTSSHLTTHKRIHTGEKPYKCEECGKAFNQFSQLTTHKIIHTGEKPYKCKECGKAFKRSSNLTEHRIIHTGEKPYKCEECGKAFNLSSHLTTHKKIHTGEKPYKCKECGKAFNQSSTLARHKIIHAGEKPYKCEECGKAFYQYSNLTQHKIIHTGEKPYKCEECGKAFNWSSTLTKHKVIHTGEKPYKCKECGKAFNQCSNLTTHKKIHAVEKSDK

SEQ ID NO: 101206 - protein, 77 aa, Homo sapiens
  Payload ID: 20158
  Gene Name: zinc finger protein 724, pseudogene
  ENSP ID: ENSP00000471547
MGPLTFMDVAIEFSVEEWQCLDTAQQNLYRNVMLENYRNLVFLGIAVSKPDLITCLEQGKEPWNMERHEMVAKPPGR

SEQ ID NO: 101207 - protein, 99 aa, Homo sapiens
  Payload ID: 20158
  Gene Name: zinc finger protein 724, pseudogene
  ENSP ID: ENSP00000473253
MDVAIEFSVEEWQCLDTAQQNLYRNVMLENYRNLVFLGIAVSKPDLITCLEQGKEPWNMERHEMVAKPPGMCCYFAQDLRPEQSIKASLQRIILRKYEK

SEQ ID NO: 101208 - protein, 738 aa, Homo sapiens [sequence omitted]

SEQ ID NO: 101209 - protein, 108 aa, Homo sapiens
  Payload ID: 20159
  Gene Name: zinc finger protein 726
  ENSP ID: ENSP00000334762
MGLLTFRDVAIEFSLEEWQCLDTAQKNLYRNVMLENYRNLAFLGIAVSKPDLIICLEKEKEPWNMKRDEMVDEPPGLAVSNPDLISCLEQIKEPWNVKRHETVVKYSG

SEQ ID NO: 101210 - protein, 77 aa, Homo sapiens
  Payload ID: 20159
  Gene Name: zinc finger protein 726
  Uniprot ID: A6NNF4
  ENSP ID: ENSP00000432583
MGLLTFRDVAIEFSLEEWQCLDTAQKNLYRNVMLENYRNLAFLGIAVSKPDLIICLEKEKEPWNMKRDEMVDEPPGR

SEQ ID NO: 101211 - protein, 89 aa, Homo sapiens
  Payload ID: 20159
  Gene Name: zinc finger protein 726
  ENSP ID: ENSP00000433319
MGLLTFRDVAIEFSLEEWQCLDTAQKNLYRNVMLENYRNLAFLGIAVSKPDLIICLEKEKEPWNMKRDEMVDEPPDGVSLCHPGWSAVA

SEQ ID NO: 101212 - protein, 109 aa, Homo sapiens
  Payload ID: 20159
  Gene Name: zinc finger protein 726
  ENSP ID: ENSP00000461349
MGLLTFRDVAIEFSLEEWQCLDTAQKNLYRNVMLENYRNLAFLGIAVSKPDLIICLEKEKEPWNMKRDEMVDEPPGLAVSNPDLISCLEQIKEPWNVKRHETVVKYSGR

SEQ ID NO: 101213 - protein, 616 aa, Homo sapiens
  Payload ID: 20159
  Gene Name: zinc finger protein 726
  Uniprot ID: A6NNF4
  ENSP ID: ENSP00000471516
MGLLTFRDVAIEFSLEEWQCLDTAQKNLYRNVMLENYRNLAFLGIAVSKPDLIICLEKEKEPWNMKRDEMVDEPPGICPHFAQDIWPEQGVEDSFQKVILRRFEKCGHENLQLRKGCKSVDECKVHKEGYNGLNQCFTTTQGKASQCGKYLKVFYKFINLNRYKIRHTRKKPFKCKNCVKSFCMFSHKTQHKSIYTTEKSYKCKECGKTFNWSSTLTNHKKTHTEEKPYKCEEYGKAFNQSSNYTTHKVTHTGEKPYKCEECGKAFSQSSTLTIHKRIHTGEKPCKCEECGKAFSQPSALTIHKRMHIGEKPYKCEECGKAFVWSSTLTRHKRLHSGEKPYKCEECAKAFSQFGHLTTHRIIHTGEKPYKCEECGKAFIWPSTLTKHKRIHTGEKPYKCEECGKAFHRSSNLTKHKIIHTGEKPYKCEECGKAFIWSSNLTEHKKIHTREKPYKCEECSKAFSRSSALTTHKRMHTGEKPYKCEECGKAFSQSSTLTAHKIIHTGEKPYKCEECGKAFILSSTLSKHKRIHTGEKPYKCEECGKTFNQSSNLSTHKIIHTGEKPYKCEECGKAFNRSSNLSTHKIIHTGEKPYKCDECGKSFIWSSTLFKHKRIHT

SEQ ID NO: 101214 - protein, 499 aa, Homo sapiens
  Payload ID: 20160
  Gene Name: zinc finger protein 727
  Uniprot ID: A8MUV8
  ENSP ID: ENSP00000485448
MRVLTFRDVAVEFSPEEWECLDSAQQRLYRDVMLENYGNLFSLGLAIFKPDLITYLEQRKEPWNARRQKTVAKHPAGSLHFTAEILLEHDINDSFQKVILRKSGSCDLNTLRLKKDYQRVGNCKGQKSSYNGIHQCLSATRSKTCQYNKCGKAFGLCSIFTEHKKIFSREKCYKCEECGKDCRLSDFTIQKRIHTADRSYKCEECGKACKKFSNLTEHNRVHTGKKPYKCEECGKTFTCSSALTKHKRNHTGDRPYKCEECHKAFRCCSDLTKHKRIHTGEKPYKCKECHKAFRCCSDLTKHKRIHTGEKPYKCNECGKAFMWISALSQHNRIHTGEKPYICEECGKAFTYSSTLISHKRIHMELRPYKCEECGKTFKWFSDLTNHKRIHTGEKPYKCEECGKSFTCSSNLIKHKRIHMEVRPYKCEECGKTFKWFPDLTNHKRIHTGEKPYKCEECGKTFTCSSSLIKHKRSHTGDRPTSAKNVAKPLGGSQTLLNIR

SEQ ID NO: 101215 - protein, 76 aa, Homo sapiens
  Payload ID: 20161
  Gene Name: zinc finger protein 728
  ENSP ID: ENSP00000470208
  MOD_RES (1)..(1): Any amino acid
XEQGKEPWNMKRHELVKEPPGRTGHELWLRKLELSLGTAIGTKVCRPASIALNGYHSPGLWKTQDLSQTVAGRSLG

SEQ ID NO: 101216 - protein, 622 aa, Homo sapiens
  Payload ID: 20161
  Gene Name: zinc finger protein 728
  Uniprot ID: P0DKX0
  ENSP ID: ENSP00000471593
MGSLTFRDVAIQFSLEEWQCLDTAQQNLYRNVMLENYRNLVFLGIAAPKPDLIIFLEQGKEPWNMKRHELVKEPPVICSHFAQDLWPEQGREDSFQKVILRRYEKCGHENLQLKIGCTNVDECKVHKKGYNKLNQSLTTTQSKVFQCGKYANIFHKCSNSKRHKIRHTGKKLLKCKEYVRSFCMLSHLSQHKRIYTRENSYKSEEHGKAFNWSSALTYKRIHTGEKPCKCEECGKAFSKFSILTKHKVIHTGEKHYKCEECGKAFTRSSSLIEHKRSHAGEKPYKCEECGKAFSKASTLTAHKTIHAGEKPYKCEECGKAFNRSSNLMEHKRIHTGEKPCKCEECGKAFGNFSTLTKHKVIHTGEKPYKCEECGKAFSWPSSLTEHKRIHAGDKPYKCEECGKTFKWSSTLTKHKIIHTGEKPYKCEECGKAFTTFSSLTKHKVIHTGEKHYKCEECGKVFSWSSSLTTHKAIHAGEKLYKCEECGKAFKWSSNLMEHKRIHTGEKPYKCEECGKAFSKVANLTKHKVIHTGEKQYKCEECGKAFIWSSRLSEHKRIHTGEKPYKCEECGKAFSWVSVLNKHKKIHAGKKFYKCEECGKDFNQSSHLTTHKRIHTGGKTLQM

SEQ ID NO: 101217 - protein, 1252 aa, Homo sapiens
  Payload ID: 20162
  Gene Name: zinc finger protein 729
  Uniprot ID: A6NN14
  ENSP ID: ENSP00000469582
MPGAPGSLEMGPLTFRDVTIEFSLEEWQCLDTVQQNLYRDVMLENYRNLVFLGMAVFKPDLITCLKQGKEPWNMKRHEMVTKPPVMRSHFTQDLWPDQSTKDSFQEVILRTYARCGHKNLRLRKDCKSANEGKMHKEGYNKLNQCRTATQRKIFQCNKHMKVFHKYSNRNKVRHTKKKTFKCIKCSKSFFMLSCLIRHKRIHIRQNIYKCEERGKAFKSFSTLTKHKIIHTEDKPYKYKKCGNAFKFSSTFTKHKRIHTGETPFRCEECGKAFNQSSNLTDHKRIHTGEKTYKCEECGKAFKGSSNFNAHKVIHTAEKPYKCEDCGKTFNHFSALRKHKIIHTGKKPYKREECGKAFSQSSTLRKHEIIHTGEKPYKCEECGKAFKWSSKLTVHKVVHTGEKPYKCEECGKAFSQFSTLKKHKIIHTGKKPYKCEECGKAFNSSSTLMKHKIIHTGEKPYKCEECGKAFRQSSHLTRHKAIHTGEKPYKCEECGKAFNHFSDLRRHKIIHTGKKPYKCEECGKAFSQSSTLRNHQIIHTGEKPYKCEECGKAFKWSSKLTVHKVIHTGEKPCKCEECGKAFKHFSALRKHKVIHTREKLYKCEECGKAFNNSSILAKHKIIHTGKKPYKCEECGKAFRQSSHLTRHKAIHTGEKPYKCEECGKAFSHFSALRRHKIIHTGKKPYKCEECGKAFSHFSALRRHKIIHTGEKPYKCEECGKAFKWSSKLTVHKVIHTAEKPCKCEECGKSFKHFSALRKHKVIHTREKLYKCEECVKAFNSFSALMKHKVIHTGEKPYKCEECGKAFKWSSKLTVHKVIHTGEKPCKCEECGKAFKHFSALRKHKVIHTGKKPYKCEECGKAFSQSSSLRKHEIIHSGEKPYKCEECGKAFKWLSKLTVHKVIHTAEKPCKCEECGKAFKHFSALRKHKIIHTGKKPYKCEECGKAFNDSSTLMKHKIIHTGKKPYKCAECGKAFKQSSHLTRHKAIHTGEKPYKCEECGKDFNNSSTLKKHKLIHTREKLYKCEECVKAFNNFSALMKHKIIHTGEKPYKCEECGKAFKWSSKLTEHKVIHTGEKPCKCEECDKAFKHFSALRKHKVIHTGKKPYQCDECGKAFNNSSTLTKHKIIHTGEKPYKCEECGKAFSQSSILTKHKIIHSVEKPYKCEECGKAFNQSSHLTRHKTIHTGEKPYKCEECGKAFIQCSYLIRHKTIHTREKPTNVKKVPKLLSNPHTLLDKTIHTGEKPYKCEECAKAF

SEQ ID NO: 101218 - protein, 10 aa, Homo sapiens
  Payload ID: 20162
  Gene Name: zinc finger protein 729
  ENSP ID: ENSP00000485572
MPGAPGSLEM

SEQ ID NO: 101219 - protein, 80 aa, Homo sapiens
  Payload ID: 20163
  Gene Name: zinc finger protein 730
  ENSP ID: ENSP00000469805
  MOD_RES (1)..(1): Any amino acid
XRNLVFLGIAVSKPDLITCLEQEKEPWNLKTHDMVAKPPGTAFSIFYMFVKFYKYMQCQYTFSEFGYFGTSFFHFSGQIC

SEQ ID NO: 101220 - protein, 45 aa, Homo sapiens
  Payload ID: 20163
  Gene Name: zinc finger protein 730
  ENSP ID: ENSP00000469853
MLDNYRNLVFLGIAVSKPDLITCLEQEKEPWNLKTHDMVAKPPGR

SEQ ID NO: 101221 - protein, 503 aa, Homo sapiens
  Payload ID: 20163
  Gene Name: zinc finger protein 730
  Uniprot ID: Q6ZMV8
  ENSP ID: ENSP00000472959
MGALTFRDVAIEFSLEEWQCLDTEQQNLYRNVMLDNYRNLVFLGIAVSKPDLITCLEQEKEPWNLKTHDMVAKPPVICSHIAQDLWPEQGIKDYFQEVILRQYKKCRHENLLLRKGCKNVDEFKMHKKGYNRHNQCLTTSHSKIFQCDKYVKVFHKFSNSNRHKIRHTSKKPFKCKECGKLFCILSHLAQHKKIHTGEKSYKCEEYGKAFNESSNCTTHKRITEKKPYKCKECGKAFNWFSHFTTHKRIHTGEKPYQCEKCGKFFNQSTNLTTHKRIHTGEKPYKCEECGKAFNQSSNLTEHKKIHTKEQPYKCEKCGKAFKWSSTLTKHKRIHNGEKPYKCEECGKAFNRSSTLNRHKITHTGGKPYKYKECGKAFNQSSTLTIHKIIHTVEKFYKCEECGKAFSRISHLTTHKRIHTGEKPYKCEECGRAFNQSSTLTTHKRIHTGEKPYECEECGKAFNRSSTLTTHKIIHSGEKIYKCKECGKAFRRFSHLTRHKTIHT

SEQ ID NO: 101222 - protein, 585 aa, Homo sapiens
  Payload ID: 20164
  Gene Name: zinc finger protein 732
  Uniprot ID: B4DXR9
  ENSP ID: ENSP00000415774
MELLTFRDVAIEFSPEEWKCLDPAQQNLYRDVMLENYRNLISLGVAISNPDLVIYLEQRKEPYKVKIHETVAKHPAVCSHFTQDFLPVQGIEDSFHKLILRRYEKCGHENLELRKSCKRKVQKGGYNEFNQCLSTIQSKIFQCNVHVKVFSTFSNSNQRRIRHTGEKHFKECGKSFQKFSDLTQHQGIHAGEKPYTCEECGKDFKWYLIFNEYEIIHTGEKPFTCEECGNIFTTSSNFAKHKVHTGEKSYKYEECGKAFNRSSTLTKHKRIHAEEKPFTCEECGKIITSSSNVAKHKKIHTGEKLYKCQECGKVFNRSTTLTKHNRIHTGEKPYTCEECGKAFSRSSVLNEHKRIHTGEKPYKCEQCGKAFRQSATLNKHKSIHTGEKPYTCEECGKAFSRFTTLNEHKRIHTGERPHKCEECGKAFGWSTDLNKHKIIHTGEKPYKCEECGKAFGWSAYLSKHKKIHTGEKPYRCEECGKAFLCSRALNKHKTIHTGEKPYECEECGKAFGWSTYLSKHKKIHTGEKPYRCEECGKAFRRSRVLNKYKTIHTGDKTPKCKGCGKAFKWSSYLNQHNKIYTGEKL

SEQ ID NO: 101223 - protein, 584 aa, Homo sapiens [sequence omitted]

SEQ ID NO: 101224 - protein, 412 aa, Homo sapiens
  Payload ID: 20165
  Gene Name: zinc finger protein 735
  Uniprot ID: P0CB33
  ENSP ID: ENSP00000485547
MAKRPGPPGSREMGLLTFRDIAIEFSLAEWQCLDHAQQNLYRDVMLENYRNLFSLGMTVSKPDLIACLEQNKEPQNIKRNEMAAKHPVTCSHFNQDLQPEQSIKDSLQKVIPRTYGKCGHENLQLKKCCKRVDECEVHKGGYNDLNQCLSNTQNKIFQTHKCVKVFSKFSNSNRHNARYTGKKHLKCKKYGKSFCMFSHLNQHQIIHTKEKSYKCEECGKSFNHSSSGTTHKRILTGEKPYRCEECGKAFRWPSNLTRHKRIHTGEKPYACEECGQAFRRSSTLTNHKRIHTGERPYKCEECGKAFSVSSALIYHKRIHTGEKPYTCEECGKAFNCSSTLKTHKIIHTGEKPYTCEECGRTFNCSSTVKAHKRIHTGEKPYKCEECDKAFKWHSSLAKHKIIHTGEKPYKCK

SEQ ID NO: 101225 - protein, 427 aa, Homo sapiens
  Payload ID: 20166
  Gene Name: zinc finger protein 736
  Uniprot ID: B4DX44
  ENSP ID: ENSP00000347210
MGVLTFRDVAVEFSPEEWECLDSAQQRLYRDVMLENYGNLVSLGLAIFKPDLMTCLEQRKEPWKVKRQEAVAKHPAGSFHFTAEILPDHDIKDSFQKVILRKYGSCDLNNLHLKKDYQSVGNCKGQKSSYNGLHQCLSATHSKTCQCNKCGRGFQLCSIFTEHKDIFSREKCHKCEECGKDCRLFSDFTRHKKIHTVERCYKCEECGKAFKKFSNLTEHKRVHTGEKPYKCEGCGKTFTCSSTLVKHKRNHTGDRPYKCEECGKAFKCFSDLTNHKRIHTGEKPYKCEECNKAYRWFSDLAKHKIIHTGDKPYTCNECGKAFKWFSALSKHKRIHTGEKPYICEECGKAFTRSSTLFNHKRIHMEERPYKCEECSKTFKCFSDLTNHKRIHTGEKPYKCEECGKASSWFSHLIRHKRIHTREKLHKC

SEQ ID NO: 101226 - protein, 10 aa, Homo sapiens
  Payload ID: 20166
  Gene Name: zinc finger protein 736
  ENSP ID: ENSP00000391083
MGVLTFRDVA

SEQ ID NO: 101227 - protein, 427 aa, Homo sapiens; identical to SEQ ID NO: 101225
  Payload ID: 20166
  Gene Name: zinc finger protein 736
  Uniprot ID: B4DX44
  ENSP ID: ENSP00000400852

SEQ ID NO: 101228 - protein, 536 aa, Homo sapiens
  Payload ID: 20167
  Gene Name: zinc finger protein 737
  Uniprot ID: O75373
  ENSP ID: ENSP00000395733
MGPLQFRDVAIEFSLEEWHCLDTAQRNLYRNVMLENYRNLVFLGIVVSKPDLITCLEQGKKPLTMKKHEMVANPSVTCSHFARDLWPEQSIKDSFQKVTLRRYENYGHDNLQFKKGCESVDECKVHKRGYNGLNQYLTTTQSKIFQCDKYVKVIHKFSNSNRHKIRHTGKKPFKCIECGKAFNQSSTLTTHKKIHTGEKPFKCEECGKAFNWSSHLTTHKRIHTGEKRYKCEDCGKAFSRFSYLTAHKIIHSGEKPYKCEECGKAFKRSSNLTTHKIIHTGEKPYKCEECGKAFKRSSILTAHKIIHSGEKPYKCEECGKAFKHPSVLTTHKRIHTGEKPYKCEECGRAFKYFSSLTTHKIIHSGEKPYKCEECGKAFNWSSHLTTHKRIHTGEKPYKCEECGEAFKYSSSLTTHKIIHTGQQPFKCEECGKAFKCFSILTTHKRIHTGEKPYKCEECGKAFNSSSHLTAHKRIHTGEKPYKCERCGKAFKRSFILTRHKRIHTGEKPYKCEECGKGFKCPSTLTTHKVIHTGEKL

SEQ ID NO: 101229 - protein, 43 aa, Homo sapiens
  Payload ID: 20167
  Gene Name: zinc finger protein 737
  ENSP ID: ENSP00000470737
MVGVQWRDLGLLQPPPPGFKQFSCLSLLSSWDYRGHCNLETWP

SEQ ID NO: 101230 - protein, 233 aa, Homo sapiens
  Payload ID: 20167
  Gene Name: zinc finger protein 737
  ENSP ID: ENSP00000471784
MKKHEMVANPSVTCSHFARDLWPEQSIKDSFQKVTLRRYENYGHDNLQFKKGCESVDECKVHKRGYNGLNQYLTTTQSKIFQCDKYVKVIHKFSNSNRHKIRHTGKKPFKCIECGKAFNQSSTLTTHKKIHTGEKPFKCEECGKAFNWSSHLTTHKRIHTGEKRYKCEDCGKAFSRFSYLTAHKIIHSGEKPYKCEECGKAFKRSSNLTTHKIIHTGEKPYKCEECGKAFKRS

SEQ ID NO: 101231 - protein, 131 aa, Homo sapiens
  Payload ID: 20167
  Gene Name: zinc finger protein 737
  ENSP ID: ENSP00000471973
MGPLQFRDVAIEFSLEEWHCLDTAQRNLYRNVMLENYRNLVFLGIVVSKPDLITCLEQGKKPLTMKKHEMVANPSETGFHHVGKGGLKLLTSDDLPASASQSTGITGMRHPARPNCVGFYVGRTDHKLWLR

SEQ ID NO: 101232 - protein, 53 aa, Homo sapiens
  Payload ID: 20167
  Gene Name: zinc finger protein 737
  ENSP ID: ENSP00000471995
  MOD_RES (1)..(1): Any amino acid
XHKRIHTGEKPYKCEECGKGFKCPSTLTTHKFFVYCREVAVLLENCYSHLYPH

SEQ ID NO: 101233 - protein, 137 aa, Homo sapiens
  Payload ID: 20168
  Gene Name: zinc finger protein 738
  Uniprot ID: Q8NE65
  ENSP ID: ENSP00000311957
MDDLRYGVYPVKGASGYPGAERNLLEYSYFEKGPLTFRDVVIEFSQEEWQCLDTAQQDLYRKVMLENFRNLVFLGIDVSKPDLITCLEQGKDPWNMKRHSMVATPPESGVLKFPTIIILLSRCFFQSVNICFIYLEP

SEQ ID NO: 101234 - protein, 117 aa, Homo sapiens
  Payload ID: 20168
  Gene Name: zinc finger protein 738
  ENSP ID: ENSP00000370252
MDDLRYGVYPVKGASGYPGAERNLLEYSYFEKGPLTFRDVVIEFSQEEWQCLDTAQQDLYRKVMLENFRNLVFLGIDVSKPDLITCLEQGKDPWNMKRHSMVATPPDGVSLLFPRPE

SEQ ID NO: 101235 - protein, 68 aa, Homo sapiens
  Payload ID: 20168
  Gene Name: zinc finger protein 738
  ENSP ID: ENSP00000470939
MDDLRYGVYPVKGASGYPGAERNLLEYSYFEKTEFRSCCPGWSAMARSQLTSTSASRVQAILLPQPSE

SEQ ID NO: 101236 - protein, 129 aa, Homo sapiens
  Payload ID: 20168
  Gene Name: zinc finger protein 738
  ENSP ID: ENSP00000471336
MDDLRYGVYPVKGASGYPGAERNLLEYSYFEKGPLTFRDVVIEFSQEEWQCLDTAQQDLYRKVMLENFRNLVFLGIDVSKPDLITCLEQGKDPWNMKRHSMVATPPGIFFVVRGGLHKTFKRYNVFQSS

SEQ ID NO: 101237 - protein, 44 aa, Homo sapiens
  Payload ID: 20168
  Gene Name: zinc finger protein 738
  ENSP ID: ENSP00000473241
MMESRSVSQAGVQWRDLGSPQPPPPGFKQFSHFSLLSSWDYRTT

SEQ ID NO: 101238 - protein, 572 aa, Homo sapiens
  Payload ID: 20169
  Gene Name: zinc finger protein 74
  ENSP ID: ENSP00000349098
MLENYQNLLALGPPLHKPDVISHLERGEEPWSMQREVPRGPCPEWELKAVPSQQQGICKEEPAQEPIMERPLGGAQAWGRQAGALQRSQAAPGRRTCHGLGRPVEEFPLRCPLFAQQRVPEGGPLLDTRKNVQATEGRTKAPARLCAGENASTPSEPEKFPQVRRQRGAGAGEGEFVCGECGKAFRQSSSLTLHRRWHSREKAYKCDECGKAFTWSTNLLEHRRIHTGEKPFFCGECGKAFSCHSSLNVHQRIHTGERPYKCSACEKAFSCSSLLSMHLRVHTGEKPYRCGECGKAFNQRTHLTRHHRIHTGEKPYQCGSCGKAFTCHSSLTVHEKIHSGDKPFKCSDCEKAFNSRSRLTLHQRTHTGEKPFKCADCGKGFSCHAYLLVHRRIHSGEKPFKCNECGKAFSSHAYLIVHRRIHTGEKPFDCSQCWKAFSCHSSLIVHQRIHTGEKPYKCSECGRAFSQNHCLIKHQKIHSGEKSFKCEKCGEMFNWSSHLTEHQRLHSEGKPLAIQFNKHLLSTYYVPGSLLGAGDAGLRDVDPIDALDVAKLLCVVPPRAGRNFSLGSKPRN

SEQ ID NO: 101239 - protein, 212 aa, Homo sapiens
  Payload ID: 20169
  Gene Name: zinc finger protein 74
  ENSP ID: ENSP00000350101
MAPGRGTLGLALVSERGSFLSGSCSFPERESRGYIGLGSSRSQVQGIGEFQGCGCGLHPGGVGSTRLPSEGLVPGCDVGELPEPSCPRTSTAQARCDLSSGTRRGAMEHAEGSPQRALSRMGAEGGALSTAGHLQRRTGPGAHHGAAPRRGAGVGAPGRCSAEESGCALGARTCHGLGRPCRGIPPQVSPLRPATRSRGGTLAGHTQERPGH

SEQ ID NO: 101240 - protein, 644 aa, Homo sapiens
  Payload ID: 20169
  Gene Name: zinc finger protein 74
  Uniprot ID: Q16587
  ENSP ID: ENSP00000383301
MEIPAPEPEKTALSSQDPALSLKENLEDISGWGLPEARSKESVSFKDVAVDFTQEEWGQLDSPQRALYRDVMLENYQNLLALGPPLHKPDVISHLERGEEPWSMQREVPRGPCPEWELKAVPSQQQGICKEEPAQEPIMERPLGGAQAWGRQAGALQRSQAAPWAPAPAMVWDVPVEEFPLRCPLFAQQRVPEGGPLLDTRKNVQATEGRTKAPARLCAGENASTPSEPEKFPQVRRQRGAGAGEGEFVCGECGKAFRQSSSLTLHRRWHSREKAYKCDECGKAFTWSTNLLEHRRIHTGEKPFFCGECGKAFSCHSSLNVHQRIHTGERPYKCSACEKAFSCSSLLSMHLRVHTGEKPYRCGECGKAFNQRTHLTRHHRIHTGEKPYQCGSCGKAFTCHSSLTVHEKIHSGDKPFKCSDCEKAFNSRSRLTLHQRTHTGEKPFKCADCGKGFSCHAYLLVHRRIHSGEKPFKCNECGKAFSSHAYLIVHRRIHTGEKPFDCSQCWKAFSCHSSLIVHQRIHTGEKPYKCSECGRAFSQNHCLIKHQKIHSGEKSFKCEKCGEMFNWSSHLTEHQRLHSEGKPLAIQFNKHLLSTYYVPGSLLGAGDAGLRDVDPIDALDVAKLLCVVPPRAGRNFSLGSKPRN

SEQ ID NO: 101241 - protein, 178 aa, Homo sapiens
  Payload ID: 20169
  Gene Name: zinc finger protein 74
  Uniprot ID: Q16587
  ENSP ID: ENSP00000384750
MEIPAPEPEKTGIGEFQGCGCGLHPGGVGSTRLPSEGLVPGCDVGELPEPSCPRTSTAQARCDLSSGTRRGAMEHAEGSPQRALSRMGAEGGALSTAGHLQRRTGPGAHHGAAPRRGAGVGAPGRCSAEESGCALGARTCHGLGRPCRGIPPQVSPLRPATRSRGGTLAGHTQERPGH

SEQ ID NO: 101242 - protein, 612 aa, Homo sapiens
  Payload ID: 20169
  Gene Name: zinc finger protein 74
  Uniprot ID: Q16587
  ENSP ID: ENSP00000385855
MEIPAPEPEKTALSSQDPALSLKENLEDISGWGLPEARSKESVSFKDVAVDFTQEEWGQLDSPQRALYRDVMLENYQNLLALEWELKAVPSQQQGICKEEPAQEPIMERPLGGAQAWGRQAGALQRSQAAPWAPAPAMVWDVPVEEFPLRCPLFAQQRVPEGGPLLDTRKNVQATEGRTKAPARLCAGENASTPSEPEKFPQVRRQRGAGAGEGEFVCGECGKAFRQSSSLTLHRRWHSREKAYKCDECGKAFTWSTNLLEHRRIHTGEKPFFCGECGKAFSCHSSLNVHQRIHTGERPYKCSACEKAFSCSSLLSMHLRVHTGEKPYRCGECGKAFNQRTHLTRHHRIHTGEKPYQCGSCGKAFTCHSSLTVHEKIHSGDKPFKCSDCEKAFNSRSRLTLHQRTHTGEKPFKCADCGKGFSCHAYLLVHRRIHSGEKPFKCNECGKAFSSHAYLIVHRRIHTGEKPFDCSQCWKAFSCHSSLIVHQRIHTGEKPYKCSECGRAFSQNHCLIKHQKIHSGEKSFKCEKCGEMFNWSSHLTEHQRLHSEGKPLAIQFNKHLLSTYYVPGSLLGAGDAGLRDVDPIDALDVAKLLCVVPPRAGRNFSLGSKPRN

SEQ ID NO: 101243 - protein, 69 aa, Homo sapiens
  Payload ID: 20169
  Gene Name: zinc finger protein 74
  ENSP ID: ENSP00000395437
MEIPAPEPEKTALSSQDPALSLKENLEDISGWGLPEARSKSLALVTQAGVQWRNLGSLQPPPLGFKQFS

SEQ ID NO: 101244 - protein, 50 aa, Homo sapiens
  Payload ID: 20169
  Gene Name: zinc finger protein 74
  ENSP ID: ENSP00000397011
MEIPAPEPEKTEWELKAVPSQQQGICKEEPAQEPIMERPLGGAQAWGRQA

SEQ ID NO: 101245 - protein, 644 aa, Homo sapiens; identical to SEQ ID NO: 101240
  Payload ID: 20169
  Gene Name: zinc finger protein 74
  Uniprot ID: Q16587
  ENSP ID: ENSP00000483077

SEQ ID NO: 101246 - protein, 193 aa, Homo sapiens
  Payload ID: 20170
  Gene Name: zinc finger protein 740
  Uniprot ID: Q8NDX6
  ENSP ID: ENSP00000409463
MAQASLLACEGLAGVSLVPTAASKKMMLSQIASKQAENGERAGSPDVLRCSSQGHRKDSDKSRSRKDDDSLSEASHSKKTVKKVVVVEQNGSFQVKIPKNFVCEHCFGAFRSSYHLKRHILIHTGEKPFECDICDMRFIQKYHLERHKRVHSGEKPYQCERCHQCFSRTDRLLRHKRMCQGCQSKTSDGQFSL

SEQ ID NO: 101247 - protein, 644 aa, Homo sapiens
  Payload ID: 20171
  Gene Name: zinc finger protein 746
  Uniprot ID: Q6NUN9
  ENSP ID: ENSP00000345140
MAEAVAAPISPWTMAATIQAMERKIESQAARLLSLEGRTGMAEKKLADCEKTAVEFGNQLEGKWAVLGTLLQEYGLLQRRLENVENLLRNRNFWILRLPPGSKGESPKEWGKLEDWQKELYKHVMRGNYETLVSLDYAISKPEVLSQIEQGKEPCNWRRPGPKIPDVPVDPSPGSGPPVPAPDLLMQIKQEGELQLQEQQALGVEAWAAGQPDIGEEPWGLSQLDSGAGDISTDATSGVHSNFSTTIPPTSWQTDLPPHHPSSACSDGTLKLNTAASTEDVKIVIKTEVQEEEVVATPVHPTDLEAHGTLFGPGQATRFFPSPAQEGAWESQGSSFPSQDPVLGLREPARPERDMGELSPAVAQEETPPGDWLFGGVRWGWNFRCKPPVGLNPRTGPEGLPYSSPDNGEAILDPSQAPRPFNEPCKYPGRTKGFGHKPGLKKHPAAPPGGRPFTCATCGKSFQLQVSLSAHQRSCGAPDGSGPGTGGGGSGSGGGGGGSGGGSARDGSALRCGECGRCFTRPAHLIRHRMLHTGERPFPCTECEKRFTERSKLIDHYRTHTGVRPFTCTVCGKSFIRKDHLRKHQRNHAAGAKTPARGQPLPTPPAPPDPFKSPASKGPLASTDLVTDWTCGLSVLGPTDGGDM

SEQ ID NO: 101248 - protein, 645 aa, Homo sapiens
  Payload ID: 20171
  Gene Name: zinc finger protein 746
  Uniprot ID: Q6NUN9
  ENSP ID: ENSP00000395007
MAEAVAAPISPWTMAATIQAMERKIESQAARLLSLEGRTGMAEKKLADCEKTAVEFGNQLEGKWAVLGTLLQEYGLLQRRLENVENLLRNRNFWILRLPPGSKGESPKEWGKLEDWQKELYKHVMRGNYETLVSLDYAISKPEVLSQIEQGKEPCNWRRPGPKIPDVPVDPSPGSGPPVPAPDLLMQIKQEGELQLQEQQALGVEAWAAGQPDIGEEPWGLSQLDSGAGDISTDATSGVHSNFSTTIPPTSWQTDLPPHHPSSACSDGTLKLNTAASTEADVKIVIKTEVQEEEVVATPVHPTDLEAHGTLFGPGQATRFFPSPAQEGAWESQGSSFPSQDPVLGLREPARPERDMGELSPAVAQEETPPGDWLFGGVRWGWNFRCKPPVGLNPRTGPEGLPYSSPDNGEAILDPSQAPRPFNEPCKYPGRTKGFGHKPGLKKHPAAPPGGRPFTCATCGKSFQLQVSLSAHQRSCGAPDGSGPGTGGGGSGSGGGGGGSGGGSARDGSALRCGECGRCFTRPAHLIRHRMLHTGERPFPCTECEKRFTERSKLIDHYRTHTGVRPFTCTVCGKSFIRKDHLRKHQRNHAAGAKTPARGQPLPTPPAPPDPFKSPASKGPLASTDLVTDWTCGLSVLGPTDGGDM

SEQ ID NO: 101249 - protein, 187 aa, Homo sapiens
  Payload ID: 20171
  Gene Name: zinc finger protein 746
  ENSP ID: ENSP00000420329
MAEAVAAPISPWTMAATIQAMERKIESQAARLLSLEGRTGMAEKKLADCEKTAVEFGNQLEGKWAVLGTLLQEYGLLQRRLENVENLLRNRNFWILRLPPGSKGESPKEWGKLEDWQKELYKHVMRGNYETLVSLDYAISKPEVLSQIEQGKEPCNWRRPGPKIPDVPVDPSPDISVSDFPGASQHL

SEQ ID NO: 101250 - protein, 191 aa, Homo sapiens
  Payload ID: 20172
  Gene Name: zinc finger protein 747
  Uniprot ID: Q9BV97
  ENSP ID: ENSP00000252799
MTDPSLGLTVPMAPPLAPLPPRDPNGAGSEWRKPGAVSFADVAVYFSREEWGCLRPAQRALYRDVMRETYGHLGALGESPTCLPGPCASTGPAAPLGAACGVGGPGAGQAASSQRGVCVLLPQESEAASRRSSPGWRRRPNCGIRLPRIRRWRSVRQKRTQQIPETRKRKDKGKGREPWRSPTLWPPGLLG

SEQ ID NO: 101251 - protein, 190 aa, Homo sapiens
  Payload ID: 20172
  Gene Name: zinc finger protein 747
  Uniprot ID: Q9BV97
  ENSP ID: ENSP00000378528
MTDPSLGLTVPMAPPLAPLPPRDPNGAGSEWRKPGAVSFADVAVYFSREEWGCLRPAQRALYRDVMRETYGHLGALGESPTCLPGPCASTGPAAPLGAACGVGGPGAGQAASSQRGVCVLLPQESEAASRRSSPGWRRRPNCGIRLPRIRRWRSVRQKRTQIPETRKRKDKGKGREPWRSPTLWPPGLLG

SEQ ID NO: 101252 - protein, 330 aa, Homo sapiens; identical to SEQ ID NO: 949
  Payload ID: 20172
  Gene Name: zinc finger protein 747
  ENSP ID: ENSP00000457274

SEQ ID NO: 101253 - protein, 778 aa, Homo sapiens
  Payload ID: 20173
  Gene Name: zinc finger protein 749
  Uniprot ID: O43361
  ENSP ID: ENSP00000333980
MNLTEDCMVFEDVAIYFSQEEWGILNDAQRHLHSNVMLENFALLSSVGCWHGAKDEEVPSKQCVSVRVLQVTIPKPALSTLKAQPCKMCSSILKDILHLAEHDGTHPEQGLYTCAAEHDLHQKEQIREKLTRSDEWRPSFVNHSAHVGERNFTCTQGGKDFTASSDLLQQQVLNSGWKLYRDTQDGEAFQGEQNDFNSSQGGKDFCHQHGLFEHQKTHNGERPYEFSECGELFRYNSNLIKYQQNHAGERPYEGTEYGKTFIRKSNLVQHQKIHSEGFLSKRSDPIEHQEILSRPTPYECTQCGKAFLTQAHLVGHQKTHTGEQPYECNKCGKFFMYNSKLIRHQKVHTGERRYECSECGKLFMDSFTLGRHQRVHTGERPFECSICGKFFSHRSTLNMHQRVHAGKRLYKCSECGKAFSLKHNVVQHLKIHTGERPYECTECEKAFVRKSHLVQHQKIHTDAFSKRSDLIQHKRIDIRPRPYTCSECGKAFLTQAHLVGHQKIHTGERPYECTQCAKAFVRKSHLVQHEKIHTDAFSKRSDLIQHKRIDLRPRPYVCSECGKAFLTQAHLDGHQKIQTGERRYECNECGKFFLDSYKLVIHQRIHTGEKPYKCSKCGKFFRYRCTLSRHQKVHTGERPYECSECGKFFRDSYKLIIHQRVHTGEKPYECSNCGKFLRYRSTFIKHHKVCTGEKPHECSKCRELFRTKSSLIIHQQSHTGESPFKLRECGKDFNKCNTGQRQKTHTGERSYECGESSKVFKYNSSLIKHQIIHTGKRP

SEQ ID NO: 101254 - protein, 66 aa, Homo sapiens
  Payload ID: 20173
  Gene Name: zinc finger protein 749
  ENSP ID: ENSP00000397745
MCSSILKDILHLAEHDGTHPEQGLYTCAAEHDLHQKEQIREKLTRSDEWRPSFVNHSAHVGERNFT

SEQ ID NO: 101255 - protein, 723 aa, Homo sapiens
  Payload ID: 20174
  Gene Name: zinc finger protein 750
  Uniprot ID: Q32MQ0
  ENSP ID: ENSP00000269394
MSLLKERKPKKPHYIPRPPGKPFKYKCFQCPFTCNEKSHLFNHMKYGLCKNSITLVSEQDRVPKCPKSNSLDPKQTNQPDATAKPASSKSVANGLSAFDSKLQHSSAREDIKENLELQARGTHRCLGQKPALHRASPCKSPAPEAALGAQPALEGAARPSAFVPVGEHRLKGPDNAEAPETLALHNPTAKAVSFHTKSAFHTPGYPWKAGSPFLPPEFPHKISSTKGLGAISPYMHPTIPEYPPHFYTEHGLATIYSPYLLAGSSPECDAPLLSVYGTQDPRHFLPHPGPIPKHLAPSPATYDHYRFFQQYPSNLPIPYGFYRPESAFSSYGLRLPPVTGLTRDQSSHLLEEATLVYPASSPSRLNPSDPNRKHVEFESPIPEAKDSSKAGQRDTEGSKMSPRAGSAATGSPGRPSPTDFMQTSQTCEGLYDLSNKAASSALGRLYPPEQSLTAFRPVKKSTECLPAQAAETTAESPVSLNVVNGDPPAPTGSASLVSEAAPSSPDDSSGMGPLNLSKKSEINLAATHEPTYQGSPQAETASFSELQDLPLNLSVKDPCNTQAPRPAFPGRPRAAEPAAAVPQKTGTEGSEDGPSHPETKPGSLDGDGAPPTGPGEEAPDACAVDSSEEQKQTAAVALCQLAAYSPRNIRVGDGDAAAPEPACRQDTPTLSSMESQEAQCDLRPKGQKRTSLRDAGKSQQGAKKAKLQDTARVFTLRRRARVS

SEQ ID NO: 101256 - protein, 324 aa, Homo sapiens
  Payload ID: 20174
  Gene Name: zinc finger protein 750
  ENSP ID: ENSP00000458389
MSPRAGSAATGSPGRPSPTDFMQTSQTCEGLYDLSNKAASSALGRLYPPEQSLTAFRPVKKSTECLPAQAAETTAESPVSLNVVNGDPPAPTGSASLVSEAAPSSPDDSSGMGPLNLSKKSEINLAATHEPTYQGSPQAETASFSELQDLPLNLSVKDPCNTQAPRPAFPGRPRAAEPAAAVPQKTGTEGSEDGPSHPETKPGSLDGDGAPPTGPGEEAPDACAVDSSEEQKQTAAVALCQLAAYSPRNIRVGDGDAAAPEPACRQDTPTLSSMESQEAQCDLRPKGQKRTSLRDAGKSQQGAKKAKLQDTARVFTLRRRARVS

SEQ ID NO: 101257 - protein, 296 aa, Homo sapiens
  Payload ID: 20175
  Gene Name: zinc finger protein 75a
  Uniprot ID: Q96N20
  ENSP ID: ENSP00000459566
MYFSQEEWELLDPTQKALYNDVMQENYETVISLALFVLPKPKVISCLEQGEEPWVQVSPEFKDSAGKSPTGLKLKNDTENHQPVSLSDLEIQASAGVISKKAKVKVPQKTAGKENHFDMHRVGKWHQDFPVKKRKKLSTWKQELLKLMDRHKKDCAREKPFKCQECGKTFRVSSDLIKHQRIHTEEKPYKCQQCDKRFRWSSDLNKHLTTHQGIKPYKCSWCGKSFSQNTNLHTHQRTHTGEKPFTCHECGKKFSQNSHLIKHRRTHTGEQPYTCSICRRNFSRRSSLLRHQKLHL

SEQ ID NO: 101258 - protein, 37 aa, Homo sapiens
  Payload ID: 20175
  Gene Name: zinc finger protein 75a
  ENSP ID: ENSP00000459707
MYFSQEEWELLDPTQKALYNDVMQENYETVISLALFV

SEQ ID NO: 101259 - protein, 296 aa, Homo sapiens; identical to SEQ ID NO: 101257
  Payload ID: 20175
  Gene Name: zinc finger protein 75a
  Uniprot ID: Q96N20
  ENSP ID: ENSP00000482769

SEQ ID NO: 101260 - protein, 153 aa, Homo sapiens
  Payload ID: 20175
  Gene Name: zinc finger protein 75a
  ENSP ID: ENSP00000483325
MMMVDLKVAAYLDPQIRALWETKGPARESSGQSKKSPQMDCLDPKSSCWHFRNFTYDEAGGPREAVSKLQELCHLWLKPEIHSKEQILELLVLEQFLTILPRETQTQMQKHHPQSIEEAVALVEHLQRESGQTWNGVRRKIPDMYSEIGCRWI

SEQ ID NO: 101261 - protein, 415 aa, Homo sapiens
  Payload ID: 20176
  Gene Name: zinc finger protein 75D
  Uniprot ID: P51815
  ENSP ID: ENSP00000359800
MAMRELNADSCSSPQMGAMWETSGSVKENSSQSKKYSTKIENLGPESACRHFWSFRYHEATGPLETISQLQKLCHQWLRPEIHSKEQILEMLVLEQFLSILPKETQNWVQKHHPQNVKQALVLVEFLQREPDGTKNESLLTFEDVAVYFSEEEWQLLNPLEKTLYNDVMQDIYETVISLGLKLKNDTGNDHPISVSTSEIQTSGCEVSKKTRMKIAQKTMGRENPGDTHSVQKWHRAFPRKKRKKPATCKQELPKLMDLHGKGPTGEKPFKCQECGKSFRVSSDLIKHHRIHTGEKPYKCQQCDRRFRWSSDLNKHFMTHQGIKPYRCSWCGKSFSHNTNLHTHQRIHTGEKPFKCDECGKRFIQNSHLIKHQRTHTGEQPYTCSLCKRNFSRRSSLLRHQKLHRRREACLVSPN

SEQ ID NO: 101262 - protein, 510 aa, Homo sapiens
  Payload ID: 20176
  Gene Name: zinc finger protein 75D
  Uniprot ID: P51815
  ENSP ID: ENSP00000359802
MAMRELNADSCSSPQMGAMWETSGSVKENSSQSKKYSTKIENLGPESACRHFWSFRYHEATGPLETISQLQKLCHQWLRPEIHSKEQILEMLVLEQFLSILPKETQNWVQKHHPQNVKQALVLVEFLQREPDGTKNEVTAHELGKEAVLLGGTAVAPGFKWKPAEPQPMGVFQKEYWNTYRVLQEQLGWNTHKETQPVYERAVHDQQMLALSEQKRIKHWKMASKLILPESLSLLTFEDVAVYFSEEEWQLLNPLEKTLYNDVMQDIYETVISLGLKLKNDTGNDHPISVSTSEIQTSGCEVSKKTRMKIAQKTMGRENPGDTHSVQKWHRAFPRKKRKKPATCKQELPKLMDLHGKGPTGEKPFKCQECGKSFRVSSDLIKHHRIHTGEKPYKCQQCDRRFRWSSDLNKHFMTHQGIKPYRCSWCGKSFSHNTNLHTHQRIHTGEKPFKCDECGKRFIQNSHLIKHQRTHTGEQPYTCSLCKRNFSRRSSLLRHQKLHRRREACLVSPN

SEQ ID NO: 101263 - protein, 151 aa, Homo sapiens
  Payload ID: 20177
  Gene Name: zinc finger protein 76
  ENSP ID: ENSP00000229405
MESLGLHTVTLSDGTTAYVQQAVKGEKLLEGQVIQLEDGTTAYIHQVTVQKEALSFEDGQPVQLEDGSMAYIHRTPREGYDPSTLEAVQLEDGSTAYIHHPVAVPSESTILAVQTEVGLEDLAAEDDEGFSADAVVALEQYASKTFPPGSS

SEQ ID NO: 101264 - protein, 515 aa, Homo sapiens
  Payload ID: 20177
  Gene Name: zinc finger protein 76
  Uniprot ID: P36508
  ENSP ID: ENSP00000344097
MESLGLHTVTLSDGTTAYVQQAVKGEKLLEGQVIQLEDGTTAYIHQVTVQKEALSFEDGQPVQLEDGSMAYIHRTPREGYDPSTLEAVQLEDGSTAYIHHPVAVPSESTILAVQTEVGLEDLAAEDDEGFSADAVVALEQYASKVLHDSQIPRNGKGQQVGDRAFRCGYKGCGRLYTTAHHLKVHERAHTGDRPYRCDFPSCGKAFATGYGLKSHVRTHTGEKPYKCPEELCSKAFKTSGDLQKHVRTHTGERPFQCPFEGCGRSFTTSNIRKVHVRTHTGERPYTCPEPHCGRGFTSATNYKNHVRIHTGEKPYVCTVPGCGKRFTEYSSLYKHHVVHTHCKPYTCSTCGKTYRQTSTLAMHKRSAHGELEATEESEQALYEQQQLEAASAAEESPPPKRPRIAYLSEVKEERDDIPAQVAMVTEEDGAPQVALITQDGAQQVTIITSGAVVAEDSSVASLRHQQVALLATANGTHIAVQLEEQQTLEEAINVATAAMQQGAVTLETTVSESGC

SEQ ID NO: 101265 - protein, 570 aa, Homo sapiens
  Payload ID: 20177
  Gene Name: zinc finger protein 76
  Uniprot ID: P36508
  ENSP ID: ENSP00000363064
MESLGLHTVTLSDGTTAYVQQAVKGEKLLEGQVIQLEDGTTAYIHQVTVQKEALSFEDGQPVQLEDGSMAYIHRTPREGYDPSTLEAVQLEDGSTAYIHHPVAVPSESTILAVQTEVGLEDLAAEDDEGFSADAVVALEQYASKVLHDSQIPRNGKGQQVGDRAFRCGYKGCGRLYTTAHHLKVHERAHTGDRPYRCDFPSCGKAFATGYGLKSHVRTHTGEKPYKCPEELCSKAFKTSGDLQKHVRTHTGERPFQCPFEGCGRSFTTSNIRKVHVRTHTGERPYTCPEPHCGRGFTSATNYKNHVRIHTGEKPYVCTVPGCGKRFTEYSSLYKHHVVHTHCKPYTCSTCGKTYRQTSTLAMHKRSAHGELEATEESEQALYEQQQLEAASAAEESPPPKRPRIAYLSEVKEERDDIPAQVAMVTEEDGAPQVALITQDGAQQVSLSPEDLQALGSAISMVTQHGSTTLTIPSPDADLATSGTHTVTMVSADGTQTQPVTIITSGAVVAEDSSVASLRHQQVALLATANGTHIAVQLEEQQTLEEAINVATAAMQQGAVTLETTVSESGC

SEQ ID NO: 101266 - protein, 101 aa, Homo sapiens
  Payload ID: 20177
  Gene Name: zinc finger protein 76
  ENSP ID: ENSP00000418749
  MOD_RES (1)..(1): Any amino acid
XLTIPSPDADLATSGTHTVTMVSADGTQTQPVTIITSGAVVAEDSSVASLRHQQVALLATANGTHIAVQVSRDLGGKGIPRPEKSTRNKGELDEDLEEKGI

SEQ ID NO: 101267 - protein, 340 aa, Homo sapiens
  Payload ID: 20177
  Gene Name: zinc finger protein 76
  ENSP ID: ENSP00000419106
MESLGLHTVTLSDGTTAYVQQAVKGEKLLEGQVIQLEDGTTAYIHQVTVQKEALSFEDGQPVQLEDGSMAYIHRTPREGYDPSTLEAVQLEDGSTAYIHHPVAVPSESTILAVQTEVGLEDLAAEDDEGFSADAVVALEQYASKVLHDSQIPRNGKGQQVGDRAFRCGYKGCGRLYTTAHHLKVHERAHTGDRPYRCDFPSCGKAFATGYGLKSHVRTHTGEKPYKCPEELCSKAFKTSGDLQKHVRTHTGERPFQCPFEGCGRSFTTSNIRKVHVRTHTGERPYTCPEPHCGRGFTSATNYKNHVRIHTGEKPYVCTVPGCGKRFTEYSSLYKHHVVHT

SEQ ID NO: 101268 - protein, 746 aa, Homo sapiens
  Payload ID: 20178
  Gene Name: zinc finger protein 761
  ENSP ID: ENSP00000480218
MAFSQGLLTFRDVAIEFSQEEWKCLDPAQRTLYRDVMLENYRNLVSLDISSKCTMKEFLSTAQGNREVFHAGTLQIHESHHNGDFCYQDVDKDIHDYEFQWQEDERNGHEAPMTKIKKLTGITERYDQSHARNKPIKDQLGSSFHSHLPEMHIFQTEEKIDNQVVKSVHDASLVSTAQRISCRPKTHISNNHGNNFWNSSLLTQKQEVHMREKSFQCNESGKAFNYSSLLRKHQIIHLADKYKCDVCGKLFNQKRNLACHRRCHTGENPYKCNECGKTFSQTSSLTCHRRLHTGEKPYKCEECDKAFHFKSILERHRIIHTEEKPYKCNECGKTFRQKSILTRHHRLHTGEKPYKCNECGKTFSHKSSLTCHHRLHTGEKPYKCNECGKTFSHKSSLTCHRRLHTGEKPYKCEECDKAYSFRSNFEIHRKIHTEDNAYKCNECGKTFSRTSSLTCHRRRHTGEQPYKCEECDKAFRFKSNLERHRRIHTGEKPYKCNECGKTFSRKSYLTCHHRLHTGEKAYKCNECGKTFSWKSSLTCHRRLHSGEKPYKCKECGKTFNQQLTLKRHRRLHSGENPYKCEDSDKAYSFKSNLEIHQKIHTEENPYKCNECGKTFSRTSSLTCHRRLHTGEKPYKCEECDKAFRVKSNLEGHRRIHTGEKPYKCNECGKTFSRKSYFICHHRLHTGEKPYKCNECGKNFSQKSSLICHHRLHTGEKPYKCNECGKTFSQKSNLTCHRRLHTGEKQV

SEQ ID NO: 101269 - protein, 70 aa, Homo sapiens
  Payload ID: 20178
  Gene Name: zinc finger protein 761
  ENSP ID: ENSP00000481271
MAFSQGLLTFRDVAIEFSQEEWKCLDPAQRTLYRDVMLENYRNLVSLGSCCVVEIHLDLLSSRDPPQSPK

SEQ ID NO: 101270 - protein, 746 aa, Homo sapiens; identical to SEQ ID NO: 101268
  Payload ID: 20178
  Gene Name: zinc finger protein 761
  ENSP ID: ENSP00000481272

SEQ ID NO: 101271 - protein, 54 aa, Homo sapiens
  Payload ID: 20178
  Gene Name: zinc finger protein 761
  ENSP ID: ENSP00000481316
MAFSQGLLTFRDVAIEFSQEEWKCLDPAQRTLYRDVMLENYRNLVSLDRVLLCC

SEQ ID NO: 101272 - protein, 19 aa, Homo sapiens
  Payload ID: 20178
  Gene Name: zinc finger protein 761
  ENSP ID: ENSP00000482214
  MOD_RES (1)..(1): Any amino acid
XVEIHLDLLSSRDPPQSPK

SEQ ID NO: 101273 - protein, 397 aa, Homo sapiens
  Payload ID: 20179
  Gene Name: zinc finger protein 763
  Uniprot ID: Q0D2J5
  ENSP ID: ENSP00000369774
MMFQDPVACEDVAVNFTQEEWALLDISQRKLYREVMLETFRNLTSIGKKWKDQNIEYEYQNPRRNFRSLIEGNVNEIKEDSHCGETFTQVPDDRLNFQEKKASPEAKSCDNFVCGEVGIGNSSFNMNIRGDIGHKAYEYQDYAPKPYKCQQPKKAFRYHPSFRTQERNHTGEKPYACKECGKTFISHSGIRRRMVMHSGDGPYKCKFCGKAVHCLRLYLIHERTHTGEKPYECKQCVKSFSYSATHRIHERTHTGEKPYECQQCGKAFHSSSSFQAHKRTHTGGKPYECKQCGKSFSWCHSFQIHERTHTGEKPCECSKCNKAFRSYRSYLRHKRSHTGEKPYQCKECRKAFTYPSSLRRHERTHSAKKPYECKQCGKALSYKFSNTPKNALWRKTL

SEQ ID NO: 101274 - protein, 394 aa, Homo sapiens
  Payload ID: 20179
  Gene Name: zinc finger protein 763
  Uniprot ID: Q0D2J5
  ENSP ID: ENSP00000402017
MDPVACEDVAVNFTQEEWALLDISQRKLYREVMLETFRNLTSIGKKWKDQNIEYEYQNPRRNFRSLIEGNVNEIKEDSHCGETFTQVPDDRLNFQEKKASPEAKSCDNFVCGEVGIGNSSFNMNIRGDIGHKAYEYQDYAPKPYKCQQPKKAFRYHPSFRTQERNHTGEKPYACKECGKTFISHSGIRRRMVMHSGDGPYKCKFCGKAVHCLRLYLIHERTHTGEKPYECKQCVKSFSYSATHRIHERTHTGEKPYECQQCGKAFHSSSSFQAHKRTHTGGKPYECKQCGKSFSWCHSFQIHERTHTGEKPCECSKCNKAFRSYRSYLRHKRSHTGEKPYQCKECRKAFTYPSSLRRHERTHSAKKPYECKQCGKALSYKFSNTPKNALWRKTL

SEQ ID NO: 101275 - protein, 46 aa, Homo sapiens
  Payload ID: 20179
  Gene Name: zinc finger protein 763
  ENSP ID: ENSP00000465057
MDPVACEDVAVNFTQEEWALLDISQRKLYREVMLETFRNLTSIGVS

SEQ ID NO: 101276 - protein, 80 aa, Homo sapiens
  Payload ID: 20179
  Gene Name: zinc finger protein 763
  ENSP ID: ENSP00000465145
MNIRGDIGHKAYEYQDYAPKPYKCQQPKKAFRYHPSFRTQERNHTGEKPYACKECGKTFISHSGIRRRMVMHSGDGPYKC

SEQ ID NO: 101277 - protein, 148 aa, Homo sapiens
  Payload ID: 20179
  Gene Name: zinc finger protein 763
  ENSP ID: ENSP00000468692
MFGVHGNFLGIESRPPLLSLSPSLLYTCEMFQDPVACEDVAVNFTQEEWALLDISQRKLYREVMLETFRNLTSIGKKWKDQNIEYEYQNPRRNFRSLIEGNVNEIKEDSHCGETFTQVPDDRLNFQEKKASPEAKSCDNFVCGEVGIG

SEQ ID NO: 101278 - protein, 408 aa, Homo sapiens
  Payload ID: 20180
  Gene Name: zinc finger protein 764
  Uniprot ID: Q96H86
  ENSP ID: ENSP00000252797
MAPPLAPLPPRDPNGAGPEWREPGAVSFADVAVYFCREEWGCLRPAQRALYRDVMRETYGHLSALGIGGNKPALISWVEEEAELWGPAAQDPEVAKCQTQTDPADSRNKKKERQREGTGALEKPDPVAAGSPGLKSPQAPSAGPPYGWEQLSKAPHRGRPSLCAHPPVPRADQRHGCYVCGKSFAWRSTLVEHVYSHTGEKPFHCTDCGKGFGHASSLSKHRAIHRGERPHRCLECGRAFTQRSALTSHLRVHTGEKPYGCADCGRRFSQSSALYQHRRVHSGETPFPCPDCGRAFAYPSDLRRHVRTHTGEKPYPCPDCGRCFRQSSEMAAHRRTHSGEKPYPCPQCGRRFGQKSAVAKHQWVHRPGAGGHRGRVAGRLSVTLTPGHGDLDPPVGFQLYPEIFQECG

SEQ ID NO: 101279 - protein, 407 aa, Homo sapiens
  Payload ID: 20180
  Gene Name: zinc finger protein 764
  Uniprot ID: Q96H86
  ENSP ID: ENSP00000378526
MAPPLAPLPPRDPNGAGPEWREPGAVSFADVAVYFCREEWGCLRPAQRALYRDVMRETYGHLSALGIGGNKPALISWVEEEAELWGPAAQDPEVAKCQTQTDPDSRNKKKERQREGTGALEKPDPVAAGSPGLKSPQAPSAGPPYGWEQLSKAPHRGRPSLCAHPPVPRADQRHGCYVCGKSFAWRSTLVEHVYSHTGEKPFHCTDCGKGFGHASSLSKHRAIHRGERPHRCLECGRAFTQRSALTSHLRVHTGEKPYGCADCGRRFSQSSALYQHRRVHSGETPFPCPDCGRAFAYPSDLRRHVRTHTGEKPYPCPDCGRCFRQSSEMAAHRRTHSGEKPYPCPQCGRRFGQKSAVAKHQWVHRPGAGGHRGRVAGRLSVTLTPGHGDLDPPVGFQLYPEIFQECG

SEQ ID NO: 101280 - protein, 523 aa, Homo sapiens
  Payload ID: 20181
  Gene Name: zinc finger protein 765
  Uniprot ID: Q7L2R6
  ENSP ID: ENSP00000379689
MALPQGLLTFRDVAIEFSQEEWKCLDPAQRTLYRDVMLENYRNLVSLDISSKCMMKEFSSTAQGNREVFHAGTSQRHESHHNGDFCFQDIDKDIHDIEFQWQEDERNGHEALMTKIKKLTGSTERYDQNYAGNKPVKYQLGFSFHSHLPELHIFHTEEKIDNQVVKSIHDASLVSTAQRISCRPETHISNDYGNNFLNSSLFTQKQEVHMREKSFQCNDSGKAYNCSSLLRKHQLIHLGEKQYKCDICGKVFNSKRYVARHRRCHTGEKPYKCNECGKTFSQTYYLTCHRRLHTGEKPYKCEECDKAFHFKSKLQIHRRIHTGEKPYKCNECGKTFSQKSYLTCHRRLHTGEKPYKCNECGKTFSRKSHFTCHHRVHTGEKPYKCNECSKTFSHKSSLTYHRRLHTEEKPYKCNECGKTFNQQLTLNICRLHSGEKPYKCEECDKAYSFKSNLEIHQKIHTEENPYKCNECGKTFSRTSSLTYHHRLHTGQKPYKCEDCDEAFSFKSNLERHRRIYTGEKLHV

SEQ ID NO: 101281 - protein, 128 aa, Homo sapiens
  Payload ID: 20181
  Gene Name: zinc finger protein 765
  ENSP ID: ENSP00000421579
MMKEFSSTAQGNREVFHAGTSQRHESHHNGDFCFQDIDKDIHDIEFQWQEDERNGHEALMTKIKKLTGSTERYDQNYAGNKPVKYQLGFSFHSHLPELHIFHTEEKIDNQVVKSIHDASLVSTAQRIS

SEQ ID NO: 101282 - protein, 60 aa, Homo sapiens
  Payload ID: 20181
  Gene Name: zinc finger protein 765
  Uniprot ID: Q7L2R6
  ENSP ID: ENSP00000424395
MALPQGLLTFRDVAIEFSQEEWKCLDPAQRTLYRDVMLENYRNLVSLELSGECPLAAPAS

SEQ ID NO: 101283 - protein, 85 aa, Homo sapiens
  Payload ID: 20181
  Gene Name: zinc finger protein 765
  ENSP ID: ENSP00000425657
MALPQSCQGSVHWQHLPPECLPGHHHQPQELRWAELKGNAPKHAGSCVFLSWLLPGQYHCSHARDRQVEQQKYHEDKRSGILFCC

SEQ ID NO: 101284 - protein, 60 aa, Homo sapiens; identical to SEQ ID NO: 101282
  Payload ID: 20181
  Gene Name: zinc finger protein 765
  Uniprot ID: Q7L2R6
  ENSP ID: ENSP00000470468

SEQ ID NO: 101285 - protein, 468 aa, Homo sapiens
  Payload ID: 20182
  Gene Name: zinc finger protein 766
  Uniprot ID: Q5HY98
  ENSP ID: ENSP00000409652
MAQLRRGHLTFRDVAIEFSQEEWKCLDPVQKALYRDVMLENYRNLVSLGICLPDLSIISMMKQRTEPWTVENEMKVAKNPDRWEGIKDINTGRSCAVRSKAGNKPITNQLGLTFQLPLPELEIFQGEGKIYECNQVQKFISHSSSVSPLQRIYSGVKTHIFNKHRNDFVDFPLLSQEQKAHIRRKPYECNEQGKVFRVSSSLPNHQVIHTADKPNRCHECGKTVRDKSGLAEHWRIRTGEKPYKCKECGKLFNRIAYLARHEKVHTGESPYKCNECGKVFSRITYLVRHQKIHTREKPHKCNKCGKVYSSSSYLAQHWRIHTGEKLYKCNKCGKEFSGHSSLTTHLLIHTGEKPYKCKECDKAFRHKFSLTVHQRNHNGEKPYKCHECGKVFTQVSHLARHQKIHTGEKPYKCNECGKVFTQNSHLANHQRIHTGEKPYKCHVCGKVFRHSSWFVQHQRSVHERVLTN

SEQ ID NO: 101286 - protein, 471 aa, Homo sapiens
  Payload ID: 20182
  Gene Name: zinc finger protein 766
  ENSP ID: ENSP00000468950
MLCEGEAQKRKAEESGMPLTQGHLTFRDVAIEFSQEEWKCLDPVQKALYRDVMLENYRNLVSLGICLPDLSIISMMKQRTEPWTVENEMKVAKNPDRWEGIKDINTGRSCAVRSKAGNKPITNQLGLTFQLPLPELEIFQGEGKIYECNQVQKFISHSSSVSPLQRIYSGVKTHIFNKHRNDFVDFPLLSQEQKAHIRRKPYECNEQGKVFRVSSSLPNHQVIHTADKPNRCHECGKTVRDKSGLAEHWRIRTGEKPYKCKECGKLFNRIAYLARHEKVHTGESPYKCNECGKVFSRITYLVRHQKIHTREKPHKCNKCGKVYSSSSYLAQHWRIHTGEKLYKCNKCGKEFSGHSSLTTHLLIHTGEKPYKCKECDKAFRHKFSLTVHQRNHNGEKPYKCHECGKVFTQVSHLARHQKIHTGEKPYKCNECGKVFTQNSHLANHQRIHTGEKPYKCHVCGLSLWSGKESVR

SEQ ID NO: 101287 - protein, 159 aa, Homo sapiens
  Payload ID: 20182
  Gene Name: zinc finger protein 766
  ENSP ID: ENSP00000469186
MMKQRTEPWTVENEMKVAKNPDRWEGIKDINTGRSCAVRSKAGNKPITNQLGLTFQLPLPELEIFQGEGKIYECNQVQKFISHSSSVSPLQRIYSGVKTHIFNKHRNDFVDFPLLSQEQKAHIRRKPYECNEQGKVFRVSSSLPNHQVIHTADKPNRCH

SEQ ID NO: 101288 - protein, 83 aa, Homo sapiens
  Payload ID: 20182
  Gene Name: zinc finger protein 766
  ENSP ID: ENSP00000471620
MLENYRNLVSLGICLPDLSIISMMKQRTEPWTVENEMKVAKNPDRWEGIKDINTGRSCAVRSKAGNKPITNQLGLTFQLPLPE

SEQ ID NO: 101289 - protein, 105 aa, Homo sapiens
  Payload ID: 20182
  Gene Name: zinc finger protein 766
  ENSP ID: ENSP00000471965
MAQLRRGHLTFRDVAIEFSQEEWKCLDPVQKALYRDVMLENYRNLVSLGICLPDLSIISMMKQRTEPWTVENEMKVAKNPDRWEGIKDINTDGVLFCRPGWSTVV

SEQ ID NO: 101290 - protein, 115 aa, Homo sapiens
  Payload ID: 20182
  Gene Name: zinc finger protein 766
  ENSP ID: ENSP00000472041
MLENYRNLVSLGICLPDLSIISMMKQRTEPWTVENEMKVAKNPDRWEGIKDINTGRSCAVRSKAGNKPITNQLGLTFQLPLPELEIFQGEGKIYECNQVQKFISHSSSVSPLQRI

SEQ ID NO: 101291 - protein, 100 aa, Homo sapiens
  Payload ID: 20182
  Gene Name: zinc finger protein 766
  ENSP ID: ENSP00000472708
MGHLTFRDVAIEFSQEEWKCLDPVQKALYRDVMLENYRNLVSLGICLPDLSIISMMKQRTEPWTVENEMKVAKNPDRWEGIKDINTDGVLFCRPGWSTVV

SEQ ID NO: 101292 - protein, 74 aa, Homo sapiens
  Payload ID: 20182
  Gene Name: zinc finger protein 766
  ENSP ID: ENSP00000472743
MLCEGEAQKRKAEESGMPLTQGHLTFRDVAIEFSQEEWKCLDPVQKALYRDVMLENYRNLVSLGICLPDLSIIS

SEQ ID NO: 101293 - protein, 540 aa, Homo sapiens
  Payload ID: 20183
  Gene Name: zinc finger protein 768
  Uniprot ID: Q9H5H4
  ENSP ID: ENSP00000369777
MEREALPWGLEPQDVQSSDEMRSPEGYLRGNMSENEEEEISQQEGSGDYEVEEIPFGLEPQSPGFEPQSPEFEPQSPRFEPESPGFESRSPGLVPPSPEFAPRSPESDSQSPEFESQSPRYEPQSPGYEPRSPGYEPRSPGYESESSRYESQNTELKTQSPEFEAQSSKFQEGAEMLLNPEEKSPLNISVGVHPLDSFTQGFGEQPTGDLPIGPPFEMPTGALLSTPQFEMLQNPLGLTGALRGPGRRGGRARGGQGPRPNICGICGKSFGRGSTLIQHQRIHTGEKPYKCEVCSKAFSQSSDLIKHQRTHTGERPYKCPRCGKAFADSSYLLRHQRTHSGQKPYKCPHCGKAFGDSSYLLRHQRTHSHERPYSCTECGKCYSQNSSLRSHQRVHTGQRPFSCGICGKSFSQRSALIPHARSHAREKPFKCPECGKRFGQSSVLAIHARTHLPGRTYSCPDCGKTFNRSSTLIQHQRSHTGERPYRCAVCGKGFCRSSTLLQHHRVHSGERPYKCDDCGKAFSQSSDLIRHQRTHAAGRR

SEQ ID NO: 101294 - protein, 509 aa, Homo sapiens
  Payload ID: 20183
  Gene Name: zinc finger protein 768
  ENSP ID: ENSP00000456527
MSENEEEEISQQEGSGDYEVEEIPFGLEPQSPGFEPQSPEFEPQSPRFEPESPGFESRSPGLVPPSPEFAPRSPESDSQSPEFESQSPRYEPQSPGYEPRSPGYEPRSPGYESESSRYESQNTELKTQSPEFEAQSSKFQEGAEMLLNPEEKSPLNISVGVHPLDSFTQGFGEQPTGDLPIGPPFEMPTGALLSTPQFEMLQNPLGLTGALRGPGRRGGRARGGQGPRPNICGICGKSFGRGSTLIQHQRIHTGEKPYKCEVCSKAFSQSSDLIKHQRTHTGERPYKCPRCGKAFADSSYLLRHQRTHSGQKPYKCPHCGKAFGDSSYLLRHQRTHSHERPYSCTECGKCYSQNSSLRSHQRVHTGQRPFSCGICGKSFSQRSALIPHARSHAREKPFKCPECGKRFGQSSVLAIHARTHLPGRTYSCPDCGKTFNRSSTLIQHQRSHTGERPYRCAVCGKGFCRSSTLLQHHRVHSGERPYKCDDCGKAFSQSSDLIRHQRTHAAGRR

SEQ ID NO: 101295 - protein, 545 aa, Homo sapiens
  Payload ID: 20184
  Gene Name: zinc finger protein 77
  Uniprot ID: Q15935
  ENSP ID: ENSP00000319053
MDCVIFEEVAVNFTPEEWALLDHAQRSLYRDVMLETCRNLASLDCYIYVRTSGSSSQRDVFGNGISNDEEIVKFTGSDSWSIFGENWRFDNTGDQHQIPQRHLRSQLGRLCESNEGHQCGETLSQTANLLVHKSYPTEAKPSECTKCGKAFENRQRSHTGQRPCKECGQACSCLSCQSPPMKTQTVEKPCNCQDSRTASVTYVKSLSSKKSYECQKCGKAFICPSSFRGHVNSHHGQKTHACKVCGKTFMYYSYLTRHVRTHTGEKPYECKECGKAFSCPSYFREHVRTHTGEKPYECKHCGKSFSCYSSFRDHVRTHTGEKPCQCKHCGKAFTCYSSLREHGRTHSGEKPYECKECGKAFRYPSSLRAHMRMHTGEKPYVCKQCGKAFGCPTYFRRHVKTHSGVKPYQCKECGKAYSFSSSLRIHVRTHTGEKPFECKHCGKAFSCHSSLREHVRTHSGEKPYECNQCGKAFSHAQYFQKHVRSHSGVKPYECTECGKAYSCSSSLRVHVRTHTGERPYECKQCGKTFRYLASLQAHVRTHAGA

SEQ ID NO: 101296 - protein, 691 aa, Homo sapiens
  Payload ID: 20185
  Gene Name: zinc finger protein 770
  Uniprot ID: Q6IQ21
  ENSP ID: ENSP00000348673
MMAENNLKMLKIQQCVVANKLPRNRPYVCNICFKHFETPSKLARHYLIHTGQKPFECDVCHKTFRQLVHLERHQLTHSLPFKCSICQRHFKNLKTFVKHQQLHNETYQNNVKQVRRLLEAKQEKSMYGVYNTFTTEERWALHPCSKSDPMYSMKRRKNIHACTICGKMFPSQSKLDRHVLIHTGQRPFKCVLCTKSFRQSTHLKIHQLTHSEERPFQCCFCQKGFKIQSKLLKHKQIHTRNKAFRALLLKKRRTESRPLPNKLNANQGGFENGEIGESEENNPLDVHSIYIVPFQCPKCEKCFESEQILNEHSCFAARSGKIPSRFKRSYNYKTIVKKILAKLKRARSKKLDNFQSEKKVFKKSFLRNCDLISGEQSSEQTQRTFVGSLGKHGTYKTIGNRKKKTLTLPFSWQNMGKNLKGILTTENILSIDNSVNKKDLSICGSSGEEFFNNCEVLQCGFSVPRENIRTRHKICPCDKCEKVFPSISKLKRHYLIHTGQRPFGCNICGKSFRQSAHLKRHEQTHNEKSPYASLCQVEFGNFNNLSNHSGNNVNYNASQQCQAPGVQKYEVSESDQMSGVKAESQDFIPGSTGQPCLPNVLLESEQSNPFCSYSEHQEKNDVFLYRCSVCAKSFRSPSKLERHYLIHAGQKPFECSVCGKTFRQAPHWKRHQLTHFKERPQGKVVALDSVM

SEQ ID NO: 101297 - protein, 132 aa, Homo sapiens
  Payload ID: 20185
  Gene Name: zinc finger protein 770
  ENSP ID: ENSP00000453474
MMAENNLKMLKIQQCVVANKLPRNRPYVCNICFKHFETPSKLARHYLIHTGQKPFECDVCHKTFRQLVHLERHQLTHSLPFKCSICQRHFKNLKTFVKHQQLHNETYQNNVKQVRRLLEAKQEKSMYGVYNT

SEQ ID NO: 101298 - protein, 317 aa, Homo sapiens
  Payload ID: 20186
  Gene Name: zinc finger protein 771
  Uniprot ID: Q7L3S4
  ENSP ID: ENSP00000323945
MPGEQQAEEEEEEEMQEEMVLLVKGEEDEGEEKYEVVKLKIPMDNKEVPGEAPAPSADPARPHACPDCGRAFARRSTLAKHARTHTGERPFGCTECGRRFSQKSALTKHGRTHTGERPYECPECDKRFSAASNLRQHRRRHTGEKPYACAHCGRRFAQSSNYAQHLRVHTGEKPYACPDCGRAFGGSSCLARHRRTHTGERPYACADCGTRFAQSSALAKHRRVHTGEKPHRCAVCGRRFGHRSNLAEHARTHTGERPYPCAECGRRFRLSSHFIRHRRAHMRRRLYICAGCGRDFKLPPGATAATATERCPECEGS

SEQ ID NO: 101299 - protein, 317 aa, Homo sapiens; identical to SEQ ID NO: 101298
  Payload ID: 20186
  Gene Name: zinc finger protein 771
  Uniprot ID: Q7L3S4
  ENSP ID: ENSP00000416197

SEQ ID NO: 101300 - protein, 62 aa, Homo sapiens
  Payload ID: 20186
  Gene Name: zinc finger protein 771
  ENSP ID: ENSP00000456456
MPGEQQAEEEEEEEMQEEMVLLVKGEEDEGEEKYEVVKLKIPMDNKERHDLALSPRLECSGT

SEQ ID NO: 101301 - protein, 52 aa, Homo sapiens
  Payload ID: 20186
  Gene Name: zinc finger protein 771
  ENSP ID: ENSP00000460549
MPGEQQAEEEEEEEMQEEMVLLVKGEEDEGEEKYEVVKLKIPMDNKEEAECP

SEQ ID NO: 101302 - protein, 489 aa, Homo sapiens
  Payload ID: 20187
  Gene Name: zinc finger protein 772
  Uniprot ID: Q68DY9
  ENSP ID: ENSP00000341165
MAAAEPMGPAQVPMNSEVIVDPIQGQVNFEDVFVYFSQEEWVLLDEAQRLLYRDVMLENFALMASLGHTSFMSHIVASLVMGSEPWVPDWVDMTLAVATETPGGSDPGCWHGMEDEEIPFEQSFSIGMSQIRIPKGGPSTQKAYPCGTCGLVLKDILHLAEHQETHPGQKPYMCVLCGKQFCFSANLHQHQKQHSGEKPFRSDKSRPFLLNNCAVQSMEMSFVTGEACKDFLASSSIFEHHAPHNEWKPHSNTKCEEASHCGKRHYKCSECGKTFSRKDSLVQHQRVHTGERPYECGECGKTFSRKPILAQHQRIHTGEMPYECGICGKVFNHSSNLIVHQRVHTGARPYKCSECGKAYSHKSTLVQHESIHTGERPYECSECGKYFGHKYRLIKHWSVHTGARPYECIACGKFFSQSSDLIAHQRVHNGEKPYVCSECGKAFSHKHVLVQHHRIHTGERPYKCSECGKAFRQRASLIRHWKIHTGERP

SEQ ID NO: 101303 - protein, 448 aa, Homo sapiens
  Payload ID: 20187
  Gene Name: zinc finger protein 772
  Uniprot ID: Q68DY9
  ENSP ID: ENSP00000348992
MAAAEPMGPAQVPMNSEVIVDPIQGQVNFEDVFVYFSQEEWVLLDEAQRLLYRDVMLENFALMASLGCWHGMEDEEIPFEQSFSIGMSQIRIPKGGPSTQKAYPCGTCGLVLKDILHLAEHQETHPGQKPYMCVLCGKQFCFSANLHQHQKQHSGEKPFRSDKSRPFLLNNCAVQSMEMSFVTGEACKDFLASSSIFEHHAPHNEWKPHSNTKCEEASHCGKRHYKCSECGKTFSRKDSLVQHQRVHTGERPYECGECGKTFSRKPILAQHQRIHTGEMPYECGICGKVFNHSSNLIVHQRVHTGARPYKCSECGKAYSHKSTLVQHESIHTGERPYECSECGKYFGHKYRLIKHWSVHTGARPYECIACGKFFSQSSDLIAHQRVHNGEKPYVCSECGKAFSHKHVLVQHHRIHTGERPYKCSECGKAFRQRASLIRHWKIHTGERP

SEQ ID NO: 101304 - protein, 377 aa, Homo sapiens
  Payload ID: 20187
  Gene Name: zinc finger protein 772
  Uniprot ID: Q68DY9
  ENSP ID: ENSP00000395967
MEDEEIPFEQSFSIGMSQIRIPKGGPSTQKAYPCGTCGLVLKDILHLAEHQETHPGQKPYMCVLCGKQFCFSANLHQHQKQHSGEKPFRSDKSRPFLLNNCAVQSMEMSFVTGEACKDFLASSSIFEHHAPHNEWKPHSNTKCEEASHCGKRHYKCSECGKTFSRKDSLVQHQRVHTGERPYECGECGKTFSRKPILAQHQRIHTGEMPYECGICGKVFNHSSNLIVHQRVHTGARPYKCSECGKAYSHKSTLVQHESIHTGERPYECSECGKYFGHKYRLIKHWSVHTGARPYECIACGKFFSQSSDLIAHQRVHNGEKPYVCSECGKAFSHKHVLVQHHRIHTGERPYKCSECGKAFRQRASLIRHWKIHTGERP

SEQ ID NO: 101305 - protein, 72 aa, Homo sapiens
  Payload ID: 20187
  Gene Name: zinc finger protein 772
  ENSP ID: ENSP00000400754
MAAAEPMGPAQVPMNSEVIVDPIQVRGECPCSHRSHPHPIRSPALWCYIEHSPATLRSLGSEDSGEAPSPGS

SEQ ID NO: 101306 - protein, 42 aa, Homo sapiens
  Payload ID: 20187
  Gene Name: zinc finger protein 772
  ENSP ID: ENSP00000415214
MAAAEPMGPAQVPMNSEVIVDPIQVVGMEWRMKRYLLSRAFL

SEQ ID NO: 101307 - protein, 38 aa, Homo sapiens
  Payload ID: 20187
  Gene Name: zinc finger protein 772
  ENSP ID: ENSP00000471079
MAAAEPMGPAQVPMNSEVIVDPIQEHELNNYSCKKAHS

SEQ ID NO: 101308 - protein, 25 aa, Homo sapiens
  Payload ID: 20187
  Gene Name: zinc finger protein 772
  ENSP ID: ENSP00000471647
MAAAEPMGPAQEHELNNYSCKKAHS

SEQ ID NO: 101309 - protein, 417 aa, Homo sapiens
  Payload ID: 20187
  Gene Name: zinc finger protein 772
  ENSP ID: ENSP00000477730
MNSEVIVDPIQGQVNFEDVFVYFSQEEWVLLDEAQRLLYRDVMLENFALMASLGHTSFMSHIVASLVMGSEPWVPDWVDMTLAVATETPGGSCWHGMEDEEIPFEQSFSIGIANLHQHQKQHSGEKPFRSDKSRPFLLNNCAVQSMEMSFVTGEACKDFLASSSIFEHHAPHNEWKPHSNTKCEEASHCGKRHYKCSECGKTFSRKDSLVQHQRVHTGERPYECGECGKTFSRKPILAQHQRIHTGEMPYECGICGKVFNHSSNLIVHQRVHTGARPYKCSECGKAYSHKSTLVQHESIHTGERPYECSECGKYFGHKYRLIKHWSVHTGARPYECIACGKFFSQSSDLIAHQRVHNGEKPYVCSECGKAFSHKHVLVQHHRIHTGERPYKCSECGKAFRQRASLIRHWKIHTGERP

SEQ ID NO: 101310 - protein, 414 aa, Homo sapiens
  Payload ID: 20187
  Gene Name: zinc finger protein 772
  ENSP ID: ENSP00000480278
MAAAEPMGPAQGQVNFEDVFVYFSQEEWVLLDEAQRLLYRDVMLENFALMASLGHTSFMSHIVASLVMGSEPWVPDWVDMTLAVATGCWHGMEDEEIPFEQSFSIGIFSANLHQHQKQHSGEKPFRSDKSRPFLLNNCAVQSMEMSFVTGEACKDFLASSSIFEHHAPHNEWKPHSNTKCEEASHCGKRHYKCSECGKTFSRKDSLVQHQRVHTGERPYECGECGKTFSRKPILAQHQRIHTGEMPYECGICGKVFNHSSNLIVHQRVHTGARPYKCSECGKAYSHKSTLVQHESIHTGERPYECSECGKYFGHKYRLIKHWSVHTGARPYECIACGKFFSQSSDLIAHQRVHNGEKPYVCSECGKAFSHKHVLVQHHRIHTGERPYKCSECGKAFRQRASLIRHWKIHTGERP

SEQ ID NO: 101311 - protein, 442 aa, Homo sapiens
  Payload ID: 20188
  Gene Name: zinc finger protein 773
  Uniprot ID: Q6PK81
  ENSP ID: ENSP00000282292
MAAATLRDPAQQGYVTFEDVAVYFSQEEWRLLDDAQRLLYRNVMLENFTLLASLGLASSKTHEITQLESWEEPFMPAWEVVTSAILRGSWQGAKAEAAAEQSASVEVPSSNVQQHQKQHCGEKPLKRQEGRVPVLRSCRVHLSEKSLQSREVGKDLLTSSGVLKHQVTHTGEKSHRSSKSREAFHAGKRHYKCSECGKAFGQKYLLVQHQRLHTGEKPYECSECGKLFSHKSNLFIHQIVHTGERPYGCSDCGKSFSRNADLIQHQRVHTGEKPFTCSECGKAFRHNSTLVQHHRIHTGVRPYECSECGKLFSFNSSLMKHQRVHTGERPYKCSECGKFYSHKSSLINHWRVHTGERPYECSECGKFFSQSSSLMQHRKVHTGEKPFKCNECGRFFSENSSLVKHQRVHTGAKPYECRECGKFFRHSSSLVKHRRIHTGEIQ

SEQ ID NO: 101312 - protein, 117 aa, Homo sapiens
  Payload ID: 20188
  Gene Name: zinc finger protein 773
  ENSP ID: ENSP00000468846
MAAATLRDPAQQGYVTFEDVAVYFSQEEWRLLDDAQRLLYRNVMLENFTLLASLGLASSKTHEITQLESWEEPFMPAWEVVTSAILRVWLRNRSANLLTQIFFPNRQPQVAPEQGRE

SEQ ID NO: 101313 - protein, 117 aa, Homo sapiens; identical to SEQ ID NO: 101312
  Payload ID: 20188
  Gene Name: zinc finger protein 773
  ENSP ID: ENSP00000469199

SEQ ID NO: 101314 - protein, 441 aa, Homo sapiens
  Payload ID: 20188
  Gene Name: zinc finger protein 773
  Uniprot ID: Q6PK81
  ENSP ID: ENSP00000469416
MAAATLRDPAQGYVTFEDVAVYFSQEEWRLLDDAQRLLYRNVMLENFTLLASLGLASSKTHEITQLESWEEPFMPAWEVVTSAILRGSWQGAKAEAAAEQSASVEVPSSNVQQHQKQHCGEKPLKRQEGRVPVLRSCRVHLSEKSLQSREVGKDLLTSSGVLKHQVTHTGEKSHRSSKSREAFHAGKRHYKCSECGKAFGQKYLLVQHQRLHTGEKPYECSECGKLFSHKSNLFIHQIVHTGERPYGCSDCGKSFSRNADLIQHQRVHTGEKPFTCSECGKAFRHNSTLVQHHRIHTGVRPYECSECGKLFSFNSSLMKHQRVHTGERPYKCSECGKFYSHKSSLINHWRVHTGERPYECSECGKFFSQSSSLMQHRKVHTGEKPFKCNECGRFFSENSSLVKHQRVHTGAKPYECRECGKFFRHSSSLVKHRRIHTGEIQ

SEQ ID NO: 101315 - protein, 101 aa, Homo sapiens
  Payload ID: 20188
  Gene Name: zinc finger protein 773
  ENSP ID: ENSP00000470189
MAAATLRDPAQGYVTFEDVAVYFSQEEWRLLDDAQRLLYRNVMLENFTLLASLGLASSKTHEITQLESWEEPFMPAWEVVTSAILRVPNRQPQVAPEQGRE

SEQ ID NO: 101316 - protein, 483 aa, Homo sapiens
  Payload ID: 20189
  Gene Name: zinc finger protein 774
  Uniprot ID: Q6NX45
  ENSP ID: ENSP00000346348
MWLGTSGKSGLPGHCLENPLQECHPAQLEEWALKGISRPSVISQPEQKEEPWVLPLQNFEARKIPRESHTDCEHQVAKLNQDNSETAEQCGTSSERTNKDLSHTLSWGGNWEQGLELEGQHGTLPGEGQLESFSQERDLNKLLDGYVGEKPMCAECGKSFNQSSYLIRHLRTHTGERPYTCIECGKGFKQSSDLVTHRRTHTGEKPYQCKGCEKKFSDSSTLIKHQRTHTGERPYECPECGKTFGRKPHLIMHQRTHTGEKPYACLECHKSFSRSSNFITHQRTHTGVKPYRCNDCGESFSQSSDLIKHQRTHTGERPFKCPECGKGFRDSSHFVAHMSTHSGERPFSCPDCHKSFSQSSHLVTHQRTHTGERPFKCENCGKGFADSSALIKHQRIHTGERPYKCGECGKSFNQSSHFITHQRIHLGDRPYRCPECGKTFNQRSHFLTHQRTHTGEKPFHCSKCNKSFRQKAHLLCHQNTHLI

SEQ ID NO: 101317 - protein, 87 aa, Homo sapiens
  Payload ID: 20189
  Gene Name: zinc finger protein 774
  ENSP ID: ENSP00000368383
MWLGTSGKSGLPGHCLENPLQECHPAQLEEWALKGISRPSVISQPEQKEEPWVLPLQNFEARKIPRESHTGPSRLCTSTFLHSIEIN

SEQ ID NO: 101318 - protein, 44 aa, Homo sapiens
  Payload ID: 20189
  Gene Name: zinc finger protein 774
  ENSP ID: ENSP00000453202
MWLGTSGKSGLPGHCLENPLQECHPAQLEEWALKGLGWTLTSAT

SEQ ID NO: 101319 - protein, 78 aa, Homo sapiens
  Payload ID: 20189
  Gene Name: zinc finger protein 774
  ENSP ID: ENSP00000454184
MWLGTSGKSGLPGHCLENPLQECHPAQLEEWALKGISRPSVISQPEQKEEPWVLPLQNFEARKIPRESHTDCEHQVAK

SEQ ID NO: 101320 - protein, 537 aa, Homo sapiens
  Payload ID: 20190
  Gene Name: zinc finger protein 775
  Uniprot ID: Q96BV0
  ENSP ID: ENSP00000330838
MESGLAGNGTGAGLVMKVKQEKPERLLQTLAPQAMLVEKDKENIFQQHRGLPPRQTMGRPRALGGQEESGSPRWAPPTEQDAGLAGRAPGSASGPLSPSLSSGEGHFVCLDCGKRFSWWSSLKIHQRTHTGEKPYLCGKCGKSFSQKPNLARHQRHHTGERPFCCPECARRFSQKQHLLKHQKTHSRPATHSCPECERCFRHQVGLRIHQRAHARDRQGSRAGLHELIQDAAARRACRLQPGPPRGRPEWAWLGLCQGWWGQPGARAAVSGPEGPGEPRQFICNECGKSFTWWSSLNIHQRIHTGERPYACPECGRRFSQKPNLTRHLRNHTGERPHPCPHCGRGFRQKQHLLKHLRTHLPGAQAAPCPSCGKSCRSRAALRAHQRAHAVAEPAVPAGEPGDQPQAEAIPGLAARPRSSQRSPGARDTLWGRGQAGLAGPGEPRQFICNECGKSFSWWSALTIHQRIHTGERPYPCPECGRRFSQKPNLTRHRRNHTGERPYLCPACGRGFSQKQHLLKHQRVHRAAPACSPKEEAR

SEQ ID NO: 101321 - protein, 166 aa, Homo sapiens
  Payload ID: 20190
  Gene Name: zinc finger protein 775
  ENSP ID: ENSP00000417483
MESGLAGNGTGAGLVMKVKQEKPERLLQTLAPQAMLVEKDKENIFQQHRGLPPRQTMGRPRALGGQEESGSPRWAPPTEQDAGLAGRAPGSASGPLSPSLSSGEGHFVCLDCGKRFSWWSSLKIHQRTHTGEKPYLCGKCGKSFSQKPNLARHQRHHTGERPFCCP

SEQ ID NO: 101322 - protein, 144 aa, Homo sapiens
  Payload ID: 20190
  Gene Name: zinc finger protein 775
  ENSP ID: ENSP00000419336
MESGLAGNGTGAGLVMKVKQEKPERLLQTLAPQAMLVEKDKENIFQQHRGLPPRQTMGRPRALGGQEESGSPRWAPPTEQDAGLAGRAPGSASGPLSPSLSSGEGHFVCLDCGKRFSWWSSLKIHQRTHTGEKPYLCGKCGKSF

SEQ ID NO: 101323 - protein, 518 aa, Homo sapiens
  Payload ID: 20191
  Gene Name: zinc finger protein 776
  Uniprot ID: Q68DI1
  ENSP ID: ENSP00000321812
MAAAALRPPAQGTVTFEDVAVNFSQEEWSLLSEAQRCLYHDVMLENLTLISSLGCWYGAKDETPSKQTLSIQQESPLRTHWTGVCTKKVHLWGMCGPLLGDILHQGTQHNQKLNGFGAYEKKLDDDANHHQDQKQHIGEKSYRSNAKGTSFVKNCKFHMSHEPFIFHEVGKDFLSSLRLLQQEDIHTSGKSNFETKHGIPLQGGKTHYICGESTIPFSNKHSLVLHQRLLPREGPYVCSDSGKFTSKSNSFNNHQGVRTGKRPYQCGQCDESFWYKAHLTEHQRVHTGERPYECGECDKSFSHKHSLVDHQRVHTGERPYECDECGKSFSHKRSLVHHQRVHTGERPYQCGECGKSFNHKCNLIQHQRVHTGERPFECTACGKLFRSNSHLKEHQRVHTGERPYECKECRKSFRYKSHLTEHQRVHTGERPYECRECGKCFHQKGSLIQHQQIHSGERPHECGECGKCFHQKGSLIRHQQIHSGERPHECGECGKCFRQKGNLIKHQRVHTGERHHEC

SEQ ID NO: 101324 - protein, 58 aa, Homo sapiens
  Payload ID: 20191
  Gene Name: zinc finger protein 776
  ENSP ID: ENSP00000405772
MAAAALRPPAQGTVTFEDVAVNFSQEEWSLLSEAQRCLYHDVMLENLTLISSLAFYFF

SEQ ID NO: 101325 - protein, 38 aa, Homo sapiens
  Payload ID: 20191
  Gene Name: zinc finger protein 776
  ENSP ID: ENSP00000416901
  MOD_RES (1)..(1): Any amino acid
XVAVNFSQEEWSLLSEAQRCLYHDVMLENLTLISSLGK

SEQ ID NO: 101326 - protein, 831 aa, Homo sapiens
  Payload ID: 20192
  Gene Name: zinc finger protein 777
  Uniprot ID: Q9ULD5
  ENSP ID: ENSP00000247930
MENQRSSPLSFPSVPQEETLRQAPAGLPRETLFQSRVLPPKEIPSLSPTIPRQGSLPQTSSAPKQETSGRMPHVLQKGPSLLCSAASEQETSLQGPLASQEGTQYPPPAAAEQEVSLLSHSPHHQEAPVHSPEAPEKDPLTLSPTVPETDMDPLLQSPVSQKDTPFQISSAVQKEQPLPTAEITRLAVWAAVQAVERKLEAQAMRLLTLEGRTGTNEKKIADCEKTAVEFANHLESKWVVLGTLLQEYGLLQRRLENMENLLKNRNFWILRLPPGSNGEVPKVPVTFDDVAVHFSEQEWGNLSEWQKELYKNVMRGNYESLVSMDYAISKPDLMSQMERGERPTMQEQEDSEEGETPTDPSAAHDGIVIKIEVQTNDEGSESLETPEPLMGQVEEHGFQDSELGDPCGEQPDLDMQEPENTLEESTEGSSEFSELKQMLVQQRNCTEGIVIKTEEQDEEEEEEEEDELPQHLQSLGQLSGRYEASMYQTPLPGEMSPEGEESPPPLQLGNPAVKRLAPSVHGERHLSENRGASSQQQRNRRGERPFTCMECGKSFRLKINLIIHQRNHIKEGPYECAECEISFRHKQQLTLHQRIHRVRGGCVSPERGPTFNPKHALKPRPKSPSSGSGGGGPKPYKCPECDSSFSHKSSLTKHQITHTGERPYTCPECKKSFRLHISLVIHQRVHAGKHEVSFICSLCGKSFSRPSHLLRHQRTHTGERPFKCPECEKSFSEKSKLTNHCRVHSRERPHACPECGKSFIRKHHLLEHRRIHTGERPYHCAECGKRFTQKHHLLEHQRAHTGERPYPCTHCAKCFRYKQSLKYHLRTHTGE

SEQ ID NO: 101327 - protein, 687 aa, Homo sapiens
  Payload ID: 20193
  Gene Name: zinc finger protein 778
  Uniprot ID: Q96MU6
  ENSP ID: ENSP00000305203
MLENYENLASVGHHLFQPSVIYWLEQEEELRAGRRAVLQEWRLKTKGPALRQDRSWFRASNETQTARSHNGGQLCDRTQCGEAFSEHSGLSTHVRTQNTGDSCVSNHYERDFFIPCQKTLFKIGEQFSVLGQCGKAFSSTPNVVSQQACTRDRSLDYSSCGEVFLNQSYLQARAGSHNGEETWKWKPCGKALTHSMGCATPVEMHAVRNPHVCRECGKAFRYTAYLTGRVQVHPGEKPCELEECGKASPVSSSLTQHVRIHAAEKPCECKECGKAFTGLSGLSKHVQTDPGQKPYECKDCGKACGGFYLLNEHGKTHTREKPFACVVCGKYFRNSSCLNNHVRIHTGIKPYTCSYCGKAFTVRCGLTRHVRTHTGEKPYTCKDCGKAFCTSSGLTEHVRTHTGEKPYECKDCGKSFTVSSSLTEHARIHTGEKPYECKQCGKAFTGRSGLTKHMRTHTGEKPYECKDCGKAYNRVYLLNEHVKTHTEEKPFICTVCRKSFRNSSCLNKHIQIHTGIKPYECKDCGKTFTVSSSLTEHIRTHTGEKPYECKVCGKAFTTSSHLIVHIRTHTGEKPYICKECGKAFASSSHLIEHRRTHTGEKPYICNECGKAFRASSHLHKHGRIHTGQKPYKCKECGKAYNRFYLLKEHLKTYTEEQVFVCKDCGKSFKNSSCLNHHTQIHTDEKPF

SEQ ID NO: 101328 - protein, 757 aa, Homo sapiens
  Payload ID: 20193
  Gene Name: zinc finger protein 778
  ENSP ID: ENSP00000405289
MAAPDLAHGGHVSRDSVCLHEEQTQAAGMVAGWLINCYQDAVTFDDVAVDFTQEEWTLLDPSQRDLYRDVMLENYENLASVGHHLFQPSVIYWLEQEEELRAGRRAVLQEWRLKTKGPALRQDRSWFRASNETQTARSHNGGQLCDRTQCGEAFSEHSGLSTHVRTQNTGDSCVSNHYERDFFIPCQKTLFKIGEQFSVLGQCGKAFSSTPNVVSQQACTRDRSLDYSSCGEVFLNQSYLQARAGSHNGEETWKWKPCGKALTHSMGCATPVEMHAVRNPHVCRECGKAFRYTAYLTGRVQVHPGEKPCELEECGKASPVSSSLTQHVRIHAAEKPCECKECGKAFTGLSGLSKHVQTDPGQKPYECKDCGKACGGFYLLNEHGKTHTREKPFACVVCGKYFRNSSCLNNHVRIHTGIKPYTCSYCGKAFTVRCGLTRHVRTHTGEKPYTCKDCGKAFCTSSGLTEHVRTHTGEKPYECKDCGKSFTVSSSLTEHARIHTGEKPYECKQCGKAFTGRSGLTKHMRTHTGEKPYECKDCGKAYNRVYLLNEHVKTHTEEKPFICTVCRKSFRNSSCLNKHIQIHTGIKPYECKDCGKTFTVSSSLTEHIRTHTGEKPYECKVCGKAFTTSSHLIVHIRTHTGEKPYICKECGKAFASSSHLIEHRRTHTGEKPYICNECGKAFRASSHLHKHGRIHTGQKPYKCKECGKAYNRFYLLKEHLKTYTEEQVFVCKDCGKSFKNSSCLNHHTQIHTDEKPF

SEQ ID NO: 101329 - protein, 47 aa, Homo sapiens
  Payload ID: 20193
  Gene Name: zinc finger protein 778
  ENSP ID: ENSP00000456655
MAAPDLAHGGHVSRDSVCLHEEQTQAAGMVAGWLINCYQDITCSNPV

SEQ ID NO: 101330 - protein, 81 aa, Homo sapiens
  Payload ID: 20193
  Gene Name: zinc finger protein 778
  ENSP ID: ENSP00000457800
MAAPDLAHGGHVSRDSVCLHEEQTQAAGMVAGWLINCYQDAVTFDDVAVDFTQEEWTLLDPSQRDLYRDVMLENYENLASV

SEQ ID NO: 101331 - protein, 729 aa, Homo sapiens
  Payload ID: 20193
  Gene Name: zinc finger protein 778
  Uniprot ID: Q96MU6
  ENSP ID: ENSP00000481538
MAAPDLAHGGHVSRDSVCLHEEQTQAAGMVAGWLINCYQDAVTFDDVAVDFTQEEWTLLDPSQRDLYRDVMLENYENLASVEWRLKTKGPALRQDRSWFRASNETQTARSHNGGQLCDRTQCGEAFSEHSGLSTHVRTQNTGDSCVSNHYERDFFIPCQKTLFKIGEQFSVLGQCGKAFSSTPNVVSQQACTRDRSLDYSSCGEVFLNQSYLQARAGSHNGEETWKWKPCGKALTHSMGCATPVEMHAVRNPHVCRECGKAFRYTAYLTGRVQVHPGEKPCELEECGKASPVSSSLTQHVRIHAAEKPCECKECGKAFTGLSGLSKHVQTDPGQKPYECKDCGKACGGFYLLNEHGKTHTREKPFACVVCGKYFRNSSCLNNHVRIHTGIKPYTCSYCGKAFTVRCGLTRHVRTHTGEKPYTCKDCGKAFCTSSGLTEHVRTHTGEKPYECKDCGKSFTVSSSLTEHARIHTGEKPYECKQCGKAFTGRSGLTKHMRTHTGEKPYECKDCGKAYNRVYLLNEHVKTHTEEKPFICTVCRKSFRNSSCLNKHIQIHTGIKPYECKDCGKTFTVSSSLTEHIRTHTGEKPYECKVCGKAFTTSSHLIVHIRTHTGEKPYICKECGKAFASSSHLIEHRRTHTGEKPYICNECGKAFRASSHLHKHGRIHTGQKPYKCKECGKAYNRFYLLKEHLKTYTEEQVFVCKDCGKSFKNSSCLNHHTQIHTDEKPF

SEQ ID NO: 101332 - protein, 641 aa, Homo sapiens
  Payload ID: 20194
  Gene Name: zinc finger protein 780A
  Uniprot ID: O75290
  ENSP ID: ENSP00000341507
MVHGSVTFRDVAIDFSQEEWECLQPDQRTLYRDVMLENYSHLISLGSSISKPDVITLLEQEKEPWMVVRKETSRRYPDLELKYGPEKVSPENDTSEVNLPKQVIKQISTTLGIEAFYFRNDSEYRQFEGLQGYQEGNINQKMISYEKLPTHTPHASLICNTHKPYECKECGKYFSRSANLIQHQSIHTGEKPFECKECGKAFRLHIQFTRHQKFHTGEKPFECNECGKAFSLLTLLNRHKNIHTGEKLFECKECGKSFNRSSNLVQHQSIHSGVKPYECKECGKGFNRGAHLIQHQKIHSNEKPFVCKECGMAFRYHYQLIEHCQIHTGEKPFECKECGKAFTLLTKLVRHQKIHTGEKPFECRECGKAFSLLNQLNRHKNIHTGEKPFECKECGKSFNRSSNLVQHQSIHAGIKPYECKECGKGFNRGAHLIQHQKIHSNEKPFVCRECEMAFRYHCQLIEHSRIHTGDKPFECQDCGKAFNRGSSLVQHQSIHTGEKPYECKECGKAFRLYLQLSQHQKTHTGEKPFECKECGKFFRRGSNLNQHRSIHTGKKPFECKECGKAFRLHMHLIRHQKLHTGEKPFECKECGKAFRLHMQLIRHQKLHTGEKPFECKECGKVFSLPTQLNRHKNIHTGEKAS

SEQ ID NO: 101333 - protein, 607 aa, Homo sapiens
  Payload ID: 20194
  Gene Name: zinc finger protein 780A
  ENSP ID: ENSP00000387705
MLENYSHLISLGSSISKPDVITLLEQEKEPWMVVRKETSRRYPDLELKYGPEKVSPENDTSEVNLPKQVIKQISTTLGIEAFYFRNDSEYRQFEGLQGYQEGNINQKMISYEKLPTHTPHASLICNTHKPYECKECGKYFSRSANLIQHQSIHTGEKPFECKECGKAFRLHIQFTRHQKFHTGEKPFECNECGKAFSLLTLLNRHKNIHTGEKLFECKECGKSFNRSSNLVQHQSIHSGVKPYECKECGKGFNRGAHLIQHQKIHSNEKPFVCKECGMAFRYHYQLIEHCQIHTGEKPFECKECGKAFTLLTKLVRHQKIHTGEKPFECRECGKAFSLLNQLNRHKNIHTGEKPFECKECGKSFNRSSNLVQHQSIHAGIKPYECKECGKGFNRGAHLIQHQKIHSNEKPFVCRECEMAFRYHCQLIEHSRIHTGDKPFECQDCGKAFNRGSSLVQHQSIHTGEKPYECKECGKAFRLYLQLSQHQKTHTGEKPFECKECGKFFRRGSNLNQHRSIHTGKKPFECKECGKAFRLHMHLIRHQKLHTGEKPFECKECGKAFRLHMQLIRHQKLHTGEKPFECKECGKVFSLPTQLNRHKNIHTGEKAS

SEQ ID NO: 101334 - protein, 642 aa, Homo sapiens
  Payload ID: 20194
  Gene Name: zinc finger protein 780A
  Uniprot ID: O75290
  ENSP ID: ENSP00000400997
MVHGSVTFRDVAIDFSQEEWECLQPDQRTLYRDVMLENYSHLISLAGSSISKPDVITLLEQEKEPWMVVRKETSRRYPDLELKYGPEKVSPENDTSEVNLPKQVIKQISTTLGIEAFYFRNDSEYRQFEGLQGYQEGNINQKMISYEKLPTHTPHASLICNTHKPYECKECGKYFSRSANLIQHQSIHTGEKPFECKECGKAFRLHIQFTRHQKFHTGEKPFECNECGKAFSLLTLLNRHKNIHTGEKLFECKECGKSFNRSSNLVQHQSIHSGVKPYECKECGKGFNRGAHLIQHQKIHSNEKPFVCKECGMAFRYHYQLIEHCQIHTGEKPFECKECGKAFTLLTKLVRHQKIHTGEKPFECRECGKAFSLLNQLNRHKNIHTGEKPFECKECGKSFNRSSNLVQHQSIHAGIKPYECKECGKGFNRGAHLIQHQKIHSNEKPFVCRECEMAFRYHCQLIEHSRIHTGDKPFECQDCGKAFNRGSSLVQHQSIHTGEKPYECKECGKAFRLYLQLSQHQKTHTGEKPFECKECGKFFRRGSNLNQHRSIHTGKKPFECKECGKAFRLHMHLIRHQKLHTGEKPFECKECGKAFRLHMQLIRHQKLHTGEKPFECKECGKVFSLPTQLNRHKNIHTGEKAS

SEQ ID NO: 101335 - protein, 158 aa, Homo sapiens
  Payload ID: 20194
  Gene Name: zinc finger protein 780A
  Uniprot ID: O75290
  ENSP ID: ENSP00000416294
MGRSPRKIDQFCNSSNMVHGSVTFRDVAIDFSQEEWECLQPDQRTLYRDVMLENYSHLISLGSSISKPDVITLLEQEKEPWMVVRKETSRRYPDLELKYGPEKVSPENDTSEVNLPKQISSLASKPSFTAIHIQRRIHCRICIAFGYLSLVYCSLEIL

SEQ ID NO: 101336 - protein, 156 aa, Homo sapiens
  Payload ID: 20194
  Gene Name: zinc finger protein 780A
  ENSP ID: ENSP00000469407
MVHGSVTFRDVAIDFSQEEWECLQPDQRTLYRDVMLENYSHLISLGSSISKPDVITLLEQEKEPWMVVRKETSRRYPDLELKYGPEKVSPENDTSEVNLPKQVIKQISTTLGIEAFYFRNDSEYRQFEGLQGYQEGNINQKMISYEKLPTHTPHAS

SEQ ID NO: 101337 - protein, 109 aa, Homo sapiens
  Payload ID: 20194
  Gene Name: zinc finger protein 780A
  ENSP ID: ENSP00000469694
MVHGSVTFRDVAIDFSQEEWECLQPDQRTLYRDVMLENYSHLISLGSSISKPDVITLLEQEKEPWMVVRKETSRRYPDLELKYGPEKVSPENDTSEVNLPKQVIKQIST

SEQ ID NO: 101338 - protein, 642 aa, Homo sapiens; identical to SEQ ID NO: 101334
  Payload ID: 20194
  Gene Name: zinc finger protein 780A
  Uniprot ID: O75290
  ENSP ID: ENSP00000469786

SEQ ID NO: 101339 - protein, 90 aa, Homo sapiens
  Payload ID: 20194
  Gene Name: zinc finger protein 780A
  ENSP ID: ENSP00000469905
MVHGSVTFRDVAIDFSQEEWECLQPDQRTLYRDVMLENYSHLISLGSSISKPDVITLLEQEKEPWMVVRKETSRRYPDLELKYGPEKVSP

SEQ ID NO: 101340 - protein, 110 aa, Homo sapiens
  Payload ID: 20194
  Gene Name: zinc finger protein 780A
  ENSP ID: ENSP00000470265
MVHGSVTFRDVAIDFSQEEWECLQPDQRTLYRDVMLENYSHLISLAGSSISKPDVITLLEQEKEPWMVVRKETSRRYPDLELKYGPEKVSPENDTSEVNLPKQVIKQIST

SEQ ID NO: 101341 - protein, 641 aa, Homo sapiens; identical to SEQ ID NO: 101332
  Payload ID: 20194
  Gene Name: zinc finger protein 780A
  Uniprot ID: O75290
  ENSP ID: ENSP00000472189

SEQ ID NO: 101342 - protein, 106 aa, Homo sapiens
  Payload ID: 20194
  Gene Name: zinc finger protein 780A
  ENSP ID: ENSP00000472779
MVHGSVTFRDVAIDFSQEEWECLQPDQRTLYRDVMLENYSHLISLGSSISKPDVITLLEQEKEPWMVVRKETSRRYPDLELKYGPEKVSPENDTSEVNLPKQVIKQ

SEQ ID NO: 101343 - protein, 90 aa, Homo sapiens; identical to SEQ ID NO: 101339
  Payload ID: 20194
  Gene Name: Zinc finger protein 780A
  ENSP ID: ENSP00000485974

SEQ ID NO: 101344 - protein, 109 aa, Homo sapiens; identical to SEQ ID NO: 101337
  Payload ID: 20194
  Gene Name: Zinc finger protein 780A
  ENSP ID: ENSP00000486312

SEQ ID NO: 101345 - protein, 642 aa, Homo sapiens; identical to SEQ ID NO: 101334
  Payload ID: 20194
  Gene Name: Zinc finger protein 780A
  ENSP ID: ENSP00000486345

SEQ ID NO: 101346 - protein, 158 aa, Homo sapiens; identical to SEQ ID NO: 101335
  Payload ID: 20194
  Gene Name: Zinc finger protein 780A
  ENSP ID: ENSP00000486672

SEQ ID NO: 101347 - protein, 106 aa, Homo sapiens; identical to SEQ ID NO: 101342
  Payload ID: 20194
  Gene Name: Zinc finger protein 780A
  ENSP ID: ENSP00000486727

SEQ ID NO: 101348 - protein, 607 aa, Homo sapiens; identical to SEQ ID NO: 101333
  Payload ID: 20194
  Gene Name: Zinc finger protein 780A
  ENSP ID: ENSP00000486823

SEQ ID NO: 101349 - protein, 110 aa, Homo sapiens; identical to SEQ ID NO: 101340
  Payload ID: 20194
  Gene Name: Zinc finger protein 780A
  ENSP ID: ENSP00000486848

SEQ ID NO: 101350 - protein, 641 aa, Homo sapiens; identical to SEQ ID NO: 101332
  Payload ID: 20194
  Gene Name: Zinc finger protein 780A
  ENSP ID: ENSP00000487177

SEQ ID NO: 101351 - protein, 642 aa, Homo sapiens; identical to SEQ ID NO: 101334
  Payload ID: 20194
  Gene Name: Zinc finger protein 780A
  ENSP ID: ENSP00000487366

SEQ ID NO: 101352 - protein, 156 aa, Homo sapiens; identical to SEQ ID NO: 101336
  Payload ID: 20194
  Gene Name: Zinc finger protein 780A
  ENSP ID: ENSP00000487510

SEQ ID NO: 101353 - protein, 641 aa, Homo sapiens; identical to SEQ ID NO: 101332
  Payload ID: 20194
  Gene Name: Zinc finger protein 780A
  ENSP ID: ENSP00000487520

SEQ ID NO: 101354 - protein, 685 aa, Homo sapiens
  Payload ID: 20195
  Gene Name: zinc finger protein 780B
  ENSP ID: ENSP00000221355
MPAYTHASPIHNTHKPYECKECGKYFSCGSNLIQHQSIHTGEKPYKCKECGKAFQLHIQLTRHQKFHTGEKTFECKECGKAFNLPTQLNRHKNIHTVKKLFECKECGKSFNRSSNLTQHQSIHAGVKPYQCKECGKAFNRGSNLIQHQKIHSNEKPFVCRECEMAFRYHYQLIEHCRIHTGEKPFECKECRKAFTLLTKLVRHQKIHMGEKPFECRECGKAFSLLNQLNRHKNIHTGEKPFECKECGKSFNRSSNLIQHQSIHADVKPYECKECGKGFNRGANLIQHQKIHSNEKPFVCRECEMAFRYHYQLIQHCQIHTGGKPFECKECGKAFSLLTQLARHKNIHTGEKPFECKDCGKAFNRGSNLVQHQSIHTGEKPYECKECGKAFRLHLQLSQHEKTHTGEKPFECKECGKFFRRGSNLNQHRSIHTGKKPFECKECGKAFRLHMHLIRHQKFHTGEKPFECKECGKAFSLHTQLNHHKNIHTGEKPFKCKECGKSFNRVSNLVQHQSIHAGVKPYECKECGKGFSRVSNLIQHQKTHSSAKPFVCKECRKTFRYHYQLTEHYRIHTGEKPFECKECGKAFGLLTQLAQHQIIHTGEKPFKCKECGKAFNRGSNLVQPQSIHTGEKPYECKECGKAFRLHLQLSLHQKLVQVRNPLNVRNVGQPSDISSNLLNIRKFILG

SEQ ID NO: 101355 - protein, 833 aa, Homo sapiens
  Payload ID: 20195
  Gene Name: zinc finger protein 780B
  Uniprot ID: Q9Y6R6
  ENSP ID: ENSP00000391641
MVHGSVTFRDVAIDFSQEEWECLQPDQRTLYRDVMLENYSHLISLGSSISKPDVITLLEQEKEPWIVVSKETSRWYPDLESKYGPEKISPENDIFEINLPKHVIKQISKTLGLEAFYFRNDSEYRSRFEGRQGHQEGYINQKIISYEEMPAYTHASPIHNTHKPYECKECGKYFSCGSNLIQHQSIHTGEKPYKCKECGKAFQLHIQLTRHQKFHTGEKTFECKECGKAFNLPTQLNRHKNIHTVKKLFECKECGKSFNRSSNLTQHQSIHAGVKPYQCKECGKAFNRGSNLIQHQKIHSNEKPFVCRECEMAFRYHYQLIEHCRIHTGEKPFECKECRKAFTLLTKLVRHQKIHMGEKPFECRECGKAFSLLNQLNRHKNIHTGEKPFECKECGKSFNRSSNLIQHQSIHADVKPYECKECGKGFNRGANLIQHQKIHSNEKPFVCRECEMAFRYHYQLIQHCQIHTGGKPFECKECGKAFSLLTQLARHKNIHTGEKPFECKDCGKAFNRGSNLVQHQSIHTGEKPYECKECGKAFRLHLQLSQHEKTHTGEKPFECKECGKFFRRGSNLNQHRSIHTGKKPFECKECGKAFRLHMHLIRHQKFHTGEKPFECKECGKAFSLHTQLNHHKNIHTGEKPFKCKECGKSFNRVSNLVQHQSIHAGVKPYECKECGKGFSRVSNLIQHQKTHSSAKPFVCKECRKTFRYHYQLTEHYRIHTGEKPFECKECGKAFGLLTQLAQHQIIHTGEKPFKCKECGKAFNRGSNLVQPQSIHTGEKPYECKECGKAFRLHLQLSLHQKLVQVRNPLNVRNVGQPSDISSNLLNIRKFILG

SEQ ID NO: 101356 - protein, 76 aa, Homo sapiens
  Payload ID: 20195
  Gene Name: zinc finger protein 780B
  ENSP ID: ENSP00000471501
MVHGSVTFRDVAIDFSQEEWECLQPDQRTLYRDVMLENYSHLISLGSSISKPDVITLLEQEKEPWIVVSKETSRWY

SEQ ID NO: 101357 - protein, 87 aa, Homo sapiens
  Payload ID: 20195
  Gene Name: zinc finger protein 780B
  ENSP ID: ENSP00000471669
MVHGSVTFRDVAIDFSQEEWECLQPDQRTLYRDVMLENYSHLISLAGSSISKPDVITLLEQEKEPWIVIWSQNMDLRKYLQKMIFLK

SEQ ID NO: 101358 - protein, 109 aa, Homo sapiens
  Payload ID: 20195
  Gene Name: zinc finger protein 780B
  ENSP ID: ENSP00000471726
MVHGSVTFRDVAIDFSQEEWECLQPDQRTLYRDVMLENYSHLISLGSSISKPDVITLLEQEKEPWIVVSKETSRWYPDLESKYGPEKISPENDIFEINLPKHVIKQISK

SEQ ID NO: 101359 - protein, 833 aa, Homo sapiens; identical to SEQ ID NO: 101355
  Payload ID: 20195
  Gene Name: zinc finger protein 780B
  Uniprot ID: Q9Y6R6
  ENSP ID: ENSP00000484593

SEQ ID NO: 101360 - protein, 685 aa, Homo sapiens; identical to SEQ ID NO: 101354
  Payload ID: 20195
  Gene Name: Zinc finger protein 780B
  ENSP ID: ENSP00000486124

SEQ ID NO: 101361 - protein, 109 aa, Homo sapiens; identical to SEQ ID NO: 101358
  Payload ID: 20195
  Gene Name: Zinc finger protein 780B
  ENSP ID: ENSP00000486635

SEQ ID NO: 101362 - protein, 87 aa, Homo sapiens; identical to SEQ ID NO: 101357
  Payload ID: 20195
  Gene Name: Zinc finger protein 780B
  ENSP ID: ENSP00000487227

SEQ ID NO: 101363 - protein, 76 aa, Homo sapiens; identical to SEQ ID NO: 101356
  Payload ID: 20195
  Gene Name: Zinc finger protein 780B
  ENSP ID: ENSP00000487473

SEQ ID NO: 101364 - protein, 833 aa, Homo sapiens; identical to SEQ ID NO: 101355
  Payload ID: 20195
  Gene Name: Zinc finger protein 780B
  ENSP ID: ENSP00000487499

SEQ ID NO: 101365 - protein, 833 aa, Homo sapiens; identical to SEQ ID NO: 101355
  Payload ID: 20195
  Gene Name: Zinc finger protein 780B
  ENSP ID: ENSP00000487572

SEQ ID NO: 101366 - protein, 327 aa, Homo sapiens
  Payload ID: 20196
  Gene Name: zinc finger protein 781
  Uniprot ID: Q8N8C0
  ENSP ID: ENSP00000351391
MQRNAMYLKNVAETACNFQLTQYQISHANQKPYECQICGKPFRKRAHLTQHNRIHTGGKPYECKECGKVFICCSTLIQHKRTHTSEKPYECLECRKTFRRSAHLIRHQRIHTGEKPYKCKQCWKAFASVSDLIDIGKFTLMRDFTNVQNVGRHLTIAQLLFSIREFTLVRSPLNVRNVAKHSIIAQHLLNTRELILMRNLMNVRNVKRLLGKVHILLNIKEFILVRNHMSVSNVGRLSLVFLILIDIREFTLVKNPMNVKNVVELLTIVQLLFNTREFTLVRRLMNISSVGRFLSPVQHLFNIREHILMKNLMNVSNARRPSSIMHI

SEQ ID NO: 101367 - protein, 327 aa, Homo sapiens; identical to SEQ ID NO: 101366
  Payload ID: 20196
  Gene Name: zinc finger protein 781
  Uniprot ID: Q8N8C0
  ENSP ID: ENSP00000466370

SEQ ID NO: 101368 - protein, 205 aa, Homo sapiens
  Payload ID: 20197
  Gene Name: zinc finger protein 782
  ENSP ID: ENSP00000417577
MNTFQASVSFQDVTVEFSQEEWQHMGPVERTLYRDVMLENYSHLVSVGYCFTKPELIFTLEQGEDPWLLEKEKGFLSRNSPEDSQPDEISEKSPENQGKHLLQVLFTNKLLTTEQEISGKPHNRDINIFRARMMPCKCDIAGSACQGLSLMAPHCQYSKEKAHERNVCDKWLISIKDGRTNTQEKSFAYSKIVKTLHHKEEVIQH

SEQ ID NO: 101369 - protein, 688 aa, Homo sapiens
  Payload ID: 20197
  Gene Name: zinc finger protein 782
  ENSP ID: ENSP00000418686
  MOD_RES (1)..(1): Any amino acid
XFINVDQSARTRGRCVCGKTPSCGDRKSCINSSFITCYCFTKPELIFTLEQGEDPWLLEKEKGFLSRNSPEDSQPDEISEKSPENQGKHLLQVLFTNKLLTTEQEISGKPHNRDINIFRARMMPCKCDIAGSACQGLSLMAPHCQYSKEKAHERNVCDKWLISIKDGRTNTQEKSFAYSKIVKTLHHKEEVIQHQTIQTLGQDFEYNESRKAFLEKAALVTSNSTHPKGKSYNFNKFGENKYDKSTFIIPQNMNPEKSHYEFNDTGNCFCRITHKTLTGGKSFSQKSHIREHHRVHIGVKPFEYGKSFNRNSTLPVHQRTHATDKYSDYHPCTETFSYQSTFSVHQKVHIRAKPYEYNECGKSCSMNSHLIWPQKSHTGEKPYECPECGKAFSEKSRLRKHQRTHTGEKPYKCDGCDKAFSAKSGLRIHQRTHTGEKPFECHECGKSFNYKSILIVHQRTHTGEKPFECNECGKSFSHMSGLRNHRRTHTGERPYKCDECGKAFKLKSGLRKHHRTHTGEKPYKCNQCGKAFGQKSQLRGHHRIHTGEKPYKCNHCGEAFSQKSNLRVHHRTHTGEKPYQCEECGKTFRQKSNLRGHQRTHTGEKPYECNECGKAFSEKSVLRKHQRTHTGEKPYNCNQCGEAFSQKSNLRVHQRTHTGEKPYKCDKCGRTFSQKSSLREHQKAHPGD

SEQ ID NO: 101370 - protein, 699 aa, Homo sapiens
  Payload ID: 20197
  Gene Name: zinc finger protein 782
  Uniprot ID: Q6ZMW2
  ENSP ID: ENSP00000419397
MNTFQASVSFQDVTVEFSQEEWQHMGPVERTLYRDVMLENYSHLVSVGYCFTKPELIFTLEQGEDPWLLEKEKGFLSRNSPEDSQPDEISEKSPENQGKHLLQVLFTNKLLTTEQEISGKPHNRDINIFRARMMPCKCDIAGSACQGLSLMAPHCQYSKEKAHERNVCDKWLISIKDGRTNTQEKSFAYSKIVKTLHHKEEVIQHQTIQTLGQDFEYNESRKAFLEKAALVTSNSTHPKGKSYNFNKFGENKYDKSTFIIPQNMNPEKSHYEFNDTGNCFCRITHKTLTGGKSFSQKSHIREHHRVHIGVKPFEYGKSFNRNSTLPVHQRTHATDKYSDYHPCTETFSYQSTFSVHQKVHIRAKPYEYNECGKSCSMNSHLIWPQKSHTGEKPYECPECGKAFSEKSRLRKHQRTHTGEKPYKCDGCDKAFSAKSGLRIHQRTHTGEKPFECHECGKSFNYKSILIVHQRTHTGEKPFECNECGKSFSHMSGLRNHRRTHTGERPYKCDECGKAFKLKSGLRKHHRTHTGEKPYKCNQCGKAFGQKSQLRGHHRIHTGEKPYKCNHCGEAFSQKSNLRVHHRTHTGEKPYQCEECGKTFRQKSNLRGHQRTHTGEKPYECNECGKAFSEKSVLRKHQRTHTGEKPYNCNQCGEAFSQKSNLRVHQRTHTGEKPYKCDKCGRTFSQKSSLREHQKAHPGD

SEQ ID NO: 101371 - protein, 44 aa, Homo sapiens
  Payload ID: 20197
  Gene Name: zinc finger protein 782
  ENSP ID: ENSP00000419978
MPAAAEESPFINVDQSARTRGRCVCGKTPSCGDRKSCINSSFIT

SEQ ID NO: 101372 - protein, 699 aa, Homo sapiens; identical to SEQ ID NO: 101370
  Payload ID: 20197
  Gene Name: zinc finger protein 782
  Uniprot ID: Q6ZMW2
  ENSP ID: ENSP00000440624

SEQ ID NO: 101373 - protein, 323 aa, Homo sapiens
  Payload ID: 20198
  Gene Name: zinc finger protein 784
  Uniprot ID: Q8NCA9
  ENSP ID: ENSP00000320096
MAAARPEAQSRSSPTPESRSQEPLDLVLVPDDCRPGTPPSDLIEIQVVKVTDTTLVPEPPEPGSFHCALCPAAFRLVSELLFHEHGHLAGAEGGGQGGDPSRCHVCGHSCPGPASLRAHYSLHTGERPYRCALCPRAFKALAPLLRHQHRHGVEPGTSRRPPDTAAVAEQRPGVAPERAEVVMAAAAAGAAVGKPFACRFCAKPFRRSSDMRDHERVHTGERPYHCGICGKGFTQSSVLSGHARIHTGERPFRCTLCDRTFNNSSNFRKHQRTHFHGPGPGLGDSGGQLGSSAAEGSGSGCGVGDPAEEGRGETAKVKVEADQ

SEQ ID NO: 101374 - protein, 42 aa, Homo sapiens
  Payload ID: 20198
  Gene Name: zinc finger protein 784
  ENSP ID: ENSP00000467725
MAAARPEAQSRSSPTPESRSQEPLDLVRARKGPGRGARGPGA

SEQ ID NO: 101375 - protein, 405 aa, Homo sapiens
  Payload ID: 20199
  Gene Name: zinc finger protein 785
  Uniprot ID: A8K8V0
  ENSP ID: ENSP00000378642
MGPPLAPRPAHVPGEAGPRRTRESRPGAVSFADVAVYFSPEEWECLRPAQRALYRDVMRETFGHLGALGFSVPKPAFISWVEGEVEAWSPEAQDPDGESSAAFSRGQGQEAGSRDGNEEKERLKKCPKQKEVAHEVAVKEWWPSVACPEFCNPRQSPMNPWLKDTLTRRLPHSCPDCGRNFSYPSLLASHQRVHSGERPFSCGQCQARFSQRRYLLQHQFIHTGEKPYPCPDCGRRFRQRGSLAIHRRAHTGEKPYACSDCKSRFTYPYLLAIHQRKHTGEKPYSCPDCSLRFAYTSLLAIHRRIHTGEKPYPCPDCGRRFTYSSLLLSHRRIHSDSRPFPCVECGKGFKRKTALEAHRWIHRSCSERRAWQQAVVGRSEPIPVLGGKDPPVHFRHFPDIFQECG

SEQ ID NO: 101376 - protein, 390 aa, Homo sapiens
  Payload ID: 20199
  Gene Name: zinc finger protein 785
  Uniprot ID: A8K8V0
  ENSP ID: ENSP00000420340
MGPPLAPRPAHVPGEAGPRRTRESRPGAVSFADVAVYFSPEEWECLRPAQRALYRDVMRETFGHLGALGFSVPKPAFISWVEGEVEAWSPEAQDPDGSRDGNEEKERLKKCPKQKEVAHEVAVKEWWPSVACPEFCNPRQSPMNPWLKDTLTRRLPHSCPDCGRNFSYPSLLASHQRVHSGERPFSCGQCQARFSQRRYLLQHQFIHTGEKPYPCPDCGRRFRQRGSLAIHRRAHTGEKPYACSDCKSRFTYPYLLAIHQRKHTGEKPYSCPDCSLRFAYTSLLAIHRRIHTGEKPYPCPDCGRRFTYSSLLLSHRRIHSDSRPFPCVECGKGFKRKTALEAHRWIHRSCSERRAWQQAVVGRSEPIPVLGGKDPPVHFRHFPDIFQECG

SEQ ID NO: 101377 - protein, 81 aa, Homo sapiens
  Payload ID: 20199
  Gene Name: zinc finger protein 785
  ENSP ID: ENSP00000456097
  MOD_RES (1)..(1): Any amino acid
XLLLSHRRIHSDSRPFPCVECGKGFKRKTALEAHRWIHRSCSERRAWQQAVVGRSEPIPVLGGKDPPVHFRHFPDIFQECG

SEQ ID NO: 101378 - protein, 69 aa, Homo sapiens
  Payload ID: 20199
  Gene Name: zinc finger protein 785
  ENSP ID: ENSP00000458511
SPEEWECLRPAQRALYRDVMRETFGHLGALGEAGPSGRDPQIFSSQTRFYLVGGRRSGGVEPGGPGSRR

SEQ ID NO: 101379 - protein, 696 aa, Homo sapiens
  Payload ID: 20200
  Gene Name: zinc finger protein 786
  ENSP ID: ENSP00000313516
MHFDPGFEEQLFWGSQQAMNSGKTKSHFQLDPESQCSFGSFVSFRPDQGITLGSPQRHDARAPPPLACGPSESTLKEGIPGPRNLDLPGLWDVPAWESTQHPWPVCGESCWENNHLVMHQRGHSKDRTRRAWEKFNKRAETQMPWSSPRVQRHFRCGVCGKSFRRKLCLLRHLAAHTGRGPFRNADGEMCFRHELTHPSHRLPQQGEKPAQCTPCGKRSLPVDSTQARRCQHSREGPASWREGRGASSSVHSGQKPGSRLPQEGNSHQEGDTEALQHGAEGPCSCSECGERSPMSARLASPCRAHTGEKPFQCAHCTKRFRLRRLLQVHQHAHGGERPFSCRKCGKGFAKQCKLTEHIRVHSGEKPFRCAKCGRNFRQRGQLLRHQRLHTDEKPFQCPECGLSFRLESMLRAHRLRHGGERPFSCSECGRGFTHQCKLREHLRVHSGERPFQCLKCDKRFRLKGILKAHQHTHSKERPFSCGECGKGFTRQSKLTEHLRVHSGERPFQCPECNRSFRLKGQLLSHQRLHTGERPFQCPECDKRYRVKADMKAHQLLHSGEMPFSCECGKGFVKHSKLIEHIRTHTGEKPFQCPKCDKSFRLKAQLLSHQGLHTGERPFHCPECDKNFRERGHMLRHQRIHRPERPFACGDCGKGFIYKSKLAEHIRVHTKSCPAPNELDIKKRLSQLFAMIEADWS

SEQ ID NO: 101380 - protein, 351 aa, Homo sapiens
  Payload ID: 20200
  Gene Name: zinc finger protein 786
  ENSP ID: ENSP00000404984
MHFDPGFEEQLFWGSQQAMNSGKTKSHFQLDPESQCSFGSFVSFRPDQGITLGSPQRHDARAPPPLACGPSESTLKEGIPGPRNLDLPGLWDVPAWESTQHPWPVCGESCWENNHLVMHQRGHSKDRTRRAWEKFNKRAETQMPWSSPRVQRHFRCGVCGKSFRRKLCLLRHLAAHTGRGPFRNADGEMCFRHELTHPSHRLPQQGEKPAQCTPCGKRSLPVDSTQARRCQHSREGPASWREGRGASSSVHSGQKPGSRLPQEGNSHQEGDTEALQHGAEGPCSCSECGERSPMSARLASPCRAHTGEKPFQCAHCTKRFRLRRLLQVHQHAHGGETVLLQEVWQGLRQAV

SEQ ID NO: 101381 - protein, 782 aa, Homo sapiens
  Payload ID: 20200
  Gene Name: zinc finger protein 786
  Uniprot ID: Q8N393
  ENSP ID: ENSP00000417470
MAEPPRLPLTFEDVAIYFSEQEWQDLEAWQKELYKHVMRSNYETLVSLDDGLPKPELISWIEHGGEPFRKWRESQKSGNIICSSVDMHFDPGFEEQLFWGSQQAMNSGKTKSHFQLDPESQCSFGSFVSFRPDQGITLGSPQRHDARAPPPLACGPSESTLKEGIPGPRNLDLPGLWDVPAWESTQHPWPVCGESCWENNHLVMHQRGHSKDRTRRAWEKFNKRAETQMPWSSPRVQRHFRCGVCGKSFRRKLCLLRHLAAHTGRGPFRNADGEMCFRHELTHPSHRLPQQGEKPAQCTPCGKRSLPVDSTQARRCQHSREGPASWREGRGASSSVHSGQKPGSRLPQEGNSHQEGDTEALQHGAEGPCSCSECGERSPMSARLASPCRAHTGEKPFQCAHCTKRFRLRRLLQVHQHAHGGERPFSCRKCGKGFAKQCKLTEHIRVHSGEKPFRCAKCGRNFRQRGQLLRHQRLHTDEKPFQCPECGLSFRLESMLRAHRLRHGGERPFSCSECGRGFTHQCKLREHLRVHSGERPFQCLKCDKRFRLKGILKAHQHTHSKERPFSCGECGKGFTRQSKLTEHLRVHSGERPFQCPECNRSFRLKGQLLSHQRLHTGERPFQCPECDKRYRVKADMKAHQLLHSGEMPFSCECGKGFVKHSKLIEHIRTHTGEKPFQCPKCDKSFRLKAQLLSHQGLHTGERPFHCPECDKNFRERGHMLRHQRIHRPERPFACGDCGKGFIYKSKLAEHIRVHTKSCPAPNELDIKKRLSQLFAMIEADWS

SEQ ID NO: 101382 - protein, 126 aa, Homo sapiens
  Payload ID: 20201
  Gene Name: zinc finger protein 787
  ENSP ID: ENSP00000465647
MELREEAWSPGPLDSEDQQMASHENPGEQPEAFPADPAASHLTLASFASGWEETPLPCFPLLGPWDHPTLASPPALGLALLAVEGGLVLWLQVSFLLDDLGDPWGPPSLPDFLCPCPSSLGSTPVC

SEQ ID NO: 101383 - protein, 39 aa, Homo sapiens
  Payload ID: 20201
  Gene Name: zinc finger protein 787
  ENSP ID: ENSP00000471514
MELREEAWSPGPLDSEDQQMASHENPVDILIMDDDDVPS

SEQ ID NO: 101384 - protein, 382 aa, Homo sapiens
  Payload ID: 20201
  Gene Name: zinc finger protein 787
  ENSP ID: ENSP00000478557
MELREEAWSPGPLDSEDQQMASHENPVDILIMDDDDVPSWPPTKLSPPQSAPPAGPPPRPRPPAPYICNECGKSFSHWSKLTRHQRTHTGERPNACADCGKTFSQSSHLVQHRRIHTGEKPYACLECGKRFSWSSNLMQHQRIHTGEKPYTCPDCGRSFTQSKSLAKHRRSHSGLKPFVCPRCGRGFSQPKSLARHLRLHPELSGPGVAAKVLAASVRRAKGPEEAVAADGEIAIPVGDGEGIIVVGAPGEGAAAAAAMAGAGAKAAGPRSRRAPAPKPYVCLECGKGFGHGAGLLAHQRAQHGDGLGAAGGEEPAHICVECGEGFVQGAALRRHKKIHAVGAPSVCSSCGQSYYRAGGEEEDDDDEAAGGRCPECRGGEGR

SEQ ID NO: 101385 - protein, 425 aa, Homo sapiens
  Payload ID: 20202
  Gene Name: zinc finger protein 789
  Uniprot ID: Q5FWF6
  ENSP ID: ENSP00000331927
MFPPARGKELLSFEDVAMYFTREEWGHLNWGQKDLYRDVMLENYRNMVLLGFQFPKPEMICQLENWDEQWILDLPRTGNRKASGSACPGSEARHKMKKLTPKQKFSEDLESYKISVVMQESAEKLSEKLHKCKEFVDSCRLTFPTSGDEYSRGFLQNLNLIQDQNAQTRWKQGRYDEDGKPFNQRSLLLGHERILTRAKSYECSECGKVIRRKAWFDQHQRIHFLENPFECKVCGQAFRQRSALTVHKQCHLQNKPYRCHDCGKCFRQLAYLVEHKRIHTKEKPYKCSKCEKTFSQNSTLIRHQVIHSGEKRHKCLECGKAFGRHSTLLCHQQIHSKPNTHKCSECGQSFGRNVDLIQHQRIHTKEEFFQCGECGKTFSFKRNLFRHQVIHTGSQPYQCVICGKSFKWHTSFIKHQGTHKGQIST

SEQ ID NO: 101386 - protein, 62 aa, Homo sapiens
  Payload ID: 20202
  Gene Name: zinc finger protein 789
  Uniprot ID: Q5FWF6
  ENSP ID: ENSP00000369047
MFPPARGKELLSFEDVAMYFTREEWGHLNWGQKDLYRDVMLENYRNMVLLVYFQFDAAIPLC

SEQ ID NO: 101387 - protein, 55 aa, Homo sapiens
  Payload ID: 20202
  Gene Name: zinc finger protein 789
  ENSP ID: ENSP00000401255
MELLSFEDVAMYFTREEWGHLNWGQKDLYRDVMLENYRNMVLLVYFQFDAAIPLC

SEQ ID NO: 101388 - protein, 118 aa, Homo sapiens
  Payload ID: 20202
  Gene Name: zinc finger protein 789
  ENSP ID: ENSP00000405206
MELLSFEDVAMYFTREEWGHLNWGQKDLYRDVMLENYRNMVLLGFQFPKPEMICQLENWDEQWILDLPRTGNRKASGSACPAAPVFHIQGFSSMALLTFWADEFFGDRMGHVLCILGC

SEQ ID NO: 101389 - protein, 56 aa, Homo sapiens
  Payload ID: 20202
  Gene Name: zinc finger protein 789
  ENSP ID: ENSP00000417227
MELLSFEDVAMYFTREEWGHLNWGQKDLYRDVMLENYRNMVLLGRTRLEDWALSVF

SEQ ID NO: 101390 - protein, 56 aa, Homo sapiens
  Payload ID: 20202
  Gene Name: zinc finger protein 789
  ENSP ID: ENSP00000419500
MELLSFEDVAMYFTREEWGHLNWGQKDLYRDVMLENYRNMVLLDAAISQQFLPSRL

SEQ ID NO: 101391 - protein, 498 aa, Homo sapiens
  Payload ID: 20203
  Gene Name: zinc finger protein 79
  Uniprot ID: Q15937
  ENSP ID: ENSP00000362446
MLEEGVLPSPGPALPQEENTGEEGMAAGLLTAGPRGSTFFSSVTVAFAQERWRCLVSTPRDRFKEGIPGKSRSLVLLGLPVSQPGMNSQLEQREGAWMLEGEDLRSPSPGWKIISGSPPEQALSEASFQDPCVEMPPGDSDHGTSDLEKSFNLRPVLSPQQRVPVEARPRKCETHTESFKNSEILKPHRAKPYACNECGKAFSYCSSLSQHQKSHTGEKPYECSECGKAFSQSSSLIQHQRIHTGEKPYKCSECGRAFSQNANLTKHQRTHTGEKPYRCSECEKAFSDCSALVQHQRIHTGEKPYECSDCGKAFRHSANLTNHQRTHTGEKPYKCSECGKAFSYCAAFIQHQRIHTGEKPYRCAACGKAFSQSANLTNHQRTHTGEKPYKCSECGKAFSQSTNLIIHQKTHTGEKPYKCNECGKFFSESSALIRHHIIHTGEKPYECNECGKAFNQSSSLSQHQRIHTGVKPYECSECGKAFRCSSAFVRHQRLHAGE

SEQ ID NO: 101392 - protein, 474 aa, Homo sapiens
  Payload ID: 20203
  Gene Name: zinc finger protein 79
  ENSP ID: ENSP00000438418
MAAGLLTAGPRGSTFFSSVTVAFAQERWRCLVSTPRDRFKEGIPGKSRSLVLLGLPVSQPGMNSQLEQREGAWMLEGEDLRSPSPGWKIISGSPPEQALSEASFQDPCVEMPPGDSDHGTSDLEKSFNLRPVLSPQQRVPVEARPRKCETHTESFKNSEILKPHRAKPYACNECGKAFSYCSSLSQHQKSHTGEKPYECSECGKAFSQSSSLIQHQRIHTGEKPYKCSECGRAFSQNANLTKHQRTHTGEKPYRCSECEKAFSDCSALVQHQRIHTGEKPYECSDCGKAFRHSANLTNHQRTHTGEKPYKCSECGKAFSYCAAFIQHQRIHTGEKPYRCAACGKAFSQSANLTNHQRTHTGEKPYKCSECGKAFSQSTNLIIHQKTHTGEKPYKCNECGKFFSESSALIRHHIIHTGEKPYECNECGKAFNQSSSLSQHQRIHTGVKPYECSECGKAFRCSSAFVRHQRLHAGE

SEQ ID NO: 101393 - protein, 474 aa, Homo sapiens; identical to SEQ ID NO: 101392
  Payload ID: 20203
  Gene Name: zinc finger protein 79
  ENSP ID: ENSP00000478201

SEQ ID NO: 101394 - protein, 364 aa, Homo sapiens
  Payload ID: 20203
  Gene Name: zinc finger protein 79
  ENSP ID: ENSP00000484833
MPPGDSDHGTSDLEKSFNLRPVLSPQQRVPVEARPRKCETHTESFKNSEILKPHRAKPYACNECGKAFSYCSSLSQHQKSHTGEKPYECSECGKAFSQSSSLIQHQRIHTGEKPYKCSECGRAFSQNANLTKHQRTHTGEKPYRCSECEKAFSDCSALVQHQRIHTGEKPYECSDCGKAFRHSANLTNHQRTHTGEKPYKCSECGKAFSYCAAFIQHQRIHTGEKPYRCAACGKAFSQSANLTNHQRTHTGEKPYKCSECGKAFSQSTNLIIHQKTHTGEKPYKCNECGKFFSESSALIRHHIIHTGEKPYECNECGKAFNQSSSLSQHQRIHTGVKPYECSECGKAFRCSSAFVRHQRLHAGE

SEQ ID NO: 101395 - protein, 636 aa, Homo sapiens
  Payload ID: 20204
  Gene Name: zinc finger protein 790
  Uniprot ID: Q6PG37
  ENSP ID: ENSP00000349161
MAHLMMFRDVAVDFSQEEWECLDLEQRDLYRDVMLENYSNMVSLGFCIYQPEAFSLLEKGKEPWKILRDETRGPCPDMQSRCQTKKLLPKNGIFEREIAQLEIMRICKNHSLDCLCFRGDWEGNTQFQTLQDNQEECFKQVIRTCEKRPTFNQHTVFNLHQRLNTGDKLNEFKELGKAFISGSDHTQHQLIHTSEKFCGDKECGNTFLPDSEVIQYQTVHTVKKTYECKECGKSFSLRSSLTGHKRIHTGEKPFKCKDCGKAFRFHSQLSVHKRIHTGEKSYECKECGKAFSCGSDLTRHQRIHTGEKPYECNECRKAFSQRSHLIKHQRIHTGEKPYECKECGKAFTRGSHLTQHQRIHTGEKSHECKECGKAFIRGSNLAQHQNVHVGRKPYKCEKCGKAYIWSSHLARHQRIHTGRKPYECKQCGKTFTWASYLAQHEKIHNERKSYECKECGKTFLHGSEFNRHQKIHTGERNYECKECGKTFFRGSELNRHQKIHTGKRPYECEECGKAFLWGSQLTRHQRMHTGEEPYVCKECGKSFIWGSQLTRHKKIHTDAEPYGCKKSSHIFSHHSYFTEQKIHNSANLCEWTDYGNTFSHESNFAQHQNIYTFEKSYEFKDFEKAFSSSSHFISLL

SEQ ID NO: 101396 - protein, 135 aa, Homo sapiens
  Payload ID: 20204
  Gene Name: zinc finger protein 790
  ENSP ID: ENSP00000433389
MAHLMMFRDVAVDFSQEEWECLDLEQRDLYRDVMLENYSNMVSLGFCIYQPEAFSLLEKGKEPWKILRDETRGPCPDMQSRCQTKKLLPKNGIFEREIAQLEIMRICKNHSLDCLCFRGDWEGNTQFQTLQDNQE

SEQ ID NO: 101397 - protein, 49 aa, Homo sapiens
  Payload ID: 20204
  Gene Name: zinc finger protein 790
  ENSP ID: ENSP00000434537
MAHLMMFRDVAVDFSQEEWECLDLEQRDLYRDVMLENYSNMVSLGFCIY

SEQ ID NO: 101398 - protein, 179 aa, Homo sapiens
  Payload ID: 20204
  Gene Name: zinc finger protein 790
  ENSP ID: ENSP00000435944
MAHLMMFRDVAVDFSQEEWECLDLEQRDLYRDVMLENYSNMVSLGFCIYQPEAFSLLEKGKEPWKILRDETRGPCPDMQSRCQTKKLLPKNGIFEREIAQLEIMRICKNHSLDCLCFRGDWEGNTQFQTLQDNQEECFKQVIRTCEKRPTFNQHTVFNLHQRLNTGDKLNEFKELGKAF

SEQ ID NO: 101399 - protein, 140 aa, Homo sapiens
  Payload ID: 20204
  Gene Name: zinc finger protein 790
  ENSP ID: ENSP00000467684
MAHLMMFRDVAVDFSQEEWECLDLEQRDLYRDVMLENYSNMVSLGFCIYQPEAFSLLEKGKEPWKILRDETRGPCPDMQSRCQTKKLLPKNGIFEREIAQLEIMRICKNHSLDCLCFRGDWEGNTQFQTLQDNQEECFKQ

SEQ ID NO: 101400 - protein, 636 aa, Homo sapiens; identical to SEQ ID NO: 101395
  Payload ID: 20204
  Gene Name: zinc finger protein 790
  Uniprot ID: Q6PG37
  ENSP ID: ENSP00000478852

SEQ ID NO: 101401 - protein, 636 aa, Homo sapiens; identical to SEQ ID NO: 101395
  Payload ID: 20204
  Gene Name: zinc finger protein 790
  Uniprot ID: Q6PG37
  ENSP ID: ENSP00000480764

SEQ ID NO: 101402 - protein, 636 aa, Homo sapiens; identical to SEQ ID NO: 101395
  Payload ID: 20204
  Gene Name: zinc finger protein 790
  Uniprot ID: Q6PG37
  ENSP ID: ENSP00000480834

SEQ ID NO: 101403 - protein, 576 aa, Homo sapiens
  Payload ID: 20205
  Gene Name: zinc finger protein 791
  Uniprot ID: Q3KP31
  ENSP ID: ENSP00000342974
MDSVAFEDVSVSFSQEEWALLAPSQKKLYRDVMQETFKNLASIGEKWEDPNVEDQHKNQGRNLRSHTGERLCEGKEGSQCAENFSPNLSVTKKTAGVKPYECTICGKAFMRLSSLTRHMRSHTGYELFEKPYKCKECEKAFSYLKSFQRHERSHTGEKPYKCKQCGKTFIYHQPFQRHERTHIGEKPYECKQCGKALSCSSSLRVHERIHTGEKPYECKQCGKAFSCSSSIRVHERTHTGEKPYACKECGKAFISHTSVLTHMITHNGDRPYKCKECGKAFIFPSFLRVHERIHTGEKPYKCKQCGKAFRCSTSIQIHERIHTGEKPYKCKECGKSFSARPAFRVHVRVHTGEKPYKCKECGKAFSRISYFRIHERTHTGEKPYECKKCGKTFNYPLDLKIHKRNHTGEKPYECKECAKTFISLENFRRHMITHTGDGPYKCRDCGKVFIFPSALRTHERTHTGEKPYECKQCGKAFSCSSYIRIHKRTHTGEKPYECKECGKAFIYPTSFQGHMRMHTGEKPYKCKECGKAFSLHSSFQRHTRIHNYEKPLECKQCGKAFSVSTSLKKHMRMHNR

SEQ ID NO: 101404 - protein, 69 aa, Homo sapiens
  Payload ID: 20205
  Gene Name: zinc finger protein 791
  ENSP ID: ENSP00000412981
MDSVAFEDVSVSFSQEEWALLAPSQKKLYRDVMQETFKNLASIEAIRERDSVKVKKVVNVQKTSVPISV

SEQ ID NO: 101405 - protein, 35 aa, Homo sapiens
  Payload ID: 20205
  Gene Name: zinc finger protein 791
  ENSP ID: ENSP00000469996
MGSGCVAQADLELLGSSDPPPSASQSARIPGLSGF

SEQ ID NO: 101406 - protein, 83 aa, Homo sapiens
  Payload ID: 20205
  Gene Name: zinc finger protein 791
  ENSP ID: ENSP00000471179
MRLSSLTRHMRSHTGYELFEKPYKCKECEKAFSYLKSFQRHERSHTGEKPYKCKQCGKTFIYHQPFQRHERTHIGEKPYECKQ

SEQ ID NO: 101407 - protein, 44 aa, Homo sapiens
  Payload ID: 20205
  Gene Name: zinc finger protein 791
  ENSP ID: ENSP00000472685
MMGSGCVAQADLELLGSSDPPPSASQSARIPGMSYYYRPNILIF

SEQ ID NO: 101408 - protein, 632 aa, Homo sapiens
  Payload ID: 20206
  Gene Name: zinc finger protein 792
  Uniprot ID: Q3KQV3
  ENSP ID: ENSP00000385099
MAAAALRDPAQGCVTFEDVTIYFSQEEWVLLDEAQRLLYCDVMLENFALIASLGLISFRSHIVSQLEMGKEPWVPDSVDMTSAMARGAYGRPGSDFCHGTEGKDLPSEHNVSVEGVAQDRSPEATLCPQKTCPCDICGLRLKDILHLAEHQTTHPRQKPFVCEAYVKGSEFSANLPRKQVQQNVHNPIRTEEGQASPVKTCRDHTSDQLSTCREGGKDFVATAGFLQCEVTPSDGEPHEATEGVVDFHIALRHNKCCESGDAFNNKSTLVQHQRIHSRERPYECSKCGIFFTYAADLTQHQKVHNRGKPYECCECGKFFSQHSSLVKHRRVHTGESPHVCGDCGKFFSRSSNLIQHKRVHTGEKPYECSDCGKFFSQRSNLIHHKRVHTGRSAHECSECGKSFNCNSSLIKHWRVHTGERPYKCNECGKFFSHIASLIQHQIVHTGERPHGCGECGKAFSRSSDLMKHQRVHTGERPYECNECGKLFSQSSSLNSHRRLHTGERPYQCSECGKFFNQSSSLNNHRRLHTGERPYECSECGKTFRQRSNLRQHLKVHKPDRPYECSECGKAFNQRPTLIRHQKIHIRERSMENVLLPCSQHTPEISSENRPYQGAVNYKLKLVHPSTHPGEVP

SEQ ID NO: 101409 - protein, 565 aa, Homo sapiens
  Payload ID: 20206
  Gene Name: zinc finger protein 792
  ENSP ID: ENSP00000474130
MGKEPWVPDSVDMTSAMARGAYGRPGSDFCHGTEGKDLPSEHNVSVEGVAQDRSPEATLCPQKTCPCDICGLRLKDILHLAEHQTTHPRQKPFVCEAYVKGSEFSANLPRKQVQQNVHNPIRTEEGQASPVKTCRDHTSDQLSTCREGGKDFVATAGFLQCEVTPSDGEPHEATEGVVDFHIALRHNKCCESGDAFNNKSTLVQHQRIHSRERPYECSKCGIFFTYAADLTQHQKVHNRGKPYECCECGKFFSQHSSLVKHRRVHTGESPHVCGDCGKFFSRSSNLIQHKRVHTGEKPYECSDCGKFFSQRSNLIHHKRVHTGRSAHECSECGKSFNCNSSLIKHWRVHTGERPYKCNECGKFFSHIASLIQHQIVHTGERPHGCGECGKAFSRSSDLMKHQRVHTGERPYECNECGKLFSQSSSLNSHRRLHTGERPYQCSECGKFFNQSSSLNNHRRLHTGERPYECSECGKTFRQRSNLRQHLKVHKPDRPYECSECGKAFNQRPTLIRHQKIHIRERSMENVLLPCSQHTPEISSENRPYQGAVNYKLKLVHPSTHPGEVP

SEQ ID NO: 101410 - protein, 406 aa, Homo sapiens
  Payload ID: 20207
  Gene Name: zinc finger protein 793
  Uniprot ID: Q6ZN11
  ENSP ID: ENSP00000396402
MIEYQIPVSFKDVVVGFTQEEWHRLSPAQRALYRDVMLETYSNLVSVGYEGTKPDVILRLEQEEAPWIGEAACPGCHCWEDIWRVNIQRKRRQDMLLRPGAAISKKTLPKEKSCEYNKFGKISLLSTDLFSSIQSPSNWNPCGKNLNHNLDLIGFKRNCAKKQDECYAYGKLLQRINHGRRPNGEKPRGCSHCEKAFTQNPALMYKPAVSDSLLYKRKRVPPTEKPHVCSECGKAFCYKSEFIRHQRSHTGEKPYGCTDCGKAFSHKSTLIKHQRIHTGVRPFECFFCGKAFTQKSHRTEHQRTHTGERPFVCSECGKSFGEKSYLNVHRKMHTGERPYRCRECGKSFSQKSCLNKHWRTHTGEKPYGCNECGKAFYQKPNLSRHQKIHARKNAYRNENLIIVGNT

SEQ ID NO: 101411 - protein, 305 aa, Homo sapiens [sequence omitted]

SEQ ID NO: 101412 - protein, 83 aa, Homo sapiens
  Payload ID: 20207
  Gene Name: zinc finger protein 793
  ENSP ID: ENSP00000465900
  MOD_RES (1)..(1): Any amino acid
XSFKDVVVGFTQEEWHRLSPAQRALYRDVMLETYSNLVSVGYEGTKPDVILRLEQEEAPWIGEAACPGCHCWALKVLRELQPR

SEQ ID NO: 101413 - protein, 59 aa, Homo sapiens
  Payload ID: 20207
  Gene Name: zinc finger protein 793
  ENSP ID: ENSP00000466509
  MOD_RES (1)..(1): Any amino acid
XYEGTKPDVILRLEQEEAPWIGEAACPGCHCWVAVPFYITTSNAQGFQFLHNLAIHHLL

SEQ ID NO: 101414 - protein, 131 aa, Homo sapiens
  Payload ID: 20207
  Gene Name: zinc finger protein 793
  ENSP ID: ENSP00000466645
MIEYQIPVSFKDVVVGFTQEEWHRLSPAQRALYRDVMLETYSNLVSVGYEGTKPDVILRLEQEEAPWIGEAACPGCHCWGKCDKSSKRGTEGGWHLWNFVQHSSLKSLESPPRASATLMTLQPPCNPTAHI

SEQ ID NO: 101415 - protein, 138 aa, Homo sapiens
  Payload ID: 20207
  Gene Name: zinc finger protein 793
  ENSP ID: ENSP00000466738
MIEYQIPVSFKDVVVGFTQEEWHRLSPAQRALYRDVMLETYSNLVSVGYEGTKPDVILRLEQEEAPWIGEAACPGCHCWEDIWRVNIQRKRRQDMLLRPGAAISKKTLPKEKSCEYNKFGKISLLSTDLFSSIQSPTW

SEQ ID NO: 101416 - protein, 93 aa, Homo sapiens
  Payload ID: 20207
  Gene Name: zinc finger protein 793
  ENSP ID: ENSP00000467919
MIEYQIPVSFKDVVVGFTQEEWHRLSPAQRALYRDVMLETYSNLVSVGYEGTKPDVILRLEQEEAPWIGEAACPGCHCWGISKLWPTDWPPAL

SEQ ID NO: 101417 - protein, 53 aa, Homo sapiens
  Payload ID: 20207
  Gene Name: zinc finger protein 793
  ENSP ID: ENSP00000468286
MIEYQIPVSFKDVVVGFTQEEWHRLSPAQRALYRDVMLETYSNLVSVGYEGTK

SEQ ID NO: 101418 - protein, 406 aa, Homo sapiens; identical to SEQ ID NO: 101410
  Payload ID: 20207
  Gene Name: zinc finger protein 793
  Uniprot ID: Q6ZN11
  ENSP ID: ENSP00000468605

SEQ ID NO: 101419 - protein, 361 aa, Homo sapiens
  Payload ID: 20207
  Gene Name: zinc finger protein 793
  ENSP ID: ENSP00000487183
MIEYQIPVSFKDVVVGFTQEEWHRLSPAQRALYRDVMLETYSNLVSVGYEGTKPDVILRLEQEEAPWIGEAACPGCHCWEDIWRVNIQRKRRQDMLLRPGAAISKKTLPKEKSCEYNKFGKISLLSTDLFSSIQSPSNWNPCGKNLNHNLDLIGFKRNCAKKQDECYAYGKLLQRINHGRRPNGEKPRGCSHCEKAFTQNPALMYKPAVSDSLLYKRKRVPPTEKPHVCSECGKAFCYKSEFIRHQRSHTGEKPYGCTDCGKAFSHKSTLIKHQRIHTGVRPFECFFCGKAFTQKSHRTEHQRTHTGERPFVCSECGKSFGEKSYLNVHRKMHTGERPYRCRECGKSFSQKSCLNKHWRTH

SEQ ID NO: 101420 - protein, 643 aa, Homo sapiens
  Payload ID: 20208
  Gene Name: zinc finger protein 799
  Uniprot ID: Q96GE5
  ENSP ID: ENSP00000411084
MASVALEDVAVNFTREEWALLGPCQKNLYKDVMQETIRNLDCVGMKWKDQNIEDQYRYPRKNLRCRMLERFVESKDGTQCGETSSQIQDSIVTKNTLPGVGPYESRMSGEVIMGHSSLNCYIRVGAGHKPYEYHECGEKPDTHKQRGKAFSYHNSLQTHERLHTGKKPYNCKECGKSFSSLGNLQRHMAVQRGDGPYKCKLCGKAFFWPSLLHMHERTHTGEKPYECKQCSKAFSFYSSYLRHERTHTGEKLYECKQCSKAFPDYSSCLRHERTHTGKKPYTCKQCGKAFSASTSLRRHETTHTDEKPYACQQCGKAFHHLGSFQRHMVMHTRDGPHKCKICGKGFDCPSSLKSHERTHTGEKLYECKQCGKALSHSSSFRRHMTMHTGDGPHKCKICGKAFVYPSVFQRHEKTHTAEKPYKCKQCGKAYRISSSLRRHETTHTGEKPYKCKCGKAFIDFYSFQNHKTTHAGEKPYECKECGKAFSCFQYLSQHRRTHTGEKPYECNTCKKAFSHFGNLKVHERIHSGEKPYECKECGKAFSWLTCFLRHERIHMREKPYECQQCGKAFTHSRFLQGHEKTHTGENPYECKECGKAFASLSSLHRHKKTHWKKTHTGENPYGCKECGKAFASLSSLHRHKKTH

SEQ ID NO: 101421 - protein, 611 aa, Homo sapiens
  Payload ID: 20208
  Gene Name: zinc finger protein 799
  ENSP ID: ENSP00000415278
MQETIRNLDCVGMKWKDQNIEDQYRYPRKNLRCRMLERFVESKDGTQCGETSSQIQDSIVTKNTLPGVGPYESRMSGEVIMGHSSLNCYIRVGAGHKPYEYHECGEKPDTHKQRGKAFSYHNSLQTHERLHTGKKPYNCKECGKSFSSLGNLQRHMAVQRGDGPYKCKLCGKAFFWPSLLHMHERTHTGEKPYECKQCSKAFSFYSSYLRHERTHTGEKLYECKQCSKAFPDYSSCLRHERTHTGKKPYTCKQCGKAFSASTSLRRHETTHTDEKPYACQQCGKAFHHLGSFQRHMVMHTRDGPHKCKICGKGFDCPSSLKSHERTHTGEKLYECKQCGKALSHSSSFRRHMTMHTGDGPHKCKICGKAFVYPSVFQRHEKTHTAEKPYKCKQCGKAYRISSSLRRHETTHTGEKPYKCKCGKAFIDFYSFQNHKTTHAGEKPYECKECGKAFSCFQYLSQHRRTHTGEKPYECNTCKKAFSHFGNLKVHERIHSGEKPYECKECGKAFSWLTCFLRHERIHMREKPYECQQCGKAFTHSRFLQGHEKTHTGENPYECKECGKAFASLSSLHRHKKTHWKKTHTGENPYGCKECGKAFASLSSLHRHKKTH

SEQ ID NO: 101422 - protein, 91 aa, Homo sapiens
  Payload ID: 20208
  Gene Name: zinc finger protein 799
  ENSP ID: ENSP00000471169
MRLTLLSRLECSGTISAHCNLRLLRSSDSPASASRVAGTTGLSGFRGCGCELHPRRVGFAGSLSEESLQRCDAGNHQEPGLCRNEMERPEH

SEQ ID NO: 101423 - protein, 575 aa, Homo sapiens
  Payload ID: 20209
  Gene Name: zinc finger protein 8
  Uniprot ID: P17098
  ENSP ID: ENSP00000477716
MDPEDEGVAGVMSVGPPAARLQEPVTFRDVAVDFTQEEWGQLDPTQRILYRDVMLETFGHLLSIGPELPKPEVISQLEQGTELWVAERGTTQGCHPAWEPRSESQASRKEEGLPEEEPSHVTGREGFPTDAPYPTTLGKDRECQSQSLALKEQNNLKQLEFGLKEAPVQDQGYKTLRLRENCVLSSSPNPFPEISRGEYLYTYDSQITDSEHNSSLVSQQTGSPGKQPGENSDCHRDSSQAIPITELTKSQVQDKPYKCTDCGKSFNHNAHLTVHKRIHTGERPYMCKECGKAFSQNSSLVQHERIHTGDKPYKCAECGKSFCHSTHLTVHRRIHTGEKPYECQDCGRAFNQNSSLGRHKRTHTGEKPYTCSVCGKSFSRTTCLFLHLRTHTEERPYECNHCGKGFRHSSSLAQHQRKHAGEKPFECRQRLIFEQTPALTKHEWTEALGCDPPLSQDERTHRSDRPFKCNQCGKCFIQSSHLIRHQITHTREEQPHGRSRRREQSSSRNSHLVQHQHPNSRKSSAGGAKAGQPESRALALFDIQKIMQEKNPVHVIGVEEPSVGASMLFDIREST

SEQ ID NO: 101424 - protein, 273 aa, Homo sapiens
  Payload ID: 20210
  Gene Name: zinc finger protein 80
  Uniprot ID: P51504
  ENSP ID: ENSP00000309812
MSPKRDGLGTGDGLHSQVLQEQVSTGDNLHECDSQGPSKDTLVREGKTYKCKECGSVFNKNSLLVRHQQIHTGVKPYECQECGKAFPEKVDFVRPMRIHTGEKPCKCVECGKVFNRRSHLLCYRQIHTGEKPYECSECGKTFSYHSVFIQHRVTHTGEKLFGCKECGKTFYYNSSLTRHMKIHTGEKPCKCSECGKTFTYRSVFFRHSMTHTAGKPYECKECGKGFYYSYSLTRHTRSHTGEKPYECLEHRKDFGYHSAFAQQSKIHSGGKNL

SEQ ID NO: 101425 - protein, 273 aa, Homo sapiens; identical to SEQ ID NO: 101424
  Payload ID: 20210
  Gene Name: zinc finger protein 80
  Uniprot ID: P51504
  ENSP ID: ENSP00000417192

SEQ ID NO: 101426 - protein, 273 aa, Homo sapiens; identical to SEQ ID NO: 101424
  Payload ID: 20210
  Gene Name: zinc finger protein 80
  Uniprot ID: P51504
  ENSP ID: ENSP00000483565

SEQ ID NO: 101427 - protein, 664 aa, Homo sapiens
  Payload ID: 20211
  Gene Name: zinc finger protein 800
  Uniprot ID: Q2TB10
  ENSP ID: ENSP00000265827
MPLRDKYCQTDHHHHGCCEPVYILEPGDPPLLQQPLQTSKSGIQQIIECFRSGTKQLKHILLKDVDTIFECKLCRSLFRGLPNLITHKKFYCPPSLQMDDNLPDVNDKQSQAINDLLEAIYPSVDKREYIIKLEPIETNQNAVFQYISRTDNPIEVTESSSTPEQTEVQIQETSTEQSKTVPVTDTEVETVEPPPVEIVTDEVAPTSDEQPQESQADLETSDNSDFGHQLICCLCRKEFNSRRGVRRHIRKVHKKKMEELKKYIETRKNPNQSSKGRSKNVLVPLSRSCPVCCKSFATKANVRRHFDEVHRGLRRDSITPDIATKPGQPLFLDSISPKKSFKTRKQKSSSKAEYNLTACKCLLCKRKYSSQIMLKRHMQIVHKITLSGTNSKREKGPNNTANSSEIKVKVEPADSVESSPPSITHSPQNELKGTNHSNEKKNTPAAQKNKVKQDSESPKSTSPSAAGGQQKTRKPKLSAGFDFKQLYCKLCKRQFTSKQNLTKHIELHTDGNNIYVKFYKCPLCTYETRRKRDVIRHITVVHKKSSRYLGKITASLEIRAIKKPIDFVLNKVAKRGPSRDEAKHSDSKHDGTSNSPSKKYEVADVGIEVKVTKNFSLHRCNKCGKAFAKKTYLEHHKKTHKANASNSPEGNKTKGRSTRSKALV

SEQ ID NO: 101428 - protein, 664 aa, Homo sapiens; identical to SEQ ID NO: 101427
  Payload ID: 20211
  Gene Name: zinc finger protein 800
  Uniprot ID: Q2TB10
  ENSP ID: ENSP00000376988

SEQ ID NO: 101429 - protein, 664 aa, Homo sapiens; identical to SEQ ID NO: 101427
  Payload ID: 20211
  Gene Name: zinc finger protein 800
  Uniprot ID: Q2TB10
  ENSP ID: ENSP00000376989

SEQ ID NO: 101430 - protein, 98 aa, Homo sapiens
  Payload ID: 20211
  Gene Name: zinc finger protein 800
  ENSP ID: ENSP00000389776
MPLRDKYCQTDHHHHGCCEPVYILEPGDPPLLQQPLQTSKSGIQQIIECFRSGTKQLKHILLKDVDTIFECKLCRSLFRGLPNLITHKKFYCPPSLQM

SEQ ID NO: 101431 - protein, 130 aa, Homo sapiens
  Payload ID: 20211
  Gene Name: zinc finger protein 800
  ENSP ID: ENSP00000401109
MPLRDKYCQTDHHHHGCCEPVYILEPGDPPLLQQPLQTSKSGIQQIIECFRSGTKQLKHILLKDVDTIFECKLCRSLFRGLPNLITHKKFYCPPSLQMDDNLPDVNDKQSQAINDLLEAIYPSVDKREYI

SEQ ID NO: 101432 - protein, 242 aa, Homo sapiens
  Payload ID: 20211
  Gene Name: zinc finger protein 800
  ENSP ID: ENSP00000403945
MPLRDKYCQTDHHHHGCCEPVYILEPGDPPLLQQPLQTSKSGIQQIIECFRSGTKQLKHILLKDVDTIFECKLCRSLFRGLPNLITHKKFYCPPSLQMDDNLPDVNDKQSQAINDLLEAIYPSVDKREYIIKLEPIETNQNAVFQYISRTDNPIEVTESSSTPEQTEVQIQETSTEQSKTVPVTDTEVETVEPPPVEIVTDEVAPTSDEQPQESQADLETSDNSDFGHQLICCLCRKEFNSR

SEQ ID NO: 101433 - protein, 336 aa, Homo sapiens
  Payload ID: 20211
  Gene Name: zinc finger protein 800
  ENSP ID: ENSP00000480871
MPLRDKYCQTDHHHHGCCEPVYILEPGDPPLLQQPLQTSKSGIQQIIECFRSGTKQLKHILLKDVDTIFECKLCRSLFRGLPNLITHKKFYCPPSLQMDDNLPDVNDKQSQAINDLLEAIYPSVDKREYIIKLEPIETNQNAVFQYISRTDNPIEVTESSSTPEQTEVQIQETSTEQSKTVPVTDTEVETVEPPPVEIVTDEVAPTSDEQPQESQADLETSDNSDFGHQLICCLCRKEFNSRRGVRRHIRKVHKKKMEELKKYIETRKNPNQSSKGRSKNVLVPLSRSCPVCCKSFATKANVRRHFDEVHRGLRRDSITPDIATKPGQPLFLDSIS

SEQ ID NO: 101434 - protein, 1209 aa, Homo sapiens
  Payload ID: 20212
  Gene Name: zinc finger protein 804A
  Uniprot ID: Q7Z570
  ENSP ID: ENSP00000303252
MECYYIVISSTHLSNGHFRNIKGVFRGPLSKNGNKTLDYAEKENTIAKALEDLKANFYCELCDKQYYKHQEFDNHINSYDHAHKQRLKELKQREFARNVASKSRKDERKQEKALQRLHKLAELRKETVCAPGSGPMFKSTTVTVRENCNEISQRVVVDSVNNQQDFKYTLIHSEENTKDATTVAEDPESANNYTAKNNQVGDQAQGIHRHKIGFSFAFPKKASVKLESSAAAFSEYSDDASVGKGFSRKSRFVPSACHLQQSSPTDVLLSSEEKTNSFHPPEAMCRDKETVQTQEIKEVSSEKDALLLPSFCKFQLQLSSDADNCQNSVPLADQIPLESVVINEDIPVSGNSFELLGNKSTVLDMSNDCISVQATTEENVKHNEASTTEVENKNGPETLAPSNTEEVNITIHKKTNFCKRQCEPFVPVLNKHRSTVLQWPSEMLVYTTTKPSISYSCNPLCFDFKSTKVNNNLDKNKPDLKDLCSQQKQEDICMGPLSDYKDVSTEGLTDYEIGSSKNKCSQVTPLLADDILSSSCDSGKNENTGQRYKNISCKIRETEKYNFTKSQIKQDTLDEKYNKIRLKETHEYWFHKSRRKKKRKKLCQHHHMEKTKESETRCKMEAENSYTENAGKYLLEPISEKQYLAAEQLLDSHQLLDKRPKSESISLSDNEEMCKTWNTEYNTYDTISSKNHCKKNTILLNGQSNATMIHSGKHNLTYSRTYCCWKTKMSSCSQDHRSLVLQNDMKHMSQNQAVKRGYNSVMNESERFYRKRRQHSHSYSSDESLNRQNHLPEEFLRPPSTSVAPCKPKKKRRRKRGRFHPGFETLELKENTDYPVKDNSSLNPLDRLISEDKKEKMKPQEVAKIERNSEQTNQLRNKLSFHPNNLLPSETNGETEHLEMETTSGELSDVSNDPTTSVCVASAPTKEAIDNTLLEHKERSENINLNEKQIPFQVPNIERNFRQSQPKSYLCHYELAEALPQGKMNETPTEWLRYNSGILNTQPPLPFKEAHVSGHTFVTAEQILAPLALPEQALLIPLENHDKFKNVPCEVYQHILQPNMLANKVKFTFPPAALPPPSTPLQPLPLQQSLCSTSVTTIHHTVLQQHAAAAAAAAAAAAAGTFKVLQPHQQFLSQIPALTRTSLPQLSVGPVGPRLCPGNQPTFVAPPQMPIIPASVLHPSHLAFPSLPHALFPSLLSPHPTVIPLQPLF

SEQ ID NO: 101435 - protein, 1124 aa, Homo sapiens
  Payload ID: 20212
  Gene Name: zinc finger protein 804A
  ENSP ID: ENSP00000483032
RLKELKQREFARNVASKSRKDERKQEKALQRLHKLAELRKETVCAPGSGPMFKSTTVTVRENCNEISQRVVVDSVNNQQDFKYTLIHSEENTKDATTVAEDPESANNYTAKNNQVGDQAQGIHRHKIGFSFAFPKKASVKLESSAAAFSEYSDDASVGKGFSRKSRFVPSACHLQQSSPTDVLLSSEEKTNSFHPPEAMCRDKETVQTQEIKEVSSEKDALLLPSFCKFQLQLSSDADNCQNSVPLADQIPLESVVINEDIPVSGNSFELLGNKSTVLDMSNDCISVQATTEENVKHNEASTTEVENKNGPETLAPSNTEEVNITIHKKTNFCKRQCEPFVPVLNKHRSTVLQWPSEMLVYTTTKPSISYSCNPLCFDFKSTKVNNNLDKNKPDLKDLCSQQKQEDICMGPLSDYKDVSTEGLTDYEIGSSKNKCSQVTPLLADDILSSSCDSGKNENTGQRYKNISCKIRETEKYNFTKSQIKQDTLDEKYNKIRLKETHEYWFHKSRRKKKRKKLCQHHHMEKTKESETRCKMEAENSYTENAGKYLLEPISEKQYLAAEQLLDSHQLLDKRPKSESISLSDNEEMCKTWNTEYNTYDTISSKNHCKKNTILLNGQSNATMIHSGKHNLTYSRTYCCWKTKMSSCSQDHRSLVLQNDMKHMSQNQAVKRGYNSVMNESERFYRKRRQHSHSYSSDESLNRQNHLPEEFLRPPSTSVAPCKPKKKRRRKRGRFHPGFETLELKENTDYPVKDNSSLNPLDRLISEDKKEKMKPQEVAKIERNSEQTNQLRNKLSFHPNNLLPSETNGETEHLEMETTSGELSDVSNDPTTSVCVASAPTKEAIDNTLLEHKERSENINLNEKQIPFQVPNIERNFRQSQPKSYLCHYELAEALPQGKMNETPTEWLRYNSGILNTQPPLPFKEAHVSGHTFVTAEQILAPLALPEQALLIPLENHDKFKNVPCEVYQHILQPNMLANKVKFTFPPAALPPPSTPLQPLPLQQSLCSTSVTTIHHTVLQQHAAAAAAAAAAAAAGTFKVLQPHQQFLSQIPALTRTSLPQLSVGPVGPRLCPGNQPTFVAPPQMPIIPASVLHPSHLAFPSLPHALFPSLLSPHPTVIPLQPLF

SEQ ID NO: 101436 - protein, 1349 aa, Homo sapiens
  Payload ID: 20213
  Gene Name: zinc finger protein 804B
  Uniprot ID: A4D1E1
  ENSP ID: ENSP00000329638
MACYLVISSRHLSNGHYRGIKGVFRGPLCKNGSPSPDFAEKKSTAKALEDVKANFYCELCDKQYHKHQEFDNHINSYDHAHKQRLKELKQREFARNVASKSWKDEKKQEKALKRLHQLAELRQQSECVSGNGPAYKAPRVAIEKQLQQGIFPIKNGRKVSCMKSALLLKGKNLPRIISDKQRSTMPNRHQLQSDRRCLFGNQVLQTSSDLSNANHRTGVSFTFSKKVHLKLESSASVFSENTEETHDCNKSPIYKTKQTADKCKCCRFANKDTHLTKEKEVNISPSHLESVLHNTISINSKILQDKHDSIDETLEDSIGIHASFSKSNIHLSDVDFTPTSREKETRNTLKNTLENCVNHPCQANASFSPPNIYNHSDARISECLDEFSSLEPSEQKSTVHLNPNSRIENREKSLDKTERVSKNVQRLVKEACTHNVASKPLPFLHVQSKDGHTTLQWPTELLLFTKTEPCISYGCNPLYFDFKLSRNTKEDHNLEDLKTELGKKPLELKTKRESQVSGLTEDQQKLIQEDYQYPKPKTMIANPDWEKFQRKYNLDYSDSEPNKSEYTFSANDLEMKNPKVPLYLNTSLKDCAGKNNSSENKLKEASRAHWQGCRKAVLNDIDEDLSFPSYISRFKKHKLIPCSPHLEFEDERQFNCKSSPCTVGGHSDHGKDFSVILKSNHISMTSKVSGCGNQRYKRYSPQSCLSRYSSSLDTSPSSMSSLRSTCSSHRFNGNSRGNLLCFHKREHHSVERHKRKCLKHNCFYLSDDITKSSQMQSEPQKERNCKLWESFKNEKYSKRRYCHCRERQKLGKNQQQFSGLKSTRIIYCDSNSQISCTGSSKKPPNCQGTQHDRLDSYSIEKMYYLNKSKRNQESLGSPHICDLGKVRPMKCNSGNISCLLKNCSSGPSETTESNTAEGERTPLTAKILLERVQAKKCQEQSSNVEISSNSCKSELEAPSQVPCTIQLAPSGCNRQALPLSEKIQYASESRNDQDSAIPRTTEKDKSKSSHTNNFTILADTDCDNHLSKGIIHLVTESQSLNIKRDATTKEQSKPLISEIQPFIQSCDPVPNEFPGAFPSNKYTGVTDSTETQEDQINLDLQDVSMHINHVEGNINSYYDRTMQKPDKVEDGLEMCHKSISPPLIQQPITFSPDEIDKYKILQLQAQQHMQKQLLSKHLRVLPAAGPTAFSPASTVQTVPVHQHTSITTIHHTFLQHFAVSASLSSHSSHLPIAHLHPLSQAHFSPISFSTLTPTIIPAHPTFLAGHPLHLVAATPFHPSHITLQPLPPTAFIPTLFGPHLNPATTSIIHLNPLIQPVFQGQDFCHHSCSSQMQQLNEVKEALNVSTHLN

SEQ ID NO: 101437 - protein, 1266 aa, Homo sapiens
  Payload ID: 20213
  Gene Name: zinc finger protein 804B
  ENSP ID: ENSP00000478506
RLKELKQREFARNVASKSWKDEKKQEKALKRLHQLAELRQQSECVSGNGPAYKAPRVAIEKQLQQGIFPIKNGRKVSCMKSALLLKGKNLPRIISDKQRSTMPNRHQLQSDRRCLFGNQVLQTSSDLSNANHRTGVSFTFSKKVHLKLESSASVFSENTEETHDCNKSPIYKTKQTADKCKCCRFANKDTHLTKEKEVNISPSHLESVLHNTISINSKILQDKHDSIDETLEDSIGIHASFSKSNIHLSDVDFTPTSREKETRNTLKNTLENCVNHPCQANASFSPPNIYNHSDARISECLDEFSSLEPSEQKSTVHLNPNSRIENREKSLDKTERVSKNVQRLVKEACTHNVASKPLPFLHVQSKDGHTTLQWPTELLLFTKTEPCISYGCNPLYFDFKLSRNTKEDHNLEDLKTELGKKPLELKTKRESQVSGLTEDQQKLIQEDYQYPKPKTMIANPDWEKFQRKYNLDYSDSEPNKSEYTFSANDLEMKNPKVPLYLNTSLKDCAGKNNSSENKLKEASRAHWQGCRKAVLNDIDEDLSFPSYISRFKKHKLIPCSPHLEFEDERQFNCKSSPCTVGGHSDHGKDFSVILKSNHISMTSKVSGCGNQRYKRYSPQSCLSRYSSSLDTSPSSMSSLRSTCSSHRFNGNSRGNLLCFHKREHHSVERHKRKCLKHNCFYLSDDITKSSQMQSEPQKERNCKLWESFKNEKYSKRRYCHCRERQKLGKNQQQFSGLKSTRIIYCDSNSQISCTGSSKKPPNCQGTQHDRLDSYSIEKMYYLNKSKRNQESLGSPHICDLGKVRPMKCNSGNISCLLKNCSSGPSETTESNTAEGERTPLTAKILLERVQAKKCQEQSSNVEISSNSCKSELEAPSQVPCTIQLAPSGCNRQALPLSEKIQYASESRNDQDSAIPRTTEKDKSKSSHTNNFTILADTDCDNHLSKGIIHLVTESQSLNIKRDATTKEQSKPLISEIQPFIQSCDPVPNEFPGAFPSNKYTGVTDSTETQEDQINLDLQDVSMHINHVEGNINSYYDRTMQKPDKVEDGLEMCHKSISPPLIQQPITFSPDEIDKYKILQLQAQQHMQKQLLSKHLRVLPAAGPTAFSPASTVQTVPVHQHTSITTIHHTFLQHFAVSASLSSHSSHLPIAHLHPLSQAHFSPISFSTLTPTIIPAHPTFLAGHPLHLVAATPFHPSHITLQPLPPTAFIPTLFGPHLNPATTSIIHLNPLIQPVFQGQDFCHHSCSSQMQQLNEVKEALNVSTHLN

SEQ ID NO: 101438 - protein, 494 aa, Homo sapiens
  Payload ID: 20214
  Gene Name: zinc finger protein 805
  Uniprot ID: Q5CZA5
  ENSP ID: ENSP00000365414
MQGERLRPGLDSQKEKLPGKMSPKHDGLGTADSVCSRIIQDRVSLGDDVHDCDSHGSGKNPVIQEEENIFKCNECEKVFNKKRLLARHERIHSGVKPYECTECGKTFSKSTYLLQHHMVHTGEKPYKCMECGKAFNRKSHLTQHQRIHSGEKPYKCSECGKAFTHRSTFVLHNRSHTGEKPFVCKECGKAFRDRPGFIRHYIIHSGENPYECFECGKVFKHRSYLMWHQQTHTGEKPYECSECGKAFCESAALIHHYVIHTGEKPFECLECGKAFNHRSYLKRHQRIHTGEKPYVCSECGKAFTHCSTFILHKRAHTGEKPFECKECGKAFSNRADLIRHFSIHTGEKPYECMECGKAFNRRSGLTRHQRIHSGEKPYECIECGKTFCWSTNLIRHSIIHTGEKPYECSECGKAFSRSSSLTQHQRMHTGRNPISVTDVGRPFTSGQTSVNIQELLLGKNFLNVTTEENLLQEEASYMASDRTYQRETPQVSSL

SEQ ID NO: 101439 - protein, 627 aa, Homo sapiens
  Payload ID: 20214
  Gene Name: zinc finger protein 805
  Uniprot ID: Q5CZA5
  ENSP ID: ENSP00000412999
MAMALTDPAQVSVTFDDVAVTFTQEEWGQLDLAQRTLYQEVMLENCGLLVSLGCPVPRPELIYHLEHGQEPWTRKEDLSQGTCPGDKGKPKSTEPTTCELALSEGISFWGQLTQGASGDSQLGQPKDQDGFSEMQGERLRPGLDSQKEKLPGKMSPKHDGLGTADSVCSRIIQDRVSLGDDVHDCDSHGSGKNPVIQEEENIFKCNECEKVFNKKRLLARHERIHSGVKPYECTECGKTFSKSTYLLQHHMVHTGEKPYKCMECGKAFNRKSHLTQHQRIHSGEKPYKCSECGKAFTHRSTFVLHNRSHTGEKPFVCKECGKAFRDRPGFIRHYIIHSGENPYECFECGKVFKHRSYLMWHQQTHTGEKPYECSECGKAFCESAALIHHYVIHTGEKPFECLECGKAFNHRSYLKRHQRIHTGEKPYVCSECGKAFTHCSTFILHKRAHTGEKPFECKECGKAFSNRADLIRHFSIHTGEKPYECMECGKAFNRRSGLTRHQRIHSGEKPYECIECGKTFCWSTNLIRHSIIHTGEKPYECSECGKAFSRSSSLTQHQRMHTGRNPISVTDVGRPFTSGQTSVNIQELLLGKNFLNVTTEENLLQEEASYMASDRTYQRETPQVSSL

SEQ ID NO: 101440 - protein, 903 aa, Homo sapiens
  Payload ID: 20215
  Gene Name: zinc finger protein 808
  Uniprot ID: Q8N4W9
  ENSP ID: ENSP00000352846
MLREEAAQKRKGKESGMALPQGRLTFRDVAIEFSLAEWKFLNPAQRALYREVMLENYRNLEAVDISSKHMMKEVLSTGQGNREVIHTGTLQRHQSYHIGDFCFQEIEKEIHNIEFQCQEDERNGHEAPTTKIKKLTGSTDQHDHRHAGNKPIKDQLGSSFYSHLPELHIFQIKGEIANQLEKSTSDASSVSTSQRISCRPQIHISNNYGNNPLNSSLLPQKQEVHMREKSFPCNESGKAFNCSSLLRKHQIPHLGDKQYKCDVCGKLFNHKQYLACHRRCHTGEKPYKCKECGKSFSYKSSLTCHHRLHTGVKPYKCNECGKVFRQNSALVIHKAIHTGEKPYKCNECGKAFNQQSHLSRHQRLHTGVKPYKCKICEKAFACHSYLANHTRIHSGEKTYKCNECGKAFNHQSSLARHHILHTGEKPYKCEECDKVFSQKSTLERHKRIHTGEKPYKCKVCDTAFTCNSQLARHRRIHTGEKTYKCNECRKTFSRRSSLLCHRRLHSGEKPYKCNQCGNTFRHRASLVYHRRLHTLEKSYKCTVCNKVFMRNSVLAVHTRIHTAKKPYKCNECGKAFNQQSHLSRHRRLHTGEKPYKCEACDKVFGQKSALESHKRIHTGEKPYRCQVCDTAFTWNSQLARHTRIHTGEKTYKCNECGKTFSYKSSLVWHRRLHGGEKSYKCKVCDKAFVCRSYVAKHTRIHSGMKPYKCNECSKTFSNRSSLVCHRRIHSGEKPYKCSECSKTFSQKATLLCHRRLHSGEKPYKCNDCGNTFRHWSSLVYHRRLHTGEKSYKCTVCDKAFVRNSYLARHIRIHTAEKPYKCNECGKAFNEQSHLSRHHRIHTGEKPYKCEACDKVFSRKSHLKRHRIIHTGEKPYKCNECGKAFSDRSTLIHHQAIHGIGKFD

SEQ ID NO: 101441 - protein, 83 aa, Homo sapiens
  Payload ID: 20215
  Gene Name: zinc finger protein 808
  ENSP ID: ENSP00000417727
MLREEAAQKRKGKESGMALPQGRLTFRDVAIEFSLAEWKFLNPAQRALYREVMLENYRNLEAVDISSKHMMKEVLSTGQGNRE

SEQ ID NO: 101442 - protein, 102 aa, Homo sapiens
  Payload ID: 20215
  Gene Name: zinc finger protein 808
  ENSP ID: ENSP00000418528
MMKEVLSTGQGNREVIHTGTLQRHQSYHIGDFCFQEIEKEIHNIEFQCQEDERNGHEAPTTKIKKLTGSTDQHDHRHAGNKPIKDQLGSSFYSHLPELHIFQ

SEQ ID NO: 101443 - protein, 173 aa, Homo sapiens
  Payload ID: 20215
  Gene Name: zinc finger protein 808
  ENSP ID: ENSP00000418696
MLREEAAQKRKGKESGMALPQGRLTFRDVAIEFSLAEWKFLNPAQRALYREVMLENYRNLEAVDISSKHMMKEVLSTGQGNREVIHTGTLQRHQSYHIGDFCFQEIEKEIHNIEFQCQEDERNGHEAPTTKIKKLTGSTDQHDHRHAGNKPIKDQLGSSFYSHLPELHIFQIK

SEQ ID NO: 101444 - protein, 180 aa, Homo sapiens
  Payload ID: 20215
  Gene Name: zinc finger protein 808
  ENSP ID: ENSP00000419291
MLREEAAQKRKGKESGMALPQGRLTFRDVAIEFSLAEWKFLNPAQRALYREVMLENYRNLEAVDISSKHMMKEVLSTGQGNREVIHTGTLQRHQSYHIGDFCFQEIEKEIHNIEFQCQEDERNGHEAPTTKIKKLTGSTDQHDHRHAGNKPIKDQLGSSFYSHLPELHIFQIKGEIANQL

SEQ ID NO: 101445 - protein, 834 aa, Homo sapiens
  Payload ID: 20215
  Gene Name: zinc finger protein 808
  Uniprot ID: Q8N4W9
  ENSP ID: ENSP00000420522
MMKEVLSTGQGNREVIHTGTLQRHQSYHIGDFCFQEIEKEIHNIEFQCQEDERNGHEAPTTKIKKLTGSTDQHDHRHAGNKPIKDQLGSSFYSHLPELHIFQIKGEIANQLEKSTSDASSVSTSQRISCRPQIHISNNYGNNPLNSSLLPQKQEVHMREKSFPCNESGKAFNCSSLLRKHQIPHLGDKQYKCDVCGKLFNHKQYLACHRRCHTGEKPYKCKECGKSFSYKSSLTCHHRLHTGVKPYKCNECGKVFRQNSALVIHKAIHTGEKPYKCNECGKAFNQQSHLSRHQRLHTGVKPYKCKICEKAFACHSYLANHTRIHSGEKTYKCNECGKAFNHQSSLARHHILHTGEKPYKCEECDKVFSQKSTLERHKRIHTGEKPYKCKVCDTAFTCNSQLARHRRIHTGEKTYKCNECRKTFSRRSSLLCHRRLHSGEKPYKCNQCGNTFRHRASLVYHRRLHTLEKSYKCTVCNKVFMRNSVLAVHTRIHTAKKPYKCNECGKAFNQQSHLSRHRRLHTGEKPYKCEACDKVFGQKSALESHKRIHTGEKPYRCQVCDTAFTWNSQLARHTRIHTGEKTYKCNECGKTFSYKSSLVWHRRLHGGEKSYKCKVCDKAFVCRSYVAKHTRIHSGMKPYKCNECSKTFSNRSSLVCHRRIHSGEKPYKCSECSKTFSQKATLLCHRRLHSGEKPYKCNDCGNTFRHWSSLVYHRRLHTGEKSYKCTVCDKAFVRNSYLARHIRIHTAEKPYKCNECGKAFNEQSHLSRHHRIHTGEKPYKCEACDKVFSRKSHLKRHRIIHTGEKPYKCNECGKAFSDRSTLIHHQAIHGIGKFD

SEQ ID NO: 101446 - protein, 76 aa, Homo sapiens
  Payload ID: 20215
  Gene Name: zinc finger protein 808
  ENSP ID: ENSP00000479648
MIEARSSVKLHPMQNRRIHTGEKPHKCDDCGKAFTSHSHLVGHQRIHTGQKSCKCHQCGKVFSPRSLLAEHEKIHF

SEQ ID NO: 101447 - protein, 69 aa, Homo sapiens
  Payload ID: 20216
  Gene Name: zinc finger protein 81
  ENSP ID: ENSP00000334641
MPANEDAPQPGEHGSACEVSVSFEDVTVDFSREEWQQLDSTQRRLYQDVMLENYSHLLSVGKDNHPVKL

SEQ ID NO: 101448 - protein, 661 aa, Homo sapiens
  Payload ID: 20216
  Gene Name: zinc finger protein 81
  Uniprot ID: P51508
  ENSP ID: ENSP00000341151
MPANEDAPQPGEHGSACEVSVSFEDVTVDFSREEWQQLDSTQRRLYQDVMLENYSHLLSVGFEVPKPEVIFKLEQGEGPWTLEGEAPHQSCSDGKFGIKPSQRRISGKSTFHSEMEGEDTRDDSLYSILEELWQDAEQIKRCQEKHNKLLSRTTFLNKKILNTEWDYEYKDFGKFVHPSPNLILSQKRPHKRDSFGKSFKHNLDLHIHNKSNAAKNLDKTIGHGQVFTQNSSYSHHENTHTGVKFCERNQCGKVLSLKHSLSQNVKFPIGEKANTCTEFGKIFTQRSHFFAPQKIHTVEKPHELSKCVNVFTQKPLLSIYLRVHRDEKLYICTKCGKAFIQNSELIMHEKTHTREKPYKCNECGKSFFQVSSLLRHQTTHTGEKLFECSECGKGFSLNSALNIHQKIHTGERHHKCSECGKAFTQKSTLRMHQRIHTGERSYICTQCGQAFIQKAHLIAHQRIHTGEKPYECSDCGKSFPSKSQLQMHKRIHTGEKPYICTECGKAFTNRSNLNTHQKSHTGEKSYICAECGKAFTDRSNFNKHQTIHTGEKPYVCADCGRAFIQKSELITHQRIHTTEKPYKCPDCEKSFSKKPHLKVHQRIHTGEKPYICAECGKAFTDRSNFNKHQTIHTGDKPYKCSDCGKGFTQKSVLSMHRNIHT

SEQ ID NO: 101449 - protein, 103 aa, Homo sapiens
  Payload ID: 20216
  Gene Name: zinc finger protein 81
  ENSP ID: ENSP00000366149
MPANEDAPQPGEHGSACEVSVSFEDVTVDFSREEWQQLDSTQRRLYQDVMLENYSHLLSVGFEVPKPEVIFKLEQGEGPWTLEGEAPHQSCSGISTYFVTSTV

SEQ ID NO: 101450 - protein, 661 aa, Homo sapiens; identical to SEQ ID NO: 101448
  Payload ID: 20216
  Gene Name: zinc finger protein 81
  Uniprot ID: P51508
  ENSP ID: ENSP00000366153

SEQ ID NO: 101451 - protein, 454 aa, Homo sapiens
  Payload ID: 20217
  Gene Name: zinc finger protein 812
  Uniprot ID: P0C7V5
  ENSP ID: ENSP00000395629
MAVTDLSHGFFPREPICPFEEKTKIGTMVEDYLANSYQDSVTFDDVAVEFTPEEWALLDTTEKCLYRDVMLENYVNLASVEATVDGNSENCGEVFSEWFCLKTHMRAQNGGNIFEGNCYGKDILSVHKEASIGQELSKFNPCGKVFTLTPDLAAHLGILNARQPYKCKECRKGFKYFASLDNHMGIHIGEKFCEFQECRRAITHSSHLKQCVTVHTGKKSKKTKKHGKSFTNFSQLSAHVKIHKGEKSFECKECGRSFRNSSSFNVHIQIHTGIKPHKYTECGKAFTRSTHLTQHVRTHTGIKPYECKECGQAFTQYTGLAIHIRNHTGEKHYQCKECGKAFNGSSTLTQHKIIHTGEKPYGCVECGKTFITSSYRSKHLKTHHEERPFVCKICGKAFLYSSPLNVHLQTHTREKALICKECGKAFAVSSHLSRHERIHTGEEPYEYKGMNVTI

SEQ ID NO: 101452 - protein, 454 aa, Homo sapiens; identical to SEQ ID NO: 101451
  Payload ID: 20217
  Gene Name: zinc finger protein 812
  Uniprot ID: P0C7V5
  ENSP ID: ENSP00000440451

SEQ ID NO: 101453 - protein, 32 aa, Homo sapiens
  Payload ID: 20217
  Gene Name: zinc finger protein 812
  ENSP ID: ENSP00000465513
MRAQNGGNIFEGNCYGKDILSVHKEASIGQEL

SEQ ID NO: 101454 - protein, 28 aa, Homo sapiens
  Payload ID: 20217
  Gene Name: zinc finger protein 812
  ENSP ID: ENSP00000466817
MAVTDLSHGFFPREPICPFEEKTKIGTM

SEQ ID NO: 101455 - protein, 617 aa, Homo sapiens
  Payload ID: 20218
  Gene Name: zinc finger protein 813
  Uniprot ID: Q6ZN06
  ENSP ID: ENSP00000379684
MALPQGLLTFRDVAIEFSQEEWKCLDPAQRTLYRDVMLENYRNLVSLDISSKCMMKEFSSTAQGNREVIHTGTLQRHESHHTGDFRFQEIDKDIHNLEFQWQEDERNSHEAPMTEIKKLTGSADRYDQRHAGNKPIKDQLGSSFHSHLPELHMFQTQGKIGNQVEKSINDASSISTSQRISCRPKTHISNNYGNNFRNSSLLTQKQEVHMREKSFQCNESGKAFNYSSLLRKHQIIHLGEKQYKCDVCGKVFNRKRNLVCHRRCHTGEKPYRCNECGKTFSQTYSLTCHRRLHTGEKPYKCEECDKAFSFKSNLKRHRRIHAGEKPYKCNECGKTFSQTSSLTCHRRLHTGEKPFKCNECGKTFSRKSSLTCHHRLHTGEKPYKCNECGKTFSQELTLKCHRRLHTGEKPYKCNECGKVFNKKANLARHHRLHSGEKPYKCTECVKTFSRNSALVIHKAIHIGEKRYKCNECGKTFSRISALVIHTAIHTGEKPYKCNECGKGFNRKTHLACHHRLHTGEKPYKCNECGKVFNRKTHLAHHHRLHTGDKPYKCNECGKVFNQKAHLARHHRLHTGEKPYKCNECGKVFNQKANLARHHRLHTGEKPYKFNECGKAFN

SEQ ID NO: 101456 - protein, 146 aa, Homo sapiens
  Payload ID: 20218
  Gene Name: zinc finger protein 813
  ENSP ID: ENSP00000418289
MALPQGLLTFRDVAIEFSQEEWKCLDPAQRTLYRDVMLENYRNLVSLDTGFLLFCLADLKLLPSGDPSTSASETAAITDISSKCMMKEFSSTAQGNREVIHTGTLQRHESHHTGDFRFQEIDKDIHNLEFQWQEDERNSHEAPMTE

SEQ ID NO: 101457 - protein, 125 aa, Homo sapiens
  Payload ID: 20218
  Gene Name: zinc finger protein 813
  ENSP ID: ENSP00000419821
MMKEFSSTAQGNREVIHTGTLQRHESHHTGDFRFQEIDKDIHNLEFQWQEDERNSHEAPMTEIKKLTGSADRYDQRHAGNKPIKDQLGSSFHSHLPELHMFQTQGKIGNQVEKSINDASSISTSQ

SEQ ID NO: 101458 - protein, 855 aa, Homo sapiens
  Payload ID: 20219
  Gene Name: zinc finger protein 814
  Uniprot ID: B7Z6K7
  ENSP ID: ENSP00000410545
MAAAATLRLSAQGTVTFEDVAVNFTWEEWNLLSEAQRCLYRDVTLENLALISSLGCWCGVEDEAAPSKQSIYIQRETQVRTPMAGVSPKKAHPCEMCGPILGDILHVADHQGTHHKQKLHRCEAWGNKLYDSGNFHQHQNEHIGEKPYRGSVEEALFAKRCKLHVSGESSVFSESGKDFLPRSGLLQQEASHTGEKSNSKTECVSPIQCGGAHYSCGESMKHFSTKHILSQHQRLLTREECYVCCECGKSFSKYASLSNHQRVHTEKKHECGECGKSFSKYVSFSNHQRVHTEKKHECGECGKSFSKYVSFSNHQRVHTGKRPYECGECGKSFSKYASFSNHQRVHTEKKHYECGECGKSFSKYVSFSNHQRVHTGKRPYECGECGKSFSKYASFSNHQRVHTDKKHYECGECGKSFSQKSSLIQHQRFHTGEKPYGCEECGKSFSSEGHLRSHQRVHAGERPFKCGECVKSFSHKRSLVHHQRVHSGERPYQCGECGKSFSQKGNLVLHQRVHTGARPYECGECGKSFSSKGHLRNHQQIHTGDRLYECGECGKSFSHKGTLILHQRVHPRERSYGCGECGKSFSSIGHLRSHQRVHTGERPYECGECGKSFSHKRSLVHHQRMHTGERPYKCGDCGKSFNEKGHLRNHQRVHTTERPFKCGECGKCFSHKGNLILHQHGHTGERPYVCRECGKLFKKKSHLLVHQRIHNGEKPYACEACQKFFRNKYQLIAHQRVHTGERPYECNDCGKSFTHSSTFCVHKRIHTGEKPYECSECGKSFAESSSFTKHKRVHTGEKPYECSECGKSFAESSSLTKHKRVHTGEKPYKCEKCGKLFNKKSHLLVHQSSHWRKAI

SEQ ID NO: 101459 - protein, 62 aa, Homo sapiens
  Payload ID: 20219
  Gene Name: zinc finger protein 814
  ENSP ID: ENSP00000469641
MAAAATLRLSAQGTVTFEDVAVNFTWEEWNLLSEAQRCLYRDVTLENLALISSLGKLLTLTL

SEQ ID NO: 101460 - protein, 39 aa, Homo sapiens
  Payload ID: 20219
  Gene Name: zinc finger protein 814
  ENSP ID: ENSP00000469704
MAAAATLRLSAQQLLLGTILNWAERPSQTRGRQMAPVTP

SEQ ID NO: 101461 - protein, 68 aa, Homo sapiens
  Payload ID: 20219
  Gene Name: zinc finger protein 814
  ENSP ID: ENSP00000469912
MAAAATLRLSAQGTVTFEDVAVNFTWEEWNLLSEAQRCLYRDVTLENLALISSLVYATRSSQMKPVAR

SEQ ID NO: 101462 - protein, 113 aa, Homo sapiens
  Payload ID: 20219
  Gene Name: zinc finger protein 814
  ENSP ID: ENSP00000470296
MAAAATLRLSAQESHSVIQTGVQWRDHSSPQPPPTGDILIQGTVTFEDVAVNFTWEEWNLLSEAQRCLYRDVTLENLALISSLDPALDGSADNTQTGNLGQSVLPSHPEQKTA

SEQ ID NO: 101463 - protein, 84 aa, Homo sapiens
  Payload ID: 20219
  Gene Name: zinc finger protein 814
  ENSP ID: ENSP00000470328
MAAAATLRLSAQGTVTFEDVAVNFTWEEWNLLSEAQRCLYRDVTLENLALISSLDPALDGSADNTQTGNLGQSVLPSHPEQKTA

SEQ ID NO: 101464 - protein, 94 aa, Homo sapiens
  Payload ID: 20219
  Gene Name: zinc finger protein 814
  ENSP ID: ENSP00000470748
  MOD_RES (1)..(1): Any amino acid
XLSAQGTVTFEDVAVNFTWEEWNLLSEAQRCLYRDVTLENLALISSLGMTFLHVCQALDSLRQVIHPPTSASQSAGITGSHSIPQARVRWHHLG

SEQ ID NO: 101465 - protein, 79 aa, Homo sapiens
  Payload ID: 20219
  Gene Name: zinc finger protein 814
  ENSP ID: ENSP00000471045
MAAAATLRLSAQGTVTFEDVAVNFTWEEWNLLSEAQRCLYRDVTLENLALISSLGCWCGVEDEAAPSKQSIYIQRETQG

SEQ ID NO: 101466 - protein, 91 aa, Homo sapiens
  Payload ID: 20219
  Gene Name: zinc finger protein 814
  ENSP ID: ENSP00000471385
MAAAATLRLSAQGTVTFEDVAVNFTWEEWNLLSEAQRCLYRDVTLENLALISSLGMTFLHVCQALDSLRQVIHPPTSASQSAGITGVSHCA

SEQ ID NO: 101467 - protein, 91 aa, Homo sapiens; identical to SEQ ID NO: 101466
  Payload ID: 20219
  Gene Name: zinc finger protein 814
  ENSP ID: ENSP00000472089

SEQ ID NO: 101468 - protein, 577 aa, Homo sapiens [sequence omitted]

SEQ ID NO: 101469 - protein, 98 aa, Homo sapiens
  Payload ID: 20220
  Gene Name: zinc finger protein 816
  ENSP ID: ENSP00000333199
MLREEATKKSKEKEPGMALPQMESYSAAQAGVQWHDLGSLQHSSLVLKLFSCISLPGTLDFQGCGYRVLFGGVEMPEPCTEGFIQGCDVGELQEPGVC

SEQ ID NO: 101470 - protein, 651 aa, Homo sapiens
  Payload ID: 20220
  Gene Name: zinc finger protein 816
  Uniprot ID: Q0VGE8
  ENSP ID: ENSP00000350295
MLREEATKKSKEKEPGMALPQGRLTFRDVAIEFSLEEWKCLNPAQRALYRAVMLENYRNLEFVDSSLKSMMEFSSTRHSITGEVIHTGTLQRHKSHHIGDFCFPEMKKDIHHFEFQWQEVERNGHEAPMTKIKKLTGSTDRSDHRHAGNKPIKDQLGLSFHSHLPELHMFQTKGKISNQLDKSIGASSASESQRISCRLKTHISNKYGKNFLHSSFTQIQEICMREKPCQSNECGKAFNYSSLLRRHHITHSREREYKCDVCGKIFNQKQYIVYHHRCHTGEKTYKCNECGKTFTQMSSLVCHRRLHTGEKPYKCNECGKTFSEKSSLRCHRRLHTGEKPYKCNECGKTFGRNSALVIHKAIHTGEKPYKCNECGKTFSQKSSLQCHHILHTGEKPYKCEECDNVYIRRSHLERHRKIHTGEGSYKCKVCDKVFRSDSYLAEHQRVHTGEKPYKCNKCGRSFSRKSSLQYHHTLHTGEKPYTCNECGKVFSRRENLARHHRLHAGEKPYKCEECDKVFSRRSHLERHRRIHTGEKPYKCKVCDKAFRSDSCLANHTRVHTGEKPYKCNKCAKVFNQKGILAQHQRVHTGEKPYKCNECGKVFNQKASLAKHQRVHTAEKPYKCNECGKAFTGQSTLIHHQAIHGCRETLQM

SEQ ID NO: 101471 - protein, 651 aa, Homo sapiens; identical to SEQ ID NO: 101470
  Payload ID: 20220
  Gene Name: zinc finger protein 816
  Uniprot ID: Q0VGE8
  ENSP ID: ENSP00000403266

SEQ ID NO: 101472 - protein, 114 aa, Homo sapiens
  Payload ID: 20220
  Gene Name: zinc finger protein 816
  ENSP ID: ENSP00000408965
MLREEATKKSKEKEPGMALPQGRLTFRDVAIEFSLEEWKCLNPAQRALYRAVMLENYRNLEFVDSSLKSMMEFSSTRHSITGEVIHTGTLQRHKSHHIGDFCFPEMKKDIHHFE

SEQ ID NO: 101473 - protein, 76 aa, Homo sapiens
  Payload ID: 20220
  Gene Name: zinc finger protein 816
  ENSP ID: ENSP00000469688
MLREEATKKSKEKEPGMALPQGRLTFRDVAIEFSLEEWKCLNPAQRALYRAVMLENYRNLEFVEFCSCCPGWSAMW

SEQ ID NO: 101474 - protein, 97 aa, Homo sapiens
  Payload ID: 20220
  Gene Name: zinc finger protein 816
  ENSP ID: ENSP00000470838
MLREEATKKSKEKEPGMALPQGRLTFRDVAIEFSLEEWKCLNPAQRALYRAVMLENYRNLEFVGEENVPPDMRNLHLSILALSGFIFSFVILPHTCF

SEQ ID NO: 101475 - protein, 58 aa, Homo sapiens
  Payload ID: 20220
  Gene Name: zinc finger protein 816
  ENSP ID: ENSP00000471215
MLREEATKKSKEKEPGMALPQGCGYRVLFGGVEMPEPCTEGFIQGCDVGELQEPGVCG

SEQ ID NO: 101476 - protein, 97 aa, Homo sapiens; identical to SEQ ID NO: 101474
  Payload ID: 20220
  Gene Name: zinc finger protein 816
  ENSP ID: ENSP00000472475

SEQ ID NO: 101477 - protein, 370 aa, Homo sapiens
  Payload ID: 20221
  Gene Name: zinc finger protein 821
  ENSP ID: ENSP00000313822
MSRRKQTNPNKVHCDSEGDEEETTQDEVSSHTSEEDGGVVKVEKELENTEQPVGGNEVVEHEVTGNLNSDPLLELCQCPLCQLDCGSREQLIAHVYQHTAAVVSAKSYMCPVCGRALSSPGSLGRHLLIHSEDQRSNCAVCGARFTSHATFNSEKLPEVLNMESLPTVHNEGPSSAEGKDIAFSPPVYPAGILLVCNNCAAYRKLLEAQTPSVRKWALRRQNEPLEVRLQRLERERTAKKSRRDNETPEEREVRRMRDREAKRLQRMQETDEQRARRLQRDREAMRLKRANETPEKRQARLIREREAKRLKRRLEKMDMMLRAQFGQDPSAMAALAAEMNFFQLPVSGVELDSQLLGKMAFEEQNSSSLH

SEQ ID NO: 101478 - protein, 412 aa, Homo sapiens
  Payload ID: 20221
  Gene Name: zinc finger protein 821
  Uniprot ID: O75541
  ENSP ID: ENSP00000398089
MSRRKQTNPNKVHWDQVFAGLEEQARQAMMKTDFPGDLGSQRQAIQQLRDQDSSSSDSEGDEEETTQDEVSSHTSEEDGGVVKVEKELENTEQPVGGNEVVEHEVTGNLNSDPLLELCQCPLCQLDCGSREQLIAHVYQHTAAVVSAKSYMCPVCGRALSSPGSLGRHLLIHSEDQRSNCAVCGARFTSHATFNSEKLPEVLNMESLPTVHNEGPSSAEGKDIAFSPPVYPAGILLVCNNCAAYRKLLEAQTPSVRKWALRRQNEPLEVRLQRLERERTAKKSRRDNETPEEREVRRMRDREAKRLQRMQETDEQRARRLQRDREAMRLKRANETPEKRQARLIREREAKRLKRRLEKMDMMLRAQFGQDPSAMAALAAEMNFFQLPVSGVELDSQLLGKMAFEEQNSSSLH

SEQ ID NO: 101479 - protein, 370 aa, Homo sapiens; identical to SEQ ID NO: 101477
  Payload ID: 20221
  Gene Name: zinc finger protein 821
  ENSP ID: ENSP00000405908

SEQ ID NO: 101480 - protein, 62 aa, Homo sapiens
  Payload ID: 20221
  Gene Name: zinc finger protein 821
  ENSP ID: ENSP00000455454
MSRRKQTNPNKVHWDQVFAGLEEQARQAMMKTDFPGDLGSQRQAIQQLRDQDSSSSEFCTFW

SEQ ID NO: 101481 - protein, 412 aa, Homo sapiens; identical to SEQ ID NO: 101478
  Payload ID: 20221
  Gene Name: zinc finger protein 821
  Uniprot ID: O75541
  ENSP ID: ENSP00000455648

SEQ ID NO: 101482 - protein, 138 aa, Homo sapiens
  Payload ID: 20221
  Gene Name: zinc finger protein 821
  ENSP ID: ENSP00000455738
MSRRKQTNPNKVHWDQVFAGLEEQARQAMMKTDFPGDLGSQRQAIQQLRDQDSSSSDSEGDEEETTQDEVSSHTSEEDGGVVKVEKELENTEQPVGGNEVVEHEARNLNSDPLLELCQCPLCQLDCGSREQLIAHVYQ

SEQ ID NO: 101483 - protein, 62 aa, Homo sapiens; identical to SEQ ID NO: 101480
  Payload ID: 20221
  Gene Name: zinc finger protein 821
  ENSP ID: ENSP00000456031

SEQ ID NO: 101484 - protein, 66 aa, Homo sapiens
  Payload ID: 20221
  Gene Name: zinc finger protein 821
  ENSP ID: ENSP00000456087
MSRRKQTNPNKVHWDQVFAGLEEQARQAMMKTDFPGDLGSQRQAIQQLRDQDSSSSEFCTFWSQGI

SEQ ID NO: 101485 - protein, 105 aa, Homo sapiens
  Payload ID: 20221
  Gene Name: zinc finger protein 821
  ENSP ID: ENSP00000456106
MSRRKQTNPNKVHWDQVFAGLEEQARQAMMKTDFPGDLGSQRQAIQQLRDQDSSSSDSEGDEEETTQDEVSSHTSEEDGGVVKVEKELENTEQPVGGNEVVEHEA

SEQ ID NO: 101486 - protein, 250 aa, Homo sapiens
  Payload ID: 20221
  Gene Name: zinc finger protein 821
  ENSP ID: ENSP00000456193
MSRRKQTNPNKVHCDSEGDEEETTQDEVSSHTSEEDGGVVKVEKELENTEQPVGGNEVVEHEVTGNLNSDPLLELCQCPLCQLDCGSREQLIAHVYQHTAAVVSAKSYMCPVCGRALSSPGSLGRHLLIHSEDQRSNCAVCGARFTSHATFNSEKLPEVLNMESLPTVHNEGPSSAEGKDIAFSPPVYPAGILLVCNNCAAYRKLLEAQTPSVRKWALRRQNEPLEVRLQRLERERTAKKSRRDNETPEE

SEQ ID NO: 101487 - protein, 403 aa, Homo sapiens
  Payload ID: 20221
  Gene Name: zinc finger protein 821
  ENSP ID: ENSP00000456563
MSRRKQTNPNKVHWDQVFAGLEEQARQAMMKTDFPGDLGSQRQAIQQLRDQDSSSSDSEGDEEETTQDEVSSHTSEEDGGVVKVEKELENTEQPVGGNEVVEHEVTGNLNSDPLLELCQCPLCQLDCGSREQLIAHVYQHTAAVVSAKSYMCPVCGRALSSPGSLGRHLLIHSEDQRSNCAVCGARFTSHATFNSEKLPEVLNMESLPTVHNEGPSSAEGKDIAFSPPVYPAGILLVCNNCAAYRKLLEAQTPSVRKWALRRQNEPLEVRLQRLERERTAKKSRRDNETPEEREVRRMRDREAKRLQRMQETDEQRARRLQRDREAMRLKRANETPEKRQARLIREREAKRLKRRLEKMDMMLRAQFGQDPSAMAALAAEMNFFQLPVSGVELDSQLLGKMAF

SEQ ID NO: 101488 - protein, 105 aa, Homo sapiens; identical to SEQ ID NO: 101485
  Payload ID: 20221
  Gene Name: zinc finger protein 821
  ENSP ID: ENSP00000457068

SEQ ID NO: 101489 - protein, 62 aa, Homo sapiens; identical to SEQ ID NO: 101480
  Payload ID: 20221
  Gene Name: zinc finger protein 821
  ENSP ID: ENSP00000457202

SEQ ID NO: 101490 - protein, 62 aa, Homo sapiens
  Payload ID: 20221
  Gene Name: zinc finger protein 821
  ENSP ID: ENSP00000457396
MSRRKQTNPNKVHWDQVFAGLEEQARQAMMKTDFPGDLGSQRQAIQQLRDQDSSSSHREFEF

SEQ ID NO: 101491 - protein, 62 aa, Homo sapiens; identical to SEQ ID NO: 101480
  Payload ID: 20221
  Gene Name: zinc finger protein 821
  ENSP ID: ENSP00000457985

SEQ ID NO: 101492 - protein, 212 aa, Homo sapiens
  Payload ID: 20221
  Gene Name: zinc finger protein 821
  ENSP ID: ENSP00000458112
MSRRKQTNPNKVHCDSEGDEEETTQDEVSSHTSEEDGGVVKVEKELENTEQPVGGNEVVEHEVTGNLNSDPLLELCQCPLCQLDCGSREQLIAHVYQHTAAVVSAKSYMCPVCGRALSSPGSLGRHLLIHSEDQRSNCAVCGARFTSHATFNSEKLPEVLNMESLPTVHNEGPSSAEGKDIAFSPPVYPAGILLVCNNCAAYRKLLEAQTPS

SEQ ID NO: 101493 - protein, 139 aa, Homo sapiens
  Payload ID: 20221
  Gene Name: zinc finger protein 821
  ENSP ID: ENSP00000481362
MSRRKQTNPNKVHWDQVFAGLEEQARQAMMKTDFPGDLGSQRQAIQQLRDQDSSSSDSEGDEEETTQDEVSSHTSEEDGGVVKVEKELENTEQPVGGNEVVEHEVTGNLNSDPLLELCQCPLCQLDCGSREQLIAHVYQ

SEQ ID NO: 101494 - protein, 610 aa, Homo sapiens
  Payload ID: 20222
  Gene Name: zinc finger protein 823
  Uniprot ID: P16415
  ENSP ID: ENSP00000340683
MDSVAFEDVAVNFTQEEWALLGPSQKSLYRNVMQETIRNLDCIEMKWEDQNIGDQCQNAKRNLRSHTCEIKDDSQCGETFGQIPDSIVNKNTPRVNPCDSGECGEVVLGHSSLNCNIRVDTGHKSCEHQEYGEKPYTHKQRGKAISHQHSFQTHERPPTGKKPFDCKECAKTFSSLGNLRRHMAAHHGDGPYKCKLCGKAFVWPSLFHLHERTHTGEKPYECKQCSKAFPFYSSYLRHERIHTGEKAYECKQCSKAFPDYSTYLRHERTHTGEKPYKCTQCGKAFSCYYYTRLHERTHTGEQPYACKQCGKTFYHHTSFRRHMIRHTGDGPHKCKICGKGFDCPSSVRNHETTHTGEKPYECKQCGKVLSHSSSFRSHMITHTGDGPQKCKICGKAFGCPSLFQRHERTHTGEKPYQCKQCGKAFSLAGSLRRHEATHTGVKPYKCQCGKAFSDLSSFQNHETTHTGEKPYECKECGKAFSCFKYLSQHKRTHTVEKPYECKTCRKAFSHFSNLKVHERIHSGEKPYECKECGKAFSWLTCLLRHERIHTGEKPYECLQCGKAFTRSRFLRGHEKTHTGEKLYECKECGKALSSLRSLHRHKRTHWKDTL

SEQ ID NO: 101495 - protein, 67 aa, Homo sapiens
  Payload ID: 20222
  Gene Name: zinc finger protein 823
  ENSP ID: ENSP00000387514
MDSVAFEDVAVNFTQEEWALLGPSQKSLYRNVMQETIRNLDCIEVIHVKLKMTVNVEKLLARFQIVL

SEQ ID NO: 101496 - protein, 469 aa, Homo sapiens
  Payload ID: 20222
  Gene Name: zinc finger protein 823
  ENSP ID: ENSP00000410654
MKWEDQNIGDQCQNAKRNLRSHTCEIKDDSQCGETFGQIPDSIVNKNTPRVNPCDSGECGEVVLGHSSLNCNIRVDTGHKSCEHQEYGEKPYTHKQRGKAISHQHSFQTHERPPTGKKPFDCKECAKTFSSLGNLRRHMAAHHGDGPYKCKLCGKAFVWPSLFHLHERTHTGEKPYECKQCSKAFPFYSSYLRHERIHTGEKAYECKQCSKAFPDYSTYLRHERTHTGEKPYKCTQCGKAFSCYYYTRLHERTHTGEQPYACKQCGKTFYHHTSFRRHMIRHTGDGPHKCKICGKGFDCPSSVRNHETTHTGEKPYECKQCGKVLSHSSSFRSHMITHTGDGPQKCKICGKAFGCPSLFQRHERTHTGEKPYQCKQCGKAFSLAGSLRRHEATHTGVKPYKCQCGKAFSDLSSFQNHETTHTGEKPYECKECGKAFSCFKYLSQHKRTHTVEKPYECKTCRKAFSHFSN

SEQ ID NO: 101497 - protein, 92 aa, Homo sapiens
  Payload ID: 20222
  Gene Name: zinc finger protein 823
  ENSP ID: ENSP00000466840
MAAHHGDGPYKCKLCGKAFVWPSLFHLHERTHTGEKPYECKQCSKAFPFYSSYLRHERIHTGEKAYECKQCSKAFPDYSTYLRHERTHTGEK

SEQ ID NO: 101498 - protein, 1077 aa, Homo sapiens
  Payload ID: 20223
  Gene Name: zinc finger protein 827
  Uniprot ID: Q17R98
  ENSP ID: ENSP00000368761
MPRRKQEQPKRLPSHVSRQEEAEGELSEGEHWYGNSSETPSEASYGEVQENYKLSLEDRIQEQSTSPDTSLGSTTPSSHTLELVALDSEVLRDSLQCQDHLSPGVSSLCDDDPGSNKPLSSNLRRLLEAGSLKLDAAATANGRVESPVNVGSNLSFSPPSHHAQQLSVLARKLAEKQEQNDQYTPSNRFIWNQGKWLPNSTTTCSLSPDSAILKLKAAANAVLQDKSLTRTEETMRFESFSSPFSSQSASSTLAALSKKVSERSLTPGQEHPPPASSFLSLASMTSSAALLKEVAARAAGSLLAEKSSLLPEDPLPPPPSEKKPEKVTPPPPPPPPPPPPPPPQSLELLLLPVPKGRVSKPSNSASEEESGKPFQCPICGLVIKRKSYWKRHMVIHTGLKSHQCPLCPFRCARKDNLKSHMKVHQHQDRGETFQCQLCPFTSSRHFSLKLHMRCHQHFLRTEAKVKEEIPDPDVKGSPHLSDSACLGQQREGGGTELVGTMMTSNTPERTSQGGAGVSPLLVKEEPKEDNGLPTSFTLNAADRPANHTKLKDPSEYVANSASALFSQDISVKMASDFLMKLSAANQKEPMNLNFKVKEEPKEGESLSTTLPRSSYVFSPESEVSAPGVSEDALKPQEGKGSVLRRDVSVKAASELLMKLSAESYKETQMVKIKEEPMEVDIQDSHVSISPSRNVGYSTLIGREKTEPLQKMPEGRVPPERNLFSQDISVKMASELLFQLSEKVSKEHNHTKENTIRTTTSPFFSEDTFRQSPFTSNSKELLPSDSVLHGRISAPETEKIVLEAGNGLPSWKFNDQLFPCDVCGKVFGRQQTLSRHLSLHTEERKYKCHLCPYAAKCRANLNQHLTVHSVKLVSTDTEDIVSAVTSEGSDGKKHPYYYSCHVCGFETELNVQFVSHMSLHVDKEQWMFSICCTACDFVTMEEAEIKTHIGTKHTGEDRKTPSESNSPSSSSLSALSDSANSKDDSDGSQKNKGGNNLLVISVMPGSQPSLNSEEKPEKGFECVFCNFVCKTKNMFERHLQIHLITRMFECDVCHKFMKTPEQLLEHKKCHTVPTGGLK

SEQ ID NO: 101499 - protein, 1081 aa, Homo sapiens
  Payload ID: 20223
  Gene Name: zinc finger protein 827
  Uniprot ID: Q17R98
  ENSP ID: ENSP00000421863
MPRRKQEQPKRLPSHVSRQEEAEGELSEGEHWYGNSSETPSEASYGEVQENYKLSLEDRIQEQSTSPDTSLGSTTPSSHTLELVALDSEVLRDSLQCQDHLSPGVSSLCDDDPGSNKPLSSNLRRLLEAGSLKLDAAATANGRVESPVNVGSNLSFSPPSHHAQQLSVLARKLAEKQEQNDQYTPSNRFIWNQGKWLPNSTTTCSLSPDSAILKLKAAANAVLQDKSLTRTEETMRFESFSSPFSSQSASSTLAALSKKVSERSLTPGQEHPPPASSFLSLASMTSSAALLKEVAARAAGSLLAEKSSLLPEDPLPPPPSEKKPEKVTPPPPPPPPPPPPPPPQSLELLLLPVPKGRVSKPSNSASEEESGKPFQCPICGLVIKRKSYWKRHMVIHTGLKSHQCPLCPFRCARKDNLKSHMKVHQHQDRGETFQCQLCPFTSSRHFSLKLHMRCHQHFLRTEAKVKEEIPDPDVKGSPHLSDSACLGQQREGGGTELVGTMMTSNTPERTSQGGAGVSPLLVKEEPKEDNGLPTSFTLNAADRPANHTKLKDPSEYVANSASALFSQDISVKMASDFLMKLSAANQKEPMNLNFKVKEEPKEGESLSTTLPRSSYVFSPESEVSAPGVSEDALKPQEGKGSVLRRDVSVKAASELLMKLSAESYKETQMVKIKEEPMEVDIQDSHVSISPSRNVGYSTLIGREKTEPLQKMPEGRVPPERNLFSQDISVKMASELLFQLSEKVSKEHNHTKENTIRTTTSPFFSEDTFRQSPFTSNSKELLPSDSVLHGRISAPETEKIVLEAGNGLPSWKFNDQLFPCDVCGKVFGRQQTLSRHLSLHTEERKYKCHLCPYAAKCRANLNQHLTVHSVKLVSTDTEDIVSAVTSEGSDGKKHPYYYSCHVCGFETELNVQFVSHMSLHVDKEQWMFSICCTACDFVTMEEAEIKTHIGTKHTGEDRKTPSESNSPSSSSLSALSDSANSKDDSDGSQKNKGGNNLLVISVMPGSQPSLNSEEKPEKGFECVFCNFVCKTKNMFERHLQIHLITRMFECDVCHKFMKTPEQLLEHKKCHTVPTGGLNSGQW

SEQ ID NO: 101500 - protein, 731 aa, Homo sapiens
  Payload ID: 20223
  Gene Name: zinc finger protein 827
  ENSP ID: ENSP00000423130
MPRRKQEQPKRLPSPSEEESGKPFQCPICGLVIKRKSYWKRHMVIHTGLKSHQCPLCPFRCARKDNLKSHMKVHQHQDRGETFQCQLCPFTSSRHFSLKLHMRCHQHFLRTEAKVKEEIPDPDVKGSPHLSDSACLGQQREGGGTELVGTMMTSNTPERTSQGGAGVSPLLVKEEPKEDNGLPTSFTLNAADRPANHTKLKDPSEYVANSASALFSQDISVKMASDFLMKLSAANQKEPMNLNFKVKEEPKEGESLSTTLPRSSYVFSPESEVSAPGVSEDALKPQEGKGSVLRRDVSVKAASELLMKLSAESYKETQMVKIKEEPMEVDIQDSHVSISPSRNVGYSTLIGREKTEPLQKMPEGRVPPERNLFSQDISVKMASELLFQLSEKVSKEHNHTKENTIRTTTSPFFSEDTFRQSPFTSNSKELLPSDSVLHGRISAPETEKIVLEAGNGLPSWKFNDQLFPCDVCGKVFGRQQTLSRHLSLHTEERKYKCHLCPYAAKCRANLNQHLTVHSVKLVSTDTEDIVSAVTSEGSDGKKHPYYYSCHVCGFETELNVQFVSHMSLHVDKEQWMFSICCTACDFVTMEEAEIKTHIGTKHTGEDRKTPSESNSPSSSSLSALSDSANSKDDSDGSQKNKGGNNLLVISVMPGSQPSLNSEEKPEKGFECVFCNFVCKTKNMFERHLQIHLITRMFECDVCHKFMKTPEQLLEHKKCHTVPTGGLNSGQW

SEQ ID NO: 101501 - protein, 178 aa, Homo sapiens
  Payload ID: 20223
  Gene Name: zinc finger protein 827
  ENSP ID: ENSP00000424456
  MOD_RES (1)..(1): Any amino acid
XVCGFETELNVQFVSHMSLHVDKEQWMFSICCTACDFVTMEEAEIKTHIGTKHTGEDRKTPSESNSPSSSSLSALSDSANSKDDSDGSQKNKGGNNLLVISVMPGSQPSLNSEEKPEKGFECVFCNFVCKTKNMFERHLQIHLITRMFECDVCHKFMKTPEQLLEHKKCHTVPTGGLK

SEQ ID NO: 101502 - protein, 179 aa, Homo sapiens
  Payload ID: 20223
  Gene Name: zinc finger protein 827
  ENSP ID: ENSP00000424541
FMKTPEQLLEHKKCHTVPTGGLKCPFCIYSTNRPAAMECHLKTHYKMEYKCRICQTVKANQLELETHTREHRLGNHYKCDQCGYLSKTANKLIEHVRVHTGERPFHCDQCSYSCKRKDNLNLHKKLKHAPRQTFSCEECLFKTTHPFVFSRHVKKHQSGDCPEEDKKGLCPAPKEPAGP

SEQ ID NO: 101503 - protein, 513 aa, Homo sapiens
  Payload ID: 20224
  Gene Name: zinc finger protein 829
  Uniprot ID: Q3KNS6
  ENSP ID: ENSP00000428679
MTGKGLGEDTEDRWGAGALGPCGRSGLKGGGCVWEAEAGGSRGQEIETILANMETSLRSGQIPTLDSSEHNLSPEPLELDRMPHSPLISIPHVWCHPEEEERMHDELLQAVSKGPVMFRDVSIDFSQEEWECLDADQMNLYKEVMLENFSNLVSVGLSNSKPAVISLLEQGKEPWMVDRELTRGLCSDLESMCETKILSLKKRHFSQVIITREDMSTFIQPTFLIPPQKTMSEEKPWECKICGKTFNQNSQFIQHQRIHFGEKHYESKEYGKSFSRGSLVTRHQRIHTGKKPYECKECGKAFSCSSYFSQHQRIHTGEKPYECKECGKAFKYCSNLNDHQRIHTGEKPYECKVCGKAFTKSSQLFLHLRIHTGEKPYECKECGKAFTQHSRLIQHQRMHTGEKPYECKQCGKAFNSASTLTNHHRIHAGEKLYECEECRKAFIQSSELIQHQRIHTDEKPYECNECGKAFNKGSNLTRHQRIHTGEKPYDCKECGKAFGSRSDLIRHEGIHTG

SEQ ID NO: 101504 - protein, 432 aa, Homo sapiens
  Payload ID: 20224
  Gene Name: zinc finger protein 829
  Uniprot ID: Q3KNS6
  ENSP ID: ENSP00000429266
MPHSPLISIPHVWCHPEEEERMHDELLQAVSKGPVMFRDVSIDFSQEEWECLDADQMNLYKEVMLENFSNLVSVGLSNSKPAVISLLEQGKEPWMVDRELTRGLCSDLESMCETKILSLKKRHFSQVIITREDMSTFIQPTFLIPPQKTMSEEKPWECKICGKTFNQNSQFIQHQRIHFGEKHYESKEYGKSFSRGSLVTRHQRIHTGKKPYECKECGKAFSCSSYFSQHQRIHTGEKPYECKECGKAFKYCSNLNDHQRIHTGEKPYECKVCGKAFTKSSQLFLHLRIHTGEKPYECKECGKAFTQHSRLIQHQRMHTGEKPYECKQCGKAFNSASTLTNHHRIHAGEKLYECEECRKAFIQSSELIQHQRIHTDEKPYECNECGKAFNKGSNLTRHQRIHTGEKPYDCKECGKAFGSRSDLIRHEGIHTG

SEQ ID NO: 101505 - protein, 248 aa, Homo sapiens
  Payload ID: 20224
  Gene Name: zinc finger protein 829
  Uniprot ID: Q3KNS6
  ENSP ID: ENSP00000482037
MNKEYGKSFSRGSLVTRHQRIHTGKKPYECKECGKAFSCSSYFSQHQRIHTGEKPYECKECGKAFKYCSNLNDHQRIHTGEKPYECKVCGKAFTKSSQLFLHLRIHTGEKPYECKECGKAFTQHSRLIQHQRMHTGEKPYECKQCGKAFNSASTLTNHHRIHAGEKLYECEECRKAFIQSSELIQHQRIHTDEKPYECNECGKAFNKGSNLTRHQRIHTGEKPYDCKECGKAFGSRSDLIRHEGIHTG

SEQ ID NO: 101506 - protein, 516 aa, Homo sapiens
  Payload ID: 20225
  Gene Name: zinc finger protein 83
  Uniprot ID: P51522
  ENSP ID: ENSP00000301096
MHGRKDDAQKQPVKNQLGLNPQSHLPELQLFQAEGKIYKYDHMEKSVNSSSLVSPPQRISSTVKTHISHTYECNFVDSLFTQKEKANIGTEHYKCSERGKAFHQGLHFTIHQIIHTKETQFKCDICGKIFNKKSNLASHQRIHTGEKPYKCNECGKVFHNMSHLAQHRRIHTGEKPYKCNECGKVFNQISHLAQHQRIHTGEKPYKCNECGKVFHQISHLAQHRTIHTGEKPYECNKCGKVFSRNSYLVQHLIIHTGEKPYRCNVCGKVFHHISHLAQHQRIHTGEKPYKCNECGKVFSHKSSLVNHWRIHTGEKPYKCNECGKVFSHKSSLVNHWRIHTGEKPYKCNECGKVFSRNSYLAQHLIIHAGEKPYKCDECDKAFSQNSHLVQHHRIHTGEKPYKCDECGKVFSQNSYLAYHWRIHTGEKAYKCNECGKVFGLNSSLAHHRKIHTGEKPFKCNECGKAFSMRSSLTNHHAIHTGEKHFKCNECGKLFRDNSYLVRHQRFHAGKKSNTCN

SEQ ID NO: 101507 - protein, 516 aa, Homo sapiens; identical to SEQ ID NO: 101506
  Payload ID: 20225
  Gene Name: zinc finger protein 83
  Uniprot ID: P51522
  ENSP ID: ENSP00000439681

SEQ ID NO: 101508 - protein, 516 aa, Homo sapiens; identical to SEQ ID NO: 101506
  Payload ID: 20225
  Gene Name: zinc finger protein 83
  Uniprot ID: P51522
  ENSP ID: ENSP00000440713

SEQ ID NO: 101509 - protein, 516 aa, Homo sapiens; identical to SEQ ID NO: 101506
  Payload ID: 20225
  Gene Name: zinc finger protein 83
  Uniprot ID: P51522
  ENSP ID: ENSP00000445993

SEQ ID NO: 101510 - protein, 30 aa, Homo sapiens
  Payload ID: 20225
  Gene Name: zinc finger protein 83
  ENSP ID: ENSP00000469259
MVLPQVFFLNVRSRNYHQKRRVIQEKYSRQ

SEQ ID NO: 101511 - protein, 53 aa, Homo sapiens
  Payload ID: 20225
  Gene Name: zinc finger protein 83
  ENSP ID: ENSP00000471100
MVLPQGLLTFRDVAIEFSQEEWKCLDPAQRTLYRDVMLENYRNLVSLDVLRSS

SEQ ID NO: 101512 - protein, 125 aa, Homo sapiens
  Payload ID: 20225
  Gene Name: zinc finger protein 83
  ENSP ID: ENSP00000471352
MVLPQGLLTFRDVAIEFSQEEWKCLDPAQRTLYRDVMLENYRNLVSLGHDLILFFLFPRWSFCSCCPGWSAVAQSRLTTTSASRVQAILPPQPQKLLELQVFFLNVRSRNYHQKRRVIQEKYSRQ

SEQ ID NO: 101513 - protein, 71 aa, Homo sapiens
  Payload ID: 20225
  Gene Name: zinc finger protein 83
  ENSP ID: ENSP00000471703
MVLPQGLLTFRDVAIEFSQEEWKCLDPAQRTLYRDVMLENYRNLVSLGSPSDAEPKLDGTAAILAHCNLPA

SEQ ID NO: 101514 - protein, 55 aa, Homo sapiens
  Payload ID: 20225
  Gene Name: zinc finger protein 83
  ENSP ID: ENSP00000472092
MVLPQGLLTFRDVAIEFSQEEWKCLDPAQRTLYRDVMLENYRNLVSLGRLSQNTA

SEQ ID NO: 101515 - protein, 105 aa, Homo sapiens
  Payload ID: 20225
  Gene Name: zinc finger protein 83
  ENSP ID: ENSP00000472147
MVLPQGLLTFRDVAIEFSQEEWKCLDPAQRTLYRDVMLENYRNLVSLGIFSKCEIKELPPKKESNTGEIFQTVMLERHESHDIQDFCFRETQKNVHDSQCLWKHD

SEQ ID NO: 101516 - protein, 125 aa, Homo sapiens
  Payload ID: 20225
  Gene Name: zinc finger protein 83
  ENSP ID: ENSP00000472392
MVLPQGLLTFRDVAIEFSQEEWKCLDPAQRTLYRDVMLENYRNLVSLGIFSKCEIKELPPKKESNTGEIFQTVMLERHESHDIQDFCFRETQKNGLPLMPSRSWTVLLPSWLTATSLPDSPASAC

SEQ ID NO: 101517 - protein, 516 aa, Homo sapiens; identical to SEQ ID NO: 101506
  Payload ID: 20225
  Gene Name: zinc finger protein 83
  Uniprot ID: P51522
  ENSP ID: ENSP00000472619

SEQ ID NO: 101518 - protein, 92 aa, Homo sapiens
  Payload ID: 20225
  Gene Name: zinc finger protein 83
  ENSP ID: ENSP00000473096
MVLPQGLLTFRDVAIEFSQEEWKCLDPAQRTLYRDVMLENYRNLVSLDGVFALVAQAGVQWHNLGSPPPPPPGFKRFSRLSLRSCWNYRYFF

SEQ ID NO: 101519 - protein, 372 aa, Homo sapiens
  Payload ID: 20226
  Gene Name: zinc finger protein 830
  Uniprot ID: Q96NB3
  ENSP ID: ENSP00000354518
MASSASARTPAGKRVINQEELRRLMKEKQRLSTSRKRIESPFAKYNRLGQLSCALCNTPVKSELLWQTHVLGKQHREKVAELKGAKEASQGSSASSAPHSVKRKAPDADDQDVKRAKATLVPQVQPSTSAWTTNFDKIGKEFIRATPSKPSGLSLLPDYEDEEEEEEEEEGDGERKRGDASKPLSDAQGKEHSVSSSREVTSSVLPNDFFSTNPPKAPIIPHSGSIEKAEIHEKVVERRENTAEALPEGFFDDPEVDARVRKVDAPKDQMDKEWDEFQKAMRQVNTISEAIVAEEDEEGRLDRQIGEIDEQIECYRRVEKLRNRQDEIKNKLKEILTIKELQKKEEENADSDDEGELQDLLSQDWRVKGALL

SEQ ID NO: 101520 - protein, 106 aa, Homo sapiens
  Payload ID: 20226
  Gene Name: zinc finger protein 830
  ENSP ID: ENSP00000463839
KDQMDKEWDEFQKAMRQVNTISEAIVAEEDEEGRLDRQIGEIDEQIECYRRVEKLRNRQDEIKNKLKEILTIKELQKKEEENADSDDEGELQDLLSQDWRVKGALL

SEQ ID NO: 101521 - protein, 1677 aa, Homo sapiens
  Payload ID: 20227
  Gene Name: zinc finger protein 831
  Uniprot ID: Q5JPB2
  ENSP ID: ENSP00000360069
MEVPEPTCPAPPARDQPAPTPGPPGAPGGQASPHLTLGPVLLPPEQGLAPPTVFLKALPIPLYHTVPPGGLQPRAPLVTGSLDGGNVPFILSPVLQPEGPGPTQVGKPAAPTLTVNIVGTLPVLSPGLGPTLGSPGKVRNAGKYLCPHCGRDCLKPSVLEKHIRSHTGERPFPCATCGIAFKTQSNLYKHRRTQTHLNNSRLSSESEGAGGGLLEEGDKAGEPPRPEGRGESRCQGMHEGASERPLSPGAHVPLLAKNLDVRTEAAPCPGSAFADREAPWDSAPMASPGLPAASTQPWRKLPEQKSPTAGKPCALQRQQATAAEKPWDAKAPEGRLRKCESTDSGYLSRSDSAEQPHAPCSPLHSLSEHSAESEGEGGPGPGPGVAGAEPGAREAGLELEKKRLEERIAQLISHNQAVVDDAQLDNVRPRKTGLSKQGSIDLPTPYTYKDSFHFDIRALEPGRRRAPGPVRSTWTPPDKSRPLFFHSVPTQLSTTVECVPVTRSNSLPFVEGSRTWLEPREPRDPWSRTQKPLSPRPGPARLGCRSGLSSTDVPSGHPRALVRQAAVEDLPGTPIGDALVPAEDTDAKRTAAREAMAGKGRAGGRKCGQRRLKMFSQEKWQVYGDETFKRIYQKMKASPHGGKKAREVGMGSGAELGFPLQKEAAGSSGTVPTQDRRTPVHEDISAGATPEPWGNPPALEASLVTEPTKHGETVARRGDSDRPRVEEAVSSPALGGRDSPCSGSRSPLVSPNGRLELGWQMPPAPGPLKGGDVEAPRPVWPDPKLEGGARGVGDVQETCLWAQTVLRWPSRGSGEDKLPSERKKLKVEDLHSWKQPEPVSAETPGGPTQPASLSSQKQDADPGEVPGGSKESARQVGEPLESSGASLAAASVALKRVGPRDKATPLHPAAPAPAEHPSLATPPQAPRVLSALADNAFSPKYLLRLPQAETPLPLPIPWGPRHSQDSLCSSGWPEERASFVGSGLGTPLSPSPASGPSPGEADSILEDPSCSRPQDGRKGAQLGGDKGDRMATSRPAARELPISAPGAPREATSSPPTPTCEAHLVQDMEGDSHRIHRLCMGSTLARARLSGDVLNPWVPNWELGEPPGNAPEDPSSGPLVGPDPCSPLQPGSFLTALTRPQGVPPGWPELALSSHSGTSRSHSTRSPHSTQNPFPSLKAEPRLTWCCLSRSVPLPAEQKAKAASVYLAVHFPGSSLRDEGPNGPPGSNGGWTWTSPGEGGPAQMSKFSYPTVPGVMPQHQVSEPEWKKGLPWRAKMSRGNSKQRKLKINPKRYKGNFLQSCVQLRASRLRTPTWVRRRSRHPPALEGLKPCRTPGQTSSEIAGLNLQEEPSCATSESPPCCGKEEKKEGDCRQTLGTLSLGTSSRIVREMDKRTVKDISPSAGEHGDCTTHSTAATSGLSLQSDTCLAVVNDVPLPPGKGLDLGLLETQLLASQDSVSTDPKPYIFSDAQRPSSFGSKGTFPHHDIATSVAAVCISLPVRTDHIAQEIHSAESRDHSQTAGRTLTSSSPDSKVTEEGRAQTLLPGRPSSGQRISDSVPLESTEKTHLEIPASGPSSASSHHKEGRHKTFFPSRGQYGCGEMTVPCPSLGSDGRKRQVSGLITRKDSVVPSKPEQPIEIPEAPSKSLKKRSLEGMRKQTRVEFSDTSSDDEDRLVIEI

SEQ ID NO: 101522 - protein, 537 aa, Homo sapiens
  Payload ID: 20228
  Gene Name: zinc finger protein 835
  Uniprot ID: Q9Y2P0
  ENSP ID: ENSP00000444747
MEGLLSVALQGAELEGNWKHEGQVEDLQENQESCPEPEAVACKGDPAGDSMQERDEFSRIPRTISSPAATQASVPDDSSSRRCSAPGESPKERHPDSRQRERGGGPKKPWKCGDCGKAFSYCSAFILHQRIHTGEKPFACPECGKAFSQSVHLTLHQRTHTGEKPYACHECGKAFSQGSYLASHWRTHTGEKPHRCADCGKAFTRVTHLTQHRRVHTGERPYACAQCAKAFRNRSSLIEHQRIHTGEKPYECSACAKAFRFSSALIRHQRIHTEEKPYRCGQCAKAFAQIAHLTQHRRVHTGEKPYTCQDCGALFSQSASLAEHRRIHTGEKPYACGQCAKAFTQVSHLTQHQRTHTGERPYPCHDCGKRFSNRSHLLQHRLVHTGERPYRCLQCGAAFSHVSSLIEHQKIHTGERPYKCGECGKAFSQGSSLALHQRTHTGERPYTCPECGKAFSNRSYLIQHHIVHTGEKPYECSGCGKAFSFSSALIRHQRTHADSSGRLCPAPTPDSTPGLSQGGETCQQGCPGRNPRGPAED

SEQ ID NO: 101523 - protein, 92 aa, Homo sapiens
  Payload ID: 20228
  Gene Name: zinc finger protein 835
  ENSP ID: ENSP00000470133
MEGLLSVALQGAELEGNWKHEGQVEDLQENQESCPEPEAVACKGDPAGDSMQERDEFSRIPRTISSPAATQASVPDDSSSRRCSAPGESPKE

SEQ ID NO: 101524 - protein, 936 aa, Homo sapiens
  Payload ID: 20229
  Gene Name: zinc finger protein 836
  ENSP ID: ENSP00000325038
LCIVQGPLTFRDVAIEFSQEEWKSLDPVQKALYWDVMLENYRNLVFLGILPKCMTKELPPIGNSNTGEKCQTVTLERHECYDVENFYLREIQKNLQDLEFQWKDGEINYKEVPMTYKNNLNGKRGQHSQEDVENKCIENQLTLSFQSRLTELQKFQTEGKIYECNQSEKTVNNSSLVSPLQRILPSVQTNISKKYENEFLQLSLPTQLEKTHIREKPYMCKGCGKAFRVSSSLINHQMVHTTEKPYKCNECGKAFHRGSLLTIHQIVHTRGKPYQCGVCGKIFRQNSDLVNHRRSHTGEKPYKCNECGKSFSQSYNLAIHQRIHTGEKPYKCNECGKTFKQGSCLTTHQIIHTGEKPYQCDICGKVFRQNSNLVNHQRIHTGEKPYKCNICGKSFSQSSNLATHQTVHSGNKPYKCDECGKTFKRSSSLTTHQIIHTGEKPYTCDVCDKVFSQRSQLARHQRSHTGEKPYKCNECGKVFSQTSHLVGHRRIHTGEKPYKCDKCGKAFKQGSLLTRHKIIHTREKRYQCGECGKVFSENSCLVRHLRIHTGEQPYKCNVCGKVFNYSGNLSIHKRIHTGEKPFQCNECGTVFRNYSCLARHLRIHTGQKPYKCNVCGKVFNDSGNLSNHKRIHTGEKPFQCNECGKVFSYYSCLARHRKIHTGEKPYKCNDCGKAYTQRSSLTKHLIIHTGEKPYNCNEFGGAFIQSSKLARYHRNPTGEKPHKCSHCGRTFSHITGLTYHQRRHTGEMPYKCIECGQVFNSTSNLARHRRIHTGEKPYKCNECGKVFRHQSTLARHRSIHTGEKPYVCNECGKAFRVRSILVNHQKMHTGDKPYKCNECGKAFIERSKLVYHQRNHTGEKPYKCIECGKAFGRFSCLNKHQMIHSGEKPYKCNECGKSFISRSGLTKHQTKHTAESLKTKFNVEKPLDVLLTSGFK

SEQ ID NO: 101525 - protein, 105 aa, Homo sapiens
  Payload ID: 20229
  Gene Name: zinc finger protein 836
  ENSP ID: ENSP00000470043
MALTQGPLTFRDVAIEFSQEEWKSLDPVQKALYWDVMLENYRNLVFLGILPKCMTKELPPIGNSNTGEKCQTVTLERHECYDVENFYLREIQKNLQDLEFQWKDG

SEQ ID NO: 101526 - protein, 936 aa, Homo sapiens
  Payload ID: 20229
  Gene Name: zinc finger protein 836
  Uniprot ID: Q6ZNA1
  ENSP ID: ENSP00000470239
MALTQGPLTFRDVAIEFSQEEWKSLDPVQKALYWDVMLENYRNLVFLGILPKCMTKELPPIGNSNTGEKCQTVTLERHECYDVENFYLREIQKNLQDLEFQWKDGEINYKEVPMTYKNNLNGKRGQHSQEDVENKCIENQLTLSFQSRLTELQKFQTEGKIYECNQSEKTVNNSSLVSPLQRILPSVQTNISKKYENEFLQLSLPTQLEKTHIREKPYMCKGCGKAFRVSSSLINHQMVHTTEKPYKCNECGKAFHRGSLLTIHQIVHTRGKPYQCGVCGKIFRQNSDLVNHRRSHTGEKPYKCNECGKSFSQSYNLAIHQRIHTGEKPYKCNECGKTFKQGSCLTTHQIIHTGEKPYQCDICGKVFRQNSNLVNHQRIHTGEKPYKCNICGKSFSQSSNLATHQTVHSGNKPYKCDECGKTFKRSSSLTTHQIIHTGEKPYTCDVCDKVFSQRSQLARHQRSHTGEKPYKCNECGKVFSQTSHLVGHRRIHTGEKPYKCDKCGKAFKQGSLLTRHKIIHTREKRYQCGECGKVFSENSCLVRHLRIHTGEQPYKCNVCGKVFNYSGNLSIHKRIHTGEKPFQCNECGTVFRNYSCLARHLRIHTGQKPYKCNVCGKVFNDSGNLSNHKRIHTGEKPFQCNECGKVFSYYSCLARHRKIHTGEKPYKCNDCGKAYTQRSSLTKHLIIHTGEKPYNCNEFGGAFIQSSKLARYHRNPTGEKPHKCSHCGRTFSHITGLTYHQRRHTGEMPYKCIECGQVFNSTSNLARHRRIHTGEKPYKCNECGKVFRHQSTLARHRSIHTGEKPYVCNECGKAFRVRSILVNHQKMHTGDKPYKCNECGKAFIERSKLVYHQRNHTGEKPYKCIECGKAFGRFSCLNKHQMIHSGEKPYKCNECGKSFISRSGLTKHQTKHTAESLKTKFNVEKPLDVLLTSGFK

SEQ ID NO: 101527 - protein, 30 aa, Homo sapiens
  Payload ID: 20229
  Gene Name: zinc finger protein 836
  ENSP ID: ENSP00000470372
KHQTKHTAESLKTKFNVEKPLDVLLTSGFK

SEQ ID NO: 101528 - protein, 88 aa, Homo sapiens
  Payload ID: 20229
  Gene Name: zinc finger protein 836
  ENSP ID: ENSP00000472008
MALTQGPLTFRDVAIEFSQEEWKSLDPVQKALYWDVMLENYRNLVFLGKDNFALEVKICPRVFLYFLCCLSWEPFHYLTETEALLTHK

SEQ ID NO: 101529 - protein, 531 aa, Homo sapiens
  Payload ID: 20230
  Gene Name: zinc finger protein 837
  Uniprot ID: Q96EG3
  ENSP ID: ENSP00000405699
MEAPAQKAGQGGLPKADAQGASGAREKRPEEPRPLEEDRAGSRPTQKGDLRGAAGGRTTPPGGGSRGCSLGVSPGPGTRHSAGTRPLVREPCGPTSSQNPELVIPEGLQAREGPCRSPARGGDCSRNSCLAWHRGAPAGETPPVCDPCPERIQNHPRTQLCEVHTDCWPCQPGTGAPTCPRTPKPTSRGRNPLVEQPRACACGEAFAWRALRIPQERLQATEEPRPCARCGKRFRPNQQQQAGKSPPVCPECGQTSRPRPIVPDPPAQRLYACDECGKAFTRTSSLLQHQRIHTGERPYECAECGKAFVRCSGLYRHQKTHSAERHRRGPVLARRAFRLGCPPCGDYSERSPRRGSGAGEKPYECADCAKAFGLFSHLVEHRRVHTGEKPYACPECGKAFNQRSNLSRHQRTHSSAKPYACPLCEKAFKGRSGLVQHQRAHTGERPYGCSECGKTFRGCSELRQHERLHSGEKPYICRDCGKAFVRNCSLVRHLRTHTGERPYACGDCGRAFSQRSNLNEHRKRHGGRAAP

SEQ ID NO: 101530 - protein, 531 aa, Homo sapiens; identical to SEQ ID NO: 101529
  Payload ID: 20230
  Gene Name: zinc finger protein 837
  Uniprot ID: Q96EG3
  ENSP ID: ENSP00000471478

SEQ ID NO: 101531 - protein, 927 aa, Homo sapiens
  Payload ID: 20231
  Gene Name: zinc finger protein 839
  Uniprot ID: A8K0R7
  ENSP ID: ENSP00000399863
MADAEPEAGGGSEDGGGGGGPAPPGQSGSVARVAPLGPEQLRQVLEQVTKAQPPPPPPPFVLRDAARRLRDAAQQAALQRGRGTEPPRLPRLLPPQQLEAICVKVTSGETKGQERPMLLPTTIQPQTARKSQLPRGNSCLVGLHIASPQLLRVQPLVRTEPQSCFLSDLCQPPAQGFVQRPLPALQVVPAKRVPAPKAPDEQGSMLTPLSASDPLAVTSLSSSSAHPFISNLHTRHTEKLKKSLKVKTRSGRVSRPPKYKAKDYKFIKTEDLADGHLSDSDDYSELCVEEDEDQRERHALFDLSSCSLRPKSFKCQTCEKSYIGKGGLARHFKLNPGHGQLDPEMVLSEKASGSTLRGCTEERTLSLTSLGLSMPADPCEGGARSCLVTESARGGLQNGQSVDVEETLPSEPENGALLRSERYQGPRRRACSETLAESRTAVLQQRRAAQLPGGPAAAGEQRASPSKARLKEFLQQCDREDLVELALPQLAQVVTVYEFLLMKVEKDHLAKPFFPAIYKEFEELHKMVKKMCQDYLSSSGLCSQETLEINNDKVAESLGITEFLRKKEIHPDNLGPKHLSRDMDGEQLEGASSEKREREAAEEGLASVKRPRREALSNDTTESLAANSRGREKPRPLHALAAGFSPPVNVTVSPRSEESHTTTVSGGNGSVFQAGPQLQALANLEARRGSIGAALSSRDVSGLPVYAQSGEPRRLTQAQVAAFPGENALEHSSDQDTWDSLRSPGFCSPLSSGGGAESLPPGGPGHAEAGHLGKVCDFHLNHQQPSPTSVLPTEVAAPPLEKILSVDSVAVDCAYRTVPKPGPQPGPHGSLLTEGCLRSLSGDLNRFPCGMEVHSGQRELESVVAVGEAMAFEISNGSHELLSQGQKQIFIQTSDGLILSPPGTIVSQEEDIVTVTDAEGRACGWAR

SEQ ID NO: 101532 - protein, 247 aa, Homo sapiens
  Payload ID: 20231
  Gene Name: zinc finger protein 839
  ENSP ID: ENSP00000452819
  MOD_RES (1)..(1): Any amino acid
XRYQGPRRRACSETLAESRTAVLQQRRAAQLPGGPAAAGEQRASPSKARLKEFLQQCDREDLVELALPQLAQVVTVYEFLLMKVEKDHLAKPFFPAIYKEFEELHKMVKKMCQDYLSSSGLCSQETLEINNDKVAESLGITEFLRKKEIHPDNLGPKHLSRDMDGEQLEGASSEKREREAAEEGLASVKRPRREALSNDTTESLAANSRGREKPRPLHALAAGTIVSQEEDIVTVTDAEGRACGWAR

SEQ ID NO: 101533 - protein, 57 aa, Homo sapiens
  Payload ID: 20231
  Gene Name: zinc finger protein 839
  ENSP ID: ENSP00000452983
MKVEKDHLAKPFFPAIYKEFEELHKMVKKMCQDYLSSSGLCSQETLEINNDKVAESL

SEQ ID NO: 101534 - protein, 811 aa, Homo sapiens
  Payload ID: 20231
  Gene Name: zinc finger protein 839
  Uniprot ID: A8K0R7
  ENSP ID: ENSP00000453109
MLLPTTIQPQTARKSQLPRGNSCLVGLHIASPQLLRVQPLVRTEPQSCFLSDLCQPPAQGFVQRPLPALQVVPAKRVPAPKAPDEQGSMLTPLSASDPLAVTSLSSSSAHPFISNLHTRHTEKLKKSLKVKTRSGRVSRPPKYKAKDYKFIKTEDLADGHLSDSDDYSELCVEEDEDQRERHALFDLSSCSLRPKSFKCQTCEKSYIGKGGLARHFKLNPGHGQLDPEMVLSEKASGSTLRGCTEERTLSLTSLGLSMPADPCEGGARSCLVTESARGGLQNGQSVDVEETLPSEPENGALLRSERYQGPRRRACSETLAESRTAVLQQRRAAQLPGGPAAAGEQRASPSKARLKEFLQQCDREDLVELALPQLAQVVTVYEFLLMKVEKDHLAKPFFPAIYKEFEELHKMVKKMCQDYLSSSGLCSQETLEINNDKVAESLGITEFLRKKEIHPDNLGPKHLSRDMDGEQLEGASSEKREREAAEEGLASVKRPRREALSNDTTESLAANSRGREKPRPLHALAAGFSPPVNVTVSPRSEESHTTTVSGGNGSVFQAGPQLQALANLEARRGSIGAALSSRDVSGLPVYAQSGEPRRLTQAQVAAFPGENALEHSSDQDTWDSLRSPGFCSPLSSGGGAESLPPGGPGHAEAGHLGKVCDFHLNHQQPSPTSVLPTEVAAPPLEKILSVDSVAVDCAYRTVPKPGPQPGPHGSLLTEGCLRSLSGDLNRFPCGMEVHSGQRELESVVAVGEAMAFEISNGSHELLSQGQKQIFIQTSDGLILSPPGTIVSQEEDIVTVTDAEGRACGWAR

SEQ ID NO: 101535 - protein, 475 aa, Homo sapiens
  Payload ID: 20231
  Gene Name: zinc finger protein 839
  ENSP ID: ENSP00000453137
PCEGGARSCLVTESARGGLQFLQQCDREDLVELALPQLAQVVTVYEFLLMKVEKDHLAKPFFPAIYKEFEELHKMVKKMCQDYLSSSGLCSQETLEINNDKVAESLGITEFLRKKEIHPDNLGPKHLSRDMDGEQLEGASSEKREREAAEEGLASVKRPRREALSNDTTESLAANSRGREKPRPLHALAAGFSPPVNVTVSPRSEESHTTTVSGGNGSVFQAGPQLQALANLEARRGSIGAALSSRDVSGLPVYAQSGEPRRLTQAQVAAFPGENALEHSSDQDTWDSLRSPGFCSPLSSGGGAESLPPGGPGHAEAGHLGKVCDFHLNHQQPSPTSVLPTEVAAPPLEKILSVDSVAVDCAYRTVPKPGPQPGPHGSLLTEGCLRSLSGDLNRFPCGMEVHSGQRELESVVAVGEAMAFEISNGSHELLSQGQKQIFIQTSDGLILSPPGTIVSQEEDIVTVTDAEGRACGWAR

SEQ ID NO: 101536 - protein, 811 aa, Homo sapiens; identical to SEQ ID NO: 101534
  Payload ID: 20231
  Gene Name: zinc finger protein 839
  Uniprot ID: A8K0R7
  ENSP ID: ENSP00000453363

SEQ ID NO: 101537 - protein, 527 aa, Homo sapiens
  Payload ID: 20231
  Gene Name: zinc finger protein 839
  ENSP ID: ENSP00000453415
  MOD_RES (1)..(1): Any amino acid
XVEETLPSEPENGALLRSERYQGPRRRACSETLAESRTAVLQQRRAAQLPGGPAAAGEQRASPSKARLKEFLQQCDREDLVELALPQLAQVVTVYEFLLMKVEKDHLAKPFFPAIYKEFEELHKMVKKMCQDYLSSSGLCSQETLEINNDKVAESLGITEFLRKKEIHPDNLGPKHLSRDMDGEQLEGASSEKREREAAEEGLASVKRPRREALSNDTTESLAANSRGREKPRPLHALAAGEGFSPPVNVTVSPRSEESHTTTVSGGNGSVFQAGPQLQALANLEARRGSIGAALSSRDVSGLPVYAQSGEPRRLTQAQVAAFPGENALEHSSDQDTWDSLRSPGFCSPLSSGGGAESLPPGGPGHAEAGHLGKVCDFHLNHQQPSPTSVLPTEVAAPPLEKILSVDSVAVDCAYRTVPKPGPQPGPHGSLLTEGCLRSLSGDLNRFPCGMEVHSGQRELESVVAVGEAMAFEISNGSHELLSQGQKQIFIQTSDGLILSPPGTIVSQEEDIVTVTDAEGRACGWAR

SEQ ID NO: 101538 - protein, 493 aa, Homo sapiens
  Payload ID: 20231
  Gene Name: zinc finger protein 839
  ENSP ID: ENSP00000453515
AARRLRDAAQQAALQRGRGTEPPRLPRLLPPQQLEAICVKVTSGETKGQERPMLLPTTIQPQTARKSQLPRGNSCLVGLHIASPQLLRVQPLVRTEPQSCFLSDLCQPPAQGFVQRPLPALQVVPAKRVPAPKAPDEQGSMLTPLSASDPLAVTSLSSSSAHPFISNLHTRHTEKLKKSLKVKTRSGRVSRPPKYKAKDYKFIKTEDLADGHLSDSDDYSELCVEEDEDQRERHALFDLSSCSLRPKSFKCQTCEKSYIGKGGLARHFKLNPGHGQLDPEMVLSEKASGSTLRGCTEERTLSLTSLGLSMPADPCEGGARSCLVTESARGGLQNGQSVDVEETLPSEPENGALLRSERYQGPRRRACSETLAESRTAVLQQRRAAQLPGGPAAAGEQRASPSKARLKEFLQQCDREDLVELALPQLAQVVTVYEFLLMKVEKDHLAKPFFPAIYKEFEELHKMVKKMCQDYLSSSGLCSQETLEINNDKKTQK

SEQ ID NO: 101539 - protein, 144 aa, Homo sapiens
  Payload ID: 20231
  Gene Name: zinc finger protein 839
  ENSP ID: ENSP00000453744
  MOD_RES (1)..(1): Any amino acid
XVEKDHLAKPFFPAIYKEFEELHKMVKKMCQDYLSSSGLCSQETLEINNDKVAESLGITEFLRKKEIHPDNLGPKHLSRDMDGEQLEGASSEKREREAAEEGLASVKRPRREALSNDTTESLAANSRGREKPRPLHALAAVRRA

SEQ ID NO: 101540 - protein, 190 aa, Homo sapiens
  Payload ID: 20231
  Gene Name: zinc finger protein 839
  ENSP ID: ENSP00000454159
  MOD_RES (1)..(1): Any amino acid
XRACSETLAESRTAVLQQRRAAQLPGGPAAAGEQRASPSKARLKEFLQQCDREDLVELALPQLAQVVTVYEFLLMKVAESLGITEFLRKKEIHPDNLGPKHLSRDMDGEQLEGASSEKREREAAEEGLASVKRPRREALSNDTTESLAANSRGREKPRPLHALAAGTIVSQEEDIVTVTDAEGRACGWAR

SEQ ID NO: 101541 - protein, 738 aa, Homo sapiens
  Payload ID: 20232
  Gene Name: zinc finger protein 84
  Uniprot ID: P51523
  ENSP ID: ENSP00000331465
MTMLQESFSFDDLSVDFTQKEWQLLDPSQKNLYKDVMLENYSSLVSLGYEVMKPDVIFKLEQGEEPWVGDGEIPSSDSPEVWKVDGNMMWHQDNQDKLKIIKRGHECDAFGKNFNLNMNFVPLRKSNSEGDLDGLILKHHLDLLIPKGDYGKAESDDFNVFDNFFLHSKPEDTDTWLKYYDCDKYKESYKKSQIIIYHRNRLGEKLYECSECRKRFSKKPSLIKHQSRHIRDIAFGCGNCGKTFPQKSQFITHHRTHTGEKPYNCSQCGKAFSQKSQLTSHQRTHTGEKPYECGECGKAFSRKSHLISHWRTHTGEKPYGCNECGRAFSEKSNLINHQRIHTGEKPFECRECGKAFSRKSQLVTHHRTHTGTKPFGCSDCRKAFFEKSELIRHQTIHTGEKPYECSECRKAFRERSSLINHQRTHTGEKPHGCIQCGKAFSQKSHLISHQMTHTGEKPFICSKCGKAFSRKSQLVRHQRTHTGEKPYECSECGKAFSEKLSLTNHQRIHTGEKPYVCSECGKAFCQKSHLISHQRTHTGEKPYECSECGKAFGEKSSLATHQRTHTGEKPYECRDCEKAFSQKSQLNTHQRIHTGEKPYECSLCRKAFFEKSELIRHLRTHTGEKPYECNECRKAFREKSSLINHQRIHTGEKPFECSECGKAFSRKSHLIPHQRTHTGEKPYGCSECRKAFSQKSQLVNHQRIHTGEKPYRCIECGKAFSQKSQLINHQRTHTVKKS

SEQ ID NO: 101542 - protein, 738 aa, Homo sapiens; identical to SEQ ID NO: 101541
  Payload ID: 20232
  Gene Name: zinc finger protein 84
  Uniprot ID: P51523
  ENSP ID: ENSP00000376133

SEQ ID NO: 101543 - protein, 69 aa, Homo sapiens
  Payload ID: 20232
  Gene Name: zinc finger protein 84
  ENSP ID: ENSP00000387416
MTMLQESFSFDDLSVDFTQKEWQLLDPSQKNLYKDVMLENYSSLVSLGYEVMKPDVIFKLEQGEEPWVG

SEQ ID NO: 101544 - protein, 6 aa, Homo sapiens
  Payload ID: 20232
  Gene Name: zinc finger protein 84
  ENSP ID: ENSP00000437636
MTMLQV

SEQ ID NO: 101545 - protein, 737 aa, Homo sapiens
  Payload ID: 20232
  Gene Name: zinc finger protein 84
  ENSP ID: ENSP00000437949
MTMLQESFSFDDLSVDFTQKEWQLLDPSQKNLYKDVMLENYSSLVSLGYEVMKPDVIFKLEQGEEPWVGDGEIPSSDSPVWKVDGNMMWHQDNQDKLKIIKRGHECDAFGKNFNLNMNFVPLRKSNSEGDLDGLILKHHLDLLIPKGDYGKAESDDFNVFDNFFLHSKPEDTDTWLKYYDCDKYKESYKKSQIIIYHRNRLGEKLYECSECRKRFSKKPSLIKHQSRHIRDIAFGCGNCGKTFPQKSQFITHHRTHTGEKPYNCSQCGKAFSQKSQLTSHQRTHTGEKPYECGECGKAFSRKSHLISHWRTHTGEKPYGCNECGRAFSEKSNLINHQRIHTGEKPFECRECGKAFSRKSQLVTHHRTHTGTKPFGCSDCRKAFFEKSELIRHQTIHTGEKPYECSECRKAFRERSSLINHQRTHTGEKPHGCIQCGKAFSQKSHLISHQMTHTGEKPFICSKCGKAFSRKSQLVRHQRTHTGEKPYECSECGKAFSEKLSLTNHQRIHTGEKPYVCSECGKAFCQKSHLISHQRTHTGEKPYECSECGKAFGEKSSLATHQRTHTGEKPYECRDCEKAFSQKSQLNTHQRIHTGEKPYECSLCRKAFFEKSELIRHLRTHTGEKPYECNECRKAFREKSSLINHQRIHTGEKPFECSECGKAFSRKSHLIPHQRTHTGEKPYGCSECRKAFSQKSQLVNHQRIHTGEKPYRCIECGKAFSQKSQLINHQRTHTVKKS

SEQ ID NO: 101546 - protein, 78 aa, Homo sapiens
  Payload ID: 20232
  Gene Name: zinc finger protein 84
  ENSP ID: ENSP00000438982
MTMLQESFSFDDLSVDFTQKEWQLLDPSQKNLYKDVMLENYSSLVSLGYEVMKPDVIFKLEQGEEPWVGDGEIPSSDS

SEQ ID NO: 101547 - protein, 145 aa, Homo sapiens
  Payload ID: 20232
  Gene Name: zinc finger protein 84
  ENSP ID: ENSP00000439130
MTMLQESFSFDDLSVDFTQKEWQLLDPSQKNLYKDVMLENYSSLVSLGYEVMKPDVIFKLEQGEEPWVGDGEIPSSDSPVSGCFLPHGETWSAVREKNEAMMKAKSRKSPDCVPVPGSSGLHVQVHLCPFHVLIVEFFCEILQIS

SEQ ID NO: 101548 - protein, 84 aa, Homo sapiens
  Payload ID: 20232
  Gene Name: zinc finger protein 84
  ENSP ID: ENSP00000442963
MTMLQESFSFDDLSVDFTQKEWQLLDPSQKNLYKDVMLENYSSLVSLGYEVMKPDVIFKLEQGEEPWVGDGEIPSSDSPGTSIV

SEQ ID NO: 101549 - protein, 738 aa, Homo sapiens; identical to SEQ ID NO: 101541
  Payload ID: 20232
  Gene Name: zinc finger protein 84
  Uniprot ID: P51523
  ENSP ID: ENSP00000445549

SEQ ID NO: 101550 - protein, 236 aa, Homo sapiens
  Payload ID: 20232
  Gene Name: zinc finger protein 84
  ENSP ID: ENSP00000445820
MTMLQESFSFDDLSVDFTQKEWQLLDPSQKNLYKDVMLENYSSLVSLGYEVMKPDVIFKLEQGEEPWVGDGEIPSSDSPEVWKVDGNMMWHQDNQDKLKIIKRGHECDAFGKNFNLNMNFVPLRKSNSEGDLDGLILKHHLDLLIPKGDYGKAESDDFNVFDNFFLHSKPEDTDTWLKYYDCDKYKESYKKSQIIIYHRNRLGEKLYECSECRKRFSKKPSLIKHQSRHIRDIAFG

SEQ ID NO: 101551 - protein, 55 aa, Homo sapiens
  Payload ID: 20232
  Gene Name: zinc finger protein 84
  ENSP ID: ENSP00000445958
MTMLQESFSFDDLSVDFTQKEWQLLDPSQKNLYKDVMLENYSSLVSLGYEVMKPD

SEQ ID NO: 101552 - protein, 924 aa, Homo sapiens
  Payload ID: 20233
  Gene Name: zinc finger protein 841
  Uniprot ID: Q6ZN19
  ENSP ID: ENSP00000374185
MALPQGSLTFRDVAVEFSQEEWKCLDPVQKALYRDVMLENYRNLGFLGLCLPDLNIISMLEQGKEPWTVVSQVKIARNPNCGECMKGVITGISPKCVIKELPPIQNSNTGEKFQAVMLEGHESYDTENFYFREIRKNLQEVDFQWKDGEINYKEGPMTHKNNLTGQRVRHSQGDVENKHMENQLILRFQSGLGELQKFQTAEKIYGCNQIERTVNNCFLASPLQRIFPGVQTNISRKYGNDFLQLSLPTQDEKTHIREKPYIGNECGKAFRVSSSLINHQMIHTTEKPYRCNESGKAFHRGSLLTVHQIVHTRGKPYQCDVCGRIFRQNSDLVNHRRSHTGDKPYICNECGKSFSKSSHLAVHQRIHTGEKPYKCNRCGKCFSQSSSLATHQTVHTGDKPYKCNECGKTFKRNSSLTAHHIIHAGKKPYTCDVCGKVFYQNSQLVRHQIIHTGETPYKCNECGKVFFQRSRLAGHRRIHTGEKPYKCNECGKVFSQHSHLAVHQRVHTGEKPYKCNECGKAFNWGSLLTVHQRIHTGEKPYKCNVCGKVFNYGGYLSVHMRCHTGEKPLHCNKCGMVFTYYSCLARHQRMHTGEKPYKCNVCGKVFIDSGNLSIHRRSHTGEKPFQCNECGKVFSYYSCLARHRKIHTGEKPYKCNDCGKAYTQRSSLTKHLVIHTGENPYHCNEFGEAFIQSSKLARYHRNPTGEKPHKCSECGRTFSHKTSLVYHQRRHTGEMPYKCIECGKVFNSTTTLARHRRIHTGEKPYKCNECGKVFRYRSGLARHWSIHTGEKPYKCNECGKAFRVRSILLNHQMMHTGEKPYKCNECGKAFIERSNLVYHQRNHTGEKPYKCMECGKAFGRRSCLTKHQRIHSSEKPYKCNECGKSYISRSGLTKHQIKHAGENLTTKLNVERPLDVVLTSGIPK

SEQ ID NO: 101553 - protein, 808 aa, Homo sapiens
  Payload ID: 20233
  Gene Name: zinc finger protein 841
  Uniprot ID: Q6ZN19
  ENSP ID: ENSP00000415453
MLEGHESYDTENFYFREIRKNLQEVDFQWKDGEINYKEGPMTHKNNLTGQRVRHSQGDVENKHMENQLILRFQSGLGELQKFQTAEKIYGCNQIERTVNNCFLASPLQRIFPGVQTNISRKYGNDFLQLSLPTQDEKTHIREKPYIGNECGKAFRVSSSLINHQMIHTTEKPYRCNESGKAFHRGSLLTVHQIVHTRGKPYQCDVCGRIFRQNSDLVNHRRSHTGDKPYICNECGKSFSKSSHLAVHQRIHTGEKPYKCNRCGKCFSQSSSLATHQTVHTGDKPYKCNECGKTFKRNSSLTAHHIIHAGKKPYTCDVCGKVFYQNSQLVRHQIIHTGETPYKCNECGKVFFQRSRLAGHRRIHTGEKPYKCNECGKVFSQHSHLAVHQRVHTGEKPYKCNECGKAFNWGSLLTVHQRIHTGEKPYKCNVCGKVFNYGGYLSVHMRCHTGEKPLHCNKCGMVFTYYSCLARHQRMHTGEKPYKCNVCGKVFIDSGNLSIHRRSHTGEKPFQCNECGKVFSYYSCLARHRKIHTGEKPYKCNDCGKAYTQRSSLTKHLVIHTGENPYHCNEFGEAFIQSSKLARYHRNPTGEKPHKCSECGRTFSHKTSLVYHQRRHTGEMPYKCIECGKVFNSTTTLARHRRIHTGEKPYKCNECGKVFRYRSGLARHWSIHTGEKPYKCNECGKAFRVRSILLNHQMMHTGEKPYKCNECGKAFIERSNLVYHQRNHTGEKPYKCMECGKAFGRRSCLTKHQRIHSSEKPYKCNECGKSYISRSGLTKHQIKHAGENLTTKLNVERPLDVVLTSGIPK

SEQ ID NO: 101554 - protein, 90 aa, Homo sapiens
  Payload ID: 20233
  Gene Name: zinc finger protein 841
  ENSP ID: ENSP00000470100
MALPQGSLTFRDVAVEFSQEEWKCLDPVQKALYRDVMLENYRNLGFLGLCLPDLNIISMLEQGKEPWTVVSQVKIARNPNCGECMKGVIT

SEQ ID NO: 101555 - protein, 924 aa, Homo sapiens; identical to SEQ ID NO: 101552
  Payload ID: 20233
  Gene Name: zinc finger protein 841
  Uniprot ID: Q6ZN19
  ENSP ID: ENSP00000470746

SEQ ID NO: 101556 - protein, 512 aa, Homo sapiens
  Payload ID: 20233
  Gene Name: zinc finger protein 841
  ENSP ID: ENSP00000471190
  MOD_RES (1)..(1): Any amino acid
XNSNTGEKFQAVMLEGHESYDTENFYFREIRKNLQEVDFQWKDGEINYKEGPMTHKNNLTGQRVRHSQGDVENKHMENQLILRFQSGLGELQKFQTAEKIYGCNQIERTVNNCFLASPLQRIFPGVQTNISRKYGNDFLQLSLPTQDEKTHIREKPYIGNECGKAFRVSSSLINHQMIHTTEKPYRCNESGKAFHRGSLLTVHQIVHTRGKPYQCDVCGRIFRQNSDLVNHRRSHTGDKPYICNECGKSFSKSSHLAVHQRIHTGEKPYKCNRCGKCFSQSSSLATHQTVHTGDKPYKCNECGKTFKRNSSLTAHHIIHAGKKPYTCDVCGKVFYQNSQLVRHQIIHTGETPYKCNECGKVFRYRSGLARHWSIHTGEKPYKCNECGKAFRVRSILLNHQMMHTGEKPYKCNECGKAFIERSNLVYHQRNHTGEKPYKCMECGKAFGRRSCLTKHQRIHSSEKPYKCNECGKSYISRSGLTKHQIKHAGENLTTKLNVERPLDVVLTSGIPK

SEQ ID NO: 101557 - protein, 348 aa, Homo sapiens
  Payload ID: 20234
  Gene Name: zinc finger protein 843
  Uniprot ID: Q8N446
  ENSP ID: ENSP00000322899
MRSLPFALTVESVSARAPTCCSTGRFTQGRQPCKCKACGRGFTQSASLLQHWRVHSDWRETLSLSPVRQDLLWPLQPHQAPASPLGRSHSSAGVRQGFSGQLCCWLTKEHTLAEALRLSPVPAGFWGPVEADRPPANSHRRVCPFCCCSCGDSVNEKTSLSQRVLPHPGEKTCRGGSVESVSLAPSSVAPDSTSGLRPCGSPGSFLQHLPPSTLLPRPPFLYPGPPLSLQPLVPSGLPAVPAVPLGGLEVAQVPPATQPAAQQEGAMGPRSCASAGRDSREAVQAPGYPEPARKASQHRAAGPLGEARARLQRQCRAPPPPSNPHWRGALPVFPVWKASSRRSNLARH

SEQ ID NO: 101558 - protein, 293 aa, Homo sapiens
  Payload ID: 20234
  Gene Name: zinc finger protein 843
  ENSP ID: ENSP00000455858
MRSLPFALTVESVSARAPTCCSTGRFTQGRQPCKCKACGRGFTQSASLLQHWRVHSDWRETLSLSPVRQDLLWPLQPHQAPASPLGRSHSSAGVRQGFSGQLCCWLTKEHTLAEALRLSPVPAGFWGPVEADRPPANSHRRVCPFCCCSCGDSVNEKTSLSQRVLPHPGEKTCRGGSVESVSLAPSSVAPDSTSGLRPCGSPGSFLQHLPPSTLLPRPPFLYPGPPLTGITGAHHHAQLIFVFLVERGFDHAGQAGLELLTSGDPPTSASQSGGIIGMSHRTQPLLCFLDKYF

SEQ ID NO: 101559 - protein, 348 aa, Homo sapiens; identical to SEQ ID NO: 101557
  Payload ID: 20234
  Gene Name: zinc finger protein 843
  Uniprot ID: Q8N446
  ENSP ID: ENSP00000483573

SEQ ID NO: 101560 - protein, 666 aa, Homo sapiens
  Payload ID: 20235
  Gene Name: zinc finger protein 844
  Uniprot ID: Q08AG5
  ENSP ID: ENSP00000392024
MDLVAFEDVAVNFTQEEWSLLDPSQKNLYREVMQETLRNLASIGEKWKDQNIEDQYKNPRNNLRSLLGERVDENTEENHCGETSSQIPDDTLNKKTSPGVKSCESSVCGEVFVGHSSLNRHIRADTAHKPSEYQEYGQEPYKCQQRKKAFRCHPSFQMQEKAHTGEKLYDCKECGKTFISHSSIQRHMIMHNGDGTYKCKFCGKACPCLSIYLIHERVHTGEKPYKCKQCGKAFSYSTSLQIHERTHTGEKPYECKECGKAFGSPNSLYEHRRTHTGEKPYECKQCGKAFRWFHSFQIHERTHSEEKAYECTKCGKAFKCPSYLCRHEVTHSGKKPCECKQCGKALSYLNFQRHMKMHTRMRPYKCKTVEKPLILPVRFEDMKELTLERNLMNASTVVKPSIVPVPFTIMKGLTLERNPMNVSSVVKPSFLPLPFDIMKGLTLERNRMSVSNVGKPSDLPHTFKCMEGLTLKRNPMNVSSVVKPSFFPLPFDIMKGLTLERNPMSVSNVGKPSHLPHTFKCMKGLTLESNCMNLNNVKKPLDLSETFKFMKRHTLERNPIRNMEKHSTISLPFKYMQQCTEDRMPMNVKSVTKHSYLPRSFEYMQEHTLERNPMNVRNAEKRSIIFLLCVYTKGCTLERNHINVRIVGKHSVCLVPFVDIKGLTLE

SEQ ID NO: 101561 - protein, 71 aa, Homo sapiens
  Payload ID: 20235
  Gene Name: zinc finger protein 844
  ENSP ID: ENSP00000402097
MDLVAFEDVAVNFTQEEWSLLDPSQKNLYREVMQETLRNLASIEVFWERELMKIQKKIIVEKLLARFQMTH

SEQ ID NO: 101562 - protein, 96 aa, Homo sapiens
  Payload ID: 20235
  Gene Name: zinc finger protein 844
  ENSP ID: ENSP00000448588
MQEKAHTGEKLYDCKECGKTFISHSSIQRHMIMHNGDGTYKCKFCGKACPCLSIYLIHERVHTGEKPYKCKQCGKAFSYSTSLQIHERTHTGEKPY

SEQ ID NO: 101563 - protein, 970 aa, Homo sapiens
  Payload ID: 20236
  Gene Name: zinc finger protein 845
  Uniprot ID: Q96IR2
  ENSP ID: ENSP00000388311
MALSQGLLTFRDVAIEFSQEEWKCLDPAQRTLYRDVMLENYRNLVSLDISSKCMMKEFSSTAQGNTEVIHTGTLQRHERHHIGDFCFQEMEKDIHDFEFQWKEDERNSHEAPMTEIKQLTGSTNRHDQRHAGNKPIKDQLGSSFHSHLPELHMFQTEGKIGNQVEKSINSASLVSTSQRISCRPKTHISKNYGNNFLNSSLLTQKQEVHMREKSFQCNESGKAFNYSSVLRKHQIIHLGAKQYKCDVCGKVFNQKRYLACHRRCHTGKKPYKCNDCGKTFSQELTLTCHHRLHTGEKHYKCSECGKTFSRNSALVIHKAIHTGEKSYKCNECGKTFSQTSYLVYHRRLHTGEKPYKCEECDKAFSFKSNLERHRKIHTGEKPYKCNECSRTFSRKSSLTRHRRLHTGEKPYKCNDCGKTFSQMSSLVYHRRLHTGEKPYKCEECDEAFSFKSNLERHRRIHTGEKPYKCNDCGKTFSQTSSLVYHRRLHTGEKPYKCEECDEAFSFKSNLERHRIIHTGEKLYKCNECGKTFSRKSSLTRHCRLHTGEKPYQCNECGKAFRGQSALIYHQAIHGIGKLYKCNDCHQVFSNATTIANHWRIHNEERSYKCNRCGKFFRHRSYLAVHWRTHSGEKPYKCEECDEAFSFKSNLQRHRRIHTGEKPYRCNECGKTFSRKSYLTCHRRLHTGEKPYKCNECGKTFGRNSALIIHKAIHTGEKPYKCNECGKAFSQKSSLTCHLRLHTGEKPYKCEECDKVFSRKSSLEKHRRIHTGEKPYKCKVCDKAFGRDSHLAQHTRIHTGEKPYKCNECGKNFRHNSALVIHKAIHSGEKPYKCNECGKTFRHNSALEIHKAIHTGEKPYKCSECGKVFNRKANLSRHHRLHTGEKPYKCNKCGKVFNQQAHLACHHRIHTGEKPYKCNECGKTFRHNSVLVIHKTIHTGEKPYKCNECGKVFNRKAKLARHHRIHTGKKH

SEQ ID NO: 101564 - protein, 970 aa, Homo sapiens; identical to SEQ ID NO: 101563
  Payload ID: 20236
  Gene Name: zinc finger protein 845
  Uniprot ID: Q96IR2
  ENSP ID: ENSP00000470005

SEQ ID NO: 101565 - protein, 136 aa, Homo sapiens
  Payload ID: 20236
  Gene Name: zinc finger protein 845
  ENSP ID: ENSP00000472689
MALSQGLLTFRDVAIEFSQEEWKCLDPAQRTLYRDVMLENYRNLVSLDISSKCMMKEFSSTAQGNTEVIHTGTLQRHERHHIGDFCFQEMEKDIHDFEFQWKEDERNSHEAPMTEIKQLTGSTNRHDQRHAGNKPI

SEQ ID NO: 101566 - protein, 533 aa, Homo sapiens
  Payload ID: 20237
  Gene Name: zinc finger protein 846
  Uniprot ID: Q147U1
  ENSP ID: ENSP00000380999
MDSSQHLVTFEDVAVDFTQEEWTLLDQAQRDLYRDVMLENYKNLIILAGSELFKRSLMSGLEQMEELRTGVTGVLQELDLQLKTKGSPLLQDISAERSPNGVQLERSNTAEKLYDSNHSGKVFNEHPFLMTHMITHIGEKTSEDNQSGKALRKNFPHSFYKKSHAEGKMPKCVKHEKAFNQFPNLTRQNKTHTQEKLCECKDCWRTFLNQSSLKLHIRSHNGDKHYVCKECGKAFSNSSHLIGHGRIHSGEKPYVCKECGKAFTQSTGLKLHIRTHSGEKPYKCKECGKAFTHSSYLTDHTRIHSGKKPYVCMECGKAFTRSTGLILHMRIHTGEKPYECKECGKAFIHSSYLTKHVRIHSGEKLYLCKACGKAFTRSSGLVLHMRTHTGEKPYECKECGKAFNNSSMLSQHVRIHTGEKPYECKECGKAFTQSSGLSTHLRTHTGEKACECKECGKAFARSTNLNMHMRTHTGEKPYACKECGKAFRYSTYLNVHTRTHTGAKPYECKKCGKNFTQSSALAKHLRTKACEKT

SEQ ID NO: 101567 - protein, 210 aa, Homo sapiens
  Payload ID: 20237
  Gene Name: zinc finger protein 846
  Uniprot ID: Q147U1
  ENSP ID: ENSP00000465467
MTHMITHIGEKTSEDNQSGKALRKNFPHSFYKKSHAEGKMPKCVKHEKAFNQFPNLTRQNKTHTQEKLCECKDCWRTFLNQSSLKLHIRSHNGDKHYVCKECGKAFSNSSHLIGHGRIHSGEKPYVCKECGKAFTQSTGLKLHIRTHSGEKPYKCKECGKAFTHSSYLTDHTRIHSGKKPYVCMECGKAFTRSTGLILHMRIHTGEKPYE

SEQ ID NO: 101568 - protein, 99 aa, Homo sapiens
  Payload ID: 20237
  Gene Name: zinc finger protein 846
  ENSP ID: ENSP00000466175
MDSSQHLVTFEDVAVDFTQEEWTLLDQAQRDLYRDVMLENYKNLIILAGSELFKRSLMSGLEQMEELRTGVTGVLQELDLQLKTKGSPLLQDISAERSP

SEQ ID NO: 101569 - protein, 86 aa, Homo sapiens
  Payload ID: 20237
  Gene Name: zinc finger protein 846
  ENSP ID: ENSP00000466236
MDSSQHLVTFEDVAVDFTQEEWTLLDQAQRDLYRDVMLENYKNLIILAGSELFKRSLMSGLEQMEELRTGVTGVLQGEKQYCRETV

SEQ ID NO: 101570 - protein, 175 aa, Homo sapiens
  Payload ID: 20237
  Gene Name: zinc finger protein 846
  ENSP ID: ENSP00000466547
MDSSQHLVTFEDVAVDFTQEEWTLLDQAQRDLYRDVMLENYKNLIILGSELFKRSLMSGLEQMEELRTGVTGVLQELDLQLKTKGSPLLQDISAERSPNGVQLERSNTAEKLYDSNHSGKVFNEHPFLMTHMITHIGEKTSEDNQSGKALRKNFPHSFYKKSHAEGKMPKCVKHE

SEQ ID NO: 101571 - protein, 81 aa, Homo sapiens
  Payload ID: 20237
  Gene Name: zinc finger protein 846
  ENSP ID: ENSP00000466599
MDSSQHLVTFEDVAVDFTQEEWTLLDQAQRDLYRDVMLENYKNLIILAGSELFKRSLMSGLEQMEELRTGVTGVLQGEKQY

SEQ ID NO: 101572 - protein, 86 aa, Homo sapiens; identical to SEQ ID NO: 101569
  Payload ID: 20237
  Gene Name: zinc finger protein 846
  ENSP ID: ENSP00000467021

SEQ ID NO: 101573 - protein, 210 aa, Homo sapiens; identical to SEQ ID NO: 101567
  Payload ID: 20237
  Gene Name: zinc finger protein 846
  Uniprot ID: Q147U1
  ENSP ID: ENSP00000467891

SEQ ID NO: 101574 - protein, 87 aa, Homo sapiens
  Payload ID: 20238
  Gene Name: zinc finger protein 85
  Uniprot ID: Q03923
  ENSP ID: ENSP00000300540
MGPLTFRDVAIEFSLKEWQCLDTAQRNLYRNVMLENYRNLVFLGITVSKPDLITCLEQGKEAWSMKRHEIMVAKPTESYSVTQSGMQ

SEQ ID NO: 101575 - protein, 595 aa, Homo sapiens
  Payload ID: 20238
  Gene Name: zinc finger protein 85
  Uniprot ID: Q03923
  ENSP ID: ENSP00000329793
MGPLTFRDVAIEFSLKEWQCLDTAQRNLYRNVMLENYRNLVFLGITVSKPDLITCLEQGKEAWSMKRHEIMVAKPTVMCSHFAQDLWPEQNIKDSFQKVTLKRYGKCRHENLPLRKGCESMDECKMHKGGCNGLNQCLTATQSKIFQCDKYVKVAHKFSNSNRHEIRHTKKKPFKCTKCGKSFGMISCLTEHSRIHTRVNFYKCEECGKAFNWSSTLTKHKRIHTGEKPYKCEECGKAFNQSSNLIKHKKIHTGEKPYKCEECGKTFNRFSTLTTHKIIHTGEKPYKCKECGKAFNRSSTLTTHRKIHTGEKPYKCEECGKAFKQSSNLTTHKIIHTGEKPYKCKKCGKAFNQSAHLTTHEVIHTGEKPYKCEKCGKAFNHFSHLTTHKIIHTGEKPYKCKECGKAFKHSSTLTKHKIIHTGEKPYKCKECEKAFNQSSKLTEHKKIHTGEKPYECEKCGKAFNQSSNLTRHKKSHTEEKPYKCEECGKGFKWPSTLTIHKIIHTGEKPYKCEECGKAFNQSSKLTKHKKIHTGEKPYTCEECGKAFNQSSNLTKHKRIHTGEKPYKCEECDKAFKWSSVLTKHKIIHTGEKLQI

SEQ ID NO: 101576 - protein, 562 aa, Homo sapiens
  Payload ID: 20238
  Gene Name: zinc finger protein 85
  Uniprot ID: Q03923
  ENSP ID: ENSP00000342340
MGPLTFRDVAIEFSLKEWQCLDTAQRNLYRNVMLENYRNLVFLVMCSHFAQDLWPEQNIKDSFQKVTLKRYGKCRHENLPLRKGCESMDECKMHKGGCNGLNQCLTATQSKIFQCDKYVKVAHKFSNSNRHEIRHTKKKPFKCTKCGKSFGMISCLTEHSRIHTRVNFYKCEECGKAFNWSSTLTKHKRIHTGEKPYKCEECGKAFNQSSNLIKHKKIHTGEKPYKCEECGKTFNRFSTLTTHKIIHTGEKPYKCKECGKAFNRSSTLTTHRKIHTGEKPYKCEECGKAFKQSSNLTTHKIIHTGEKPYKCKKCGKAFNQSAHLTTHEVIHTGEKPYKCEKCGKAFNHFSHLTTHKIIHTGEKPYKCKECGKAFKHSSTLTKHKIIHTGEKPYKCKECEKAFNQSSKLTEHKKIHTGEKPYECEKCGKAFNQSSNLTRHKKSHTEEKPYKCEECGKGFKWPSTLTIHKIIHTGEKPYKCEECGKAFNQSSKLTKHKKIHTGEKPYTCEECGKAFNQSSNLTKHKRIHTGEKPYKCEECDKAFKWSSVLTKHKIIHTGEKLQI

SEQ ID NO: 101577 - protein, 146 aa, Homo sapiens
  Payload ID: 20238
  Gene Name: zinc finger protein 85
  ENSP ID: ENSP00000469243
MGPLTFRDVAIEFSLKEWQCLDTAQRNLYRNVMLENYRNLVFLGITVSKPDLITCLEQGKEAWSMKRHEIMVAKPTGEVSRCRPGWSTECNGAISAHCSLRLLGSSNSPASASQVAEITGMRHHARLIFVFLVEVGFHHVGHAGLE

SEQ ID NO: 101578 - protein, 55 aa, Homo sapiens
  Payload ID: 20238
  Gene Name: zinc finger protein 85
  ENSP ID: ENSP00000469496
MLENYRNLVFLGITVSKPDLITCLEQGKEAWSMKRHEIMVAKPTESYSVTQSGMQ

SEQ ID NO: 101579 - protein, 231 aa, Homo sapiens
  Payload ID: 20238
  Gene Name: zinc finger protein 85
  ENSP ID: ENSP00000469673
MSYELLRKVYILMLLRSVLYASVRIMCSHFAQDLWPEQNIKDSFQKVTLKRYGKCRHENLPLRKGCESMDECKMHKGGCNGLNQCLTATQSKIFQCDKYVKVAHKFSNSNRHEIRHTKKKPFKCTKCGKSFGMISCLTEHSRIHTRVNFYKCEECGKAFNWSSTLTKHKRIHTGEKPYKCEECGKAFNQSSNLIKHKKIHTGEKPYKCEECGKTFNRFSTLTTHKIIHTGE

SEQ ID NO: 101580 - protein, 122 aa, Homo sapiens
  Payload ID: 20238
  Gene Name: zinc finger protein 85
  ENSP ID: ENSP00000470347
MGPLTFRDVAIEFSLKEWQCLDTAQRNLYRNVMLENYRNLVFLGITVSKPDLITCLEQGKEAWSMKRHEIMVAKPTGCLSKRMSYELLRKVYILMLLRSVLYASVRIMCSHFAQDLWPEQNI

SEQ ID NO: 101581 - protein, 129 aa, Homo sapiens
  Payload ID: 20238
  Gene Name: zinc finger protein 85
  ENSP ID: ENSP00000470667
MKRHEIMVAKPTVMCSHFAQDLWPEQNIKDSFQKVTLKRYGKCRHENLPLRKGCESMDECKMHKGGCNGLNQCLTATQSKIFQCDKYVKVAHKFSNSNRHEIRHTKKKPFKCTKCGKSFGMISCLTEHS

SEQ ID NO: 101582 - protein, 119 aa, Homo sapiens
  Payload ID: 20238
  Gene Name: zinc finger protein 85
  ENSP ID: ENSP00000471286
MGPLTFRDVAIEFSLKEWQCLDTAQRNLYRNVMLENYRNLVFLDLITCLEQGKEAWSMKRHEIMVAKPTVMCSHFAQDLWPEQNIKDSFQKVTLKRYGKCRHENLPLRKGCESMDECKM

SEQ ID NO: 101583 - protein, 62 aa, Homo sapiens
  Payload ID: 20238
  Gene Name: zinc finger protein 85
  ENSP ID: ENSP00000471467
MGPLTFRDVAIEFSLKEWQCLDTAQRNLYRNVMLENYRNLVFLARPDHLSGARERGLEYEET

SEQ ID NO: 101584 - protein, 234 aa, Homo sapiens
  Payload ID: 20238
  Gene Name: zinc finger protein 85
  ENSP ID: ENSP00000471588
MCSHFAQDLWPEQNIKDSFQKVTLKRYGKCRHENLPLRKGCESMDECKMHKGGCNGLNQCLTATQSKIFQCDKYVKVAHKFSNSNRHEIRHTKKKPFKCTKCGKSFGMISCLTEHSRIHTRVNFYKCEECGKAFNWSSTLTKHKRIHTGEKPYKCEECGKAFNQSSNLIKHKKIHTGEKPYKCEECGKTFNRFSTLTTHKIIHTGEKPYKCKECGKAFNRSSTLTTHRKIHTGE

SEQ ID NO: 101585 - protein, 509 aa, Homo sapiens
  Payload ID: 20238
  Gene Name: zinc finger protein 85
  ENSP ID: ENSP00000472145
MSYELLRKVYILMLLRSVLYASVRIMCSHFAQDLWPEQNIKDSFQKVTLKRYGKCRHENLPLRKGCESMDECKMHKGGCNGLNQCLTATQSKIFQCDKYVKVAHKFSNSNRHEIRHTKKKPFKCTKCGKSFGMISCLTEHSRIHTRVNFYKCEECGKAFNWSSTLTKHKRIHTGEKPYKCEECGKAFNQSSNLIKHKKIHTGEKPYKCEECGKTFNRFSTLTTHKIIHTGEKPYKCKECGKAFNRSSTLTTHRKIHTGEKPYKCEECGKAFKQSSNLTTHKIIHTGEKPYKCKKCGKAFNQSAHLTTHEVIHTGEKPYKCEKCGKAFNHFSHLTTHKIIHTGEKPYKCKECGKAFKHSSTLTKHKIIHTGEKPYKCKECEKAFNQSSKLTEHKKIHTGEKPYECEKCGKAFNQSSNLTRHKKSHTEEKPYKCEECGKGFKWPSTLTIHKIIHTGEKPYKCEECGKAFNQSSKLTKHKKIHTGEKPYTCEECGKAFNQSSNLTKHKRIHT

SEQ ID NO: 101586 - protein, 141 aa, Homo sapiens
  Payload ID: 20238
  Gene Name: zinc finger protein 85
  ENSP ID: ENSP00000473059
MCSHFAQDLWPEQNIKDSFQKVTLKRYGKCRHENLPLRKGCESMDECKMHKGGCNGLNQCLTATQSKIFQCDKYVKVAHKFSNSNRHEIRHTKKKPFKCTKCGKSFGMISCLTEHSRIHTRVNFYKCEECGKAFNWSSTLT

SEQ ID NO: 101587 - protein, 536 aa, Homo sapiens
  Payload ID: 20238
  Gene Name: zinc finger protein 85
  ENSP ID: ENSP00000478096
MSLSAQPSSSFYKPVSEVMCSHFAQDLWPEQNIKDSFQKVTLKRYGKCRHENLPLRKGCESMDECKMHKGGCNGLNQCLTATQSKIFQCDKYVKVAHKFSNSNRHEIRHTKKKPFKCTKCGKSFGMISCLTEHSRIHTRVNFYKCEECGKAFNWSSTLTKHKRIHTGEKPYKCEECGKAFNQSSNLIKHKKIHTGEKPYKCEECGKTFNRFSTLTTHKIIHTGEKPYKCKECGKAFNRSSTLTTHRKIHTGEKPYKCEECGKAFKQSSNLTTHKIIHTGEKPYKCKKCGKAFNQSAHLTTHEVIHTGEKPYKCEKCGKAFNHFSHLTTHKIIHTGEKPYKCKECGKAFKHSSTLTKHKIIHTGEKPYKCKECEKAFNQSSKLTEHKKIHTGEKPYECEKCGKAFNQSSNLTRHKKSHTEEKPYKCEECGKGFKWPSTLTIHKIIHTGEKPYKCEECGKAFNQSSKLTKHKKIHTGEKPYTCEECGKAFNQSSNLTKHKRIHTGEKPYKCEECDKAFKWSSVLTKHKIIHTGEKLQI

SEQ ID NO: 101588 - protein, 87 aa, Homo sapiens; identical to SEQ ID NO: 101574
  Payload ID: 20238
  Gene Name: zinc finger protein 85
  Uniprot ID: Q03923
  ENSP ID: ENSP00000479120

SEQ ID NO: 101589 - protein, 562 aa, Homo sapiens; identical to SEQ ID NO: 101576
  Payload ID: 20238
  Gene Name: zinc finger protein 85
  Uniprot ID: Q03923
  ENSP ID: ENSP00000479316

SEQ ID NO: 101590 - protein, 595 aa, Homo sapiens; identical to SEQ ID NO: 101575
  Payload ID: 20238
  Gene Name: zinc finger protein 85
  Uniprot ID: Q03923
  ENSP ID: ENSP00000483118

SEQ ID NO: 101591 - protein, 55 aa, Homo sapiens; identical to SEQ ID NO: 101578
  Payload ID: 20238
  Gene Name: zinc finger protein 85
  ENSP ID: ENSP00000485121

SEQ ID NO: 101592 - protein, 62 aa, Homo sapiens; identical to SEQ ID NO: 101583
  Payload ID: 20238
  Gene Name: zinc finger protein 85
  ENSP ID: ENSP00000485138

SEQ ID NO: 101593 - protein, 129 aa, Homo sapiens; identical to SEQ ID NO: 101581
  Payload ID: 20238
  Gene Name: zinc finger protein 85
  ENSP ID: ENSP00000485174

SEQ ID NO: 101594 - protein, 146 aa, Homo sapiens; identical to SEQ ID NO: 101577
  Payload ID: 20238
  Gene Name: zinc finger protein 85
  ENSP ID: ENSP00000485250

SEQ ID NO: 101595 - protein, 122 aa, Homo sapiens; identical to SEQ ID NO: 101580
  Payload ID: 20238
  Gene Name: zinc finger protein 85
  ENSP ID: ENSP00000485354

SEQ ID NO: 101596 - protein, 119 aa, Homo sapiens; identical to SEQ ID NO: 101582
  Payload ID: 20238
  Gene Name: zinc finger protein 85
  ENSP ID: ENSP00000485573

SEQ ID NO: 101597 - protein, 1090 aa, Homo sapiens
  Payload ID: 20239
  Gene Name: zinc finger protein 850
  Uniprot ID: A8MQ14
  ENSP ID: ENSP00000464976
MNMEGLVMFQDLSIDFSQEEWECLDAAQKDLYRDVMMENYSSLVSLGLSIPKPDVISLLEQGKEPWMVSRDVLGGWCRDSEFRCKTKDSCLPKEIYEVTSSQWVRMEKCHSLVGSSVRDDWECKGQFQHQDINQERYLEKAIMTYETTPTFCLQTSLTLHHRIHPGEKLYKSTECMAFKYGSELTQQQETHTGEKLYKCKECGKAFHHFSYLVKHQRIHTGEKPCACKEYGKAFISGSHLIQHQKMYTDERPHECQESVKAFRPSAHLIQHWRIHTGDKPYECKECGKSFTSGSTLNQHQQIHTGEKPYHCKQCGKSFTVGSTLIRHQQIHTGEKPYDCKECGKSFASGSALIRHQRIHTGEKPYDCKECGKSFTFHSALIRHQRIHTGEKPYDCKECGKSFTFRSGLIGHQAIHTGEKPYDCKECGKSFTAGSTLIQHQRIHTGEKPYDCKECGKSFASGSALLQHQRIHTGEKPYCCKECGKSFTFRSTRNRHQRIHTGEKPYNCKECGKSFASGSALLQHQRIHTGEKPYHCKECGKSFTFRSGLIGHQAVHTGEKPYDCKECGKSFTSRSALIQHQRIHTGEKPYHCKECGKSFTVGSTLLQHQQIHTGEKPYDCKECGKAFRLRLRLTQHQQIHTGEKPYQCQECGKAFVSVSGLTQHHRIHTGEKPYECPDCGKAFRQRTYLNQHRRIHTGEKPYECKECGKSFTFCSGLIQHQQNHTDEKPYDGKECGKSFTSHSTLIQHQQIHTGEKPYDCKECGKSFTSHSTLIQHQQIHTGEKLYDCKECGKSFTSHSTLIQHQPLHTGEKPYHCKECGKSFTLRSALIQHRPVHTGEKRYSCKECGKSFTSRSTLIEHQRIHTGEKPYHCKECGKSFAFRSAIIQHRRIHTGEKPYDCKECGKAFRRRSKLTQHQRIHTGEKPYRCHECGKAFVRFSGLTKHHSIHTGEKPYECKTCGKSFRQRTHLTLHQRIHTGDRPYECKECGKSFTCGSELIRHQRTHTGEKPYDCKECGKAFRCPSQLSQHKRIHTGEKTYQCPECGKAFFYASGLSRHQSVHTGEKPYECKTCGKAFKQLTQLTRHQRIHDLT

SEQ ID NO: 101598 - protein, 84 aa, Homo sapiens
  Payload ID: 20239
  Gene Name: zinc finger protein 850
  ENSP ID: ENSP00000465189
MNMEGLVMFQDLSIDFSQEEWECLDAAQKDLYRDVMMENYSSLVSLGLSIPKPDVISLLEQGKEPWMVSRDVLGGWCRDRMKKA

SEQ ID NO: 101599 - protein, 1058 aa, Homo sapiens
  Payload ID: 20239
  Gene Name: zinc finger protein 850
  ENSP ID: ENSP00000483509
MNMEGLVMFQDLSIDFSQEEWECLDAAQKDLYRDVMMENYSSLVSLDSEFRCKTKDSCLPKEIYEVTSSQWVRMEKCHSLVGSSVRDDWECKGQFQHQDINQERYLEKAIMTYETTPTFCLQTSLTLHHRIHPGEKLYKSTECMAFKYGSELTQQQETHTGEKLYKCKECGKAFHHFSYLVKHQRIHTGEKPCACKEYGKAFISGSHLIQHQKMYTDERPHECQESVKAFRPSAHLIQHWRIHTGDKPYECKECGKSFTSGSTLNQHQQIHTGEKPYHCKQCGKSFTVGSTLIRHQQIHTGEKPYDCKECGKSFASGSALIRHQRIHTGEKPYDCKECGKSFTFHSALIRHQRIHTGEKPYDCKECGKSFTFRSGLIGHQAIHTGEKPYDCKECGKSFTAGSTLIQHQRIHTGEKPYDCKECGKSFASGSALLQHQRIHTGEKPYCCKECGKSFTFRSTRNRHQRIHTGEKPYNCKECGKSFASGSALLQHQRIHTGEKPYHCKECGKSFTFRSGLIGHQAVHTGEKPYDCKECGKSFTSRSALIQHQRIHTGEKPYHCKECGKSFTVGSTLLQHQQIHTGEKPYDCKECGKAFRLRLRLTQHQQIHTGEKPYQCQECGKAFVSVSGLTQHHRIHTGEKPYECPDCGKAFRQRTYLNQHRRIHTGEKPYECKECGKSFTFCSGLIQHQQNHTDEKPYDGKECGKSFTSHSTLIQHQQIHTGEKPYDCKECGKSFTSHSTLIQHQQIHTGEKLYDCKECGKSFTSHSTLIQHQPLHTGEKPYHCKECGKSFTLRSALIQHRPVHTGEKRYSCKECGKSFTSRSTLIEHQRIHTGEKPYHCKECGKSFAFRSAIIQHRRIHTGEKPYDCKECGKAFRRRSKLTQHQRIHTGEKPYRCHECGKAFVRFSGLTKHHSIHTGEKPYECKTCGKSFRQRTHLTLHQRIHTGDRPYECKECGKSFTCGSELIRHQRTHTGEKPYDCKECGKAFRCPSQLSQHKRIHTGEKTYQCPECGKAFFYASGLSRHQSVHTGEKPYECKTCGKAFKQLTQLTRHQRIHDLT

SEQ ID NO: 101600 - protein, 543 aa, Homo sapiens
  Payload ID: 20240
  Gene Name: zinc finger protein 852
  Uniprot ID: Q6ZMS4
  ENSP ID: ENSP00000389841
MVRPQDTVAYEDLSEDYTQKKWKGLALSQRALHWNMMLENDRSMASLGRNMMESSELTPKQEIFKGSESSNSTSGGLFGVVPGGTETGDVCEDTFKELEGQPSNEEGSRLESDFLEIIDEDKKKSTKDRYEEYKEVEEHPPLSSSPVEHEGVLKGQKSYRCDECGKAFYWSSHLIGHRRIHTGEKPYECNECGKTFRQTSQLIVHLRTHTGEKPYECSECGKAYRHSSHLIQHQRLHNGEKPYKCNECAKAFNQSSKLFDHQRTHTGEKPYECKECGAAFSRSKNLVRHQFLHTGKKPYKCNECGRAFCSNRNLIDHQRTHTGEKPYKCNECGKAFSRSKCLIRHQSLHTGEKPYKCSECGKAFNQISQLVEHERIHTGEKPFKCSECGKAFGLSKCLIRHQRLHTSEKPYKCNECGKSFNQNSYLIIHQRIHTGEKPYECNECGKVFSYNSSLMVHQRTHTGEKPYKCNSCGKAFSDSSQLTVHQRVHTGEKNLMNVLSVGKPLVSVPLLITTSELMLERSPQVWLGHLLKAWFSETDSKDL

SEQ ID NO: 101601 - protein, 529 aa, Homo sapiens
  Payload ID: 20240
  Gene Name: zinc finger protein 852
  ENSP ID: ENSP00000482223
MVRPQDTVAYEDLSEDYTQKKWKGLALSQRALHWNMMLENDRSMASLGRNMMESSELTPKQEIFKGSESSNSTSGGLFGVVPGGTETGDVCEDTFKELEGQPSNEEGSRLESDFLEIIDEDKKKSTKDRYEEYKEVEEHPPLSSSPVEHEGVLKGQKSYRCDECGKAFYWSSHLIGHRRIHTGEKPYECNECGKTFRQTSQLIVHLRTHTGEKPYECSECGKAYRHSSHLIQHQRLHNGEKPYKCNECAKAFNQSSKLFDHQRTHTGEKPYECKECGAAFSRSKNLVRHQFLHTGKKPYKCNECGRAFCSNRNLIDHQRTHTGEKPYKCNECGKAFSRSKCLIRHQSLHTGEKPYKCSECGKAFNQISQLVEHERIHTGEKPFKCSECGKAFGLSKCLIRHQRLHTSEKPYKCNECGKSFNQNSYLIIHQRIHTGEKPYECNECGKVFSYNSSLMVHQRTHTGEKPYKCNSCGKAFSDSSQLTVHQRVHTGEPYECIECGKAFSQRSTFNHHQRTHAGEKPSGLARSSS

SEQ ID NO: 101602 - protein, 543 aa, Homo sapiens; identical to SEQ ID NO: 101600
  Payload ID: 20240
  Gene Name: zinc finger protein 852
  Uniprot ID: Q6ZMS4
  ENSP ID: ENSP00000487256

SEQ ID NO: 101603 - protein, 529 aa, Homo sapiens; identical to SEQ ID NO: 101601
  Payload ID: 20240
  Gene Name: zinc finger protein 852
  ENSP ID: ENSP00000487322

SEQ ID NO: 101604 - protein, 659 aa, Homo sapiens
  Payload ID: 20241
  Gene Name: zinc finger protein 853
  Uniprot ID: P0CG23
  ENSP ID: ENSP00000455585
MLHQPTPGNRGLTARMEVGPATETFVLELQCLEDGGPGPDTLSGGSGGSESQEEEEPQERNSSPQRPAVSAPVGASEIAEETRPGQRELQLQQLEQQPEPQQQPQHEQLQQPQPHLELQQQPQQDGQQQLSQLQQEKHQSVHHQELKPELQLMHQQQQLQPQQVQEQQRLQQQQEQLQTQQAQEQQVLQQQEQLQQQVQEQQLLQQQQEQLQQQQLLQQQEQLQQQQFQQQQEQLQQQQQLLLLQQQGQLQQQLLQQQQAQLQQQLLEQQQAQLQQQLLLQQQEQLQQQQQQQLLQQQQEQLQQQQLQPPPLEPEEEEEVELELMPVDLGSEQELEQQRQELERQQELERQQEQRQLQLKLQEELQQLEQQLEQQQQQLEQQEVQLELTPVELGAQQQEVQLELTPVQPELQLELVPAAGGGGAAVPGAPAAVVVAPPGYVVVQELMVLPAVAAPAVVAIPGPAGSAALTPARQRRRRRARDRPTICGECGKGFSRSTDLVRHQATHTGERPHRCGECGKGFSQHSNLVTHQRIHTGEKPYACSYCAKRFSESSALVQHQRTHTGERPYACGDCGKRFSVSSNLLRHRRTHSGERPYVCEDCGERFRHKVQIRRHERQLHGAGRSRGLGLLRASRPAALGGPARAEQAATATAPADKAL

SEQ ID NO: 101605 - protein, 632 aa, Homo sapiens
  Payload ID: 20242
  Gene Name: zinc finger protein 860
  Uniprot ID: A6NHJ4
  ENSP ID: ENSP00000373274
MLREEAAQKRKEKEPGMALPQGHLTFRDVAIEFSLEEWKCLDPTQRALYRAMMLENYRNLHSVDISSKCMMKKFSSTAQGNTEVDTGTLERHESHHIGDFCFQKIGKDIHDFEFQWQEDKRNSHEATMTQIKKLTGSTDRYDRRHPGNKPIKDQLGLSFHSHLPELHIFQTKGKVGNQVEKSINDASSVLTSQRISSRPKIHISNNYENNFFHSSLLTLKQEVHIREKSFQCNESGKAFNCSSLLRKHQIIYLGGKQYKCDVCGKVFNQKRYLACHHRCHTGEKPYKCNECGKVFNQQSNLASHHRLHTGEKPYKCEECDKVFSRKSNLERHRRIHTGEKPYKCKVCEKAFRRDSHLTQHTRIHTGEKPYKCNECGKAFSGQSTLIHHQAIHGIGKLYKCNDCHKVFSNATTIANHWRIHNEERSYKCNKCGKFFRRRSYLVVHWRTHTGEKPYKCNECGKTFHHNSALVIHKAIHTGEKPYKCNECGKTFRHNSALVIHKAIHTGEKPYKCNECGKVFNQQATLARHHRLHTGEKPYKCEECDTVFSRKSHHETHKRIHTGEKPYKCDDFDEAFSQASSYAKQRRIHMGEKHHKCDDCGKAFTSHSHRIRHQRIHTGQKSYKCHKRGKVFS

SEQ ID NO: 101606 - protein, 1169 aa, Homo sapiens
  Payload ID: 20243
  Gene Name: zinc finger protein 862
  Uniprot ID: O60290
  ENSP ID: ENSP00000223210
MEPRESGKAPVTFDDITVYLLQEEWVLLSQQQKELCGSNKLVAPLGPTVANPELFRKFGRGPEPWLGSVQGQRSLLEHHPGKKQMGYMGEMEVQGPTRESGQSLPPQKKAYLSHLSTGSGHIEGDWAGRNRKLLKPRSIQKSWFVQFPWLIMNEEQTALFCSACREYPSIRDKRSRLIEGYTGPFKVETLKYHAKSKAHMFCVNALAARDPIWAARFRSIRDPPGDVLASPEPLFTADCPIFYPPGPLGGFDSMAELLPSSRAELEDPGGDGAIPAMYLDCISDLRQKEITDGIHSSSDINILYNDAVESCIQDPSAEGLSEEVPVVFEELPVVFEDVAVYFTREEWGMLDKRQKELYRDVMRMNYELLASLGPAAAKPDLISKLERRAAPWIKDPNGPKWGKGRPPGNKKMVAVREADTQASAADSALLPGSPVEARASCCSSSICEEGDGPRRIKRTYRPRSIQRSWFGQFPWLVIDPKETKLFCSACIERPNLHDKSSRLVRGYTGPFKVETLKYHEVSKAHRLCVNTVEIKEDTPHTALVPEISSDLMANMEHFFNAAYSIAYHSRPLNDFEKILQLLQSTGTVILGKYRNRTACTQFIKYISETLKREILEDVRNSPCVSVLLDSSTDASEQACVGIYIRYFKQMEVKESYITLAPLYSETADGYFETIVSALDELDIPFRKPGWVVGLGTDGSAMLSCRGGLVEKFQEVIPQLLPVHCVAHRLHLAVVDACGSIDLVKKCDRHIRTVFKFYQSSNKRLNELQEGAAPLEQEIIRLKDLNAVRWVASRRRTLHALLVSWPALARHLQRVAEAGGQIGHRAKGMLKLMRGFHFVKFCHFLLDFLSIYRPLSEVCQKEIVLITEVNATLGRAYVALESLRHQAGPKEEEFNASFKDGRLHGICLDKLEVAEQRFQADRERTVLTGIEYLQQRFDADRPPQLKNMEVFDTMAWPSGIELASFGNDDILNLARYFECSLPTGYSEEALLEEWLGLKTIAQHLPFSMLCKNALAQHCRFPLLSKLMAVVVCVPISTSCCERGFKAMNRIRTDERTKLSNEVLNMLMMTAVNGVAVTEYDPQPAIQHWYLTSSGRRFSHVYTCAQVPARSPASARLRKEEMGALYVEEPRTQKPPILPSREAAEVLKDCIMEPPERLLYPHTSQEAPGMS

SEQ ID NO: 101607 - protein, 93 aa, Homo sapiens
  Payload ID: 20243
  Gene Name: zinc finger protein 862
  ENSP ID: ENSP00000417450
MGYMGEMEVQGPTRESGQSLPPQKKAYLSHLSTGSGHIEGDWAGRNRKLLKPRSIQKSWFVQFPWLIMNEEQTALFCSACREYPSIRDKRSRL

SEQ ID NO: 101608 - protein, 1059 aa, Homo sapiens
  Payload ID: 20244
  Gene Name: zinc finger protein 865
  Uniprot ID: P0CJ78
  ENSP ID: ENSP00000457715
MEANPAGSGAGGGGSSGIGGEDGVHFQSYPFDFLEFLNHQRFEPMELYGEHAKAVAALPCAPGPPPQPPPQPPPPQYDYPPQSTFKPKAEVPSSSSSSSSSSSSSSSSSSSSSSSSSQAKKPDPPLPPAFGAPPPPLFDAAFPTPQWGIVDLSGHQHLFGNLKRGGPASGPGVTPGLGAPAGAPGPLPAPSQTPPGPPAAAACDPTKDDKGYFRRLKYLMERRFPCGVCQKSFKQSSHLVQHMLVHSGERPYECGVCGRTYNHVSSLIRHRRCHKDVPPAAGGPPQPGPHLPPLGLPAPAASAATAAAPSTVSSGPPATPVAPAPSADGSAAPAGVGVPPPATGGGDGPFACPLCWKVFKKPSHLHQHQIIHTGEKPFSCSVCSKSFNRRESLKRHVKTHSADLLRLPCGICGKAFRDASYLLKHQAAHAGAGAGGPRPVYPCDLCGKSYSAPQSLLRHKAAHAPPAAAAEAPKDGAASAPQPPPTFPPGPYLLPPDPPTTDSEKAAAAAAAVVYGAVPVPLLGAHPLLLGGAGTSGAGGSGASVPGKTFCCGICGRGFGRRETLKRHERIHTGEKPHQCPVCGKRFRESFHLSKHHVVHTRERPYKCELCGKVFGYPQSLTRHRQVHRLQLPCALAGAAGLPSTQGTPGACGPGASGTSAGPTDGLSYACSDCGEHFPDLFHVMSHKEVHMAEKPYGCDACGKTFGFIENLMWHKLVHQAAPERLLPPAPGGLQPPDGSSGTDAASVLDNGLAGEVGAAVAALAGVSGGEDAGGAAVAGAGGGASSGPERFSCATCGQSFKHFLGLVTHKYVHLVRRTLGCGLCGQSFAGAYDLLLHRRSHRQKRGFRCPVCGKRFWEAALLMRHQRCHTEQRPYRCGVCGRGFLRSWYLRQHRVVHTGERAFKCGVCAKRFAQSSSLAEHRRLHAVARPQRCSACGKTFRYRSNLLEHQRLHLGERAYRCEHCGKGFFYLSSVLRHQRAHEPPRPELRCPACLKAFKDPGYFRKHLAAHQGGRPFRCSSCGEGFANTYGLKKHRLAHKAENLGGPGAGAGTLAGKDA

SEQ ID NO: 101609 - protein, 33 aa, Homo sapiens
  Payload ID: 20244
  Gene Name: zinc finger protein 865
  ENSP ID: ENSP00000487098
PVPAPSASAVPRAARRCSACGKTFRYRSNLLEH

SEQ ID NO: 101610 - protein, 531 aa, Homo sapiens
  Payload ID: 20245
  Gene Name: zinc finger protein 878
  Uniprot ID: C9JN71
  ENSP ID: ENSP00000447931
MDSVAFEDVAVNFTQEEWALLDPSQKNLYREVMQETLRNLTSIGKKWNNQYIEDEHQNPRRNLRRLIGERLSESKESHQHGEVLTQVPDDTLKKKTPGVQSYESSVCGEIGIGLSSLNRHLRAFSYSSSLAIHGRTHTGEKPYECKECGKAFRFPSSVRRHERIHSAKKPYECKQCGKAFSFPSSVRRHERIHSAKKPYECKQCGKALSYLVSFQTHMRMHTGERPHKCNICGKAFFSPSSLKRHEKSHTGEKRYKCKQCDKAFNCPSSFQYHERTHSGEKPYECTQCRKAFRSVKYLRVHERKHTGEKPYECKLCGKGFISSTSFRYHEKTHTGEKPYECKKCVKAFSFVKDLRIHERTHTGEKPFECKQCGKTFTSSNSFHYHERTHTGEKPYECKQCGKAFRSASVLQKHIRTHTGEKPYGCKQCGKVFRVASQLKMHERTHTGEKPYECKQCGKAFISSNSIRYHKRTHTGEKPYKCKQCGKAFISSNSFLYHERIHTGEKPYECKQCGKAFRSASILQKHVRTHAG

SEQ ID NO: 101611 - protein, 563 aa, Homo sapiens
  Payload ID: 20246
  Gene Name: zinc finger protein 879
  Uniprot ID: B4DU55
  ENSP ID: ENSP00000414887
MARRLLPAHVQESVTFRDVAVFFSQDEWLHLDSAQRALYREVMLENYSILVSLGILFSKPKVISQLEQGEDPWMVESGVPQGAHLGWESLFGTIVSKEENQEVMKKLIIDGTFDFKLEKTYINEDKLEKQQGKKNRLFSKVLVTIKKVYMKERSFKGVEFGKNLGLKSSLIRKPRIVSRGRRPRSQQYSVLFKQLGVNTVRKCYKCNICGKIFLHSSSLSKHQRIHTGEKLYKCKECRKAFSQSSSLTQHLRVHTGEKPYICSECGKAFSFTTSLIGHQRMHTGERPYKCKECGKTFKGSSSLNNHQRIHTGEKPYKCNECGRAFSQCSSLIQHHRIHTGEKPYECTQCGKAFTSISRLSRHHRIHTGEKPFHCNECGKVFSYHSALIIHQRIHTGEKPYACKECGKAFSQSSALIQHQRIHTGEKPYKCNECGKAFSWISRLNIHHRIHTGEKPYNCKECGKAFSSHSGVNTHRKIHTGEKPYKCNDCEKAFNQSSALIQHQRIHTGEKPYNCKVCGKAFRQSSSLMTHMRIHTGEKPYKCKECGKAFSQSSSLTNHQRTHN

SEQ ID NO: 101612 - protein, 134 aa, Homo sapiens
  Payload ID: 20246
  Gene Name: zinc finger protein 879
  ENSP ID: ENSP00000428477
MARRLLPAHVQESVTFRDVAVFFSQDEWLHLDSAQRALYREVMLENYSILVSLGILFSKPKVISQLEQGEDPWMVESGVPQGAHLGWESLFGTIVSKEENQEVMKKLIIDGTFDFKLEKTYINEDKLEKQQGKK

SEQ ID NO: 101613 - protein, 107 aa, Homo sapiens
  Payload ID: 20246
  Gene Name: zinc finger protein 879
  ENSP ID: ENSP00000430047
MARRLLPAHVQSWMNRSGFAIPGVRDVQGCGRVLQPGRVVAPGLCPESLVPGGDAGELQHPGLTGDSLFQAKGHLPVRARRRPLDGGEWSSPRRTSRMGKLVWNHSF

SEQ ID NO: 101614 - protein, 41 aa, Homo sapiens
  Payload ID: 20246
  Gene Name: zinc finger protein 879
  ENSP ID: ENSP00000431043
MARRLLPAHVQESVTFRDVAVFFSQDEWLHLDSAQRALYRE

SEQ ID NO: 101615 - protein, 98 aa, Homo sapiens
  Payload ID: 20247
  Gene Name: zinc finger protein 880
  Uniprot ID: Q6PDB4
  ENSP ID: ENSP00000343625
MLRRGHLAFRDVAIEFPQEEWKCLDPAQRTLYREVMVENYRNLVFLGICLPDLSVISMLEQRRDPRNLQSEVKIANNPGSCSVTQAVVEWQSSVAIVA

SEQ ID NO: 101616 - protein, 577 aa, Homo sapiens
  Payload ID: 20247
  Gene Name: zinc finger protein 880
  Uniprot ID: Q6PDB4
  ENSP ID: ENSP00000406318
MLRRGHLAFRDVAIEFPQEEWKCLDPAQRTLYREVMVENYRNLVFLGICLPDLSVISMLEQRRDPRNLQSEVKIANNPGGRECIKGVNAESSSKLGSNAGNKSLKNQLGLTFQLHLSELQLFQAERNISGCKHVEKPINNSLVSPLQKIYSSVKSHILNKYRNDFDDSPFLPQEQKAQIREKPCECNEHGKAFRVSSRLANNQVIHTADNPYKCNECDKVFSNSSNLVQHQRIHTGEKPYKCHECGKLFNRISLLARHQRIHTGEKPYKCHECGKVFTQNSHLANHHRIHTGEKPYKCNECGKVFNRNAHLARHQKIHSGEKPYKCKECGKAFSGGSGLTAHLVIHTGEKLYKCNKCGKVFNRNAHLTRHQRIHTGEKPYECKECGKVFRHKFCLTNHHRMHTGEQPYKCNECGKAFRDCSGLTAHLLIHTGEKPYKCKECAKVFRHRLSLSNHQRFHTGEKPYRCDECGKDFTRNSNLANHHRIHTGEKPYKCSECHKVFSHNSHLARHRQIHTGEKSYKCNECGKVFSHKLYLKKHERIHTGEKPYRCHECGKDFTRNSNLANHHRIHTGEKPYR

SEQ ID NO: 101617 - protein, 125 aa, Homo sapiens
  Payload ID: 20247
  Gene Name: zinc finger protein 880
  ENSP ID: ENSP00000414470
MLRRGHLAFRDVAIEFPQEEWKCLDPAQRTLYREVMVENYRNLVFLGICLPDLSVISMLEQRRDPRNLQSEVKIANNPGGRECIKGVNAESRSVTQAGVQCRDLGSLQPSLPGFKQFFCIGLPKC

SEQ ID NO: 101618 - protein, 125 aa, Homo sapiens; identical to SEQ ID NO: 101617
  Payload ID: 20247
  Gene Name: zinc finger protein 880
  ENSP ID: ENSP00000471067

SEQ ID NO: 101619 - protein, 117 aa, Homo sapiens
  Payload ID: 20247
  Gene Name: zinc finger protein 880
  ENSP ID: ENSP00000471324
MLRRGHLAFRDVAIEFPQEEWKCLDPAQRTLYREVMVENYRNLVFLGICLPDLSVISMLEQRRDPRNLQSEVKIANNPGGRECIKGVNAGKSLDGQSGGPIIFFFFKQGLALSPRLS

SEQ ID NO: 101620 - protein, 544 aa, Homo sapiens
  Payload ID: 20248
  Gene Name: zinc finger protein 891
  Uniprot ID: A8MT65
  ENSP ID: ENSP00000437590
MAVMDLSSPWALTKQDSACFHLRNAEEERMIAVFLTTWLQEPMTFKDVAVEFTQEEWMMLDSAQRSLYRDVMLENYRNLTSVEYQLYRLTVISPLDQEEIRNMKKRIPQAICPDQKIQPKTKESTVQKILWEEPSNAVKMIKLTMHNWSSTLREDWECHKIRKQHKIPGGHWRQMIYAPKKTVPQELFRDYHELEENSKLGSKLIFSQSIFTSKHCQKCYSEIGCLKHNSIINNYVKNSISEKLYESHECDTTLWHFQRNQTVQKEYTYSKHGMHFTHNMFPVPNNLHMAQNACECNKDETLCHQSSLKKQGQTHTEKKHECNQCGKAFKRISNLTLYKKSHMGEKQYECKECGKVFNDSSTLRRHVRTHTGEKPYECNQCGKAFSQKTSLKAHMRTHTGEKPYECNQCGKSFGTSSYLIVHKRIHTGEKLYECSECGKAFNTSSHLKVHKKIHTGENVYECSDCGKVFSGVSSLRMHIRTHTGEKPYECKECRKAFSVSSSLRRHVRIHTGEKPYECIQCGKAFSQSSSLIIHKRIHTERETL

SEQ ID NO: 101621 - protein, 601 aa, Homo sapiens
  Payload ID: 20249
  Gene Name: zinc finger protein 90
  Uniprot ID: Q03938
  ENSP ID: ENSP00000410466
MGPLEFRDVAIEFSLEEWHCLDTAQQNLYRDVMLENYRHLVFLGIVVTKPDLITCLEQGKKPFTVKRHEMIAKSPVMCFHFAQDLCPEQSLKDSFQKVIVTRYEKREYGNLELKKGCESVDEGKVHKRGYNGLNQCLTATQSKVFQCDTYVKVSHIFSNSNRHKIRDTGKKPFKCIECGKAFNQSSTLATHKKIHTGEITCKCEECGKAFNRSSHLTSHKRIHTGEKRYKCEDCGKELKYSSTLTAHKRIHTGEKRYKCEDCGKELKYSSTLTAHKRIHTGEKPYKCDKCGRAFISSSILYVHKISHTEEKPYKCEECGKAFKLSSILSTHKRIHTGEKPYKCEECGKAFRRSLVLRTHKRIHTGEKPYKCDKCGKAFISSSLLYKHKISHSEKKPYKCEECGKAFKRSSTLTIHKISHTEEKPYKCQECDKVFKRSSALSTHKIIHSGEKPYKCEECGKAFKRSSNLTTHKISHTEEKLYKCQECDKAFKYSSALSTHKIIHSGENPYKCEECGKAFKRSSVLSKHKIIHTGAKPYKCEECGKAFKRSSQLTSHKISHTGEKPYKCEECGKAFNLSSDLNTHKRIHIGQKAYIVKNMANL

SEQ ID NO: 101622 - protein, 76 aa, Homo sapiens
  Payload ID: 20249
  Gene Name: zinc finger protein 90
  ENSP ID: ENSP00000418166
MGPLEFRDVAIEFSLEEWHCLDTAQQNLYRDVMLENYRHLVFLGIVVTKPDLITCLEQGKKPFTVKRHEMIAKSPG

SEQ ID NO: 101623 - protein, 112 aa, Homo sapiens
  Payload ID: 20249
  Gene Name: zinc finger protein 90
  ENSP ID: ENSP00000420111
MGPLEFRDVAIEFSLEEWHCLDTAQQNLYRDVMLENYRHLVFLGIVVTKPDLITCLEQGKKPFTVKRHEMIAKSPDGVHFLIQAGVQQRNLCVIIATFTSQVQAILLPQSPK

SEQ ID NO: 101624 - protein, 129 aa, Homo sapiens
  Payload ID: 20249
  Gene Name: zinc finger protein 90
  ENSP ID: ENSP00000482310
MPSKGPLQSVQVFGRKKTATAVAHCRRGNGLIKLLEPVLLLGKERFAGVDIRVRVKGGAHVAQIYAIRQSTSKALVAYYQKYVDEASKKEIKDILIQYDRTLLVADPRRCKSKKFGGPGARACYQKSYR

SEQ ID NO: 101625 - protein, 1191 aa, Homo sapiens
  Payload ID: 20250
  Gene Name: zinc finger protein 91
  Uniprot ID: Q05481
  ENSP ID: ENSP00000300619
MPGTPGSLEMGLLTFRDVAIEFSPEEWQCLDTAQQNLYRNVMLENYRNLAFLGIALSKPDLITYLEQGKEPWNMKQHEMVDEPTGICPHFPQDFWPEQSMEDSFQKVLLRKYEKCGHENLQLRKGCKSVDECKVHKEGYNKLNQCLTTAQSKVFQCGKYLKVFYKFLNSNRHTIRHTGKKCFKCKKCVKSFCIRLHKTQHKCVYITEKSCKCKECEKTFHWSSTLTNHKEIHTEDKPYKCEECGKAFKQLSTLTTHKIICAKEKIYKCEECGKAFLWSSTLTRHKRIHTGEKPYKCEECGKAFSHSSTLAKHKRIHTGEKPYKCEECGKAFSRSSTLAKHKRIHTGEKPYKCKECGKAFSNSSTLANHKITHTEEKPYKCKECDKAFKRLSTLTKHKIIHAGEKLYKCEECGKAFNRSSNLTIHKFIHTGEKPYKCEECGKAFNWSSSLTKHKRFHTREKPFKCKECGKAFIWSSTLTRHKRIHTGEKPYKCEECGKAFRQSSTLTKHKIIHTGEKPYKFEECGKAFRQSLTLNKHKIIHSREKPYKCKECGKAFKQFSTLTTHKIIHAGKKLYKCEECGKAFNHSSSLSTHKIIHTGEKSYKCEECGKAFLWSSTLRRHKRIHTGEKPYKCEECGKAFSHSSALAKHKRIHTGEKPYKCKECGKAFSNSSTLANHKITHTEEKPYKCKECDKTFKRLSTLTKHKIIHAGEKLYKCEECGKAFNRSSNLTIHKFIHTGEKPYKCEECGKAFNWSSSLTKHKRIHTREKPFKCKECGKAFIWSSTLTRHKRIHTGEKPYKCEECGKAFSRSSTLTKHKTIHTGEKPYKCKECGKAFKHSSALAKHKIIHAGEKLYKCEECGKAFNQSSNLTTHKIIHTKEKPSKSEECDKAFIWSSTLTEHKRIHTREKTYKCEECGKAFSQPSHLTTHKRMHTGEKPYKCEECGKAFSQSSTLTTHKIIHTGEKPYKCEECGKAFRKSSTLTEHKIIHTGEKPYKCEECGKAFSQSSTLTRHTRMHTGEKPYKCEECGKAFNRSSKLTTHKIIHTGEKPYKCEECGKAFISSSTLNGHKRIHTREKPYKCEECGKAFSQSSTLTRHKRLHTGEKPYKCGECGKAFKESSALTKHKIIHTGEKPYKCEKCGKAFNQSSILTNHKKIHTITPVIPLLWEAEAGGSRGQEMETILANTVKPLLY

SEQ ID NO: 101626 - protein, 1159 aa, Homo sapiens
  Payload ID: 20250
  Gene Name: zinc finger protein 91
  Uniprot ID: Q05481
  ENSP ID: ENSP00000380272
MPGTPGSLEMGLLTFRDVAIEFSPEEWQCLDTAQQNLYRNVMLENYRNLAFLGICPHFPQDFWPEQSMEDSFQKVLLRKYEKCGHENLQLRKGCKSVDECKVHKEGYNKLNQCLTTAQSKVFQCGKYLKVFYKFLNSNRHTIRHTGKKCFKCKKCVKSFCIRLHKTQHKCVYITEKSCKCKECEKTFHWSSTLTNHKEIHTEDKPYKCEECGKAFKQLSTLTTHKIICAKEKIYKCEECGKAFLWSSTLTRHKRIHTGEKPYKCEECGKAFSHSSTLAKHKRIHTGEKPYKCEECGKAFSRSSTLAKHKRIHTGEKPYKCKECGKAFSNSSTLANHKITHTEEKPYKCKECDKAFKRLSTLTKHKIIHAGEKLYKCEECGKAFNRSSNLTIHKFIHTGEKPYKCEECGKAFNWSSSLTKHKRFHTREKPFKCKECGKAFIWSSTLTRHKRIHTGEKPYKCEECGKAFRQSSTLTKHKIIHTGEKPYKFEECGKAFRQSLTLNKHKIIHSREKPYKCKECGKAFKQFSTLTTHKIIHAGKKLYKCEECGKAFNHSSSLSTHKIIHTGEKSYKCEECGKAFLWSSTLRRHKRIHTGEKPYKCEECGKAFSHSSALAKHKRIHTGEKPYKCKECGKAFSNSSTLANHKITHTEEKPYKCKECDKTFKRLSTLTKHKIIHAGEKLYKCEECGKAFNRSSNLTIHKFIHTGEKPYKCEECGKAFNWSSSLTKHKRIHTREKPFKCKECGKAFIWSSTLTRHKRIHTGEKPYKCEECGKAFSRSSTLTKHKTIHTGEKPYKCKECGKAFKHSSALAKHKIIHAGEKLYKCEECGKAFNQSSNLTTHKIIHTKEKPSKSEECDKAFIWSSTLTEHKRIHTREKTYKCEECGKAFSQPSHLTTHKRMHTGEKPYKCEECGKAFSQSSTLTTHKIIHTGEKPYKCEECGKAFRKSSTLTEHKIIHTGEKPYKCEECGKAFSQSSTLTRHTRMHTGEKPYKCEECGKAFNRSSKLTTHKIIHTGEKPYKCEECGKAFISSSTLNGHKRIHTREKPYKCEECGKAFSQSSTLTRHKRLHTGEKPYKCGECGKAFKESSALTKHKIIHTGEKPYKCEKCGKAFNQSSILTNHKKIHTITPVIPLLWEAEAGGSRGQEMETILANTVKPLLY

SEQ ID NO: 101627 - protein, 122 aa, Homo sapiens
  Payload ID: 20250
  Gene Name: zinc finger protein 91
  ENSP ID: ENSP00000468867
MPGTPGSLEMGLLTFRDVAIEFSPEEWQCLDTAQQNLYRNVMLENYRNLAFLGIALSKPDLITYLEQGKEPWNMKQHEMVDEPTDGVLLHRQAGVQWRDLVPLLTATSASPIEVILLSQPPE

SEQ ID NO: 101628 - protein, 185 aa, Homo sapiens
  Payload ID: 20250
  Gene Name: zinc finger protein 91
  ENSP ID: ENSP00000471709
MEDSFQKVLLRKYEKCGHENLQLRKGCKSVDECKVHKEGYNKLNQCLTTAQSKVFQCGKYLKVFYKFLNSNRHTIRHTGKKCFKCKKCVKSFCIRLHKTQHKCVYITEKSCKCKECEKTFHWSSTLTNHKEIHTEDKPYKCEECGKAFKQLSTLTTHKIICAKEKIYKCEECGKAFLWSSTLTRH

SEQ ID NO: 101629 - protein, 586 aa, Homo sapiens
  Payload ID: 20251
  Gene Name: zinc finger protein 92
  Uniprot ID: Q03936
  ENSP ID: ENSP00000332595
MGPLTFRDVKIEFSLEEWQCLDTAQRNLYRDVMLENYRNLVFLGIAVSKPDLITWLEQGKEPWNLKRHEMVDKTPVMCSHFAQDVWPEHSIKDSFQKVILRTYGKYGHENLQLRKDHKSVDACKVYKGGYNGLNQCLTTTDSKIFQCDKYVKVFHKFPNVNRNKIRHTGKKPFKCKNRGKSFCMLSQLTQHKKIHTREYSYKCEECGKAFNWSSTLTKHKIIHTGEKPYKCEECGKAFNRSSNLTKHKIIHTGEKPYKCEECGKAFNRSSTLTKHKRIHTEEKPYKCEECGKAFNQFSILNKHKRIHMEDKPYKCEECGKAFRVFSILKKHKIIHTGEKPYKCEECGKAFNQFSNLTKHKIIHTGEKPYKCDECGKAFNQSSTLTKHKRIHTGEKPYKCEECGKAFKQSSTLTEHKIIHTGEKPYKCEKCGKAFSWSSAFTKHKRNHMEDKPYKCEECGKAFSVFSTLTKHKIIHTREKPYKCEECGKAFNQSSIFTKHKIIHTEGKSYKCEKCGNAFNQSSNLTARKIIYTGEKPYKYEECDKAFNKFSTLITHQIIYTGEKPCKHECGRAFNKSSNYTKEKLQT

SEQ ID NO: 101630 - protein, 554 aa, Homo sapiens
  Payload ID: 20251
  Gene Name: zinc finger protein 92
  Uniprot ID: Q03936
  ENSP ID: ENSP00000350113
MGPLTFRDVKIEFSLEEWQCLDTAQRNLYRDVMLENYRNLVFLVMCSHFAQDVWPEHSIKDSFQKVILRTYGKYGHENLQLRKDHKSVDACKVYKGGYNGLNQCLTTTDSKIFQCDKYVKVFHKFPNVNRNKIRHTGKKPFKCKNRGKSFCMLSQLTQHKKIHTREYSYKCEECGKAFNWSSTLTKHKIIHTGEKPYKCEECGKAFNRSSNLTKHKIIHTGEKPYKCEECGKAFNRSSTLTKHKRIHTEEKPYKCEECGKAFNQFSILNKHKRIHMEDKPYKCEECGKAFRVFSILKKHKIIHTGEKPYKCEECGKAFNQFSNLTKHKIIHTGEKPYKCDECGKAFNQSSTLTKHKRIHTGEKPYKCEECGKAFKQSSTLTEHKIIHTGEKPYKCEKCGKAFSWSSAFTKHKRNHMEDKPYKCEECGKAFSVFSTLTKHKIIHTREKPYKCEECGKAFNQSSIFTKHKIIHTEGKSYKCEKCGNAFNQSSNLTARKIIYTGEKPYKYEECDKAFNKFSTLITHQIIYTGEKPCKHECGRAFNKSSNYTKEKLQT

SEQ ID NO: 101631 - protein, 517 aa, Homo sapiens
  Payload ID: 20251
  Gene Name: zinc finger protein 92
  Uniprot ID: Q03936
  ENSP ID: ENSP00000396126
MVDKTPVMCSHFAQDVWPEHSIKDSFQKVILRTYGKYGHENLQLRKDHKSVDACKVYKGGYNGLNQCLTTTDSKIFQCDKYVKVFHKFPNVNRNKIRHTGKKPFKCKNRGKSFCMLSQLTQHKKIHTREYSYKCEECGKAFNWSSTLTKHKIIHTGEKPYKCEECGKAFNRSSNLTKHKIIHTGEKPYKCEECGKAFNRSSTLTKHKRIHTEEKPYKCEECGKAFNQFSILNKHKRIHMEDKPYKCEECGKAFRVFSILKKHKIIHTGEKPYKCEECGKAFNQFSNLTKHKIIHTGEKPYKCDECGKAFNQSSTLTKHKRIHTGEKPYKCEECGKAFKQSSTLTEHKIIHTGEKPYKCEKCGKAFSWSSAFTKHKRNHMEDKPYKCEECGKAFSVFSTLTKHKIIHTREKPYKCEECGKAFNQSSIFTKHKIIHTEGKSYKCEKCGNAFNQSSNLTARKIIYTGEKPYKYEECDKAFNKFSTLITHQIIYTGEKPCKHECGRAFNKSSNYTKEKLQT

SEQ ID NO: 101632 - protein, 510 aa, Homo sapiens
  Payload ID: 20251
  Gene Name: zinc finger protein 92
  ENSP ID: ENSP00000400495
MCSHFAQDVWPEHSIKDSFQKVILRTYGKYGHENLQLRKDHKSVDACKVYKGGYNGLNQCLTTTDSKIFQCDKYVKVFHKFPNVNRNKIRHTGKKPFKCKNRGKSFCMLSQLTQHKKIHTREYSYKCEECGKAFNWSSTLTKHKIIHTGEKPYKCEECGKAFNRSSNLTKHKIIHTGEKPYKCEECGKAFNRSSTLTKHKRIHTEEKPYKCEECGKAFNQFSILNKHKRIHMEDKPYKCEECGKAFRVFSILKKHKIIHTGEKPYKCEECGKAFNQFSNLTKHKIIHTGEKPYKCDECGKAFNQSSTLTKHKRIHTGEKPYKCEECGKAFKQSSTLTEHKIIHTGEKPYKCEKCGKAFSWSSAFTKHKRNHMEDKPYKCEECGKAFSVFSTLTKHKIIHTREKPYKCEECGKAFNQSSIFTKHKIIHTEGKSYKCEKCGNAFNQSSNLTARKIIYTGEKPYKYEECDKAFNKFSTLITHQIIYTGEKPCKHECGRAFNKSSNYTKEKLQT

SEQ ID NO: 101633 - protein, 620 aa, Homo sapiens
  Payload ID: 20252
  Gene Name: zinc finger protein 93
  Uniprot ID: P35789
  ENSP ID: ENSP00000342002
MGPLQFRDVAIEFSLEEWHCLDTAQRNLYRNVMLENYSNLVFLGIVVSKPDLIAHLEQGKKPLTMKRHEMVANPSVICSHFAQDLWPEQNIKDSFQKVILRRYEKRGHGNLQLIKRCESVDECKVHTGGYNGLNQCSTTTQSKVFQCDKYGKVFHKFSNSNRHNIRHTEKKPFKCIECGKAFNQFSTLITHKKIHTGEKPYICEECGKAFKYSSALNTHKRIHTGEKPYKCDKCDKAFIASSTLSKHEIIHTGKKPYKCEECGKAFNQSSTLTKHKKIHTGEKPYKCEECGKAFNQSSTLTKHKKIHTGEKPYVCEECGKAFKYSRILTTHKRIHTGEKPYKCNKCGKAFIASSTLSRHEFIHMGKKHYKCEECGKAFIWSSVLTRHKRVHTGEKPYKCEECGKAFKYSSTLSSHKRSHTGEKPYKCEECGKAFVASSTLSKHEIIHTGKKPYKCEECGKAFNQSSSLTKHKKIHTGEKPYKCEECGKAFNQSSSLTKHKKIHTGEKPYKCEECGKAFNQSSTLIKHKKIHTREKPYKCEECGKAFHLSTHLTTHKILHTGEKPYRCRECGKAFNHSATLSSHKKIHSGEKPYECDKCGKAFISPSSLSRHEIIHTGEKP

SEQ ID NO: 101634 - protein, 123 aa, Homo sapiens
  Payload ID: 20252
  Gene Name: zinc finger protein 93
  ENSP ID: ENSP00000467377
MGPLQFRDVAIEFSLEEWHCLDTAQRNLYRNVMLENYSNLVFLGIVVSKPDLIAHLEQGKKPLTMKRHEMVANPSGARLLSQHFGRPRWVDPEVRRSRPSGQHGEIPSLLKYKKLARHGGPCL

SEQ ID NO: 101635 - protein, 120 aa, Homo sapiens
  Payload ID: 20252
  Gene Name: zinc finger protein 93
  ENSP ID: ENSP00000467553
MKRHEMVANPSVICSHFAQDLWPEQNIKDSFQKVILRRYEKRGHGNLQLIKRCESVDECKVHTGGYNGLNQCSTTTQSKVFQCDKYGKVFHKFSNSNRHNIRHTEKKPFKCIECGKAFNQ

SEQ ID NO: 101636 - protein, 119 aa, Homo sapiens
  Payload ID: 20252
  Gene Name: zinc finger protein 93
  ENSP ID: ENSP00000467652
MGPLQFRDVAIEFSLEEWHCLDTAQRNLYRNVMLENYSNLVFLGIVVSKPDLIAHLEQGKKPLTMKRHEMVANPSGPGVVVVLMCNPRILGGQAKRIPGAQKFENSLGNIWRPLSMKKI

SEQ ID NO: 101637 - protein, 84 aa, Homo sapiens
  Payload ID: 20252
  Gene Name: zinc finger protein 93
  ENSP ID: ENSP00000468563
MGPLQFRDVAIEFSLEEWHCLDTAQRNLYRNVMLENYSNLVFLGIVVSKPDLIAHLEQGKKPLTMKRHEMVANPSDGVNLCHPG

SEQ ID NO: 101638 - protein, 572 aa, Homo sapiens
  Payload ID: 20253
  Gene Name: zinc finger protein 98
  Uniprot ID: A6NK75
  ENSP ID: ENSP00000350418
MPGPLGSLEMGVLTFRDVALEFSLEEWQCLDTAQQNLYRNVMLENYRNLVFVGIAASKPDLITCLEQGKEPWNVKRHEMVTEPPVVYSYFAQDLWPKQGKKNYFQKVILRTYKKCGRENLQLRKYCKSMDECKVHKECYNGLNQCLTTTQNKIFQYDKYVKVFHKFSNSNRHKIGHTGKKSFKCKECEKSFCMLSHLAQHKRIHSGEKPYKCKECGKAYNEASNLSTHKRIHTGKKPYKCEECGKAFNRLSHLTTHKIIHTGKKPYKCEECGKAFNQSANLTTHKRIHTGEKPYKCEECGRAFSQSSTLTAHKIIHAGEKPYKCEECGKAFSQSSTLTTHKIIHTGEKFYKCEECGKAFSRLSHLTTHKRIHSGEKPYKCEECGKAFKQSSTLTTHKRIHAGEKFYKCEVCSKAFSRFSHLTTHKRIHTGEKPYKCEECGKAFNLSSQLTTHKIIHTGEKPYKCEECGKAFNQSSTLSKHKVIHTGEKPYKCEECGKAFNQSSHLTTHKMIHTGEKPYKCEECGKAFNNSSILNRHKMIHTGEKLYKPESCNNACDNIAKISKYKRNCAGEK

SEQ ID NO: 101639 - protein, 87 aa, Homo sapiens
  Payload ID: 20253
  Gene Name: zinc finger protein 98
  ENSP ID: ENSP00000470558
MPGPLGSLEMGVLTFRDVALEFSLEEWQCLDTAQQNLYRNVMLENYRNLVFVGIAASKPDLITCLEQGKEPWNVKRHEMVTEPPGLQ

SEQ ID NO: 101640 - protein, 130 aa, Homo sapiens
  Payload ID: 20253
  Gene Name: zinc finger protein 98
  ENSP ID: ENSP00000470736
MLENYRNLVFVGIAASKPDLITCLEQGKEPWNVKRHEMVTEPPVVYSYFAQDLWPKQGKKNYFQKVILRTYKKCGRENLQLRKYCKSMDECKVHKECYNGLNQCLTTTQNKIFQYDKYVKVFHKFSNSNR

SEQ ID NO: 101641 - protein, 131 aa, Homo sapiens
  Payload ID: 20253
  Gene Name: zinc finger protein 98
  ENSP ID: ENSP00000472301
MSEETLQSKLAAAKKKLPWGAVQGSRAMSDLLLLLLDLTLLLLLMLLGFAGYSGQLAGVAVSAGSPPIPTSSMWSPMVRLGGFSPELQHLPQTLLHRCPLGQPCMGVLTFRDVALEFSLEEWQCLDTAQQN

SEQ ID NO: 101642 - protein, 1037 aa, Homo sapiens [sequence omitted]

SEQ ID NO: 101643 - protein, 864 aa, Homo sapiens
  Payload ID: 20254
  Gene Name: zinc finger protein 99
  Uniprot ID: A8MXY4
  ENSP ID: ENSP00000472969
MGSLTFWDVTIEFALEEWQCLDMAQQNLYRNVMLENYRNLVFLGIAVSKLDLITCLKQGKEPWNMKRHEMVTKPPVISSHFTQDFWPDQSIKDSFQEIILRTYARCGHKNLRLRKDCESVNEGKMHEEAYNKLNQCWTTTQGKIFQCNKYVKVFHKYSNSNRYKIRHTKKKTFKCMKCSKSFFMLSHLIQHKRIHTRENIYKCEERGKAFKWFSTLIKHKIIHTEDKPYKYKKCGKAFNISSMFTKCKIIHTGKKPCKCEECGKVFNNSSTLMKHKIIHTGKKPYKCEECGKAFKQSSHLTRHKAIHTGEKPYKCEECGKAFNHFSALRKHQIIHTGKKPYKCEECGKAFSQSSTLRKHEIIHTEEKPYKYEECGKAFSNLSALRKHEIIHTGQKPYKCEECGKAFKWSSKLTVHKVIHTAEKPCKCEECGKAFKRFSALRKHKIIHTGKQPYKCEECSKAFSNFSALRKHEIIHTGEKPYKCEECGKAFKWSSKLTVHKVIHMEEKPCKCEECGKAFKHFSALRKHKIIHTGKKPYKCEECGKAFNNSSTLMKHKIIHTGKKPYKCEECGKAFKQSSHLTRHKAIHTGEKPYKCEECGKAFNHFSALRKHQIIHTGKKPYKCEECGKAFSQSSTLRKHEIIHTGEKPYKCEECGKAFKWSSHLTRHKVIHTEEKPYKCEECGKAFNHFSALRKHKIIHTGKKPYKCEECGKAFSQSSTLRKHEIIHTGEKPYKCEECGKAFKWSSKLTVHKVIHTAEKPCKCEECGKAFKHFSALRKHKIIHTGKKPYKCEECGKAFNNSSTLRKHEIIHTGEKSYKCEECGKAFQWSSKLTLHKVIHMERNPANVKNVAKLLNISQPLENMR

SEQ ID NO: 101644 - protein, 29 aa, Homo sapiens
  Payload ID: 20255
  Gene Name: zinc finger protein interacting with K protein 1
  ENSP ID: ENSP00000303820
MAAAALRAPTQVVAMEQRMKRHLLTRMFL

SEQ ID NO: 101645 - protein, 474 aa, Homo sapiens
  Payload ID: 20255
  Gene Name: zinc finger protein interacting with K protein 1
  ENSP ID: ENSP00000438487
MAAAALRAPTQGCVTFEDIAIYFSQDEWGLLDEAQRLLYLEVMLENFALVASLGCGHGTEDEETPSDQNVSVGVSQSKAGSSTQKTQSCEMCVPVLKDILHLADLPGQKPYLVGECTNHHQHQKHHSAKKSLKRDMDRASYVKCCLFCMSLKPFRKWEVGKDLPAMLRLLRSLVFPGGKKPGTITECGEDIRSQKSHYKSGECGKASRHKHTPVYHPRVYTGKKLYECSKCGKAFRGKYSLVQHQRVHTGERPWECNECGKFFSQTSHLNDHRRIHTGERPYECSECGKLFRQNSSLVDHQKIHTGARPYECSQCGKSFSQKATLVKHQRVHTGERPYKCGECGNSFSQSAILNQHRRIHTGAKPYECGQCGKSFSQKATLIKHQRVHTGERPYKCGDCGKSFSQSSILIQHRRIHTGARPYECGQCGKSFSQKSGLIQHQVVHTGERPYECNKCGNSFSQCSSLIHHQKCHNT

SEQ ID NO: 101646 - protein, 432 aa, Homo sapiens
  Payload ID: 20255
  Gene Name: zinc finger protein interacting with K protein 1
  Uniprot ID: Q3SY52
  ENSP ID: ENSP00000468937
MLENFALVASLGCGHGTEDEETPSDQNVSVGVSQSKAGSSTQKTQSCEMCVPVLKDILHLADLPGQKPYLVGECTNHHQHQKHHSAKKSLKRDMDRASYVKCCLFCMSLKPFRKWEVGKDLPAMLRLLRSLVFPGGKKPGTITECGEDIRSQKSHYKSGECGKASRHKHTPVYHPRVYTGKKLYECSKCGKAFRGKYSLVQHQRVHTGERPWECNECGKFFSQTSHLNDHRRIHTGERPYECSECGKLFRQNSSLVDHQKIHTGARPYECSQCGKSFSQKATLVKHQRVHTGERPYKCGECGNSFSQSAILNQHRRIHTGAKPYECGQCGKSFSQKATLIKHQRVHTGERPYKCGDCGKSFSQSSILIQHRRIHTGARPYECGQCGKSFSQKSGLIQHQVVHTGERPYECNKCGNSFSQCSSLIHHQKCHNT

SEQ ID NO: 101647 - protein, 107 aa, Homo sapiens
  Payload ID: 20255
  Gene Name: zinc finger protein interacting with K protein 1
  ENSP ID: ENSP00000469971
MAAAALRAPTQDEWGLLDEAQRLLYLEVMLENFALVASLGCGHGTEDEETPSDQNVSVGVSQSKAGSSTQKTQSCEMCVPVLKDILHLADLPGQKPYLVGECTNHHQ

SEQ ID NO: 101648 - protein, 30 aa, Homo sapiens
  Payload ID: 20255
  Gene Name: zinc finger protein interacting with K protein 1
  ENSP ID: ENSP00000470019
MDLTKGCVTFEDIAIYFSQDEWGLLDEAQR

SEQ ID NO: 101649 - protein, 110 aa, Homo sapiens
  Payload ID: 20255
  Gene Name: zinc finger protein interacting with K protein 1
  ENSP ID: ENSP00000472088
MDLTKGCVTFEDIAIYFSQDEWGLLDEAQRLLYLEVMLENFALVASLGCGHGTEDEETPSDQNVSVGVSQSKAGSSTQKTQSCEMCVPVLKDILHLADLPGQKPYLVGEC

SEQ ID NO: 101650 - protein, 487 aa, Homo sapiens
  Payload ID: 20255
  Gene Name: zinc finger protein interacting with K protein 1
  Uniprot ID: Q3SY52
  ENSP ID: ENSP00000472867
MAAAALRAPTQVTVSPETHMDLTKGCVTFEDIAIYFSQDEWGLLDEAQRLLYLEVMLENFALVASLGCGHGTEDEETPSDQNVSVGVSQSKAGSSTQKTQSCEMCVPVLKDILHLADLPGQKPYLVGECTNHHQHQKHHSAKKSLKRDMDRASYVKCCLFCMSLKPFRKWEVGKDLPAMLRLLRSLVFPGGKKPGTITECGEDIRSQKSHYKSGECGKASRHKHTPVYHPRVYTGKKLYECSKCGKAFRGKYSLVQHQRVHTGERPWECNECGKFFSQTSHLNDHRRIHTGERPYECSECGKLFRQNSSLVDHQKIHTGARPYECSQCGKSFSQKATLVKHQRVHTGERPYKCGECGNSFSQSAILNQHRRIHTGAKPYECGQCGKSFSQKATLIKHQRVHTGERPYKCGDCGKSFSQSSILIQHRRIHTGARPYECGQCGKSFSQKSGLIQHQVVHTGERPYECNKCGNSFSQCSSLIHHQKCHNT

SEQ ID NO: 101651 - protein, 1006 aa, Homo sapiens
  Payload ID: 20256
  Gene Name: zinc finger protein, FOG family member 1
  Uniprot ID: Q8IX07
  ENSP ID: ENSP00000326630
MSRRKQSNPRQIKRSLGDMEAREEVQLVGASHMEQKATAPEAPSPPSADVNSPPPLPPPTSPGGPKELEGQEPEPRPTEEEPGSPWSGPDELEPVVQDGQRRIRARLSLATGLSWGPFHGSVQTRASSPRQAEPSPALTLLLVDEACWLRTLPQALTEAEANTEIHRKDDALWCRVTKPVPAGGLLSVLLTAEPHSTPGHPVKKEPAEPTCPAPAHDLQLLPQQAGMASILATAVINKDVFPCKDCGIWYRSERNLQAHLLYYCASRQGTGSPAAAATDEKPKETYPNERVCPFPQCRKSCPSASSLEIHMRSHSGERPFVCLICLSAFTTKANCERHLKVHTDTLSGVCHSCGFISTTRDILYSHLVTNHMVCQPGSKGEIYSPGAGHPATKLPPDSLGSFQQQHTALQGPLASADLGLAPTPSPGLDRKALAEATNGEARAEPLAQNGGSSEPPAAPRSIKVEAVEEPEAAPILGPGEPGPQAPSRTPSPRSPAPARVKAELSSPTPGSSPVPGELGLAGALFLPQYVFGPDAAPPASEILAKMSELVHSRLQQGAGAGAGGAQTGLFPGAPKGATCFECEITFSNVNNYYVHKRLYCSGRRAPEDAPAARRPKAPPGPARAPPGQPAEPDAPRSSPGPGAREEGAGGAATPEDGAGGRGSEGSQSPGSSVDDAEDDPSRTLCEACNIRFSRHETYTVHKRYYCASRHDPPPRRPAAPPGPPGPAAPPAPSPAAPVRTRRRRKLYELHAAGAPPPPPPGHAPAPESPRPGSGSGSGPGLAPARSPGPAADGPIDLSKKPRRPLPGAPAPALADYHECTACRVSFHSLEAYLAHKKYSCPAAPPPGALGLPAAACPYCPPNGPVRGDLLEHFRLAHGLLLGAPLAGPGVEARTPADRGPSPAPAPAASPQPGSRGPRDGLGPEPQEPPPGPPPSPAAAPEAVPPPPAPPSYSDKGVQTPSKGTPAPLPNGNHRYCRLCNIKFSSLSTFIAHKKYYCSSHAAEHVK

SEQ ID NO: 101652 - protein, 151 aa, Homo sapiens
  Payload ID: 20256
  Gene Name: zinc finger protein, FOG family member 1
  ENSP ID: ENSP00000480412
MSRRKQSNPRQIKRSLGDMEAREEVQLVGASHMEQKATAPEAPSPPSADVNSPPPLPPPTSPGGPKELEGQEPEPRPTEEEPGSPWSGPDELEPVVQDGQRRIRARLSLATGLSWGPFHGSVQTRASSPRQAEPRGAISALAPSVQTHRTR

SEQ ID NO: 101653 - protein, 158 aa, Homo sapiens
  Payload ID: 20256
  Gene Name: zinc finger protein, FOG family member 1
  ENSP ID: ENSP00000482796
MSRRKQSNPRQIKRSLGDMEAREEVQLVGASHMEQKATAPEAPSPPSADVNSPPPLPPPTSPGGPKELEGQEPEPRPTEEEPGSPWSGPDELEPVVQDGQRRIRARLSLATGLSWGPFHGSVQTRASSPRQAEPMRKLRLQDVKSIAQIPRIKQQREK

SEQ ID NO: 101654 - protein, 117 aa, Homo sapiens
  Payload ID: 20256
  Gene Name: zinc finger protein, FOG family member 1
  ENSP ID: ENSP00000484216
MSRRKQSNPRQIKRSLGDMEAREEVQLVGASHMEQKATAPEAPSPPSADELEPVVQDGQRRIRARLSLATGLSWGPFHGSVQTRASSPRQAEPMRKLRLQDVKSIAQIPRIKQQREK

SEQ ID NO: 101655 - protein, 1151 aa, Homo sapiens
  Payload ID: 20257
  Gene Name: zinc finger protein, FOG family member 2
  Uniprot ID: Q8WW38
  ENSP ID: ENSP00000384179
MSRRKQSKPRQIKRPLEDAIEDEEEECPSEETDIISKGDFPLEESFSTEFGPENLSCEEVEYFCNKGDDEGIQETAESDGDTQSEKPGQPGVETDDWDGPGELEVFQKDGERKIQSRQQLPVGTTWGPFPGKMDLNNNSLKTKAQVPMVLTAGPKWLLDVTWQGVEDNKNNCIVYSKGGQLWCTTTKAISEGEELIAFVVDFDSRLQAASQMTLTEGMYPARLLDSIQLLPQQAAMASILPTAIVNKDIFPCKSCGIWYRSERNLQAHLMYYCSGRQREAAPVSEENEDSAHQISSLCPFPQCTKSFSNARALEMHLNSHSGVKMEEFLPPGASLKCTVCSYTADSVINFHQHLFSHLTQAAFRCNHCHFGFQTQRELLQHQELHVPSGKLPRESDMEHSPSATEDSLQPATDLLTRSELPQSQKAMQTKDASSDTELDKCEKKTQLFLTNQRPEIQPTTNKQSFSYTKIKSEPSSPRLASSPVQPNIGPSFPVGPFLSQFSFPQDITMVPQASEILAKMSELVHRRLRHGSSSYPPVIYSPLMPKGATCFECNITFNNLDNYLVHKKHYCSSRWQQMAKSPEFPSVSEKMPEALSPNTGQTSINLLNPAAHSADPENPLLQTSCINSSTVLDLIGPNGKGHDKDFSTQTKKLSTSSNNDDKINGKPVDVKNPSVPLVDGESDPNKTTCEACNITFSRHETYMVHKQYYCATRHDPPLKRSASNKVPAMQRTMRTRKRRKMYEMCLPEQEQRPPLVQQRFLDVANLNNPCTSTQEPTEGLGECYHPRCDIFPGIVSKHLETSLTINKCVPVSKCDTTHSSVSCLEMDVPIDLSKKCLSQSERTTTSPKRLLDYHECTVCKISFNKVENYLAHKQNFCPVTAHQRNDLGQLDGKVFPNPESERNSPDVSYERSIIKCEKNGNLKQPSPNGNLFSSHLATLQGLKVFSEAAQLIATKEENRHLFLPQCLYPGAIKKAKGADQLSPYYGIKPSDYISGSLVIHNTDIEQSRNAENESPKGQASSNGCAALKKDSLPLLPKNRGMVIVNGGLKQDERPAANPQQENISQNPQHEDDHKSPSWISENPLAANENVSPGIPSAEEQLSSIAKGVNGSSQAPTSGKYCRLCDIQFNNLSNFITHKKFYCSSHAAEHVK

SEQ ID NO: 101656 - protein, 26 aa, Homo sapiens
  Payload ID: 20257
  Gene Name: zinc finger protein, FOG family member 2
  ENSP ID: ENSP00000428149
MDLNNNSLKTKAQVPMVLTAGPKWLL

SEQ ID NO: 101657 - protein, 1019 aa, Homo sapiens
  Payload ID: 20257
  Gene Name: zinc finger protein, FOG family member 2
  ENSP ID: ENSP00000428720
MDLNNNSLKTKAQVPMVLTAGPKWLLDVTWQGVEDNKNNCIVYSKGGQLWCTTTKAISEGEELIAFVVDFDSRLQAASQMTLTEGMYPARLLDSIQLLPQQAAMASILPTAIVNKDIFPCKSCGIWYRSERNLQAHLMYYCSGRQREAAPVSEENEDSAHQISSLCPFPQCTKSFSNARALEMHLNSHSGVKMEEFLPPGASLKCTVCSYTADSVINFHQHLFSHLTQAAFRCNHCHFGFQTQRELLQHQELHVPSGKLPRESDMEHSPSATEDSLQPATDLLTRSELPQSQKAMQTKDASSDTELDKCEKKTQLFLTNQRPEIQPTTNKQSFSYTKIKSEPSSPRLASSPVQPNIGPSFPVGPFLSQFSFPQDITMVPQASEILAKMSELVHRRLRHGSSSYPPVIYSPLMPKGATCFECNITFNNLDNYLVHKKHYCSSRWQQMAKSPEFPSVSEKMPEALSPNTGQTSINLLNPAAHSADPENPLLQTSCINSSTVLDLIGPNGKGHDKDFSTQTKKLSTSSNNDDKINGKPVDVKNPSVPLVDGESDPNKTTCEACNITFSRHETYMVHKQYYCATRHDPPLKRSASNKVPAMQRTMRTRKRRKMYEMCLPEQEQRPPLVQQRFLDVANLNNPCTSTQEPTEGLGECYHPRCDIFPGIVSKHLETSLTINKCVPVSKCDTTHSSVSCLEMDVPIDLSKKCLSQSERTTTSPKRLLDYHECTVCKISFNKVENYLAHKQNFCPVTAHQRNDLGQLDGKVFPNPESERNSPDVSYERSIIKCEKNGNLKQPSPNGNLFSSHLATLQGLKVFSEAAQLIATKEENRHLFLPQCLYPGAIKKAKGADQLSPYYGIKPSDYISGSLVIHNTDIEQSRNAENESPKGQASSNGCAALKKDSLPLLPKNRGMVIVNGGLKQDERPAANPQQENISQNPQHEDDHKSPSWISENPLAANENVSPGIPSAEEQLSSIAKGVNGSSQAPTSGKYCRLCDIQFNNLSNFITHKKFYCSSHAAEHVK

SEQ ID NO: 101658 - protein, 1019 aa, Homo sapiens; identical to SEQ ID NO: 101657
  Payload ID: 20257
  Gene Name: zinc finger protein, FOG family member 2
  ENSP ID: ENSP00000430757

SEQ ID NO: 101659 - protein, 805 aa, Homo sapiens
  Payload ID: 20258
  Gene Name: zinc finger protein, X-linked
  Uniprot ID: P17010
  ENSP ID: ENSP00000304985
MDEDGLELQQEPNSFFDATGADGTHMDGDQIVVEVQETVFVSDVVDSDITVHNFVPDDPDSVVIQDVIEDVVIEDVQCPDIMEEADVSETVIIPEQVLDSDVTEEVSLAHCTVPDDVLASDITSASMSMPEHVLTGDSIHVSDVGHVGHVGHVEHVVHDSVVEAEIVTDPLTTDVVSEEVLVADCASEAVIDANGIPVDQQDDDKGNCEDYLMISLDDAGKIEHDGSSGMTMDTESEIDPCKVDGTCPEVIKVYIFKADPGEDDLGGTVDIVESEPENDHGVELLDQNSSIRVPREKMVYMTVNDSQPEDEDLNVAEIADEVYMEVIVGEEDAAAAAAAAAVHEQQMDDNEIKTFMPIAWAAAYGNNSDGIENRNGTASALLHIDESAGLGRLAKQKPKKRRRPDSRQYQTAIIIGPDGHPLTVYPCMICGKKFKSRGFLKRHMKNHPEHLAKKKYRCTDCDYTTNKKISLHNHLESHKLTSKAEKAIECDECGKHFSHAGALFTHKMVHKEKGANKMHKCKFCEYETAEQGLLNRHLLAVHSKNFPHICVECGKGFRHPSELKKHMRIHTGEKPYQCQYCEYRSADSSNLKTHVKTKHSKEMPFKCDICLLTFSDTKEVQQHALIHQESKTHQCLHCDHKSSNSSDLKRHIISVHTKDYPHKCDMCDKGFHRPSELKKHVAAHKGKKMHQCRHCDFKIADPFVLSRHILSVHTKDLPFRCKRCRKGFRQQSELKKHMKTHSGRKVYQCEYCEYSTTDASGFKRHVISIHTKDYPHRCEYCKKGFRRPSEKNQHIMRHHKEVGLP

SEQ ID NO: 101660 - protein, 755 aa, Homo sapiens
  Payload ID: 20258
  Gene Name: zinc finger protein, X-linked
  ENSP ID: ENSP00000343384
MDEDGLELQQEPNSFFDATGADGTHMDGDQIVVEVQETVFVSDVVDSDITVHNFVPDDPDSVVIQDVIEDVVIEDVQCPDIMEEADVSETVIIPEQVLDSDVTEEVSLAHCTVPDDVLASDITSASMSMPEHVLTGDSIHVSDVGHVGHVGHVEHVVHDSVVEAEIVTDPLTTDVVSEEVLVADCASEAVIDANGIPVDQQDDDKGNCEDYLMISCGTVDIVESEPENDHGVELLDQNSSIRVPREKMVYMTVNDSQPEDEDLNVAEIADEVYMEVIVGEEDAAAAAAAAAVHEQQMDDNEIKTFMPIAWAAAYGNNSDGIENRNGTASALLHIDESAGLGRLAKQKPKKRRRPDSRQYQTAIIIGPDGHPLTVYPCMICGKKFKSRGFLKRHMKNHPEHLAKKKYRCTDCDYTTNKKISLHNHLESHKLTSKAEKAIECDECGKHFSHAGALFTHKMVHKEKGANKMHKCKFCEYETAEQGLLNRHLLAVHSKNFPHICVECGKGFRHPSELKKHMRIHTGEKPYQCQYCEYRSADSSNLKTHVKTKHSKEMPFKCDICLLTFSDTKEVQQHALIHQESKTHQCLHCDHKSSNSSDLKRHIISVHTKDYPHKCDMCDKGFHRPSELKKHVAAHKGKKMHQCRHCDFKIADPFVLSRHILSVHTKDLPFRCKRCRKGFRQQSELKKHMKTHSGRKVYQCEYCEYSTTDASGFKRHVISIHTKDYPHRCEYCKKGFRRPSEKNQHIMRHHKEVGLP

SEQ ID NO: 101661 - protein, 805 aa, Homo sapiens; identical to SEQ ID NO: 101659
  Payload ID: 20258
  Gene Name: zinc finger protein, X-linked
  Uniprot ID: P17010
  ENSP ID: ENSP00000368475

SEQ ID NO: 101662 - protein, 844 aa, Homo sapiens
  Payload ID: 20258
  Gene Name: zinc finger protein, X-linked
  Uniprot ID: P17010
  ENSP ID: ENSP00000368486
MDEDGLELQQEPNSFFDATDRVSFCHPGWSTVAPSGSTATSASQAQVICSASRVTGATGADGTHMDGDQIVVEVQETVFVSDVVDSDITVHNFVPDDPDSVVIQDVIEDVVIEDVQCPDIMEEADVSETVIIPEQVLDSDVTEEVSLAHCTVPDDVLASDITSASMSMPEHVLTGDSIHVSDVGHVGHVGHVEHVVHDSVVEAEIVTDPLTTDVVSEEVLVADCASEAVIDANGIPVDQQDDDKGNCEDYLMISLDDAGKIEHDGSSGMTMDTESEIDPCKVDGTCPEVIKVYIFKADPGEDDLGGTVDIVESEPENDHGVELLDQNSSIRVPREKMVYMTVNDSQPEDEDLNVAEIADEVYMEVIVGEEDAAAAAAAAAVHEQQMDDNEIKTFMPIAWAAAYGNNSDGIENRNGTASALLHIDESAGLGRLAKQKPKKRRRPDSRQYQTAIIIGPDGHPLTVYPCMICGKKFKSRGFLKRHMKNHPEHLAKKKYRCTDCDYTTNKKISLHNHLESHKLTSKAEKAIECDECGKHFSHAGALFTHKMVHKEKGANKMHKCKFCEYETAEQGLLNRHLLAVHSKNFPHICVECGKGFRHPSELKKHMRIHTGEKPYQCQYCEYRSADSSNLKTHVKTKHSKEMPFKCDICLLTFSDTKEVQQHALIHQESKTHQCLHCDHKSSNSSDLKRHIISVHTKDYPHKCDMCDKGFHRPSELKKHVAAHKGKKMHQCRHCDFKIADPFVLSRHILSVHTKDLPFRCKRCRKGFRQQSELKKHMKTHSGRKVYQCEYCEYSTTDASGFKRHVISIHTKDYPHRCEYCKKGFRRPSEKNQHIMRHHKEVGLP

SEQ ID NO: 101663 - protein, 135 aa, Homo sapiens
  Payload ID: 20258
  Gene Name: zinc finger protein, X-linked
  ENSP ID: ENSP00000411637
MDEDGLELQQEPNSFFDATGADGTHMDGDQIVVEVQETVFVSDVVDSDITVHNFVPDDPDSVVIQDVIEDVVIEDVQCPDIMEEADVSETVIIPEQVLDSDVTEEVSLAHCTVPDDVLASDITSASMSMPEHVLT

SEQ ID NO: 101664 - protein, 31 aa, Homo sapiens
  Payload ID: 20258
  Gene Name: zinc finger protein, X-linked
  ENSP ID: ENSP00000416298
MDEDGLELQQEPNSFFDATGADGTHMDGDQI

SEQ ID NO: 101665 - protein, 576 aa, Homo sapiens
  Payload ID: 20258
  Gene Name: zinc finger protein, X-linked
  Uniprot ID: P17010
  ENSP ID: ENSP00000438233
MTMDTESEIDPCKVDGTCPEVIKVYIFKADPGEDDLGGTVDIVESEPENDHGVELLDQNSSIRVPREKMVYMTVNDSQPEDEDLNVAEIADEVYMEVIVGEEDAAAAAAAAAVHEQQMDDNEIKTFMPIAWAAAYGNNSDGIENRNGTASALLHIDESAGLGRLAKQKPKKRRRPDSRQYQTAIIIGPDGHPLTVYPCMICGKKFKSRGFLKRHMKNHPEHLAKKKYRCTDCDYTTNKKISLHNHLESHKLTSKAEKAIECDECGKHFSHAGALFTHKMVHKEKGANKMHKCKFCEYETAEQGLLNRHLLAVHSKNFPHICVECGKGFRHPSELKKHMRIHTGEKPYQCQYCEYRSADSSNLKTHVKTKHSKEMPFKCDICLLTFSDTKEVQQHALIHQESKTHQCLHCDHKSSNSSDLKRHIISVHTKDYPHKCDMCDKGFHRPSELKKHVAAHKGKKMHQCRHCDFKIADPFVLSRHILSVHTKDLPFRCKRCRKGFRQQSELKKHMKTHSGRKVYQCEYCEYSTTDASGFKRHVISIHTKDYPHRCEYCKKGFRRPSEKNQHIMRHHKEVGLP

SEQ ID NO: 101666 - protein, 801 aa, Homo sapiens
  Payload ID: 20259
  Gene Name: zinc finger protein, Y-linked
  Uniprot ID: P08048
  ENSP ID: ENSP00000155093
MDEDEFELQPQEPNSFFDGIGADATHMDGDQIVVEIQEAVFVSNIVDSDITVHNFVPDDPDSVVIQDVVEDVVIEEDVQCSDILEEADVSENVIIPEQVLDSDVTEEVSLPHCTVPDDVLASDITSTSMSMPEHVLTSESMHVCDIGHVEHMVHDSVVEAEIITDPLTSDIVSEEVLVADCAPEAVIDASGISVDQQDNDKASCEDYLMISLDDAGKIEHDGSTGVTIDAESEMDPCKVDSTCPEVIKVYIFKADPGEDDLGGTVDIVESEPENDHGVELLDQNSSIRVPREKMVYMTVNDSQQEDEDLNVAEIADEVYMEVIVGEEDAAVAAAAAAVHEQQIDEDEMKTFVPIAWAAAYGNNSDGIENRNGTASALLHIDESAGLGRLAKQKPKKKRRPDSRQYQTAIIIGPDGHPLTVYPCMICGKKFKSRGFLKRHMKNHPEHLAKKKYHCTDCDYTTNKKISLHNHLESHKLTSKAEKAIECDECGKHFSHAGALFTHKMVHKEKGANKMHKCKFCEYETAEQGLLNRHLLAVHSKNFPHICVECGKGFRHPSELRKHMRIHTGEKPYQCQYCEYRSADSSNLKTHIKTKHSKEMPFKCDICLLTFSDTKEVQQHTLVHQESKTHQCLHCDHKSSNSSDLKRHVISVHTKDYPHKCEMCEKGFHRPSELKKHVAVHKGKKMHQCRHCDFKIADPFVLSRHILSVHTKDLPFRCKRCRKGFRQQNELKKHMKTHSGRKVYQCEYCEYSTTDASGFKRHVISIHTKDYPHRCEYCKKGFRRPSEKNQHIMRHHKEVGLP

SEQ ID NO: 101667 - protein, 801 aa, Homo sapiens; identical to SEQ ID NO: 101666
  Payload ID: 20259
  Gene Name: zinc finger protein, Y-linked
  Uniprot ID: P08048
  ENSP ID: ENSP00000372525

SEQ ID NO: 101668 - protein, 91 aa, Homo sapiens
  Payload ID: 20259
  Gene Name: zinc finger protein, Y-linked
  ENSP ID: ENSP00000388814
MDEDEFELQPQEPNSFFDGIGADATHMDGDQIVVEIQEAVFVSNIVDSDITVHNFVPDDPDSVVIQDVVEDVVIEEDVQCSDILEEADVSE

SEQ ID NO: 101669 - protein, 724 aa, Homo sapiens
  Payload ID: 20259
  Gene Name: zinc finger protein, Y-linked
  Uniprot ID: P08048
  ENSP ID: ENSP00000393908
MDGDQIVVEIQEAVFVSNIVDSDITVHNFVPDDPDSVVIQDVVEDVVIEEDVQCSDILEEADVSENVIIPEQVLDSDVTEEVSLPHCTVPDDVLASDITSTSMSMPEHVLTSESMHVCDIGHVEHMVHDSVVEAEIITDPLTSDIVSEEVLVADCAPEAVIDASGISVDQQDNDKASCEDYLMISLDDAGKIEHDGSTGVTIDAESEMDPCKVDSTCPEVIKVYIFKADPGEDDLGGTVDIVESEPENDHGVELLDQNSSIRVPREKMVYMTVNDSQQEDEDLSNNSDGIENRNGTASALLHIDESAGLGRLAKQKPKKKRRPDSRQYQTAIIIGPDGHPLTVYPCMICGKKFKSRGFLKRHMKNHPEHLAKKKYHCTDCDYTTNKKISLHNHLESHKLTSKAEKAIECDECGKHFSHAGALFTHKMVHKEKGANKMHKCKFCEYETAEQGLLNRHLLAVHSKNFPHICVECGKGFRHPSELRKHMRIHTGEKPYQCQYCEYRSADSSNLKTHIKTKHSKEMPFKCDICLLTFSDTKEVQQHTLVHQESKTHQCLHCDHKSSNSSDLKRHVISVHTKDYPHKCEMCEKGFHRPSELKKHVAVHKGKKMHQCRHCDFKIADPFVLSRHILSVHTKDLPFRCKRCRKGFRQQNELKKHMKTHSGRKVYQCEYCEYSTTDASGFKRHVISIHTKDYPHRCEYCKKGFRRPSEKNQHIMRHHKEVGLP

SEQ ID NO: 101670 - protein, 610 aa, Homo sapiens
  Payload ID: 20259
  Gene Name: zinc finger protein, Y-linked
  Uniprot ID: P08048
  ENSP ID: ENSP00000485605
MDEDEFELQPQEPNSFFDGIVDDAGKIEHDGSTGVTIDAESEMDPCKVDSTCPEVIKVYIFKADPGEDDLGGTVDIVESEPENDHGVELLDQNSSIRVPREKMVYMTVNDSQQEDEDLNVAEIADEVYMEVIVGEEDAAVAAAAAAVHEQQIDEDEMKTFVPIAWAAAYGNNSDGIENRNGTASALLHIDESAGLGRLAKQKPKKKRRPDSRQYQTAIIIGPDGHPLTVYPCMICGKKFKSRGFLKRHMKNHPEHLAKKKYHCTDCDYTTNKKISLHNHLESHKLTSKAEKAIECDECGKHFSHAGALFTHKMVHKEKGANKMHKCKFCEYETAEQGLLNRHLLAVHSKNFPHICVECGKGFRHPSELRKHMRIHTGEKPYQCQYCEYRSADSSNLKTHIKTKHSKEMPFKCDICLLTFSDTKEVQQHTLVHQESKTHQCLHCDHKSSNSSDLKRHVISVHTKDYPHKCEMCEKGFHRPSELKKHVAVHKGKKMHQCRHCDFKIADPFVLSRHILSVHTKDLPFRCKRCRKGFRQQNELKKHMKTHSGRKVYQCEYCEYSTTDASGFKRHVISIHTKDYPHRCEYCKKGFRRPSEKNQHIMRHHKEVGLP

SEQ ID NO: 101671 - protein, 310 aa, Homo sapiens
  Payload ID: 20260
  Gene Name: zinc finger protein-like 1
  Uniprot ID: O95159
  ENSP ID: ENSP00000294258
MGLCKCPKRKVTNLFCFEHRVNVCEHCLVANHAKCIVQSYLQWLQDSDYNPNCRLCNIPLASRETTRLVCYDLFHWACLNERAAQLPRNTAPAGYQCPSCNGPIFPPTNLAGPVASALREKLATVNWARAGLGLPLIDEVVSPEPEPLNTSDFSDWSSFNASSTPGPEEVDSASAAPAFYSQAPRPPASPGRPEQHTVIHMGNPEPLTHAPRKVYDTRDDDRTPGLHGDCDDDKYRRRPALGWLARLLRSRAGSRKRPLTLLQRAGLLLLLGLLGFLALLALMSRLGRAAADSDPNLDPLMNPHIRVGPS

SEQ ID NO: 101672 - protein, 109 aa, Homo sapiens
  Payload ID: 20260
  Gene Name: zinc finger protein-like 1
  ENSP ID: ENSP00000415088
MGLCKCPKRKVTNLFCFEHRVNVCEHCLVANHAKCIVQSYLQWLQDSDYNPNCRLCNIPLASRETTRLVCYGEALAPRGDQASLRGQLGDWFPGPPQAAGQSLSLGLPQ

SEQ ID NO: 101673 - protein, 53 aa, Homo sapiens
  Payload ID: 20260
  Gene Name: zinc finger protein-like 1
  ENSP ID: ENSP00000432377
  MOD_RES (1)..(1): Any amino acid
XDYNPNCRLCNIPLASRETTRLVCYDSFLQIDEVVSPEPEPLNTSDFSDWSSF

SEQ ID NO: 101674 - protein, 172 aa, Homo sapiens
  Payload ID: 20260
  Gene Name: zinc finger protein-like 1
  ENSP ID: ENSP00000432529
MGLCKCPKRKVTNLFCFEHRVNVCEHCLCIVQSYLQWLQDSDYNPNCRLCNIPLASRETTRLVCYDLFHWACLNERAAQLPRNTAPAGYQCPSCNGPIFPPTNLAGPVASALREKLATVNWARAGLGLPLIDEVVSPEPEPLNTSDFSDWSSFNASSTPGPEEVDSASAAPA

SEQ ID NO: 101675 - protein, 65 aa, Homo sapiens
  Payload ID: 20260
  Gene Name: zinc finger protein-like 1
  ENSP ID: ENSP00000432833
MGLCKCPKRKVTNLFCFEHRVNVCEHCLVANHAKVGPSGERLSRALGGQGGIGFLQIHEGPRARM

SEQ ID NO: 101676 - protein, 65 aa, Homo sapiens; identical to SEQ ID NO: 101675
  Payload ID: 20260
  Gene Name: zinc finger protein-like 1
  ENSP ID: ENSP00000433673

SEQ ID NO: 101677 - protein, 188 aa, Homo sapiens
  Payload ID: 20260
  Gene Name: zinc finger protein-like 1
  ENSP ID: ENSP00000434454
MGLCKCPKRKVTNLFCFEHRVNVCEHCLVANHAKCIVQSYLQWLQDSDYNPNCRLCNIPLASRETTRLVCYDLFHWACLNERAAQLPRNTAPAGYQCPSCNGPIFPPTNLAGPVASALREKLATVNWARAGLGLPLIDEVVSPEPEPLNTSDFSDWSSFNASSTPGPEEVDSASAAPAFYSQAPRPPA

SEQ ID NO: 101678 - protein, 10 aa, Homo sapiens
  Payload ID: 20260
  Gene Name: zinc finger protein-like 1
  ENSP ID: ENSP00000434780
  MOD_RES (1)..(1): Any amino acid
XPGPPQAAGQ

SEQ ID NO: 101679 - protein, 80 aa, Homo sapiens
  Payload ID: 20260
  Gene Name: zinc finger protein-like 1
  ENSP ID: ENSP00000435677
MGLCKCPKRKVTNLFCFEHRVNVCEHCLVANHAKISFTGPASMNVLPSYPETRHLPAISAPAAMAPSSPQPTWLAPWPPH

SEQ ID NO: 101680 - protein, 207 aa, Homo sapiens
  Payload ID: 20260
  Gene Name: zinc finger protein-like 1
  ENSP ID: ENSP00000437090
MGLCKCPKRKVTNLFCFEHRVNVCEHCLVANHAKCIVQSYLQWLQDSDYNPNCRLCNIPLASRETTRLVCYDLFHWACLNERAAQLPRNTAPAGYQCPSCNGPIFPPTNLAGPVASALREKLATVNWARAGLGLPLIDEVVSPEPEPLNTSDFSDWSSFNASSTPGPEEVDSASAAPAFYSQAPRPPASPGRPEQHTVIHMGNPEPL

SEQ ID NO: 101681 - protein, 1074 aa, Homo sapiens
  Payload ID: 20261
  Gene Name: zinc finger RNA binding protein
  Uniprot ID: Q96KR1
  ENSP ID: ENSP00000265069
MIPICPVVSFTYVPSRLGEDAKMATGNYFGFTHSGAAAAAAAAQYSQQPASGVAYSHPTTVASYTVHQAPVAAHTVTAAYAPAAATVAVARPAPVAVAAAATAAAYGGYPTAHTATDYGYTQRQQEAPPPPPPATTQNYQDSYSYVRSTAPAVAYDSKQYYQQPTATAAAVAAAAQPQPSVAETYYQTAPKAGYSQGATQYTQAQQTRQVTAIKPATPSPATTTFSIYPVSSTVQPVAAAATVVPSYTQSATYSTTAVTYSGTSYSGYEAAVYSAASSYYQQQQQQQKQAAAAAAAAAATAAWTGTTFTKKAPFQNKQLKPKQPPKPPQIHYCDVCKISCAGPQTYKEHLEGQKHKKKEAALKASQNTSSSNSSTRGTQNQLRCELCDVSCTGADAYAAHIRGAKHQKVVKLHTKLGKPIPSTEPNVVSQATSSTAVSASKPTASPSSIAANNCTVNTSSVATSSMKGLTTTGNSSLNSTSNTKVSAVPTNMAAKKTSTPKINFVGGNKLQSTGNKAEDIKGTECVKSTPVTSAVQIPEVKQDTVSEPVTPASLAALQSDVQPVGHDYVEEVRNDEGKVIRFHCKLCECSFNDPNAKEMHLKGRRHRLQYKKKVNPDLQVEVKPSIRARKIQEEKMRKQMQKEEYWRRREEEERWRMEMRRYEEDMYWRRMEEEQHHWDDRRRMPDGGYPHGPPGPLGLLGVRPGMPPQPQGPAPLRRPDSSDDRYVMTKHATIYPTEEELQAVQKIVSITERALKLVSDSLSEHEKNKNKEGDDKKEGGKDRALKGVLRVGVLAKGLLLRGDRNVNLVLLCSEKPSKTLLSRIAENLPKQLAVISPEKYDIKCAVSEAAIILNSCVEPKMQVTITLTSPIIREENMREGDVTSGMVKDPPDVLDRQKCLDALAALRHAKWFQARANGLQSCVIIIRILRDLCQRVPTWSDFPSWAMELLVEKAISSASSPQSPGDALRRVFECISSGIILKGSPGLLDPCEKDPFDTLATMTDQQREDITSSAQFALRLLAFRQIHKVLGMDPLPQMSQRFNIHNNRKRRRDSDGVDGFEAEGKKDKKDYDNF

SEQ ID NO: 101682 - protein, 182 aa, Homo sapiens
  Payload ID: 20261
  Gene Name: zinc finger RNA binding protein
  ENSP ID: ENSP00000422300
  MOD_RES (1)..(1): Any amino acid
XGVRPGMPPQPQGPAPLRRPDSSDDRYVMTKHATIYPTEEELQAVQKIVSITERALKLVSDSLSEHEKNKNKEGDDKKEGGKDRALKGVLRVGVLAKGLLLRGDRNVNLVLLCSEKPSKTLLSRIAENLPKQLAVISPEKYDIKCAVSEAAIILNSCVEPKMQVTITLTSPIIREENMREGG

SEQ ID NO: 101683 - protein, 939 aa, Homo sapiens
  Payload ID: 20262
  Gene Name: zinc finger RNA binding protein 2
  Uniprot ID: Q9UPR6
  ENSP ID: ENSP00000262961
MATSQYFDFAQGGGPQYSAQPPTLPLPTVGASYTAQPTPGMDPAVNPAFPPAAPAGYGGYQPHSGQDFAYGSRPQEPVPTATTMATYQDSYSYGQSAAARSYEDRPYFQSAALQSGRMTAADSGQPGTQEACGQPSPHGSHSHAQPPQQAPIVESGQPASTLSSGYTYPTATGVQPESSASIVTSYPPPSYNPTCTAYTAPSYPNYDASVYSAASPFYPPAQPPPPPGPPQQLPPPPAPAGSGSSPRADSKPPLPSKLPRPKAGPRQLQLHYCDICKISCAGPQTYREHLGGQKHRKKEAAQKTGVQPNGSPRGVQAQLHCDLCAVSCTGADAYAAHIRGSKHQKVFKLHAKLGKPIPTLEPALATESPPGAEAKPTSPTGPSVCASSRPALAKRPVASKALCEGPPEPQAAGCRPQWGKPAQPKLEGPGAPTQGGSKEAPAGCSDAQPVGPEYVEEVFSDEGRVLRFHCKLCECSFNDLNAKDLHVRGRRHRLQYRKKVNPDLPIATEPSSRARKVLEERMRKQRHLAEERLEQLRRWHAERRRLEEEPPQDVPPHAPPDWAQPLLMGRPESPASAPLQPGRRPASSDDRHVMCKHATIYPTEQELLAVQRAVSHAERALKLVSDTLAEEDRGRREEEGDKRSSVAPQTRVLKGVMRVGILAKGLLLRGDRNVRLALLCSEKPTHSLLRRIAQQLPRQLQMVTEDEYEVSSDPEANIVISSCEEPRMQVTISVTSPLMREDPSTDPGVEEPQADAGDVLSPKKCLESLAALRHARWFQARASGLQPCVIVIRVLRDLCRRVPTWGALPAWAMELLVEKAVSSAAGPLGPGDAVRRVLECVATGTLLTDGPGLQDPCERDQTDALEPMTLQEREDVTASAQHALRMLAFRQTHKVLGMDLLPPRHRLGARFRKRQRGPGEGEEGAGEKKRGRRGGEGLV

SEQ ID NO: 101684 - protein, 70 aa, Homo sapiens
  Payload ID: 20262
  Gene Name: zinc finger RNA binding protein 2
  Uniprot ID: Q9UPR6
  ENSP ID: ENSP00000388567
MATSQYFDFAQGGGPQYSPEVETTPPALASGLPCALPWTVGCSGSDAVTALCPSLRGLACICSILWDPAW

SEQ ID NO: 101685 - protein, 366 aa, Homo sapiens
  Payload ID: 20262
  Gene Name: zinc finger RNA binding protein 2
  Uniprot ID: Q9UPR6
  ENSP ID: ENSP00000388974
MATSQYFDFAQGGGPQYSAQPPTLPLPTVGASYTAQPTPGMDPAVNPAFPPAAPAGYGGYQPHSGQDFAYGSRPQEPVPTATTMATYQDSYSYGQSAAARSYEDRPYFQSAALQSGRMTAADSGQPGTQEACGQPSPHGSHSHAQPPQQAPIVESGQPASTLSSGYTYPTATGVQPESSASIVTSYPPPSYNPTCTAYTAPSYPNYDASVYSAASPFYPPAQPPPPPGPPQQLPPPPAPAGSGSSPRADSKPPLPSKLPRPKAGPRQLQLHYCDICKISCAGPQTYREHLGGQKHRKKEAAQKTGVQPNGSPRGVQAQLHCDLCAVSCTGADAYAAHIRGSKHQKGLLSHRQQAADPSGGNQPNLN

SEQ ID NO: 101686 - protein, 44 aa, Homo sapiens
  Payload ID: 20262
  Gene Name: zinc finger RNA binding protein 2
  ENSP ID: ENSP00000465574
  MOD_RES (1)..(1): Any amino acid
XATSQYFDFAQGGGPQYSTLLEDGTLVWLFPAAVTAPMTAAGPH

SEQ ID NO: 101687 - protein, 44 aa, Homo sapiens
  Payload ID: 20262
  Gene Name: zinc finger RNA binding protein 2
  ENSP ID: ENSP00000467592
MATSQYFDFAQGGGPQYSTLLEDGTLVWLFPAAVTAPMTAAGPH

SEQ ID NO: 101688 - protein, 68 aa, Homo sapiens
  Payload ID: 20262
  Gene Name: zinc finger RNA binding protein 2
  ENSP ID: ENSP00000467762
MNLPPDRPGLLSLSVSPEVETTPPALASGLPCALPWTVGCSGSDAVTALCPSLRGLACICSILWDPAW

SEQ ID NO: 101689 - protein, 68 aa, Homo sapiens; identical to SEQ ID NO: 101688
  Payload ID: 20262
  Gene Name: zinc finger RNA binding protein 2
  ENSP ID: ENSP00000468289

SEQ ID NO: 101690 - protein, 563 aa, Homo sapiens
  Payload ID: 20263
  Gene Name: zinc finger with KRAB and SCAN domains 1
  Uniprot ID: P17029
  ENSP ID: ENSP00000323148
MMTAESREATGLSPQAAQEKDGIVIVKVEEEDEEDHMWGQDSTLQDTPPPDPEIFRQRFRRFCYQNTFGPREALSRLKELCHQWLRPEINTKEQILELLVLEQFLSILPKELQVWLQEYRPDSGEEAVTLLEDLELDLSGQQVPGQVHGPEMLARGMVPLDPVQESSSFDLHHEATQSHFKHSSRKPRLLQSRALPAAHIPAPPHEGSPRDQAMASALFTADSQAMVKIEDMAVSLILEEWGCQNLARRNLSRDNRQENYGSAFPQGGENRNENEESTSKAETSEDSASRGETTGRSQKEFGEKRDQEGKTGERQQKNPEEKTRKEKRDSGPAIGKDKKTITGERGPREKGKGLGRSFSLSSNFTTPEEVPTGTKSHRCDECGKCFTRSSSLIRHKIIHTGEKPYECSECGKAFSLNSNLVLHQRIHTGEKPHECNECGKAFSHSSNLILHQRIHSGEKPYECNECGKAFSQSSDLTKHQRIHTGEKPYECSECGKAFNRNSYLILHRRIHTREKPYKCTKCGKAFTRSSTLTLHHRIHARERASEYSPASLDAFGAFLKSCV

SEQ ID NO: 101691 - protein, 125 aa, Homo sapiens
  Payload ID: 20263
  Gene Name: zinc finger with KRAB and SCAN domains 1
  ENSP ID: ENSP00000394445
MMTAESREATGLSPQAAQEKDGIVIVKVEEEDEEDHMWGQDSTLQDTPPPDPEIFRQRFRRFCYQNTFGPREALSRLKELCHQWLRPEINTKEQILELLVLEQFLSILPKELQVWLQEYRPDSGE

SEQ ID NO: 101692 - protein, 527 aa, Homo sapiens
  Payload ID: 20263
  Gene Name: zinc finger with KRAB and SCAN domains 1
  ENSP ID: ENSP00000409172
MWGQDSTLQDTPPPDPEIFRQRFRRFCYQNTFGPREALSRLKELCHQWLRPEINTKEQILELLVLEQFLSILPKELQVWLQEYRPDSGEEAVTLLEDLELDLSGQQVPGQVHGPEMLARGMVPLDPVQESSSFDLHHEATQSHFKHSSRKPRLLQSRALPAAHIPAPPHEGSPRDQAMASALFTADSQAMVKIEDMAVSLILEEWGCQNLARRNLSRDNRQENYGSAFPQGGENRNENEESTSKAETSEDSASRGETTGRSQKEFGEKRDQEGKTGERQQKNPEEKTRKEKRDSGPAIGKDKKTITGERGPREKGKGLGRSFSLSSNFTTPEEVPTGTKSHRCDECGKCFTRSSSLIRHKIIHTGEKPYECSECGKAFSLNSNLVLHQRIHTGEKPHECNECGKAFSHSSNLILHQRIHSGEKPYECNECGKAFSQSSDLTKHQRIHTGEKPYECSECGKAFNRNSYLILHRRIHTREKPYKCTKCGKAFTRSSTLTLHHRIHARERASEYSPASLDAFGAFLKSCV

SEQ ID NO: 101693 - protein, 350 aa, Homo sapiens
  Payload ID: 20263
  Gene Name: zinc finger with KRAB and SCAN domains 1
  ENSP ID: ENSP00000443508
MASALFTADSQAMVKIEDMAVSLILEEWGCQNLARRNLSRDNRQENYGSAFPQGGENRNENEESTSKAETSEDSASRGETTGRSQKEFGEKRDQEGKTGERQQKNPEEKTRKEKRDSGPAIGKDKKTITGERGPREKGKGLGRSFSLSSNFTTPEEVPTGTKSHRCDECGKCFTRSSSLIRHKIIHTGEKPYECSECGKAFSLNSNLVLHQRIHTGEKPHECNECGKAFSHSSNLILHQRIHSGEKPYECNECGKAFSQSSDLTKHQRIHTGEKPYECSECGKAFNRNSYLILHRRIHTREKPYKCTKCGKAFTRSSTLTLHHRIHARERASEYSPASLDAFGAFLKSCV

SEQ ID NO: 101694 - protein, 527 aa, Homo sapiens; identical to SEQ ID NO: 101692
  Payload ID: 20263
  Gene Name: zinc finger with KRAB and SCAN domains 1
  ENSP ID: ENSP00000480305

SEQ ID NO: 101695 - protein, 967 aa, Homo sapiens
  Payload ID: 20264
  Gene Name: zinc finger with KRAB and SCAN domains 2
  Uniprot ID: Q63HK3
  ENSP ID: ENSP00000331626
MAVALDSQIDAPLEVEGCLIMKVEKDPEWASEPILEGSDSSETFRKCFRQFCYEDVTGPHEAFSKLWELCCRWLKPEMRSKEQILELLVIEQFLTILPEKIQAWAQKQCPQSGEEAVALVVHLEKETGRLRQQVSSPVHREKHSPLGAAWEVADFQPEQVETQPRAVSREEPGSLHSGHQEQLNRKRERRPLPKNARPSPWVPALADEWNTLDQEVTTTRLPAGSQEPVKDVHVARGFSYRKSVHQIPAQRDLYRDFRKENVGNVVSLGSAVSTSNKITRLEQRKEPWTLGLHSSNKRSILRSNYVKEKSVHAIQVPARSAGKTWREQQQWGLEDEKIAGVHWSYEETKTFLAILKESRFYETLQACPRNSQVYGAVAEWLRECGFLRTPEQCRTKFKSLQKSYRKVRNGHMLEPCAFFEDMDALLNPAARAPSTDKPKEMIPVPRLKRIAISAKEHISLVEEEEAAEDSDDDEIGIEFIRKSEIHGAPVLFQNLSGVHWGYEETKTFLDILRETRFYEALQACHRKSKLYGAVAEQLRECGFLRTPEQCRTKFKSLQKSYRKVKNGHVLESCAFYKEMDALINSRASAPSPSTPEEVPSPSRQERGGIEVEPQEPTGWEPEETSQEAVIEDSCSERMSEEEIVQEPEFQGPPGLLQSPNDFEIGSSIKEDPTQIVYKDMEQHRALIEKSKRVVSQSTDPSKYRKRECISGRQWENLQGIRQGKPMSQPRDLGKAVVHQRPFVGKRPYRLLKYGESFGRSTRLMCRMTHHKENPYKCGVCGKCFGRSRSLIRHQRIHTGEKPFKCLDCGKSFNDSSNFGAHQRIHTGEKPYRCGECGKCFSQSSSLIIHQRTHTGEKPYQCGECGKSFTNSSHFSAHRRVHTGENPYKCVDCEKSFNNCTRFREHRRIHTGEKPYGCAQCGKRFSKSSVLTKHREVHVREKPLPHPPSLYCPENPHKGKTDEFRKTF

SEQ ID NO: 101696 - protein, 232 aa, Homo sapiens
  Payload ID: 20264
  Gene Name: zinc finger with KRAB and SCAN domains 2
  ENSP ID: ENSP00000455586
MAVALDSQIDAPLEVEGCLIMKVEKDPEWASEPILEGSDSSETFRKCFRQFCYEDVTGPHEAFSKLWELCCRWLKPEMRSKEQILELLVIEQFLTILPEKIQAWAQKQCPQSGEEAVALVVHLEKETGRLRQQVSSPVHREKHSPLGAAWEVADFQPEQVETQPRAVSREEPGSLHSGHQEQLNRKRERRPLPKNARPSPWVPALADEWNTLDQEVTTTRLPAGSQCHYRNQ

SEQ ID NO: 101697 - protein, 538 aa, Homo sapiens
  Payload ID: 20265
  Gene Name: zinc finger with KRAB and SCAN domains 3
  Uniprot ID: Q9BRR0
  ENSP ID: ENSP00000252211
MARELSESTALDAQSTEDQMELLVIKVEEEEAGFPSSPDLGSEGSRERFRGFRYPEAAGPREALSRLRELCRQWLQPEMHSKEQILELLVLEQFLTILPGNLQSWVREQHPESGEEVVVLLEYLERQLDEPAPQVSGVDQGQELLCCKMALLTPAPGSQSSQFQLMKALLKHESVGSQPLQDRVLQVPVLAHGGCCREDKVVASRLTPESQGLLKVEDVALTLTPEWTQQDSSQGNLCRDEKQENHGSLVSLGDEKQTKSRDLPPAEELPEKEHGKISCHLREDIAQIPTCAEAGEQEGRLQRKQKNATGGRRHICHECGKSFAQSSGLSKHRRIHTGEKPYECEECGKAFIGSSALVIHQRVHTGEKPYECEECGKAFSHSSDLIKHQRTHTGEKPYECDDCGKTFSQSCSLLEHHRIHTGEKPYQCSMCGKAFRRSSHLLRHQRIHTGDKNVQEPEQGEAWKSRMESQLENVETPMSYKCNECERSFTQNTGLIEHQKIHTGEKPYQCNACGKGFTRISYLVQHQRSHVGKNILSQ

SEQ ID NO: 101698 - protein, 390 aa, Homo sapiens
  Payload ID: 20265
  Gene Name: zinc finger with KRAB and SCAN domains 3
  Uniprot ID: Q9BRR0
  ENSP ID: ENSP00000341883
MALLTPAPGSQSSQFQLMKALLKHESVGSQPLQDRVLQVPVLAHGGCCREDKVVASRLTPESQGLLKVEDVALTLTPEWTQQDSSQGNLCRDEKQENHGSLVSLGDEKQTKSRDLPPAEELPEKEHGKISCHLREDIAQIPTCAEAGEQEGRLQRKQKNATGGRRHICHECGKSFAQSSGLSKHRRIHTGEKPYECEECGKAFIGSSALVIHQRVHTGEKPYECEECGKAFSHSSDLIKHQRTHTGEKPYECDDCGKTFSQSCSLLEHHRIHTGEKPYQCSMCGKAFRRSSHLLRHQRIHTGDKNVQEPEQGEAWKSRMESQLENVETPMSYKCNECERSFTQNTGLIEHQKIHTGEKPYQCNACGKGFTRISYLVQHQRSHVGKNILSQ

SEQ ID NO: 101699 - protein, 538 aa, Homo sapiens; identical to SEQ ID NO: 101697
  Payload ID: 20265
  Gene Name: zinc finger with KRAB and SCAN domains 3
  Uniprot ID: Q9BRR0
  ENSP ID: ENSP00000366465

SEQ ID NO: 101700 - protein, 545 aa, Homo sapiens
  Payload ID: 20266
  Gene Name: zinc finger with KRAB and SCAN domains 4
  Uniprot ID: Q969J2
  ENSP ID: ENSP00000366509
MAREPRKNAALDAQSAEDQTGLLTVKVEKEEASALTAEVRAPCSPARGPERSRQRFRGFRYPEAAGPREALSRLRELCGQWLQPEMHSKEQILELLVLEQFLTILPGNLQSWVREQHPESGEEVVVLLEYLERQLDEPAPQVPVGDQGQELLCCKMALLTQTQGSQSSQCQPMKALFKHESLGSQPLHDRVLQVPGLAQGGCCREDAMVASRLTPGSQGLLKMEDVALTLTPGWTQLDSSQVNLYRDEKQENHSSLVSLGGEIQTKSRDLPPVKKLPEKEHGKICHLREDIAQIPTHAEAGEQEGRLQRKQKNAIGSRRHYCHECGKSFAQSSGLTKHRRIHTGEKPYECEDCGKTFIGSSALVIHQRVHTGEKPYECEECGKVFSHSSNLIKHQRTHTGEKPYECDDCGKTFSQSCSLLEHHKIHTGEKPYQCNMCGKAFRRNSHLLRHQRIHGDKNVQNPEHGESWESQGRTESQWENTEAPVSYKCNECERSFTRNRSLIEHQKIHTGEKPYQCDTCGKGFTRTSYLVQHQRSHVGKKTLSQ

SEQ ID NO: 101701 - protein, 839 aa, Homo sapiens
  Payload ID: 20267
  Gene Name: zinc finger with KRAB and SCAN domains 5
  Uniprot ID: Q9Y2L8
  ENSP ID: ENSP00000322872
MIMTESREVIDLDPPAETSQEQEDLFIVKVEEEDCTWMQEYNPPTFETFYQRFRHFQYHEASGPREALSQLRVLCCEWLRPELHTKEQILELLVLEQFLTILPEEFQPWVREHHPESGEEAVAVIENIQRELEERRQQIVACPDVLPRKMATPGAVQESCSPHPLTVDTQPEQAPQKPRLLEENALPVLQVPSLPLKDSQELTASLLSTGSQKLVKIEEVADVAVSFILEEWGHLDQSQKSLYRDDRKENYGSITSMGYESRDNMELIVKQISDDSESHWVAPEHTERSVPQDPDFAEVSDLKGMVQRWQVNPTVGKSRQNPSQKRDLDAITDISPKQSTHGERGHRCSDCGKFFLQASNFIQHRRIHTGEKPFKCGECGKSYNQRVHLTQHQRVHTGEKPYKCQVCGKAFRVSSHLVQHHSVHSGERPYGCNECGKNFGRHSHLIEHLKRHFREKSQRCSDKRSKNTKLSVKKKISEYSEADMELSGKTQRNVSQVQDFGEGCEFQGKLDRKQGIPMKEILGQPSSKRMNYSEVPYVHKKSSTGERPHKCNECGKSFIQSAHLIQHQRIHTGEKPFRCEECGKSYNQRVHLTQHQRVHTGEKPYTCPLCGKAFRVRSHLVQHQSVHSGERPFKCNECGKGFGRRSHLAGHLRLHSREKSHQCRECGEIFFQYVSLIEHQVLHMGQKNEKNGICEEAYSWNLTVIEDKKIELQEQPYQCDICGKAFGYSSDLIQHYRTHTAEKPYQCDICRENVGQCSHTKQHQKIYSSTKSHQCHECGRGFTLKSHLNQHQRIHTGEKPFQCKECGMNFSWSCSLFKHLRSHERTDPINTLSVEGSLL

SEQ ID NO: 101702 - protein, 839 aa, Homo sapiens; identical to SEQ ID NO: 101701
  Payload ID: 20267
  Gene Name: zinc finger with KRAB and SCAN domains 5
  Uniprot ID: Q9Y2L8
  ENSP ID: ENSP00000377725

SEQ ID NO: 101703 - protein, 839 aa, Homo sapiens; identical to SEQ ID NO: 101701
  Payload ID: 20267
  Gene Name: zinc finger with KRAB and SCAN domains 5
  Uniprot ID: Q9Y2L8
  ENSP ID: ENSP00000392104

SEQ ID NO: 101704 - protein, 222 aa, Homo sapiens
  Payload ID: 20267
  Gene Name: zinc finger with KRAB and SCAN domains 5
  ENSP ID: ENSP00000405716
MIMTESREVIDLDPPAETSQEQEDLFIVKVEEEDCTWMQEYNPPTFETFYQRFRHFQYHEASGPREALSQLRVLCCEWLRPELHTKEQILELLVLEQFLTILPEEFQPWVREHHPESGEEAVAVIENIQRELEERRQQIVACPDVLPRKMATPGAVQESCSPHPLTVDTQPEQAPQKPRLLEENALPVLQVPSLPLKDSQELTASLLSTGSQVMSPGTIWSS

SEQ ID NO: 101705 - protein, 754 aa, Homo sapiens
  Payload ID: 20268
  Gene Name: zinc finger with KRAB and SCAN domains 7
  Uniprot ID: Q9P0L1
  ENSP ID: ENSP00000273320
MTTAGRGNLGLIPRSTAFQKQEGRLTVKQEPANQTWGQGSSLQKNYPPVCEIFRLHFRQLCYHEMSGPQEALSRLRELCRWWLMPEVHTKEQILELLVLEQFLSILPGELRTWVQLHHPESGEEAVAVVEDFQRHLSGSEEVSAPAQKQEMHFEETTALGTTKESPPTSPLSGGSAPGAHLEPPYDPGTHHLPSGDFAQCTSPVPTLPQVGNSGDQAGATVLRMVRPQDTVAYEDLSVDYTQKKWKSLTLSQRALQWNMMPENHHSMASLAGENMMKGSELTPKQEFFKGSESSNRTSGGLFGVVPGAAETGDVCEDTFKELEGQTSDEEGSRLENDFLEITDEDKKKSTKDRYDKYKEVGEHPPLSSSPVEHEGVLKGQKSYRCDECGKAFNRSSHLIGHQRIHTGEKPYECNECGKTFRQTSQLIVHLRTHTGEKPYECSECGKAYRHSSHLIQHQRLHNGEKPYKCNECAKAFTQSSRLTDHQRTHTGEKPYECNECGEAFIRSKSLARHQVLHTGKKPYKCNECGRAFCSNRNLIDHQRIHTGEKPYECSECGKAFSRSKCLIRHQSLHTGEKPYKCSECGKAFNQNSQLIEHERIHTGEKPFECSECGKAFGLSKCLIRHQRLHTGEKPYKCNECGKSFNQNSHLIIHQRIHTGEKPYECNECGKVFSYSSSLMVHQRTHTGEKPYKCNDCGKAFSDSSQLIVHQRVHTGEKPYECSECGKAFSQRSTFNHHQRTHTGEKSSGLAWSVS

SEQ ID NO: 101706 - protein, 276 aa, Homo sapiens
  Payload ID: 20268
  Gene Name: zinc finger with KRAB and SCAN domains 7
  Uniprot ID: Q9P0L1
  ENSP ID: ENSP00000345404
MTTAGRGNLGLIPRSTAFQKQEGRLTVKQEPANQTWGQGSSLQKNYPPVCEIFRLHFRQLCYHEMSGPQEALSRLRELCRWWLMPEVHTKEQILELLVLEQFLSILPGELRTWVQLHHPESGEEAVAVVEDFQRHLSGSEEVSAPAQKQEMHFEETTALGTTKESPPTSPLSGGSAPGAHLEPPYDPGTHHLPSGDFAQCTSPVPTLPQVGNSGDQAGATVLRMVRPQDTVAYEDLSVDYTQKKWKSLTLSQRALQWNMMPENHHSMASLGWSTMA

SEQ ID NO: 101707 - protein, 121 aa, Homo sapiens
  Payload ID: 20268
  Gene Name: zinc finger with KRAB and SCAN domains 7
  ENSP ID: ENSP00000389243
PPTSPLSGGSAPGAHLEPPYDPGTHHLPSGDFAQCTSPVPTLPQVGNSGDQAGATVLRMVRPQDTVAYEDLSVDYTQKKWKSLTLSQRALQWNMMPENHHSMASLDGETGTEEELIPKHHS

SEQ ID NO: 101708 - protein, 754 aa, Homo sapiens; identical to SEQ ID NO: 101705
  Payload ID: 20268
  Gene Name: zinc finger with KRAB and SCAN domains 7
  Uniprot ID: Q9P0L1
  ENSP ID: ENSP00000395524

SEQ ID NO: 101709 - protein, 373 aa, Homo sapiens
  Payload ID: 20268
  Gene Name: zinc finger with KRAB and SCAN domains 7
  ENSP ID: ENSP00000405034
MHFEETTALGTTKESPPTSPLSGGSAPGAHLEPPYDPGTHHLPSGDFAQCTSPVPTLPQVGNSGDQAGATVLRMVRPQDTVAYEDLSVDYTQKKWKSLTLSQRALQWNMMPENHHSMASLGENMMKGSELTPKQEFFKGSESSNRTSGGLFGVVPGAAETGDVCEDTFKELEGQTSDEEGSRLENDFLEITDEDKKKSTKDRYDKYKEVGEHPPLSSSPVEHEGVLKGQKSYRCDECGKAFNRSSHLIGHQRIHTGEKPYECNECGKTFRQTSQLIVHLRTHTGEKPYECSECGKAYRHSSHLIQHQRLHNGEKPYKCNECAKAFTQSSRLTDHQRTHTGEKPYECNECGEAFIRSKSLARHQVLHTGWSTMA

SEQ ID NO: 101710 - protein, 202 aa, Homo sapiens
  Payload ID: 20268
  Gene Name: zinc finger with KRAB and SCAN domains 7
  ENSP ID: ENSP00000415710
MTTAGRGNLGLIPRSTAFQKQEGRLTVKQEPANQTWGQGSSLQKNYPPVCEIFRLHFRQLCYHEMSGPQEALSRLRELCRWWLMPEVHTKEQILELLVLEQFLSILPGELRTWVQLHHPESGEEAVAVVEDFQRHLSGSEEVSAPAQKQEMHFEETTALGTTKESPPTSPLSGGSAPGAHLEPPYDPGTHHLPSGDFGYCGI

SEQ ID NO: 101711 - protein, 276 aa, Homo sapiens; identical to SEQ ID NO: 101706
  Payload ID: 20268
  Gene Name: zinc finger with KRAB and SCAN domains 7
  Uniprot ID: Q9P0L1
  ENSP ID: ENSP00000416681

SEQ ID NO: 101712 - protein, 373 aa, Homo sapiens; identical to SEQ ID NO: 101709
  Payload ID: 20268
  Gene Name: zinc finger with KRAB and SCAN domains 7
  ENSP ID: ENSP00000485833

SEQ ID NO: 101713 - protein, 754 aa, Homo sapiens; identical to SEQ ID NO: 101705
  Payload ID: 20268
  Gene Name: zinc finger with KRAB and SCAN domains 7
  Uniprot ID: Q9P0L1
  ENSP ID: ENSP00000485942

SEQ ID NO: 101714 - protein, 754 aa, Homo sapiens; identical to SEQ ID NO: 101705
  Payload ID: 20268
  Gene Name: zinc finger with KRAB and SCAN domains 7
  Uniprot ID: Q9P0L1
  ENSP ID: ENSP00000485948

SEQ ID NO: 101715 - protein, 276 aa, Homo sapiens; identical to SEQ ID NO: 101706
  Payload ID: 20268
  Gene Name: zinc finger with KRAB and SCAN domains 7
  Uniprot ID: Q9P0L1
  ENSP ID: ENSP00000486331

SEQ ID NO: 101716 - protein, 276 aa, Homo sapiens; identical to SEQ ID NO: 101706
  Payload ID: 20268
  Gene Name: zinc finger with KRAB and SCAN domains 7
  Uniprot ID: Q9P0L1
  ENSP ID: ENSP00000486642

SEQ ID NO: 101717 - protein, 121 aa, Homo sapiens; identical to SEQ ID NO: 101707
  Payload ID: 20268
  Gene Name: zinc finger with KRAB and SCAN domains 7
  ENSP ID: ENSP00000486803

SEQ ID NO: 101718 - protein, 202 aa, Homo sapiens; identical to SEQ ID NO: 101710
  Payload ID: 20268
  Gene Name: zinc finger with KRAB and SCAN domains 7
  ENSP ID: ENSP00000487540

SEQ ID NO: 101719 - protein, 578 aa, Homo sapiens
  Payload ID: 20269
  Gene Name: zinc finger with KRAB and SCAN domains 8
  Uniprot ID: Q15776
  ENSP ID: ENSP00000332750
MAEESRKPSAPSPPDQTPEEDLVIVKVEEDHGWDQESSLHESNPLGQEVFRLRFRQLRYQETLGPREALIQLRALCHQWLRPDLNTKEQILELLVLEQFLTILPEELQTLVKEHQLENGEEVVTLLEDLERQIDILGRPVSARVHGHRVLWEEVVHSASAPEPPNTQLQSEATQHKSPVPQESQERAMSTSQSPTRSQKGSSGDQEMTATLLTAGFQTLEKIEDMAVSLIREEWLLDPSQKDLCRDNRPENFRNMFSLGGETRSENRELASKQVISTGIQPHGETAAKCNGDVIRGLEHEEARDLLGRLERQRGNPTQERRHKCDECGKSFAQSSGLVRHWRIHTGEKPYQCNVCGKAFSYRSALLSHQDIHNKVKRYHCKECGKAFSQNTGLILHQRIHTGEKPYQCNQCGKAFSQSAGLILHQRIHSGERPYECNECGKAFSHSSHLIGHQRIHTGEKPYECDECGKTFRRSSHLIGHQRSHTGEKPYKCNECGRAFSQKSGLIEHQRIHTGERPYKCKECGKAFNGNTGLIQHLRIHTGEKPYQCNECGKAFIQRSSLIRHQRIHSGEKSESISV

SEQ ID NO: 101720 - protein, 578 aa, Homo sapiens; identical to SEQ ID NO: 101719
  Payload ID: 20269
  Gene Name: zinc finger with KRAB and SCAN domains 8
  Uniprot ID: Q15776
  ENSP ID: ENSP00000402948

SEQ ID NO: 101721 - protein, 158 aa, Homo sapiens
  Payload ID: 20269
  Gene Name: zinc finger with KRAB and SCAN domains 8
  Uniprot ID: Q15776
  ENSP ID: ENSP00000439117
MAEESRKPSAPSPPDQTPEEDLVIVKVEEDHGWDQESSLHESNPLGQEVFRLRFRQLRYQETLGPREALIQLRALCHQWLRPDLNTKEQILELLVLEQFLTILPEELQTLVKEHQLENGEEVVTLLEDLERQIDILGRPVSRRRSQLAYMDIGYSGRR

SEQ ID NO: 101722 - protein, 158 aa, Homo sapiens; identical to SEQ ID NO: 101721
  Payload ID: 20269
  Gene Name: zinc finger with KRAB and SCAN domains 8
  Uniprot ID: Q15776
  ENSP ID: ENSP00000475589

SEQ ID NO: 101723 - protein, 280 aa, Homo sapiens
  Payload ID: 20270
  Gene Name: zinc finger with UFM1-specific peptidase domain
  ENSP ID: ENSP00000357562
MLSCNICGETVTSEPDMKAHLIVHMESEIICPFCKLSGVNYDEMCFHIETAHFEQNTLERNFERINTVQYGTSDNKKDNTLQCGMEVNSSILSGCASNHPKNSAQNLTKDSTLKHEGFYSENLTESRKFLKSREKQSSLTEIKGSVYETTYSPPECPFCGKIEEHSEDMETHVKTKHANLLDIPLEDCDQPLYDCPMCGLICTNYHILQEHVDLHLEENSFQQGMDRVQCSGDLQLAHQLQQEEDRKRRSEESRQEIEEFQKLQELLKHFIGIIRMLPQM

SEQ ID NO: 101724 - protein, 578 aa, Homo sapiens
  Payload ID: 20270
  Gene Name: zinc finger with UFM1-specific peptidase domain
  Uniprot ID: Q96AP4
  ENSP ID: ENSP00000357565
MLSCNICGETVTSEPDMKAHLIVHMESEIICPFCKLSGVNYDEMCFHIETAHFEQNTLERNFERINTVQYGTSDNKKDNTLQCGMEVNSSILSGCASNHPKNSAQNLTKDSTLKHEGFYSENLTESRKFLKSREKQSSLTEIKGSVYETTYSPPECPFCGKIEEHSEDMETHVKTKHANLLDIPLEDCDQPLYDCPMCGLICTNYHILQEHVDLHLEENSFQQGMDRVQCSGDLQLAHQLQQEEDRKRRSEESRQEIEEFQKLQRQYGLDNSGGYKQQQLRNMEIEVNRGRMPPSEFHRRKADMMESLALGFDDGKTKTSGIIEALHRYYQNAATDVRRVWLSSVVDHFHSSLGDKGWGCGYRNFQMLLSSLLQNDAYNDCLKGMLIPCIPKIQSMIEDAWKEGFDPQGASQLNNRLQGTKAWIGACEVYILLTSLRVKCHIVDFHKSTGPLGTHPRLFEWILNYYSSEGEGSPKVVCTSKPPIYLQHQGHSRTVIGIEEKKNRTLCLLILDPGCPSREMQKLLKQDIEASSLKQLRKSMGNLKHKQYQILAVEGALSLEEKLARRQASQVFTAEKIP

SEQ ID NO: 101725 - protein, 268 aa, Homo sapiens
  Payload ID: 20271
  Gene Name: zinc finger, AN1-type domain 1
  Uniprot ID: Q8TCF1
  ENSP ID: ENSP00000220669
MAELDIGQHCQVEHCRQRDFLPFVCDDCSGIFCLEHRSRESHGCPEVTVINERLKTDQHTSYPCSFKDCAERELVAVICPYCEKNFCLRHRHQSDHECEKLEIPKPRMAATQKLVKDIIDSKTGETASKRWKGAKNSETAAKVALMKLKMHADGDKSLPQTERIYFQVFLPKGSKEKSKPMFFCHRWSIGKAIDFAASLARLKNDNNKFTAKKLRLCHITSGEALPLDHTLETWIAKEDCPLYNGGNIILEYLNDEEQFCKNVESYLE

SEQ ID NO: 101726 - protein, 53 aa, Homo sapiens
  Payload ID: 20271
  Gene Name: zinc finger, AN1-type domain 1
  ENSP ID: ENSP00000427811
MAATQKLVKDIIDSKTGETASKRWKGAKNSETAAKVALMKLKMHADGDKSLPQ

SEQ ID NO: 101727 - protein, 61 aa, Homo sapiens
  Payload ID: 20271
  Gene Name: zinc finger, AN1-type domain 1
  ENSP ID: ENSP00000427957
MAATQKLVKDIIDSKTGETASKRWKGAKNSETAAKVALMKLKMHADGDKSLPQTERIYFQV

SEQ ID NO: 101728 - protein, 97 aa, Homo sapiens
  Payload ID: 20271
  Gene Name: zinc finger, AN1-type domain 1
  ENSP ID: ENSP00000428101
MAATQKLVKDIIDSKTGETASKRWKGAKNSETAAKVALMKLKMHADGDKSLPQTERIYFQVFLPKGSKEKSKPMFFCHRWSIGKAIDFAASLARLKN

SEQ ID NO: 101729 - protein, 161 aa, Homo sapiens
  Payload ID: 20271
  Gene Name: zinc finger, AN1-type domain 1
  Uniprot ID: Q8TCF1
  ENSP ID: ENSP00000428139
MAATQKLVKDIIDSKTGETASKRWKGAKNSETAAKVALMKLKMHADGDKSLPQTERIYFQVFLPKGSKEKSKPMFFCHRWSIGKAIDFAASLARLKNDNNKFTAKKLRLCHITSGEALPLDHTLETWIAKEDCPLYNGGNIILEYLNDEEQFCKNVESYLE

SEQ ID NO: 101730 - protein, 118 aa, Homo sapiens
  Payload ID: 20271
  Gene Name: zinc finger, AN1-type domain 1
  ENSP ID: ENSP00000428278
MAATQKLVKDIIDSKTGETASKRWKGAKNSETAAKVALMKLKMHADGDKSLPQTERIYFQVFLPKGSKEKSKPMFFCHRWSIGKAIDFAASLARLKNDNNKFTAKKLRLCHITSGEAL

SEQ ID NO: 101731 - protein, 165 aa, Homo sapiens
  Payload ID: 20271
  Gene Name: zinc finger, AN1-type domain 1
  ENSP ID: ENSP00000428375
MAELDIGQHCQVEHCRQRDFLPFVCDDCSGIFCLEHRSRESHGCPEVTVINERLKTDQHTSYPCSFKDCAERELVAVICPYCEKNFCLRHRHQSDHECEKLEIPKPRMAATQKLVKDIIDSKTGETASKRWKGAKNSETAAKVALMKLKMHADGDKSLPQMSNLE

SEQ ID NO: 101732 - protein, 43 aa, Homo sapiens
  Payload ID: 20271
  Gene Name: zinc finger, AN1-type domain 1
  ENSP ID: ENSP00000428527
MAATQKLVKDIIDSKTGETASKRWKGAKNSETAAKVALMKLKM

SEQ ID NO: 101733 - protein, 58 aa, Homo sapiens
  Payload ID: 20271
  Gene Name: zinc finger, AN1-type domain 1
  ENSP ID: ENSP00000428927
MAATQKLVKDIIDSKTGETASKRWKGAKNSETAAKVALMKLKMHADGDKSLPQMSNLE

SEQ ID NO: 101734 - protein, 227 aa, Homo sapiens
  Payload ID: 20271
  Gene Name: zinc finger, AN1-type domain 1
  Uniprot ID: Q8TCF1
  ENSP ID: ENSP00000429167
MAELDIGQHCQVEHCRQRDFLPFVCDDCSGIFCLEHRSRESHGCPEVTVINERLKTDQHTSYPCSFKDCAERELVAVICPYCEKNFCLRHRHQSDHECEKLEIPKPRMAATQKLVKDIIDSKTGETASKRWKGAKNSETAAKVALMKLKMHADGDKSLPQTERIYFQVFLPKGSKEKSKPMFFCHRWSIGKAIDFAASLARLKNDNNKFTAKVTSHYNNISILIKVL

SEQ ID NO: 101735 - protein, 126 aa, Homo sapiens
  Payload ID: 20271
  Gene Name: zinc finger, AN1-type domain 1
  ENSP ID: ENSP00000429527
MAATQKLVKDIIDSKTGETASKRWKGAKNSETAAKVALMKLKMHADGDKSLPQTERIYFQVFLPKGSKEKSKPMFFCHRWSIGKAIDFAASLARLKNDNNKFTAKAVSHYFRRSLTLGSYFGNLDC

SEQ ID NO: 101736 - protein, 161 aa, Homo sapiens; identical to SEQ ID NO: 101729
  Payload ID: 20271
  Gene Name: zinc finger, AN1-type domain 1
  Uniprot ID: Q8TCF1
  ENSP ID: ENSP00000429999

SEQ ID NO: 101737 - protein, 120 aa, Homo sapiens
  Payload ID: 20271
  Gene Name: zinc finger, AN1-type domain 1
  ENSP ID: ENSP00000430214
MAATQKLVKDIIDSKTGETASKRWKGAKNSETAAKVALMKLKMHADGDKSLPQTERIYFQVFLPKGSKEKSKPMFFCHRWSIGKAIDFAASLARLKNDNNKFTAKVTSHYNNISILIKVL

SEQ ID NO: 101738 - protein, 53 aa, Homo sapiens; identical to SEQ ID NO: 101726
  Payload ID: 20271
  Gene Name: zinc finger, AN1-type domain 1
  ENSP ID: ENSP00000430405

SEQ ID NO: 101739 - protein, 61 aa, Homo sapiens
  Payload ID: 20271
  Gene Name: zinc finger, AN1-type domain 1
  ENSP ID: ENSP00000430499
DSKTGETASKRWKGAKNSETAAKVALMKLKMHADGDKSLPQGAKRRANQCSFATDGALERP

SEQ ID NO: 101740 - protein, 42 aa, Homo sapiens
  Payload ID: 20271
  Gene Name: zinc finger, AN1-type domain 1
  ENSP ID: ENSP00000430719
MAATQKLVKDIIDSKTGETASKRWKGAKNSETAAKVALMKLK

SEQ ID NO: 101741 - protein, 261 aa, Homo sapiens
  Payload ID: 20271
  Gene Name: zinc finger, AN1-type domain 1
  Uniprot ID: Q8TCF1
  ENSP ID: ENSP00000430736
MAELDIGQHCQVEHCRQRDFLPFVCDDCSGIFCLEHRSRESHGCPEVTVINERLKTDQHTSYPCSFKDCAERELVAVICPYCEKNFCLRHRHQSDHECEKLEIPKPRMAATQKLVKDIIDSKTGETASKRWKGAKNSETAAKVALMKLKMHADGDKSLPQVFLPKGSKEKSKPMFFCHRWSIGKAIDFAASLARLKNDNNKFTAKKLRLCHITSGEALPLDHTLETWIAKEDCPLYNGGNIILEYLNDEEQFCKNVESYLE

SEQ ID NO: 101742 - protein, 145 aa, Homo sapiens
  Payload ID: 20272
  Gene Name: zinc finger, AN1-type domain 2A
  Uniprot ID: Q8N6M9
  ENSP ID: ENSP00000314619
MEFPDLGKHCSEKTCKQLDFLPVKCDACKQDFCKDHFPYAAHKCPFAFQKDVHVPVCPLCNTPIPVKKGQIPDVVVGDHIDRDCDSHPGKKKEKIFTYRCSKEGCKKKEMLQMVCAQCHGNFCIQHRHPLDHSCRHGSRPTIKAG

SEQ ID NO: 101743 - protein, 205 aa, Homo sapiens
  Payload ID: 20272
  Gene Name: zinc finger, AN1-type domain 2A
  ENSP ID: ENSP00000380273
MEFPDLGKHCSEKTCKQLDFLPVKCDACKQDFCKDHFPYAAHKCPFAFQKDVHVPVCPLCNTPIPVKKGQIPDVVVGDHIDRDCDSHPGKKKEKSLCSLRFLHTVAQKRAARRKRCCRWYVPNVTATSVSSTDTLWTTAADTGVAPPSKLGEKRLRCDGSEHAVACVEAAYTLVGSGAPLSTIPHWLLILFVEGDGTIIKLNAEV

SEQ ID NO: 101744 - protein, 180 aa, Homo sapiens
  Payload ID: 20272
  Gene Name: zinc finger, AN1-type domain 2A
  ENSP ID: ENSP00000386031
MEFPDLGKHCSEKTCKQLDFLPVKCDACKQDFCKDHFPYAAHKCPFAFQKDVHVPVCPLCNTPIPVKKGQIPDVVVGDHIDRDCDSHPGKKKEKIFTYRCSKEGCKKKEMLQMVCAQCHGNFCIQHRHPLDHSCRHGSRPTIKAGCSPMTVSESRPLGDFLTLAPGGLAQRLGYWFTRLM

SEQ ID NO: 101745 - protein, 90 aa, Homo sapiens
  Payload ID: 20272
  Gene Name: zinc finger, AN1-type domain 2A
  ENSP ID: ENSP00000459173
  MOD_RES (1)..(1): Any amino acid
XDACKQDFCKDHFPYAAHKCPFAFQKDVHVPVCPLCNTPIPVKKGQIPDVVVGDHIDRDCDSHPGKKKEKHRHPLDHSCRHGSRPTIKAG

SEQ ID NO: 101746 - protein, 257 aa, Homo sapiens
  Payload ID: 20273
  Gene Name: zinc finger, AN1-type domain 2B
  Uniprot ID: Q8WV99
  ENSP ID: ENSP00000289528
MEFPDLGAHCSEPSCQRLDFLPLKCDACSGIFCADHVAYAQHHCGSAYQKDIQVPVCPLCNVPVPVARGEPPDRAVGEHIDRDCRSDPAQQKRKIFTNKCERAGCRQREMMKLTCERCSRNFCIKHRHPLDHDCSGEGHPTSRAGLAAISRAQAVASTSTVPSPSQTMPSCTSPSRATTRSPSWTAPPVIALQNGLSEDEALQRALEMSLAETKPQVPSCQEEEDLALAQALSASEAEYQRQQAQSRSSKPSNCSLC

SEQ ID NO: 101747 - protein, 224 aa, Homo sapiens
  Payload ID: 20273
  Gene Name: zinc finger, AN1-type domain 2B
  ENSP ID: ENSP00000386370
MEFPDLGAHCSEPSCQRLDFLPLKCDACSGIFCADHVAYAQHHCGSAYQKDIQVPVCPLCNVPVPVARGEPPDRAVGEHIDRDCRSDPAQQKRKIFTNKCERAGCRQREMMKLTCERCSRNFCIKHRHPLDHDCSGEGHPTSRAGLAAISRAQAVASTSTVPSPSQTMPSCTSPSRATTRSPSWTAPPVIALQNGLSEDEALQRALEMSLAETKPQVPRYLTLL

SEQ ID NO: 101748 - protein, 176 aa, Homo sapiens
  Payload ID: 20273
  Gene Name: zinc finger, AN1-type domain 2B
  Uniprot ID: Q8WV99
  ENSP ID: ENSP00000386399
MEFPDLGAHCSEPSCQRLDFLPLKCDACSGIFCADHVAYAQHHCGSAYQKDIQVPVCPLCNVPVPVARGEPPDRAVGEHIDRDCRSDPAQQKRKIFTNKCERAGCRQREMMKLTCERCSRNFCIKHRHPLDHDCSGEGHPTSRAGLAAISRAQAVASTSTVPSPSQTMPSCTSPSR

SEQ ID NO: 101749 - protein, 176 aa, Homo sapiens; identical to SEQ ID NO: 101748
  Payload ID: 20273
  Gene Name: zinc finger, AN1-type domain 2B
  Uniprot ID: Q8WV99
  ENSP ID: ENSP00000386824

SEQ ID NO: 101750 - protein, 145 aa, Homo sapiens
  Payload ID: 20273
  Gene Name: zinc finger, AN1-type domain 2B
  ENSP ID: ENSP00000386847
MEFPDLGAHCSEPSCQRLDFLPLKCDACSGIFCADHVAYAQHHCGSAYQKDIQVPVCPLCNVPVPVARGEPPDRAVGEHIDRDCRSDPAQQKRKIFTNKCERAGCRQREMMKLTCERCSRNFCIKHRHPLDHDCSGEGHPTSRAG

SEQ ID NO: 101751 - protein, 257 aa, Homo sapiens; identical to SEQ ID NO: 101746
  Payload ID: 20273
  Gene Name: zinc finger, AN1-type domain 2B
  Uniprot ID: Q8WV99
  ENSP ID: ENSP00000386898

SEQ ID NO: 101752 - protein, 225 aa, Homo sapiens
  Payload ID: 20273
  Gene Name: zinc finger, AN1-type domain 2B
  ENSP ID: ENSP00000387179
MEFPDLGAHCSEPSCQRLDFLPLKCDACSGIFCADHVAYAQHHCGSAYQKDIQVPVCPLCNVPVPVARGEPPDRAVGEHIDRDCRSDPAQQKRKIFTNKCERAGCRQREMMKLTCERCSRNFCIKHRHPLDHDCSGEGHPTSRAGLAAISRAQAVASTSTVPSPSQTMPSCTSPSRATTRSPSWTAPPVIALQNGLVSWAEVGWTETNTQRVKSKDAGLLSPFVE

SEQ ID NO: 101753 - protein, 145 aa, Homo sapiens; identical to SEQ ID NO: 101750
  Payload ID: 20273
  Gene Name: zinc finger, AN1-type domain 2B
  ENSP ID: ENSP00000387312

SEQ ID NO: 101754 - protein, 96 aa, Homo sapiens
  Payload ID: 20273
  Gene Name: zinc finger, AN1-type domain 2B
  ENSP ID: ENSP00000388773
MEFPDLGAHCSEPSCQRLDFLPLKCDACSGIFCADHVAYAQHHCGSAYQKDIQVPVCPLCNVPVPVARGEPPDRAVGEHIDRDCRSDPAQQKHLHQ

SEQ ID NO: 101755 - protein, 50 aa, Homo sapiens
  Payload ID: 20273
  Gene Name: zinc finger, AN1-type domain 2B
  ENSP ID: ENSP00000400760
MEFPDLGAHCSEPSCQRLDFLPLKCDACSGIFCADHVAYAQHHCGSAYQK

SEQ ID NO: 101756 - protein, 214 aa, Homo sapiens
  Payload ID: 20273
  Gene Name: zinc finger, AN1-type domain 2B
  ENSP ID: ENSP00000409931
MEFPDLGAHCSEPSCQRLDFLPLKCDACSGIFCADHVAYAQHHCGSAYQKDIQVPVCPLCNVPVPVARGEPPDRAVGEHIDRDCRSDPAQQKRKIFTNKCERAGCRQREMMKLTCERCSRNFCIKHRHPLDHDCSGEGHPTSRAGLAAISRAQAVASTSTVPSPSQTMPSCTSPSRATTRSPSWTAPPVIALQNGLVSWAEVGWTETNTQRVKS

SEQ ID NO: 101757 - protein, 257 aa, Homo sapiens; identical to SEQ ID NO: 101746
  Payload ID: 20273
  Gene Name: zinc finger, AN1-type domain 2B
  Uniprot ID: Q8WV99
  ENSP ID: ENSP00000411334

SEQ ID NO: 101758 - protein, 152 aa, Homo sapiens
  Payload ID: 20273
  Gene Name: zinc finger, AN1-type domain 2B
  ENSP ID: ENSP00000416138
  MOD_RES (1)..(1): Any amino acid
XPVIALQNGLSEDEALQRALEMSLAETKPQVPRPRAAARSRPTAACARALGLGREVHLRRTVALTPLGYTGRGGPEHPGGQRQAGVMWRSPWEPLEGLASAPAAWKRAASNCSLVGPSVDAGQALLLAPSSCHLPYAGAAPMWSGQEGAWKK

SEQ ID NO: 101759 - protein, 213 aa, Homo sapiens
  Payload ID: 20273
  Gene Name: zinc finger, AN1-type domain 2B
  ENSP ID: ENSP00000483320
MEFPDLGAHCSEPSCQRLDFLPLKCDACSGIFCADHVAYAQHHCGSAYQKIFTNKCERAGCRQREMMKLTCERCSRNFCIKHRHPLDHDCSGEGHPTSRAGLAAISRAQAVASTSTVPSPSQTMPSCTSPSRATTRSPSWTAPPVIALQNGLSEDEALQRALEMSLAETKPQVPSCQEEEDLALAQALSASEAEYQRQQAQSRSSKPSNCSLC

SEQ ID NO: 101760 - protein, 227 aa, Homo sapiens
  Payload ID: 20274
  Gene Name: zinc finger, AN1-type domain 3
  Uniprot ID: Q9H8U3
  ENSP ID: ENSP00000287218
MGDAGSERSKAPSLPPRCPCGFWGSSKTMNLCSKCFADFQKKQPDDDSAPSTSNSQSDLFSEETTSDNNNTSITTPTLSPSQQPLPTELNVTSPSKEECGPCTDTAHVSLITPTKRSCGTDSQSENEASPVKRPRLLENTERSEETSRSKQKSRRRCFQCQTKLELVQQELGSCRCGYVFCMLHRLPEQHDCTFDHMGRGREEAIMKMVKLDRKVGRSCQRIGEGCS

SEQ ID NO: 101761 - protein, 164 aa, Homo sapiens
  Payload ID: 20274
  Gene Name: zinc finger, AN1-type domain 3
  ENSP ID: ENSP00000362487
  MOD_RES (1)..(1): Any amino acid
XSSKTMNLCSKCFADFQKKQPDDDSAPSTSNSQSDLFSEETTSDNNNTSITTPTLSPSQQPLPTELNVTSPSKEECGPCTDTAHVSLITPTKRSCGTDSQSENEASPVKRPRLLENTERSEETSRSKQKSRRRCFQCQTKLELVQQELGSCRCGVSLERDVWHL

SEQ ID NO: 101762 - protein, 205 aa, Homo sapiens
  Payload ID: 20274
  Gene Name: zinc finger, AN1-type domain 3
  ENSP ID: ENSP00000362489
MGDAGSERSKAPSLPPRCPCGFWGSSKTMNLCSKCFADFQKKQPDDDSAPSTSNSQSDLFSEETTSDNNNTSITTPTLSPSQQPLPTELNVTSPSKEEYSQSENEASPVKRPRLLENTERSEETSRSKQKSRRRCFQCQTKLELVQQELGSCRCGYVFCMLHRLPEQHDCTFDHMGRGREEAIMKMVKLDRKVGRSCQRIGEGCS

SEQ ID NO: 101763 - protein, 186 aa, Homo sapiens
  Payload ID: 20274
  Gene Name: zinc finger, AN1-type domain 3
  ENSP ID: ENSP00000420240
MGDAGSERSKAPSLPPRCPCGFWGSSKTMNLCSKCFAETGFCHVDQAGLELLSSSDPPASASQSAGITDFQKKQPDDDSAPSTSNSQSDLFSEETTSDNNNTSITTPTLSPSQQPLPTELNVTSPSKEECGPCTDTAHVSLITPTKRSCGTDSQSENEASPVKRPRLLENTERSEETSRSKQKSRR

SEQ ID NO: 101764 - protein, 727 aa, Homo sapiens
  Payload ID: 20275
  Gene Name: zinc finger, AN1-type domain 4
  Uniprot ID: Q86XD8
  ENSP ID: ENSP00000339484
MDNRKEPPFFNDDNMGPFYYRLHFCDTMELFIETLTGTCFELRVSPFETVISVKAKIRRLEGIPICRQHLIWNNMELENDYCLNDYNISEGCTLKLVLAMRGGPINTRRVPTDDPLRKMAEYLDSSRVEVWEKTSCSKQVTFLVYQEGDQLNFFPAVDRGDGTLTPLSDSSKKIDFHLHVLRRKGEHRMSGGSMYNSDTDEDEETEPSSSGQQIIENSITMNKMKLLKAKMKNMNLSKKPKKAVKIKPHPPVAPRPSSGSTAPSRHRLLRVLPNIGQSCSPAFGNAYPPEISRNGISSLATQLSAERYISSITGEFLKEDNSWENNTLSHFSSNVKLPPQIPHLELGNDQELADSVLHLGSSLPRQTKHFLGNLPSSNGNIVLPSEECVTEQSLLPKVGSLASFAEGNADEQSSGLEGACKVNLELLLTNADKGLKAPEQHLKHVAGVLNGESVETSVLNYRELSPHKNRLLSPLRCSAPMSLHNSLVKPERQSKCFEFGKLQPSSSQSLDVQNITDSSFSRTTCFQGVKVDSLGKRSDVISKVEARDITEMTNKASKEPVGCVNNISFLASLAGSTSRNRLQSTRGAGRLQNSGTGLSTNLQHFQEENFRKSSPQLEHTGVFLSTHGVGMNGNNAAAGKSVGECTTHHLPPVKAPLQTKKKTTNHCFLCGKKTGLASSYECRCGNNFCASHRYAETHGCTYDYKSAGRRYLHEANPVVNAPKLPKI

SEQ ID NO: 101765 - protein, 653 aa, Homo sapiens
  Payload ID: 20275
  Gene Name: zinc finger, AN1-type domain 4
  ENSP ID: ENSP00000363486
MELENDYCLNDYNISEGCTLKLVLAMRGGPINTRRVPTDDPLRKMAEYLDSSRVEVWEKTSCSKQVTFLVYQEGDQLNFFPAVDRGDGTLTPLSDSSKKIDFHLHVLRRKGEHRMSGGSMYNSDTDEDEETEPSSSGQQIIENSITMNKMKLLKAKMKNMNLSKKPKKAVKIKPHPPVAPRPSSGSTAPSRHRLLRVLPNIGQSCSPAFGNAYPPEISRNGISSLATQLSAERYISSITGEFLKEDNSWENNTLSHFSSNVKLPPQIPHLELGNDQELADSVLHLGSSLPRQTKHFLGNLPSSNGNIVLPSEECVTEQSLLPKVGSLASFAEGNADEQSSGLEGACKVNLELLLTNADKGLKAPEQHLKHVAGVLNGESVETSVLNYRELSPHKNRLLSPLRCSAPMSLHNSLVKPERQSKCFEFGKLQPSSSQSLDVQNITDSSFSRTTCFQGVKVDSLGKRSDVISKVEARDITEMTNKASKEPVGCVNNISFLASLAGSTSRNRLQSTRGAGRLQNSGTGLSTNLQHFQEENFRKSSPQLEHTGVFLSTHGVGMNGNNAAAGKSVGECTTHHLPPVKAPLQTKKKTTNHCFLCGKKTGLASSYECRCGNNFCASHRYAETHGCTYDYKSAGRRYLHEANPVVNAPKLPKI

SEQ ID NO: 101766 - protein, 224 aa, Homo sapiens
  Payload ID: 20275
  Gene Name: zinc finger, AN1-type domain 4
  ENSP ID: ENSP00000363491
MDNRKEPPFFNDDNMGPFYYRLHFCDTMELFIETLTGTCFELRVSPFETVISVKAKIRRLEGIPICRQHLIWNNMELENDYCLNDYNISEGCTLKLVLAMRGGPINTRRVPTDDPLRKMAEYLDSSRVEVWEKTSCSKQVTFLVYQEGDQLNFFPAVDRGDGTLTPLSDSSKKIDFHLHVLRRKGEHRMRRMYYSSPPTCESPSSDKEENNKSLFSLWKENRTG

SEQ ID NO: 101767 - protein, 211 aa, Homo sapiens
  Payload ID: 20275
  Gene Name: zinc finger, AN1-type domain 4
  ENSP ID: ENSP00000434854
MDNRKEPPFFNDDNMGPFYYRLHFCDTMELFIETLTGTCFELRVSPFETVISVKAKIRRLEGIPICRQHLIWNNMELENDYCLNDYNISEGCTLKLVLAMRGGPINTRRVPTDDPLRKMAEYLDSSRVEVWEKTSCSKQVTFLVYQEGDQLNFFPAVDRGDGTLTPLSDSSKKIDFHLHVLRRKGEHRMSENLLRMTKNLYFSPVPNLKKF

SEQ ID NO: 101768 - protein, 93 aa, Homo sapiens
  Payload ID: 20275
  Gene Name: zinc finger, AN1-type domain 4
  ENSP ID: ENSP00000477595
MDNRKEPPFFNDDNMGPFYYRLHFCDTMELFIETLTGTCFELRVSPFETVISVKAKIRRLEDPGDPTEVSGWPSPVTTSAHSVMTLEAFVCPK

SEQ ID NO: 101769 - protein, 213 aa, Homo sapiens
  Payload ID: 20276
  Gene Name: zinc finger, AN1-type domain 5
  Uniprot ID: O76080
  ENSP ID: ENSP00000237937
MAQETNQTPGPMLCSTGCGFYGNPRTNGMCSVCYKEHLQRQQNSGRMSPMGTASGSNSPTSDSASVQRADTSLNNCEGAAGSTSEKSRNVPVAALPVTQQMTEMSISREDKITTPKTEVSEPVVTQPSPSVSQPSTSQSEEKAPELPKPKKNRCFMCRKKVGLTGFDCRCGNLFCGLHRYSDKHNCPYDYKAEAAAKIRKENPVVVAEKIQRI

SEQ ID NO: 101770 - protein, 213 aa, Homo sapiens; identical to SEQ ID NO: 101769
  Payload ID: 20276
  Gene Name: zinc finger, AN1-type domain 5
  Uniprot ID: O76080
  ENSP ID: ENSP00000350586

SEQ ID NO: 101771 - protein, 211 aa, Homo sapiens
  Payload ID: 20276
  Gene Name: zinc finger, AN1-type domain 5
  ENSP ID: ENSP00000366155
MAKPEQAADGGVRGRGARPPAQEAQRRRRHPVVVARDLAPGVPGSLHSTQKNMAQETNQTPGPMLCSTGCGFYGNPRTNGMCSVCYKEHLQRQQNSGRMSPMGTASGSNSPTSDSASVQRADTSLNNCEGAAGSTSEKSRNVPVAALPVTQQMTEMSISREDKITTPKTEVSEPVVTQPSPSVSQPSTSQSEEKAPELPKPKKNRCFMCRK

SEQ ID NO: 101772 - protein, 213 aa, Homo sapiens; identical to SEQ ID NO: 101769
  Payload ID: 20276
  Gene Name: zinc finger, AN1-type domain 5
  Uniprot ID: O76080
  ENSP ID: ENSP00000366159

SEQ ID NO: 101773 - protein, 213 aa, Homo sapiens; identical to SEQ ID NO: 101769
  Payload ID: 20276
  Gene Name: zinc finger, AN1-type domain 5
  Uniprot ID: O76080
  ENSP ID: ENSP00000366161

SEQ ID NO: 101774 - protein, 208 aa, Homo sapiens
  Payload ID: 20277
  Gene Name: zinc finger, AN1-type domain 6
  Uniprot ID: Q6FIF0
  ENSP ID: ENSP00000261749
MAQETNHSQVPMLCSTGCGFYGNPRTNGMCSVCYKEHLQRQNSSNGRISPPATSVSSLSESLPVQCTDGSVPEAQSALDSTSSSMQPSPVSNQSLLSESVASSQLDSTSVDKAVPETEDVQASVSDTAQQPSEEQSKSLEKPKQKKNRCFMCRKKVGLTGFECRCGNVYCGVHRYSDVHNCSYNYKADAAEKIRKENPVVVGEKIQKI

SEQ ID NO: 101775 - protein, 174 aa, Homo sapiens
  Payload ID: 20277
  Gene Name: zinc finger, AN1-type domain 6
  ENSP ID: ENSP00000452625
MLLLPNRDKGVQLRNMAQETNHSQVPMLCSTGCGFYGNPRTNGMCSVCYKEHLQRQNSSNGRISPPATSVSSLSESLPVQCTDGSVPEAQSALDSTSSSMQPSPVSNQSLLSESVASSQLDSTSVDKAVPETEDVQASVSDTAQQPSEEQSKSLEKPKQKKNRCFMCRKKVGLT

SEQ ID NO: 101776 - protein, 177 aa, Homo sapiens
  Payload ID: 20277
  Gene Name: zinc finger, AN1-type domain 6
  ENSP ID: ENSP00000452664
MAQETNHSQVPMLCSTGCGFYGNPRTNGMCSVCYKEHLQRQNSSNGRISPPATSVSSLSESLPVQCTDGSVPEAQSALDSTSSSMQPSPVSNQSLLSESVASSQLDSTSVDKAVPETEDVQASVSDTAQQPSEEQSKSLEKPKQKKNRCFMCRKKVGLTGKDLNQMFKIKMMFYNNA

SEQ ID NO: 101777 - protein, 208 aa, Homo sapiens; identical to SEQ ID NO: 101774
  Payload ID: 20277
  Gene Name: zinc finger, AN1-type domain 6
  Uniprot ID: Q6FIF0
  ENSP ID: ENSP00000452735

SEQ ID NO: 101778 - protein, 208 aa, Homo sapiens; identical to SEQ ID NO: 101774
  Payload ID: 20277
  Gene Name: zinc finger, AN1-type domain 6
  Uniprot ID: Q6FIF0
  ENSP ID: ENSP00000453291

SEQ ID NO: 101779 - protein, 158 aa, Homo sapiens
  Payload ID: 20277
  Gene Name: zinc finger, AN1-type domain 6
  ENSP ID: ENSP00000453308
MKGFIFLKAIGVQLRNMAQETNHSQVPMLCSTGCGFYGNPRTNGMCSVCYKEHLQRQNSSNGRISPPATSVSSLSESLPVQCTDGSVPEAQSALDSTSSSMQPSPVSNQSLLSESVASSQLDSTSVDKAVPETEDVQASVSDTAQQPSEEQSKSLEKP

SEQ ID NO: 101780 - protein, 159 aa, Homo sapiens
  Payload ID: 20277
  Gene Name: zinc finger, AN1-type domain 6
  ENSP ID: ENSP00000453571
MAQETNHSQVPMLCSTGCGFYGNPRTNGMCSVCYKEHLQRQNSSNGRISPPATSVSSLSESLPVQCTDGSVPEAQSALDSTSSSMQPSPVSNQSLLSESVASSQLDSTSVDKAVPETEDVQASVSDTAQQPSEEQSKSLEKPKQKKNRCFMCRKKVGLT

SEQ ID NO: 101781 - protein, 72 aa, Homo sapiens
  Payload ID: 20277
  Gene Name: zinc finger, AN1-type domain 6
  ENSP ID: ENSP00000453590
MSIRSFLESIFRCKQYSGLLLEIQRLRTRNYCMQQETLISSTYAKLGVQLRNMAQETNHSQVPMLCSTGCGF

SEQ ID NO: 101782 - protein, 208 aa, Homo sapiens; identical to SEQ ID NO: 101774
  Payload ID: 20277
  Gene Name: zinc finger, AN1-type domain 6
  Uniprot ID: Q6FIF0
  ENSP ID: ENSP00000453709

SEQ ID NO: 101783 - protein, 155 aa, Homo sapiens
  Payload ID: 20277
  Gene Name: zinc finger, AN1-type domain 6
  ENSP ID: ENSP00000453710
MKGFIFLKAIGVQLRNMAQETNHSQVPMLCSTGCGFYGNPRTNGMCSVCYKEHLQRQNSSNGRISPPATSVSSLSESLPVQCTDGSVPEAQSALDSTSSSMQPSPVSNQSLLSESVASSQLDSTSVDKAVPETEDVQASVSDTAQQPSEEQSKSL

SEQ ID NO: 101784 - protein, 208 aa, Homo sapiens; identical to SEQ ID NO: 101774
  Payload ID: 20277
  Gene Name: zinc finger, AN1-type domain 6
  Uniprot ID: Q6FIF0
  ENSP ID: ENSP00000453888

SEQ ID NO: 101785 - protein, 208 aa, Homo sapiens; identical to SEQ ID NO: 101774
  Payload ID: 20277
  Gene Name: zinc finger, AN1-type domain 6
  Uniprot ID: Q6FIF0
  ENSP ID: ENSP00000454137

SEQ ID NO: 101786 - protein, 196 aa, Homo sapiens
  Payload ID: 20277
  Gene Name: zinc finger, AN1-type domain 6
  Uniprot ID: Q6FIF0
  ENSP ID: ENSP00000454152
MAQETNHSQVPMLCSTGCGFYGNPRTNGMCSVCYKEHLQRQNSSNGRISPPVQCTDGSVPEAQSALDSTSSSMQPSPVSNQSLLSESVASSQLDSTSVDKAVPETEDVQASVSDTAQQPSEEQSKSLEKPKQKKNRCFMCRKKVGLTGFECRCGNVYCGVHRYSDVHNCSYNYKADAAEKIRKENPVVVGEKIQKI

SEQ ID NO: 101787 - protein, 148 aa, Homo sapiens
  Payload ID: 20277
  Gene Name: zinc finger, AN1-type domain 6
  ENSP ID: ENSP00000454273
MAQETNHSQVPMLCSTGCGFYGNPRTNGMCSVCYKEHLQRQNSSNGRISPPATSVSSLSESLPVQCTDGSVPEAQSALDSTSSSMQPSPVSNQSLLSESVASSQLDSTSVDKAVPETEDVQGFECRCGNVYCGVHRYSDVHNCSYNYK

SEQ ID NO: 101788 - protein, 32 aa, Homo sapiens
  Payload ID: 20277
  Gene Name: zinc finger, AN1-type domain 6
  ENSP ID: ENSP00000454409
MAQETNHSQVPMLCSTGCGFYGNPRTNGMCSV

SEQ ID NO: 101789 - protein, 87 aa, Homo sapiens
  Payload ID: 20277
  Gene Name: zinc finger, AN1-type domain 6
  ENSP ID: ENSP00000455146
MAQETNHSQVPMLCSTGCGFYGNPRTNGMCSVCYKEHLQRQNSSNGRISPPATSVSSLSESLPVQCTDGSVPEAQSALDSTSSSMQP

SEQ ID NO: 101790 - protein, 20 aa, Homo sapiens
  Payload ID: 20277
  Gene Name: zinc finger, AN1-type domain 6
  ENSP ID: ENSP00000455515
MAQETNHSQVPMLCSTGCGF

SEQ ID NO: 101791 - protein, 64 aa, Homo sapiens
  Payload ID: 20277
  Gene Name: zinc finger, AN1-type domain 6
  ENSP ID: ENSP00000456973
MAQETNHSQVPMLCSTGCGFYGNPRTNGMCSVCYKEHLQRQNSSNGRISPPATSVSSLSESLPV

SEQ ID NO: 101792 - protein, 208 aa, Homo sapiens; identical to SEQ ID NO: 101774
  Payload ID: 20277
  Gene Name: zinc finger, AN1-type domain 6
  Uniprot ID: Q6FIF0
  ENSP ID: ENSP00000478129

SEQ ID NO: 101793 - protein, 208 aa, Homo sapiens; identical to SEQ ID NO: 101774
  Payload ID: 20277
  Gene Name: zinc finger, AN1-type domain 6
  Uniprot ID: Q6FIF0
  ENSP ID: ENSP00000479071

SEQ ID NO: 101794 - protein, 208 aa, Homo sapiens; identical to SEQ ID NO: 101774
  Payload ID: 20277
  Gene Name: zinc finger, AN1-type domain 6
  Uniprot ID: Q6FIF0
  ENSP ID: ENSP00000484971

SEQ ID NO: 101795 - protein, 839 aa, Homo sapiens
  Payload ID: 20278
  Gene Name: zinc finger, B-box domain containing
  Uniprot ID: A8MT70
  ENSP ID: ENSP00000305065
MNRKDFVVLPWGKPGNSVKLKYRNAQELRMEKVQLEFENQEMEKKLQEFRSTRNKEKEDRESSEYYWKSGKVGKLVNQSYMMSQNKGNVVKFSAGKVKLKLLKEQIQEPVKPTVNYKMANSSECEKPKINGKVCGQCENKAALLVCLECGEDYCSGCFAKVHQKGALKLHRTTLLQAKSQILFNVLDVAHQFIKDVNPDEPKEENNSTKETSKIQHKPKSVLLQRSSSEVEITTMKRAQRTKPRKSLLCEGSFDEEASAQSFQEVLSQWRTGNHDDNKKQNLHAAVKDSLEECEVQTNLKIWREPLNIELKEDILSYMEKLWLKKHRRTPQEQLFKMLPDTFPHPHETTGDAQCSQNENDEDSDGEETKVQHTALLLPVETLNIERPEPSLKIVELDDTYEEEFEEAENIVPYKVKLADADSQRSCAFHDCQKNSFPYENGIHQHHVFDKGKRDFLNLCLRNSSTYYKDNSKAETSNTDFDNIVDPDVYSSDIEKIEESTSFERNLKEKNIGLESNQKSDDSCVSLESKDTLLGRDLEKAPIEEKLSQDIKESLELSNLYKRPSFEESKTTKSSLLLQEIACRSKPITKQYQGLERFFIFDTNERLNLLPSHRLECNNSSTRITLAEDREWIPDHSLSEYADNAIVLGVLQGAQSPSSSRKQQKMGQKSQRPSTANFPLSNSVKESSSCLSSSHPRSRSAAAQSSSRAASEISEIEYIDITDQNELSLDDTTDQHTLDNLEKELQVLRSLADTSEKLYSLTSEEFPDFSSQSLNISQISTDFLKTSHVRGPCGVEELSCSGRDTKIQSLLSLSESSTDEEEEDFLNKQHVITLPWSKST

SEQ ID NO: 101796 - protein, 771 aa, Homo sapiens
  Payload ID: 20278
  Gene Name: zinc finger, B-box domain containing
  Uniprot ID: A8MT70
  ENSP ID: ENSP00000376517
MEKVQLEFENQEMEKKLQEFRSTRNKEKEDRESSEYYWKSGKVGKLVNQSYMMSQNKGNVVKFSAGKVKLKLLKEQIQEPVKPTVNYKMANSSECEKPKINGKVCGQCENKAALLVCLECGEDYCSGCFAKVHQKGALKLHRTTLLQAKSQILFNVLDVAHQFIKDVNPDEPKEENNSTKETSKIQHKPKSVLLQRSSSEVEITTMKRAQRTKPRKSLLCEGSFDEEASAQSFQEVLSQWRTGNHDDNKKQNLHAAVKDSLEECEVQTNLKIWREPLNIELKEDILSYMEKLWLKKHRRTPQEQLFKMLPDTFPHPHETTGDAQCSQNENDEDSDGEETKVQHTALLLPVETLNIERPEPSLKIVELDDTYEEEFEEAENIVPYKVKLADADSQRSCAFHDCQKNSFPYENGIHQHHVFDKGKRDFLNLCLRNSSTYYKDNSKAETSNTDFDNIVDPDVYSSDIEKIEESTSFERNLKEKNIGLESNQKSDDSCVSLESKDTLLGRDLEKAPIEEKLSQDIKESLELSNLYKRPSFEESKTTKSSLLLQEIACRSKPITKQYQGLERFFIFDTNERLNLLPSHRLECNNSSTRITLAGQKSQRPSTANFPLSNSVKESSSCLSSSHPRSRSAAAQSSSRAASEISEIEYIDITDQNELSLDDTTDQHTLDNLEKELQVLRSLADTSEKLYSLTSEEFPDFSSQSLNISQISTDFLKTSHVRGPCGVEELSCSGRDTKIQSLLSLSESSTDEEEEDFLNKQHVITLPWSKST

SEQ ID NO: 101797 - protein, 800 aa, Homo sapiens
  Payload ID: 20278
  Gene Name: zinc finger, B-box domain containing
  Uniprot ID: A8MT70
  ENSP ID: ENSP00000376519
MNRKDFVVLPWGKPGNSVKLKYRNAQELRMEKVQLEFENQEMEKKLQEFRSTRNKEKEDRESSEYYWKSGKVGKLVNQSYMMSQNKGNVVKFSAGKVKLKLLKEQIQEPVKPTVNYKMANSSECEKPKINGKVCGQCENKAALLVCLECGEDYCSGCFAKVHQKGALKLHRTTLLQAKSQILFNVLDVAHQFIKDVNPDEPKEENNSTKETSKIQHKPKSVLLQRSSSEVEITTMKRAQRTKPRKSLLCEGSFDEEASAQSFQEVLSQWRTGNHDDNKKQNLHAAVKDSLEECEVQTNLKIWREPLNIELKEDILSYMEKLWLKKHRRTPQEQLFKMLPDTFPHPHETTGDAQCSQNENDEDSDGEETKVQHTALLLPVETLNIERPEPSLKIVELDDTYEEEFEEAENIVPYKVKLADADSQRSCAFHDCQKNSFPYENGIHQHHVFDKGKRDFLNLCLRNSSTYYKDNSKAETSNTDFDNIVDPDVYSSDIEKIEESTSFERNLKEKNIGLESNQKSDDSCVSLESKDTLLGRDLEKAPIEEKLSQDIKESLELSNLYKRPSFEESKTTKSSLLLQEIACRSKPITKQYQGLERFFIFDTNERLNLLPSHRLECNNSSTRITLAGQKSQRPSTANFPLSNSVKESSSCLSSSHPRSRSAAAQSSSRAASEISEIEYIDITDQNELSLDDTTDQHTLDNLEKELQVLRSLADTSEKLYSLTSEEFPDFSSQSLNISQISTDFLKTSHVRGPCGVEELSCSGRDTKIQSLLSLSESSTDEEEEDFLNKQHVITLPWSKST

SEQ ID NO: 101798 - protein, 771 aa, Homo sapiens; identical to SEQ ID NO: 101796
  Payload ID: 20278
  Gene Name: zinc finger, B-box domain containing
  Uniprot ID: A8MT70
  ENSP ID: ENSP00000376520

SEQ ID NO: 101799 - protein, 839 aa, Homo sapiens; identical to SEQ ID NO: 101795
  Payload ID: 20278
  Gene Name: zinc finger, B-box domain containing
  Uniprot ID: A8MT70
  ENSP ID: ENSP00000390232

SEQ ID NO: 101800 - protein, 68 aa, Homo sapiens
  Payload ID: 20278
  Gene Name: zinc finger, B-box domain containing
  ENSP ID: ENSP00000417088
MEKVQLEFENQEMEKKLQEFRSTRNKEKEDREMTKFIMCLAAFNDPVANSFTFTDLDLVWTSKWIMIL

SEQ ID NO: 101801 - protein, 45 aa, Homo sapiens
  Payload ID: 20278
  Gene Name: zinc finger, B-box domain containing
  ENSP ID: ENSP00000417678
  MOD_RES (1)..(1): Any amino acid
XKKAPVAFHPLILDQEVQLLNHHLELLLKFQKLNILILLTRMSFP

SEQ ID NO: 101802 - protein, 86 aa, Homo sapiens
  Payload ID: 20278
  Gene Name: zinc finger, B-box domain containing
  ENSP ID: ENSP00000418861
  MOD_RES (1)..(1): Any amino acid
XLSNSVKESSSCLSSSHPRSRSAAAQSSSRAASEISEIEYIDITDQNELSLDDTTDQHTLDNLEKELQVLRSLAGPQPEAWSPVWD

SEQ ID NO: 101803 - protein, 49 aa, Homo sapiens
  Payload ID: 20278
  Gene Name: zinc finger, B-box domain containing
  ENSP ID: ENSP00000419264
  MOD_RES (1)..(1): Any amino acid
XELSLDDTTDQHTLDNLEKELQVLRSLAGCIHFFFLSSMKNNHVKELGE

SEQ ID NO: 101804 - protein, 163 aa, Homo sapiens
  Payload ID: 20278
  Gene Name: zinc finger, B-box domain containing
  ENSP ID: ENSP00000419307
MNRKDFVVLPWGKPGNSVKLKYRNAQELRMEKVQLEFENQEMEKKLQEFRSTRNKEKEDRESSEYYWKSGKVGKLVNQSYMMSQNKGNVVKFSAGKVKLKLLKEQIQEPVKPTVNYKMANSSECEKPKINGKVCGQCENKAALLVCLECGEDYCSGCFAKVHQ

SEQ ID NO: 101805 - protein, 694 aa, Homo sapiens
  Payload ID: 20279
  Gene Name: zinc finger, BED-type containing 1
  Uniprot ID: O96006
  ENSP ID: ENSP00000370616
MENKSLESSQTDLKLVAHPRAKSKVWKYFGFDTNAEGCILQWKKIYCRICMAQIAYSGNTSNLSYHLEKNHPEEFCEFVKSNTEQMREAFATAFSKLKPESSQQPGQDALAVKAGHGYDSKKQQELTAAVLGLICEGLYPASIVDEPTFKVLLKTADPRYELPSRKYISTKAIPEKYGAVREVILKELAEATWCGISTDMWRSENQNRAYVTLAAHFLGLGAPNCLSMGSRCLKTFEVPEENTAETITRVLYEVFIEWGISAKVFGATTNYGKDIVKACSLLDVAVHMPCLGHTFNAGIQQAFQLPKLGALLSRCRKLVEYFQQSAVAMYMLYEKQKQQNVAHCMLVSNRVSWWGSTLAMLQRLKEQQFVIAGVLVEDSNNHHLMLEASEWATIEGLVELLQPFKQVAEMLSASRYPTISMVKPLLHMLLNTTLNIKETDSKELSMAKEVIAKELSKTYQETPEIDMFLNVATFLDPRYKRLPFLSAFERQQVENRVVEEAKGLLDKVKDGGYRPAEDKIFPVPEEPPVKKLMRTSTPPPASVINNMLAEIFCQTGGVEDQEEWHAQVVEELSNFKSQKVLGLNEDPLKWWSDRLALFPLLPKVLQKYWCVTATRVAPERLFGSAANVVSAKRNRLAPAHVDEQVFLYENARSGAEAEPEDQDEGEWGLDQEQVFSLGDGVSGGFFGIRDSSFL

SEQ ID NO: 101806 - protein, 694 aa, Homo sapiens; identical to SEQ ID NO: 101805
  Payload ID: 20279
  Gene Name: zinc finger, BED-type containing 1
  Uniprot ID: O96006
  ENSP ID: ENSP00000370620

SEQ ID NO: 101807 - protein, 694 aa, Homo sapiens; identical to SEQ ID NO: 101805
  Payload ID: 20279
  Gene Name: zinc finger, BED-type containing 1
  Uniprot ID: O96006
  ENSP ID: ENSP00000370621

SEQ ID NO: 101808 - protein, 271 aa, Homo sapiens
  Payload ID: 20279
  Gene Name: zinc finger, BED-type containing 1
  ENSP ID: ENSP00000419148
MENKSLESSQTDLKLVAHPRAKSKVWKYFGFDTNAEGCILQWKKIYCRICMAQIAYSGNTSNLSYHLEKNHPEEFCEFVKSNTEQMREAFATAFSKLKPESSQQPGQDALAVKAGHGYDSKKQQELTAAVLGLICEGLYPASIVDEPTFKVLLKTADPRYELPSRKYISTKAIPEKYGAVREVILKELAEATWCGISTDMWRSENQNRAYVTLAAHFLGLGAPNCLSMGSRCLKTFEVPEENTAETITRVLYEVFIEWGISAKVFGATTNY

SEQ ID NO: 101809 - protein, 218 aa, Homo sapiens
  Payload ID: 20280
  Gene Name: zinc finger, BED-type containing 2
  Uniprot ID: Q9BTP6
  ENSP ID: ENSP00000321370
MMRREDEEEEGTMMKAKGDLEMKEEEEISETGELVGPFVSAMPTPMPHNKGTRFSEAWEYFHLAPARAGHHPNQYATCRLCGRQVSRGPGVNVGTTALWKHLKSMHREELEKSGHGQAGQRQDPRPHGPQLPTGIEGNWGRLLEQVGTMALWASQREKEVLRRERAVEWRERAVEKRERALEEVERAILEMKWKVRAEKEACQREKELPAAVHPFHFV

SEQ ID NO: 101810 - protein, 234 aa, Homo sapiens
  Payload ID: 20281
  Gene Name: zinc finger, BED-type containing 3
  Uniprot ID: Q96IU2
  ENSP ID: ENSP00000255198
MRSGEPACTMDQARGLDDAAARGGQCPGLGPAPTPTPPGRLGAPYSEAWGYFHLAPGRPGHPSGHWATCRLCGEQVGRGPGFHAGTSALWRHLRSAHRRELESSGAGSSPPAAPCPPPPGPAAAPEGDWARLLEQMGALAVRGSRRERELERRELAVEQGERALERRRRALQEEERAAAQARRELQAEREALQARLRDVSRREGALGWAPAAPPPLKDDPEGDRDGCVITKVLL

SEQ ID NO: 101811 - protein, 150 aa, Homo sapiens
  Payload ID: 20281
  Gene Name: zinc finger, BED-type containing 3
  ENSP ID: ENSP00000427487
MRSGEPACTMDQARGLDDAAARGGQCPGLGPAPTPTPPGRLGAPYSEAWGYFHLAPGRPGHPSGHWATCRLCGEQVGRGPGFHAGTSALWRHLRSAHRRELESSGAGSSPPAAPCPPPPGPAAAPEGDWARLLEQMGALAVRGSRREREL

SEQ ID NO: 101812 - protein, 1171 aa, Homo sapiens
  Payload ID: 20282
  Gene Name: zinc finger, BED-type containing 4
  Uniprot ID: O75132
  ENSP ID: ENSP00000216268
MENNLKTCPKEDGDFVSDKIKFKIEEEDDDGIPPDSLERMDFKSEQEDMKQTDSGGERAGLGGTGCSCKPPGKYLSAESEDDYGALFSQYSSTLYDVAMEAVTQSLLSSRNMSSRKKSPAWKHFFISPRDSTKAICMYCVKEFSRGKNEKDLSTSCLMRHVRRAHPTVLIQENGSVSAVSSFPSPSLLLPPQPADAGDLSTILSPIKLVQKVASKIPSPDRITEESVSVVSSEEISSDMSVSEKCGREEALVGSSPHLPALHYDEPAENLAEKSLPLPKSTSGSRRRSAVWKHFYLSPLDNSKAVCIHCMNEFSRGKNGKDLGTSCLIRHMWRAHRAIVLQENGGTGIPPLYSTPPTLLPSLLPPEGELSSVSSSPVKPVRESPSASSSPDRLTEDLQSHLNPGDGLMEDVAAFSSSDDIGEASASSPEKQQADGLSPRLFESGAIFQQNKKVMKRLKSEVWHHFSLAPMDSLKAECRYCGCAISRGKKGDVGTSCLMRHLYRRHPEVVGSQKGFLGASLANSPYATLASAESSSSKLTDLPTVVTKNNQVMFPVNSKKTSKLWNHFSICSADSTKVVCLHCGRTISRGKKPTNLGTSCLLRHLQRFHSNVLKTEVSETARPSSPDTRVPRGTELSGASSFDDTNEKFYDSHPVAKKITSLIAEMIALDLQPYSFVDNVGFNRLLEYLKPQYSLPAPSYFSRTAIPGMYDNVKQIIMSHLKEAESGVIHFTSGIWMSNQTREYLTLTAHWVSFESPARPRCDDHHCSALLDVSQVDCDYSGNSIQKQLECWWEAWVTSTGLQVGITVTDNASIGKTLNEGEHSSVQCFSHTVNLIVSEAIKSQRMVQNLLSLARKICERVHRSPKAKEKLAELQREYALPQHHLIQDVPSKWSTSFHMLERLIEQKRAINEMSVECNFRELISCDQWEVMQSVCRALKPFEAASREMSTQMSTLSQVIPMVHILNRKVEMLFEETMGIDTMLRSLKEAMVSRLSATLHDPRYVFATLLDPRYKASLFTEEEAEQYKQDLIRELELMNSTSEDVAASHRCDAGSPSKDSAAEENLWSLVAKVKKKDPREKLPEAMVLAYLEEEVLEHSCDPLTYWNLKKASWPGLSALAVRFLGCPPSIVPSEKLFNTPTENGSLGQSRLMMEHFEKLIFLKVNLPLIYFQY

SEQ ID NO: 101813 - protein, 693 aa, Homo sapiens
  Payload ID: 20283
  Gene Name: zinc finger, BED-type containing 5
  Uniprot ID: Q49AG3
  ENSP ID: ENSP00000398106
MIAPLLCILSYNFNTFAILNVYSKLTMFCTTNSLPMDLLLKQGSLKQEVESFCYQIVSESNDQKVGILQSEDKQLQPSVSKKSEGELSRVKFISNSNKITFSKKPKRRKYDESYLSFGFTYFGNRDAPHAQCVLCKKILSNSSLAPSKLRRHLETKHAAYKDKDISFFKQHLDSPENNKPPTPKIVNTDNESATEASYNVSYHIALSGEAHTIGELLIKPCAKDVVMRMFDEQYSKKIDAVQLSNSTVARRIKDLAADIEEELVCRLKICDGFSLQLDESADVSGLAVLLVFVRYRFNKSIEEDLLLCESLQSNATGEEIFNCINSFMQKHEIEWEKCVDVCSDASRAVDGKIAEAVTLIKYVAPESTSSHCLLYRHALAVKIMPTSLKNVLDQAVQIINYIKARPHQSRLLKILCEEMGAQHTALLLNTEVRWLSRGKVLVRLFELRRELLVFMDSAFRLSDCLTNSSWLLRLAYLADIFTKLNEVNLSMQGKNVTVFTVFDKMSSLLRKLEFWASSVEEENFDCFPTLSDFLTEINSTVDKDICSAIVQHLRGLRATLLKYFPVTNDNNAWVRNPFTVTVKPASLVARDYESLIDLTSDSQVKQNFSELSLNDFWSSLIQEYPSIARRAVRVLLPFATMHLCETGFSYYAATKTKYRKRLDAAPHMRIRLSNITPNIKRICDKKTQKHCSH

SEQ ID NO: 101814 - protein, 693 aa, Homo sapiens; identical to SEQ ID NO: 101813
  Payload ID: 20283
  Gene Name: zinc finger, BED-type containing 5
  Uniprot ID: Q49AG3
  ENSP ID: ENSP00000415939

SEQ ID NO: 101815 - protein, 59 aa, Homo sapiens
  Payload ID: 20283
  Gene Name: zinc finger, BED-type containing 5
  ENSP ID: ENSP00000432764
MIAPLLCILSYNFNTFAILNVYSKLTMFCTTNSLPMDLLLKQGSLKQEVESFCYQIVSE

SEQ ID NO: 101816 - protein, 109 aa, Homo sapiens
  Payload ID: 20283
  Gene Name: zinc finger, BED-type containing 5
  ENSP ID: ENSP00000433093
MIAPLLCILSYNFNTFAILNVYSKLTMFCTTNSLPMDLLLKQGSLKQEVESFCYQIVSESNDQKVGILQSEDKQLQPSVSKKSEGELSRVKFISNSNKITFSKKPKRRK

SEQ ID NO: 101817 - protein, 69 aa, Homo sapiens
  Payload ID: 20283
  Gene Name: zinc finger, BED-type containing 5
  ENSP ID: ENSP00000435491
MIAPLLCILSYNFNTFAILNVYSKLTMFCTTNSLPMDLLLKQGSLKQEVESFCYQIVSESNDQKVGILQ

SEQ ID NO: 101818 - protein, 92 aa, Homo sapiens
  Payload ID: 20283
  Gene Name: zinc finger, BED-type containing 5
  ENSP ID: ENSP00000435663
MIAPLLCILSYNFNTFAILNVYSKLTMFCTTNSLPMDLLLKQGSLKQEVESFCYQIVSESNDQKVGILQSEDKQLQPSVSKKSEGELSRVKF

SEQ ID NO: 101819 - protein, 979 aa, Homo sapiens
  Payload ID: 20284
  Gene Name: zinc finger, BED-type containing 6
  Uniprot ID: P86452
  ENSP ID: ENSP00000447879
MSVCTLSVPVSSLSPGRRCNTFSDSGILGCVPINSNTDEEDVVEEKMVAEGVNKEAKQPAKKKRKKGLRIKGKRRRKKLILAKKFSKDLGSGRPVADAPALLASNDPEQDEESLFESNIEKQIYLPSTRAKTSIVWHFFHVDPQYTWRAICNLCEKSVSRGKPGSHLGTSTLQRHLQARHSPHWTRANKFGVASGEEDFTLDVSLSPSSGSNGSFEYIPTDPLDDNRMGKKHDKSASDALRAERGRFLIKSNIVKHALIPGTRAKTSAVWNFFYTDPQHISRAVCNICKRSVSRGRPGSHLGTSTLQRHLQATHPIHWAVANKDSGAVANGLDEAETERSDLLSDTLHGEKSTGSQDLTAEDLSDSDSDEPMLEVENRSESPIPVAEQGTLMRAQERETTCCGNPVSSHISQAIIQMIVEDMHPYNYFSTPAFQRFMQIVAPDYRLPSETYFFTKAVPQLYDCVREKIFLTLENVQSQKIHLTVDIWTHDPSTDYFIVTVHWVSLETASFLNNGRIPDFRKWAVLCVTGLAKDCLITNILQELNDQIGLWLSPNFLIPSFIVSDNSSNVVHAIKDGGFTHVPCFLHCLNMVIQDFFCEHKSIENMLVAARKTCHHFSHSVKARQILQEFQNDHQLPWKNLKQDETGHWISTFYMLKWLLEHCYSVHHSLGRASGVVLTSLQWTLMTYVCDILKPFEEATQKVSVKTAGLNQVLPLIHHLLLSLQKLREDFQVRGITQALNLVDSLSLKLETDTLLSAMLKSKPCILATLLDPCFKNSLEDFFPQGADLETYKQFLAEEVCNYMESSPEICQIPTSEASCPSVTVGADSFTSSLKEGTSSSGSVDSSAVDNVALGSKSFMFPSAVAVVDEYFKEKYSEFSGGDDPLIYWQRKISIWPALTQVAIQYLSCPMCSWQSECIFTKNSHFHPKQIMSLDFDNIEQLMFLKMNLKNVNYDYSTLVLSWDPEQNEVVQSSEKEILP

SEQ ID NO: 101820 - protein, 594 aa, Homo sapiens
  Payload ID: 20285
  Gene Name: zinc finger, BED-type containing 8
  Uniprot ID: Q8IZ13
  ENSP ID: ENSP00000386184
MSKKRKWDDDYVRYWFTCTTEVDGTQRPQCVLCNSVFSNADLRPSKLSDHFNRQHGGVAGHDLNSLKHMPAPSDQSETLKAFGVASHEDTLLQASYQFAYLCAKEKNPHTVAEKLVKPCALEIAQIVLGPDAQKKLQQVPLSDDVIHSRIDEMSQDILQQVLEDIKASPLKVGIQLAETTDMDDCSQLMAFVRYIKEREIVEEFLFCEPLQLSMKGIDVFNLFRDFFLKHKIALDVCGSVCTDGASSMLGENSEFVAYVKKEIPHIVVTHCLLNPHALVIKTLPTKLRDALFTVVRVINFIKGRAPNHRLFQAFFEEIGIEYSVLLFHTEMRWLSRGQILTHIFEMYEEINQFLHHKSSNLVDGFENKEFKIHLAYLADLFKHLNELSASMQRTGMNTVSAREKLSAFVRKFPFWQKRIEKRNFTNFPFLEEIIVSDNEGIFIAAEITLHLQQLSNFFHGYFSIGDLNEASKWILDPFLFNIDFVDDSYLMKNDLAELRASGQILMEFETMKLEDFWCAQFTAFPNLAKTALEILMPFATTYLCELGFSSLLHFKTKSRSCFNLSDDIRVAISKKVPRFSDIIEQKLQLQQKSL

SEQ ID NO: 101821 - protein, 594 aa, Homo sapiens; identical to SEQ ID NO: 101820
  Payload ID: 20285
  Gene Name: zinc finger, BED-type containing 8
  Uniprot ID: Q8IZ13
  ENSP ID: ENSP00000428831

SEQ ID NO: 101822 - protein, 1325 aa, Homo sapiens
  Payload ID: 20286
  Gene Name: zinc finger, BED-type containing 9
  Uniprot ID: Q6R2W3
  ENSP ID: ENSP00000395259
MEAVSRVFPALAGQAPEEQGEIIKVKVKEEDHTWDQESALRRNLSYTRELSRQRFRQFCYQETPGPREALSQLRELCRQWLNPEIHTKEQILELLVLEQFLTILPEELQSWVREHNPESGEEVVTLLEDLERELDEPRQQVSQGTYGQEVSMEEMIPLDSAKESLGTQLQSMEDRMECESPEPHPLQDNGSFLWFSMMSQSMGGDNLSSLDTNEAEIEPENMREKFFRSLARLLENKSNNTKIFSKAKYCQLIKEVKEAKAKAKKESVDYRRLARFDVILVQGNEKLIEAVNGETDKIRYYLHSEDLFDILHNTHLSIGHGGRTRMEKELQAKYKNITKEVIMLYLTLCKPCQQKNSKLKKVLTSKSIKEVSSRCQVDLIDMQLNPDGEYRFILHYQDLCTKLTFLRSLKSKRPTEVAHALLDIFTIIGAPSVLQSDNGREFSSQVVSELSNIWPELKIVHGKSQTCQSQSSAEQTEDIRKRIFSWMQTNNSSHWTEFLWFIQMSQNQPYHRSMQQTPCESAFSSEAKLGLSHSQLTEELVASLHTENELDQADKELENTLRAQYEENIETGTDSSDIEENLSVTPKVAEKSPPESRLRFLSCVVCEKECTGVNSCISCDGNIHAICGVPSQHGTEGCGRQITCSLCYETSTMKRKHDEIQRSLPVKPSKMLKPSGTPFSPDKVGDWMAKQASLDFFVKKRHAFSEHSSSNKRNVNNRSYPEEGKTKRVHASFTRKYDPSYIEFGFVAVIDGEVLKPQCIICGDVLANEAMKPSKLKRHLYSKHKEISSQPKEFFERKSSELKSQPKQVFNVSHINISALRASYKVALPVAKSKTPYTIAETLVKDCIKEVCLEMLGESAAKKVAQVPLSNDTIARRIQELANDMEDQLIEQIKLAKYFSLQLDECRDIANMIILLVYVRFEHDDDIKEEFFFSASLPTNTTSSELYEAVKNYIVNKCGLEFKFCVGVCSDGAASMTGKHSEVVTQIKELAPECKTTHCFIHRESLAMKKISAELNSVLNDIVKIVNYIKSNSLNSRLFSLLCDNMEADHKQLLLHAEIRWLSRGKVLSRMFEIRNELLVFLQGKKPMWSQLFKDVNWTARLAYLSDIFSIFNDLNASMQGKNATYFSMADKVEGQKQKLEAWKNRISTDCYDMFHNLTTIINEVGNDLDIAHLRKVISEHLTNLLECFEFYFPSKEDPRIGNLWIQNPFLSSKDNLNLTVTLQDKLLKLATDEGLKISFENTASLPSFWIKAKNDYPELAEIALKLLLLFPSTYLCETGFSTLSVIKTKHRNSLNIHYPLRVALSSIQPRLDKLTSKKQAHLSH

SEQ ID NO: 101823 - protein, 794 aa, Homo sapiens
  Payload ID: 20286
  Gene Name: zinc finger, BED-type containing 9
  ENSP ID: ENSP00000420877
MEAVSRVFPALAGQAPEEQGEIIKVKVKEEDHTWDQESALRRNLSYTRELSRQRFRQFCYQETPGPREALSQLRELCRQWLNPEIHTKEQILELLVLEQFLTILPEELQSWVREHNPESGEEVVTLLEDLERELDEPRQQVSQGTYGQEVSMEEMIPLDSAKESLGTQLQSMEDRMECESPEPHPLQDNGSFLWFSMMSQSMGGDNLSSLDTNEAEIEPENMREKFFRSLARLLENKSNNTKIFSKAKYCQLIKEVKEAKAKAKKESVDYRRLARFDVILVQGNEKLIEAVNGETDKIRYYLHSEDLFDILHNTHLSIGHGGRTRMEKELQAKYKNITKEVIMLYLTLCKPCQQKNSKLKKVLTSKSIKEVSSRCQVDLIDMQLNPDGEYRFILHYQDLCTKLTFLRSLKSKRPTEVAHALLDIFTIIGAPSVLQSDNGREFSSQVVSELSNIWPELKIVHGKSQTCQSQSSAEQTEDIRKRIFSWMQTNNSSHWTEFLWFIQMSQNQPYHRSMQQTPCESAFSSEAKLGLSHSQLTEELVASLHTENELDQADKELENTLRAQYEENIETGTDSSDIEENLSVTPKVAEKSPPESRLRFLSCVVCEKECTGVNSCISCDGNIHAICGVPSQHGTEGCGRQITCSLCYETSTMKRKHDEIQRSLPVKPSKMLKPSGTPFSPDKVGDWMAKQASLDFFVKKRHAFSEHSSSNKRNVNNRSYPEEGKTKRVHASFTRKYDPSYIEFGFVAVIDGEVLKPQCIICGDVLANEAMKPSKLKRHLYSKHKEISSQPKEF

SEQ ID NO: 101824 - protein, 325 aa, Homo sapiens
  Payload ID: 20287
  Gene Name: zinc finger, C2HC-type containing 1A
  Uniprot ID: Q96GY0
  ENSP ID: ENSP00000263849
MEGLEENGGVVQVGELLPCKICGRTFFPVALKKHGPICQKTATKKRKTFDSSRQRAEGTDIPTVKPLKPRPEPPKKPSNWRRKHEEFIATIRAAKGLDQALKEGGKLPPPPPPSYDPDYIQCPYCQRRFNENAADRHINFCKEQAARISNKGKFSTDTKGKPTSRTQVYKPPALKKSNSPGTASSGSSRLPQPSGAGKTVVGVPSGKVSSSSSSLGNKLQTLSPSHKGIAAPHAGANVKPRNSTPPSLARNPAPGVLTNKRKTYTESYIARPDGDCASSLNGGNIKGIEGHSPGNLPKFCHECGTKYPVEWAKFCCECGIRRMIL

SEQ ID NO: 101825 - protein, 197 aa, Homo sapiens
  Payload ID: 20287
  Gene Name: zinc finger, C2HC-type containing 1A
  ENSP ID: ENSP00000427797
  MOD_RES (1)..(1): Any amino acid
XYKPPALKKSNSPGTASSGSSRLPQPSGAGKTVVGVPSGKVSSSSSSLGNKLQTLSPSHKGIAAPHAGNMDKLGPPLRTGRLVQRLYDSDTKSDSAIKRHELLPIYKANVKPRNSTPPSLARNPAPGVLTNKRKTYTESYIARPDGDCASSLNGGNIKGIEGHSPGNLPKFCHECGTKYPVEWAKFCCECGIRRMIL

SEQ ID NO: 101826 - protein, 222 aa, Homo sapiens
  Payload ID: 20288
  Gene Name: zinc finger, C2HC-type containing 1B
  Uniprot ID: Q5TFG8
  ENSP ID: ENSP00000237275
MAGAEPFLADGNQELFPCEVCGRRFAADVLERHGPICKKLFNRKRKPFSSLKQRLQGTDIPTVKKTPQSKSPPVRKSNWRQQHEDFINAIRSAKQCMLAIKEGRPLPPPPPPSLNPDYIQRPYCMRRFNESAAERHTNFCKDQSSRRVFNPAQTAAKLASRAQGRAQMGPKKEPTVTSAVGALLQNRVLVATNEVPTKSGLAMDPASGAKLRQGFSKSSKKD

SEQ ID NO: 101827 - protein, 389 aa, Homo sapiens
  Payload ID: 20289
  Gene Name: zinc finger, C2HC-type containing 1C
  ENSP ID: ENSP00000238686
MAGLQRLASHLPVGVMLPHNTTEAPGPHSAKQDSYEQGDSSQQSLKGHLRNNFQKQLLSNKELILDKVYTHPKWNTQTKARSYSYPHCTGISQQDPESDSQGQGNGLFYSSGPQSWYPKANNQDFIPFTKKRVGVDRAFPLKPMVHRKSCSTGEAGTDGDHNVYPRPPEPREFSSRNFGVRNQGNFSVVGTVLAATQAEKAVANFDRTEWVQIRRLEAAGESLEEEIRRKQILLRGKLKKTEEELRRIQTQKEQAKENENGELQKIILPRSRVKGNKSNTMYKPIFSPEFEFEEEFSRDRREDETWGRSQQNSGPFQFSDYRIQRLKRERLVASNNKIRDPVSEPSVEKFSPPSETPVGALQGSARNSSLSMAPDSSGSSGSIEEPQLG

SEQ ID NO: 101828 - protein, 275 aa, Homo sapiens
  Payload ID: 20289
  Gene Name: zinc finger, C2HC-type containing 1C
  Uniprot ID: Q53FD0
  ENSP ID: ENSP00000390606
MAGLQRLASHLPVGVMLPHNTTEAPGPHSAKQDSYEQGDSSQQSLKGHLRNNFQKQLLSNKELILDKVYTHPKWNTQTKARSYSYPHCTGISQQDPESDSQGQGNGLFYSSGPQSWYPKANNQDFIPFTKKRVGVDRAFPLKPMVHRKSCSTGEAGTDGDHNVYPRPPEPREFSSRNFGVRNQGNFSVVGTVLAATQAEKAVANFDRTEWVQIRRLEAAGESLEEEIRRKQILLRGKLKKTEEELRRIQTQKEQAKENENGELQKIILPRSRVKG

SEQ ID NO: 101829 - protein, 157 aa, Homo sapiens
  Payload ID: 20289
  Gene Name: zinc finger, C2HC-type containing 1C
  ENSP ID: ENSP00000434733
  MOD_RES (1)..(1): Any amino acid
XVDRAFPLKPMVHRKSCSTGEAGTDGDHNVYPRPPEPREFSSRNFGVRNQGNFSVVGTVLAATQAEKAVANFDRTEWVQIRRLEAAGESLEEEIRRKQILLRGKLKKTEEELRRIQTQKEQAKENENGELQKIILPRSRVKVLCLWKLSGCTFLSFL

SEQ ID NO: 101830 - protein, 93 aa, Homo sapiens
  Payload ID: 20289
  Gene Name: zinc finger, C2HC-type containing 1C
  ENSP ID: ENSP00000434997
MAGLQRLASHLPVGVMLPHNTTEAPGPHSAKQDSYEQGDSSQQSLKGHLRNNFQKQLLSNKELILDKVYTHPKWNTQTKARSYSYPHCTGISQ

SEQ ID NO: 101831 - protein, 456 aa, Homo sapiens
  Payload ID: 20289
  Gene Name: zinc finger, C2HC-type containing 1C
  Uniprot ID: Q53FD0
  ENSP ID: ENSP00000435550
MAGLQRLASHLPVGVMLPHNTTEAPGPHSAKQDSYEQGDSSQQSLKGHLRNNFQKQLLSNKELILDKVYTHPKWNTQTKARSYSYPHCTGISQQDPESDSQGQGNGLFYSSGPQSWYPKANNQDFIPFTKKRVGVDRAFPLKPMVHRKSCSTGEAGTDGDHNVYPRPPEPREFSSRNFGVRNQGNFSVVGTVLAATQAEKAVANFDRTEWVQIRRLEAAGESLEEEIRRKQILLRGKLKKTEEELRRIQTQKEQAKENENGELQKIILPRSRVKGNKSNTMYKPIFSPEFEFEEEFSRDRREDETWGRSQQNSGPFQFSDYRIQRLKRERLVASNNKIRDPVSEPSVEKFSPPSETPVGALQGSARNSSLSMAPDSSGSSGSIEEPQLGECSHCGRKFLSFRLERHSNICSRMRGSKRKVFDSSRARAKGTELEQYLNWKGPASAKAEPPQKSNWR

SEQ ID NO: 101832 - protein, 92 aa, Homo sapiens
  Payload ID: 20289
  Gene Name: zinc finger, C2HC-type containing 1C
  ENSP ID: ENSP00000435684
MAGLQRLASHLPVGVMLPHNTTEAPGPHSAKQDSYEQGDSSQQSLKGHLRNNFQKQLLSNKELILDKVYTHPKWNTQTKARSYSYPHCTGIS

SEQ ID NO: 101833 - protein, 171 aa, Homo sapiens
  Payload ID: 20289
  Gene Name: zinc finger, C2HC-type containing 1C
  ENSP ID: ENSP00000437160
MAGLQRLASHLPVGVMLPHNTTEAPGPHSAKQDSYEQGDSSQQSLKGHLRNNFQKQLLSNKELILDKVYTHPKWNTQTKARSYSYPHCTGISQQDPESDSQGQGNGLFYSSGPQSWYPKANNQDFIPFTKKRVGVDRAFPLKPMVHRKSCSTGEAGTDGDHNVYPRPPEPR

SEQ ID NO: 101834 - protein, 161 aa, Homo sapiens
  Payload ID: 20289
  Gene Name: zinc finger, C2HC-type containing 1C
  ENSP ID: ENSP00000451195
MAGLQRLASHLPVGVMLPHNTTEAPGPHSAKQDSYEQGDSSQQSLKGHLRNNFQKQLLSNKELILDKVYTHPKWNTQTKARSYSYPHCTGISQQDPESDSQGQGNGLFYSSGPQSWYPKANNQDFIPFTKKRVGVDRAFPLKPMVHRKSCSTGEAGTDGDH

SEQ ID NO: 101835 - protein, 1989 aa, Homo sapiens
  Payload ID: 20290
  Gene Name: zinc finger, C3H1-type containing
  Uniprot ID: O60293
  ENSP ID: ENSP00000368017
MATADTPAPASSGLSPKEEGELEDGEISDDDNNSQIRSRSSSSSSGGGLLPYPRRRPPHSARGGGSGGGGGSSSSSSSSQQQLRNFSRSRHASERGHLRGPSSYRPKEPFRSHPPSVRMPSSSLSESSPRPSFWERSHLALDRFRFRGRPYRGGSRWSRGRGVGERGGKPGCRPPLGGGAGSGFSSSQSWREPSPPRKSSKSFGRSPSRKQNYSSKNENCVEETFEDLLLKYKQIQLELECINKDEKLALSSKEENVQEDPKTLNFEDQTSTDNVSITKDSSKEVAPEEKTQVKTFQAFELKPLRQKLTLPGDKNRLKKVKDGAKPLSLKSDTTDSSQGLQDKEQNLTRRISTSDILSEKKLGEDEEELSELQLRLLALQSASKKWQQKEQQVMKESKEKLTKTKTVQQKVKTSTKTHSAKKVSTTAKQALRKQQTKAWKKLQQQKEQERQKEEDQRKQAEEEERRKREEEIRKIRDLSNQEEQYNRFMKLVGGKRRSRSKSSDPDLRRSLDKQPTDSGGGIYQYDNYEEVAMDTDSETSSPAPSPVQPPFFSECSLGYFSPAPSLSLPPPPQVSSLPPLSQPYVEGLCVSLEPLPPLPPLPPLPPEDPEQPPKPPFADEEEEEEMLLREELLKSLANKRAFKPEETSSNSDPPSPPVLNNSHPVPRSNLSIVSINTVSQPRIQNPKFHRGPRLPRTVISLPKHKSVVVTLNDSDDSESDGEASKSTNSVFGGLESMIKEARRTAEQASKPKVPPKSEKENDPLRTPEALPEEKKIEYRLLKEEIANREKQRLIKSDQLKTSSSSPANSDVEIDGIGRIAMVTKQVTDAESKLKKHRILLMKDESVLKNLVQQEAKKKESVRNAEAKITKLTEQLQATEKILNVNRMFLKKLQEQIHRVQQRVTIKKALTLKYGEELARAKAVASKEIGKRKLEQDRFGPNKMMRLDSSPVSSPRKHSAELIAMEKRRLQKLEYEYALKIQKLKEARALKAKEQQNISPVVEEEPEFSLPQPSLHDLTQDKLTLDTEENDVDDEILSGSSRERRRSFLESNYFTKPNLKHTDTANKECINKLNKNTVEKPELFLGLKIGELQKLYSKADSLKQLILKTTTGITEKVLHGQEISVDVDFVTAQSKTMEVKPCPFRPYHSPLLVFKSYRFSPYYRTKEKLPLSSVSYSNMIEPDQCFCRFDLTGTCNDDDCQWQHIQDYTLSRKQLFQDILSYNLSLIGCAETSTNEEITASAEKYVEKLFGVNKDRMSMDQMAVLLVSNINESKGHTPPFTTYKDKRKWKPKFWRKPISDNSFSSDEEQSTGPIKYAFQPENQINVPALDTVVTPDDVRYFTNETDDIANLEASVLENPSHVQLWLKLAYKYLNQNEGECSESLDSALNVLARALENNKDNPEIWCHYLRLFSKRGTKDEVQEMCETAVEYAPDYQSFWTFLHLESTFEEKDYVCERMLEFLMGAAKQETSNILSFQLLEALLFRVQLHIFTGRCQSALAILQNALKSANDGIVAEYLKTSDRCLAWLAYIHLIEFNILPSKFYDPSNDNPSRIVNTESFVMPWQAVQDVKTNPDMLLAVFEDAVKACTDESLAVEERIEACLPLYTNMIALHQLLERYEAAMELCKSLLESCPINCQLLEALVALYLQTNQHDKARAVWLTAFEKNPQNAEVFYHMCKFFILQNRGDNLLPFLRKFIASFFKPGFEKYNNLDLFRYLLNIPGPIDIPSRLCKGNFDDDMFNHQVPYLWLIYCLCHPLQSSIKETVEAYEAALGVAMRCDIVQKIWMDYLVFANNRAAGSRNKVQEFKFFTDLVNRCLVTVPARYPIPFSSADYWSNYEFHNRVIFFYLSCVPKTQHSKTLERFCSVMPANSGLALRLLQHEWEESNVQILKLQAKMFTYNIPTCLATWKIAIAAEIVLKGQREVHRLYQRALQKLPLCASLWKDQLLFEASEGGKTDNLRKLVSKCQEIGVSLNELLNLNSNKTESKNH

SEQ ID NO: 101836 - protein, 1910 aa, Homo sapiens
  Payload ID: 20290
  Gene Name: zinc finger, C3H1-type containing
  Uniprot ID: O60293
  ENSP ID: ENSP00000446995
MATADTPAPASSGLSPKEEGELEDGEISDDDNNSQIRSRSSSSSSGGGLLPYPRRRPPHSARGGGSGGGGGSSSSSSSSQQQLRNFSRSRHASERGHLRGPSSYRPKEPFRSHPPSVRMPSSSLSESSPRPSFWERSHLALDRFRFRGRPYRGGSRWSRGRGVGERGGKPGCRPPLGGGAGSGFSSSQSWREPSPPRKSSKSFGRSPSRKQNYSSKNENCVEETFEDLLLKYKQIQLELECINKDEKLALSSKEENVQEDPKTLNFEDQTSTDNVSITKDSSKEVAPEEKTQVKTFQAFELKPLRQKLTLPGDKNRLKKVKDGAKPLSLKSDTTDSSQGLQDKEQNLTRRISTSDILSEKKLGEDEEELSELQLRLLALQSASKKWQQKEQQVMKESKEKLTKTKTVQQKVKTSTKTHSAKKVSTTAKQALRKQQTKAWKKLQQQKEQERQKEEDQRKQAEEEERRKREEEIRKIRDLSNQEEQYNRFMKLVGGKRRSRSKSSDPDLRRSLDKQPTDSGGGIYQYDNYEEVAMDTDSETSSPAPSPVQPPFFSECSLGYFSPAPSLSLPPPPQVSSLPPLSQPYVEGLCVSLEPLPPLPPLPPLPPEDPEQPPKPPFADEEEEEEMLLREELLKSLANKRAFKPEETSSNSDPPSPPVLNNSHPVPRSNLSIVSINTVSQPRIQNPKFHRGPRLPRTVISLPKHKSVVVTLNDSDDSESDGEASKSTNSVFGGLESMIKEARRTAEQASKPKVPPKSEKENDPLRTPEALPEEKKIEYRLLKEEIANREKQRLIKSDQLKTSSSSPANSDVEIDGIGRIAMVTKQVTDAESKLKKHRILLMKDESVLKNLVQQEAKKKESVRNAEAKITKLTEQLQATEKILNVNRMFLKKLQEQIHRVQQRVTIKKALTLKYGEELARAKAVASKEIGKRKLEQDRFGPNKMMRLDSSPVSSPRKHSAELIAMEKRRLQKLEYEYALKIQKLKEARALKAKEQQNISPVVEEEPEFSLPQPSLHDLTQDKLTLDTEENDVDDEILSGSSRERRRSFLESNYFTKPNLKHTDTANKECINKLNKNTVEKPELFLGLKIGELQKLYSKADSLKQLILKTTTGITEKVLHGQEISVDVDFVTAQSKTMEVKPCPFRPYHSPLLVFKSYRFSPYYRTKEKLPLSSVSYSNMIEPDQCFCRFDLTGTCNDDDCQWQHIQDYTLSRKQLFQDILSYNLSLIGCAETSTNEEITASAEKYVEKLFGVNKDRMSMDQMAVLLVSNINESKGHTPPFTTYKDKRKWKPKFWRKPISDNSFSSDEEQSTGPIKYAFQPENQINVPALDTVVTPDDVRYFTNETDDIANLEASVLENPSHVQLWLKLAYKYLNQNEGECSESLDSALNVLARALENNKDNPEIWCHYLRLFSKRGTKDEVQEMCETAVEYAPDYQSFWTFLHLESTFEEKDYVCERMLEFLMGAAKQETSNILSFQLLEALLFRVQLHIFTGRCQSALAILQNALKSANDGIVAEYLKTSDRCLAWLAYIHLIEFNILPSKFYDPSNDNPSRIVNTESFVMPWQAVQDVKTNPDMLLAVFEDAVKACTDESLAVEERIEACLPLYTNMIALHQLLERYEAAMELCKSLLESCPINCQLLEALVALYLQTNQHDKARAVWLTAFEKNPQNAEVFYHMCKFFILQNRGDNLLPFLRKFIASFFKPGFEKYNNLDLFRYLLNIPGPIDIPSRLCKGNFDDDMFNHQVPYLWLIYCLCHPLQSSIKETVEAYEAALGVAMRCDIVQKIWMDYLVFANNRAAGSRNKVQEFKFFTDLVNRCLVTVPARYPIPFSSADYWSNYEFHNRVIFFYLSCVPKTQHSKTLERFCSVMPANSGLALRLLQHEWEESNVQILKLQAKMFTYNIPTCLATWKM

SEQ ID NO: 101837 - protein, 358 aa, Homo sapiens
  Payload ID: 20290
  Gene Name: zinc finger, C3H1-type containing
  ENSP ID: ENSP00000447976
MATADTPAPASSGLSPKEEGELEDGEISDDDNNSQIRSRSSSSSSGGGLLPYPRRRPPHSARGGGSGGGGGSSSSSSSSQQQLRNFSRSRHASERGHLRGPSSYRPKEPFRSHPPSVRMPSSSLSESSPRPSFWERSHLALDRFRFRGRPYRGGSRWSRGRGVGERGGKPGCRPPLGGGAGSGFSSSQSWREPSPPRKSSKSFGRSPSRKQNYSSKNENCVEETFEDLLLKYKQIQLELECINKDEKLALSSKEENVQEDPKTLNFEDQTSTDNVSITKDSSKEVAPEEKTQVKTFQAFELKPLRQKLTLPGDKNRLKKVKDGAKPLSLKSDTTDSSQGIPYRVKEGFTPIPGLKFSA

SEQ ID NO: 101838 - protein, 346 aa, Homo sapiens
  Payload ID: 20290
  Gene Name: zinc finger, C3H1-type containing
  Uniprot ID: O60293
  ENSP ID: ENSP00000450044
MATADTPAPASSGLSPKEEGELEDGEISDDDNNSQIRSRSSSSSSGGGLLPYPRRRPPHSARGGGSGGGGGSSSSSSSSQQQLRNFSRSRHASERGHLRGPSSYRPKEPFRSHPPSVRMPSSSLSESSPRPSFWERSHLALDRFRFRGRPYRGGSRWSRGRGVGERGGKPGCRPPLGGGAGSGFSSSQSWREPSPPRKSSKSFGRSPSRKQNYSSKNENCVEETFEDLLLKYKQIQLELECINKDEKLALSSKEENVQEDPKTLNFEDQTSTDNVSITKDSSKEVAPEEKTQVKTFQAFELKPLRQKLTLPGDKNRLKKVKDGAKPLSLKSDTTDSSQGNGIKYFS

SEQ ID NO: 101839 - protein, 481 aa, Homo sapiens
  Payload ID: 20291
  Gene Name: zinc finger, C3HC-type containing 1
  Uniprot ID: Q86WB0
  ENSP ID: ENSP00000309301
MRGLPRKREAWTQPHPLEALYESLRVLEKDTSATSQSVNGSPQAEQPSLESTSKEAFFSRVETFSSLKWAGKPFELSPLVCAKYGWVTVECDMLKCSSCQAFLCASLQPAFDFDRYKQRCAELKKALCTAHEKFCFWPDSPSPDRFGMLPLDEPAILVSEFLDRFQSLCHLDLQLPSLRPEDLKTMCLTEDKISLLLHLLEDELDHRTDERKTTIKLGSDIQVHVTACILSVCGWACSSSLESMQLSLITCSQCMRKVGLWGFQQIESSMTDLDASFGLTSSPIPGLEGRPERLPLVPESPRRMMTRSQDATFSPGSEQAEKSPGPIVSRTRSWDSSSPVDRPEPEAASPTTRTRPVTRSMGTGDTPGLEVPSSPLRKAKRARLCSSSSSDTSSRSFFDPTSQHRDWCPWVNITLGKESRENGGTEPDASAPAEPGWKAVLTILLAHKQSSQPAETDSMSLSEKSRKVFRIFRQWESLCSC

SEQ ID NO: 101840 - protein, 502 aa, Homo sapiens
  Payload ID: 20291
  Gene Name: zinc finger, C3HC-type containing 1
  Uniprot ID: Q86WB0
  ENSP ID: ENSP00000351052
MAAPCEGQAFAVGVEKNWGAVVRSPEGTPQKIRQLIDEGIAPEEGGVDAKDTSATSQSVNGSPQAEQPSLESTSKEAFFSRVETFSSLKWAGKPFELSPLVCAKYGWVTVECDMLKCSSCQAFLCASLQPAFDFDRYKQRCAELKKALCTAHEKFCFWPDSPSPDRFGMLPLDEPAILVSEFLDRFQSLCHLDLQLPSLRPEDLKTMCLTEDKISLLLHLLEDELDHRTDERKTTIKLGSDIQVHVTACILSVCGWACSSSLESMQLSLITCSQCMRKVGLWGFQQIESSMTDLDASFGLTSSPIPGLEGRPERLPLVPESPRRMMTRSQDATFSPGSEQAEKSPGPIVSRTRSWDSSSPVDRPEPEAASPTTRTRPVTRSMGTGDTPGLEVPSSPLRKAKRARLCSSSSSDTSSRSFFDPTSQHRDWCPWVNITLGKESRENGGTEPDASAPAEPGWKAVLTILLAHKQSSQPAETDSMSLSEKSRKVFRIFRQWESLCSC

SEQ ID NO: 101841 - protein, 431 aa, Homo sapiens
  Payload ID: 20291
  Gene Name: zinc finger, C3HC-type containing 1
  Uniprot ID: Q86WB0
  ENSP ID: ENSP00000353933
MAAPCEGQAFAVGVEKNWGAVVRSPEGTPQKIRQLIDEGIAPEEGGVDAKDTSATSQSVNGSPQAEQPSLESTSKEAFFSRVETFSSLKWAGKPFELSPLVCAKYGWVTVECDMLKCSSCQAFLCASLQPAFDFDRYKQRCAELKKALCTAHEKFCFWPDSPSPDRFGMLPLDEPAILVSEFLDRFQSLCHLDLQLPSLRPEDLKTMCLTEDKISLLLHLLEDELDHRTDERKTTIKLGSDIQVHVTACILSVCGWACSSSLESMQLSLITCSQCMRKVGLWGFQQIESSMTDLDASFGLTSSPIPGLEGRPERLPLVPESPRRMMTRSQDATFSPGSEQDTSSRSFFDPTSQHRDWCPWVNITLGKESRENGGTEPDASAPAEPGWKAVLTILLAHKQSSQPAETDSMSLSEKSRKVFRIFRQWESLCSC

SEQ ID NO: 101842 - protein, 95 aa, Homo sapiens
  Payload ID: 20291
  Gene Name: zinc finger, C3HC-type containing 1
  ENSP ID: ENSP00000417217
MAAPCEGQAFAVGVEKNWGAVVRSPEGTPQKIRQLIDEGIAPEEGGVDAKDTSATSQSVNGSPQAEQPSLESTSKEAFFSRVETFSYFDQSPICA

SEQ ID NO: 101843 - protein, 49 aa, Homo sapiens
  Payload ID: 20291
  Gene Name: zinc finger, C3HC-type containing 1
  ENSP ID: ENSP00000417682
MAAPCEGQAFAVGVEKNWGAVVRSPEGTPQKIRQLIDEGIAPEEGGVDA

SEQ ID NO: 101844 - protein, 459 aa, Homo sapiens
  Payload ID: 20291
  Gene Name: zinc finger, C3HC-type containing 1
  ENSP ID: ENSP00000418533
MAAPCEGQAFAVGVEKNWGAVVRSPEGTPQKIRQLIDEGIAPEEGGVDAKDTSATSQSVNGSPQAEQPSLESTSKEAFFSRVETFSSLKWAGKPFELSPLVCAKYGWVTVECDMLKCSSCQAFLCASLQPAFDFDRYKQRCAELKKALCTAHEKFCFWPDSPSPDRFGMLPLDEPAILVSEFLDRFQSLCHLDLQLPSLRPEDLKTMCLTEDKISLLLHLLEDELDHRTDERKTTIKLGSDIQVHVTACILSVCGWACSSPIPGLEGRPERLPLVPESPRRMMTRSQDATFSPGSEQAEKSPGPIVSRTRSWDSSSPVDRPEPEAASPTTRTRPVTRSMGTGDTPGLEVPSSPLRKAKRARLCSSSSSDTSSRSFFDPTSQHRDWCPWVNITLGKESRENGGTEPDASAPAEPGWKAVLTILLAHKQSSQPAETDSMSLSEKSRKVFRIFRQWESLCSC

SEQ ID NO: 101845 - protein, 53 aa, Homo sapiens
  Payload ID: 20291
  Gene Name: zinc finger, C3HC-type containing 1
  ENSP ID: ENSP00000419509
MAAPCEGQAFAVGVEKNWGAVVRSPEGTPQKIRQLIDEGIAPEEGGVDATTPA

SEQ ID NO: 101846 - protein, 50 aa, Homo sapiens
  Payload ID: 20291
  Gene Name: zinc finger, C3HC-type containing 1
  ENSP ID: ENSP00000420068
MAAPCEGQAFAVGVEKNWGAVVRSPEGTPQKIRQLIDEGIAPEEGGVDAP

SEQ ID NO: 101847 - protein, 201 aa, Homo sapiens
  Payload ID: 20292
  Gene Name: zinc finger, C4H2 domain containing
  Uniprot ID: Q9NQZ6
  ENSP ID: ENSP00000338650
MEKIKARLKAEFEALESEERHLKEYKQEMDLLLQEKMAHVEELRLIHADINVMENTIKQSENDLNKLLESTRRLHDEYKPLKEHVDALRMTLGLQRLPDLCEEEEKLSLDYFEKQKAEWQTEPQEPPIPESLAAAAAAAQQLQVARKQDTRQTATFRQQPPPMKACLSCHQQIHRNAPICPLCKAKSRSRNPKKPKRKQDE

SEQ ID NO: 101848 - protein, 224 aa, Homo sapiens
  Payload ID: 20292
  Gene Name: zinc finger, C4H2 domain containing
  Uniprot ID: Q9NQZ6
  ENSP ID: ENSP00000363972
MADEQEIMCKLESIKEIRNKTLQMEKIKARLKAEFEALESEERHLKEYKQEMDLLLQEKMAHVEELRLIHADINVMENTIKQSENDLNKLLESTRRLHDEYKPLKEHVDALRMTLGLQRLPDLCEEEEKLSLDYFEKQKAEWQTEPQEPPIPESLAAAAAAAQQLQVARKQDTRQTATFRQQPPPMKACLSCHQQIHRNAPICPLCKAKSRSRNPKKPKRKQDE

SEQ ID NO: 101849 - protein, 176 aa, Homo sapiens
  Payload ID: 20292
  Gene Name: zinc finger, C4H2 domain containing
  Uniprot ID: Q9NQZ6
  ENSP ID: ENSP00000399126
MADEQEIMCKLESIKEIRNKTLQMEKIKARLKAEFEALESEERHLKEYKQEMDLLLQEKMAHVEELRLIHADINVMENTIKQSENDLNKLLESTRRLHDEYKPLKEHVDALRMTLGLQRLPDLCEEEEKLSLEPACHVTSKFTGMHLYALFARPRVGPGTPKSRNGSRMNKEREST

SEQ ID NO: 101850 - protein, 531 aa, Homo sapiens
  Payload ID: 20293
  Gene Name: zinc finger, CCCH-type with G patch domain
  Uniprot ID: Q8N5A5
  ENSP ID: ENSP00000332013
MDEESLESALQTYRAQLQQVELALGAGLDSSEQADLRQLQGDLKELIELTEASLVSVRKSSLLAALDEERPGRQEDAEYQAFREAITEAVEAPAAARGSGSETVPKAEAGPESAAGGQEEEEGEDEEELSGTKVSAPYYSSWGTLEYHNAMVVGTEEAEDGSAGVRVLYLYPTHKSLKPCPFFLEGKCRFKENCRFSHGQVVSLDELRPFQDPDLSSLQAGSACLAKHQDGLWHAARITDVDNGYYTVKFDSLLLREAVVEGDGILPPLRTEATESDSDSDGTGDSSYARVVGSDAVDSAQSSALCPSLAVVGSDAVDSGTCSSAFAGWEVHTRGIGSRLLTKMGYEFGKGLGRHAEGRVEPIHAVVLPRGKSLDQCVETLQKQTRVGKAGTNKPPRCRGRGARPGGRPAPRNVFDFLNEKLQGQAPGALEAGAAPAGRRSKDMYHASKSAKRALSLRLFQTEEKIERTQRDIRSIQEALARNAGRHSVASAQLQEKLAGAQRQLGQLRAQEAGLQQEQRKADTHKKMTEF

SEQ ID NO: 101851 - protein, 511 aa, Homo sapiens
  Payload ID: 20293
  Gene Name: zinc finger, CCCH-type with G patch domain
  Uniprot ID: Q8N5A5
  ENSP ID: ENSP00000348242
MDEESLESALQTYRAQLQQVELALGAGLDSSEQADLRQLQGDLKELIELTEASLVSVRKSSLLAALDEERPGRQEDAEYQAFREAITEAVEAPAAARGSGSETVPKAEAGPESAAGGQEEEEGEDEEELSGTKVSAPYYSSWGTLEYHNAMVVGTEEAEDGSAGVRVLYLYPTHKSLKPCPFFLEGKCRFKENCRFSHGQVVSLDELRPFQDPDLSSLQAGSACLAKHQDGLWHAARITDVDNGYYTVKFDSLLLREAVVEGDGILPPLRTEATESDSDSDGTGDSSYARVVGSDAVDSGTCSSAFAGWEVHTRGIGSRLLTKMGYEFGKGLGRHAEGRVEPIHAVVLPRGKSLDQCVETLQKQTRVGKAGTNKPPRCRGRGARPGGRPAPRNVFDFLNEKLQGQAPGALEAGAAPAGRRSKDMYHASKSAKRALSLRLFQTEEKIERTQRDIRSIQEALARNAGRHSVASAQLQEKLAGAQRQLGQLRAQEAGLQQEQRKADTHKKMTEF

SEQ ID NO: 101852 - protein, 502 aa, Homo sapiens
  Payload ID: 20293
  Gene Name: zinc finger, CCCH-type with G patch domain
  Uniprot ID: Q8N5A5
  ENSP ID: ENSP00000349634
MDEESLESALQTYRAQLQQVELALGAGLDSSEQADLRQLQGDLKELIELTEASLVSVRKSSLLAALDEERPGRQEDAEYQAFREAITEAVEAPAAARGSGSETVPKAEAGPESAAGGQEEEEGEDEEELSGTKVSAPYYSSWGTLEYHNAMVVGTEEAEDGSAGVRVLYLYPTHKSLKPCPFFLEGKCRFKENCRFSHGQVVSLDELRPFQDPDLSSLQAGSACLAKHQDGLWHAARITDVDNGYYTVKFDSLLLREAVVEGDGILPPLRTEATESDSDSDVVGSDAVDSGTCSSAFAGWEVHTRGIGSRLLTKMGYEFGKGLGRHAEGRVEPIHAVVLPRGKSLDQCVETLQKQTRVGKAGTNKPPRCRGRGARPGGRPAPRNVFDFLNEKLQGQAPGALEAGAAPAGRRSKDMYHASKSAKRALSLRLFQTEEKIERTQRDIRSIQEALARNAGRHSVASAQLQEKLAGAQRQLGQLRAQEAGLQQEQRKADTHKKMTEF

SEQ ID NO: 101853 - protein, 511 aa, Homo sapiens; identical to SEQ ID NO: 101851
  Payload ID: 20293
  Gene Name: zinc finger, CCCH-type with G patch domain
  Uniprot ID: Q8N5A5
  ENSP ID: ENSP00000358984

SEQ ID NO: 101854 - protein, 511 aa, Homo sapiens; identical to SEQ ID NO: 101851
  Payload ID: 20293
  Gene Name: zinc finger, CCCH-type with G patch domain
  Uniprot ID: Q8N5A5
  ENSP ID: ENSP00000391176

SEQ ID NO: 101855 - protein, 97 aa, Homo sapiens
  Payload ID: 20293
  Gene Name: zinc finger, CCCH-type with G patch domain
  ENSP ID: ENSP00000403966
MDEESLESALQTYRAQLQQVELALGAGLDSSEQADLRQLQGDLKELIELTEASLVSVRKSSLLAALDEERPGRQEDAEYQAFREAITEAVEAPAAAR

SEQ ID NO: 101856 - protein, 170 aa, Homo sapiens
  Payload ID: 20294
  Gene Name: zinc finger, CCHC domain containing 10
  Uniprot ID: Q8TBK6
  ENSP ID: ENSP00000324274
MATPMHRLIARRQAEANKQHVRCQKCLEFGHWTYECTGKRKYLHRPSRTAELKKALKEKENRLLLQQSIGETNVERKAKKKRSKSVTSSSSSSSDSSASDSSSESEETSTSSSSEDSDTDESSSSSSSSASSTTSSSSSDSDSDSSSSSSSSTSTDSSSDDEPPKKKKKK

SEQ ID NO: 101857 - protein, 186 aa, Homo sapiens
  Payload ID: 20294
  Gene Name: zinc finger, CCHC domain containing 10
  ENSP ID: ENSP00000347533
MATPMHRLIARRQAFDTELQPVKTFWILIQPSIVISEANKQHVRCQKCLEFGHWTYECTGKRKYLHRPSRTAELKKALKEKENRLLLQQSIGETNVERKAKKKSSSSSSSDSSASDSSSESEETSTSSSSEDSDTDESSSSSSSSASSTTSSSSSDSDSDSSSSSSSSTSTDSSSDDEPPKKKKKK

SEQ ID NO: 101858 - protein, 92 aa, Homo sapiens
  Payload ID: 20294
  Gene Name: zinc finger, CCHC domain containing 10
  ENSP ID: ENSP00000421071
MATPMHRLIARRQAEANKQHVRCQKCLEFGHWTYECTGKRKYLHRPSRTAELKKALKEKENRLLLQQRSFFPPRVYQHWRNQCRKKGQEKKV

SEQ ID NO: 101859 - protein, 114 aa, Homo sapiens
  Payload ID: 20294
  Gene Name: zinc finger, CCHC domain containing 10
  ENSP ID: ENSP00000422111
MATPMHRLIARRQAFDTELQPVKTFWILIQPSIVISEANKQHVRCQKCLEFGHWTYECTGKRKYLHRPSRTAELKKALKEKENRLLLQQRSFFPPRVYQHWRNQCRKKGQEKKV

SEQ ID NO: 101860 - protein, 192 aa, Homo sapiens
  Payload ID: 20294
  Gene Name: zinc finger, CCHC domain containing 10
  Uniprot ID: Q8TBK6
  ENSP ID: ENSP00000423276
MATPMHRLIARRQAFDTELQPVKTFWILIQPSIVISEANKQHVRCQKCLEFGHWTYECTGKRKYLHRPSRTAELKKALKEKENRLLLQQSIGETNVERKAKKKRSKSVTSSSSSSSDSSASDSSSESEETSTSSSSEDSDTDESSSSSSSSASSTTSSSSSDSDSDSSSSSSSSTSTDSSSDDEPPKKKKKK

SEQ ID NO: 101861 - protein, 72 aa, Homo sapiens
  Payload ID: 20294
  Gene Name: zinc finger, CCHC domain containing 10
  ENSP ID: ENSP00000427359
MATPMHRLIARRQAFDTELQPVKTFWILIQPSIVIRDSVAQAGLKLLSSGDPALASQSARIIGVSHCVQPHT

SEQ ID NO: 101862 - protein, 156 aa, Homo sapiens
  Payload ID: 20294
  Gene Name: zinc finger, CCHC domain containing 10
  ENSP ID: ENSP00000427430
MATPMHRLIARRQAEANKQHVRCQKCLEFGHWTYECTGKRKYLHRPSRTAELKKALKEKENRLLLQQRSKSVTSSSSSSSDSSASDSSSESEETSTSSSSEDSDTDESSSSSSSSASSTTSSSSSDSDSDSSSSSSSSTSTDSSSDDEPPKKKKKK

SEQ ID NO: 101863 - protein, 1645 aa, Homo sapiens
  Payload ID: 20295
  Gene Name: zinc finger, CCHC domain containing 11
  ENSP ID: ENSP00000257177
MEESKTLKSENHEPKKNVICEESKAVQVIGNQTLKARNDKSVKEIENSSPNRNSSKKNKQNDICIEKTEVKSCKVNAANLPGPKDLGLVLRDQSHCKAKKFPNSPVKAEKATISQAKSEKATSLQAKAEKSPKSPNSVKAEKASSYQMKSEKVPSSPAEAEKGPSLLLKDMRQKTELQQIGKKIPSSFTSVDKVNIEAVGGEKCALQNSPRSQKQQTCTDNTGDSDDSASGIEDVSDDLSKMKNDESNKENSSEMDYLENATVIDESALTPEQRLGLKQAEERLERDHIFRLEKRSPEYTNCRYLCKLCLIHIENIQGAHKHIKEKRHKKNILEKQEESELRSLPPPSPAHLAALSVAVIELAKEHGITDDDLRVRQEIVEEMSKVITTFLPECSLRLYGSSLTRFALKSSDVNIDIKFPPKMNHPDLLIKVLGILKKNVLYVDVESDFHAKVPVVVCRDRKSGLLCRVSAGNDMACLTTDLLTALGKIEPVFIPLVLAFRYWAKLCYIDSQTDGGIPSYCFALMVMFFLQQRKPPLLPCLLGSWIEGFDPKRMDDFQLKGIVEEKFVKWECNSSSATEKNSIAEENKAKADQPKDDTKKTETDNQSNAMKEKHGKSPLALETPNRVSLGQLWLELLKFYTLDFALEEYVICVRIQDILTRENKNWPKRRIAIEDPFSVKRNVARSLNSQLVYEYVVERFRAAYRYFACPQTKGGNKSTVDFKKREKGKISNKKPVKSNNMATNGCILLGETTEKINAEREQPVQCDEMDCTSQRCIIDNNNLLVNELDFADHGQDSSSLSTSKSSEIEPKLDKKQDDLAPSETCLKKELSQCNCIDLSKSPDPDKSTGTDCRSNLETESSHQSVCTDTSATSCNCKATEDASDLNDDDNLPTQELYYVFDKFILTSGKPPTIVCSICKKDGHSKNDCPEDFRKIDLKPLPPMTNRFREILDLVCKRCFDELSPPCSEQHNREQILIGLEKFIQKEYDEKARLCLFGSSKNGFGFRDSDLDICMTLEGHENAEKLNCKEIIENLAKILKRHPGLRNILPITTAKVPIVKFEHRRSGLEGDISLYNTLAQHNTRMLATYAAIDPRVQYLGYTMKVFAKRCDIGDASRGSLSSYAYILMVLYFLQQRKPPVIPVLQEIFDGKQIPQRMVDGWNAFFFDKTEELKKRLPSLGKNTESLGELWLGLLRFYTEEFDFKEYVISIRQKKLLTTFEKQWTSKCIAIEDPFDLNHNLGAGVSRKMTNFIMKAFINGRKLFGTPFYPLIGREAEYFFDSRVLTDGELAPNDRCCRVCGKIGHYMKDCPKRKSSLLFRLKKKDSEEEKEGNEEEKDSRDVLDPRDLHDTRDFRDPRDLRCFICGDAGHVRRECPEVKLARQRNSSVAAAQLVRNLVNAQQVAGSAQQQGDQSIRTRQSSECSESPSYSPQPQPFPQNSSQSAAITQPSSQPGSQPKLGPPQQGAQPPHQVQMPLYNFPQSPPAQYSPMHNMGLLPMHPLQIPAPSWPIHGPVIHSAPGSAPSNIGLNDPSIIFAQPAARPVAIPNTSHDGHWPRTVAPNSLVNSGAVGNSEPGFRGLTPPIPWEHAPRPHFPLVPASWPYGLHQNFMHQGNARFQPNKPFYTQDRCATRRCRERCPHPPRGNVSE

SEQ ID NO: 101864 - protein, 309 aa, Homo sapiens
  Payload ID: 20295
  Gene Name: zinc finger, CCHC domain containing 11
  ENSP ID: ENSP00000348063
MEESKTLKSENHEPKKNVICEESKAVQVIGNQTLKARNDKSVKEIENSSPNRNSSKKNKQNDICIEKTEVKSCKVNAANLPGPKDLGLVLRDQSHCKAKKFPNSPVKAEKATISQAKSEKATSLQAKAEKSPKSPNSVKAEKASSYQMKSEKVPSSPAEAEKGPSLLLKDMRQKTELQQIGKKIPSSFTSVDKVNIEAVGGEKCALQNSPRSQKQQTCTDNTGDSDDSASGIEDVSDDLSKMKNDESNKENSSEMDYLENATVIDESALTPEQRLGLKQAEERLERDHIFRLEKVYYVVLVIWGEMCVS

SEQ ID NO: 101865 - protein, 1644 aa, Homo sapiens
  Payload ID: 20295
  Gene Name: zinc finger, CCHC domain containing 11
  Uniprot ID: Q5TAX3
  ENSP ID: ENSP00000360599
MEESKTLKSENHEPKKNVICEESKAVQVIGNQTLKARNDKSVKEIENSSPNRNSSKKNKQNDICIEKTEVKSCKVNAANLPGPKDLGLVLRDQSHCKAKKFPNSPVKAEKATISQAKSEKATSLQAKAEKSPKSPNSVKAEKASSYQMKSEKVPSSPAEAEKGPSLLLKDMRQKTELQQIGKKIPSSFTSVDKVNIEAVGGEKCALQNSPRSQKQQTCTDNTGDSDDSASGIEDVSDDLSKMKNDESNKENSSEMDYLENATVIDESALTPEQRLGLKQAEERLERDHIFRLEKRSPEYTNCRYLCKLCLIHIENIQGAHKHIKEKRHKKNILEKQEESELRSLPPPSPAHLAALSVAVIELAKEHGITDDDLRVRQEIVEEMSKVITTFLPECSLRLYGSSLTRFALKSSDVNIDIKFPPKMNHPDLLIKVLGILKKNVLYVDVESDFHAKVPVVVCRDRKSGLLCRVSAGNDMACLTTDLLTALGKIEPVFIPLVLAFRYWAKLCYIDSQTDGGIPSYCFALMVMFFLQQRKPPLLPCLLGSWIEGFDPKRMDDFQLKGIVEEKFVKWECNSSSATEKNSIAEENKAKADQPKDDTKKTETDNQSNAMKEKHGKSPLALETPNRVSLGQLWLELLKFYTLDFALEEYVICVRIQDILTRENKNWPKRRIAIEDPFSVKRNVARSLNSQLVYEYVVERFRAAYRYFACPQTKGGNKSTVDFKKREKGKISNKKPVKSNNMATNGCILLGETTEKINAEREQPVQCDEMDCTSQRCIIDNNNLLVNELDFADHGQDSSSLSTSKSSEIEPKLDKKQDDLAPSETCLKKELSQCNCIDLSKSPDPDKSTGTDCRSNLETESSHQSVCTDTSATSCNCKATEDASDLNDDDNLPTQELYYVFDKFILTSGKPPTIVCSICKKDGHSKNDCPEDFRKIDLKPLPPMTNRFREILDLVCKRCFDELSPPCSEQHNREQILIGLEKFIQKEYDEKARLCLFGSSKNGFGFRDSDLDICMTLEGHENAEKLNCKEIIENLAKILKRHPGLRNILPITTAKVPIVKFEHRRSGLEGDISLYNTLAQHNTRMLATYAAIDPRVQYLGYTMKVFAKRCDIGDASRGSLSSYAYILMVLYFLQQRKPPVIPVLQEIFDGKQIPQRMVDGWNAFFFDKTEELKKRLPSLGKNTESLGELWLGLLRFYTEEFDFKEYVISIRQKKLLTTFEKQWTSKCIAIEDPFDLNHNLGAGVSRKMTNFIMKAFINGRKLFGTPFYPLIGREAEYFFDSRVLTDGELAPNDRCCRVCGKIGHYMKDCPKRKSLLFRLKKKDSEEEKEGNEEEKDSRDVLDPRDLHDTRDFRDPRDLRCFICGDAGHVRRECPEVKLARQRNSSVAAAQLVRNLVNAQQVAGSAQQQGDQSIRTRQSSECSESPSYSPQPQPFPQNSSQSAAITQPSSQPGSQPKLGPPQQGAQPPHQVQMPLYNFPQSPPAQYSPMHNMGLLPMHPLQIPAPSWPIHGPVIHSAPGSAPSNIGLNDPSIIFAQPAARPVAIPNTSHDGHWPRTVAPNSLVNSGAVGNSEPGFRGLTPPIPWEHAPRPHFPLVPASWPYGLHQNFMHQGNARFQPNKPFYTQDRCATRRCRERCPHPPRGNVSE

SEQ ID NO: 101866 - protein, 343 aa, Homo sapiens
  Payload ID: 20295
  Gene Name: zinc finger, CCHC domain containing 11
  ENSP ID: ENSP00000432328
MEESKTLKSENHEPKKNVICEESKAVQVIGNQTLKARNDKSVKEIENSSPNRNSSKKNKQNDICIEKTEVKSCKVNAANLPGPKDLGLVLRDQSHCKAKKFPNSPVKAEKATISQAKSEKATSLQAKAEKSPKSPNSVKAEKASSYQMKSEKVPSSPAEAEKGPSLLLKDMRQKTELQQIGKKIPSSFTSVDKVNIEAVGGEKCALQNSPRSQKQQTCTDNTGDSDDSASGIEDVSDDLSKMKNDESNKENSSEMDYLENATVIDESALTPEQRLGLKQAEERLERDHIFRLEKRSPEYTNCRYLCKLCLIHIENIQGAHKHIKEKRHKKNILNVHLGCMAHL

SEQ ID NO: 101867 - protein, 164 aa, Homo sapiens
  Payload ID: 20295
  Gene Name: zinc finger, CCHC domain containing 11
  ENSP ID: ENSP00000432475
  MOD_RES (1)..(1): Any amino acid
XQIPAPSWPIHGPVIHSAPGSAPSNIGLNDPSIIFAQPAARPVAIPNTSHDGHWPRTVAPNSLVNSGAVGNSEPGFRGLTPPIPWEHAPRPHFPLVPASWPYGLHQNFMHQGNARFQPNKPFYTQGKKAAIVEVECSRRKTAKIWRPEFKFPCYHLWLWEHHTY

SEQ ID NO: 101868 - protein, 1203 aa, Homo sapiens
  Payload ID: 20295
  Gene Name: zinc finger, CCHC domain containing 11
  ENSP ID: ENSP00000433486
MEESKTLKSENHEPKKNVICEESKAVQVIGNQTLKARNDKSVKEIENSSPNRNSSKKNKQNDICIEKTEVKSCKVNAANLPGPKDLGLVLRDQSHCKAKKFPNSPVKAEKATISQAKSEKATSLQAKAEKSPKSPNSVKAEKASSYQMKSEKVPSSPAEAEKGPSLLLKDMRQKTELQQIGKKIPSSFTSVDKVNIEAVGGEKCALQNSPRSQKQQTCTDNTGDSDDSASGIEDVSDDLSKMKNDESNKENSSEMDYLENATVIDESALTPEQRLGLKQAEERLERDHIFRLEKRSPEYTNCRYLCKLCLIHIENIQGAHKHIKEKRHKKNILEKQEESELRSLPPPSPAHLAALSVAVIELAKEHGITDDDLRVRQEIVEEMSKVITTFLPECSLRLYGSSLTRFALKSSDVNIDIKFPPKMNHPDLLIKVLGILKKNVLYVDVESDFHAKVPVVVCRDRKSGLLCRVSAGNDMACLTTDLLTALGKIEPVFIPLVLAFRYWAKLCYIDSQTDGGIPSYCFALMVMFFLQQRKPPLLPCLLGSWSPLALETPNRVSLGQLWLELLKFYTLDFALEEYVICVRIQDILTRENKNWPKRRIAIEDPFSVKRNVARSLNSQLVYEYVVERFRAAYRYFACPQTKGGNKSTVDFKKREKGKISNKKPVKSNNMATNGCILLGETTEKINAEREQPVQCDEMDCTSQRCIIDNNNLLVNELDFADHGQDSSSLSTSKSSEIEPKLDKKQDDLAPSETCLKKELSQCNCIDLSKSPDPDKSTGTDCRSNLETESSHQSVCTDTSATSCNCKATEDASDLNDDDNLPTQELYYVFDKFILTSGKPPTIVCSICKKDGHSKNDCPEDFRKIDLKPLPPMTNRFREILDLVCKRCFDELSPPCSEQHNREQILIGLEKFIQKEYDEKARLCLFGSSKNGFGFRDSDLDICMTLEGHENAEKLNCKEIIENLAKILKRHPGLRNILPITTAKVPIVKFEHRRSGLEGDISLYNTLAQHNTRMLATYAAIDPRVQYLGYTMKVFAKRCDIGDASRGSLSSYAYILMVLYFLQQRKPPVIPVLQEIFDGKQIPQRMVDGWNAFFFDKTEELKKRLPSLGKNTESLGELWLGLLRFYTEEFDFKEYVISIRQKKLLTTFEKQWTSKCIAIEDPFDLNHNLGAGVSRKMTNFIMKAFINGRKLFGTPFYPLIGREA

SEQ ID NO: 101869 - protein, 337 aa, Homo sapiens
  Payload ID: 20295
  Gene Name: zinc finger, CCHC domain containing 11
  ENSP ID: ENSP00000433711
  MOD_RES (1)..(1): Any amino acid
XIPQRMVDGWNAFFFDKTEELKKRLPSLGKNTESLGELWLGLLRFYTEEFDFKEYVISIRQKKLLTTFEKQWTSKCIAIEDPFDLNHNLGAGVSRKMTNFIMKAFINGRKLFGTPFYPLIGREAEYFFDSRVLTDGELAPNDRCCRVCGKIGHYMKDCPKRKRLKKKDSEEEKEGNEEEKDSRDVLDPRDLHDTRDFRDPRDLRCFICGDAGHVRRECPEVKLARQRNSSVAAAQLVRNLVNAQQVAGSAQQQGDQSIRTRQSSECSESPSYSPQPQPFPQNSSQSAAITQPSSQPGSQPKLGPPQQGAQPPHQVQMPLYNFPQSPPAQYSPMHNMG

SEQ ID NO: 101870 - protein, 87 aa, Homo sapiens
  Payload ID: 20295
  Gene Name: zinc finger, CCHC domain containing 11
  ENSP ID: ENSP00000434367
MEESKTLKSENHEPKKNVICEESKAVQVIGNQTLKARNDKSVKEIENSSPNRNSSKKNKQNDICIEKTEVKSCKVNAANLPGPKDLG

SEQ ID NO: 101871 - protein, 105 aa, Homo sapiens
  Payload ID: 20295
  Gene Name: zinc finger, CCHC domain containing 11
  ENSP ID: ENSP00000434674
  MOD_RES (1)..(1): Any amino acid
XDGHWPRTVAPNSLVNSGAVGNSEPGFRGLTPPIPWEHAPRPHFPLVPASWPYGLHQNFMHQGNARFQPNKPFYTQAGLPMHSNQPILLSQGYPYLNVSYIQQKK

SEQ ID NO: 101872 - protein, 906 aa, Homo sapiens
  Payload ID: 20295
  Gene Name: zinc finger, CCHC domain containing 11
  ENSP ID: ENSP00000435256
MKNDESNKENSSEMDYLENATVIDESALTPEQRLGLKQAEERLERDHIFRLEKRSPEYTNCRYLCKLCLIHIENIQGAHKHIKEKRHKKNILEKQEESELRSLPPPSPAHLAALSVAVIELAKEHGITDDDLRVRQEIVEEMSKVITTFLPECSLRLYGSSLTRFALKSSDVNIDIKFPPKMNHPDLLIKVLGILKKNVLYVDVESDFHAKVPVVVCRDRKSGLLCRVSAGNDMACLTTDLLTALGKIEPVFIPLVLAFRYWAKLCYIDSQTDGGIPSYCFALMVMFFLQQRKPPLLPCLLGSWIEGFDPKRMDDFQLKGIVEEKFVKWECNSSSATEKNSIAEENKAKADQPKDDTKKTETDNQSNAMKEKHGKSPLALETPNRVSLGQLWLELLKFYTLDFALEEYVICVRIQDILTRENKNWPKRRIAIEDPFSVKRNVARSLNSQLVYEYVVERFRAAYRYFACPQTKGGNKSTVDFKKREKGKISNKKPVKSNNMATNGCILLGETTEKINAEREQPVQCDEMDCTSQRCIIDNNNLLVNELDFADHGQDSSSLSTSKSSEIEPKLDKKQDDLAPSETCLKKELSQCNCIDLSKSPDPDKSTGTDCRSNLETESSHQSVCTDTSATSCNCKATEDASDLNDDDNLPTQELYYVFDKFILTSGKPPTIVCSICKKDGHSKNDCPEDFRKIDLKPLPPMTNRFREILDLVCKRCFDELSPPCSEQHNREQILIGLEKFIQKEYDEKARLCLFGSSKNGFGFRDSDLDICMTLEGHENAEKLNCKEIIENLAKILKRHPGLRNILPITTAKVPIVKFEHRRSGLEGDISLYNTLAQHNTRMLATYAAIDPRVQYLGYTMKVFAKIFDGKQIPQRMVDGWNAFFFDKTEELKKRLPSLGKNTESL

SEQ ID NO: 101873 - protein, 77 aa, Homo sapiens
  Payload ID: 20295
  Gene Name: zinc finger, CCHC domain containing 11
  ENSP ID: ENSP00000435568
MEESKTLKSENHEPKKNVICEESKAVQVIGNQTLKARNDKSVKEIENSSPNRNSSKKNKQNDICIEKTEVKSCKVNA

SEQ ID NO: 101874 - protein, 338 aa, Homo sapiens
  Payload ID: 20295
  Gene Name: zinc finger, CCHC domain containing 11
  ENSP ID: ENSP00000435700
GWNAFFFDKTEELKKRLPSLGKNTESLGELWLGLLRFYTEEFDFKEYVISIRQKKLLTTFEKQWTSKCIAIEDPFDLNHNLGAGVSRKMTNFIMKAFINGRKLFGTPFYPLIGREAEYFFDSRVLTDGELAPNDRCCRVCGKIGHYMKDCPKRKRLKKKDSEEEKEGNEEEKDSRDVLDPRDLHDTRDFRDPRDLRCFICGDAGHVRRECPEVKLARQRNSSVAAAQLVRNLVNAQQVAGSAQQQGDQSIRTRQSSECSESPSYSPQPQPFPQNSSQSAAITQPSSQPGSQPKLGPPQQGAQPPHQIPAPSWPIHGPVIHSAPGSAPSNIGLNDPSII

SEQ ID NO: 101875 - protein, 108 aa, Homo sapiens
  Payload ID: 20295
  Gene Name: zinc finger, CCHC domain containing 11
  ENSP ID: ENSP00000436810
ARPVAIPNTSHDGHWPRTVAPNSLVNSGAVGNSEPGFRGLTPPIPWEHAPRPHFPLVPASWPYGLHQNFMHQGNARFQPNKPFYTQDRCATRRCRERCPHPPRGNVSE

SEQ ID NO: 101876 - protein, 151 aa, Homo sapiens
  Payload ID: 20295
  Gene Name: zinc finger, CCHC domain containing 11
  ENSP ID: ENSP00000437091
  MOD_RES (1)..(1): Any amino acid
XQPQPFPQNSSQSAAITQPSSQPGSQPKLGPPQQGAQPPHQPAARPVAIPNTSHDGHWPRTVAPNSLVNSGAVGNSEPGFRGLTPPIPWEHAPRPHFPLVPASWPYGLHQNFMHQGNARFQPNKPFYTQDRCATRRCRERCPHPPRGNVSE

SEQ ID NO: 101877 - protein, 402 aa, Homo sapiens
  Payload ID: 20296
  Gene Name: zinc finger, CCHC domain containing 12
  Uniprot ID: Q6PEW1
  ENSP ID: ENSP00000308921
MASIIARVGNSRRLNAPLPPWAHSMLRSLGRSLGPIMASMADRNMKLFSGRVVPAQGEETFENWLTQVNGVLPDWNMSEEEKLKRLMKTLRGPAREVMRVLQATNPNLSVADFLRAMKLVFGESESSVTAHGKFFNTLQAQGEKASLYVIRLEVQLQNAIQAGIIAEKDANRTRLQQLLLGGELSRDLRLRLKDFLRMYANEQERLPNFLELIRMVREEEDWDDAFIKRKRPKRSESMVERAVSPVAFQGSPPIVIGSADCNVIEIDDTLDDSDEDVILVESQDPPLPSWGAPPLRDRARPQDEVLVIDSPHNSRAQFPSTSGGSGYKNNGPGEMRRARKRKHTIRCSYCGEEGHSKETCDNESDKAQVFENLIITLQELTHTEMERSRVAPGEYNDFSEPL

SEQ ID NO: 101878 - protein, 166 aa, Homo sapiens
  Payload ID: 20297
  Gene Name: zinc finger, CCHC domain containing 13
  Uniprot ID: Q8WW36
  ENSP ID: ENSP00000345633
MSSKDFFACGHSGHWARGCPRGGAGGRRGGGHGRGSQCGSTTLSYTCYCCGESGRNAKNCVLLGNICYNCGRSGHIAKDCKDPKRERRQHCYTCGRLGHLARDCDRQKEQKCYSCGKLGHIQKDCAQVKCYRCGEIGHVAINCSKARPGQLLPLRQIPTSSQGMSQ

SEQ ID NO: 101879 - protein, 949 aa, Homo sapiens
  Payload ID: 20298
  Gene Name: zinc finger, CCHC domain containing 14
  Uniprot ID: Q8WYQ9
  ENSP ID: ENSP00000268616
MASNHPAFSFHQKQVLRQELTQIQSSLNGGGGHGGKGAPGPGGALPTCPACHKITPRTEAPVSSVSNSLENALHTSAHSTEESLPKRPLGKHSKVSVEKIDLKGLSHTKNDRNVECSFEVLWSDSSITSVTKSSSEVTEFISKLCQLYPEENLEKLIPCLAGPDAFYVERNHVDLDSGLRYLASLPSHVLKNDHVRRFLSTSSPPQQLQSPSPGNPSLSKVGTVMGVSGRPVCGVAGIPSSQSGAQHHGQHPAGSAAPLPHCSHAGSAGSALAYRTQMDTSPAILMPSSLQTPQTQEQNGILDWLRKLRLHKYYPVFKQLSMEKFLSLTEEDLNKFESLTMGAKKKLKTQLELEKEKSERRCLNPSAPPLVTSSGVARVPPTSHVGPVQSGRGSHAAELRVEVEQPHHQLPREGSSSEYSSSSSSPMGVQAREESSDSAEENDRRVEIHLESSDKEKPVMLLNHFTSSSARPTAQVLPVQNEASSNPSGHHPLPPQMLSAASHITPIRMLNSVHKPERGSADMKLLSSSVHSLLSLEERNKGSGPRSSMKVDKSFGSAMMDVLPASAPHQPVQVLSGLSESSSMSPTVSFGPRTKVVHASTLDRVLKTAQQPALVVETSTAATGTPSTVLHAARPPIKLLLSSSVPADSAISGQTSCPNNVQISVPPAIINPRTALYTANTKVAFSAMSSMPVGPLQGGFCANSNTASPSSHPSTSFANMATLPSCPAPSSSPALSSVPESSFYSSSGGGGSTGNIPASNPNHHHHHHHQQPPAPPQPAPPPPGCIVCTSCGCSGSCGSSGLTVSYANYFQHPFSGPSVFTFPFLPFSPMCSSGYVSAQQYGGGSTFPVVHAPYSSSGTPDPVLSGQSTFAVPPMQNFMAGTAGVYQTQGLVGSSNGSSHKKSGNLSCYNCGATGHRAQDCKQPSMDFNRPGTFRLKYAPPAESLDSTD

SEQ ID NO: 101880 - protein, 949 aa, Homo sapiens; identical to SEQ ID NO: 101879
  Payload ID: 20298
  Gene Name: zinc finger, CCHC domain containing 14
  Uniprot ID: Q8WYQ9
  ENSP ID: ENSP00000455431

SEQ ID NO: 101881 - protein, 846 aa, Homo sapiens
  Payload ID: 20298
  Gene Name: zinc finger, CCHC domain containing 14
  ENSP ID: ENSP00000456499
  MOD_RES (1)..(1): Any amino acid
XFEVLWSDSSITSVTKSSSEVTEFISKLCQLYPEENLEKLIPCLAGPDAFYVERNHVDLDSGLRYLASLPSHVLKNDHVRRFLSTSSPPQQLQSPSPGNPSLSKVGTVMGVSGRPVCGVAGIPSSQSGAQHHGQHPAGSAAPLPHCSHAGSAGSALAYRTQMDTSPAILMPSSLQTPQTQEQNGILDWLRKLRLHKYYPVFKQLSMEKFLSLTEEDLNKFESLTMGAKKKLKTQLELEKEKSERRCLNPSAPPLVTSSGVARVPPTSHVGPVQSGRGSHAAELRVEVEQPHHQLPREGSSSEYSSSSSSPMGVQAREESSDSAEENDRRVEIHLESSDKEKPVMLLNHFTSSSARPTAQVLPVQNEASSNPSGHHPLPPQMLSAASHITPIRMLNSVHKPERGSADMKLLSSSVHSLLSLEERNKGSGPRSSMKVDKSFGSAMMDVLPASAPHQPVQVLSGLSESSSMSPTVSFGPRTKVVHASTLDRVLKTAQQPALVVETSTAATGTPSTVLHAARPPIKLLLSSSVPADSAISGQTSCPNNVQISVPPAIINPRTALYTANTKVAFSAMSSMPVGPLQGGFCANSNTASPSSHPSTSFANMATLPSCPAPSSSPALSSVPESSFYSSSGGGGSTGNIPASNPNHHHHHHHQQPPAPPQPAPPPPGCIVCTSCGCSGSCGSSGLTVSYANYFQHPFSGPSVFTFPFLPFSPMCSSGYVSAQQYGGGSTFPVVHAPYSSSGTPDPVLSGQSTFAVPPMQNFMAGTAGVYQTQGLVGSSNGSSHKKSGNLSCYNCGATGHRAQDCKQPSMDFNRPGKRAPWPRPPGSRRTSAHKCLVFMKSKLLSL

SEQ ID NO: 101882 - protein, 310 aa, Homo sapiens
  Payload ID: 20299
  Gene Name: zinc finger, CCHC domain containing 16
  Uniprot ID: Q6ZR62
  ENSP ID: ENSP00000340590
MEKCTKSSSTMQVEPSFLQAENLILRLQMQHPTTENTAKRGQVMPALATTVMPVPYSLEHLTQFHGDPANCSEFLTQVTTYLTALQISNPANDAQIKLFFDYLSQQLESCGIISGPDKSTLLKQYENLILEFQQSFGKPTKQEINPLMNAKFDKGDNSSQQDPATFHLLAQNLICNETNQSGQFEKALADPNQDEESVTDMMDNLPDLITQCIQLDKKHSDRPELLQSETQLPLLASLIQHQALFSPTDPPPKKGPIQLREGQLPLTPAKRARQQETQLCLYCSQSGHFTRDCLAKRSRAPATTNNTAHQ

SEQ ID NO: 101883 - protein, 241 aa, Homo sapiens
  Payload ID: 20300
  Gene Name: zinc finger, CCHC domain containing 17
  Uniprot ID: Q9NP64
  ENSP ID: ENSP00000343557
MNSGRPETMENLPALYTIFQGEVAMVTDYGAFIKIPGCRKQGLVHRTHMSSCRVDKPSEIVDVGDKVWVKLIGREMKNDRIKVSLSMKVVNQGTGKDLDPNNVIIEQEERRRRSFQDYTGQKITLEAVLNTTCKKCGCKGHFAKDCFMQPGGTKYSLIPDEEEEKEEAKSAEFEKPDPTRNPSRKRKKEKKKKKHRDRKSSDSDSSDSESDTGKRARHTSKDSKAAKKKKKKKKHKKKHKE

SEQ ID NO: 101884 - protein, 241 aa, Homo sapiens; identical to SEQ ID NO: 101883
  Payload ID: 20300
  Gene Name: zinc finger, CCHC domain containing 17
  Uniprot ID: Q9NP64
  ENSP ID: ENSP00000362819

SEQ ID NO: 101885 - protein, 212 aa, Homo sapiens
  Payload ID: 20300
  Gene Name: zinc finger, CCHC domain containing 17
  ENSP ID: ENSP00000391336
MGPLSKSQAVGSKVWSIELMSSCRVDKPSEIVDVGDKVWVKLIGREMKNDRIKVSLSMKVVNQGTGKDLDPNNVIIEQEERRRRSFQDYTGQKITLEAVLNTTCKKCGCKGHFAKDCFMQPGGTKYSLIPDEEEEKEEAKSAEFEKPDPTRNPSRKRKKEKKKKKHRDRKSSDSDSSDSESDTGKRARHTSKDSKAAKKKKKKKKHKKKHKE

SEQ ID NO: 101886 - protein, 233 aa, Homo sapiens
  Payload ID: 20300
  Gene Name: zinc finger, CCHC domain containing 17
  Uniprot ID: Q9NP64
  ENSP ID: ENSP00000444742
MKQLIEDTEKNKVYVAMVTDYGAFIKIPGCRKQGLVHRTHMSSCRVDKPSEIVDVGDKVWVKLIGREMKNDRIKVSLSMKVVNQGTGKDLDPNNVIIEQEERRRRSFQDYTGQKITLEAVLNTTCKKCGCKGHFAKDCFMQPGGTKYSLIPDEEEEKEEAKSAEFEKPDPTRNPSRKRKKEKKKKKHRDRKSSDSDSSDSESDTGKRARHTSKDSKAAKKKKKKKKHKKKHKE

SEQ ID NO: 101887 - protein, 263 aa, Homo sapiens
  Payload ID: 20300
  Gene Name: zinc finger, CCHC domain containing 17
  ENSP ID: ENSP00000480986
MRKNGVGGCLSLEATPRLCSLNLPFSAEGADSKGWEAGPESPAVVAMVTDYGAFIKIPGCRKQGLVHRTHMSSCRVDKPSEIVDVGDKVWVKLIGREMKNDRIKVSLSMKVVNQGTGKDLDPNNVIIEQEERRRRSFQDYTGQKITLEAVLNTTCKKCGCKGHFAKDCFMQPGGTKYSLIPDEEEEKEEAKSAEFEKPDPTRNPSRKRKKEKKKKKHRDRKSSDSDSSDSESDTGKRARHTSKDSKAAKKKKKKKKHKKKHKE

SEQ ID NO: 101888 - protein, 146 aa, Homo sapiens
  Payload ID: 20300
  Gene Name: zinc finger, CCHC domain containing 17
  ENSP ID: ENSP00000481299
MNSGRPETMENLPALYTIFQGEVAMVTDYGAFIKIPGCRKQGLVHRTHMSSCRVDKPSEIVDVGDKVWVKLIGREMKNDRIKVSLSMKVVNQGTGKDLDPNNVIIEQEERRRRSFQDYTGQKITLEAVLNTTCKKCGCKGEEEKET

SEQ ID NO: 101889 - protein, 160 aa, Homo sapiens
  Payload ID: 20300
  Gene Name: zinc finger, CCHC domain containing 17
  ENSP ID: ENSP00000481743
MKQLIEDTEKNKVYVAMVTDYGAFIKIPGCRKQGLVHRTHMSSCRVDKPSEIVDVGDKVWVKLIGREMKNDRIKVSLSMKVVNQGTGKDLDPNNVIIERRRKRNIEIGSHLTLTAQTLRVIQARGQGTHQKTARQQRRRKRRRSTRRSTRSESIKSVGGG

SEQ ID NO: 101890 - protein, 179 aa, Homo sapiens
  Payload ID: 20300
  Gene Name: zinc finger, CCHC domain containing 17
  ENSP ID: ENSP00000482122
MGPLSKSQAVGSKMKNDRIKVSLSMKVVNQGTGKDLDPNNVIIEQEERRRRSFQDYTGQKITLEAVLNTTCKKCGCKGHFAKDCFMQPGGTKYSLIPDEEEEKEEAKSAEFEKPDPTRNPSRKRKKEKKKKKHRDRKSSDSDSSDSESDTGKRARHTSKDSKAAKKKKKKKKHKKKHKE

SEQ ID NO: 101891 - protein, 243 aa, Homo sapiens
  Payload ID: 20300
  Gene Name: zinc finger, CCHC domain containing 17
  ENSP ID: ENSP00000486079
MVTDYGAFIKIPGCRKQGLVHRTHMSSCRVDKPSEIVDVGDKVWVKLIGREMKNDRIKVSLSMKVVNQGTGKDLDPNNVIIEQEERRRRSFQDYTGQKITLEAVLNTTCKKCGCKGRVKPLPFPRFSPCGWTLFWKKEAAQCHFAKDCFMQPGGTKYSLIPDEEEEKEEAKSAEFEKPDPTRNPSRKRKKEKKKKKHRDRKSSDSDSSDSESDTGKRARHTSKDSKAAKKKKKKKKHKKKHKE

SEQ ID NO: 101892 - protein, 403 aa, Homo sapiens
  Payload ID: 20301
  Gene Name: zinc finger, CCHC domain containing 18
  Uniprot ID: P0CG32
  ENSP ID: ENSP00000473824
MASITACVGNSRQQNAPLPPWAHSMLRSLGRSLCPLVVKMAERNMKLFSGRVVPAQGKETFENWLIQVNEVLPDWSMSEEEKLKRLMKTLRGPAREVMRLLQAANPNLSVADFLRAMKLVFGESESSVTAHGKFFNTLQAQGEKASLYVIRLEVQLQNAIQAGILAEKDANQTRLQQLLLGAELNRDLRFRLKHLLRMYANKQERLPNFLELIKMIREEEDWDDAFIKRKRPKRSEPIMERAASPVAFQGAQPIAISSADCNCNVIEIDDTLDDSDEDVILVVSLYPSLTPTGAPPFRGRARPLDQVLVIDSPNNSGAQSLSTSGGSGYKNDGPGNIRRARKRKYTTRCSYCGEEGHSKETCDNESNKAQVFENLIITLQELTHTEERSKEVPGEHSDASEPQ

SEQ ID NO: 101893 - protein, 403 aa, Homo sapiens; identical to SEQ ID NO: 101892
  Payload ID: 20301
  Gene Name: zinc finger, CCHC domain containing 18
  Uniprot ID: P0CG32
  ENSP ID: ENSP00000482195

SEQ ID NO: 101894 - protein, 1178 aa, Homo sapiens
  Payload ID: 20302
  Gene Name: zinc finger, CCHC domain containing 2
  Uniprot ID: Q9C0B9
  ENSP ID: ENSP00000269499
MLRMKLPLKPTHPAEPPPEAEEPEADARPGAKAPSRRRRDCRPPPPPPPPAGPSRGPLPPPPPPRGLGPPVAGGAAAGAGMPGGGGGPSAALREQERVYEWFGLVLGSAQRLEFMCGLLDLCNPLELRFLGSCLEDLARKDYHYLRDSEAKANGLSDPGPLADFREPAVRSRLIVYLALLGSENREAAGRLHRLLPQVDSVLKSLRAARGEGSRGGAEDERGEDGDGEQDAEKDGSGPEGGIVEPRVGGGLGSRAQEELLLLFTMASLHPAFSFHQRVTLREHLERLRAALRGGPEDAEVEVEPCKFAGPRAQNNSAHGDYMQNNESSLIEQAPIPQDGLTVAPHRAQREAVHIEKIMLKGVQRKRADKYWEYTFKVNWSDLSVTTVTKTHQELQEFLLKLPKELSSETFDKTILRALNQGSLKREERRHPDLEPILRQLFSSSSQAFLQSQKVHSFFQSISSDSLHSINNLQSSLKTSKILEHLKEDSSEASSQEEDVLQHAIIHKKHTGKSPIVNNIGTSCSPLDGLTMQYSEQNGIVDWRKQSCTTIQHPEHCVTSADQHSAEKRSLSSINKKKGKPQTEKEKIKKTDNRLNSRINGIRLSTPQHAHGGTVKDVNLDIGSGHDTCGETSSESYSSPSSPRHDGRESFESEEEKDRDTDSNSEDSGNPSTTRFTGYGSVNQTVTVKPPVQIASLGNENGNLLEDPLNSPKYQHISFMPTLHCVMHNGAQKSEVVVPAPKPADGKTIGMLVPSPVAISAIRESANSTPVGILGPTACTGESEKHLELLASPLPIPSTFLPHSSTPALHLTVQRLKLPPPQGSSESCTVNIPQQPPGSLSIASPNTAFIPIHNPGSFPGSPVATTDPITKSASQVVGLNQMVPQIEGNTGTVPQPTNVKVVLPAAGLSAAQPPASYPLPGSPLAAGVLPSQNSSVLSTAATSPQPASAGISQAQATVPPAVPTHTPGPAPSPSPALTHSTAQSDSTSYISAVGNTNANGTVVPPQQMGSGPCGSCGRRCSCGTNGNLQLNSYYYPNPMPGPMYRVPSFFTLPSICNGSYLNQAHQSNGNQLPFFLPQTPYANGLVHDPVMGSQANYGMQQMAGFGRFYPVYPAPNVVANTSGSGPKKNGNVSCYNCGVSGHYAQDCKQSSMEANQQGTYRLRYAPPLPPSNDTLDSAD

SEQ ID NO: 101895 - protein, 857 aa, Homo sapiens
  Payload ID: 20302
  Gene Name: zinc finger, CCHC domain containing 2
  Uniprot ID: Q9C0B9
  ENSP ID: ENSP00000464791
MQNNESSLIEQAPIPQDGLTVAPHRAQREAVHIEKIMLKGVQRKRADKYWEYTFKVNWSDLSVTTVTKTHQELQEFLLKLPKELSSETFDKTILRALNQGSLKREERRHPDLEPILRQLFSSSSQAFLQSQKVHSFFQSISSDSLHSINNLQSSLKTSKILEHLKEDSSEASSQEEDVLQHAIIHKKHTGKSPIVNNIGTSCSPLDGLTMQYSEQNGIVDWRKQSCTTIQHPEHCVTSADQHSAEKRSLSSINKKKGKPQTEKEKIKKTDNRLNSRINGIRLSTPQHAHGGTVKDVNLDIGSGHDTCGETSSESYSSPSSPRHDGRESFESEEEKDRDTDSNSEDSGNPSTTRFTGYGSVNQTVTVKPPVQIASLGNENGNLLEDPLNSPKYQHISFMPTLHCVMHNGAQKSEVVVPAPKPADGKTIGMLVPSPVAISAIRESANSTPVGILGPTACTGESEKHLELLASPLPIPSTFLPHSSTPALHLTVQRLKLPPPQGSSESCTVNIPQQPPGSLSIASPNTAFIPIHNPGSFPGSPVATTDPITKSASQVVGLNQMVPQIEGNTGTVPQPTNVKVVLPAAGLSAAQPPASYPLPGSPLAAGVLPSQNSSVLSTAATSPQPASAGISQAQATVPPAVPTHTPGPAPSPSPALTHSTAQSDSTSYISAVGNTNANGTVVPPQQMGSGPCGSCGRRCSCGTNGNLQLNSYYYPNPMPGPMYRVPSFFTLPSICNGSYLNQAHQSNGNQLPFFLPQTPYANGLVHDPVMGSQANYGMQQMAGFGRFYPVYPAPNVVANTSGSGPKKNGNVSCYNCGVSGHYAQDCKQSSMEANQQGTYRLRYAPPLPPSNDTLDSAD

SEQ ID NO: 101896 - protein, 378 aa, Homo sapiens
  Payload ID: 20302
  Gene Name: zinc finger, CCHC domain containing 2
  ENSP ID: ENSP00000465548
  MOD_RES (1)..(1): Any amino acid
XGLGPPVAGGAAAGAGMPGGGGGPSAALREQERVYEWFGLVLGSAQRLEFMCGLLDLCNPLELRFLGSCLEDLARKDYHYLRDSEAKANGLSDPGPLADFREPAVRSRLIVYLALLGSENREAAGRLHRLLPQVDSVLKSLRAARGEGSRGGAEDERGEDGDGEQDAEKDGSGPEGGIVEPRVGGGLGSRAQEELLLLFTMASLHPAFSFHQRVTLREHLERLRAALRGGPEDAEVEVEPCKFAGPRAQVRRTEPPWTRGAIAAPAASPASLSDAPCPSPSPAQVARNPHPAAPSARGLSFVSLGRSVPLPHPTPHPGRHSHPPSQNALEVPSVPRCCHGRRGAPRPGPLSEEKCRDVFGSEHLSARCGSRRALEEPV

SEQ ID NO: 101897 - protein, 106 aa, Homo sapiens
  Payload ID: 20302
  Gene Name: zinc finger, CCHC domain containing 2
  ENSP ID: ENSP00000468368
FFLPQTPYANGLVHDPVMGSQANYGMQQMAGFGRFYPVYPAPNVVANTSGSGPKKNGNVSCYNCGVSGHYAQDCKQSSMEANQQGTYRLRYAPPLPPSNDTLDSAD

SEQ ID NO: 101898 - protein, 1098 aa, Homo sapiens
  Payload ID: 20302
  Gene Name: zinc finger, CCHC domain containing 2
  ENSP ID: ENSP00000468789
  MOD_RES (1)..(1): Any amino acid
XPGGGGGPSAALREQERVYEWFGLVLGSAQRLEFMCGLLDLCNPLELRFLGSCLEDLARKDYHYLRDSEAKANGLSDPGPLADFREPAVRSRLIVYLALLGSENREAAGRLHRLLPQVDSVLKSLRAARGEGSRGGAEDERGEDGDGEQDAEKDGSGPEGGIVEPRVGGGLGSRAQEELLLLFTMASLHPAFSFHQRVTLREHLERLRAALRGGPEDAEVEVEPCKFAGPRAQNNSAHGDYMQNNESSLIEQAPIPQDGLTVAPHRAQREAVHIEKIMLKGVQRKRADKYWEYTFKVNWSDLSVTTVTKTHQELQEFLLKLPKELSSETFDKTILRALNQGSLKREERRHPDLEPILRQLFSSSSQAFLQSQKVHSFFQSISSDSLHSINNLQSSLKTSKILEHLKEDSSEASSQEEDVLQHAIIHKKHTGKSPIVNNIGTSCSPLDGLTMQYSEQNGIVDWRKQSCTTIQHPEHCVTSADQHSAEKRSLSSINKKKGKPQTEKEKIKKTDNRLNSRINGIRLSTPQHAHGGTVKDVNLDIGSGHDTCGETSSESYSSPSSPRHDGRESFESEEEKDRDTDSNSEDSGNPSTTRFTGYGSVNQTVTVKPPVQIASLGNENGNLLEDPLNSPKYQHISFMPTLHCVMHNGAQKSEVVVPAPKPADGKTIGMLVPSPVAISAIRESANSTPVGILGPTACTGESEKHLELLASPLPIPSTFLPHSSTPALHLTVQRLKLPPPQGSSESCTVNIPQQPPGSLSIASPNTAFIPIHNPGSFPGSPVATTDPITKSASQVVGLNQMVPQIEGNTGTVPQPTNVKVVLPAAGLSAAQPPASYPLPGSPLAAGVLPSQNSSVLSTAATSPQPASAGISQAQATVPPAVPTHTPGPAPSPSPALTHSTAQSDSTSYISAVGNTNANGTVVPPQQMGSGPCGSCGRRCSCGTNGNLQLNSYYYPNPMPGPMYRVPSFFTLPSICNGSYLNQAHQSNGNQLPFFLPQTPYANGLVHDPVMGSQANYGMQQMAGFGRFYPVYPAPNVVANTSGSGPKKNGNVSCYNCGVSGHYAQDCKQSSMEANQQGTYRLRYAPPLPPSNDTLDSAD

SEQ ID NO: 101899 - protein, 195 aa, Homo sapiens
  Payload ID: 20302
  Gene Name: zinc finger, CCHC domain containing 2
  ENSP ID: ENSP00000480901
MQNNESSLIEQAPIPQDGLTVAPHRAQREAVHIEKIMLKGVQRKRADKYWEYTFKVNWSDLSVTTVTKTHQELQEFLLKLPKELSSETFDKTILRALNQGSLKREERRHPDLEPILRQLFSSSSQAFLQSQKVHSFFQSISSDSLHSINNLQSSLKTSKILEHLKEDSSEASSQEEDVLQHAIIHKKHTGKSPIV

SEQ ID NO: 101900 - protein, 228 aa, Homo sapiens
  Payload ID: 20303
  Gene Name: zinc finger, CCHC domain containing 24
  ENSP ID: ENSP00000361408
MQEVCSGEDTHGGHFPSRPGHTGAEQQCVQGRLTLWLPQQHRRWPQLPHRALLRPDPHLRGSQAQQAAPTQLPVPPVLQQRTLHQGLPPGTPQRRGPDSIPGQKALLRRVQVSQVQEKMDERELLGQHGAGVHQVPHQRVSTQAETPGEARRPGRVRPEQGAPAAPLREVQGPGLLLPSRAVTGCPPAPRATPRQPEETLLPCATPRGCVSPCAWGALAGLRGWAGGS

SEQ ID NO: 101901 - protein, 241 aa, Homo sapiens
  Payload ID: 20303
  Gene Name: zinc finger, CCHC domain containing 24
  Uniprot ID: Q8N2G6
  ENSP ID: ENSP00000361411
MSLLSAIDTSAASVYQPAQLLNWVYLSLQDTHQASAFDAFRPEPTAGAAPPELAFGKGRPEQLGSPLHSSYLNSFFQLQRGEALSNSVYKGASPYGSLNNIADGLSSLTEHFSDLTLTSEARKPSKRPPPNYLCHLCFNKGHYIKDCPQARPKGEGLTPYQGKKRCFGEYKCPKCKRKWMSGNSWANMGQECIKCHINVYPHKQRPLEKPDGLDVSDQSKEHPQHLCEKCKVLGYYCRRVQ

SEQ ID NO: 101902 - protein, 403 aa, Homo sapiens
  Payload ID: 20304
  Gene Name: zinc finger, CCHC domain containing 3
  Uniprot ID: Q9NUD5
  ENSP ID: ENSP00000484056
MATGGGAEEERKRGRPQLLPPARPAARGEEADGGREKMGWAQVVKNLAEKKGEFREPRPPRREEESGGGGGSAGLGGPAGLAAPDLGDFPPAGRGDPKGRRRDPAGEAVDPRKKKGAAEAGRRKKAEAAAAAMATPARPGEAEDAAERPLQDEPAAAAGPGKGRFLVRICFQGDEGACPTRDFVVGALILRSIGMDPSDIYAVIQIPGSREFDVSFRSAEKLALFLRVYEEKREQEDCWENFVVLGRSKSSLKTLFILFRNETVDVEDIVTWLKRHCDVLAVPVKVTDRFGIWTGEYKCEIELRQGEGGVRHLPGAFFLGAERGYSWYKGQPKTCFKCGSRTHMSGSCTQDRCFRCGEEGHLSPYCRKGIVCNLCGKRGHAFAQCPKAVHNSVAAQLTGVAGH

SEQ ID NO: 101903 - protein, 513 aa, Homo sapiens
  Payload ID: 20305
  Gene Name: zinc finger, CCHC domain containing 4
  Uniprot ID: Q9H5U6
  ENSP ID: ENSP00000303468
MAASRNGFEAVEAEGSAGCRGSSGMEVVLPLDPAVPAPLCPHGPTLLFVKVTQGKEETRRFYACSACRDRKDCNFFQWEDEKLSGARLAAREAHNRRCQPPLSRTQCVERYLKFIELPLTQRKFCQTCQQLLLPDDWGQHSEHQVLGNVSITQLRRPSQLLYPLENKKTNAQYLFADRSCQFLVDLLSALGFRRVLCVGTPRLHELIKLTASGDKKSNIKSLLLDIDFRYSQFYMEDSFCHYNMFNHHFFDGKTALEVCRAFLQEDKGEGIIMVTDPPFGGLVEPLAITFKKLIAMWKEGQSQDDSHKELPIFWIFPYFFESRICQFFPSFQMLDYQVDYDNHALYKHGKTGRKQSPVRIFTNIPPNKIILPTEEGYRFCSPCQRYVSLENQHCELCNSCTSKDGRKWNHCFLCKKCVKPSWIHCSICNHCAVPDHSCEGPKHGCFICGELDHKRSTCPNIATSKRANKAVRKQKQRKSNKMKMETTKGQSMNHTSATRRKKRRERAHQYLGS

SEQ ID NO: 101904 - protein, 229 aa, Homo sapiens
  Payload ID: 20305
  Gene Name: zinc finger, CCHC domain containing 4
  Uniprot ID: Q9H5U6
  ENSP ID: ENSP00000422115
MAASRNGFEAVEAEGSAGCRGSSGMEVVLPLDPAVPAPLCPHGPTLLFVKVTQGKEETRRFYACSACRDRKDCNFFQWEDEKLSGARLAAREAHNRRCQPPLSRTQCVERYLKFIELPLTQRKFCQTCQQLLLPDDWGQHSEHQVLGNVSITQLRRPSQLLYPLENKKTNAQYLFADRSCQFLVDLLSALGFRRVLCVGTPRLHELIKLTASGDKKSNIKSLLLDIDFR

SEQ ID NO: 101905 - protein, 302 aa, Homo sapiens
  Payload ID: 20305
  Gene Name: zinc finger, CCHC domain containing 4
  ENSP ID: ENSP00000422269
  MOD_RES (1)..(1): Any amino acid
XWGQHSEHQVLGNVSITQLRRPSQLLYPLENKKTNAQYLFADRSCQFLVDLLSALGFRRVLCVGTPRLHELIKLTASGDKKSNIKSLLLDIDFRYSQFYMEDSFCHYNMFNHHFFDGKTALEVCRAFLQEDKGEGIIMVTDPPFGGLVEPLAITFKKLIAMWKEGQSQDDSHKELPIFWIFPYFFESRICQFFPSFQMLDYQVDYDNHALYKHGKTGRKQSPVRIFTNIPPNKIILPTEEGYRFCSPCQRYVSLENQHCELCNSCTSKDGRKWNHCFLCKKCVKPSWIHCSICNHCAVPDHS

SEQ ID NO: 101906 - protein, 127 aa, Homo sapiens [sequence omitted]

SEQ ID NO: 101907 - protein, 475 aa, Homo sapiens
  Payload ID: 20306
  Gene Name: zinc finger, CCHC domain containing 5
  Uniprot ID: Q8N8U3
  ENSP ID: ENSP00000316794
MVEDLAASYIVLKLENEIRQAQVQWLMEENAALQAQIPELQKSQAAKEYDLLRKSSEAKEPQKLPEHMNPPAAWEAQKTPEFKEPQKPPEPQDLLPWEPPAAWELQEAPAAPESLAPPATRESQKPPMAHEIPTVLEGQGPANTQDATIAQEPKNSEPQDPPNIEKPQEAPEYQETAAQLEFLELPPPQEPLEPSNAQEFLELSAAQESLEGLIVVETSAASEFPQAPIGLEATDFPLQYTLTFSGDSQKLPEFLVQLYSYMRVRGHLYPTEAALVSFVGNCFSGRAGWWFQLLLDIQSPLLEQCESFIPVLQDTFDNPENMKDANQCIHQLCQGEGHVATHFHLIAQELNWDESTLWIQFQEGLASSIQDELSHTSPATNLSDLITQCISLEEKPDPNPLGKSSSAEGDGPESPPAENQPMQAAINCPHISEAEWVRWHKGRLCLYCGYPGHFARDCPVKPHQALQAGNIQACQ

SEQ ID NO: 101908 - protein, 784 aa, Homo sapiens
  Payload ID: 20307
  Gene Name: zinc finger, CCHC domain containing 6
  ENSP ID: ENSP00000277141
MGNEHISVHPENSDCIQADVNSDDYKGDKVYHPETGRKNEKEKVGRKGKHLLTVDQKRGEHVVCGSTRNNESESTLDLEGFQNPTAKECEGLATLDNKADLDGESTEGTEELEDSLNHFTHSVQGQTSEMIPSDEEEEDDEEEEEEEEPRLTINQREDEDGMANEDELDNTYTGSGDEDALSEEDDELGEAAKYEDVKECGKHVERALLVELNKISLKEENVCEEKNSPVDQSDFFYEFSKLIFTKGKSPTVVCSLCKREGHLKKDCPEDFKRIQLEPLPPLTPKFLNILDQVCIQCYKDFSPTIIEDQAREHIRQNLESFIRQDFPGTKLSLFGSSKNGFGFKQSDLDVCMTINGLETAEGLDCVRTIEELARVLRKHSGLRNILPITTAKVPIVKFFHLRSGLEVDISLYNTLALHNTRLLSAYSAIDPRVKYLCYTMKVFTKMCDIGDASRGSLSSYAYTLMVLYFLQQRNPPVIPVLQEIYKGEKKPEIFVDGWNIYFFDQIDELPTYWSECGKNTESVGQLWLGLLRFYTEEFDFKEHVISIRRKSLLTTFKKQWTSKYIVIEDPFDLNHNLGAGLSRKMTNFIMKAFINGRRVFGIPVKGFPKDYPSKMEYFFDPDVLTEGELAPNDRCCRICGKIGHFMKDCPMRRKVRRRRDQEDALNQRYPENKEKRSKEDKEIHNKYTEREVSTKEDKPIQCTPQKAKPMRAAADLGREKILRPPVEKWKRQDDKDLREKRCFICGREGHIKKECPQFKGSSGSLSSKYMTQGKASAKRTQQES

SEQ ID NO: 101909 - protein, 168 aa, Homo sapiens
  Payload ID: 20307
  Gene Name: zinc finger, CCHC domain containing 6
  ENSP ID: ENSP00000365114
MEAGSPENKKQRSRPRKPRKTRNEENEQDGDLEGPVIDESVLSTKELLGLQQAEERLKRDCIDRLKRRPRNYPTAKYTCRLCDVLIESIAFAHKHIKEKRHKKNIKEKQEEELLTTLPPPTPSQINAVGIAIDKVVQEFGLHNENLEQRLEIKRIMENVFQHKLPGIF

SEQ ID NO: 101910 - protein, 124 aa, Homo sapiens
  Payload ID: 20307
  Gene Name: zinc finger, CCHC domain containing 6
  ENSP ID: ENSP00000365115
MSQPDVLLLVQECLKNSDSFIDVDADFHARVPVVVCREKQSGLLCKVSAGNENACLTTKHLTALGKLEPKLVPLVIAFRYWAKLCSIDRPEEGGLPPYVFALMAIFFLQQRKEPLLPVYLGSWV

SEQ ID NO: 101911 - protein, 395 aa, Homo sapiens
  Payload ID: 20307
  Gene Name: zinc finger, CCHC domain containing 6
  ENSP ID: ENSP00000365124
MTINGLETAEGLDCVRTIEELARVLRKHSGLRNILPITTAKVPIVKFFHLRSGLEVDISLYNTLALHNTRLLSAYSAIDPRVKYLCYTMKVFTKIYKGEKKPEIFVDGWNIYFFDQIDELPTYWSECGKNTESVGQLWLGLLRFYTEEFDFKEHVISIRRKSLLTTFKKQWTSKYIVIEDPFDLNHNLGAGLSRKMTNFIMKAFINGRRVFGIPVKGFPKDYPSKMEYFFDPDVLTEGELAPNDRCCRICGKIGHFMKDCPMRRKVRRRRDQEDALNQRYPENKEKRSKEDKEIHNKYTEREVSTKEDKPIQCTPQKAKPMRAAADLGREKILRPPVEKWKRQDDKDLREKRCFICGREGHIKKECPQFKGSSGSLSSKYMTQGKASAKRTQQES

SEQ ID NO: 101912 - protein, 1259 aa, Homo sapiens
  Payload ID: 20307
  Gene Name: zinc finger, CCHC domain containing 6
  Uniprot ID: Q5VYS8
  ENSP ID: ENSP00000365127
MGDTAKPYFVKRTKDRGTMDDDDFRRGHPQQDYLIIDDHAKGHGSKMEKGLQKKKITPGNYGNTPRKGPCAVSSNPYAFKNPIYSQPAWMNDSHKDQSKRWLSDEHTGNSDNWREFKPGPRIPVINRQRKDSFQENEDGYRWQDTRGCRTVRRLFHKDLTSLETTSEMEAGSPENKKQRSRPRKPRKTRNEENEQDGDLEGPVIDESVLSTKELLGLQQAEERLKRDCIDRLKRRPRNYPTAKYTCRLCDVLIESIAFAHKHIKEKRHKKNIKEKQEEELLTTLPPPTPSQINAVGIAIDKVVQEFGLHNENLEQRLEIKRIMENVFQHKLPDCSLRLYGSSCSRLGFKNSDVNIDIQFPAIIEGFSLSKLGNFNLQDIEKDVVIWEHTDSAAGDTGITKEEAPRETPIKRGQVSLILDVKHQPSVPVGQLWVELLRFYALEFNLADLVISIRVKELVSRELKDWPKKRIAIEDPYSVKRNVARTLNSQPVFEYILHCLRTTYKYFALPHKITKSSLLKPLNAITCISEHSKEVINHHPDVQTKDDKLKNSVLAQGPGATSSAANTCKVQPLTLKETAESFGSPPKEEMGNEHISVHPENSDCIQADVNSDDYKGDKVYHPETGRKNEKEKVGRKGKHLLTVDQKRGEHVVCGSTRNNESESTLDLEGFQNPTAKECEGLATLDNKADLDGESTEGTEELEDSLNHFTHSVQGQTSEMIPSDEEEEDDEEEEEEEEPRLTINQREDEDGMANEDELDNTYTGSGDEDALSEEDDELGEAAKYEDVKECGKHVERALLVELNKISLKEENVCEEKNSPVDQSDFFYEFSKLIFTKGKGLDCVRTIEELARVLRKHSGLRNILPITTAKVPIVKFFHLRSGLEVDISLYNTLALHNTRLLSAYSAIDPRVKYLCYTMKVFTKMCDIGDASRGSLSSYAYTLMVLYFLQQRNPPVIPVLQEIYKGEKKPEIFVDGWNIYFFDQIDELPTYWSECGKNTESVGQLWLGLLRFYTEEFDFKEHVISIRRKSLLTTFKKQWTSKYIVIEDPFDLNHNLGAGLSRKMTNFIMKAFINGRRVFGIPVKGFPKDYPSKMEYFFDPDVLTEGELAPNDRCCRICGKIGHFMKDCPMRRKVRRRRDQEDALNQRYPENKEKRSKEDKEIHNKYTEREVSTKEDKPIQCTPQKAKPMRAAADLGREKILRPPVEKWKRQDDKDLREKRCFICGREGHIKKECPQFKGSSGSLSSKYMTQGKASAKRTQQES

SEQ ID NO: 101913 - protein, 1495 aa, Homo sapiens
  Payload ID: 20307
  Gene Name: zinc finger, CCHC domain containing 6
  Uniprot ID: Q5VYS8
  ENSP ID: ENSP00000365130
MGDTAKPYFVKRTKDRGTMDDDDFRRGHPQQDYLIIDDHAKGHGSKMEKGLQKKKITPGNYGNTPRKGPCAVSSNPYAFKNPIYSQPAWMNDSHKDQSKRWLSDEHTGNSDNWREFKPGPRIPVINRQRKDSFQENEDGYRWQDTRGCRTVRRLFHKDLTSLETTSEMEAGSPENKKQRSRPRKPRKTRNEENEQDGDLEGPVIDESVLSTKELLGLQQAEERLKRDCIDRLKRRPRNYPTAKYTCRLCDVLIESIAFAHKHIKEKRHKKNIKEKQEEELLTTLPPPTPSQINAVGIAIDKVVQEFGLHNENLEQRLEIKRIMENVFQHKLPDCSLRLYGSSCSRLGFKNSDVNIDIQFPAIMSQPDVLLLVQECLKNSDSFIDVDADFHARVPVVVCREKQSGLLCKVSAGNENACLTTKHLTALGKLEPKLVPLVIAFRYWAKLCSIDRPEEGGLPPYVFALMAIFFLQQRKEPLLPVYLGSWIEGFSLSKLGNFNLQDIEKDVVIWEHTDSAAGDTGITKEEAPRETPIKRGQVSLILDVKHQPSVPVGQLWVELLRFYALEFNLADLVISIRVKELVSRELKDWPKKRIAIEDPYSVKRNVARTLNSQPVFEYILHCLRTTYKYFALPHKITKSSLLKPLNAITCISEHSKEVINHHPDVQTKDDKLKNSVLAQGPGATSSAANTCKVQPLTLKETAESFGSPPKEEMGNEHISVHPENSDCIQADVNSDDYKGDKVYHPETGRKNEKEKVGRKGKHLLTVDQKRGEHVVCGSTRNNESESTLDLEGFQNPTAKECEGLATLDNKADLDGESTEGTEELEDSLNHFTHSVQGQTSEMIPSDEEEEDDEEEEEEEEPRLTINQREDEDGMANEDELDNTYTGSGDEDALSEEDDELGEAAKYEDVKECGKHVERALLVELNKISLKEENVCEEKNSPVDQSDFFYEFSKLIFTKGKSPTVVCSLCKREGHLKKDCPEDFKRIQLEPLPPLTPKFLNILDQVCIQCYKDFSPTIIEDQAREHIRQNLESFIRQDFPGTKLSLFGSSKNGFGFKQSDLDVCMTINGLETAEGLDCVRTIEELARVLRKHSGLRNILPITTAKVPIVKFFHLRSGLEVDISLYNTLALHNTRLLSAYSAIDPRVKYLCYTMKVFTKMCDIGDASRGSLSSYAYTLMVLYFLQQRNPPVIPVLQEIYKGEKKPEIFVDGWNIYFFDQIDELPTYWSECGKNTESVGQLWLGLLRFYTEEFDFKEHVISIRRKSLLTTFKKQWTSKYIVIEDPFDLNHNLGAGLSRKMTNFIMKAFINGRRVFGIPVKGFPKDYPSKMEYFFDPDVLTEGELAPNDRCCRICGKIGHFMKDCPMRRKVRRRRDQEDALNQRYPENKEKRSKEDKEIHNKYTEREVSTKEDKPIQCTPQKAKPMRAAADLGREKILRPPVEKWKRQDDKDLREKRCFICGREGHIKKECPQFKGSSGSLSSKYMTQGKASAKRTQQES

SEQ ID NO: 101914 - protein, 205 aa, Homo sapiens
  Payload ID: 20308
  Gene Name: zinc finger, CCHC domain containing 7
  ENSP ID: ENSP00000316365
MFGGYETIEAYEDDLYRDESSSELSVDSEVEFQLYSQIHYAQDLDDVIREEEHEEKNSGNSESSSSKPNQKKLIVLSDSEVIQLSDGSEVITLSDEDSIYRCKGKNVRVQAQENAHGLSSSLQSNELVDKKCKSDIEKPKSEERSGVIREVMIIEVSSSEEEESTISEGDNVESWMLLGCEVDDKDDDILLNLVGCENSVTEGQE

SEQ ID NO: 101915 - protein, 543 aa, Homo sapiens
  Payload ID: 20308
  Gene Name: zinc finger, CCHC domain containing 7
  Uniprot ID: Q8N3Z6
  ENSP ID: ENSP00000337839
MMFGGYETIEAYEDDLYRDESSSELSVDSEVEFQLYSQIHYAQDLDDVIREEEHEEKNSGNSESSSSKPNQKKLIVLSDSEVIQLSDGSEVITLSDEDSIYRCKGKNVRVQAQENAHGLSSSLQSNELVDKKCKSDIEKPKSEERSGVIREVMIIEVSSSEEEESTISEGDNVESWMLLGCEVDDKDDDILLNLVGCENSVTEGEDGINWSISDKDIEAQIANNRTPGRWTQRYYSANKNIICRNCDKRGHLSKNCPLPRKVRRCFLCSRRGHLLYSCPAPLCEYCPVPKMLDHSCLFRHSWDKQCDRCHMLGHYTDACTEIWRQYHLTTKPGPPKKPKTPSRPSALAYCYHCAQKGHYGHECPEREVYDPSPVSPFICYYDDKYEIQEREKRLKQKIKVLKKNGVIPEPSKLPYIKAANENPHHDIRKGRASWKSNRWPQENKETQKEMKNKNRNWEKHRKADRHREVDEDFPRGPKTYSSPGSFKTQKPSKPFHRSSHYHTSREDKSPKEGKRGKQKKKERCWEDDDNDNLFLIKQRKKKS

SEQ ID NO: 101916 - protein, 543 aa, Homo sapiens; identical to SEQ ID NO: 101915
  Payload ID: 20308
  Gene Name: zinc finger, CCHC domain containing 7
  Uniprot ID: Q8N3Z6
  ENSP ID: ENSP00000443113

SEQ ID NO: 101917 - protein, 185 aa, Homo sapiens
  Payload ID: 20309
  Gene Name: zinc finger, CCHC domain containing 8
  ENSP ID: ENSP00000437578
MKDCPMPRNAARISEKRKEYMDACGEANNQNFQQRYHAEEVEERFGRFKPGVISEELQDALGVTDKSLPPFIYRMRQLGYPPGWLKEAELENSGLALYDGKDGTDGETEVGEIQQNKSVTYDLSKLVNYPGFNISTPRGIPDEWRIFGSIPMQACQQKDVFANYLTSNFQAPGVKSGNKRSSSHS

SEQ ID NO: 101918 - protein, 469 aa, Homo sapiens
  Payload ID: 20309
  Gene Name: zinc finger, CCHC domain containing 8
  Uniprot ID: Q6NZY4
  ENSP ID: ENSP00000438993
MKDCPMPRNAARISEKRKEYMDACGEANNQNFQQRYHAEEVEERFGRFKPGVISEELQDALGVTDKSLPPFIYRMRQLGYPPGWLKEAELENSGLALYDGKDGTDGETEVGEIQQNKSVTYDLSKLVNYPGFNISTPRGIPDEWRIFGSIPMQACQQKDVFANYLTSNFQAPGVKSGNKRSSSHSSPGSPKKQKNESNSAGSPADMELDSDMEVPHGSQSSESFQFQPPLPPDTPPLPRGTPPPVFTPPLPKGTPPLTPSDSPQTRTASGAVDEDALTLEELEEQQRRIWAALEQAESVNSDSDVPVDTPLTGNSVASSPCPNELDLPVPEGKTSEKQTLDEPEVPEIFTKKSEAGHASSPDSEVTSLCQKEKAELAPVNTEGALLDNGSVVPNCDISNGGSQKLFPADTSPSTATKIHSPIPDMSKFATGITPFEFENMAESTGMYLRIRSLLKNSPRNQQKNKKASE

SEQ ID NO: 101919 - protein, 38 aa, Homo sapiens
  Payload ID: 20309
  Gene Name: zinc finger, CCHC domain containing 8
  ENSP ID: ENSP00000440234
MKDCPMPRNAARISEKRKEYMDACGEANNQNFQQRYHA

SEQ ID NO: 101920 - protein, 211 aa, Homo sapiens
  Payload ID: 20309
  Gene Name: zinc finger, CCHC domain containing 8
  ENSP ID: ENSP00000441112
MKDCPMPRNAARISEKRKEYMDACGEANNQNFQQRYHAEEVEERFGRFKPGVISEELQDALGVTDKSLPPFIYRMRQLGYPPGWLKEAELENSGLALYDGKDGTDGETEVGEIQQNKSVTYDLSKLVNYPGFNISTPRGIPDEWRIFGSIPMQACQQKDVFANYLTSNFQAPGVKSGNKRSSSHSSPGSPKKQKNESNSAGSPADMELDSG

SEQ ID NO: 101921 - protein, 469 aa, Homo sapiens; identical to SEQ ID NO: 101918
  Payload ID: 20309
  Gene Name: zinc finger, CCHC domain containing 8
  Uniprot ID: Q6NZY4
  ENSP ID: ENSP00000441423

SEQ ID NO: 101922 - protein, 707 aa, Homo sapiens
  Payload ID: 20309
  Gene Name: zinc finger, CCHC domain containing 8
  Uniprot ID: Q6NZY4
  ENSP ID: ENSP00000488055
MAAEVYFGDLELFEPFDHPEESIPKPVHTRFKDDDGDEEDENGVGDAELRERLRQCEETIEQLRAENQELKRKLNILTRPSGILVNDTKLDGPILQILFMNNAISKQYHQEIEEFVSNLVKRFEEQQKNDVEKTSFNLLPQPSSIVLEEDHKVEESCAIKNNKEAFSVVGSVLYFTNFCLDKLGQPLLNENPQLSEGWEIPKYHQVFSHIVSLEGQEIQVKAKRPKPHCFNCGSEEHQMKDCPMPRNAARISEKRKEYMDACGEANNQNFQQRYHAEEVEERFGRFKPGVISEELQDALGVTDKSLPPFIYRMRQLGYPPGWLKEAELENSGLALYDGKDGTDGETEVGEIQQNKSVTYDLSKLVNYPGFNISTPRGIPDEWRIFGSIPMQACQQKDVFANYLTSNFQAPGVKSGNKRSSSHSSPGSPKKQKNESNSAGSPADMELDSDMEVPHGSQSSESFQFQPPLPPDTPPLPRGTPPPVFTPPLPKGTPPLTPSDSPQTRTASGAVDEDALTLEELEEQQRRIWAALEQAESVNSDSDVPVDTPLTGNSVASSPCPNELDLPVPEGKTSEKQTLDEPEVPEIFTKKSEAGHASSPDSEVTSLCQKEKAELAPVNTEGALLDNGSVVPNCDISNGGSQKLFPADTSPSTATKIHSPIPDMSKFATGITPFEFENMAESTGMYLRIRSLLKNSPRNQQKNKKASE

SEQ ID NO: 101923 - protein, 271 aa, Homo sapiens
  Payload ID: 20310
  Gene Name: zinc finger, CCHC domain containing 9
  Uniprot ID: Q8N567
  ENSP ID: ENSP00000254037
MTRWARVSTTYNKRPLPATSWEDMKKGSFEGTSQNLPKRKQLEANRLSLKNDAPQAKHKKNKKKKEYLNEDVNGFMEYLRQNSQMVHNGQIIATDSEEVREEIAVALKKDSRREGRRLKRQAAKKNAMVCFHCRKPGHGIADCPAALENQDMGTGICYRCGSTEHEITKCKAKVDPALGEFPFAKCFVCGEMGHLSRSCPDNPKGLYADGGGCKLCGSVEHLKKDCPESQNSERMVTVGRWAKGMSADYEEILDVPKPQKPKTKIPKVVNF

SEQ ID NO: 101924 - protein, 271 aa, Homo sapiens; identical to SEQ ID NO: 101923
  Payload ID: 20310
  Gene Name: zinc finger, CCHC domain containing 9
  Uniprot ID: Q8N567
  ENSP ID: ENSP00000369546

SEQ ID NO: 101925 - protein, 271 aa, Homo sapiens; identical to SEQ ID NO: 101923
  Payload ID: 20310
  Gene Name: zinc finger, CCHC domain containing 9
  Uniprot ID: Q8N567
  ENSP ID: ENSP00000385047

SEQ ID NO: 101926 - protein, 271 aa, Homo sapiens; identical to SEQ ID NO: 101923
  Payload ID: 20310
  Gene Name: zinc finger, CCHC domain containing 9
  Uniprot ID: Q8N567
  ENSP ID: ENSP00000412637

SEQ ID NO: 101927 - protein, 524 aa, Homo sapiens
  Payload ID: 20311
  Gene Name: zinc finger, CW type with PWWP domain 1
  Uniprot ID: Q9H0M4
  ENSP ID: ENSP00000354210
MMTTLQNKEECGKGPKRIFAPPAQKSYSLLPCSPNSPKEETPGISSPETEARISLPKASLKKKEEKATMKNVPSREQEKKRKAQINKQAEKKEKEKSSLTNAEFEEIVQIVLQKSLQECLGMGSGLDFAETSCAQPVVSTQSDKEPGITASATDTDNANGEEVPHTQEISVSWEGEAAPEIRTSKLGQPDPAPSKKKSNRLTLSKRKKEAQDEKVEKTQGGHEHRQEDRLKKTVQDHSQIRDQQKGEISGFGQCLVWVQCSFPNCGKWRRLCGNIDPSVLPDNWSCDQNTDVQYNRCDIPEETWTGLESDVAYASYIPGSIIWAKQYGYPWWPGMIESDPDLGEYFLFTSHLDSLPSKYHVTFFGETVSRAWIPVNMLKNFQELSLELSVMKKRRNDCSQKLGVALMMAQEAEQISIQERVNLFGFWSRFNGSNSNGERKDLQLSGLNSPGSCLEKKEKEEELEKEEGEKTALRKNLKLPRARPWQPAFQREKKLEQCQRTWAYQRVRGPAPHLRKKSPDTGNP

SEQ ID NO: 101928 - protein, 648 aa, Homo sapiens
  Payload ID: 20311
  Gene Name: zinc finger, CW type with PWWP domain 1
  Uniprot ID: Q9H0M4
  ENSP ID: ENSP00000381109
MMTTLQNKEECGKGPKRIFAPPAQKSYSLLPCSPNSPKEETPGISSPETEARISLPKASLKKKEEKATMKNVPSREQEKKRKAQINKQAEKKEKEKSSLTNAEFEEIVQIVLQKSLQECLGMGSGLDFAETSCAQPVVSTQSDKEPGITASATDTDNANGEEVPHTQEISVSWEGEAAPEIRTSKLGQPDPAPSKKKSNRLTLSKRKKEAHEKVEKTQGGHEHRQEDRLKKTVQDHSQIRDQQKGEISGFGQCLVWVQCSFPNCGKWRRLCGNIDPSVLPDNWSCDQNTDVQYNRCDIPEETWTGLESDVAYASYIPGSIIWAKQYGYPWWPGMIESDPDLGEYFLFTSHLDSLPSKYHVTFFGETVSRAWIPVNMLKNFQELSLELSVMKKRRNDCSQKLGVALMMAQEAEQISIQERVNLFGFWSRFNGSNSNGERKDLQLSGLNSPGSCLEKKEKEEELEKEEGEKTDPILPIRKRVKIQTQKTKPRGLGGDAGTADGRGRTLQRKIMKRSLGRKSTAPPAPRMGRKEGQGNSDSDQPGPKKKFKAPQSKALAASFSEGKEVRTVPKNLGLSACKGACPSSAKEEPRHREPLTQEAGSVPLEDEASSDLDLEQLMEDVGRELGQSGELQHSNSDGEDFPVALFGK

SEQ ID NO: 101929 - protein, 246 aa, Homo sapiens
  Payload ID: 20311
  Gene Name: zinc finger, CW type with PWWP domain 1
  ENSP ID: ENSP00000418351
GQCLVWVQCSFPNCGKWRRLCGNIDPSVLPDNWSCDQNTDVQYNRCDIPEETWTGLESDVAYASYIPGSIIWAKQYGYPWWPGMIESDPDLGEYFLFTSHLDSLPSKYHVTFFGETVSRAWIPVNMLKNFQELSLELSVMERVNLFGFWSRFNGSNSNGERKDLQLSGLNSPGSCLEKKEKEEELEKEEGEKTALRKNLKLPRARPWQPAFQREKKLEQCQRTWAYQRVRGPAPHLRKKSPDTGNP

SEQ ID NO: 101930 - protein, 477 aa, Homo sapiens
  Payload ID: 20311
  Gene Name: zinc finger, CW type with PWWP domain 1
  Uniprot ID: Q9H0M4
  ENSP ID: ENSP00000419187
MGSGLDFAETSCAQPVVSTQSDKEPGITASATDTDNANGEEVPHTQEISVSWEGEAAPEIRTSKLGQPDPAPSKKKSNRLTLSKRKKEAQDEKVEKTQGGHEHRQEDRLKKTVQDHSQIRDQQKGEISGFGQCLVWVQCSFPNCGKWRRLCGNIDPSVLPDNWSCDQNTDVQYNRCDIPEETWTGLESDVAYASYIPGSIIWAKQYGYPWWPGMIESDPDLGEYFLFTSHLDSLPSKYHVTFFGETVSRAWIPVNMLKNFQELSLELSVMKKRRNDCSQKLGVALMMAQEAEQISIQERVNLFGFWSRFNGSNSNGERKDLQLSGLNSPGSCLEKKEKEEELEKEEGEKTDPILPIRKRVKIQTQKTKPRGPKKKFKAPQSKALAASFSEGKEVRTVPKNLGLSACKGACPSSAKEEPRHREPLTQEAGSVPLEDEASSDLDLEQLMEDVGRELGQSGELQHSNSDGEDFPVALFGK

SEQ ID NO: 101931 - protein, 38 aa, Homo sapiens
  Payload ID: 20311
  Gene Name: zinc finger, CW type with PWWP domain 1
  ENSP ID: ENSP00000419447
MFQAGNRRKKERHKSTSKQRRKKRKNQVLPMQNLRRLS

SEQ ID NO: 101932 - protein, 356 aa, Homo sapiens
  Payload ID: 20312
  Gene Name: zinc finger, CW type with PWWP domain 2
  Uniprot ID: Q504Y3
  ENSP ID: ENSP00000373278
MDKEKLDVKIEYCNYAMDSSVENMYVNKVWVQCENENCLKWRLLSSEDSAKVDHDEPWYCFMNTDSRYNNCSISEEDFPEESQLHQCGFKIVYSQLPLGSLVLVKLQNWPSWPGILCPDRFKGKYVTYDPDGNVEEYHIEFLGDPHSRSWIKATFVGHYSITLKPEKCKNKKKWYKSALQEACLLYGYSHEQRLEMCCLSKLQDKSETHDKVAALVKKRKQTSKNNIEKKKPKFRKRKRKAILKCSFENVYSDDALSKENRVVCETEVLLKELEQMLQQALQPTATPDESEEGHGEEINMGEKLSKCSPEAPAGSLFENHYEEDYLVIDGIKLKAGECIEDITNKFKEIDALMSEF

SEQ ID NO: 101933 - protein, 165 aa, Homo sapiens
  Payload ID: 20312
  Gene Name: zinc finger, CW type with PWWP domain 2
  ENSP ID: ENSP00000393521
  MOD_RES (1)..(1): Any amino acid
XDSSVENMYVNKVWVQCENENCLKWRLLSSEDSAKVDHDEPWYCFMNTDSRYNNCSISEEDFPEESQLHQCGFKIVYSQLPLGSLVLVKLQNWPSWPGILCPDRFKGKYVTYDPDGNVEEYHIEFLGDPHSRSWIKATFVGHYSITLKIMRSMTYIHMLLQTYKK

SEQ ID NO: 101934 - protein, 191 aa, Homo sapiens
  Payload ID: 20312
  Gene Name: zinc finger, CW type with PWWP domain 2
  ENSP ID: ENSP00000395421
  MOD_RES (1)..(1): Any amino acid
XAFSAIKMRVNAKNLPQMSRKTLGIINAEVKRINTGERRGEEKQTSKNNIEKKKPKFRKRKRKAILKCSFENVYSDDALSKENRVVCETEVLLKELEQMLQQALQPTATPDESEEGHGEEINMGEKTIFFFGDRVSLCHQGWSEVMQSLLTAISASQVQVILLPQPPEYLGLQNNNQRRFMVEDEEKLCLS

SEQ ID NO: 101935 - protein, 241 aa, Homo sapiens
  Payload ID: 20312
  Gene Name: zinc finger, CW type with PWWP domain 2
  ENSP ID: ENSP00000395687
  MOD_RES (1)..(1): Any amino acid
XWIKATFVGHYSITLKTGVQWHNLASLQHLPPRFKQFSYLSLPSSWELQPEKCKNKKKWYKSALQEACLLYGYSHEQRLEMCCLSKLQDKSETHDKVAALVKKRKQTSKNNIEKKKPKFRKRKRKAILKCSFENVYSDDALSKENRVVCETEVLLKELEQMLQQALQPTATPDESEEGHGEEINMGEKLSKCSPEAPAGSLFENHYEEDYLVIDGIKLKAGECIEDITNKFKEIDALMSEF

SEQ ID NO: 101936 - protein, 126 aa, Homo sapiens
  Payload ID: 20312
  Gene Name: zinc finger, CW type with PWWP domain 2
  ENSP ID: ENSP00000395930
MDKEKLDVKIEYCNYAMDSSVENMYVNKVWVQCENENCLKWRLLSSEDSAKVDHDEPWYCFMNTDSRYNNCSISEEDFPEESQLHQCGFKIVYSQLPLGSLVLVKLQNWPSWPGILCPDRFKGKYV

SEQ ID NO: 101937 - protein, 2354 aa, Homo sapiens
  Payload ID: 20313
  Gene Name: zinc finger, DBF-type containing 2
  Uniprot ID: Q9HCK1
  ENSP ID: ENSP00000363545
MQKRQGYCSYCRVQYNNLEQHLFSAQHRSLTRQSRRQICTSSLMERFLQDVLQHHPYHCQESSSTQDETHVNTGSSSEVVHLDDAFSEEEEEDEDKVEDEDATEERPSEVSEPIEELHSRPHKSQEGTQEVSVRPSVIQKLEKGQQQPLEFVHKIGASVRKCNLVDIGQATNNRSNLVRPPVICNAPASCLPESSNDRPVTANTTSLPPAAHLDSVSKCDPNKVEKYLEQPDGASRNPVPSSHVETTSFSYQKHKESNRKSLRMNSDKLVLWKDVKSQGKTLSAGLKFHERMGTKGSLRVKSPSKLAVNPNKTDMPSNKGIFEDTIAKNHEEFFSNMDCTQEEKHLVFNKTAFWEQKCSVSSEMKFDCISLQSASDQPQETAQDLSLWKEEQIDQEDNYESRGSEMSFDCSSSFHSLTDQSKVSAKEVNLSKEVRTDVQYKNNKSYVSKISSDCDDILHLVTNQSQMIVKEISLQNARHISLVDQSYESSSSETNFDCDASPQSTSDYPQQSVTEVNLPKEVHIGLVDKNYGSSSSEVSADSVFPLQSVVDRPPVAVTETKLRKKAHTSLVDNYGSSCSETSFDCDVSLESVVDHPQLTVKGRNLKGRQVHLKHKKRKPSSAKAHLDCDVSLGTVADESQRAVEKINLLKEKNADLMDMNCESHGPEMGFQADAQLADQSQVAEIERQKVDVDLENKSVQSSRSSLSSDSPASLYHSAHDEPQEALDEVNLKELNIDMEVRSYDCSSSELTFDSDPPLLSVTEQSHLDAEGKERHIDLEDESCESDSSEITFDSDIPLYSVIDQPEVAVYEEETVDLESKSNESCVSEITFDSDIPLHSGNDHPEVAVKEVIQKEEYIHLERKNDEPSGSEISSDSHAPLHSVTNSPEVAVKKLNPQKEEQVHLENKENEPIDSEVSLDYNIIFHSVTGRSEDPIKEISLHTKEHMYLENKSVFETSLDSDVPLQAATHKPEVIVKETWLQREKHAEFQGRSTEFSGSKTSLDSGVPHYSVTEPQVAVNKINRKKQYVLENKNDKCSGSEIILDSNVPPQSMTDQPQLAFLKEKHVNLKDKNSKSGDSKITFDSEQLQEAVKKIDQWKEEVIGLKNKINEPSTYKLIHHPDVSVQSVADQPKVAIKHVNLGNENHMYLEVKNSQYSCSEMNLDSGFLGQSIVNRPQITILEQEHIELEGKHNQCCGSEVSFDSDDPLQSVADRLRETVKEISLWKDEEVDTEDRRNEAKGFEIMYDSDVLQPVAGQPEEVVKEVSLWKEHVDLENKIVKPTDSRINFDSHEPLQSVTNKIPGANKEINLLREEHVCLDDKGYVPSDSEIIYVSNIPLQSVIKQPHILEEEHASLEDKSSNSYSPEESSDSNDSFQAAADELQKPVKEINLWKEDHIYLEDKSYKLGDFDVSYASHIPVQFVTDQSSVPVKEINLQKKDHNDLENKNCEVCGSEIKCHSCVHLQSEVDQPQVSYKEADLQKEEHVVMEEKTDQPSDSEMMYDSDVPFQIVVNQFPGSVKETHLPKVVLVDLVPGDSDYEVISDDIPLQLVTDPPQLTVKDISCINTECIDIEDKSCDFFGSEVRCNCKASTPSMTNQCKETFKIINRKKDYIILGEPSCQSCGSEMNFNVDASDQSMTYESQGPDEKMVKYIDSEDKSCGYNGSKGKFNLEDTSHRTTHRLQKAHKEASLRKDPRNAGLKGKSCQSSASAVDFGASSKSALHRRADKKKRSKLKHRDLEVSCEPDGFEMNFQCAPPLPSDTDQPQETVKKRHPCKKVSSDLKEKNHDSQSSSVLKVDSVRNLKKAKDVIEDNPDEPVLEALPHVPPSFVGKTWSQIMREDDIKINALVKEFREGRFHCYFDDDCETKKVSSKGKKKVTWADLQGKEDTAPTQAVSESDDIVCGISDIDDLSVALDKPCHRHPPAERPPKQKGRVASQCQTAKISHSTQTSCKNYPVMKRKIIRQEEDPPKSKCSRLQDDRKTKKKVKIGTVEFPASCTKVLKPMQPKALVCVLSSLNIKLKEGEGLPFPKMRHHSWDNDIRFICKYKRNIFDYYEPLIKQIVISPPLSVIVPEFERRNWVKIHFNRSNQNSSAGDNDADGQGSASAPLMAVPARYGFNSHQGTSDSSLFLEESKVLHARELPKKRNFQLTFLNHDVVKISPKSVRNKLLESQSKKKIHGKRVTTSSNKLGFPKKVYKPIILQQKPRKASEKQSIWIRTKPSDIIRKYISKYSVFLRHRYQSRSAFLGRYLKKKKSVVSRLKKAKRTAKVLLNSSVPPAGAEELSSAMANPPPKRPVRASCRVARRRKKTDESYHGRQKGPSTPVRAYDLRSSSCLQQRERMMTRLANKLRGNEVK

SEQ ID NO: 101938 - protein, 2352 aa, Homo sapiens
  Payload ID: 20313
  Gene Name: zinc finger, DBF-type containing 2
  ENSP ID: ENSP00000478626
MIPDGSSEIQEVMKNSGKHLFSAQHRSLTRQSRRQICTSSLMERFLQDVLQHHPYHCQESSSTQDETHVNTGSSSEVVHLDDAFSEEEEEDEDKVEDEDATEERPSEVSEPIEELHSRPHKSQEGTQEVSVRPSVIQKLEKGQQQPLEFVHKIGASVRKCNLVDIGQATNNRSNLVRPPVICNAPASCLPESSNDRPVTANTTSLPPAAHLDSVSKCDPNKVEKYLEQPDGASRNPVPSSHVETTSFSYQKHKESNRKSLRMNSDKLVLWKDVKSQGKTLSAGLKFHERMGTKGSLRVKSPSKLAVNPNKTDMPSNKGIFEDTIAKNHEEFFSNMDCTQEEKHLVFNKTAFWEQKCSVSSEMKFDCISLQSASDQPQETAQDLSLWKEEQIDQEDNYESRGSEMSFDCSSSFHSLTDQSKVSAKEVNLSKEVRTDVQYKNNKSYVSKISSDCDDILHLVTNQSQMIVKEISLQNARHISLVDQSYESSSSETNFDCDASPQSTSDYPQQSVTEVNLPKEVHIGLVDKNYGSSSSEVSADSVFPLQSVVDRPPVAVTETKLRKKAHTSLVDNYGSSCSETSFDCDVSLESVVDHPQLTVKGRNLKGRQVHLKHKKRKPSSAKAHLDCDVSLGTVADESQRAVEKINLLKEKNADLMDMNCESHGPEMGFQADAQLADQSQVAEIERQKVDVDLENKSVQSSRSSLSSDSPASLYHSAHDEPQEALDEVNLKELNIDMEVRSYDCSSSELTFDSDPPLLSVTEQSHLDAEGKERHIDLEDESCESDSSEITFDSDIPLYSVIDQPEVAVYEEETVDLESKSNESCVSEITFDSDIPLHSGNDHPEVAVKEVIQKEEYIHLERKNDEPSGSEISSDSHAPLHSVTNSPEVAVKKLNPQKEEQVHLENKENEPIDSEVSLDYNIIFHSVTGRSEDPIKEISLHTKEHMYLENKSVFETSLDSDVPLQAATHKPEVIVKETWLQREKHAEFQGRSTEFSGSKTSLDSGVPHYSVTEPQVAVNKINRKKQYVLENKNDKCSGSEIILDSNVPPQSMTDQPQLAFLKEKHVNLKDKNSKSGDSKITFDSEQLQEAVKKIDQWKEEVIGLKNKINEPSTYKLIHHPDVSVQSVADQPKVAIKHVNLGNENHMYLEVKNSQYSCSEMNLDSGFLGQSIVNRPQITILEQEHIELEGKHNQCCGSEVSFDSDDPLQSVADRLRETVKEISLWKDEEVDTEDRRNEAKGFEIMYDSDVLQPVAGQPEEVVKEVSLWKEHVDLENKIVKPTDSRINFDSHEPLQSVTNKIPGANKEINLLREEHVCLDDKGYVPSDSEIIYVSNIPLQSVIKQPHILEEEHASLEDKSSNSYSPEESSDSNDSFQAAADELQKPVKEINLWKEDHIYLEDKSYKLGDFDVSYASHIPVQFVTDQSSVPVKEINLQKKDHNDLENKNCEVCGSEIKCHSCVHLQSEVDQPQVSYKEADLQKEEHVVMEEKTDQPSDSEMMYDSDVPFQIVVNQFPGSVKETHLPKVVLVDLVPGDSDYEVISDDIPLQLVTDPPQLTVKDISCINTECIDIEDKSCDFFGSEVRCNCKASTPSMTNQCKETFKIINRKKDYIILGEPSCQSCGSEMNFNVDASDQSMTYESQGPDEKMVKYIDSEDKSCGYNGSKGKFNLEDTSHRTTHRLQKAHKEASLRKDPRNAGLKGKSCQSSASAVDFGASSKSALHRRADKKKRSKLKHRDLEVSCEPDGFEMNFQCAPPLPSDTDQPQETVKKRHPCKKVSSDLKEKNHDSQSSSVLKVDSVRNLKKAKDVIEDNPDEPVLEALPHVPPSFVGKTWSQIMREDDIKINALVKEFREGRFHCYFDDDCETKKVSSKGKKKVTWADLQGKEDTAPTQAVSESDDIVCGISDIDDLSVALDKPCHRHPPAERPPKQKGRVASQCQTAKISHSTQTSCKNYPVMKRKIIRQEEDPPKSKCSRLQDDRKTKKKVKIGTVEFPASCTKVLKPMQPKALVCVLSSLNIKLKEGEGLPFPKMRHHSWDNDIRFICKYKRNIFDYYEPLIKQIVISPPLSVIVPEFERRNWVKIHFNRSNQNSSAGDNDADGQGSASAPLMAVPARYGFNSHQGTSDSSLFLEESKVLHARELPKKRNFQLTFLNHDVVKISPKSVRNKLLESQSKKKIHGKRVTTSSNKLGFPKKVYKPIILQQKPRKASEKQSIWIRTKPSDIIRKYISKYSVFLRHRYQSRSAFLGRYLKKKKSVVSRLKKAKRTAKVLLNSSVPPAGAEELSSAMANPPPKRPVRASCRVARRRKKTDESYHGRQKGPSTPVRAYDLRSSSCLQQRERMMTRLANKLRGNEVK

SEQ ID NO: 101939 - protein, 485 aa, Homo sapiens
  Payload ID: 20314
  Gene Name: zinc finger, DHHC-type containing 1
  Uniprot ID: Q8WTX9
  ENSP ID: ENSP00000340299
MYKMNICNKPSNKTAPEKSVWTAPAQPSGPSPELQGQRSRRNGWSWPPHPLQIVAWLLYLFFAVIGFGILVPLLPHHWVPAGYACMGAIFAGHLVVHLTAVSIDPADANVRDKSYAGPLPIFNRSQHAHVIEDLHCNLCNVDVSARSKHCSACNKCVCGFDHHCKWLNNCVGERNYRLFLHSVASALLGVLLLVLVATYVFVEFFVNPMRLRTNRHFEVLKNHTDVWFVFLPAAPVETQAPAILALAALLILLGLLSTALLGHLLCFHIYLMWHKLTTYEYIVQHRPPQEAKGVHRELESCPPKMRPIQEMEFYMRTFRHMRPEPPGQAGPAAVNAKHSRPASPDPTPGRRDCAGPPVQVEWDRKKPLPWRSPLLLLAMWGPQAPPCLCRKRGRGACIKCERLRPRIRRRGLGPPAAAPARRRIPRTPALCTPLALPAPTTRRRQSPWTRFQWRRRAWAAPLWPPRGAGADSPRWRGRRVRPPFS

SEQ ID NO: 101940 - protein, 351 aa, Homo sapiens
  Payload ID: 20314
  Gene Name: zinc finger, DHHC-type containing 1
  ENSP ID: ENSP00000459264
EDLHCNLCNVDVSARSKHCSACNKCVCGFDHHCKWLNNCVGERNYRLFLHSVASALLGVLLLVLVATYVFVEFFVNPMRLRTNRHFEVLKNHTDVWFVFLPAAPVETQAPAILALAALLILLGLLSTALLGHLLCFHIYLMWHKLTTYEYIVQHRPPQEAKGVHRELESCPPKMRPIQEMEFYMRTFRHMRPEPPGQAGPAAVNANPSQFLATRGQAEPPPPSSPDTLALPPRIRPQKKRKRRVYKVRTSETSDPASGPRAPSRRSSSSTDSADASPVHAAGPAGAYHSASAESVDEIPVAQTRLGSAALAAPRGRGRQPTLARQARAPAVFVSPSSGEPRAPGGREAGLA

SEQ ID NO: 101941 - protein, 412 aa, Homo sapiens
  Payload ID: 20315
  Gene Name: zinc finger, DHHC-type containing 11
  Uniprot ID: Q9H8X9
  ENSP ID: ENSP00000283441
MDTRSGSQCSVTPEAILNNEKLVLPPRISRVNGWSLPLHYFQVVTWAVFVGLSSATFGIFIPFLPHAWKYIAYVVTGGIFSFHLVVHLIASCIDPADSNVRLMKNYSQPMPLFDRSKHAHVIQNQFCHLCKVTVNKKTKHCISCNKCVSGFDHHCKWINNCVGSRNYWFFFSTVASATAGMLCLIAILLYVLVQYLVNPGVLRTDPRYEDVKNMNTWLLFLPLFPVQVQTLIVVIIGMLVLLLDFLGLVHLGQLLIFHIYLKAKKMTTFEYLINNRKEESSKHQAVRKDPYVQMDKGVLQQGAGALGSSAQGVKAKSSLLIHKHLCHFCTSVNQDGDSTAREGDEDPCPSALGAKARNSRLICRRLCQFSTRVHPDGGSMAQEADDAPSISTLGLQQETTEPMKTDSAESED

SEQ ID NO: 101942 - protein, 213 aa, Homo sapiens
  Payload ID: 20315
  Gene Name: zinc finger, DHHC-type containing 11
  ENSP ID: ENSP00000397719
MLQARNQSPSSQRPLDVLRRNQDPQSPASISVIIFITPKEEPALQEGLHLQEDGLPATAEDAATCLTVLSSQPASCRASCCLRADGPGMLAHPVSTVWEMGAQYEMGAQYWEMGAHSTGKWEHSTEKWEHSTEKWEYTTEKWEHSTGKWAYSTEKWEHSTGKWETVLGNGSPQYWERGVTVLGNGSTGKWEHSTGKWEHSTGKPQTWILSFSA

SEQ ID NO: 101943 - protein, 221 aa, Homo sapiens
  Payload ID: 20315
  Gene Name: zinc finger, DHHC-type containing 11
  ENSP ID: ENSP00000423817
HCISCNKCVSGFDHHCKWINNCVGSRNYWFFFSTVASATAGMLCLIAILLYVLVQYLVNPGVLRTDPRYEDVKNMNTWLLFLPLFPVQVQTLIVVIIGMLVLLLDFLGLVHLGQLLIFHIYLKAKKMTTFEYLINNRKEESSKHQAVRKDPYVQMDKGVLQQGAGALGSSAQGVKAKSSLLIHKHLCHFCTSVNQDGDSTARGHLTTLPQDFREQAPVTWK

SEQ ID NO: 101944 - protein, 51 aa, Homo sapiens
  Payload ID: 20315
  Gene Name: zinc finger, DHHC-type containing 11
  ENSP ID: ENSP00000426873
MKVQTLIVVIIGMLVLLLDFLGLVHLGQLLIFHIYLKAKKMTTFEYLINNR

SEQ ID NO: 101945 - protein, 142 aa, Homo sapiens
  Payload ID: 20315
  Gene Name: zinc finger, DHHC-type containing 11
  Uniprot ID: Q9H8X9
  ENSP ID: ENSP00000427067
MNTWLLFLPLFPVQVQTLIVVIIGMLVLLLDFLGLVHLGQLLIFHIYLSMSPTLSPRSPQGWVVRAAHLTPLLEYVPNPEPPTPGARVFVPRVRMCSGSASPRSEIMDKKGKSQEEIKSMRTQQAQQEAELTPRPAGVVPGA

SEQ ID NO: 101946 - protein, 382 aa, Homo sapiens
  Payload ID: 20316
  Gene Name: zinc finger, DHHC-type containing 11B
  ENSP ID: ENSP00000442373
MAQVLPFCVLQMDTRSGSQCSVTPEAIRNNEELVLPPRISRVNGWSLPLHYFRVVTWAVFVGLSLATFRIFIPLLPHSWKYIAYVVTGGIFSFHLVVHLIASCIDPADSNVRLMKNYSQPMPLFDRSKHAHVIQNQFCHLCKVTVNKKTKHCISCNKCVSGFDHHCKWINNCVGSRNYWFFFSTVASATAGMLCLIAILLYVLVQYLVNPRVLRTDPRYEDVKNMNTWLLFLPLFPVQVQTLIVVIIRMLVLLLDLLGLVQLGQLLIFHIYLKAKKMTTFEYLINTRKEESSKHQAVRKDPYVQMDKGFLQQGAGALGSSAQGVKAKSSLLIYKCPCHFCTSVNQDGDSKAQEADDAPSTSTLGLQQETTEPMKTDSAESED

SEQ ID NO: 101947 - protein, 371 aa, Homo sapiens
  Payload ID: 20316
  Gene Name: zinc finger, DHHC-type containing 11B
  Uniprot ID: P0C7U3
  ENSP ID: ENSP00000445280
MDTRSGSQCSVTPEAIRNNEELVLPPRISRVNGWSLPLHYFRVVTWAVFVGLSLATFRIFIPLLPHSWKYIAYVVTGGIFSFHLVVHLIASCIDPADSNVRLMKNYSQPMPLFDRSKHAHVIQNQFCHLCKVTVNKKTKHCISCNKCVSGFDHHCKWINNCVGSRNYWFFFSTVASATAGMLCLIAILLYVLVQYLVNPRVLRTDPRYEDVKNMNTWLLFLPLFPVQVQTLIVVIIRMLVLLLDLLGLVQLGQLLIFHIYLKAKKMTTFEYLINTRKEESSKHQAVRKDPYVQMDKGFLQQGAGALGSSAQGVKAKSSLLIYKCPCHFCTSVNQDGDSKAQEADDAPSTSTLGLQQETTEPMKTDSAESED

SEQ ID NO: 101948 - protein, 142 aa, Homo sapiens
  Payload ID: 20316
  Gene Name: zinc finger, DHHC-type containing 11B
  ENSP ID: ENSP00000484004
MNTWLLFLPLFPVQVQTLIVVIIRMLVLLLDLLGLVQLGQLLIFHIYLSMSPTLSPRSPQAWLVRAAHLTPLLEYVPNPEPPTPGARVFVPRVRMCSGSASPRSEIMDKKGKSQEEIKSMRAQQAQQEAELTLRPAGALPGA

SEQ ID NO: 101949 - protein, 267 aa, Homo sapiens
  Payload ID: 20317
  Gene Name: zinc finger, DHHC-type containing 12
  Uniprot ID: Q96GR4
  ENSP ID: ENSP00000361748
MAPWALLSPGVLVRTGHTVLTWGITLVLFLHDTELRQWEEQGELLLPLTFLLLVLGSLLLYLAVSLMDPGYVNVQPQPQEELKEEQTAMVPPAIPLRRCRYCLVLQPLRARHCRECRRCVRRYDHHCPWMENCVGERNHPLFVVYLALQLVVLLWGLYLAWSGLRFFQPWGQWLRSSGLLFATFLLLSLFSLVASLLLVSHLYLVASNTTTWEFISSHRIAYLRQRPSNPFDRGLTRNLAHFFCGWPSGSWETLWAEEEEEGSSPAV

SEQ ID NO: 101950 - protein, 281 aa, Homo sapiens
  Payload ID: 20317
  Gene Name: zinc finger, DHHC-type containing 12
  ENSP ID: ENSP00000361752
MAPWALLSPGVLVRTGHTVLTWGITLVLFLHDTGEPDPERPRTHPIPQLRQWEEQGELLLPLTFLLLVLGSLLLYLAVSLMDPGYVNVQPQPQEELKEEQTAMVPPAIPLRRCRYCLVLQPLRARHCRECRRCVRRYDHHCPWMENCVGERNHPLFVVYLALQLVVLLWGLYLAWSGLRFFQPWGQWLRSSGLLFATFLLLSLFSLVASLLLVSHLYLVASNTTTWEFISSHRIAYLRQRPSNPFDRGLTRNLAHFFCGWPSGSWETLWAEEEEEGSSPAV

SEQ ID NO: 101951 - protein, 210 aa, Homo sapiens
  Payload ID: 20317
  Gene Name: zinc finger, DHHC-type containing 12
  ENSP ID: ENSP00000384205
MAPWALLSPGVLVRTGHTVLTWGITLVLFLHDTDKSADELLATHSHSWNQHLQAFAQPGTHFPTSNCTPTPPTPVLPGPASLCSPASPELRQWEEQGELLLPLTFLLLVLGSLLLYLAVSLMDPGYVNVQPQPQEELKEEQTAMVPPAIPLRRCRYCLVLQPLRARHCRECRRCVRRYDHHCPWMENCVGERNHPLFVVYLALQLVVLLW

SEQ ID NO: 101952 - protein, 205 aa, Homo sapiens
  Payload ID: 20317
  Gene Name: zinc finger, DHHC-type containing 12
  ENSP ID: ENSP00000387587
MAPWALLSPGVLVRTGHTVLTWGITLVLFLHDTELRQWEEQGELLLPLTFLLLVLGSLLLYLAVSLMDPGYVNVQPQPQEELKEEQTAMVPPAIPLRRCRYCLVLQPLRARHCRECRRCVRRYDHHCPWMENCVGERNHPLFVVYLALQLVVLLWGLYLACTRPLSPAPQVRPPVLPALGSVVAVQRAPVRHLPAAVPLLVGGQP

SEQ ID NO: 101953 - protein, 492 aa, Homo sapiens
  Payload ID: 20318
  Gene Name: zinc finger, DHHC-type containing 13
  Uniprot ID: Q8IUH4
  ENSP ID: ENSP00000382288
MVILLLQHGADPTLIDGEGFSSIHLAVLFQHMPIIAYLISKGQSVNMTDVNGQTPLMLSAHKVIGPEPTGFLLKFNPSLNVVDKIHQNTPLHWAVAAGNVNAVDKLLEAGSSLDIQNVKGETPLDMALQNKNQLIIHMLKTEAKMRANQKFRLWRWLQKCELFLLLMLSVITMWAIGYILDFNSDSWLLKGCLLVTLFFLTSLFPRFLVGYKNLVYLPTAFLLSSVFWIFMTWFILFFPDLAGAPFYFSFIFSIVAFLYFFYKTWATDPGFTKASEEEKKVNIITLAETGSLDFRTFCTSCLIRKPLRSLHCHVCNCCVARYDQHCLWTGRCIGFGNHHYYIFFLFFLSMVCGWIIYGSFIYLSSHCATTFKEDGLWTYLNQIVACSPWVLYILMLATFHFSWSTFLLLNQLFQIAFLGLTSHERISLQKQSKHMKQTLSLRKTPYNLGFMQNLADFFQCGCFGLVKPCVVDWTSQYTMVFHPAREKVLRSV

SEQ ID NO: 101954 - protein, 622 aa, Homo sapiens
  Payload ID: 20318
  Gene Name: zinc finger, DHHC-type containing 13
  Uniprot ID: Q8IUH4
  ENSP ID: ENSP00000400113
MEGPGLGSQCRNHSHGPHPPGFGRYGICAHENKELANAREALPLIEDSSNCDIVKATQYGIFERCKELVEAGYDVRQPDKENVSLLHWAAINNRLDLVKFYISKGAVVDQLGGDLNSTPLHWAIRQGHLPMVILLLQHGADPTLIDGEGFSSIHLAVLFQHMPIIAYLISKGQSVNMTDVNGQTPLMLSAHKVIGPEPTGFLLKFNPSLNVVDKIHQNTPLHWAVAAGNVNAVDKLLEAGSSLDIQNVKGETPLDMALQNKNQLIIHMLKTEAKMRANQKFRLWRWLQKCELFLLLMLSVITMWAIGYILDFNSDSWLLKGCLLVTLFFLTSLFPRFLVGYKNLVYLPTAFLLSSVFWIFMTWFILFFPDLAGAPFYFSFIFSIVAFLYFFYKTWATDPGFTKASEEEKKVNIITLAETGSLDFRTFCTSCLIRKPLRSLHCHVCNCCVARYDQHCLWTGRCIGFGNHHYYIFFLFFLSMVCGWIIYGSFIYLSSHCATTFKEDGLWTYLNQIVACSPWVLYILMLATFHFSWSTFLLLNQLFQIAFLGLTSHERISLQKQSKHMKQTLSLRKTPYNLGFMQNLADFFQCGCFGLVKPCVVDWTSQYTMVFHPAREKVLRSV

SEQ ID NO: 101955 - protein, 109 aa, Homo sapiens
  Payload ID: 20319
  Gene Name: zinc finger, DHHC-type containing 14
  ENSP ID: ENSP00000345721
  MOD_RES (1)..(1): Any amino acid
XGGYRPPPRTKEVIINGQTVKLKYCFTCKIFRPPRASHCSLCDNCVVFIFAFVITHVILRSQQTGFLNALKDSPASVLEAVVCFFSVWSIVGLSGFHTYLISSNQTTNE

SEQ ID NO: 101956 - protein, 488 aa, Homo sapiens
  Payload ID: 20319
  Gene Name: zinc finger, DHHC-type containing 14
  Uniprot ID: Q8IZN3
  ENSP ID: ENSP00000352821
MPPGGGGPMKDCEYSQISTHSSSPMESPHKKKKIAARRKWEVFPGRNKFFCNGRIMMARQTGVFYLTLVLILVTSGLFFAFDCPYLAVKITPAIPAVAGILFFFVMGTLLRTSFSDPGVLPRATPDEAADLERQIDIANGTSSGGYRPPPRTKEVIINGQTVKLKYCFTCKIFRPPRASHCSLCDNCVERFDHHCPWVGNCVGKRNYRFFYMFILSLSFLTVFIFAFVITHVILRSQQTGFLNALKDSPASVLEAVVCFFSVWSIVGLSGFHTYLISSNQTTNEDIKGSWSNKRGKENYNPYSYGNIFTNCCVALCGPISPSLIDRRGYIQPDTPQPAAPSNGITMYGATQSQSDMCDQDQCIQSTKFVLQAAATPLLQSEPSLTSDELHLPGKPGLGTPCASLTLGPPTPPASMPNLAEATLADVMPRKDEHMGHQFLTPDEAPSPPRLLAAGSPLAHSRTMHVLGLASQDSLHEDSVRGLVKLSSV

SEQ ID NO: 101957 - protein, 473 aa, Homo sapiens
  Payload ID: 20319
  Gene Name: zinc finger, DHHC-type containing 14
  Uniprot ID: Q8IZN3
  ENSP ID: ENSP00000410713
MPPGGGGPMKDCEYSQISTHSSSPMESPHKKKKIAARRKWEVFPGRNKFFCNGRIMMARQTGVFYLTLVLILVTSGLFFAFDCPYLAVKITPAIPAVAGILFFFVMGTLLRTSFSDPGVLPRATPDEAADLERQIDIANGTSSGGYRPPPRTKEVIINGQTVKLKYCFTCKIFRPPRASHCSLCDNCVERFDHHCPWVGNCVGKRNYRFFYMFILSLSFLTVFIFAFVITHVILRSQQTGFLNALKDSPASVLEAVVCFFSVWSIVGLSGFHTYLISSNQTTNEDIKGSWSNKRGKENYNPYSYGNIFTNCCVALCGPISPSLIDRRGYIQPDTPQPAAPSNGITMYGATQSQSDMAAATPLLQSEPSLTSDELHLPGKPGLGTPCASLTLGPPTPPASMPNLAEATLADVMPRKDEHMGHQFLTPDEAPSPPRLLAAGSPLAHSRTMHVLGLASQDSLHEDSVRGLVKLSSV

SEQ ID NO: 101958 - protein, 123 aa, Homo sapiens
  Payload ID: 20319
  Gene Name: zinc finger, DHHC-type containing 14
  ENSP ID: ENSP00000428211
  MOD_RES (1)..(1): Any amino acid
XCPYLAVKITPAIPAVAGILFFFVMGTLLRTSFSDPGVLPRATPDEAADLERQIDIANGTSSGGYRPPPRTKEVIINGQTVKLKYCFTCKIFRPPRASHCSLCDNCVERFDHHCPWVHSKQDS

SEQ ID NO: 101959 - protein, 337 aa, Homo sapiens
  Payload ID: 20320
  Gene Name: zinc finger, DHHC-type containing 15
  Uniprot ID: Q96MV8
  ENSP ID: ENSP00000362465
MRRGWKMALSGGLRCCRRVLSWVPVLVIVLVVLWSYYAYVFELCLVTVLSPAEKVIYLILYHAIFVFFTWTYWKSIFTLPQQPNQKFHLSYTDKERYENEERPEVQKQMLVDMAKKLPVYTRTGSGAVRFCDRCHLIKPDRCHHCSVCAMCVLKMDHHCPWVNNCIGFSNYKFFLQFLAYSVLYCLYIATTVFSYFIKYWRGELPSVRSKFHVLFLLFVACMFFVSLVILFGYHCWLVSRNKTTLEAFCTPVFTSGPEKNGFNLGFIKNIQQVFGDKKKFWLIPIGSSPGDGHSFPMRSMNESQNPLLANEETWEDNEDDNQDYPEGSSSLAVETET

SEQ ID NO: 101960 - protein, 328 aa, Homo sapiens
  Payload ID: 20320
  Gene Name: zinc finger, DHHC-type containing 15
  Uniprot ID: Q96MV8
  ENSP ID: ENSP00000445420
MRRGWKMALSGGLRCCRRVLSWVPVLVIVLVVLWSYYAYVFELCLVIYLILYHAIFVFFTWTYWKSIFTLPQQPNQKFHLSYTDKERYENEERPEVQKQMLVDMAKKLPVYTRTGSGAVRFCDRCHLIKPDRCHHCSVCAMCVLKMDHHCPWVNNCIGFSNYKFFLQFLAYSVLYCLYIATTVFSYFIKYWRGELPSVRSKFHVLFLLFVACMFFVSLVILFGYHCWLVSRNKTTLEAFCTPVFTSGPEKNGFNLGFIKNIQQVFGDKKKFWLIPIGSSPGDGHSFPMRSMNESQNPLLANEETWEDNEDDNQDYPEGSSSLAVETET

SEQ ID NO: 101961 - protein, 296 aa, Homo sapiens
  Payload ID: 20321
  Gene Name: zinc finger, DHHC-type containing 16
  Uniprot ID: Q969W1
  ENSP ID: ENSP00000304487
MRGQRSLLLGPARLCLRLLLLLGYRRRCPPLLRGLVQRWRYGKVCLRSLLYNSFGGSDTAVDAAFEPVYWLVDNVIRWFGVGRNDIATVSICKKCIYPKPARTHHCSICNRCVLKMDHHCPWLNNCVGHYNHRYFFSFCFFMTLGCVYCSYGSWDLFREAYAAIETYHQTPPPTFSFRERMTHKSLVYLWFLCSSVALALGALTVWHAVLISRGETSIERHINKKERRRLQAKGRVFRNPYNYGCLDNWKVFLGVDTGRHWLTRVLLPSSHLPHGNGMSWEPPPWVTAHSASVMAV

SEQ ID NO: 101962 - protein, 338 aa, Homo sapiens
  Payload ID: 20321
  Gene Name: zinc finger, DHHC-type containing 16
  Uniprot ID: Q969W1
  ENSP ID: ENSP00000323360
MRGQRSLLLGPARLCLRLLLLLGYRRRCPPLLRGLVQRWRYGKVCLRSLLYNSFGGSDTAVDAAFEPVYWLVDNVIRWFGVVFVVLVIVLTGSIVAIAYLCVLPLILRTYSVPRLCWHFFYSHWNLILIVFHYYQAITTPPGYPPQGRNDIATVSICKKCIYPKPARTHHCSICNSYGSWDLFREAYAAIEKMKQLDKNKLQAVANQTYHQTPPPTFSFRERMTHKSLVYLWFLCSSVALALGALTVWHAVLISRGETSIERHINKKERRRLQAKGRVFRNPYNYGCLDNWKVFLGVDTGRHWLTRVLLPSSHLPHGNGMSWEPPPWVTAHSASVMAV

SEQ ID NO: 101963 - protein, 361 aa, Homo sapiens
  Payload ID: 20321
  Gene Name: zinc finger, DHHC-type containing 16
  Uniprot ID: Q969W1
  ENSP ID: ENSP00000345383
MRGQRSLLLGPARLCLRLLLLLGYRRRCPPLLRGLVQRWRYGKVCLRSLLYNSFGGSDTAVDAAFEPVYWLVDNVIRWFGVVFVVLVIVLTGSIVAIAYLCVLPLILRTYSVPRLCWHFFYSHWNLILIVFHYYQAITTPPGYPPQGRNDIATVSICKKCIYPKPARTHHCSICNRCVLKMDHHCPWLNNCVGHYNHRYFFSFCFFMTLGCVYCSYGSWDLFREAYAAIETYHQTPPPTFSFRERMTHKSLVYLWFLCSSVALALGALTVWHAVLISRGETSIERHINKKERRRLQAKGRVFRNPYNYGCLDNWKVFLGVDTGRHWLTRVLLPSSHLPHGNGMSWEPPPWVTAHSASVMAV

SEQ ID NO: 101964 - protein, 361 aa, Homo sapiens; identical to SEQ ID NO: 101963
  Payload ID: 20321
  Gene Name: zinc finger, DHHC-type containing 16
  Uniprot ID: Q969W1
  ENSP ID: ENSP00000359879

SEQ ID NO: 101965 - protein, 307 aa, Homo sapiens
  Payload ID: 20321
  Gene Name: zinc finger, DHHC-type containing 16
  ENSP ID: ENSP00000359883
MRGQRSLLLGPARLCLRLLLLLGYRRRCPPLLRGLVQRWRYGKVCLRSLLYNSFGGSDTAVDAAFEPVYWLVDNVIRWFGVVFVVLVIVLTGSIVAIAYLCVLPLILRTYSVPRLCWHFFYSHWNLILIVFHYYQAITTPPGYPPQGRNDIATVSICKKCIYPKPARTHHCSICNRCVLKMDHHCHILPPALSKLPTSLRPSFLSSVALALGALTVWHAVLISRGETSIERHINKKERRRLQAKGRVFRNPYNYGCLDNWKVFLGVDTGRHWLTRVLLPSSHLPHGNGMSWEPPPWVTAHSASVMAV

SEQ ID NO: 101966 - protein, 377 aa, Homo sapiens
  Payload ID: 20321
  Gene Name: zinc finger, DHHC-type containing 16
  Uniprot ID: Q969W1
  ENSP ID: ENSP00000359891
MRGQRSLLLGPARLCLRLLLLLGYRRRCPPLLRGLVQRWRYGKVCLRSLLYNSFGGSDTAVDAAFEPVYWLVDNVIRWFGVVFVVLVIVLTGSIVAIAYLCVLPLILRTYSVPRLCWHFFYSHWNLILIVFHYYQAITTPPGYPPQGRNDIATVSICKKCIYPKPARTHHCSICNRCVLKMDHHCPWLNNCVGHYNHRYFFSFCFFMTLGCVYCSYGSWDLFREAYAAIEKMKQLDKNKLQAVANQTYHQTPPPTFSFRERMTHKSLVYLWFLCSSVALALGALTVWHAVLISRGETSIERHINKKERRRLQAKGRVFRNPYNYGCLDNWKVFLGVDTGRHWLTRVLLPSSHLPHGNGMSWEPPPWVTAHSASVMAV

SEQ ID NO: 101967 - protein, 377 aa, Homo sapiens; identical to SEQ ID NO: 101966
  Payload ID: 20321
  Gene Name: zinc finger, DHHC-type containing 16
  Uniprot ID: Q969W1
  ENSP ID: ENSP00000377357

SEQ ID NO: 101968 - protein, 301 aa, Homo sapiens
  Payload ID: 20321
  Gene Name: zinc finger, DHHC-type containing 16
  ENSP ID: ENSP00000396286
  MOD_RES (1)..(1): Any amino acid
XAVDAAFEPVYWLVDNVIRWFGVVFVVLVIVLTGSIVAIAYLCVLPLILRTYSVPRLCWHFFYSHWNLILIVFHYYQAITTPPGYPPQGRNDIATVSICKKCIYPKPARTHHCSICNRCVLKMDHHCPWLNNCVGHYNHRYFFSFCFFMTLGCVYCSYGSWDLFREAYAAIEKMKQLDKNKLQAVANQTYHQTPPPTFSFRERMTHKSLVYLWFLCSRGETSIERHINKKERRRLQAKGRVFRNPYNYGCLDNWKVFLGVDTGRHWLTRVLLPSSHLPHGNGMSWEPPPWVTAHSASVMAV

SEQ ID NO: 101969 - protein, 242 aa, Homo sapiens
  Payload ID: 20321
  Gene Name: zinc finger, DHHC-type containing 16
  ENSP ID: ENSP00000398532
MRGQRSLLLGPARLCLRLLLLLGYRRRCPPLLRGLVQRWRYGKVCLRSLLYNSFGGSDTAVDAAFEPVYWLVDNVIRWFGVGRNDIATVSICKKCIYPKPARTHHCSICNRCVLKMDHHCPWLNNCVGHYNHRYFFSFCFFMTLGCVYCSYGSWDLFREAYAAIEKMKQLDKNKLQAVANQTYHQTPPPTFSFRERMTHKSLVYLWFLCSSVALALGALTVWHAVLISRGETSIERHINKKE

SEQ ID NO: 101970 - protein, 213 aa, Homo sapiens
  Payload ID: 20321
  Gene Name: zinc finger, DHHC-type containing 16
  ENSP ID: ENSP00000400719
MRGQRSLLLGPARLCLRLLLLLGYRRRCPPLLRGLVQRWRYGKVCLRSLLYNSFGGSDTAVDAAFEPVYWLVDNVIRWFGVVFVVLVIVLTGSIVAIAYLCVLPLILRTYSVPRLCWHFFYSHWNLILIVFHYYQAITTPPGYPPQGRNDIATVSICKKCIYPKPARTHHCSICNRCVLKMDHHCPWLNNCVGHYNHRYFFSFCFFMTLGCVY

SEQ ID NO: 101971 - protein, 319 aa, Homo sapiens
  Payload ID: 20321
  Gene Name: zinc finger, DHHC-type containing 16
  ENSP ID: ENSP00000405240
  MOD_RES (1)..(1): Any amino acid
XRRCPPLLRGLVQRWRYGKVCLRSLLYNSFGGSDTAVDAAFEPVYWLVDNVIRWFGVVFVVLVIVLTGSIVAIAYLCVLPLILRTYSVPRLCWHFFYSHWNLILIVFHYYQAITTPPGYPPQGRNDIATVSICKKCIYPKPARTHHCSICNRCVLKMDHHCPWLNNCVGHYNHRYFFSFCFFMTLGCVYCSYGSWDLFREAYAAIETYHQTPPPTFSFRERMTHKSLVYLWFLCSRGETSIERHINKKERRRLQAKGRVFRNPYNYGCLDNWKVFLGVDTGRHWLTRVLLPSSHLPHGNGMSWEPPPWVTAHSASVMAV

SEQ ID NO: 101972 - protein, 632 aa, Homo sapiens
  Payload ID: 20322
  Gene Name: zinc finger, DHHC-type containing 17
  Uniprot ID: Q8IUH5
  ENSP ID: ENSP00000403397
MQREEGFNTKMADGPDEYDTEAGCVPLLHPEEIKPQSHYNHGYGEPLGRKTHIDDYSTWDIVKATQYGIYERCRELVEAGYDVRQPDKENVTLLHWAAINNRIDLVKYYISKGAIVDQLGGDLNSTPLHWATRQGHLSMVVQLMKYGADPSLIDGEGCSCIHLAAQFGHTSIVAYLIAKGQDVDMMDQNGMTPLMWAAYRTHSVDPTRLLLTFNVSVNLGDKYHKNTALHWAVLAGNTTVISLLLEAGANVDAQNIKGESALDLAKQRKNVWMINHLQEARQAKGYDNPSFLRKLKADKEFRQKVMLGTPFLVIWLVGFIADLNIDSWLIKGLMYGGVWATVQFLSKSFFDHSMHSALPLGIYLATKFWMYVTWFFWFWNDLNFLFIHLPFLANSVALFYNFGKSWKSDPGIIKATEEQKKKTIVELAETGSLDLSIFCSTCLIRKPVRSKHCGVCNRCIAKFDHHCPWVGNCVGAGNHRYFMGYLFFLLFMICWMIYGCISYWGLHCETTYTKDGFWTYITQIATCSPWMFWMFLNSVFHFMWVAVLLMCQMYQISCLGITTNERMNARRYKHFKVTTTSIESPFNHGCVRNIIDFFEFRCCGLFRPVIVDWTRQYTIEYDQISGSGYQLV

SEQ ID NO: 101973 - protein, 44 aa, Homo sapiens
  Payload ID: 20322
  Gene Name: zinc finger, DHHC-type containing 17
  ENSP ID: ENSP00000446954
  MOD_RES (1)..(1): Any amino acid
XFNTKMADGPDEYDTEAGCVPLLHPENGLARCGPLHLGLLSLQN

SEQ ID NO: 101974 - protein, 35 aa, Homo sapiens
  Payload ID: 20322
  Gene Name: zinc finger, DHHC-type containing 17
  ENSP ID: ENSP00000447871
MQREEGFNTKMADGPDEYDTEAGCVPLLHPEIWNI

SEQ ID NO: 101975 - protein, 35 aa, Homo sapiens
  Payload ID: 20322
  Gene Name: zinc finger, DHHC-type containing 17
  ENSP ID: ENSP00000447934
NTKMADGPDEYDTEAGCVPLLHPEFEMELRSCCPG

SEQ ID NO: 101976 - protein, 155 aa, Homo sapiens
  Payload ID: 20322
  Gene Name: zinc finger, DHHC-type containing 17
  ENSP ID: ENSP00000448757
  MOD_RES (1)..(1): Any amino acid
XIVKATQYGIYERCRELVEAGYDVRQPDKENVTLLHWAAINNRIDLVKYYISKGAIVDQLGGDLNSTPLHWATRQGHLSMVVQLMKYGADPSLIDGEGCSCIHLAAQFGHTSIVAYLIAKGQDYFKKCTCILEMLSEVAEDIPDNTIKVNPEMDL

SEQ ID NO: 101977 - protein, 201 aa, Homo sapiens
  Payload ID: 20322
  Gene Name: zinc finger, DHHC-type containing 17
  ENSP ID: ENSP00000449551
  MOD_RES (1)..(1): Any amino acid
XEEGFNTKMADGPDEYDTEAGCVPLLHPEEIKPQSHYNHGYGEPLGRKTHIDDYSTWDIVKATQYGIYERCRELVEAGYDVRQPDKENVTLLHWAAINNRIDLVKYYISKGAIVDQLGGDLNSTPLHWATRQGHLSMVVQLMKYGADPSLIDGEGCSCIHLAAQFGHTSIVAYLIAKGQDVDMMDQNGMTPLMWAAYRTHS

SEQ ID NO: 101978 - protein, 28 aa, Homo sapiens
  Payload ID: 20322
  Gene Name: zinc finger, DHHC-type containing 17
  ENSP ID: ENSP00000449728
NTKMADGPDEYDTEAGCVPLLHPEIWNI

SEQ ID NO: 101979 - protein, 161 aa, Homo sapiens
  Payload ID: 20322
  Gene Name: zinc finger, DHHC-type containing 17
  ENSP ID: ENSP00000449734
MALPDVGPFTLDYSAFRTDVDMMDQNGMTPLMWAAYRTHSVDPTRLLLTFNVSVNLGDKYHKNTALHWAVLAGNTTVISLLLEAGANVDAQNIKGESALDLAKQRKNVWMINHLQEARQAKGYDNPSFLRKLKADKEFRQKVMLGTPFLVIWLVGFIADLN

SEQ ID NO: 101980 - protein, 48 aa, Homo sapiens
  Payload ID: 20322
  Gene Name: zinc finger, DHHC-type containing 17
  ENSP ID: ENSP00000449836
  MOD_RES (1)..(1): Any amino acid
XSGLCAPSPPRDMEYMNAVENWWKQVMMYGNRTKKMLPSSIGLPSITE

SEQ ID NO: 101981 - protein, 126 aa, Homo sapiens
  Payload ID: 20322
  Gene Name: zinc finger, DHHC-type containing 17
  ENSP ID: ENSP00000450295
MGIVMSFQEIKPQSHYNHGYGEPLGRKTHIDDYSTWDIVKATQYGIYERCRELVEAGYDVRQPDKENVTLLHWAAINNRIDLVKYYISKGAIVDQLGGDLNSTPLHWATRQGHLSMVVQLMKYGAD

SEQ ID NO: 101982 - protein, 253 aa, Homo sapiens
  Payload ID: 20323
  Gene Name: zinc finger, DHHC-type containing 18
  Uniprot ID: Q9NUE0
  ENSP ID: ENSP00000363256
MSCLLQTSFTDPGILPRATVCEAAALEKQIDNTGSSTYRPPPRTREVLINGQMVKLKYCFTCKMFRPPRTSHCSVCDNCVERFDHHCPWVGNCVGRRNYRFFYAFILSLSFLTAFIFACVVTHLTLRAQGSNFLSTLKETPASVLELVICFFSIWSILGLSGFHTYLVASNLTTNEDIKGSWSSKRGGEASVNPYSHKSIITNCCAVLCGPLPPSLIDRRGFVQSDTVLPSPIRSDEPACRAKPDASMVGGHP

SEQ ID NO: 101983 - protein, 388 aa, Homo sapiens
  Payload ID: 20323
  Gene Name: zinc finger, DHHC-type containing 18
  Uniprot ID: Q9NUE0
  ENSP ID: ENSP00000363257
MKDCEYQQISPGAAPLPASPGARRPGPAASPTPGPGPAPPAAPAPPRWSSSGSGSGSGSGSLGRRPRRKWEVFPGRNRFYCGGRLMLAGHGGVFALTLLLILTTTGLFFVFDCPYLARKLTLAIPIIAAILFFFVMSCLLQTSFTDPGILPRATVCEAAALEKQIDNTGSSTYRPPPRTREVLINGQMVKLKYCFTCKMFRPPRTSHCSVCDNCVERFDHHCPWVGNCVGRRNYRFFYAFILSLSFLTAFIFACVVTHLTLRAQGSNFLSTLKETPASVLELVICFFSIWSILGLSGFHTYLVASNLTTNEDIKGSWSSKRGGEASVNPYSHKSIITNCCAVLCGPLPPSLIDRRGFVQSDTVLPSPIRSDEPACRAKPDASMVGGHP

SEQ ID NO: 101984 - protein, 158 aa, Homo sapiens
  Payload ID: 20323
  Gene Name: zinc finger, DHHC-type containing 18
  ENSP ID: ENSP00000435510
MSCLLQTSFTDPGILPRATVCEAAALEKQIDNTGSSTYRPPPRTREVLINGQMVKLKYCFTCKMFRPPRTSHCSVCDNCVERFDHHCPWVGNCVGRRNYRFFYAFILSLSFLTAFIFACVVTHLTLRAQGSNFLSTLKETPASVLELVICFFSIWSIL

SEQ ID NO: 101985 - protein, 161 aa, Homo sapiens
  Payload ID: 20323
  Gene Name: zinc finger, DHHC-type containing 18
  ENSP ID: ENSP00000436203
  MOD_RES (1)..(1): Any amino acid
XFYAFILSLSFLTAFIFACVVTHLTLRAQGSNFLSTLKETPASVLELVICFFSIWSILGLSGFHTYLVASNLTTNEDIKGSWSSKRGGEASVNPYSHKSIITNCCAVLCGPLPPSLIDRRGFVQSDTVLPSPIRSDEPACRAKPDASMEDTCQDFAISCTA

SEQ ID NO: 101986 - protein, 309 aa, Homo sapiens
  Payload ID: 20324
  Gene Name: zinc finger, DHHC-type containing 19
  Uniprot ID: Q8WVZ1
  ENSP ID: ENSP00000296326
MTLLTDATPLVKEPHPLPLVPRPWFLPSLFAAFNVVLLVFFSGLFFAFPCRWLAQNGEWAFPVITGSLFVLTFFSLVSLNFSDPGILHQGSAEQGPLTVHVVWVNHGAFRLQWCPKCCFHRPPRTYHCPWCNICVEDFDHHCKWVNNCIGHRNFRFFMLLVLSLCLYSGAMLVTCLIFLVRTTHLPFSTDKAIAIVVAVSAAGLLVPLSLLLLIQALSVSSADRTYKGKCRHLQGYNPFDQGCASNWYLTICAPLGPKYMAEAVQLQRVVGPDWTSMPNLHPPMSPSALNPPAPTSGSLQSREGTPGAW

SEQ ID NO: 101987 - protein, 282 aa, Homo sapiens
  Payload ID: 20324
  Gene Name: zinc finger, DHHC-type containing 19
  ENSP ID: ENSP00000380678
MTLLTDATPLVKEPHPLPLVPRPWFLPSLFAAFNVVLLVFFSGLFFAFPCRWLAQNGEWAFPVITGSLFVLTFFSLVSLNFSDPGILHQGSAEQGPLTVHVVWVNHGAFRLQWCPKCCFHRPPRTYHCPWCNICVEDFDHHCKWVNNCIGHRNFRFFMLLVLSLCLYSGAMLVTCLIFLVRTTHLPFSTDKAIAIVVAVSAAGLLVPLSLLLLIQALSVSSADRTYKGKCRHLQGYNPFDQGCASNWYLTICAPLGPKAAASWMRLASASCRAKPWAVCFPS

SEQ ID NO: 101988 - protein, 229 aa, Homo sapiens
  Payload ID: 20324
  Gene Name: zinc finger, DHHC-type containing 19
  Uniprot ID: Q8WVZ1
  ENSP ID: ENSP00000393710
MTLLTDATPLVKEPHPLPLVPRPWFLPSLFAAFNVVLLVFFSGLFFAFPCRWLAQNGEWAFPVITGSLFVLTFFSLVSLNFSDPGILHQGSAEQGPLTVHVVWVNHGAFRLQWCPKCCFHRPPRTYHCPWCNICVEDFDHHCKWVNNCIGHRNFRFFMLLVLSLCLYSGAMLVTCLIFLVRTTHLPFSTDKAIAIVVAVSAAGLLVPLSLLLLIQALSVSSADRTYKGK

SEQ ID NO: 101989 - protein, 367 aa, Homo sapiens
  Payload ID: 20325
  Gene Name: zinc finger, DHHC-type containing 2
  Uniprot ID: Q9UIJ5
  ENSP ID: ENSP00000262096
MAPSGPGSSARRRCRRVLYWIPVVFITLLLGWSYYAYAIQLCIVSMENTGEQVVCLMAYHLLFAMFVWSYWKTIFTLPMNPSKEFHLSYAEKDLLEREPRGEAHQEVLRRAAKDLPIYTRTMSGAIRYCDRCQLIKPDRCHHCSVCDKCILKMDHHCPWVNNCVGFSNYKFFLLFLAYSLLYCLFIAATDLQYFIKFWTNGLPDTQAKFHIMFLFFAAAMFSVSLSSLFGYHCWLVSKNKSTLEAFRSPVFRHGTDKNGFSLGFSKNMRQVFGDEKKYWLLPIFSSLGDGCSFPTCLVNQDPEQASTPAGLNSTAKNLENHQFPAKPLRESQSHLLTDSQSWTESSINPGKCKAGMSNPALTMENET

SEQ ID NO: 101990 - protein, 130 aa, Homo sapiens
  Payload ID: 20325
  Gene Name: zinc finger, DHHC-type containing 2
  ENSP ID: ENSP00000430317
MENTGEQVVCLMAYHLLFAMFVWSYWKTIFTLPMNPSKEFHLSYAEKDLLEREPRGEAHQEVLRRAAKDLPIYTRTMSGAIRYCDRCQLIKPDRCHHCSVCDKCILKMDHHCPWVNNCVGFSNYKFFLLF

SEQ ID NO: 101991 - protein, 7 aa, Homo sapiens
  Payload ID: 20325
  Gene Name: zinc finger, DHHC-type containing 2
  ENSP ID: ENSP00000430804
MENTGEQ

SEQ ID NO: 101992 - protein, 320 aa, Homo sapiens
  Payload ID: 20326
  Gene Name: zinc finger, DHHC-type containing 20
  Uniprot ID: Q5W0Z9
  ENSP ID: ENSP00000313583
MAPWTLWRCCQRVVGWVPVLFITFVVVWSYYAYVVELCVFTIFGNEENGKTVVYLVAFHLFFVMFVWSYWMTIFTSPASPSKEFYLSNSEKERYEKEFSQERQQEILRRAARALPIYTTSASKTIRYCEKCQLIKPDRAHHCSACDSCILKMDHHCPWVNNCVGFSNYKFFLLFLLYSLLYCLFVAATVLEYFIKFWTNELTDTRAKFHVLFLFFVSAMFFISVLSLFSYHCWLVGKNRTTIESFRAPTFSYGPDGNGFSLGCSKNWRQVFGDEKKYWLLPIFSSLGDGCSFPTRLVGMDPEQASVTNQNEYARRSKLQR

SEQ ID NO: 101993 - protein, 354 aa, Homo sapiens
  Payload ID: 20326
  Gene Name: zinc finger, DHHC-type containing 20
  Uniprot ID: Q5W0Z9
  ENSP ID: ENSP00000371905
MAPWTLWRCCQRVVGWVPVLFITFVVVWSYYAYVVELCVFTIFGNEENGKTVVYLVAFHLFFVMFVWSYWMTIFTSPASPSKEFYLSNSEKERYEKEFSQERQQEILRRAARALPIYTTSASKTIRYCEKCQLIKPDRAHHCSACDSCILKMDHHCPWVNNCVGFSNYKFFLLFLLYSLLYCLFVAATVLEYFIKFWTNELTDTRAKFHVLFLFFVSAMFFISVLSLFSYHCWLVGKNRTTIESFRAPTFSYGPDGNGFSLGCSKNWRQVFGDEKKYWLLPIFSSLGDGCSFPTRLVGMDPEQASVTNQNEYARSGSNQPFPIKPLSESKNRLLDSESQWLENGAEEGIVKSGV

SEQ ID NO: 101994 - protein, 365 aa, Homo sapiens
  Payload ID: 20326
  Gene Name: zinc finger, DHHC-type containing 20
  Uniprot ID: Q5W0Z9
  ENSP ID: ENSP00000383433
MAPWTLWRCCQRVVGWVPVLFITFVVVWSYYAYVVELCVFTIFGNEENGKTVVYLVAFHLFFVMFVWSYWMTIFTSPASPSKEFYLSNSEKERYEKEFSQERQQEILRRAARALPIYTTSASKTIRYCEKCQLIKPDRAHHCSACDSCILKMDHHCPWVNNCVGFSNYKFFLLFLLYSLLYCLFVAATVLEYFIKFWTNELTDTRAKFHVLFLFFVSAMFFISVLSLFSYHCWLVGKNRTTIESFRAPTFSYGPDGNGFSLGCSKNWRQVFGDEKKYWLLPIFSSLGDGCSFPTRLVGMDPEQASVTNQNEYARSSGSNQPFPIKPLSESKNRLLDSESQWLENGAEEGIVKSGTNNHVTVAIEN

SEQ ID NO: 101995 - protein, 365 aa, Homo sapiens; identical to SEQ ID NO: 101994
  Payload ID: 20326
  Gene Name: zinc finger, DHHC-type containing 20
  Uniprot ID: Q5W0Z9
  ENSP ID: ENSP00000401232

SEQ ID NO: 101996 - protein, 292 aa, Homo sapiens
  Payload ID: 20326
  Gene Name: zinc finger, DHHC-type containing 20
  ENSP ID: ENSP00000443236
MFVWSYWMTIFTSPASPSKEFYLSNSEKERYEKEFSQERQQEILRRAARALPIYTTSASKTIRYCEKCQLIKPDRAHHCSACDSCILKMDHHCPWVNNCVGFSNYKFFLLFLLYSLLYCLFVAATVLEYFIKFWTNELTDTRAKFHVLFLFFVSAMFFISVLSLFSYHCWLVGKNRTTIESFRAPTFSYGPDGNGFSLGCSKNWRQVFGDEKKYWLLPIFSSLGDGCSFPTRLVGMDPEQASVTNQNEYARSSGSNQPFPIKPLSESKNRLLDSESQWLENGAEEGIVKSGV

SEQ ID NO: 101997 - protein, 19 aa, Homo sapiens
  Payload ID: 20326
  Gene Name: zinc finger, DHHC-type containing 20
  ENSP ID: ENSP00000485858
EEGIVKSGTNNHVTVAIEN

SEQ ID NO: 101998 - protein, 265 aa, Homo sapiens
  Payload ID: 20327
  Gene Name: zinc finger, DHHC-type containing 21
  Uniprot ID: Q8IVQ6
  ENSP ID: ENSP00000370303
MGLRIHFVVDPHGWCCMGLIVFVWLYNIVLIPKIVLFPHYEEGHIPGILIIIFYGISIFCLVALVRASITDPGRLPENPKIPHGEREFWELCNKCNLMRPKRSHHCSRCGHCVRRMDHHCPWINNCVGEDNHWLFLQLCFYTELLTCYALMFSFCHYYYFLPLKKRNLDLFVFRHELAIMRLAAFMGITMLVGITGLFYTQLIGIITDTTSIEKMSNCCEDISRPRKPWQQTFSEVFGTRWKILWFIPFRQRQPLRVPYHFANHV

SEQ ID NO: 101999 - protein, 263 aa, Homo sapiens
  Payload ID: 20328
  Gene Name: zinc finger, DHHC-type containing 22
  Uniprot ID: Q8N966
  ENSP ID: ENSP00000318222
MLALRLLNVVAPAYFLCISLVTFVLQLFLFLPSMREDPAAARLFSPALLHGALFLFLSANALGNYVLVIQNSPDDLGACQGASARKTPCPSPSTHFCRVCARVTLRHDHHCFFTGNCIGSRNMRNFVLFCLYTSLACLYSMVAGVAYISAVLSISFAHPLAFLTLLPTSISQFFSGAVLGSEMFVILMLYLWFAIGLACAGFCCHQLLLILRGQTRHQVRKGVAVRARPWRKNLQEVFGKRWLLGLLVPMFNVGSESSKQQDK

SEQ ID NO: 102000 - protein, 40 aa, Homo sapiens
  Payload ID: 20328
  Gene Name: zinc finger, DHHC-type containing 22
  ENSP ID: ENSP00000450478
MLALRLLNVVAPAYFLCISLVTFVLQLFLFLPSMREDPAA

SEQ ID NO: 102001 - protein, 109 aa, Homo sapiens
  Payload ID: 20328
  Gene Name: zinc finger, DHHC-type containing 22
  ENSP ID: ENSP00000451337
MLALRLLNVVAPAYFLCISLVTFVLQLFLFLPSMREDPAAARLFSPALLHGALFLFLSANALGNYVLVIQNSPDDLGACQGASARKTPCPSPSTHFCRVCARVTLRHDH

SEQ ID NO: 102002 - protein, 409 aa, Homo sapiens
  Payload ID: 20329
  Gene Name: zinc finger, DHHC-type containing 23
  Uniprot ID: Q8IYP9
  ENSP ID: ENSP00000330485
MTQKGSMKPVKKKKTEEPELEPLCCCEYIDRNGEKNHVATCLCDCQDLDEGCDRWITCKSLQPETCERIMDTISDRLRIPWLRGAKKVNISIIPPLVLLPVFLHVASWHFLLGVVVLTSLPVLALWYYYLTHRRKEQTLFFLSLGLFSLGYMYYVFLQEVVPKGRVGPVQLAVLTCGLFLILLALHRAKKNPGYLSNPASGDRSLSSSQLECLSRKGQEKTKGFPGADMSGSLNNRTTKDDPKGSSKMPAGSPTKAKEDWCAKCQLVRPARAWHCRICGICVRRMDHHCVWINSCVGESNHQAFILALLIFLLTSVYGITLTLDTICRDRSVFTALFYCPGVYANYSSALSFTCVWYSVIITAGMAYIFLIQLINISYNVTEREVQQALRQKTGRRLLCGLIVDTGLLG

SEQ ID NO: 102003 - protein, 75 aa, Homo sapiens
  Payload ID: 20329
  Gene Name: zinc finger, DHHC-type containing 23
  ENSP ID: ENSP00000417579
YNVTEREVQQALRQKTGRRLLCGLIVDTDLSYSRTKYLIADIARGTFQVPGSLEEFQLPSYEVAVAFLLLLFPLS

SEQ ID NO: 102004 - protein, 403 aa, Homo sapiens
  Payload ID: 20329
  Gene Name: zinc finger, DHHC-type containing 23
  ENSP ID: ENSP00000417840
MKPVKKKKTEEPELEPLCCCEYIDRNGEKNHVATCLCDCQDLDEGCDRWITCKSLQPETCERIMDTISDRLRIPWLRGAKKVNISIIPPLVLLPVFLHVASWHFLLGVVVLTSLPVLALWYYYLTHRRKEQTLFFLSLGLFSLGYMYYVFLQEVVPKGRVGPVQLAVLTCGLFLILLALHRAKKNPGYLSNPASGDRSLSSSQLECLSRKGQEKTKGFPGADMSGSLNNRTTKDDPKGSSKMPAGSPTKAKEDWCAKCQLVRPARAWHCRICGICVRRMDHHCVWINSCVGESNHQAFILALLIFLLTSVYGITLTLDTICRDRSVFTALFYCPGVYANYSSALSFTCVWYSVIITAGMAYIFLIQLINISYNVTEREVQQALRQKTGRRLLCGLIVDTGLLG

SEQ ID NO: 102005 - protein, 412 aa, Homo sapiens
  Payload ID: 20329
  Gene Name: zinc finger, DHHC-type containing 23
  ENSP ID: ENSP00000420251
MTQKGSMKPVKKKKTEEPELEPLCCCEYIDRNGEKNHVATCLCDCQDLDEGCDRWITCKSLQPETCERIMDTISDRLRIPWLRGAKKVNISIIPPLVLLPVFLHVASWHFLLGVVVLTSLPVLALWYYYLTHRRKEQTLFFLSLGLFSLGYMYYVFLQEVVPKGRVGPVQLAVLTCGLFLILLALHRAKKNPGYLSNPASGDRSLSSSQLECLSRKGQEKTKGFPGADMSGSLNNRTTKDDPKGSSKMPAGSPTKAKEDWCAKCQLVRPARAWHCRICGICVRRMDHHCVWINSCVGESNHQAFILALLIFLLTSVYGITLTLDTICRDRSVFTALFYCPGVYANYSSALSFTCVWYSVIITAGMAYIFLIQLINISYNVTEREVQQALRQKTGRRLLCGLIVDTGKVLAHL

SEQ ID NO: 102006 - protein, 148 aa, Homo sapiens
  Payload ID: 20329
  Gene Name: zinc finger, DHHC-type containing 23
  ENSP ID: ENSP00000420292
MTQKGSMKPVKKKKTEEPELEPLCCCEYIDRNGEKNHVATCLCDCQDLDEGCDRWITCKSLQPETCERIMDTISDRLRIPWLRGAKKVNISIIPPLVLLPVFLHVASWHFLLGVVVLTSLPVLALWYYYLTHRRKEQTLFFLSLGLFS

SEQ ID NO: 102007 - protein, 284 aa, Homo sapiens
  Payload ID: 20330
  Gene Name: zinc finger, DHHC-type containing 24
  Uniprot ID: Q6UX98
  ENSP ID: ENSP00000309429
MGQPWAAGSTDGAPAQLPLVLTALWAAAVGLELAYVLVLGPGPPPLGPLARALQLALAAFQLLNLLGNVGLFLRSDPSIRGVMLAGRGLGQGWAYCYQCQSQVPPRSGHCSACRVCILRRDHHCRLLGRCVGFGNYRPFLCLLLHAAGVLLHVSVLLGPALSALLRAHTPLHMAALLLLPWLMLLTGRVSLAQFALAFVTDTCVAGALLCGAGLLFHGMLLLRGQTTWEWARGQHSYDLGPCHNLQAALGPRWALVWLWPFLASPLPGDGITFQTTADVGHTAS

SEQ ID NO: 102008 - protein, 261 aa, Homo sapiens
  Payload ID: 20330
  Gene Name: zinc finger, DHHC-type containing 24
  ENSP ID: ENSP00000431321
MGQPWAAGSTDGAPAQLPLVLTALWAAAVGLELAYVLVLGPGPPPLGPLARALQLALAAFQLLNLLGNVGLFLRSDPSIRGVMLAGRGLGQGWAYCYQCQSQVPPRSGHCSACRVCILRRDHHCRLLGRCVGFGNYRPFLCLLLHAAGVLLHVSVLLGPALSALLRAHTPLHMAALLLLPWLMLLTDNPCPATALTTTKRSPWCPRSILCMCLQQLSEHPRLPPAHLHREVPSTPQAQCCGNQPHAPSSLRNSDLQATCTS

SEQ ID NO: 102009 - protein, 202 aa, Homo sapiens
  Payload ID: 20330
  Gene Name: zinc finger, DHHC-type containing 24
  ENSP ID: ENSP00000436503
MGQPWAAGSTDGAPAQLPLVLTALWAAAVGLELAYVLVLGPGPPPLGPLARALQLALAAFQLLNLLGNVGLFLRSDPSIRGVMLAGRGLGQGWAYCYQCQSQVPPRSGHCSACRVCILRRDHHCRLLGRCVGFGNYRPFLCLLLHAAGVLLHVSVLLGPALSALLRAHTPLHMAALLLLPWLMLLTAPSSLRNSDLQATCTS

SEQ ID NO: 102010 - protein, 327 aa, Homo sapiens; identical to SEQ ID NO: 61091
  Payload ID: 20331
  Gene Name: zinc finger, DHHC-type containing 3
  Uniprot ID: Q9NYG2
  ENSP ID: ENSP00000296127

SEQ ID NO: 102011 - protein, 333 aa, Homo sapiens; identical to SEQ ID NO: 61094
  Payload ID: 20331
  Gene Name: zinc finger, DHHC-type containing 3
  ENSP ID: ENSP00000345268

SEQ ID NO: 102012 - protein, 299 aa, Homo sapiens; identical to SEQ ID NO: 61097
  Payload ID: 20331
  Gene Name: zinc finger, DHHC-type containing 3
  Uniprot ID: Q9NYG2
  ENSP ID: ENSP00000395502

SEQ ID NO: 102013 - protein, 60 aa, Homo sapiens; identical to SEQ ID NO: 61092
  Payload ID: 20331
  Gene Name: zinc finger, DHHC-type containing 3
  ENSP ID: ENSP00000402545
  MOD_RES (1)..(1): Any amino acid

SEQ ID NO: 102014 - protein, 195 aa, Homo sapiens; identical to SEQ ID NO: 61096
  Payload ID: 20331
  Gene Name: zinc finger, DHHC-type containing 3
  ENSP ID: ENSP00000404108

SEQ ID NO: 102015 - protein, 44 aa, Homo sapiens; identical to SEQ ID NO: 61098
  Payload ID: 20331
  Gene Name: zinc finger, DHHC-type containing 3
  ENSP ID: ENSP00000408294

SEQ ID NO: 102016 - protein, 111 aa, Homo sapiens; identical to SEQ ID NO: 61095
  Payload ID: 20331
  Gene Name: zinc finger, DHHC-type containing 3
  ENSP ID: ENSP00000409755
  MOD_RES (1)..(1): Any amino acid

SEQ ID NO: 102017 - protein, 95 aa, Homo sapiens; identical to SEQ ID NO: 61093
  Payload ID: 20331
  Gene Name: zinc finger, DHHC-type containing 3
  ENSP ID: ENSP00000416132

SEQ ID NO: 102018 - protein, 344 aa, Homo sapiens
  Payload ID: 20332
  Gene Name: zinc finger, DHHC-type containing 4
  Uniprot ID: Q9NPG8
  ENSP ID: ENSP00000337475
MDFLVLFLFYLASVLMGLVLICVCSKTHSLKGLARGGAQIFSCIIPECLQRAVHGLLHYLFHTRNHTFIVLHLVLQGMVYTEYTWEVFGYCQELELSLHYLLLPYLLLGVNLFFFTLTCGTNPGIITKANELLFLHVYEFDEVMFPKNVRCSTCDLRKPARSKHCSVCNWCVHRFDHHCVWVNNCIGAWNIRYFLIYVLTLTASAATVAIVSTTFLVHLVVMSDLYQETYIDDLGHLHVMDTVFLIQYLFLTFPRIVFMLGFVVVLSFLLGGYLLFVLYLAATNQTTNEWYRGDWAWCQRCPLVAWPPSAEPQVHRNIHSHGLRSNLQEIFLPAFPCHERKKQE

SEQ ID NO: 102019 - protein, 344 aa, Homo sapiens; identical to SEQ ID NO: 102018
  Payload ID: 20332
  Gene Name: zinc finger, DHHC-type containing 4
  Uniprot ID: Q9NPG8
  ENSP ID: ENSP00000379934

SEQ ID NO: 102020 - protein, 344 aa, Homo sapiens; identical to SEQ ID NO: 102018
  Payload ID: 20332
  Gene Name: zinc finger, DHHC-type containing 4
  Uniprot ID: Q9NPG8
  ENSP ID: ENSP00000379935

SEQ ID NO: 102021 - protein, 344 aa, Homo sapiens; identical to SEQ ID NO: 102018
  Payload ID: 20332
  Gene Name: zinc finger, DHHC-type containing 4
  Uniprot ID: Q9NPG8
  ENSP ID: ENSP00000379937

SEQ ID NO: 102022 - protein, 344 aa, Homo sapiens; identical to SEQ ID NO: 102018
  Payload ID: 20332
  Gene Name: zinc finger, DHHC-type containing 4
  Uniprot ID: Q9NPG8
  ENSP ID: ENSP00000379941

SEQ ID NO: 102023 - protein, 344 aa, Homo sapiens; identical to SEQ ID NO: 102018
  Payload ID: 20332
  Gene Name: zinc finger, DHHC-type containing 4
  Uniprot ID: Q9NPG8
  ENSP ID: ENSP00000385027

SEQ ID NO: 102024 - protein, 165 aa, Homo sapiens
  Payload ID: 20332
  Gene Name: zinc finger, DHHC-type containing 4
  ENSP ID: ENSP00000418496
MDFLVLFLFYLASVLMGLVLICVCSKTHSLKGLARGGAQIFSCIIPECLQRAVHGLLHYLFHTRNHTFIVLHLVLQGMVYTEYTWEVFGYCQELELSLHYLLLPYLLLGVNLFFFTLTCGTNPGIITKANELLFLHVYEFDEVMFPKNVRCSTCDLRKPARSKHC

SEQ ID NO: 102025 - protein, 715 aa, Homo sapiens
  Payload ID: 20333
  Gene Name: zinc finger, DHHC-type containing 5
  Uniprot ID: Q9C0B5
  ENSP ID: ENSP00000287169
MPAESGKRFKPSKYVPVSAAAIFLVGATTLFFAFTCPGLSLYVSPAVPIYNAIMFLFVLANFSMATFMDPGIFPRAEEDEDKEDDFRAPLYKTVEIKGIQVRMKWCATCRFYRPPRCSHCSVCDNCVEEFDHHCPWVNNCIGRRNYRYFFLFLLSLTAHIMGVFGFGLLYVLYHIEELSGVRTAVTMAVMCVAGLFFIPVAGLTGFHVVLVARGRTTNEQVTGKFRGGVNPFTNGCCNNVSRVLCSSPAPRYLGRPKKEKTIVIRPPFLRPEVSDGQITVKIMDNGIQGELRRTKSKGSLEITESQSADAEPPPPPKPDLSRYTGLRTHLGLATNEDSSLLAKDSPPTPTMYKYRPGYSSSSTSAAMPHSSSAKLSRGDSLKEPTSIAESSRHPSYRSEPSLEPESFRSPTFGKSFHFDPLSSGSRSSSLKSAQGTGFELGQLQSIRSEGTTSTSYKSLANQTRNGSLSYDSLLTPSDSPDFESVQAGPEPDPPLGYTSPFLSARLAQQREAERHPRLVPTGPTHREPSPVRYDNLSRHIVASLQEREKLLRQSPPLPGREEEPGLGDSGIQSTPGSGHAPRTSSSSDDSKRSPLGKTPLGRPAVPRFGKPDGLRGRGVGSPEPGPTAPYLGRSMSYSSQKAQPGVSETEEVALQPLLTPKDEVQLKTTYSKSNGQPKSLGSASPGPGQPPLSSPTRGGVKKVSGVGGTTYEISV

SEQ ID NO: 102026 - protein, 138 aa, Homo sapiens
  Payload ID: 20333
  Gene Name: zinc finger, DHHC-type containing 5
  ENSP ID: ENSP00000431209
MKWCATCRFYRPPRCSHCSVCDNCVEEFDHHCPWVNNCIGRRNYRYFFLFLLSLTAHIMGVFGFGLLYVLYHIEELSGVRTAVTMAVMCVAGLFFIPVAGLTGFHVVLVARGRTTNEQVTGKFRGGVNPFTNGCCNNV

SEQ ID NO: 102027 - protein, 662 aa, Homo sapiens
  Payload ID: 20333
  Gene Name: zinc finger, DHHC-type containing 5
  Uniprot ID: Q9C0B5
  ENSP ID: ENSP00000432202
MFLFVLANFSMATFMDPGIFPRAEEDEDKEDDFRAPLYKTVEIKGIQVRMKWCATCRFYRPPRCSHCSVCDNCVEEFDHHCPWVNNCIGRRNYRYFFLFLLSLTAHIMGVFGFGLLYVLYHIEELSGVRTAVTMAVMCVAGLFFIPVAGLTGFHVVLVARGRTTNEQVTGKFRGGVNPFTNGCCNNVSRVLCSSPAPRYLGRPKKEKTIVIRPPFLRPEVSDGQITVKIMDNGIQGELRRTKSKGSLEITESQSADAEPPPPPKPDLSRYTGLRTHLGLATNEDSSLLAKDSPPTPTMYKYRPGYSSSSTSAAMPHSSSAKLSRGDSLKEPTSIAESSRHPSYRSEPSLEPESFRSPTFGKSFHFDPLSSGSRSSSLKSAQGTGFELGQLQSIRSEGTTSTSYKSLANQTRNGSLSYDSLLTPSDSPDFESVQAGPEPDPPLGYTSPFLSARLAQQREAERHPRLVPTGPTHREPSPVRYDNLSRHIVASLQEREKLLRQSPPLPGREEEPGLGDSGIQSTPGSGHAPRTSSSSDDSKRSPLGKTPLGRPAVPRFGKPDGLRGRGVGSPEPGPTAPYLGRSMSYSSQKAQPGVSETEEVALQPLLTPKDEVQLKTTYSKSNGQPKSLGSASPGPGQPPLSSPTRGGVKKVSGVGGTTYEISV

SEQ ID NO: 102028 - protein, 103 aa, Homo sapiens
  Payload ID: 20333
  Gene Name: zinc finger, DHHC-type containing 5
  ENSP ID: ENSP00000435593
MKWCATCRFYRPPRCSHCSVCDNCVEEFDHHCPWVNNCIGRRNYRYFFLFLLSLTAHIMGVFGFGLLYVLYHIEELSGVRTAVTMAVMCVAGLFFIPVAGLTG

SEQ ID NO: 102029 - protein, 300 aa, Homo sapiens
  Payload ID: 20333
  Gene Name: zinc finger, DHHC-type containing 5
  ENSP ID: ENSP00000435722
RAEEDEDKEDDFRAPLYKTVEIKGIQVRMKWCATCRFYRPPRCSHCSVCDNCVEVTGKFRGGVNPFTNGCCNNVSRVLCSSPAPRYLGRPKKEKTIVIRPPFLRPEVSDGQITVKIMDNGIQGELRRTKSKGSLEITESQSADAEPPPPPKPDLSRYTGLRTHLGLATNEDSSLLAKDSPPTPTMYKYRPGYSSSSTSAAMPHSSSAKLSRGDSLKEPTSIAESSRHPSYRSEPSLEPESFRSPTFGKSFHFDPLSSGSRSSSLKSAQGTGFELGQLQSIRSEGTTSTSYKSLANQTRNG

SEQ ID NO: 102030 - protein, 409 aa, Homo sapiens
  Payload ID: 20334
  Gene Name: zinc finger, DHHC-type containing 6
  Uniprot ID: Q9H6R6
  ENSP ID: ENSP00000358412
MGTFCSVIKFENLQELKRLCHWGPIIALGVIAICSTMAMIDSVLWYWPLHTTGGSVNFIMLINWTVMILYNYFNAMFVGPGFVPLGWKPDTMYLQYCKVCQAYKAPRSHHCRKCNRCVMKMDHHCPWINNCCGYQNHASFTLFLLLAPLGCIHAAFIFVMTMYTQLYHRLSFGWNTVKIDMSAARRDPLPIVPFGLAAFATTLFALGLALGTTIAVGMLFFIQMKIILRNKTSIESWIEEKAKDRIQYYQLDEVFVFPYDMGSRWRNFKQVFTWSGVPEGDGLEWPVREGCHQYSLTIEQLKQKADKRVRSVRYKVIEDYSGACCPLNKGIKTFFTSPCTEEPRIQLQKGEFILATRGLRYWLYGDKILDDSFIEGVSRIRGWFPRKCVEKCPCDAETDQAPEGEKKNR

SEQ ID NO: 102031 - protein, 413 aa, Homo sapiens
  Payload ID: 20334
  Gene Name: zinc finger, DHHC-type containing 6
  Uniprot ID: Q9H6R6
  ENSP ID: ENSP00000358413
MGTFCSVIKFENLQELKRLCHWGPIIALGVIAICSTMAMIDSVLWYWPLHTTGGSVNFIMLINWTVMILYNYFNAMFVGPGFVPLGWKPEISQDTMYLQYCKVCQAYKAPRSHHCRKCNRCVMKMDHHCPWINNCCGYQNHASFTLFLLLAPLGCIHAAFIFVMTMYTQLYHRLSFGWNTVKIDMSAARRDPLPIVPFGLAAFATTLFALGLALGTTIAVGMLFFIQMKIILRNKTSIESWIEEKAKDRIQYYQLDEVFVFPYDMGSRWRNFKQVFTWSGVPEGDGLEWPVREGCHQYSLTIEQLKQKADKRVRSVRYKVIEDYSGACCPLNKGIKTFFTSPCTEEPRIQLQKGEFILATRGLRYWLYGDKILDDSFIEGVSRIRGWFPRKCVEKCPCDAETDQAPEGEKKNR

SEQ ID NO: 102032 - protein, 383 aa, Homo sapiens
  Payload ID: 20334
  Gene Name: zinc finger, DHHC-type containing 6
  ENSP ID: ENSP00000486105
MGTFCSVIKFENLQELKRLCHWGPIIALGVIAICSTMAMIDSVLWYWPLHTTGGSVNFIMLINWTVMILYNYFNAMFVGPGFVPLGWKPEISQDTMYLQYCKVCQAYKAPRSHHCRKCNRCVMKMDHHCPWINNCCGYQNHASFTLFLLLAPLGCIHAAFIFVMTMYTQLYHRLSFGWNTVKIDMSAARRDPLPIVPFGLAAFATTLFALGLALGTTIAVGMLFFIQMKIILRNKTSIESWIEEKAKDRIQYYQLDEVFVFPYDMGSRWRNFKQVFTWSGVPEGDGLEWPVREGCHQYSLTIEQLKQKADKRVRSVRYKVIEDYSGACCPLNKGIKTFFTSPCTEEPRIQLQKGEFILATRGLRYWLYGDKILDDSFIEGVLV

SEQ ID NO: 102033 - protein, 308 aa, Homo sapiens
  Payload ID: 20335
  Gene Name: zinc finger, DHHC-type containing 7
  Uniprot ID: Q9NXF8
  ENSP ID: ENSP00000315604
MQPSGHRLRDVEHHPLLAENDNYDSSSSSSSEADVADRVWFIRDGCGMICAVMTWLLVAYADFVVTFVMLLPSKDFWYSVVNGVIFNCLAVLALSSHLRTMLTDPGAVPKGNATKEYMESLQLKPGEVIYKCPKCCCIKPERAHHCSICKRCIRKMDHHCPWVNNCVGEKNQRFFVLFTMYIALSSVHALILCGFQFISCVRGQWTECSDFSPPITVILLIFLCLEGLLFFTFTAVMFGTQIHSICNDETEIERLKSEKPTWERRLRWEGMKSVFGGPPSLLWMNPFVGFRFRRLPTRPRKGGPEFSV

SEQ ID NO: 102034 - protein, 345 aa, Homo sapiens
  Payload ID: 20335
  Gene Name: zinc finger, DHHC-type containing 7
  Uniprot ID: Q9NXF8
  ENSP ID: ENSP00000341681
MQPSGHRLRDVEHHPLLAENDNYDSSSSSSSEADVADRVWFIRDGCGMICAVMTWLLVAYADFVVTFVMLLPSKDFWYSVVNGVIFNCLAVLALSSHLRTMLTDPEKSSDCRPSACTVKTGLDPTLVGICGEGTESVQSLLLGAVPKGNATKEYMESLQLKPGEVIYKCPKCCCIKPERAHHCSICKRCIRKMDHHCPWVNNCVGEKNQRFFVLFTMYIALSSVHALILCGFQFISCVRGQWTECSDFSPPITVILLIFLCLEGLLFFTFTAVMFGTQIHSICNDETEIERLKSEKPTWERRLRWEGMKSVFGGPPSLLWMNPFVGFRFRRLPTRPRKGGPEFSV

SEQ ID NO: 102035 - protein, 95 aa, Homo sapiens
  Payload ID: 20335
  Gene Name: zinc finger, DHHC-type containing 7
  ENSP ID: ENSP00000454390
MQPSGHRLRDVEHHPLLAENDNYDSSSSSSSEADVADRVWFIRDGCGMICAVMTWLLVAYADFVVTFVMLLPSKDFWYSVVNGVIFNCLAVLALS

SEQ ID NO: 102036 - protein, 141 aa, Homo sapiens
  Payload ID: 20335
  Gene Name: zinc finger, DHHC-type containing 7
  ENSP ID: ENSP00000454965
MESLQLKPGEVIYKCPKCCCIKPERAHHCSICKRCIRKMDHHCPWVNNCVGEKNQRFFVLFTMYIALSSVHALILCGFQFISCVRGQWTECSDFSPPITVILLIFLCLEGLLFFTFTAVMFGTQIHSICNDETEIERLKSE

SEQ ID NO: 102037 - protein, 345 aa, Homo sapiens; identical to SEQ ID NO: 102034
  Payload ID: 20335
  Gene Name: zinc finger, DHHC-type containing 7
  Uniprot ID: Q9NXF8
  ENSP ID: ENSP00000456782

SEQ ID NO: 102038 - protein, 673 aa, Homo sapiens
  Payload ID: 20336
  Gene Name: zinc finger, DHHC-type containing 8
  Uniprot ID: Q9ULC8
  ENSP ID: ENSP00000317804
MPRSPGTRLKPAKYIPVATAAALLVGSSTLFFVFTCPWLTRAVSPAVPVYNGIIFLFVLANFSMATFMDPGVFPRADEDEDKEDDFRAPLYKNVDVRGIQVRMKWCATCHFYRPPRCSHCSVCDNCVEVTGKFRGGVNPFTRGCCGNVEHVLCSPLAPRYVVEPPRLPLAVSLKPPFLRPELLDRAAPLKVKLSDNGLKAGLGRSKSKGSLDRLDEKPLDLGPPLPPKIEAGTFSSDLQTPRPGSAESALSVQRTSPPTPAMYKFRPAFPTGPKVPFCGPGEQVPGPDSLTLGDDSIRSLDFVSEPSLDLPDYGPGGLHAAYPPSPPLSASDAFSGALRSLSLKASSRRGGDHVALQPLRSEGGPPTPHRSIFAPHALPNRNGSLSYDSLLNPGSPGGHACPAHPAVGVAGYHSPYLHPGATGDPPRPLPRSFSPVLGPRPREPSPVRYDNLSRTIMASIQERKDREERERLLRSQADSLFGDSGVYDAPSSYSLQQASVLSEGPRGPALRYGSRDDLVAGPGFGGARNPALQTSLSSLSSSVSRAPRTSSSSLQADQASSNAPGPRPSSGSHRSPARQGLPSPPGTPHSPSYAGPKAVAFIHTDLPEPPPSLTVQRDHPQLKTPPSKLNGQSPGLARLGPATGPPGPSASPTRHTLVKKVSGVGGTTYEISV

SEQ ID NO: 102039 - protein, 765 aa, Homo sapiens
  Payload ID: 20336
  Gene Name: zinc finger, DHHC-type containing 8
  Uniprot ID: Q9ULC8
  ENSP ID: ENSP00000334490
MPRSPGTRLKPAKYIPVATAAALLVGSSTLFFVFTCPWLTRAVSPAVPVYNGIIFLFVLANFSMATFMDPGVFPRADEDEDKEDDFRAPLYKNVDVRGIQVRMKWCATCHFYRPPRCSHCSVCDNCVEDFDHHCPWVNNCIGRRNYRYFFLFLLSLSAHMVGVVAFGLVYVLNHAEGLGAAHTTITMAVMCVAGLFFIPVIGLTGFHVVLVTRGRTTNEQVTGKFRGGVNPFTRGCCGNVEHVLCSPLAPRYVVEPPRLPLAVSLKPPFLRPELLDRAAPLKVKLSDNGLKAGLGRSKSKGSLDRLDEKPLDLGPPLPPKIEAGTFSSDLQTPRPGSAESALSVQRTSPPTPAMYKFRPAFPTGPKVPFCGPGEQVPGPDSLTLGDDSIRSLDFVSEPSLDLPDYGPGGLHAAYPPSPPLSASDAFSGALRSLSLKASSRRGGDHVALQPLRSEGGPPTPHRSIFAPHALPNRNGSLSYDSLLNPGSPGGHACPAHPAVGVAGYHSPYLHPGATGDPPRPLPRSFSPVLGPRPREPSPVRYDNLSRTIMASIQERKDREERERLLRSQADSLFGDSGVYDAPSSYSLQQASVLSEGPRGPALRYGSRDDLVAGPGFGGARNPALQTSLSSLSSSVSRAPRTSSSSLQADQASSNAPGPRPSSGSHRSPARQGLPSPPGTPHSPSYAGPKAVAFIHTDLPEPPPSLTVQRDHPQLKTPPSKLNGQSPGLARLGPATGPPGPSASPTRHTLVKKVSGVGGTTYEISV

SEQ ID NO: 102040 - protein, 778 aa, Homo sapiens
  Payload ID: 20336
  Gene Name: zinc finger, DHHC-type containing 8
  Uniprot ID: Q9ULC8
  ENSP ID: ENSP00000384716
MPRSPGTRLKPAKYIPVATAAALLVGSSTLFFVFTCPWLTRAVSPAVPVYNGIIFLFVLANFSMATFMDPGVFPRADEDEDKEDDFRAPLYKNVDVRGIQVRMKWCATCHFYRPPRCSHCSVCDNCVEDFDHHCPWVNNCIGRRNYRYFFLFLLSLSAHMVGVVAFGLVYVLNHAEGLGAAHTTITMAVMCVAGLFFIPVIGLTGFHVVLVTRGRTTNEQVTGKFRGGVNPFTRGCCGNVEHVLCSPLAPRYVVEPPRLPLAVSLKPPFLRPELLDRAAPLKVKLSDNGLKAGLGRSKSKGSLDRLDEKPLDLGPPLPPKIEAGTFSSDLQTPRPGSAESALSVQRTSPPTPAMYKFRPAFPTGPKVPFCGPGEQVPGPDSLTLGDDSIRSLDFVSEPSLDLPDYGPGGLHAAYPPSPPLSASDAFSGALRSLSLKASSRRGGDHVALQPLRSEGGPPTPHRSIFAPHALPNRNGSLSYDSLLNPGSPGGHACPAHPAVGVAGYHSPYLHPGATGDPPRPLPRSFSPVLGPRPREPSPVRYDNLSRTIMASIQERKDREERERLLRSQADSLFGDSGVYDAPSSYSLQQASVLSEGPRGPALRYGSRDDLVAGPGFGGARNPALQTSLSSLSSSVSRAPRTSSSSLQADQASSNAPGPRPSSGSHRSPARQGLPSPPGTPHSPSYAGPKAVAFIHTDLPEPPPSLTVQRGRIGTCTRGWGRRGQPWVPPGLHLCHLGRPEDRPPLRAPWSQAAGAPPRGAMCRLHLAASSLFPSLSGP

SEQ ID NO: 102041 - protein, 180 aa, Homo sapiens
  Payload ID: 20336
  Gene Name: zinc finger, DHHC-type containing 8
  ENSP ID: ENSP00000412807
MVLREGSCAGRQNASACWPHGTTGCPWLTRAVSPAVPVYNGIIFLFVLANFSMATFMDPGVFPRADEDEDKEDDFRAPLYKNVDVRGIQVRMKWCATCHFYRPPRCSHCSVCDNCVEDFDHHCPWVNNCIGRRNYRYFFLFLLSLSAHMVGVVAFGLVYVLNHAEGLGAAHTTITYPWFL

SEQ ID NO: 102042 - protein, 364 aa, Homo sapiens
  Payload ID: 20337
  Gene Name: zinc finger, DHHC-type containing 9
  Uniprot ID: Q9Y397
  ENSP ID: ENSP00000349689
MSVMVVRKKVTRKWEKLPGRNTFCCDGRVMMARQKGIFYLTLFLILGTCTLFFAFECRYLAVQLSPAIPVFAAMLFLFSMATLLRTSFSDPGVIPRALPDEAAFIEMEIEATNGAVPQGQRPPPRIKNFQINNQIVKLKYCYTCKIFRPPRASHCSICDNCVERFDHHCPWVGNCVGKRNYRYFYLFILSLSLLTIYVFAFNIVYVALKSLKIGFLETLKETPGTVLEVLICFFTLWSVVGLTGFHTFLVALNQTTNEDIKGSWTGKNRVQNPYSHGNIVKNCCEVLCGPLPPSVLDRRGILPLEESGSRPPSTQETSSSLLPQSPAPTEHLNSNEMPEDSSTPEEMPPPEPPEPPQEAAEAEK

SEQ ID NO: 102043 - protein, 364 aa, Homo sapiens; identical to SEQ ID NO: 102042
  Payload ID: 20337
  Gene Name: zinc finger, DHHC-type containing 9
  Uniprot ID: Q9Y397
  ENSP ID: ENSP00000360103

SEQ ID NO: 102044 - protein, 170 aa, Homo sapiens
  Payload ID: 20337
  Gene Name: zinc finger, DHHC-type containing 9
  ENSP ID: ENSP00000383991
MSVMVVRKKVTRKWEKLPGRNTFCCDGRVMMARQKGIFYLTLFLILGTCTLFFAFECRYLAVQLSPAIPVFAAMLFLFSMATLLRTSFSDPGVIPRALPDEAAFIEMEIEATNGAVPQGQRPPPRIKNFQINNQIVKLKYCYTCKIFRPPRASHCSICDNCVERFDHHCP

SEQ ID NO: 102045 - protein, 194 aa, Homo sapiens
  Payload ID: 20337
  Gene Name: zinc finger, DHHC-type containing 9
  ENSP ID: ENSP00000406165
  MOD_RES (1)..(1): Any amino acid
XLFLILGTCTLFFAFECRYLAVQLSPAIPVFAAMLFLFSMATLLRTSFSDPGVIPRALPDEAAFIEMEIEATNGAVPQGQRPPPRIKNFQINNQIVKLKYCYTCKIFRPPRASHCSICDNCVESLKIGFLETLKETPGTVLEVLICFFTLWSVVGLTGFHTFLVALNQTTNEDIKGSWTGKNRVQNPYSHGNIV

SEQ ID NO: 102046 - protein, 763 aa, Homo sapiens
  Payload ID: 20338
  Gene Name: zinc finger, FYVE domain containing 1
  Uniprot ID: Q9HBF4
  ENSP ID: ENSP00000326921
MSAQTSPAEKGLNPGLMCQESYACSGTDEAIFECDECCSLQCLRCEEELHRQERLRNHERIRLKPGHVPYCDLCKGLSGHLPGVRQRAIVRCQTCKINLCLECQKRTHSGGNKRRHPVTVYNVSNLQESLEAEEMDEETKRKKMTEKVVSFLLVDENEEIQVTNEEDFIRKLDCKPDQHLKVVSIFGNTGDGKSHTLNHTFFYGREVFKTSPTQESCTVGVWAAYDPVHKVAVIDTEGLLGATVNLSQRTRLLLKVLAISDLVIYRTHADRLHNDLFKFLGDASEAYLKHFTKELKATTARCGLDVPLSTLGPAVIIFHETVHTQLLGSDHPSEVPEKLIQDRFRKLGRFPEAFSSIHYKGTRTYNPPTDFSGLRRALEQLLENNTTRSPRHPGVIFKALKALSDRFSGEIPDDQMAHSSFFPDEYFTCSSLCLSCGVGCKKSMNHGKEGVPHEAKSRCRYSHQYDNRVYTCKACYERGEEVSVVPKTSASTDSPWMGLAKYAWSGRQYWFGNQDPVDTVVRTEIVHVWPGTDGFLKDNNNAAQRLLDGMNFMAQSVSELSLGPTKAVTSWLTDQIAPAYWRPNSQILSCNKCATSFKDNDTKHHCRACGEGFCDSCSSKTRPVPERGWGPAPVRVCDNCYEARNVQLAVTEAQVDDEGGTLIARKVGEAVQNTLGAVVTAIDIPLGLVKDAARPAYWVPDHEILHCHNCRKEFSIKLSKHHCRACGQGFCDECSHDRRAVPSRGWDHPVRVCFNCNKKPGDL

SEQ ID NO: 102047 - protein, 362 aa, Homo sapiens
  Payload ID: 20338
  Gene Name: zinc finger, FYVE domain containing 1
  Uniprot ID: Q9HBF4
  ENSP ID: ENSP00000377757
MAHSSFFPDEYFTCSSLCLSCGVGCKKSMNHGKEGVPHEAKSRCRYSHQYDNRVYTCKACYERGEEVSVVPKTSASTDSPWMGLAKYAWSGYVIECPNCGVVYRSRQYWFGNQDPVDTVVRTEIVHVWPGTDGFLKDNNNAAQRLLDGMNFMAQSVSELSLGPTKAVTSWLTDQIAPAYWRPNSQILSCNKCATSFKDNDTKHHCRACGEGFCDSCSSKTRPVPERGWGPAPVRVCDNCYEARNVQLAVTEAQVDDEGGTLIARKVGEAVQNTLGAVVTAIDIPLGLVKDAARPAYWVPDHEILHCHNCRKEFSIKLSKHHCRACGQGFCDECSHDRRAVPSRGWDHPVRVCFNCNKKPGDL

SEQ ID NO: 102048 - protein, 777 aa, Homo sapiens
  Payload ID: 20338
  Gene Name: zinc finger, FYVE domain containing 1
  Uniprot ID: Q9HBF4
  ENSP ID: ENSP00000450742
MSAQTSPAEKGLNPGLMCQESYACSGTDEAIFECDECCSLQCLRCEEELHRQERLRNHERIRLKPGHVPYCDLCKGLSGHLPGVRQRAIVRCQTCKINLCLECQKRTHSGGNKRRHPVTVYNVSNLQESLEAEEMDEETKRKKMTEKVVSFLLVDENEEIQVTNEEDFIRKLDCKPDQHLKVVSIFGNTGDGKSHTLNHTFFYGREVFKTSPTQESCTVGVWAAYDPVHKVAVIDTEGLLGATVNLSQRTRLLLKVLAISDLVIYRTHADRLHNDLFKFLGDASEAYLKHFTKELKATTARCGLDVPLSTLGPAVIIFHETVHTQLLGSDHPSEVPEKLIQDRFRKLGRFPEAFSSIHYKGTRTYNPPTDFSGLRRALEQLLENNTTRSPRHPGVIFKALKALSDRFSGEIPDDQMAHSSFFPDEYFTCSSLCLSCGVGCKKSMNHGKEGVPHEAKSRCRYSHQYDNRVYTCKACYERGEEVSVVPKTSASTDSPWMGLAKYAWSGYVIECPNCGVVYRSRQYWFGNQDPVDTVVRTEIVHVWPGTDGFLKDNNNAAQRLLDGMNFMAQSVSELSLGPTKAVTSWLTDQIAPAYWRPNSQILSCNKCATSFKDNDTKHHCRACGEGFCDSCSSKTRPVPERGWGPAPVRVCDNCYEARNVQLAVTEAQVDDEGGTLIARKVGEAVQNTLGAVVTAIDIPLGLVKDAARPAYWVPDHEILHCHNCRKEFSIKLSKHHCRACGQGFCDECSHDRRAVPSRGWDHPVRVCFNCNKKPGDL

SEQ ID NO: 102049 - protein, 362 aa, Homo sapiens; identical to SEQ ID NO: 102047
  Payload ID: 20338
  Gene Name: zinc finger, FYVE domain containing 1
  Uniprot ID: Q9HBF4
  ENSP ID: ENSP00000452232

SEQ ID NO: 102050 - protein, 789 aa, Homo sapiens
  Payload ID: 20338
  Gene Name: zinc finger, FYVE domain containing 1
  ENSP ID: ENSP00000452442
MSAQTSPAEKGLNPGLMCQESYACSGTDEAIFECDECCSLQCLRCEEELHRQERLRNHERIRLKPGHVPYCDLCKGLSGHLPGVRQRAIVRCQTCKINLCLECQKRTHSGGNKRRHPVTVYNVSNLQESLEAEEMDEETKRKKMTEKVVSFLLVDENEEIQVTNEEDFIRKLDCKPDQHLKVVSIFGNTGDGKSHTLNHTFFYGREVFKTSPTQESCTVGVWAAYDPVHKVAVIDTEGLLGATVNLSQRTRLLLKVLAISDLVIYRTHADRLHNDLFKFLGDASEAYLKHFTKELKATTARCGLDVPLSTLGPAVIIFHETVHTQLLGSDHPSEVPEKLIQDRFRKLGRFPEAFSSIHYKGTRTYNPPTDFSGLRRALEQLLENNTTRSPRHPGVIFKALKALSDRFSGEIPDDQMAHSSFFPDEYFTCSSLCLSCGVGCKKSMNHGKEGVPHEAKSRCRYSHQYDNRVYTCKACYERGEEVSVVPKTSASTDSPWMGLAKYAWSGYVIECPNCGVVYRSRQYWFGNQDPVDTVVRTEIVHVWPGTDGFLKDNNNAAQRLLDGMNFMAQSVSELSLGPTKAVTSWLTDQIAPAYWRPNSQILSCNKCATSFKDNDTKHHCRACGEGFCDSCSSKTRPVPERGWGPAPVRVCDNCYEARNVQLAVTEAQVDDEGGTLIARKVGEAVQNTLGAVVTAIDIPLGLVKDAARPAYWVPDHEILHCHNCRKEFSIKLSKHHCRACGQGFCDECSHDRRAVPSRGWDHPVRVCFNCNKKPAWTSLSVMTGKGPLC

SEQ ID NO: 102051 - protein, 1539 aa, Homo sapiens
  Payload ID: 20339
  Gene Name: zinc finger, FYVE domain containing 16
  Uniprot ID: Q7Z3T8
  ENSP ID: ENSP00000337159
MDSYFKAAVSDLDKLLDDFEQNPDEQDYLQDVQNAYDSNHCSVSSELASSQRTSLLPKDQECVNSCASSETSYGTNESSLNEKTLKGLTSIQNEKNVTGLDLLSSVDGGTSDEIQPLYMGRCSKPICDLISDMGNLVHATNSEEDIKKLLPDDFKSNADSLIGLDLSSVSDTPCVSSTDHDSDTVREQQNDISSELQNREIGGIKELGIKVDTTLSDSYNYSGTENLKDKKIFNQLESIVDFNMSSALTRQSSKMFHAKDKLQHKSQPCGLLKDVGLVKEEVDVAVITAAECLKEEGKTSALTCSLPKNEDLCLNDSNSRDENFKLPDFSFQEDKTVIKQSAQEDSKSLDLKDNDVIQDSSSALHVSSKDVPSSLSCLPASGSMCGSLIESKARGDFLPQHEHKDNIQDAVTIHEEIQNSVVLGGEPFKENDLLKQEKCKSILLQSLIEGMEDRKIDPDQTVIRAESLDGGDTSSTVVESQEGLSGTHVPESSDCCEGFINTFSSNDMDGQDLDYFNIDEGAKSGPLISDAELDAFLTEQYLQTTNIKSFEENVNDSKSQMNQIDMKGLDDGNINNIYFNAEAGAIGESHGINIICEIVDKQNTIENGLSLGEKSTIPVQQGLPTSKSEITNQLSVSDINSQSVGGARPKQLFSLPSRTRSSKDLNKPDVPDTIESEPSTADTVVPITCAIDSTADPQVSFNSNYIDIESNSEGGSSFVTANEDSVPENTCKEGLVLGQKQPTWVPDSEAPNCMNCQVKFTFTKRRHHCRACGKVFCGVCCNRKCKLQYLEKEARVCVVCYETISKAQAFERMMSPTGSNLKSNHSDECTTVQPPQENQTSSIPSPATLPVSALKQPGVEGLCSKEQKRVWFADGILPNGEVADTTKLSSGSKRCSEDFSPLSPDVPMTVNTVDHSHSTTVEKPNNETGDITRNEIIQSPISQVPSVEKLSMNTGNEGLPTSGSFTLDDDVFAETEEPSSPTGVLVNSNLPIASISDYRLLCDINKYVCNKISLLPNDEDSLPPLLVASGEKGSVPVVEEHPSHEQIILLLEGESFHPVTFVLNANLLVNVKFIFYSSDKYWYFSTNGLHGLGQAEIIILLLCLPNEDTIPKDIFRLFITIYKDALKGKYIENLDNITFTESFLSSKDHGGFLFITPTFQKLDDLSLPSNPFLCGILIQKLEIPWAKVFPMRLMLRLGAEYKAYPAPLTSIRGRKPLFGEIGHTIMNLLVDLRNYQYTLHNIDQLLIHMEMGKSCIKIPRKKYSDVMKVLNSSNEHVISIGASFSTEADSHLVCIQNDGIYETQANSATGHPRKVTGASFVVFNGALKTSSGFLAKSSIVEDGLMVQITPETMNGLRLALREQKDFKITCGKVDAVDLREYVDICWVDAEEKGNKGVISSVDGISLQGFPSEKIKLEADFETDEKIVKCTEVFYFLKDQDLSILSTSYQFAKEIAMACSAALCPHLKTLKSNGMNKIGLRVSIDTDMVEFQAGSEGQLLPQHYLNDLDSALIPVIHGGTSNSSLPLEIELVFFIIEHLF

SEQ ID NO: 102052 - protein, 51 aa, Homo sapiens
  Payload ID: 20339
  Gene Name: zinc finger, FYVE domain containing 16
  ENSP ID: ENSP00000421785
  MOD_RES (1)..(1): Any amino acid
XGLCSKEQKRVWFADGILPNGEVADTTKLSSGSKRCSEDFSPLSPDVPMCL

SEQ ID NO: 102053 - protein, 40 aa, Homo sapiens
  Payload ID: 20339
  Gene Name: zinc finger, FYVE domain containing 16
  ENSP ID: ENSP00000422356
MGRCSKPICDLISDMGNLVHATNSEEDIKKLLPDDFKSNA

SEQ ID NO: 102054 - protein, 1539 aa, Homo sapiens; identical to SEQ ID NO: 102051
  Payload ID: 20339
  Gene Name: zinc finger, FYVE domain containing 16
  Uniprot ID: Q7Z3T8
  ENSP ID: ENSP00000423663

SEQ ID NO: 102055 - protein, 37 aa, Homo sapiens
  Payload ID: 20339
  Gene Name: zinc finger, FYVE domain containing 16
  ENSP ID: ENSP00000426500
  MOD_RES (1)..(1): Any amino acid
XNGALKTSSGFLAKSSIVEELSVQWMEYHYKDFQVKK

SEQ ID NO: 102056 - protein, 51 aa, Homo sapiens
  Payload ID: 20339
  Gene Name: zinc finger, FYVE domain containing 16
  ENSP ID: ENSP00000426536
TGSNLKSNHSDECTTVQPPQENQTSSIPSPATLPVSALKQPGVEVPAIGKS

SEQ ID NO: 102057 - protein, 1539 aa, Homo sapiens; identical to SEQ ID NO: 102051
  Payload ID: 20339
  Gene Name: zinc finger, FYVE domain containing 16
  Uniprot ID: Q7Z3T8
  ENSP ID: ENSP00000426848

SEQ ID NO: 102058 - protein, 403 aa, Homo sapiens
  Payload ID: 20340
  Gene Name: zinc finger, FYVE domain containing 19
  Uniprot ID: Q96K21
  ENSP ID: ENSP00000299173
MNYDSQQPPLPPLPYAGCRRASGFPALGRGGTVPVGVWGGAGQGREGRSWGEGPRGPGLGRRDLSSADPAVLGATMESRCYGCAVKFTLFKKEYGCKNCGRAFCSGCLSFSAAVPRTGNTQQKVCKQCHEVLTRGSSANASKWSPPQNYKKRVAALEAKQKPSTSQSQGLTRQDQMIAERLARLRQENKPKLVPSQAEIEARLAALKDERQGSIPSTQEMEARLAALQGRVLPSQTPQPAHHTPDTRTQAQQTQDLLTQLAAEVAIDESWKGGGPVTLQDYRLPDSDDDEDEETAIQRVLQQLTEEASLDEASGFNIPAEQASRPWTQPRGAEPEAQDVDPRPEAEEEELPWCCICNEDATLRCAGCDGDLFCARCFREGHDAFELKEHQTSAYSPPRAGQEH

SEQ ID NO: 102059 - protein, 461 aa, Homo sapiens
  Payload ID: 20340
  Gene Name: zinc finger, FYVE domain containing 19
  Uniprot ID: Q96K21
  ENSP ID: ENSP00000337824
MPAVAEALGQEGPPDLSRSAFLATVLTSLSAAFSSMPSSAYSLPFSRSLELDYHTSSCFRGTMVKADCPVPITDLPDSSGKLQYGCKNCGRAFCSGCLSFSAAVPRTGNTQQKVCKQCHEVLTRGSSANASKWSPPQNYKKRVAALEAKQKPSTSQSQGLTRQDQMIAERLARLRQENKPKLVPSQAEIEARLAALKDERQGSIPSTQEMEARLAALQGRVLPSQTPQPAHHTPDTRTQAQQTQDLLTQLAAEVAIDESWKGGGPAASLQNDLNQGGPGSTNSKRQANWSLEEEKSRLLAEAALELREENTRQERILALAKRLAMLRGQDPERVTLQDYRLPDSDDDEDEETAIQRVLQQLTEEASLDEASGFNIPAEQASRPWTQPRGAEPEAQDVDPRPEAEEEELPWCCICNEDATLRCAGCDGDLFCARCFREGHDAFELKEHQTSAYSPPRAGQEH

SEQ ID NO: 102060 - protein, 471 aa, Homo sapiens
  Payload ID: 20340
  Gene Name: zinc finger, FYVE domain containing 19
  Uniprot ID: Q96K21
  ENSP ID: ENSP00000347498
MNYDSQQPPLPPLPYAGCRRASGFPALGRGGTVPVGVWGGAGQGREGRSWGEGPRGPGLGRRDLSSADPAVLGATMESRCYGCAVKFTLFKKEYGCKNCGRAFCSGCLSFSAAVPRTGNTQQKVCKQCHEVLTRGSSANASKWSPPQNYKKRVAALEAKQKPSTSQSQGLTRQDQMIAERLARLRQENKPKLVPSQAEIEARLAALKDERQGSIPSTQEMEARLAALQGRVLPSQTPQPAHHTPDTRTQAQQTQDLLTQLAAEVAIDESWKGGGPAASLQNDLNQGGPGSTNSKRQANWSLEEEKSRLLAEAALELREENTRQERILALAKRLAMLRGQDPERVTLQDYRLPDSDDDEDEETAIQRVLQQLTEEASLDEASGFNIPAEQASRPWTQPRGAEPEAQDVDPRPEAEEEELPWCCICNEDATLRCAGCDGDLFCARCFREGHDAFELKEHQTSAYSPPRAGQEH

SEQ ID NO: 102061 - protein, 271 aa, Homo sapiens
  Payload ID: 20340
  Gene Name: zinc finger, FYVE domain containing 19
  ENSP ID: ENSP00000454704
  MOD_RES (1)..(1): Any amino acid
XPGLGRRDLSSADPAVLGATMESRCYGCAVKFTLFKKEYGCKNCGRAFCSGCLSFSAAVPRTGNTQQKVCKQCHEVLTRRVAALEAKQKPSTSQSQGLTRQDQMIAERLARLRQENKPKLVPSQAEIEARLAALKDERQGSIPSTQEMEARLAALQGRVLPSQTPQPAHHTPDTRTQAQQTQDLLTQLAAEVAIDESWKGGGPAASLQNDLNQGGPGSTNSKRQANWSLEEEKSRLLAEAALELREENTRQERILALAKRLAMLRGQDPER

SEQ ID NO: 102062 - protein, 101 aa, Homo sapiens
  Payload ID: 20340
  Gene Name: zinc finger, FYVE domain containing 19
  ENSP ID: ENSP00000455157
  MOD_RES (1)..(1): Any amino acid
XRRASGFPALGRGGTVPVGVWGGAGQGREGRSWGEGPRGPGLGRRDLSSADPAVLGATMESRCYGCAVKFTLFKKEGLCEGPLKCFSTAVRIVAGPSVQAA

SEQ ID NO: 102063 - protein, 448 aa, Homo sapiens
  Payload ID: 20340
  Gene Name: zinc finger, FYVE domain containing 19
  ENSP ID: ENSP00000456223
MPAVAEALGQEGPPDLSRSAFLATVLTSLSAAFSSMPSSAYRSIYPAVLGATMESRCYGCAVKFTLFKKEYGCKNCGRAFCSGCLSFSAAVPRTGNTQQKVCKQCHEVLTRGSSANASKWSPPQNYKKRVAALEAKQKPSTSQSQGLTRQDQMIAERLARLRQENKPKLVPSQAEIEARLAALKDERQGSIPSTQEMEARLAALQGRVLPSQTPQPAHHTPDTRTQAQQTQDLLTQLAAEVAIDESWKGGGPAASLQNDLNQGGPGSTNSKRQANWSLEEEKSRLLAEAALELREENTRQERILALAKRLAMLRGQDPERVTLQDYRLPDSDDDEDEETAIQRVLQQLTEEASLDEASGFNIPAEQASRPWTQPRGAEPEAQDVDPRPEAEEEELPWCCICNEDATLRCAGCDGDLFCARCFREGHDAFELKEHQTSAYSPPRAGQEH

SEQ ID NO: 102064 - protein, 307 aa, Homo sapiens
  Payload ID: 20340
  Gene Name: zinc finger, FYVE domain containing 19
  ENSP ID: ENSP00000456304
GGTVPVGVWGGAGQGREGRSWGEGPRGPGLGRRDLSSADPAVLGATMESRCYGCAVKFTLFKKEYGCKNCGRAFCSGCLSFSAAVPRTGNTQQKVCKQCHEVLTRGSSANASKWSPPQNYKKRVAALEAKQKPSTSQSQGLTRQDQMIAERLARLRQENKPKLVPSQAEIEARLAALKDERQGSIPSTQEMEARLAALQGRVLPSQTPQPAHHTPDTRTQAQQTQDLLTQLAAEVAIDESWKGGGPGLPLQVTLQDYRLPDSDDDEDEETAIQRVLQQLTEEASLDEASGFNIPAEQASRPWTQPRG

SEQ ID NO: 102065 - protein, 21 aa, Homo sapiens
  Payload ID: 20340
  Gene Name: zinc finger, FYVE domain containing 19
  ENSP ID: ENSP00000456485
  MOD_RES (1)..(1): Any amino acid
XRRDLSSADPAVLGATMEIRL

SEQ ID NO: 102066 - protein, 51 aa, Homo sapiens
  Payload ID: 20340
  Gene Name: zinc finger, FYVE domain containing 19
  ENSP ID: ENSP00000456679
  MOD_RES (1)..(1): Any amino acid
XLGRRDLSSADPAVLGATMESRCYGCAVKFTLFKKERVFCQCLQVVTTSEL

SEQ ID NO: 102067 - protein, 296 aa, Homo sapiens
  Payload ID: 20340
  Gene Name: zinc finger, FYVE domain containing 19
  Uniprot ID: Q96K21
  ENSP ID: ENSP00000457617
MIAERLARLRQENKPKLVPSQAEIEARLAALKDERQGSIPSTQEMEARLAALQGRVLPSQTPQPAHHTPDTRTQAQQTQDLLTQLAAEVAIDESWKGGGPAASLQNDLNQGGPGSTNSKRQANWSLEEEKSRLLAEAALELREENTRQERILALAKRLAMLRGQDPERVTLQDYRLPDSDDDEDEETAIQRVLQQLTEEASLDEASGFNIPAEQASRPWTQPRGAEPEAQDVDPRPEAEEEELPWCCICNEDATLRCAGCDGDLFCARCFREGHDAFELKEHQTSAYSPPRAGQEH

SEQ ID NO: 102068 - protein, 57 aa, Homo sapiens
  Payload ID: 20340
  Gene Name: zinc finger, FYVE domain containing 19
  ENSP ID: ENSP00000457839
MIAERLARLRQENKPKLVPSQAEIEARLAALKDERQGSIPSTQEMEARLAALQGRVL

SEQ ID NO: 102069 - protein, 47 aa, Homo sapiens
  Payload ID: 20340
  Gene Name: zinc finger, FYVE domain containing 19
  ENSP ID: ENSP00000458096
SWGEGPRGPGLGRRDLSSADPAVLGATMESRCYGCAVKFTLFKKEAA

SEQ ID NO: 102070 - protein, 252 aa, Homo sapiens
  Payload ID: 20341
  Gene Name: zinc finger, FYVE domain containing 21
  Uniprot ID: Q9BQ24
  ENSP ID: ENSP00000216602
MSSEVSARRDAKKLVRSPSGLRMVPEHRAFGSPFGLEEPQWVPDKECRRCMQCDAKFDFLTRKHHCRRCGKCFCDRCCSQKVPLRRMCFVDPVRQCAECALVSLKEAEFYDKQLKVLLSGATFLVTFGNSEKPETMTCRLSNNQRYLFLDGDSHYEIEIVHISTVQILTEGFPPGEKDIHAYTSLRGSQPASEGGNARATGMFLQYTVPGTEGVTQLKLTVVEDVTVGRRQAVAWLVAMHKAAKLLYESRDQ

SEQ ID NO: 102071 - protein, 234 aa, Homo sapiens
  Payload ID: 20341
  Gene Name: zinc finger, FYVE domain containing 21
  Uniprot ID: Q9BQ24
  ENSP ID: ENSP00000310543
MSSEVSARRDAKKLVRSPSGLRMVPEHRAFGSPFGLEEPQWVPDKECRRCMQCDAKFDFLTRKHHCRRCGKCFCDRCCSQKVPLRRMCFVDPVRQCAECALVSLKEAEFYDKQLKVLLSGATFLVTFGNSEKPETMTCRLSNNQRYLFLDGDSHYEIEIVHISTVQILTEGFPPGGGNARATGMFLQYTVPGTEGVTQLKLTVVEDVTVGRRQAVAWLVAMHKAAKLLYESRDQ

SEQ ID NO: 102072 - protein, 93 aa, Homo sapiens
  Payload ID: 20341
  Gene Name: zinc finger, FYVE domain containing 21
  ENSP ID: ENSP00000450746
MSSEVSARRDAKKLVRSPSGLRMVPEHRAFGSPFGLEEPQWVPDKECRRCMQCDAKFDFLTRKVRRIPAAWWGAQGLATGGARVQRPAQGPRV

SEQ ID NO: 102073 - protein, 62 aa, Homo sapiens
  Payload ID: 20341
  Gene Name: zinc finger, FYVE domain containing 21
  ENSP ID: ENSP00000452301
MSSEVSARRDAKKLVRSPSGLRMVPEHRAFGSPFGLEEPQWVPDKEEPPSSSRLETQRNLKL

SEQ ID NO: 102074 - protein, 115 aa, Homo sapiens
  Payload ID: 20341
  Gene Name: zinc finger, FYVE domain containing 21
  ENSP ID: ENSP00000473477
  MOD_RES (1)..(1): Any amino acid
XKVLLSGATFLVTFGNSEKPETMTCRLSNNQRYLFLDGDSHYEIEIVHISTVQILTEGFPPGEKDIHAYTSLRGSQPASEGQPLPPHRGSPHAAGPFLPSPPGFCPRGGPCQGSL

SEQ ID NO: 102075 - protein, 2539 aa, Homo sapiens
  Payload ID: 20342
  Gene Name: zinc finger, FYVE domain containing 26
  Uniprot ID: Q68DK2
  ENSP ID: ENSP00000251119
MNHPFGKEEAASQKQLFGFFCECLRRGEWELAQACVPQLQEGQGDIPKRVEDILQALVVCPNLLRCGQDINPQRVAWVWLLVLEKWLAREKKLLPVVFRRKLEFLLLSEDLQGDIPENILEELYETLTQGAVGHVPDGNPRRESWTPRLSSEAVSVLWDLLRQSPQPAQALLELLLEEDDGTGLCHWPLQNALVDLIRKALRALQGPDSVPPGVVDAIYGALRTLRCPAEPLGVELHLLCEELLEACRTEGSPLREERLLSCLLHKASRGLLSLYGHTYAEKVTEKPPRATASGKVSPDHLDPERAMLALFSNPNPAEAWKVAYFYCLSNNKHFLEQILVTALTLLKEEDFPNLGCLLDREFRPLSCLLVLLGWTHCQSLESAKRLLQTLHRTQGPGCDELLRDACDGLWAHLEVLEWCIQQSSNPIPKRDLLYHLHGGDSHSVLYTLHHLTNLPALREEDVLKLLQKVPAKDPQQEPDAVDAPVPEHLSQCQNLTLYQGFCAMKYAIYALCVNSHQHSQCQDCKDSLSEDLASATEPANDSLSSPGAANLFSTYLARCQQYLCSIPDSLCLELLENIFSLLLITSADLHPEPHLPEDYAEDDDIEGKSPSGLRSPSESPQHIAHPERKSERGSLGVPKTLAYTMPSHVKAEPKDSYPGPHRHSFLDLKHFTSGISGFLADEFAIGAFLRLLQEQLDEISSRSPPEKPKQESQSCSGSRDGLQSRLHRLSKVVSEAQWRHKVVTSNHRSEEQPSRRYQPATRHPSLRRGRRTRRSQADGRDRGSNPSLESTSSELSTSTSEGSLSAMSGRNELHSRLHPHPQSSLIPMMFSPPESLLASCILRGNFAEAHQVLFTFNLKSSPSSGELMFMERYQEVIQELAQVEHKIENQNSDAGSSTIRRTGSGRSTLQAIGSAAAAGMVFYSISDVTDKLLNTSGDPIPMLQEDFWISTALVEPTAPLREVLEDLSPPAMAAFDLACSQCQLWKTCKQLLETAERRLNSSLERRGRRIDHVLLNADGIRGFPVVLQQISKSLNYLLMSASQTKSESVEEKGGGPPRCSITELLQMCWPSLSEDCVASHTTLSQQLDQVLQSLREALELPEPRTPPLSSLVEQAAQKAPEAEAHPVQIQTQLLQKNLGKQTPSGSRQMDYLGTFFSYCSTLAAVLLQSLSSEPDHVEVKVGNPFVLLQQSSSQLVSHLLFERQVPPERLAALLAQENLSLSVPQVIVSCCCEPLALCSSRQSQQTSSLLTRLGTLAQLHASHCLDDLPLSTPSSPRTTENPTLERKPYSSPRDSSLPALTSSALAFLKSRSKLLATVACLGASPRLKVSKPSLSWKELRGRREVPLAAEQVARECERLLEQFPLFEAFLLAAWEPLRGSLQQGQSLAVNLCGWASLSTVLLGLHSPIALDVLSEAFEESLVARDWSRALQLTEVYGRDVDDLSSIKDAVLSCAVACDKEGWQYLFPVKDASLRSRLALQFVDRWPLESCLEILAYCISDTAVQEGLKCELQRKLAELQVYQKILGLQSPPVWCDWQTLRSCCVEDPSTVMNMILEAQEYELCEEWGCLYPIPREHLISLHQKHLLHLLERRDHDKALQLLRRIPDPTMCLEVTEQSLDQHTSLATSHFLANYLTTHFYGQLTAVRHREIQALYVGSKILLTLPEQHRASYSHLSSNPLFMLEQLLMNMKVDWATVAVQTLQQLLVGQEIGFTMDEVDSLLSRYAEKALDFPYPQREKRSDSVIHLQEIVHQAADPETLPRSPSAEFSPAAPPGISSIHSPSLRERSFPPTQPSQEFVPPATPPARHQWVPDETESICMVCCREHFTMFNRRHHCRRCGRLVCSSCSTKKMVVEGCRENPARVCDQCYSYCNKDVPEEPSEKPEALDSSKNESPPYSFVVRVPKADEVEWILDLKEEENELVRSEFYYEQAPSASLCIAILNLHRDSIACGHQLIEHCCRLSKGLTNPEVDAGLLTDIMKQLLFSAKMMFVKAGQSQDLALCDSYISKVDVLNILVAAAYRHVPSLDQILQPAAVTRLRNQLLEAEYYQLGVEVSTKTGLDTTGAWHAWGMACLKAGNLTAAREKFSRCLKPPFDLNQLNHGSRLVQDVVEYLESTVRPFVSLQDDDYFATLRELEATLRTQSLSLAVIPEGKIMNNTYYQECLFYLHNYSTNLAIISFYVRHSCLREALLHLLNKESPPEVFIEGIFQPSYKSGKLHTLENLLESIDPTLESWGKYLIAACQHLQKKNYYHILYELQQFMKDQVRAAMTCIRFFSHKAKSYTELGEKLSWLLKAKDHLKIYLQETSRSSGRKKTTFFRKKMTAADVSRHMNTLQLQMEVTRFLHRCESAGTSQITTLPLPTLFGNNHMKMDVACKVMLGGKNVEDGFGIAFRVLQDFQLDAAMTYCRAARQLVEKEKYSEIQQLLKCVSESGMAAKSDGDTILLNCLEAFKRIPPQELEGLIQAIHNDDNKVRAYLICCKLRSAYLIAVKQEHSRATALVQQVQQAAKSSGDAVVQDICAQWLLTSHPRGAHGPGSRK

SEQ ID NO: 102076 - protein, 444 aa, Homo sapiens
  Payload ID: 20342
  Gene Name: zinc finger, FYVE domain containing 26
  ENSP ID: ENSP00000450431
MNHPFGKEEAASQKQLFGFFCECLRRGEWELAQACVPQLQEGQGDIPKRVEDILQALVVCPNLLRCGQDINPQRVAWVWLLVLEKWLAREKKLLPVVFRRKLEFLLLSEDLQGDIPENILEELYETLTQGAVGHVPDGNPRRESWTPRLSSEAVSVLWDLLRQSPQPAQALLELLLEEDDGTGLCHWPLQNALVDLIRKALRALQGPDSVPPGVVDAIYGALRTLRCPAEPLGVELHLLCEELLEACRTEGSPLREERLLSCLLHKASRGLLSLYGHTYAEKVTEKPPRATASGKVSPDHLDPERAMLALFSNPNPAEAWKVAYFYCLSNNKHFLEQILVTALTLLKEEDFPNLGCLLDREFRPLSCLLVLLGWTHCQSLESAKRLLQTLHRTQGPGCDELLRDACDGLWAHLEVLEWCIQQSRCCKSLLNLPGQVSTVSVQYS

SEQ ID NO: 102077 - protein, 2225 aa, Homo sapiens
  Payload ID: 20342
  Gene Name: zinc finger, FYVE domain containing 26
  ENSP ID: ENSP00000450603
MNHPFGKEEAASQKQLFGFFCECLRRGEWELAQACVPQLQEGQGDIPKRVEDILQALVVCPNLLRCGQDINPQRVAWVWLLVLEKWLAREKKLLPVVFRRKLEFLLLSEDLQGDIPENILEELYETLTQGAVGHVPDGNPRRESWTPRLSSEAVSVLWDLLRQSPQPAQALLELLLEEDDGTGLCHWPLQNALVDLIRKALRALQGPDSVPPGVVDAIYGALRTLRCPAEPLGVELHLLCEELLEACRTEGSPLREERLLSCLLHKASRGLLSLYGHTYAEKVTEKPPRATASGKVSPDHLDPERAMLALFSNPNPAEAWKVAYFYCLSNNKHFLEQILVTALTLLKEEDFPNLGCLLDREFRPLSCLLVLLGWTHCQSLESAKRLLQTLHRTQGPGCDELLRDACDGLWAHLEVLEWCIQQSSNPIPKRDLLYHLHGGDSHSVLYTLHHLTNLPALREEDVLKLLQKVPAKDPQQEPDAVDAPVPEHLSQCQNLTLYQGFCAMKYAIYALCVNSHQHSQCQDCKDSLSEDLASATEPANDSLSSPGAANLFSTYLARCQQYLCSIPDSLCLELLENIFSLLLITSADLHPEPHLPEDYAEDDDIEGKSPSGLRSPSESPQHIAHPERKSERGSLGVPKTLAYTMPSHVKAEPKDSYPGPHRHSFLDLKHFTSGISGFLADEFAIGAFLRLLQEQLDEISSRSPPEKPKQESQSCSGSRDGLQSRLHRLSKVVSEAQWRHKVVTSNHRSEEQPSRRYQPATRHPSLRRGRRTRRSQADGRDRGSNPSLESTSSELSTSTSEGSLSAMSGRNELHSRLHPHPQSSLIPMMFSPPESLLASCILRGNFAEAHQVLFTFNLKSSPSSGELMFMERYQEVIQELAQVEHKIENQNSDAGSSTIRRTGSGRSTLQAIGSAAAAGMVFYSISDVTDKLLNTSGDPIPMLQEDFWISTALVEPTAPLREVLEDLSPPAMAAFDLACSQCQLWKTCKQLLETAERRLNSSLERRGRRIDHVLLNADGIRGFPVVLQQISKSLNYLLMSASQTKSESVEEKGGGPPRCSITELLQMCWPSLSEDCVASHTTLSQQLDQVLQSLREALELPEPRTPPLSSLVEQAAQKAPEAEAHPVQIQTQLLQKNLGKQTPSGSRQMDYLGTFFSYCSTLAAVLLQSLSSEPDHVEVKVGNPFVLLQQSSSQLVSHLLFERQVPPERLAALLAQENLSLSVPQVIVSCCCEPLALCSSRQSQQTSSLLTRLGTLAQLHASHCLDDLPLSTPSSPRTTENPTLERKPYSSPRDSSLPALTSSALAFLKSRSKLLATVACLGASPRLKVSKPSLSWKELRGRREVPLAAEQVARECERLLEQFPLFEAFLLAAWEPLRGSLQQGQSLAVNLCGWASLSTVLLGLHSPIALDVLSEAFEESLVARDWSRALQLTEVYGRDVDDLSSIKDAVLSCAVACDKEGWQYLFPVKDASLRSRLALQFVDRWPLESCLEILAYCISDTAVQEGLKCELQRKLAELQVYQKILGLQSPPVWCDWQTLRSCCVEDPSTVMNMILEAQEYELCEEWGCLYPIPREHLISLHQKHLLHLLERRDHDKALQLLRRIPDPTMCLEVTEQSLDQHTSLATSHFLANYLTTHFYGQLTAVRHREIQALYVGSKILLTLPEQHRASYSHLSSNPLFMLEQLLMNMKVDWATVAVQTLQQLLVGQEIGFTMDEVDSLLSRYAEKALDFPYPQREKRSDSVIHLQEIVHQAADPETLPRSPSAEFSPAAPPGISSIHSPSLRERSFPPTQPSQEFVPPATPPARHQWVPDETESICMVCCREHFTMFNRRHHCRRCGRLVCSSCSTKKMVVEGCRENPARVCDQCYSYCNKDVPEEPSEKPEALDSSKNESPPYSFVVRVPKADEVEWILDLKEEENELVRSEFYYEQAPSASLCIAILNLHRDSIACGHQLIEHCCRLSKGLTNPEVDAGLLTDIMKQLLFSAKMMFVKAGQSQDLALCDSYISKVDVLNILVAAAYRHVPSLDQILQPAAVTRLRNQLLEAEYYQLGVEVSTKTGLDTTGAWHAWGMACLKAGNLTAAREKFSRCLKPPFDLNQLNHGSRLVQDVVEYLESTVRPFVSLQDDDYFATLRELEATLRTQSLSLAVIPEGKIMNNTYYQECLFYLHNYSTNLAIISFYVRHSCLREALLHLLNKVGHGHSSKRQCLPYSSGLDHSALSGTITP

SEQ ID NO: 102078 - protein, 327 aa, Homo sapiens
  Payload ID: 20342
  Gene Name: zinc finger, FYVE domain containing 26
  ENSP ID: ENSP00000452142
MNNTYYQECLFYLHNYSTNLAIISFYVRHSCLREALLHLLNKESPPEVFIEGIFQPSYKSGKLHTLENLLESIDPTLESWGKYLIAACQHLQKKNYYHILYELQQFMKDQVRAAMTCIRFFSHKAKSYTELGEKLSWLLKAKDHLKIYLQETSRSSGRKKTTFFRKKMTAADVSRHMNTLQLQMEVTRFLHRCESAGTSQITTLPLPTLFGNNHMKMDVACKVMLGGKNVEDGFGIAFRVLQDFQLDAAMTYCRAARQLVEKEKYSEIQQLLKCVSESGMAAKSDGDTILLNCLEAFKRIPPQELEGLIQAIHNDDNKVSGIVSKRW

SEQ ID NO: 102079 - protein, 372 aa, Homo sapiens
  Payload ID: 20343
  Gene Name: zinc finger, FYVE domain containing 27
  Uniprot ID: Q5T4F4
  ENSP ID: ENSP00000337993
MQTSEREGSGPELSPSVMPEAPLESPPFPTKSPAFDLFNLVLSYKRLEIYLEPLKDAGAWYSVGALMISVPALLGYLQEVCRARLPDSELMRRKYHSVRQEDLQRGRLSRPEAVAEVKSFLIQLEAFLSRLCCTCEAAYRVLHWENPVVSSQFYGALLGTVCMLYLLPLCWVLTLLNSTLFLGNVEFFRVVSEYRASLQQRMNPKQEEHAFESPPPPDVGGKDGLMDSTPALTPTEDLTPGSVEEAEEAEPDEEFKDAIEEDDEGAPCPAEDELALQDNGFLSKNEVLRSKVSRLTERLRKRYPTNNFGNCTGCSATFSVLKKRRSCSNCGNSFCSRCCSFKVPKSSMGATAPEAQRETVFVCASCNQTLSK

SEQ ID NO: 102080 - protein, 318 aa, Homo sapiens
  Payload ID: 20343
  Gene Name: zinc finger, FYVE domain containing 27
  Uniprot ID: Q5T4F4
  ENSP ID: ENSP00000350148
MQTSEREGSGPELSPSVMPEAPLESPPFPTKSPAFDLFNLVLSYKRLEIYLEPLKDAGDGVRYLLSLIQLEAFLSRLCCTCEAAYRVLHWENPVVSSQFYGALLGTVCMLYLLPLCWVLTLLNSTLFLGNVEFFRVVSEYRASLQQRMNPKQEEHAFESPPPPDVGGKDGLMDSTPALTPTEDLTPGSVEEAEEAEPDEEFKDAIEEDDEGAPCPAEDELALQDNGFLSKNEVLRSKVSRLTERLRKRYPTNNFGNCTGCSATFSVLKKRRSCSNCGNSFCSRCCSFKVPKSSMGATAPEAQRETVFVCASCNQTLSK

SEQ ID NO: 102081 - protein, 404 aa, Homo sapiens
  Payload ID: 20343
  Gene Name: zinc finger, FYVE domain containing 27
  Uniprot ID: Q5T4F4
  ENSP ID: ENSP00000353069
MQTSEREGSGPELSPSVMPEAPLESPPFPTKSPAFDLFNLVLSYKRLEIYLEPLKDAGDGVRYLLRWQMPLCSLLTCLGLNVLFLTLNEGAWYSVGALMISVPALLGYLQEVCRARLPDSELMRRKYHSVRQEDLQRGRLSRPEAVAEVKSFLIQLEAFLSRLCCTCEAAYRVLHWENPVVSSQFYGALLGTVCMLYLLPLCWVLTLLNSTLFLGNVEFFRVVSEYRASLQQRMNPKQEEHAFESPPPPDVGGKDGLMDSTPALTPTEDLTPGSVEEAEEAEPDEEFKDAIEEDDEGAPCPAEDELALQDNGFLSKNEVLRSKVSRLTERLRKRYPTNNFGNCTGCSATFSVLKKRRSCSNCGNSFCSRCCSFKVPKSSMGATAPEAQRETVFVCASCNQTLSK

SEQ ID NO: 102082 - protein, 311 aa, Homo sapiens
  Payload ID: 20343
  Gene Name: zinc finger, FYVE domain containing 27
  Uniprot ID: Q5T4F4
  ENSP ID: ENSP00000359642
MISVPALLGYLQEVCRARLPDSELMRRKYHSVRQEDLQRGRLSRPEAVAEVKSFLIQLEAFLSRLCCTCEAAYRVLHWENPVVSSQFYGALLGTVCMLYLLPLCWVLTLLNSTLFLGNVEFFRVVSEYRASLQQRMNPKQEEHAFESPPPPDVGGKDGLMDSTPALTPTESLSSQDLTPGSVEEAEEAEPDEEFKDAIEEDDEGAPCPAEDELALQDNGFLSKNEVLRSKVSRLTERLRKRYPTNNFGNCTGCSATFSVLKKRRSCSNCGNSFCSRCCSFKVPKSSMGATAPEAQRETVFVCASCNQTLSK

SEQ ID NO: 102083 - protein, 286 aa, Homo sapiens
  Payload ID: 20343
  Gene Name: zinc finger, FYVE domain containing 27
  Uniprot ID: Q5T4F4
  ENSP ID: ENSP00000359646
MQTSEREGSGPELSPSVMPEAPLESPPFPTKSPAFDLFNLVLSYKRLEIYLEPLKDAGDGVRYLLRFYGALLGTVCMLYLLPLCWVLTLLNSTLFLGNVEFFRVVSEYRASLQQRMNPKQEEHAFESPPPPDVGGKDGLMDSTPALTPTEDLTPGSVEEAEEAEPDEEFKDAIEEDDEGAPCPAEDELALQDNGFLSKNEVLRSKVSRLTERLRKRYPTNNFGNCTGCSATFSVLKKRRSCSNCGNSFCSRCCSFKVPKSSMGATAPEAQRETVFVCASCNQTLSK

SEQ ID NO: 102084 - protein, 411 aa, Homo sapiens
  Payload ID: 20343
  Gene Name: zinc finger, FYVE domain containing 27
  Uniprot ID: Q5T4F4
  ENSP ID: ENSP00000377282
MQTSEREGSGPELSPSVMPEAPLESPPFPTKSPAFDLFNLVLSYKRLEIYLEPLKDAGDGVRYLLRWQMPLCSLLTCLGLNVLFLTLNEGAWYSVGALMISVPALLGYLQEVCRARLPDSELMRRKYHSVRQEDLQRGRLSRPEAVAEVKSFLIQLEAFLSRLCCTCEAAYRVLHWENPVVSSQFYGALLGTVCMLYLLPLCWVLTLLNSTLFLGNVEFFRVVSEYRASLQQRMNPKQEEHAFESPPPPDVGGKDGLMDSTPALTPTEDLTPGSVEEAEEAEPDEEFKDAIEETHLVVLEDDEGAPCPAEDELALQDNGFLSKNEVLRSKVSRLTERLRKRYPTNNFGNCTGCSATFSVLKKRRSCSNCGNSFCSRCCSFKVPKSSMGATAPEAQRETVFVCASCNQTLSK

SEQ ID NO: 102085 - protein, 416 aa, Homo sapiens
  Payload ID: 20343
  Gene Name: zinc finger, FYVE domain containing 27
  Uniprot ID: Q5T4F4
  ENSP ID: ENSP00000409594
MQTSEREGSGPELSPSVMPEAPLESPPFPTKSPAFDLFNLVLSYKRLEIYLEPLKDAGDGVRYLLRWQMPLCSLLTCLGLNVLFLTLNEGAWYSVGALMISVPALLGYLQEVCRARLPDSELMRRKYHSVRQEDLQRGRLSRPEAVAEVKSFLIQLEAFLSRLCCTCEAAYRVLHWENPVVSSQFYGALLGTVCMLYLLPLCWVLTLLNSTLFLGNVEFFRVVSEYRASLQQRMNPKQEEHAFESPPPPDVGGKDGLMDSTPALTPTESLSSQDLTPGSVEEAEEAEPDEEFKDAIEETHLVVLEDDEGAPCPAEDELALQDNGFLSKNEVLRSKVSRLTERLRKRYPTNNFGNCTGCSATFSVLKKRRSCSNCGNSFCSRCCSFKVPKSSMGATAPEAQRETVFVCASCNQTLSK

SEQ ID NO: 102086 - protein, 887 aa, Homo sapiens
  Payload ID: 20344
  Gene Name: zinc finger, FYVE domain containing 28
  Uniprot ID: Q9HCC9
  ENSP ID: ENSP00000290974
MMNRFRKWLYKPKRSDPQLLARFYYADEELNQVAAELDSLDGRKDPQRCTLLVSQFRSCQDNVLNIINQIMDECIPQDRAPRDFCVKFPEEIRHDNLAGQLWFGAECLAAGSIIMNRELESMAMRPLAKELTRSLEDVRGALRDQALRDLNTYTEKMREALRHFDVLFAEFELSYVSAMVPVKSPREYYVQQEVIVLFCETVERALDFGYLTQDMIDDYEPALMFSIPRLAIVCGLVVYADGPLNLDRKVEDMSELFRPFHTLLRKIRDLLQTLTEEELHTLERNLCISQDVEFPIRADVQGPAALAPALSAPLPPEGPLSAKAKDPDAELACSMQYDDQELEQLSRMVHRAGDEMSSLLSPPIACQSPAHRPGAEGSPGGEASPGRPRLRSGSDEEERVFFMDDVEGTAEALARPESPAGPFGWAGSTWADPQEKGQGGPGGAAGISLPASEKEEDLSNNNLEAEGTDGASLAGTSSCSCLDSRLHLDGWEVGADDAETAEMIAHRTGGMKLSATVIFNPKSPTSLDSAVATQEAASEPVAEGMDGGPHKLSTGATNCLLHSCVCCGSCGDSREDVVERLREKCSPGGVIGASYAAGLAKASDRAPERQEEAPPPSEDASNGREPKAPTSDKCLPHTSGSQVDTASGLQGEAGVAGQQEPEARELHAGSPSAHEAPQALSGSSSSTAGSCSSDKMGPEAAPAATHAAPQATREKIRSRFHGSHDLIHRLFVCISGVADQLQTNYASDLRSILKTLFEVMATKPETDDKEKLRKVTQTLRSAALEDCALCQETLSSSELAAKTRDGDFEDPPEWVPDEACGFCTACKAPFTVIRRKHHCRSCGKIFCSRCSSHSAPLPRYGQVKPVRVCTHCYMFHVTPFYSDKAGL

SEQ ID NO: 102087 - protein, 172 aa, Homo sapiens
  Payload ID: 20344
  Gene Name: zinc finger, FYVE domain containing 28
  Uniprot ID: Q9HCC9
  ENSP ID: ENSP00000422638
MMNRFRKWLYKPKDNVLNIINQIMDECIPQDRAPRDFCVKFPEEIRHDNLAGQLWFGAECLAAGSIIMNRELESMAMRPLAKELTRSLEDVRGALRDQALRDLNTYTEKMREALRHFDVLFAEFELSYVSAMVPVKSPREYYVQQEVIVLFCETVERNGKGVLKFMWNCNGP

SEQ ID NO: 102088 - protein, 287 aa, Homo sapiens
  Payload ID: 20344
  Gene Name: zinc finger, FYVE domain containing 28
  Uniprot ID: Q9HCC9
  ENSP ID: ENSP00000423694
MMNRFRKWLYKPKRSDPQLLARFYYADEELNQVAAELDSLDGRKDPQRCTLLVSQFRSCQDNVLNIINQIMDECIPQDRAPRDFCVKFPEEIRHDNLAGQLWFGAECLAAGSIIMNRELESMAMRPLAKELTRSLEDVRGALRDQALRDLNTYTEKMREALRHFDVLFAEFELSYVSAMVPVKSPREYYVQQEVIVLFCETVERALDFGYLTQDMIDDYEPALMFSIPRLAIVCPLLPAHPRTRAGATAHVACRMVAGSSSGALTHPPVSKQGVISALLRPLPELPP

SEQ ID NO: 102089 - protein, 857 aa, Homo sapiens
  Payload ID: 20344
  Gene Name: zinc finger, FYVE domain containing 28
  Uniprot ID: Q9HCC9
  ENSP ID: ENSP00000425706
MMNRFRKWLYKPKRSDPQLLARFYYADEELNQVAAELDSLDGRKDPQRCTLLVSQFRSCQDNVLNIINQIMDECIPQDRAPRDFCVKFPEEIRHDNLAGQLWFGAECLAAGSIIMNRELESMAMRPLAKELTRSLEDVRGALRDQALRDLNTYTEKMREALRHFDVLFAEFELSYVSAMVPVKSPREYYVQQEVIVLFCETVESGLVVYADGPLNLDRKVEDMSELFRPFHTLLRKIRDLLQTLTEEELHTLERNLCISQDVEFPIRADVQGPAALAPALSAPLPPEGPLSAKAKDPDAELACSMQYDDQELEQLSRMVHRAGDEMSSLLSPPIACQSPAHRPGAEGSPGGEASPGRPRLRSGSDEEERVFFMDDVEGTAEALARPESPAGPFGWAGSTWADPQEKGQGGPGGAAGISLPASEKEEDLSNNNLEAEGTDGASLAGTSSCSCLDSRLHLDGWEVGADDAETAEMIAHRTGGMKLSATVIFNPKSPTSLDSAVATQEAASEPVAEGMDGGPHKLSTGATNCLLHSCVCCGSCGDSREDVVERLREKCSPGGVIGASYAAGLAKASDRAPERQEEAPPPSEDASNGREPKAPTSDKCLPHTSGSQVDTASGLQGEAGVAGQQEPEARELHAGSPSAHEAPQALSGSSSSTAGSCSSDKMGPEAAPAATHAAPQATREKIRSRFHGSHDLIHRLFVCISGVADQLQTNYASDLRSILKTLFEVMATKPETDDKEKLRKVTQTLRSAALEDCALCQETLSSSELAAKTRDGDFEDPPEWVPDEACGFCTACKAPFTVIRRKHHCRSCGKIFCSRCSSHSAPLPRYGQVKPVRVCTHCYMFHVTPFYSDKAGL

SEQ ID NO: 102090 - protein, 163 aa, Homo sapiens
  Payload ID: 20344
  Gene Name: zinc finger, FYVE domain containing 28
  Uniprot ID: Q9HCC9
  ENSP ID: ENSP00000425766
MDECIPQDRAPRDFCVKFPEEIRHDNLAGQLWFGAECLAAGSIIMNRELESMAMRPLAKELTRSLEDVRGALRDQALRDLNTYTEKMREALRHFDVLFAEFELSYVSAMVPVKSPREYYVQQEVIVLFCETVERALDFGYLTQDMIDDYEPALMFSIPRLAIV

SEQ ID NO: 102091 - protein, 817 aa, Homo sapiens
  Payload ID: 20344
  Gene Name: zinc finger, FYVE domain containing 28
  Uniprot ID: Q9HCC9
  ENSP ID: ENSP00000426299
MDECIPQDRAPRDFCVKFPEEIRHDNLAGQLWFGAECLAAGSIIMNRELESMAMRPLAKELTRSLEDVRGALRDQALRDLNTYTEKMREALRHFDVLFAEFELSYVSAMVPVKSPREYYVQQEVIVLFCETVERALDFGYLTQDMIDDYEPALMFSIPRLAIVCGLVVYADGPLNLDRKVEDMSELFRPFHTLLRKIRDLLQTLTEEELHTLERNLCISQDVEFPIRADVQGPAALAPALSAPLPPEGPLSAKAKDPDAELACSMQYDDQELEQLSRMVHRAGDEMSSLLSPPIACQSPAHRPGAEGSPGGEASPGRPRLRSGSDEEERVFFMDDVEGTAEALARPESPAGPFGWAGSTWADPQEKGQGGPGGAAGISLPASEKEEDLSNNNLEAEGTDGASLAGTSSCSCLDSRLHLDGWEVGADDAETAEMIAHRTGGMKLSATVIFNPKSPTSLDSAVATQEAASEPVAEGMDGGPHKLSTGATNCLLHSCVCCGSCGDSREDVVERLREKCSPGGVIGASYAAGLAKASDRAPERQEEAPPPSEDASNGREPKAPTSDKCLPHTSGSQVDTASGLQGEAGVAGQQEPEARELHAGSPSAHEAPQALSGSSSSTAGSCSSDKMGPEAAPAATHAAPQATREKIRSRFHGSHDLIHRLFVCISGVADQLQTNYASDLRSILKTLFEVMATKPETDDKEKLRKVTQTLRSAALEDCALCQETLSSSELAAKTRDGDFEDPPEWVPDEACGFCTACKAPFTVIRRKHHCRSCGKIFCSRCSSHSAPLPRYGQVKPVRVCTHCYMFHVTPFYSDKAGL

SEQ ID NO: 102092 - protein, 82 aa, Homo sapiens
  Payload ID: 20344
  Gene Name: zinc finger, FYVE domain containing 28
  ENSP ID: ENSP00000427471
MDECIPQDRAPRDFCVKFPEEIRHDNLAGQLWFGAECLAAGSIIMNRELESMAMRPLAKELTRSLEDVRGALRDQALRDLNT

SEQ ID NO: 102093 - protein, 192 aa, Homo sapiens
  Payload ID: 20344
  Gene Name: zinc finger, FYVE domain containing 28
  ENSP ID: ENSP00000427654
MGPEAAPAATHAAPQATREKIRSRFHGSHDLIHRLFVCISGVADQLQTNYASDLRSILKTLFEVMATKPETDDKEKLRKVTQTLRSAALEDCALCQETLSSSELAAKTRDGDFEDPPEWVPDEACGFCTACKAPFTVIRRKHHCRSCGKIFCSRCSSHSAPLPRYGQVKPVRVCTHCYMFHVTPFYSDKAGL

SEQ ID NO: 102094 - protein, 1425 aa, Homo sapiens
  Payload ID: 20345
  Gene Name: zinc finger, FYVE domain containing 9
  Uniprot ID: O95405
  ENSP ID: ENSP00000287727
MENYFQAEAYNLDKVLDEFEQNEDETVSSTLLDTKWNKILDPPSHRLSFNPTLASVNESAVSNESQPQLKVFSLAHSAPLTTEEEDHCANGQDCNLNPEIATMWIDENAVAEDQLIKRNYSWDDQCSAVEVGEKKCGNLACLPDEKNVLVVAVMHNCDKRTLQNDLQDCNNYNSQSLMDAFSCSLDNENRQTDQFSFSINESTEKDMNSEKQMDPLNRPKTEGRSVNHLCPTSSDSLASVCSPSQLKDDGSIGRDPSMSAITSLTVDSVISSQGTDGCPAVKKQENYIPDEDLTGKISSPRTDLGSPNSFSHMSEGILMKKEPAEESTTEESLRSGLPLLLKPDMPNGSGRNNDCERCSDCLVPNEVRADENEGYEHEETLGTTEFLNMTEHFSESQDMTNWKLTKLNEMNDSQVNEEKEKFLQISQPEDTNGDSGGQCVGLADAGLDLKGTCISESEECDFSTVIDTPAANYLSNGCDSYGMQDPGVSFVPKTLPSKEDSVTEEKEIEESKSECYSNIYEQRGNEATEGSGLLLNSTGDLMKKNYLHNFCSQVPSVLGQSSPKVVASLPSISVPFGGARPKQPSNLKLQIPKPLSDHLQNDFPANSGNNTKNKNDILGKAKLGENSATNVCSPSLGNISNVDTNGEHLESYEAEISTRPCLALAPDSPDNDLRAGQFGISARKPFTTLGEVAPVWVPDSQAPNCMKCEARFTFTKRRHHCRACGKVFCASCCSLKCKLLYMDRKEARVCVICHSVLMNAQAWENMMSASSQSPNPNNPAEYCSTIPPLQQAQASGALSSPPPTVMVPVGVLKHPGAEVAQPREQRRVWFADGILPNGEVADAAKLTMNGTSSAGTLAVSHDPVKPVTTSPLPAETDICLFSGSITQVGSPVGSAMNLIPEDGLPPILISTGVKGDYAVEEKPSQISVMQQLEDGGPDPLVFVLNANLLSMVKIVNYVNRKCWCFTTKGMHAVGQSEIVILLQCLPDEKCLPKDIFNHFVQLYRDALAGNVVSNLGHSFFSQSFLGSKEHGGFLYVTSTYQSLQDLVLPTPPYLFGILIQKWETPWAKVFPIRLMLRLGAEYRLYPCPLFSVRFRKPLFGETGHTIMNLLADFRNYQYTLPVVQGLVVDMEVRKTSIKIPSNRYNEMMKAMNKSNEHVLAGGACFNEKADSHLVCVQNDDGNYQTQAISIHNQPRKVTGASFFVFSGALKSSSGYLAKSSIVEDGVMVQITAENMDSLRQALREMKDFTITCGKADAEEPQEHIHIQWVDDDKNVSKGVVSPIDGKSMETITNVKIFHGSEYKANGKVIRWTEVFFLENDDQHNCLSDPADHSRLTEHVAKAFCLALCPHLKLLKEDGMTKLGLRVTLDSDQVGYQAGSNGQPLPSQYMNDLDSALVPVIHGGACQLSEGPVVMELIFYILENIV

SEQ ID NO: 102095 - protein, 1366 aa, Homo sapiens
  Payload ID: 20345
  Gene Name: zinc finger, FYVE domain containing 9
  Uniprot ID: O95405
  ENSP ID: ENSP00000349737
MENYFQAEAYNLDKVLDEFEQNEDETVSSTLLDTKWNKILDPPSHRLSFNPTLASVNESAVSNESQPQLKVFSLAHSAPLTTEEEDHCANGQDCNLNPEIATMWIDENAVAEDQLIKRNYSWDDQCSAVEVGEKKCGNLACLPDEKNVLVVAVMHNCDKRTLQNDLQDCNNYNSQSLMDAFSCSLDNENRQTDQFSFSINESTEKDMNSEKQMDPLNRPKTEGRSVNHLCPTSSDSLASVCSPSQLKDDGSIGRDPSMSAITSLTVDSVISSQGTDGCPAVKKQENYIPDEDLTGKISSPRTDLGSPNSFSHMSEGILMKKEPAEESTTEESLRSGLPLLLKPDMPNGSGRNNDCERCSDCLVPNEVRADENEGYEHEETLGTTEFLNMTEHFSESQDMTNWKLTKLNEMNDSQVNEEKEKFLQISQPEDTNGDSGGQCVGLADAGLDLKGTCISESEECDFSTVIDTPAANYLSNGCDSYGMQDPGVSFVPKTLPSKEDSVTEEKEIEESKSECYSNIYEQRGNEATEGSGLLLNSTGDLMKKNYLHNFCSQVPSVLGQSSPKVVASLPSISVPFGGARPKQPSNLKLQIPKPLSDHLQNDFPANSGNNTKNKNDILGKAKLGENSATNVCSPSLGNISNVDTNGEHLESYEAEISTRPCLALAPDSPDNDLRAGQFGISARKPFTTLGEVAPVWVPDSQAPNCMKCEARFTFTKRRHHCRACGKVFCASCCSLKCKLLYMDRKEARVCVICHSVLMNVAQPREQRRVWFADGILPNGEVADAAKLTMNGTSSAGTLAVSHDPVKPVTTSPLPAETDICLFSGSITQVGSPVGSAMNLIPEDGLPPILISTGVKGDYAVEEKPSQISVMQQLEDGGPDPLVFVLNANLLSMVKIVNYVNRKCWCFTTKGMHAVGQSEIVILLQCLPDEKCLPKDIFNHFVQLYRDALAGNVVSNLGHSFFSQSFLGSKEHGGFLYVTSTYQSLQDLVLPTPPYLFGILIQKWETPWAKVFPIRLMLRLGAEYRLYPCPLFSVRFRKPLFGETGHTIMNLLADFRNYQYTLPVVQGLVVDMEVRKTSIKIPSNRYNEMMKAMNKSNEHVLAGGACFNEKADSHLVCVQNDDGNYQTQAISIHNQPRKVTGASFFVFSGALKSSSGYLAKSSIVEDGVMVQITAENMDSLRQALREMKDFTITCGKADAEEPQEHIHIQWVDDDKNVSKGVVSPIDGKSMETITNVKIFHGSEYKANGKVIRWTEVFFLENDDQHNCLSDPADHSRLTEHVAKAFCLALCPHLKLLKEDGMTKLGLRVTLDSDQVGYQAGSNGQPLPSQYMNDLDSALVPVIHGGACQLSEGPVVMELIFYILENIV

SEQ ID NO: 102096 - protein, 1425 aa, Homo sapiens; identical to SEQ ID NO: 102094
  Payload ID: 20345
  Gene Name: zinc finger, FYVE domain containing 9
  Uniprot ID: O95405
  ENSP ID: ENSP00000360647

SEQ ID NO: 102097 - protein, 271 aa, Homo sapiens
  Payload ID: 20346
  Gene Name: zinc finger, GATA-like protein 1
  Uniprot ID: P0C6A0
  ENSP ID: ENSP00000384434
MTEPQVGCVACPRVHKEPAQVGTPWPAKPRSHPRKRDPTALLPRSLWPACQESVTALCFLQETVERLGQSPAQDTPVLGPCWDPMALGTQGRLLLDRDSKDTQTRISQKGRRLQPPGTPSAPPQRRPRKQLNPCRGTERVDPGFEGVTLKFQIKPDSSLQIIPTYSLPCSSRSQESPADAVGGPAAHPGGTEAHSAGSEALEPRRCASCRTQRTPLWRDAEDGTPLCNACGIRYKKYGTRCSSCWLVPRKNVQPKRLCGRCGVSLDPIQEG

SEQ ID NO: 102098 - protein, 187 aa, Homo sapiens
  Payload ID: 20346
  Gene Name: zinc finger, GATA-like protein 1
  ENSP ID: ENSP00000385403
MALGTQGRLLLDRDSKDTQTRISQKGRRLQPPGTPSAPPQRRPRKQLNPCRGTERVDPGFEGVTLKFQIKPDSSLQIIPTYSLPCSSRSQESPADAVGGPAAHPGGTEAHSAGSEALEPRRCASCRTQRTPLWRDAEDGTPLCNACGIRYKKYGTRCSSCWLVPRKNVQPKRLCGRCGVSLDPIQEG

SEQ ID NO: 102099 - protein, 1062 aa, Homo sapiens
  Payload ID: 20347
  Gene Name: zinc finger, GRF-type containing 1
  Uniprot ID: Q86YA3
  ENSP ID: ENSP00000309095
MESQEFIVLYTHQKMKKSKVWQDGILKITHLGNKAILYDDKGACLESLFLKCLEVKPGDDLESDRYLITVEEVKVAGAIGIVKQNVNKEAPELNSRTFISSGRSLGCQPSGLKRKFTGFQGPRQVPKKMVIMESGESAASHEAKKTGPTIFSPFCSMPPLFPTVGKKDVNNILADPENIVTYKNRERNAMDFSSVFSPSFQINPEVLCEENYFCSPVNSGNKLSDSLLTNEPVKRDSLASHYSGVSQNIRSKAQILALLKSESSSSCEELNSEMTEHFPQKQPQGSLKIATKPKYLIQQEECAEMKSTENLYYQHQSENTMRNKSRWAMYLSSQSSPIHSSTVDGNDTERKPKAQEDDVNSNLKDLSLQKIIQFVETYAEERKKYNVDQSVGNNDPSWNQEVKLEIPSFNESSSLQVTCSSAENDGILSESDIQEDNKIPFNQNDKGCIKGSVLIKENAQEVNTCGTLEKEYEQSESSLPELKHLQIESSNNSRISDDITDMISESKMDNESLNSIHESLSNVTQPFLEVTFNLNNFETSDTEEESQESNKISQDSESWVKDILVNDGNSCFQKRSENTNCEEIEGEHLPFLTSVSDKPTVTFPVKETLPSQFCDKTYVGFDMGICKTENTGKEIEEYSDTLSNFESFKWTDAVYGDNKEDANKPIQEVRINYDFALPPNKSKGINMNLHIPHIQNQIAENSNLFSEDAQPQPFILGSDLDKNDEHVLPSTSSSDNSVQLLNTNQNHYECIALDKSNTHISNSLFYPLGKKHLISKDTEAHISEPEDLGKIRSPPPDHVEVETAREGKQYWNPRNSSELSGLVNTISILKSLCEHSTALDSLEILKKKNTVFQQGTQQTYEPDSPPEVRKPFITVVSPKSPHLHKDSQQILKEDEVELSEPLQSVQFSSSGSKEETAFQAVIPKQIERKTCDPKPVEFQGHQVKGSATSGVMVRGHSSQLGCSQFPDSTEYENFMTETPELPSTCMQIDFLQVTSPEENISTLSPVSTFSLNSRDEDFMVEFSETSLKARTLPDDLHFLNLEGSRYHIALISVYSFKMKFFI

SEQ ID NO: 102100 - protein, 2104 aa, Homo sapiens
  Payload ID: 20347
  Gene Name: zinc finger, GRF-type containing 1
  Uniprot ID: Q86YA3
  ENSP ID: ENSP00000390505
MESQEFIVLYTHQKMKKSKVWQDGILKITHLGNKAILYDDKGACLESLFLKCLEVKPGDDLESDRYLITVEEVKVAGAIGIVKQNVNKEAPELNSRTFISSGRSLGCQPSGLKRKFTGFQGPRQVPKKMVIMESGESAASHEAKKTGPTIFSPFCSMPPLFPTVGKKDVNNILADPENIVTYKNRERNAMDFSSVFSPSFQINPEVLCEENYFCSPVNSGNKLSDSLLTNEPVKRDSLASHYSGVSQNIRSKAQILALLKSESSSSCEELNSEMTEHFPQKQPQGSLKIATKPKYLIQQEECAEMKSTENLYYQHQSENTMRNKSRWAMYLSSQSSPIHSSTVDGNDTERKPKAQEDDVNSNLKDLSLQKIIQFVETYAEERKKYNVDQSVGNNDPSWNQEVKLEIPSFNESSSLQVTCSSAENDGILSESDIQEDNKIPFNQNDKGCIKGSVLIKENAQEVNTCGTLEKEYEQSESSLPELKHLQIESSNNSRISDDITDMISESKMDNESLNSIHESLSNVTQPFLEVTFNLNNFETSDTEEESQESNKISQDSESWVKDILVNDGNSCFQKRSENTNCEEIEGEHLPFLTSVSDKPTVTFPVKETLPSQFCDKTYVGFDMGICKTENTGKEIEEYSDTLSNFESFKWTDAVYGDNKEDANKPIQEVRINYDFALPPNKSKGINMNLHIPHIQNQIAENSNLFSEDAQPQPFILGSDLDKNDEHVLPSTSSSDNSVQLLNTNQNHYECIALDKSNTHISNSLFYPLGKKHLISKDTEAHISEPEDLGKIRSPPPDHVEVETAREGKQYWNPRNSSELSGLVNTISILKSLCEHSTALDSLEILKKKNTVFQQGTQQTYEPDSPPEVRKPFITVVSPKSPHLHKDSQQILKEDEVELSEPLQSVQFSSSGSKEETAFQAVIPKQIERKTCDPKPVEFQGHQVKGSATSGVMVRGHSSQLGCSQFPDSTEYENFMTETPELPSTCMQIDFLQVTSPEENISTLSPVSTFSLNSRDEDFMVEFSETSLKARTLPDDLHFLNLEGMKKSRSLENENLQRLSLLSRTQVPLITLPRTDGPPDLDSHSYMINSNTYESSGSPMLNLCEKSAVLSFSIEPEDQNETFFSEESREVNPGDVSLNNISTQSKWLKYQNTSQCNVATPNRVDKRITDGFFAEAVSGMHFRDTSERQSDAVNESSLDSVHLQMIKGMLYQQRQDFSSQDSVSRKKVLSLNLKQTSKTEEIKNVLGGSTCYNYSVKDLQEISGSELCFPSGQKIKSAYLPQRQIHIPAVFQSPAHYKQTFTSCLIEHLNILLFGLAQNLQKALSKVDISFYTSLKGEKLKNAENNVPSCHHSQPAKLVMVKKEGPNKGRLFYTCDGPKADRCKFFKWLEDVTPGYSTQEGARPGMVLSDIKSIGLYLRSQKIPLYEECQLLVRKGFDFQRKQYGKLKKFTTVNPEFYNEPKTKLYLKLSRKERSSAYSKNDLWVVSKTLDFELDTFIACSAFFGPSSINEIEILPLKGYFPSNWPTNMVVHALLVCNASTELTTLKNIQDYFNPATLPLTQYLLTTSSPTIVSNKRVSKRKFIPPAFTNVSTKFELLSLGATLKLASELIQVHKLNKDQATALIQIAQMMASHESIEEVKELQTHTFPITIIHGVFGAGKSYLLAVVILFFVQLFEKSEAPTIGNARPWKLLISSSTNVAVDRVLLGLLSLGFENFIRVGSVRKIAKPILPYSLHAGSENESEQLKELHALMKEDLTPTERVYVRKSIEQHKLGTNRTLLKQVRVVGVTCAACPFPCMNDLKFPVVVLDECSQITEPASLLPIARFECEKLILVGDPKQLPPTIQGSDAAHENGLEQTLFDRLCLMGHKPILLRTQYRCHPAISAIANDLFYKGALMNGVTEIERSPLLEWLPTLCFYNVKGLEQIERDNSFHNVAEATFTLKLIQSLIASGIAGSMIGVITLYKSQMYKLCHLLSAVDFHHPDIKTVQVSTVDAFQGAEKEIIILSCVRTRQVGFIDSEKRMNVALTRGKRHLLIVGNLACLRKNQLWGRVIQHCEGREDGLQHANQYEPQLNHLLKDYFEKQVEEKQKKKSEKEKSKDKSHS

SEQ ID NO: 102101 - protein, 681 aa, Homo sapiens
  Payload ID: 20347
  Gene Name: zinc finger, GRF-type containing 1
  ENSP ID: ENSP00000404365
CEKSAVLSFSIEPEDQNETFFSEESREVNPGDVSLNNISTQSKWLKYQNTSQCNVATPNRVDKRITDGFFAEAVSGMHFRDTSERQSDAVNESSLDSVHLQMIKGMLYQQRQDFSSQDSVSRKKVLSLNLKQTSKTEEIKNVLGGSTCYNYSVKDLQEISGSELCFPSGQKIKSAYLPQRQIHIPAVFQSPAHYKQTFTSCLIEHLNILLFGLAQNLQKALSKVDISFYTSLKGEKLKNAENNVPSCHHSQPAKLVMVKKEGPNKGRLFYTCDGPKADRCKFFKWLEDVTPGYSTQEGARPGMVLSDIKSIGLYLRSQKIPLYEECQLLVRKGFDFQRKQYGKLKKFTTVNPEFYNEPKTKLYLKLSRKERSSAYSKNDLWVVSKTLDFELDTFIACSAFFGPSSINEIEILPLKGYFPSNWPTNMVVHALLVCNASTELTTLKNIQDYFNPATLPLTQYLLTTSSPTIVSNKRVSKRKFIPPAFTNVSTKFELLSLGATLKLASELIQVHKLNKDQATALIQIAQMMASHESIEEVKELQTHTFPITIIHGVFGAGKSYLLAVVILFFVQLFEKSEAPTIGNARPWKLLISSSTNVAVDRVLLGLLSLGFENFIRVGSVRKIAKPILPYSLHAGSENESEQLKELHALMKEDLTPTERVYVRKSIEQHKLGTNRTLLKQV

SEQ ID NO: 102102 - protein, 61 aa, Homo sapiens
  Payload ID: 20347
  Gene Name: zinc finger, GRF-type containing 1
  ENSP ID: ENSP00000424429
MESQEFIVLYTHQKMKKSKVWQDGILKITHLGNKTESCSVAQAGVQWHSLGSLQPLHPRFK

SEQ ID NO: 102103 - protein, 2104 aa, Homo sapiens; identical to SEQ ID NO: 102100
  Payload ID: 20347
  Gene Name: zinc finger, GRF-type containing 1
  Uniprot ID: Q86YA3
  ENSP ID: ENSP00000424737

SEQ ID NO: 102104 - protein, 38 aa, Homo sapiens
  Payload ID: 20347
  Gene Name: zinc finger, GRF-type containing 1
  ENSP ID: ENSP00000424946
MESQEFIVLYTHQKMKKSKVWQDGILKITHLGNKIQCL

SEQ ID NO: 102105 - protein, 174 aa, Homo sapiens
  Payload ID: 20347
  Gene Name: zinc finger, GRF-type containing 1
  ENSP ID: ENSP00000424995
MESQEFIVLYTHQKMKKSKVWQDGILKITHLGNKAILYDDKGACLESLFLKCLEVKPGDDLESDRYLITVEEVKVAGAIGIVKQNVNKEAPELNSRTFISSGRSLGCQPSGLKRKFTGFQGPRQVPKKMVIMESGESAASHEAKKTGPTIFSPFCSMPPLFPTVGKKDVNNILA

SEQ ID NO: 102106 - protein, 935 aa, Homo sapiens
  Payload ID: 20347
  Gene Name: zinc finger, GRF-type containing 1
  ENSP ID: ENSP00000426938
MESQEFIVLYTHQKMKKSKVWQDGILKITHLGNKAILYDDKGACLESLFLKCLEVKPGDDLESDRYLITVEEVKVAGAIGIVKQNVNKEAPELNSRTFISSGRSLGCQPSGLKRKFTGFQGPRQVPKKMVIMESGESAASHEAKKTGPTIFSPFCSMPPLFPTVGKKDVNNILADPENIVTYKNRERNAMDFSSVFSPSFQINPEVLCEENYFCSPVNSGNKLSDSLLTNEPVKRDSLASHYSGVSQNIRSKAQILALLKSESSSSCEELNSEMTEHFPQKQPQGSLKIATKPKYLIQQEECAEMKSTENLYYQHQSENTMRNKSRWAMYLSSQSSPIHSSTVDGNDTERKPKAQEDDVNSNLKDLSLQKIIQFVETYAEERKKYNVDQSVGNNDPSWNQEVKLEIPSFNESSSLQVTCSSAENDGILSESDIQEDNKIPFNQNDKGCIKGSVLIKENAQEVNTCGTLEKEYEQSESSLPELKHLQIESSNNSRISDDITDMISESKMDNESLNSIHESLSNVTQPFLEVTFNLNNFETSDTEEESQESNKISQDSESWVKDILVNDGNSCFQKRSENTNCEEIEGEHLPFLTSVSDKPTVTFPVKETLPSQFCDKTYVGFDMGICKTENTGKEIEEYSDTLSNFESFKWTDAVYGDNKEDANKPIQEVRINYDFALPPNKSKGINMNLHIPHIQNQIAENSNLFSEDAQPQPFILGSDLDKNDEHVLPSTSSSDNSVQLLNTNQNHYECIALDKSNTHISNSLFYPLGKKHLISKDTEAHISEPEDLGKIRSPPPDHVEVETAREGKQYWNPRNSSELSGLVNTISILKSLCEHSTALDSLEILKKKNTVFQQGTQQTYEPDSPPEVRKPFITVVSPKSPHLHKDSQQILKEDEVELSEPLQSVQFSSSGSKEETAFQAVIPKQIERKTCDPKG

SEQ ID NO: 102107 - protein, 239 aa, Homo sapiens
  Payload ID: 20347
  Gene Name: zinc finger, GRF-type containing 1
  Uniprot ID: Q86YA3
  ENSP ID: ENSP00000482897
MGHKPILLRTQYRCHPAISAIANDLFYKGALMNGVTEIERSPLLEWLPTLCFYNVKGLEQIERDNSFHNVAEATFTLKLIQSLIASGIAGSMIGVITLYKSQMYKLCHLLSAVDFHHPDIKTVQVSTVDAFQGAEKEIIILSCVRTRQVGFIDSEKRMNVALTRGKRHLLIVGNLACLRKNQLWGRVIQHCEGREDGLQHANQYEPQLNHLLKDYFEKQVEEKQKKKSEKEKSKDKSHS

SEQ ID NO: 102108 - protein, 154 aa, Homo sapiens
  Payload ID: 20348
  Gene Name: zinc finger, HIT-type containing 1
  Uniprot ID: O43257
  ENSP ID: ENSP00000304593
MVEKKTSVRSQDPGQRRVLDRAARQRRINRQLEALENDNFQDDPHAGLPQLGKRLPQFDDDADTGKKKKKTRGDHFKLRFRKNFQALLEEQNLSVAEGPNYLTACAGPPSRPQRPFCAVCGFPSPYTCVSCGARYCTVRCLGTHQETRCLKWTV

SEQ ID NO: 102109 - protein, 403 aa, Homo sapiens
  Payload ID: 20349
  Gene Name: zinc finger, HIT-type containing 2
  Uniprot ID: Q9UHR6
  ENSP ID: ENSP00000308548
MEPAGPCGFCPAGEVQPARYTCPRCNAPYCSLRCYRTHGTCAENFYRDQVLGELRGCSAPPSRLASALRRLRQQRETEDEPGEAGLSSGPAPGGLSGLWERLAPGEKAAFERLLSRGEAGRLLPPWRPWWWNRGAGPQLLEELDNAPGSDAAELELAPARTPPDSVKDASAAEPAAAERVLGDVPGACTPVVPTRIPAIVSLSRGPVSPLVRFQLPNVLFAYAHTLALYHGGDDALLSDFCATLLGVSGALGAQQVFASAEEALQAAAHVLEAGEHPPGPLGTRGAMHEVARILLGEGPTNQKGYTLAALGDLAQTLGRARKQAVAREERDHLYRARKKCQFLLAWTNENEAALTPLALDCARAHQAHAVVAEEVAALTGELERLWGGPVPPAPRTLIEELPS

SEQ ID NO: 102110 - protein, 186 aa, Homo sapiens
  Payload ID: 20349
  Gene Name: zinc finger, HIT-type containing 2
  ENSP ID: ENSP00000436896
MEPAGPCGFCPAGEVQPARYTCPRCNAPYCSLRCYRTHGTCAENFYRDQLPNVLFAYAHTLALYHGGDDALLSDFCATLLGVSGALGAQQVFASAEEALQAAAHVLEAGEHPPGPLGTRGAMHEVARILLGEGPTNQKGYTLAALGDLAQTLGRARKQAVAREERDHLYRARKKCQFLLAWTNENE

SEQ ID NO: 102111 - protein, 40 aa, Homo sapiens
  Payload ID: 20350
  Gene Name: zinc finger, HIT-type containing 3
  ENSP ID: ENSP00000478067
MASLKCSTVVCVICLEKPKYRCPACRVPYATLKLVLLRKK

SEQ ID NO: 102112 - protein, 148 aa, Homo sapiens
  Payload ID: 20350
  Gene Name: zinc finger, HIT-type containing 3
  Uniprot ID: Q15649
  ENSP ID: ENSP00000478183
MASLKCSTVVCVICLEKPKYRCPACRVPYCSVVCFRKHKEQCNPETRPVEKKIRSALPTKTVKPVENKDDDDSIADFLNSDEEEDRVSLQNLKNLDGLSSCHPGWSAAAQSRLTATSPSQIQAILMPQPPEQLGLQAPATTPNQFLYF

SEQ ID NO: 102113 - protein, 148 aa, Homo sapiens; identical to SEQ ID NO: 102112
  Payload ID: 20350
  Gene Name: zinc finger, HIT-type containing 3
  Uniprot ID: Q15649
  ENSP ID: ENSP00000479727

SEQ ID NO: 102114 - protein, 42 aa, Homo sapiens
  Payload ID: 20350
  Gene Name: zinc finger, HIT-type containing 3
  ENSP ID: ENSP00000481499
MVNLDQGEDKAKLMRAYMQEPLFVEFADCCLGIVEPSQNEES

SEQ ID NO: 102115 - protein, 155 aa, Homo sapiens
  Payload ID: 20350
  Gene Name: zinc finger, HIT-type containing 3
  Uniprot ID: Q15649
  ENSP ID: ENSP00000481504
MASLKCSTVVCVICLEKPKYRCPACRVPYCSVVCFRKHKEQCNPETRPVEKKIRSALPTKTVKPVENKDDDDSIADFLNSDEEEDRVSLQNLKNLGESATLRSLLLNPHLRQLMVNLDQGEDKAKLMRAYMQEPLFVEFADCCLGIVEPSQNEES

SEQ ID NO: 102116 - protein, 90 aa, Homo sapiens
  Payload ID: 20350
  Gene Name: zinc finger, HIT-type containing 3
  ENSP ID: ENSP00000481522
  MOD_RES (1)..(1): Any amino acid
XCVICLEKPKYRCPACRVPYCSVVCFRKHKGESATLRSLLLNPHLRQLMVNLDQGEDKAKLMRAYMQEPLFVEFADCCLGIVEPSQNEES

SEQ ID NO: 102117 - protein, 12 aa, Homo sapiens
  Payload ID: 20350
  Gene Name: zinc finger, HIT-type containing 3
  ENSP ID: ENSP00000481843
MVNLDQGEDKAK

SEQ ID NO: 102118 - protein, 90 aa, Homo sapiens; identical to SEQ ID NO: 102116
  Payload ID: 20350
  Gene Name: zinc finger, HIT-type containing 3
  ENSP ID: ENSP00000482153
  MOD_RES (1)..(1): Any amino acid

SEQ ID NO: 102119 - protein, 42 aa, Homo sapiens
  Payload ID: 20350
  Gene Name: zinc finger, HIT-type containing 3
  ENSP ID: ENSP00000483088
MASLKCSTVVCVICLEKPKYRCPACRVPYCSVVCFRKHKVQP

SEQ ID NO: 102120 - protein, 29 aa, Homo sapiens
  Payload ID: 20350
  Gene Name: zinc finger, HIT-type containing 3
  ENSP ID: ENSP00000484178
MVNLDQGEDKAKLMRAYMQEPLFVEFADC

SEQ ID NO: 102121 - protein, 155 aa, Homo sapiens; identical to SEQ ID NO: 102115
  Payload ID: 20350
  Gene Name: zinc finger, HIT-type containing 3
  Uniprot ID: Q15649
  ENSP ID: ENSP00000484687

SEQ ID NO: 102122 - protein, 29 aa, Homo sapiens
  Payload ID: 20350
  Gene Name: zinc finger, HIT-type containing 3
  ENSP ID: ENSP00000487661
MVNLDQGEDKAKLMRAYMQEPLFVEFADC

SEQ ID NO: 102123 - protein, 42 aa, Homo sapiens; identical to SEQ ID NO: 102114
  Payload ID: 20350
  Gene Name: zinc finger, HIT-type containing 3
  ENSP ID: ENSP00000487918

SEQ ID NO: 102124 - protein, 40 aa, Homo sapiens; identical to SEQ ID NO: 102111
  Payload ID: 20350
  Gene Name: zinc finger, HIT-type containing 3
  ENSP ID: ENSP00000488252

SEQ ID NO: 102125 - protein, 12 aa, Homo sapiens
  Payload ID: 20350
  Gene Name: zinc finger, HIT-type containing 3
  ENSP ID: ENSP00000488528
MVNLDQGEDKAK

SEQ ID NO: 102126 - protein, 42 aa, Homo sapiens; identical to SEQ ID NO: 102119
  Payload ID: 20350
  Gene Name: zinc finger, HIT-type containing 3
  ENSP ID: ENSP00000488910

SEQ ID NO: 102127 - protein, 470 aa, Homo sapiens
  Payload ID: 20351
  Gene Name: zinc finger, HIT-type containing 6
  Uniprot ID: Q9NWK9
  ENSP ID: ENSP00000359606
MEFAAENEGKSGGGLHSVAEGVRLSPEPGREGVRDLAGAEEFGGGEEGTGLTGIKEIGDGEEGSGQRPEEIPMDLTVVKQEIIDWPGTEGRLAGQWVEQEVEDRPEVKDENAGVLEVKQETDSSLVVKEAKVGEPEVKEEKVKEEVMDWSEVKEEKDNLEIKQEEKFVGQCIKEELMHGECVKEEKDFLKKEIVDDTKVKEEPPINHPVGCKRKLAMSRCETCGTEEAKYRCPRCMRYSCSLPCVKKHKAELTCNGVRDKTAYISIQQFTEMNLLSDYRFLEDVARTADHISRDAFLKRPISNKYMYFMKNRARRQGINLKLLPNGFTKRKENSTFFDKKKQQFCWHVKLQFPQSQAEYIEKRVPDDKTINEILKPYIDPEKSDPVIRQRLKAYIRSQTGVQILMKIEYMQQNLVRYYELDPYKSLLDNLRNKVIIEYPTLHVVLKGSNNDMKVLHQVKSESTKNVGNEN

SEQ ID NO: 102128 - protein, 431 aa, Homo sapiens
  Payload ID: 20351
  Gene Name: zinc finger, HIT-type containing 6
  Uniprot ID: Q9NWK9
  ENSP ID: ENSP00000414344
MEFAAENEGKSGGGLHSVAEGVRLSPEPGREGVRDLAGAEEFGGGEEGTGLTGIKEIGDGEEGSGQRPEEIPMDLTVVKQETDSSLVVKEAKVGEPEVKEEKVKEEVMDWSEVKEEKDNLEIKQEEKFVGQCIKEELMHGECVKEEKDFLKKEIVDDTKVKEEPPINHPVGCKRKLAMSRCETCGTEEAKYRCPRCMRYSCSLPCVKKHKAELTCNGVRDKTAYISIQQFTEMNLLSDYRFLEDVARTADHISRDAFLKRPISNKYMYFMKNRARRQGINLKLLPNGFTKRKENSTFFDKKKQQFCWHVKLQFPQSQAEYIEKRVPDDKTINEILKPYIDPEKSDPVIRQRLKAYIRSQTGVQILMKIEYMQQNLVRYYELDPYKSLLDNLRNKVIIEYPTLHVVLKGSNNDMKVLHQVKSESTKNVGNEN

SEQ ID NO: 102129 - protein, 527 aa, Homo sapiens
  Payload ID: 20352
  Gene Name: zinc finger, imprinted 2
  Uniprot ID: Q9NZV7
  ENSP ID: ENSP00000468984
MYQPEDDNNSDVTSDDDMTRNRRESSPPHSVHSFSGDRDWDRRGRSRDMEPRDRWSHTRNPRSRMPPRDLSLPVVAKTSFEMDREDDRDSRAYESRSQDAESYQNVVDLAEDRKPHNTIQDNMENYRKLLSLGFLAQDSVPAEKRNTEMLDNLPSAGSQFPDFKHLGTFLVFEELVTFEDVLVDFSPEELSSLSAAQRNLYREVMLENYRNLVSLGHQFSKPDIISRLEEEESYAMETDSRHTVICQGESHDDPLEPHQGNQEKLLTPITMNDPKTLTPERSYGSDEFERSSNLSKQSKDPLGKDPQEGTAPGICTSPQSASQENKHNRCEFCKRTFSTQVALRRHERIHTGKKPYECKQCAEAFYLMPHLNRHQKTHSGRKTSGCNEGRKPSVQCANLCERVRIHSQEDYFECFQCGKAFLQNVHLLQHLKAHEAARVLPPGLSHSKTYLIRYQRKHDYVGERACQCCDCGRVFSRNSYLIQHYRTHTQERPYQCQLCGKCFGRPSYLTQHYQLHSQEKTVECDHC

SEQ ID NO: 102130 - protein, 66 aa, Homo sapiens
  Payload ID: 20352
  Gene Name: zinc finger, imprinted 2
  ENSP ID: ENSP00000469173
MYQPEDDNNSDVTSDDDMTRNRRESSPPHSVHSFSGDRDWDRRGRSRDMEPRDRWSHTRNPRSSES

SEQ ID NO: 102131 - protein, 193 aa, Homo sapiens
  Payload ID: 20352
  Gene Name: zinc finger, imprinted 2
  ENSP ID: ENSP00000469185
MYQPEDDNNSDVTSDDDMTRNRRESSPPHSVHSFSGDRDWDRRGRSRDMEPRDRWSHTRNPRSRMPPRDLSLPVVAKTSFEMDREDDRDSRAYESRSQDAESYQNVVDLAEDRKPHNTIQDNMENYRKLLSLGVQLAEDDGHSHMTQGHSSRSKRSAYPSTSRGFLAQDSVPAEKRNTEMLDNLPSAGSQVGP

SEQ ID NO: 102132 - protein, 527 aa, Homo sapiens; identical to SEQ ID NO: 102129
  Payload ID: 20352
  Gene Name: zinc finger, imprinted 2
  Uniprot ID: Q9NZV7
  ENSP ID: ENSP00000470326

SEQ ID NO: 102133 - protein, 162 aa, Homo sapiens
  Payload ID: 20352
  Gene Name: zinc finger, imprinted 2
  ENSP ID: ENSP00000471643
MYQPEDDNNSDVTSDDDMTRNRRESSPPHSVHSFSGDRDWDRRGRSRDMEPRDRWSHTRNPRSRMPPRDLSLPVVAKTSFEMDREDDRDSRAYESRSQDAESYQNVVDLAEDRKPHNTIQDNMENYRKLLSLGFLAQDSVPAEKRNTEMLDNLPSAGSQVGP

SEQ ID NO: 102134 - protein, 527 aa, Homo sapiens; identical to SEQ ID NO: 102129
  Payload ID: 20352
  Gene Name: zinc finger, imprinted 2
  Uniprot ID: Q9NZV7
  ENSP ID: ENSP00000472306

SEQ ID NO: 102135 - protein, 527 aa, Homo sapiens; identical to SEQ ID NO: 102129
  Payload ID: 20352
  Gene Name: zinc finger, imprinted 2
  Uniprot ID: Q9NZV7
  ENSP ID: ENSP00000486502

SEQ ID NO: 102136 - protein, 472 aa, Homo sapiens
  Payload ID: 20353
  Gene Name: zinc finger, imprinted 3
  Uniprot ID: Q96PE6
  ENSP ID: ENSP00000269834
MNNSQGRVTFEDVTVNFTQGEWQRLNPEQRNLYRDVMLENYSNLVSVGQGETTKPDVILRLEQGKEPWLEEEEVLGSGRAEKNGDIGGQIWKPKDVKESLAREVPSINKETLTTQKGVECDGSKKILPLGIDDVSSLQHYVQNNSHDDNGYRKLVGNNPSKFVGQQLKCNACRKLFSSKSRLQSHLRRHACQKPFECHSCGRAFGEKWKLDKHQKTHAEERPYKCENCGNAYKQKSNLFQHQKMHTKEKPYQCKTCGKAFSWKSSCINHEKIHNAKKSYQCNECEKSFRQNSTLIQHKKVHTGQKPFQCTDCGKAFIYKSDLVKHQRIHTGEKPYKCSICEKAFSQKSNVIDHEKIHTGKRAYECDLCGNTFIQKKNLIQHKKIHTGEKPYECNRCGKAFFQKSNLHSHQKTHSGERTYRCSECGKTFIRKLNLSLHKKTHTGQKPYGCSECGKAFADRSYLVRHQKRIHSR

SEQ ID NO: 102137 - protein, 638 aa, Homo sapiens
  Payload ID: 20354
  Gene Name: zinc finger, matrin-type 1
  Uniprot ID: Q5H9K5
  ENSP ID: ENSP00000361868
MESCSVTRLECSGAISAHCSLHLPGSSDSPASASQIAGTTDAIWNEQEKAELFTDKFCQVCGVMLQFESQRISHYEGEKHAQNVSFYFQMHGEQNEVPGKKMKMHVENFQVHRYEGVDKNKFCDLCNMMFSSPLIAQSHYVGKVHAKKLKQLMEEHDQASPSGFQPEMAFSMRTYVCHICSIAFTSLDMFRSHMQGSEHQIKESIVINLVKNSRKTQDSYQNECADYINVQKARGLEAKTCFRKMEESSLETRRYREVVDSRPRHRMFEQRLPFETFRTYAAPYNISQAMEKQLPHSKKTYDSFQDELEDYIKVQKARGLDPKTCFRKMRENSVDTHGYREMVDSGPRSRMCEQRFSHEASQTYQRPYHISPVESQLPQWLPTHSKRTYDSFQDELEDYIKVQKARGLEPKTCFRKIGDSSVETHRNREMVDVRPRHRMLEQKLPCETFQTYSGPYSISQVVENQLPHCLPAHDSKQRLDSISYCQLTRDCFPEKPVPLSLNQQENNSGSYSVESEVYKHLSSENNTADHQAGHKRKHQKRKRHLEEGKERPEKEQSKHKRKKSYEDTDLDKDKSIRQRKREEDRVKVSSGKLKHRKKKKSHDVPSEKEERKHRKEKKKSVEERTEEEMLWDESILGF

SEQ ID NO: 102138 - protein, 638 aa, Homo sapiens; identical to SEQ ID NO: 102137
  Payload ID: 20354
  Gene Name: zinc finger, matrin-type 1
  Uniprot ID: Q5H9K5
  ENSP ID: ENSP00000437529

SEQ ID NO: 102139 - protein, 199 aa, Homo sapiens
  Payload ID: 20355
  Gene Name: zinc finger, matrin-type 2
  Uniprot ID: Q96NC0
  ENSP ID: ENSP00000274712
MASGSGTKNLDFRRKWDKDEYEKLAEKRLTEEREKKDGKPVQPVKRELLRHRDYKVDLESKLGKTIVITKTTPQSEMGGYYCNVCDCVVKDSINFLDHINGKKHQRNLGMSMRVERSTLDQVKKRFEVNKKKMEEKQKDYDFEERMKELREEEEKAKAYKKEKQKEKKRRAEEDLTFEEDDEMAAVMGFSGFGSTKKSY

SEQ ID NO: 102140 - protein, 53 aa, Homo sapiens
  Payload ID: 20355
  Gene Name: zinc finger, matrin-type 2
  ENSP ID: ENSP00000473397
MGGYYCNVCDCVVKDSINFLDHINGKKHQRNLGMSMRVERSTLDQVKKRFEVN

SEQ ID NO: 102141 - protein, 129 aa, Homo sapiens
  Payload ID: 20355
  Gene Name: zinc finger, matrin-type 2
  ENSP ID: ENSP00000473644
ASGSGTKNLDFRRKWDKDEYEKLAEKRLTEEREKKDGKPVQPVKRELLRHRDYKVDLESKLGKTIVITKTTPQSEMGGYYCNVCDCVVKDSINFLDHINGKKRKAWRSEKPGHVYACGTFHPGSGEETF

SEQ ID NO: 102142 - protein, 289 aa, Homo sapiens
  Payload ID: 20356
  Gene Name: zinc finger, matrin-type 3
  Uniprot ID: Q9HA38
  ENSP ID: ENSP00000311221
MILLQHAVLPPPKQPSPSPPMSVATRSTGTLQLPPQKPFGQEASLPLAGEEELSKGGEQDCALEELCKPLYCKLCNVTLNSAQQAQAHYQGKNHGKKLRNYYAANSCPPPARMSNVVEPAATPVVPVPPQMGSFKPGGRVILATENDYCKLCDASFSSPAVAQAHYQGKNHAKRLRLAEAQSNSFSESSELGQRRARKEGNEFKMMPNRRNMYTVQNNSAGPYFNPRSRQRIPRDLAMCVTPSGQFYCSMCNVGAGEEMEFRQHLESKQHKSKVSEQRYRNEMENLGYV

SEQ ID NO: 102143 - protein, 288 aa, Homo sapiens
  Payload ID: 20356
  Gene Name: zinc finger, matrin-type 3
  Uniprot ID: Q9HA38
  ENSP ID: ENSP00000396506
MILLQHAVLPPPKQPSPSPPMSVATRSTGTLQLPPQKPFGQEASLPLAGEEELSKGGEQDCALEELCKPLYCKLCNVTLNSAQQAQAHYQGKNHGKKLRNYYAANSCPPPARMSNVVEPAATPVVPVPPQMGSFKPGGRVILATENDYCKLCDASFSSPAVAQAHYQGKNHAKRLRLAEAQSNSFSESSELGQRRARKEGNEFKMMPNRRNMYTVQNNSGPYFNPRSRQRIPRDLAMCVTPSGQFYCSMCNVGAGEEMEFRQHLESKQHKSKVSEQRYRNEMENLGYV

SEQ ID NO: 102144 - protein, 148 aa, Homo sapiens
  Payload ID: 20356
  Gene Name: zinc finger, matrin-type 3
  ENSP ID: ENSP00000398920
MILLQHAVLPPPKQPSPSPPMSVATRSTGTLQLPPQKPFGQEASLPLAGEEELSKGGEQDCALEELCKPLYCKLCNVTLNSAQQAQAHYQGKNHGKKLRNYYAANSCPPPARMSNVVEPAATPVVPVPPQMGSFKPGGRVILATENDY

SEQ ID NO: 102145 - protein, 229 aa, Homo sapiens
  Payload ID: 20357
  Gene Name: zinc finger, matrin-type 4
  Uniprot ID: Q9H898
  ENSP ID: ENSP00000297737
MKSSDIDQDLFTDSYCKVCSAQLISESQRVAHYESRKHASKVRLYYMLHPRDGGCPAKRLRSENGSDADMVDKNKCCTLCNMSFTSAVVADSHYQGKIHAKRLKLLLGEKTPLKTTATPLSPLKPPRMDTAPVVASPYQRRDSDRYCGLCAAWFNNPLMAQQHYDGKKHKKNAARVALLEQLGTTLDMGELRGLRRNYRCTICSVSLNSIEQYHAHLKGSKHQTNLKNK

SEQ ID NO: 102146 - protein, 153 aa, Homo sapiens
  Payload ID: 20357
  Gene Name: zinc finger, matrin-type 4
  Uniprot ID: Q9H898
  ENSP ID: ENSP00000319785
MKSSDIDQDLFTDSYCKVCSAQLISESQRVAHYESRKHASKVRLYYMLHPRDGGCPAKRLRSENGSDADMVDKNKCCTLCNMSFTSAVVADSHYQGKIHAKRLKLLLGEKTPLKTTGLRRNYRCTICSVSLNSIEQYHAHLKGSKHQTNLKNK

SEQ ID NO: 102147 - protein, 46 aa, Homo sapiens
  Payload ID: 20357
  Gene Name: zinc finger, matrin-type 4
  ENSP ID: ENSP00000427918
MKSSDIDQDLFTDSYCKVCSAQLISESQRVAHYECGAVPLGMSNVT

SEQ ID NO: 102148 - protein, 211 aa, Homo sapiens
  Payload ID: 20357
  Gene Name: zinc finger, matrin-type 4
  ENSP ID: ENSP00000428423
MKSSDIDQDLFTDSYCKVCSAQLISESQRVAHYESRKHASKVRLYYMLHPRDGGCPAKRLRSENGSDADMVDKNKCCTLCNMSFTSAVVADSHYQGKIHAKRLKLLLGEKTPLKTTATPLSPLKPPRMDTAPVVASPYQRRDSDRYCGLCAAWFNNPLMAQQHYDGKKHKKNAARVALLEQLGTTLDMGELRGLRRNYRCTICSVSLNSIE

SEQ ID NO: 102149 - protein, 46 aa, Homo sapiens; identical to SEQ ID NO: 102147
  Payload ID: 20357
  Gene Name: zinc finger, matrin-type 4
  ENSP ID: ENSP00000429068

SEQ ID NO: 102150 - protein, 61 aa, Homo sapiens
  Payload ID: 20357
  Gene Name: zinc finger, matrin-type 4
  ENSP ID: ENSP00000430050
MKSSDIDQDLFTDSYCKVCSAQLISESQRVAHYEGPEFLRKGNFIRHTKPKEDVTLKKVAV

SEQ ID NO: 102151 - protein, 170 aa, Homo sapiens
  Payload ID: 20358
  Gene Name: zinc finger, matrin-type 5
  Uniprot ID: Q9UDW3
  ENSP ID: ENSP00000344241
MGKRYFCDYCDRSFQDNLHNRKKHLNGLQHLKAKKVWYDMFRDAAAILLDEQNKRPCRKFLLTGQCDFGSNCRFSHMSERDLQELSIQVEEERRAREWLLDAPELPEGHLEDWLEKRAKRLSSAPSSRAEPIRTTVFQYPVGWPPVQELPPSLRAPPPGGWPLQPRVQWG

SEQ ID NO: 102152 - protein, 1067 aa, Homo sapiens
  Payload ID: 20359
  Gene Name: zinc finger, MIZ-type containing 1
  Uniprot ID: Q9ULJ6
  ENSP ID: ENSP00000334474
MNSMDRHIQQTNDRLQCIKQHLQNPANFHNAATELLDWCGDPRAFQRPFEQSLMGCLTVVSRVAAQQGFDLDLGYRLLAVCAANRDKFTPKSAALLSSWCEELGRLLLLRHQKSRQSDPPGKLPMQPPLSSMSSMKPTLSHSDGSFPYDSVPWQQNTNQPPGSLSVVTTVWGVTNTSQSQVLGNPMANANNPMNPGGNPMASGMTTSNPGLNSPQFAGQQQQFSAKAGPAQPYIQQSMYGRPNYPGSGGFGASYPGGPNAPAGMGIPPHTRPPADFTQPAAAAAAAAVAAAAATATATATATVAALQETQNKDINQYGPMGPTQAYNSQFMNQPGPRGPASMGGSMNPASMAAGMTPSGMSGPPMGMNQPRPPGISPFGTHGQRMPQQTYPGPRPQSLPIQNIKRPYPGEPNYGNQQYGPNSQFPTQPGQYPAPNPPRPLTSPNYPGQRMPSQPSSGQYPPPTVNMGQYYKPEQFNGQNNTFSGSSYSNYSQGNVNRPPRPVPVANYPHSPVPGNPTPPMTPGSSIPPYLSPSQDVKPPFPPDIKPNMSALPPPPANHNDELRLTFPVRDGVVLEPFRLEHNLAVSNHVFHLRPTVHQTLMWRSDLELQFKCYHHEDRQMNTNWPASVQVSVNATPLTIERGDNKTSHKPLHLKHVCQPGRNTIQITVTACCCSHLFVLQLVHRPSVRSVLQGLLKKRLLPAEHCITKIKRNFSSVAASSGNTTLNGEDGVEQTAIKVSLKCPITFRRIQLPARGHDCKHVQCFDLESYLQLNCERGTWRCPVCNKTALLEGLEVDQYMWGILNAIQHSEFEEVTIDPTCSWRPVPIKSDLHIKDDPDGIPSKRFKTMSPSQMIMPNVMEMIAALGPGPSPYPLPPPPGGTNSNDYSSQGNNYQGHGNFDFPHGNPGGTSMNDFMHGPPQLSHPPDMPNNMAALEKPLSHPMQETMPHAGSSDQPHPSIQQGLHVPHPSSQSGPPLHHSGAPPPPPSQPPRQPPQAAPSSHPHSDLTFNPSSALEGQAGAQGASDMPEPSLDLLPELTNPDELLSYLDPPDLPSNSNDDLLSLFENN

SEQ ID NO: 102153 - protein, 968 aa, Homo sapiens [sequence omitted]

SEQ ID NO: 102154 - protein, 220 aa, Homo sapiens
  Payload ID: 20359
  Gene Name: zinc finger, MIZ-type containing 1
  ENSP ID: ENSP00000481736
MNSMDRHIQQTNDRLQCIKQHLQNPANFHNAATELLDWCGDPRAFQRPFEQSLMGCLTVVSRVAAQQGFDLDLGYRLLAVCAANRDKFTPKSAALLSSWCEELGRLLLLRHQKSRQSDPPGKLPMQPPLSSMSSMKPTLSHSDGSFPYDSVPWLPAYPACTPPPSQSHPNSCSLKQKQPLAFPPPLCSIWLTTLQGLLGSLSCVHFVSGWSVPREPHGLG

SEQ ID NO: 102155 - protein, 894 aa, Homo sapiens
  Payload ID: 20360
  Gene Name: zinc finger, MIZ-type containing 2
  Uniprot ID: Q8NF64
  ENSP ID: ENSP00000265346
MNSMNPMKPALPPAPHGDGSFAYESVPWQQSATQPAGSLSVVTTVWGVGNATQSQVLGNPMGPAGSPSGSSMMPGVAGGSSALTSPQCLGQQAFAEGGANKGYVQQGVYSRGGYPGAPGFTTGYAGGPGGLGLPSHAARPSTDFTQAAAAAAVAAAAATATATATATVAALQEKQSQELSQYGAMGAGQSFNSQFLQHGGPRGPSVPAGMNPTGIGGVMGPSGLSPLAMNPTRAAGMTPLYAGQRLPQHGYPGPPQAQPLPRQGVKRTYSEVYPGQQYLQGGQYAPSTAQFAPSPGQPPAPSPSYPGHRLPLQQGMTQSLSVPGPTGLHYKPTRSIPGYPSSPLPGNPTPPMTPSSSVPYMSPNQEVKSPFLPDLKPNLNSLHSSPSGSGPCDELRLTFPVRDGVVLEPFRLQHNLAVSNHVFQLRDSVYKTLIMRPDLELQFKCYHHEDRQMNTNWPASVQVSVNATPLTIERGDNKTSHKPLYLKHVCQPGRNTIQITVTACCCSHLFVLQLVHRPSVRSVLQGLLKKRLLPAEHCITKIKRNFSSGTIPGTPGPNGEDGVEQTAIKVSLKCPITFRRIQLPARGHDCRHIQCFDLESYLQLNCERGTWRCPVCNKTALLEGLEVDQYMLGILIYIQNSDYEEITIDPTCSWKPVPVKPDMHIKEEPDGPALKRCRTVSPAHVLMPSVMEMIAALGPGAAPFAPLQPPSVPAPSDYPGQGSSFLGPGTFPESFPPTTPSTPTLAEFTPGPPPISYQSDIPSSLLTSEKSTACLPSQMAPAGHLDPTHNPGTPGLHTSNLGAPPGPQLHHSNPPPASRQSLGQASLGPTGELAFSPATGVMGPPSMSGAGEAPEPALDLLPELTNPDELLSYLGPPDLPTNNNDDLLSLFENN

SEQ ID NO: 102156 - protein, 920 aa, Homo sapiens
  Payload ID: 20360
  Gene Name: zinc finger, MIZ-type containing 2
  Uniprot ID: Q8NF64
  ENSP ID: ENSP00000311778
MNSMNPMKPALPPAPHGDGSFAYESVPWQQSATQPAGSLSVVTTVWGVGNATQSQVLGNPMGPAGSPSGSSMMPGVAGGSSALTSPQCLGQQAFAEGGANKGYVQQGVYSRGGYPGAPGFTTGYAGGPGGLGLPSHAARPSTDFTQAAAAAAVAAAAATATATATATVAALQEKQSQELSQYGAMGAGQSFNSQFLQHGGPRGPSVPAGMNPTGIGGVMGPSGLSPLAMNPTRAAGMTPLYAGQRLPQHGYPGPPQAQPLPRQGVKRTYSEVYPGQQYLQGGQYAPSTAQFAPSPGQPPAPSPSYPGHRLPLQQGMTQSLSVPGPTGLHYKPTEQFNGQGASFNGGSVSYSQPGLSGPTRSIPGYPSSPLPGNPTPPMTPSSSVPYMSPNQEVKSPFLPDLKPNLNSLHSSPSGSGPCDELRLTFPVRDGVVLEPFRLQHNLAVSNHVFQLRDSVYKTLIMRPDLELQFKCYHHEDRQMNTNWPASVQVSVNATPLTIERGDNKTSHKPLYLKHVCQPGRNTIQITVTACCCSHLFVLQLVHRPSVRSVLQGLLKKRLLPAEHCITKIKRNFSSGTIPGTPGPNGEDGVEQTAIKVSLKCPITFRRIQLPARGHDCRHIQCFDLESYLQLNCERGTWRCPVCNKTALLEGLEVDQYMLGILIYIQNSDYEEITIDPTCSWKPVPVKPDMHIKEEPDGPALKRCRTVSPAHVLMPSVMEMIAALGPGAAPFAPLQPPSVPAPSDYPGQGSSFLGPGTFPESFPPTTPSTPTLAEFTPGPPPISYQSDIPSSLLTSEKSTACLPSQMAPAGHLDPTHNPGTPGLHTSNLGAPPGPQLHHSNPPPASRQSLGQASLGPTGELAFSPATGVMGPPSMSGAGEAPEPALDLLPELTNPDELLSYLGPPDLPTNNNDDLLSLFENN

SEQ ID NO: 102157 - protein, 888 aa, Homo sapiens
  Payload ID: 20360
  Gene Name: zinc finger, MIZ-type containing 2
  ENSP ID: ENSP00000396601
MNSMNPMKPALPPAPHGDGSFAYESVPWQQSATQPAGSLSVVTTVWGVGNATQSQCLGQQAFAEGGANKGYVQQGVYSRGGYPGAPGFTTGYAGGPGGLGLPSHAARPSTDFTQAAAAAAVAAAAATATATATATVAALQEKQSQELSQYGAMGAGQSFNSQFLQHGGPRGPSVPAGMNPTGIGGVMGPSGLSPLAMNPTRAAGMTPLYAGQRLPQHGYPGPPQAQPLPRQGVKRTYSEVYPGQQYLQGGQYAPSTAQFAPSPGQPPAPSPSYPGHRLPLQQGMTQSLSVPGPTGLHYKPTEQFNGQGASFNGGSVSYSQPGLSGPTRSIPGYPSSPLPGNPTPPMTPSSSVPYMSPNQEVKSPFLPDLKPNLNSLHSSPSGSGPCDELRLTFPVRDGVVLEPFRLQHNLAVSNHVFQLRDSVYKTLIMRPDLELQFKCYHHEDRQMNTNWPASVQVSVNATPLTIERGDNKTSHKPLYLKHVCQPGRNTIQITVTACCCSHLFVLQLVHRPSVRSVLQGLLKKRLLPAEHCITKIKRNFSSGTIPGTPGPNGEDGVEQTAIKVSLKCPITFRRIQLPARGHDCRHIQCFDLESYLQLNCERGTWRCPVCNKTALLEGLEVDQYMLGILIYIQNSDYEEITIDPTCSWKPVPVKPDMHIKEEPDGPALKRCRTVSPAHVLMPSVMEMIAALGPGAAPFAPLQPPSVPAPSDYPGQGSSFLGPGTFPESFPPTTPSTPTLAEFTPGPPPISYQSDIPSSLLTSEKSTACLPSQMAPAGHLDPTHNPGTPGLHTSNLGAPPGPQLHHSNPPPASRQSLGQASLGPTGELAFSPATGVMGPPSMSGAGEAPEPALDLLPELTNPDELLSYLGPPDLPTNNNDDLLSLFENN

SEQ ID NO: 102158 - protein, 62 aa, Homo sapiens
  Payload ID: 20360
  Gene Name: zinc finger, MIZ-type containing 2
  ENSP ID: ENSP00000406820
MNSMNPMKPALPPAPHGDGSFAYESVPWQQSATQPAGSLSVVTTVWGVGNATQSQGVPLAAP

SEQ ID NO: 102159 - protein, 862 aa, Homo sapiens
  Payload ID: 20360
  Gene Name: zinc finger, MIZ-type containing 2
  Uniprot ID: Q8NF64
  ENSP ID: ENSP00000409648
MNSMNPMKPALPPAPHGDGSFAYESVPWQQSATQPAGSLSVVTTVWGVGNATQSQCLGQQAFAEGGANKGYVQQGVYSRGGYPGAPGFTTGYAGGPGGLGLPSHAARPSTDFTQAAAAAAVAAAAATATATATATVAALQEKQSQELSQYGAMGAGQSFNSQFLQHGGPRGPSVPAGMNPTGIGGVMGPSGLSPLAMNPTRAAGMTPLYAGQRLPQHGYPGPPQAQPLPRQGVKRTYSEVYPGQQYLQGGQYAPSTAQFAPSPGQPPAPSPSYPGHRLPLQQGMTQSLSVPGPTGLHYKPTRSIPGYPSSPLPGNPTPPMTPSSSVPYMSPNQEVKSPFLPDLKPNLNSLHSSPSGSGPCDELRLTFPVRDGVVLEPFRLQHNLAVSNHVFQLRDSVYKTLIMRPDLELQFKCYHHEDRQMNTNWPASVQVSVNATPLTIERGDNKTSHKPLYLKHVCQPGRNTIQITVTACCCSHLFVLQLVHRPSVRSVLQGLLKKRLLPAEHCITKIKRNFSSGTIPGTPGPNGEDGVEQTAIKVSLKCPITFRRIQLPARGHDCRHIQCFDLESYLQLNCERGTWRCPVCNKTALLEGLEVDQYMLGILIYIQNSDYEEITIDPTCSWKPVPVKPDMHIKEEPDGPALKRCRTVSPAHVLMPSVMEMIAALGPGAAPFAPLQPPSVPAPSDYPGQGSSFLGPGTFPESFPPTTPSTPTLAEFTPGPPPISYQSDIPSSLLTSEKSTACLPSQMAPAGHLDPTHNPGTPGLHTSNLGAPPGPQLHHSNPPPASRQSLGQASLGPTGELAFSPATGVMGPPSMSGAGEAPEPALDLLPELTNPDELLSYLGPPDLPTNNNDDLLSLFENN

SEQ ID NO: 102160 - protein, 920 aa, Homo sapiens; identical to SEQ ID NO: 102156
  Payload ID: 20360
  Gene Name: zinc finger, MIZ-type containing 2
  Uniprot ID: Q8NF64
  ENSP ID: ENSP00000414723

SEQ ID NO: 102161 - protein, 89 aa, Homo sapiens
  Payload ID: 20360
  Gene Name: zinc finger, MIZ-type containing 2
  ENSP ID: ENSP00000415501
MNSMNPMKPALPPAPHGDGSFAYESVPWQQSATQPAGSLSVVTTVWGVGNATQSQVLGNPMGPAGSPSGSSMMPGVAGGSSALTSPQCL

SEQ ID NO: 102162 - protein, 923 aa, Homo sapiens
  Payload ID: 20360
  Gene Name: zinc finger, MIZ-type containing 2
  ENSP ID: ENSP00000483853
MNSMNPMKPALPPAPHGDGSFAYESVPWQQSATQPAGSLSVVTTVWGVGNATQSQVLGNPMGPAGSPSGSSMMPGVAGGSSALTSPQCLGQQAFAEGGANKGYVQQGVYSRGGYPGAPGFTTGYAGGPGGLGLPSHAARPSTDFTQAAAAAAVAAAAATATATATATVAALQEKQSQELSQYGAMGAGQSFNSQFLQHGGPRGPSVPAGMNPTGIGGVMGPSGLSPLAMNPTRAAGMTPLYAGQRLPQHGYPGPPQAQPLPRQGVKRTYSEVYPGQQYLQGGQYAPSTAQFAPSPGQPPAPSPSYPGHRLPLQQGMTQSLSVPGPTGLHYKPTEQFNGQGASFNGGSVSYSQPGLSGPTRSIPGYPSSPLPGNPTPPMTPSSSVPYMSPNQEVKSPFLPDLKPNLNSLHSSPSGSGPCDELRLTFPVRDGVVLEPFRLQHNLAVSNHVFQLRDSVYKTLIMRPDLELQFKCYHHEDRQMNTNWPASVQVSVNATPLTIERGDNKTSHKPLYLKHVCARPQHHPSPSPPAAACVSCSHLFVLQLVHRPSVRSVLQGLLKKRLLPAEHCITKIKRNFSSGTIPGTPGPNGEDGVEQTAIKVSLKCPITFRRIQLPARGHDCRHIQCFDLESYLQLNCERGTWRCPVCNKTALLEGLEVDQYMLGILIYIQNSDYEEITIDPTCSWKPVPVKPDMHIKEEPDGPALKRCRTVSPAHVLMPSVMEMIAALGPGAAPFAPLQPPSVPAPSDYPGQGSSFLGPGTFPESFPPTTPSTPTLAEFTPGPPPISYQSDIPSSLLTSEKSTACLPSQMAPAGHLDPTHNPGTPGLHTSNLGAPPGPQLHHSNPPPASRQSLGQASLGPTGELAFSPATGVMGPPSMSGAGEAPEPALDLLPELTNPDELLSYLGPPDLPTNNNDDLLSLFENN

SEQ ID NO: 102163 - protein, 1142 aa, Homo sapiens
  Payload ID: 20361
  Gene Name: zinc finger, MYM-type 1
  Uniprot ID: Q5SVZ6
  ENSP ID: ENSP00000352920
MKEPLLGGECDKAVASQLGLLDEIKTEPDNAQEYCHRQQSRTQENELKINAVFSESASQLTAGIQLSLASSGVNKMLPSVSTTAIQVSCAGCKKILQKGQTAYQRKGSAQLFCSIPCITEYISSASSPVPSKRTCSNCSKDILNPKDVISVQLEDTTSCKTFCSLSCLSSYEEKRKPFVTICTNSILTKCSMCQKTAIIQYEVKYQNVKHNLCSNACLSKFHSANNFIMNCCENCGTYCYTSSSLSHILQMEGQSHYFNSSKSITAYKQKPAKPLISVPCKPLKPSDEMIETTSDLGKTELFCSINCFSAYSKAKMESSSVSVVSVVHDTSTELLSPKKDTTPVISNIVSLADTDVALPIMNTDVLQDTVSSVTATADVIVDLSKSSPSEPSNAVASSSTEQPSVSPSSSVFSQHAIGSSTEVQKDNMKSMKISDELCHPKCTSKVQKVKGKSRSIKKSCCADFECLENSKKDVAFCYSCQLFCQKYFSCGRESFATHGTSNWKKTLEKFRKHEKSEMHLKSLEFWREYQFCDGAVSDDLSIHSKQIEGNKKYLKLIIENILFLGKQCLPLRGNDQSVSSVNKGNFLELLEMRAKDKGEETFRLMNSQVDFYNSTQIQSDIIEIIKTEMLQDIVNEINDSSAFSIICDETINSAMKEQLSICVRYPQKSSKAILIKERFLGFVDTEEMTGTHLHRTIKTYLQQIGVDMDKIHGQAYDSTTNLKIKFNKIAAEFKKEEPRALYIHCYAHFLDLSIIRFCKEVKELRSALKTLSSLFNTICMSGEMLANFRNIYRLSQNKTCKKHISQSCWTVHDRTLLSVIDSLPEIIETLEVIASHSSNTSFADELSHLLTLVSKFEFVFCLKFLYRVLSVTGILSKELQNKTIDIFSLSSKIEAILECLSSERNDVYFKTIWDGTEEICQKITCKGFKVEKPSLQKRRKIQKSVDLGNSDNMFFPTSTEEQYKINIYYQGLDTILQNLKLCFSEFDYCKIKQISELLFKWNEPLNETTAKHVQEFYKLDEDIIPELRFYRHYAKLNFVIDDSCINFVSLGCLFIQHGLHSNIPCLSKLLYIALSWPITSASTENSFSTLPRLKTYLCNTMGQEKLTGPALMAVEQELVNKLMEPERLNEIVEKFISQMKEI

SEQ ID NO: 102164 - protein, 1142 aa, Homo sapiens; identical to SEQ ID NO: 102163
  Payload ID: 20361
  Gene Name: zinc finger, MYM-type 1
  Uniprot ID: Q5SVZ6
  ENSP ID: ENSP00000362427

SEQ ID NO: 102165 - protein, 461 aa, Homo sapiens
  Payload ID: 20361
  Gene Name: zinc finger, MYM-type 1
  ENSP ID: ENSP00000394233
MKEPLLGGECDKAVASQLGLLDEIKTEPDNAQEYCHRQQSRTQENELKINAVFSESASQLTAGIQLSLASSGVNKMLPSVSTTAIQVSCAGCKKILQKGQTAYQRKGSAQLFCSIPCITEYISSASSPVPSKRTCSNCSKDILNPKDVISVQLEDTTSCKTFCSLSCLSSYEEKRKPFVTICTNSILTKCSMCQKTAIIQYEVKYQNVKHNLCSNACLSKFHSANNFIMNCCENCGTYCYTSSSLSHILQMEGQSHYFNSSKSITAYKQKPAKPLISVPCKPLKPSDEMIETTSDLGKTELFCSINCFSAYSKAKMESSSVSVVSVVHDTSTELLSPKKDTTPVISNIVSLADTDVALPIMNTDVLQDTVSSVTATADVIVDLSKSSPSEPSNAVASSSTEQPSVSPSSSVFSQHAIGSSTEVQKDNMKSMKISDELCHPKCTSKVQKVKGKSRSIKKSCC

SEQ ID NO: 102166 - protein, 1142 aa, Homo sapiens; identical to SEQ ID NO: 102163
  Payload ID: 20361
  Gene Name: zinc finger, MYM-type 1
  Uniprot ID: Q5SVZ6
  ENSP ID: ENSP00000482579

SEQ ID NO: 102167 - protein, 1377 aa, Homo sapiens
  Payload ID: 20362
  Gene Name: zinc finger, MYM-type 2
  Uniprot ID: Q9UBW7
  ENSP ID: ENSP00000372324
MDTSSVGGLELTDQTPVLLGSTAMATSLTNVGNSFSGPANPLVSRSNKFQNSSVEDDDDVVFIEPVQPPPPSVPVVADQRTITFTSSKNEELQGNDSKITPSSKELASQKGSVSETIVIDDEEDMETNQGQEKNSSNFIERRPPETKNRTNDVDFSTSSFSRSKVNAGMGNSGITTEPDSEIQIANVTTLETGVSSVNDGQLENTDGRDMNLMITHVTSLQNTNLGDVSNGLQSSNFGVNIQTYTPSLTSQTKTGVGPFNPGRMNVAGDVFQNGESATHHNPDSWISQSASFPRNQKQPGVDSLSPVASLPKQIFQPSVQQQPTKPVKVTCANCKKPLQKGQTAYQRKGSAHLFCSTTCLSSFSHKPAPKKLCVMCKKDITTMKGTIVAQVDSSESFQEFCSTSCLSLYEDKQNPTKGALNKSRCTICGKLTEIRHEVSFKNMTHKLCSDHCFNRYRMANGLIMNCCEQCGEYLPSKGAGNNVLVIDGQQKRFCCQSCVSEYKQVGSHPSFLKEVRDHMQDSFLMQPEKYGKLTTCTGCRTQCRFFDMTQCIGPNGYMEPYCSTACMNSHKTKYAKSQSLGIICHFCKRNSLPQYQATMPDGKLYNFCNSSCVAKFQALSMQSSPNGQFVAPSDIQLKCNYCKNSFCSKPEILEWENKVHQFCSKTCSDDYKKLHCIVTYCEYCQEEKTLHETVNFSGVKRPFCSEGCKLLYKQDFARRLGLRCVTCNYCSQLCKKGATKELDGVVRDFCSEDCCKKFQDWYYKAARCDCCKSQGTLKERVQWRGEMKHFCDQHCLLRFYCQQNEPNMTTQKGPENLHYDQGCQTSRTKMTGSAPPPSPTPNKEMKNKAVLCKPLTMTKATYCKPHMQTKSCQTDDTWRTEYVPVPIPVPVYIPVPMHMYSQNIPVPTTVPVPVPVPVFLPAPLDSSEKIPAAIEELKSKVSSDALDTELLTMTDMMSEDEGKTETTNINSVIIETDIIGSDLLKNSDPETQSSMPDVPYEPDLDIEIDFPRAAEELDMENEFLLPPVFGEEYEEQPRPRSKKKGAKRKAVSGYQSHDDSSDNSECSFPFKYTYGVNAWKHWVKTRQLDEDLLVLDELKSSKSVKLKEDLLSHTTAELNYGLAHFVNEIRRPNGENYAPDSIYYLCLGIQEYLCGSNRKDNIFIDPGYQTFEQELNKILRSWQPSILPDGSIFSRVEEDYLWRIKQLGSHSPVALLNTLFYFNTKYFGLKTVEQHLRLSFGTVFRHWKKNPLTMENKACLRYQVSSLCGTDNEDKITTGKRKHEDDEPVFEQIENTANPSRCPVKMFECYLSKSPQNLNQRMDVFYLQPECSSSTDSPVWYTSTSLDRNTLENMLVRVLLVKDIYDKDNYELDEDTD

SEQ ID NO: 102168 - protein, 1377 aa, Homo sapiens; identical to SEQ ID NO: 102167
  Payload ID: 20362
  Gene Name: zinc finger, MYM-type 2
  Uniprot ID: Q9UBW7
  ENSP ID: ENSP00000372327

SEQ ID NO: 102169 - protein, 1377 aa, Homo sapiens; identical to SEQ ID NO: 102167
  Payload ID: 20362
  Gene Name: zinc finger, MYM-type 2
  Uniprot ID: Q9UBW7
  ENSP ID: ENSP00000479904

SEQ ID NO: 102170 - protein, 276 aa, Homo sapiens
  Payload ID: 20362
  Gene Name: zinc finger, MYM-type 2
  ENSP ID: ENSP00000483904
MDTSSVGGLELTDQTPVLLGSTAMATSLTNVGNSFSGPANPLVSRSNKFQNSSVEDDDDVVFIEPVQPPPPSVPVVADQRTITFTSSKNEELQGNDSKITPSSKELASQKGSVSETIVIDDEEDMETNQGQEKNSSNFIERRPPETKNRTNDVDFSTSSFSRSKTKTGVGPFNPGRMNVAGDVFQNGESATHHNPDSWISQSASFPRNQKQPGVDSLSPVASLPKQIFQPSVQQQPTKPVKVTCANCKKPLQKGQTAYQRKGSAHLFCSTTCLSSF

SEQ ID NO: 102171 - protein, 1370 aa, Homo sapiens
  Payload ID: 20363
  Gene Name: zinc finger, MYM-type 3
  Uniprot ID: Q14202
  ENSP ID: ENSP00000322845
MDPSDFPSPFDPLTLPEKPLAGDLPVDMEFGEDLLESQTAPTRGWAPPGPSPSSGALDLLDTPAGLEKDPGVLDGATELLGLGGLLYKAPSPPEVDHGPEGTLAWDAGDQTLEPGPGGQTPEVVPPDPGAGANSCSPEGLLEPLAPDSPITLQSPHIEEEETTSIATARRGSPGQEEELPQGQPQSPNAPPSPSVGETLGDGINSSQTKPGGSSPPAHPSLPGDGLTAKASEKPPERKRSERVRRAEPPKPEVVDSTESIPVSDEDSDAMVDDPNDEDFVPFRPRRSPRMSLRSSVSQRAGRSAVGTKMTCAHCRTPLQKGQTAYQRKGLPQLFCSSSCLTTFSKKPSGKKTCTFCKKEIWNTKDSVVAQTGSGGSFHEFCTSVCLSLYEAQQQRPIPQSGDPADATRCSICQKTGEVLHEVSNGSVVHRLCSDSCFSKFRANKGLKTNCCDQCGAYIYTKTGSPGPELLFHEGQQKRFCNTTCLGAYKKKNTRVYPCVWCKTLCKNFEMLSHVDRNGKTSLFCSLCCTTSYKVKQAGLTGPPRPCSFCRRSLSDPCYYNKVDRTVYQFCSPSCWTKFQRTSPEGGIHLSCHYCHSLFSGKPEVLDWQDQVFQFCCRDCCEDFKRLRGVVSQCEHCRQEKLLHEKLRFSGVEKSFCSEGCVLLYKQDFTKKLGLCCITCTYCSQTCQRGVTEQLDGSTWDFCSEDCKSKYLLWYCKAARCHACKRQGKLLETIHWRGQIRHFCNQQCLLRFYSQQNQPNLDTQSGPESLLNSQSPESKPQTPSQTKVENSNTVRTPEENGNLGKIPVKTRSAPTAPTPPPPPPPATPRKNKAAMCKPLMQNRGVSCKVEMKSKGSQTEEWKPQVIVLPIPVPIFVPVPMHLYCQKVPVPFSMPIPVPVPMFLPTTLESTDKIVETIEELKVKIPSNPLEADILAMAEMIAEAEELDKASSDLCDLVSNQSAEGLLEDCDLFGPARDDVLAMAVKMANVLDEPGQDLEADFPKNPLDINPSVDFLFDCGLVGPEDVSTEQDLPRTMRKGQKRLVLSESCSRDSMSSQPSCTGLNYSYGVNAWKCWVQSKYANGETSKGDELRFGPKPMRIKEDILACSAAELNYGLAQFVREITRPNGERYEPDSIYYLCLGIQQYLLENNRMVNIFTDLYYLTFVQELNKSLSTWQPTLLPNNTVFSRVEEEHLWECKQLGVYSPFVLLNTLMFFNTKFFGLQTAEEHMQLSFTNVVRQSRKCTTPRGTTKVVSIRYYAPVRQRKGRDTGPGKRKREDEAPILEQRENRMNPLRCPVKFYEFYLSKCPESLRTRNDVFYLQPERSCIAESPLWYSVIPMDRSMLESMLNRILAVREIYEELGRPGEEDLD

SEQ ID NO: 102172 - protein, 349 aa, Homo sapiens
  Payload ID: 20363
  Gene Name: zinc finger, MYM-type 3
  ENSP ID: ENSP00000363090
MDPSDFPSPFDPLTLPEKPLAGDLPVDMEFGEDLLESQTAPTRGWAPPGPSPSSGALDLLDTPAGLEKDPGVLDGATELLGLGGLLYKAPSPPEVDHGPEGTLAWDAGDQTLEPGPGGQTPEVVPPDPGAGANSCSPEGLLEPLAPDSPITLQSPHIEEEETTSIATARRGSPGQEEELPQGQPQSPNAPPSPSVGETLGDGINSSQTKPGGSSPPAHPSLPGDGLTAKASEKPPERVQKRSERVRRAEPPKPEVVDSTESRRSGTPRTRLWRRLVLEAPSMSSAHPSVSPCMRPSSSARSPSLGIPPTLLAAAYARRLERSCTRSAMAAWYTGSAAILASPNSGPTRD

SEQ ID NO: 102173 - protein, 495 aa, Homo sapiens
  Payload ID: 20363
  Gene Name: zinc finger, MYM-type 3
  Uniprot ID: Q14202
  ENSP ID: ENSP00000363093
MDPSDFPSPFDPLTLPEKPLAGDLPVDMEFGEDLLESQTAPTRGWAPPGPSPSSGALDLLDTPAGLEKDPGVLDGATELLGLGGLLYKAPSPPEVDHGPEGTLAWDAGDQTLEPGPGGQTPEVVPPDPGAGANSCSPEGLLEPLAPDSPITLQSPHIEEEETTSIATARRGSPGQEEELPQGQPQSPNAPPSPSVGETLGDGINSSQTKPGGSSPPAHPSLPGDGLTAKASEKPPERKRSERVRRAEPPKPEVVDSTESIPVSDEDSDAMVDDPNDEDFVPFRPRRSPRMSLRSSVSQRAGRSAVGTKMTCAHCRTPLQKGQTAYQRKGLPQLFCSSSCLTTFSKKPSGKKTCTFCKKEIWNTKDSVVAQTGSGGSFHEFCTSVCLSLYEAQQQRPIPQSGDPADATRCSICQKTGEVLHEVSNGSVVHRLCSDSCFSKFRANKGLKTNCCDQCGAYIYTKTGSPGPELLFHEGQQKRFCNTTCLGAYKKVGPRE

SEQ ID NO: 102174 - protein, 497 aa, Homo sapiens
  Payload ID: 20363
  Gene Name: zinc finger, MYM-type 3
  ENSP ID: ENSP00000363094
MDPSDFPSPFDPLTLPEKPLAGDLPVDMEFGEDLLESQTAPTRGWAPPGPSPSSGALDLLDTPAGLEKDPGVLDGATELLGLGGLLYKAPSPPEVDHGPEGTLAWDAGDQTLEPGPGGQTPEVVPPDPGAGANSCSPEGLLEPLAPDSPITLQSPHIEEEETTSIATARRGSPGQEEELPQGQPQSPNAPPSPSVGETLGDGINSSQTKPGGSSPPAHPSLPGDGLTAKASEKPPERVQKRSERVRRAEPPKPEVVDSTESIPVSDEDSDAMVDDPNDEDFVPFRPRRSPRMSLRSSVSQRAGRSAVGTKMTCAHCRTPLQKGQTAYQRKGLPQLFCSSSCLTTFSKKPSGKKTCTFCKKEIWNTKDSVVAQTGSGGSFHEFCTSVCLSLYEAQQQRPIPQSGDPADATRCSICQKTGEVLHEVSNGSVVHRLCSDSCFSKFRANKGLKTNCCDQCGAYIYTKTGSPGPELLFHEGQQKRFCNTTCLGAYKKVGPRE

SEQ ID NO: 102175 - protein, 1280 aa, Homo sapiens
  Payload ID: 20363
  Gene Name: zinc finger, MYM-type 3
  ENSP ID: ENSP00000363096
MDPSDFPSPFDPLTLPEKPLAGDLPVDMEFGEDLLESQTAPTRGWAPPGPSPSSGALDLLDTPAGLEKDPGVLDGATELLGLGGLLYKAPSPPEVDHGPEGTLAWDAGDQTLEPGPGGQTPEVVPPDPGAGANSCSPEGLLEPLAPDSPITLQSPHIEEEETTSIATARRGSPGQEEELPQGQPQSPNAPPSPSVGETLGDGINSSQTKPGGSSPPAHPSLPGDGLTAKASEKPPERVQKRSERVRRAEPPKPEVVDSTESIPVSDEDSDAMVDDPNDEDFVPFRPRRSPRMSLRSSVSQRAGRSAVGTKMTCAHCRTPLQKGQTAYQRKGLPQLFCSSSCLTTFSKKPSGKKTCTFCKKEIWNTKDSVVAQTGSGGSFHEFCTSVCLSLYEAQQQRPIPQSGDPADATRCSICQKTGEVLHEVSNGSVVHRLCSDSCFSKFRANKGLKTNCCDQCGAYIYTKTGSPGPELLFHEGQQKRFCNTTCLGAYKKKNTRVYPCVWCKTLCKNFEMLSHVDRNGKTSLFCSLCCTTSYKVKQAGLTGPPRPCSFCRRSLSDPCYYNKVDRTVYQFCSPSCWTKFQRTSPEGGIHLSCHYCHSLFSGKPEVLDWQDQVFQFCCRDCCEDFKRLRGVVSQCEHCRQEKLLHEKLRFSGVEKSFCSEGCVLLYKQDFTKKLGLCCITCTYCSQTCQRGVTEQLDGSTWDFCSEDCKSKYLLWYCKAARCHACKRQGKLLETIHWRGQIRHFCNQQCLLRFYSQQNQPNLDTQSGPESLLNSQSPESKPQTPSQTKVENSNTVRTPEENGNLGKIPVKTRSAPTAPTPPPPPPPATPRKNKAAMCKPLMQNRGVSCKVEMKSKGSQTEEWKPQVIVLPIPVPIFVPVPMHLYCQKVPVPFSMPIPVPVPMFLPTTLESTDKIVETIEELKVKIPSNPLEADILAMAEMIAEAEELDKASSDLCDLVSNQSAEGLLEDCDLFGPARDDVLAMAVKMANVLDEPGQDLEADFPKNPLDINPSVDFLFDCGLVGPEDVSTEQDLPRTMRKGQKRLVLSESCSRDSMSSQPSCTGLNYSYGVNAWKCWVQSKYANGETSKAKPMRIKEDILACSAAELNYGLAQFVREITRPNGERYEPDSIYYLCLGIQQYLLENNRMVNIFTDLYYLTFVQELNKSLSTWQPTLLPNNTGPGKRKREDEAPILEQRENRMNPLRCPVKFYEFYLSKCPESLRTRNDVFYLQPERSCIAESPLWYSVIPMDRSMLESMLNRILAVREIYEELGRPGEEDLD

SEQ ID NO: 102176 - protein, 1372 aa, Homo sapiens
  Payload ID: 20363
  Gene Name: zinc finger, MYM-type 3
  ENSP ID: ENSP00000363100
MDPSDFPSPFDPLTLPEKPLAGDLPVDMEFGEDLLESQTAPTRGWAPPGPSPSSGALDLLDTPAGLEKDPGVLDGATELLGLGGLLYKAPSPPEVDHGPEGTLAWDAGDQTLEPGPGGQTPEVVPPDPGAGANSCSPEGLLEPLAPDSPITLQSPHIEEEETTSIATARRGSPGQEEELPQGQPQSPNAPPSPSVGETLGDGINSSQTKPGGSSPPAHPSLPGDGLTAKASEKPPERVQKRSERVRRAEPPKPEVVDSTESIPVSDEDSDAMVDDPNDEDFVPFRPRRSPRMSLRSSVSQRAGRSAVGTKMTCAHCRTPLQKGQTAYQRKGLPQLFCSSSCLTTFSKKPSGKKTCTFCKKEIWNTKDSVVAQTGSGGSFHEFCTSVCLSLYEAQQQRPIPQSGDPADATRCSICQKTGEVLHEVSNGSVVHRLCSDSCFSKFRANKGLKTNCCDQCGAYIYTKTGSPGPELLFHEGQQKRFCNTTCLGAYKKKNTRVYPCVWCKTLCKNFEMLSHVDRNGKTSLFCSLCCTTSYKVKQAGLTGPPRPCSFCRRSLSDPCYYNKVDRTVYQFCSPSCWTKFQRTSPEGGIHLSCHYCHSLFSGKPEVLDWQDQVFQFCCRDCCEDFKRLRGVVSQCEHCRQEKLLHEKLRFSGVEKSFCSEGCVLLYKQDFTKKLGLCCITCTYCSQTCQRGVTEQLDGSTWDFCSEDCKSKYLLWYCKAARCHACKRQGKLLETIHWRGQIRHFCNQQCLLRFYSQQNQPNLDTQSGPESLLNSQSPESKPQTPSQTKVENSNTVRTPEENGNLGKIPVKTRSAPTAPTPPPPPPPATPRKNKAAMCKPLMQNRGVSCKVEMKSKGSQTEEWKPQVIVLPIPVPIFVPVPMHLYCQKVPVPFSMPIPVPVPMFLPTTLESTDKIVETIEELKVKIPSNPLEADILAMAEMIAEAEELDKASSDLCDLVSNQSAEGLLEDCDLFGPARDDVLAMAVKMANVLDEPGQDLEADFPKNPLDINPSVDFLFDCGLVGPEDVSTEQDLPRTMRKGQKRLVLSESCSRDSMSSQPSCTGLNYSYGVNAWKCWVQSKYANGETSKGDELRFGPKPMRIKEDILACSAAELNYGLAQFVREITRPNGERYEPDSIYYLCLGIQQYLLENNRMVNIFTDLYYLTFVQELNKSLSTWQPTLLPNNTVFSRVEEEHLWECKQLGVYSPFVLLNTLMFFNTKFFGLQTAEEHMQLSFTNVVRQSRKCTTPRGTTKVVSIRYYAPVRQRKGRDTGPGKRKREDEAPILEQRENRMNPLRCPVKFYEFYLSKCPESLRTRNDVFYLQPERSCIAESPLWYSVIPMDRSMLESMLNRILAVREIYEELGRPGEEDLD

SEQ ID NO: 102177 - protein, 1358 aa, Homo sapiens
  Payload ID: 20363
  Gene Name: zinc finger, MYM-type 3
  Uniprot ID: Q14202
  ENSP ID: ENSP00000363110
MDPSDFPSPFDPLTLPEKPLAGDLPVDMEFGEDLLESQTAPTRGWAPPGPSPSSGALDLLDTPAGLEKDPGVLDGATELLGLGGLLYKAPSPPEVDHGPEGTLAWDAGDQTLEPGPGGQTPEVVPPDPGAGANSCSPEGLLEPLAPDSPITLQSPHIEEEETTSIATARRGSPGQEEELPQGQPQSPNAPPSPSVGETLGDGINSSQTKPGGSSPPAHPSLPGDGLTAKASEKPPERKRSERVRRAEPPKPEVVDSTESIPVSDEDSDAMVDDPNDEDFVPFRPRRSPRMSLRSSVSQRAGRSAVGTKMTCAHCRTPLQKGQTAYQRKGLPQLFCSSSCLTTFSKKPSGKKTCTFCKKEIWNTKDSVVAQTGSGGSFHEFCTSVCLSLYEAQQQRPIPQSGDPADATRCSICQKTGEVLHEVSNGSVVHRLCSDSCFSKFRANKGLKTNCCDQCGAYIYTKTGSPGPELLFHEGQQKRFCNTTCLGAYKKKNTRVYPCVWCKTLCKNFEMLSHVDRNGKTSLFCSLCCTTSYKVKQAGLTGPPRPCSFCRRSLSDPCYYNKVDRTVYQFCSPSCWTKFQRTSPEGGIHLSCHYCHSLFSGKPEVLDWQDQVFQFCCRDCCEDFKRLRGVVSQCEHCRQEKLLHEKLRFSGVEKSFCSEGCVLLYKQDFTKKLGLCCITCTYCSQTCQRGVTEQLDGSTWDFCSEDCKSKYLLWYCKAARCHACKRQGKLLETIHWRGQIRHFCNQQCLLRFYSQQNQPNLDTQSGPESLLNSQSPESKPQTPSQTKVENSNTIPVKTRSAPTAPTPPPPPPPATPRKNKAAMCKPLMQNRGVSCKVEMKSKGSQTEEWKPQVIVLPIPVPIFVPVPMHLYCQKVPVPFSMPIPVPVPMFLPTTLESTDKIVETIEELKVKIPSNPLEADILAMAEMIAEAEELDKASSDLCDLVSNQSAEGLLEDCDLFGPARDDVLAMAVKMANVLDEPGQDLEADFPKNPLDINPSVDFLFDCGLVGPEDVSTEQDLPRTMRKGQKRLVLSESCSRDSMSSQPSCTGLNYSYGVNAWKCWVQSKYANGETSKGDELRFGPKPMRIKEDILACSAAELNYGLAQFVREITRPNGERYEPDSIYYLCLGIQQYLLENNRMVNIFTDLYYLTFVQELNKSLSTWQPTLLPNNTVFSRVEEEHLWECKQLGVYSPFVLLNTLMFFNTKFFGLQTAEEHMQLSFTNVVRQSRKCTTPRGTTKVVSIRYYAPVRQRKGRDTGPGKRKREDEAPILEQRENRMNPLRCPVKFYEFYLSKCPESLRTRNDVFYLQPERSCIAESPLWYSVIPMDRSMLESMLNRILAVREIYEELGRPGEEDLD

SEQ ID NO: 102178 - protein, 1548 aa, Homo sapiens
  Payload ID: 20364
  Gene Name: zinc finger, MYM-type 4
  Uniprot ID: Q5VZL5
  ENSP ID: ENSP00000322915
MAEREVESGPRKRFEQKSGAVFDEIVENCGGIMDTEMSEDIDHNLTPTLDSMSYGMPNQTGSENSLLDEDDYFLNSGDLAGIPVVGSDNEDEQDFSSKDNLVSSIHTDDSLEVERRVTQHESDNENEIQIQNKLKKDFPKQFDQVSVFKSIRKDFSLVRENSKETFSGKEKNRDLTYEREKRLDKPHKDLDSRLKSSFFDKAANQVEETLHTHLPQTPETNFRDSSYPFANKESIGSELGNSFASNIRIKEEPLDDEYDKAMAPQQGLLDKIKDEPDNAQEYSHGQQQKTQEGELKISAVFSVSGSPLAPQLTTGFQPSLASSGMNKMLPSVPATAVRVSCSGCKKILQKGQTAYQRKGSTQLFCSTLCLTGYTVPPARPPPPLTKKTCSSCSKDILNPKDVISAQFENTTTSKDFCSQSCLSTYELKKKPIVTINTNSISTKCSMCQKNAVIRHEVNYQNVVHKLCSDACFSKFRSANNLTMNCCENCGGYCYSGSGQCHMLQIEGQSKKFCSSSCITAYKQKSAKITPCALCKSLRSSAEMIENTNSLGKTELFCSVNCLSAYRVKMVTSAGVQVQCNSCKTSAIPQYHLAMSDGSIRNFCSYSCVVAFQNLFNKPTGMNSSVVPLSQGQVIVSIPTGSTVSAGGGSTSAVSPTSISSSAAAGLQRLAAQSQHVGFARSVVKLKCQHCNRLFATKPELLDYKGKMFQFCGKNCSDEYKKINNVMAMCEYCKIEKIVKETVRFSGADKSFCSEGCKLLYKHDLAKRWGNHCKMCSYCLQTSPKLVQNNLGGKVEEFCCEECMSKYTVLFYQMAKCDACKRQGKLSESLKWRGEMKHFCNLLCILMFCNQQSVCDPPSQNNAANISMVQAASAGPPSLRKDSTPVIANVVSLASAPAAQPTVNSNSVLQGAVPTVTAKIIGDASTQTDALKLPPSQPPRLLKNKALLCKPITQTKATSCKPHTQNKECQTEDTPSQPQIIVVPVPVPVFVPIPLHLYTQYAPVPFGIPVPMPVPMLIPSSMDSEDKVTESIEDIKEKLPTHPFEADLLEMAEMIAEDEEKKTLSQGESQTSEHELFLDTKIFEKDQGSTYSGDLESEAVSTPHSWEEELNHYALKSNAVQEADSELKQFSKGETEQDLEADFPSDSFDPLNKGQGIQARSRTRRRHRDGFPQPRRRGRKKSIVAVEPRSLIQGAFQGCSVSGMTLKYMYGVNAWKNWVQWKNAKEEQGDLKCGGVEQASSSPRSDPLGSTQDHALSQESSEPGCRVRSIKLKEDILSCTFAELSLGLCQFIQEVRRPNGEKYDPDSILYLCLGIQQYLFENGRIDNIFTEPYSRFMIELTKLLKIWEPTILPNGYMFSRIEEEHLWECKQLGAYSPIVLLNTLLFFNTKYFQLKNVTEHLKLSFAHVMRRTRTLKYSTKMTYLRFFPPLQKQESEPDKLTVGKRKRNEDDEVPVGVEMAENTDNPLRCPVRLYEFYLSKCSESVKQRNDVFYLQPERSCVPNSPMWYSTFPIDPGTLDTMLTRILMVREVHEELAKAKSEDSDVELSD

SEQ ID NO: 102179 - protein, 98 aa, Homo sapiens
  Payload ID: 20364
  Gene Name: zinc finger, MYM-type 4
  ENSP ID: ENSP00000397524
MDTEMSEDIDHNLTPTLDSMSYGMPNQTGSENSLLDEDDYFLNSGDLAGIPVVGSDNEDEQDFSSKDNLVSSIHTDDSLEVERRVTQHESDNENEIQI

SEQ ID NO: 102180 - protein, 1207 aa, Homo sapiens
  Payload ID: 20364
  Gene Name: zinc finger, MYM-type 4
  ENSP ID: ENSP00000400506
  MOD_RES (1)..(1): Any amino acid
XPLDDEYDKAMAPQQGLLDKIKDEPDNAQEYSHGQQQKTQEGELKISAVFSVSGSPLAPQLTTGFQPSLASSGMNKMLPSVPATAVRVSCSGCKKILQKGQTAYQRKGSTQLFCSTLCLTGYTVPPARPPPPLTKKTCSSCSKDILNPKDVISAQFENTTTSKDFCSQSCLSTYELKKKPIVTINTNSISTKCSMCQKNAVIRHEVNYQNVVHKLCSDACFSKFRSANNLTMNCCENCGGYCYSGSGQCHMLQIEGQSKKFCSSSCITAYKQNLFNKPTGMNSSVVPLSQGQVIVSIPTGSTVSAGGGSTSAVSPTSISSSAAAGLQRLAAQSQHVGFARSVVKLKCQHCNRLFATKPELLDYKGKMFQFCGKNCSDEYKKINNVMAMCEYCKIEKIVKETVRFSGADKSFCSEGCKLLYKHDLAKRWGNHCKMCSYCLQTSPKLVQNNLGGKVEEFCCEECMSKYTVLFYQMAKCDACKRQGKLSESLKWRGEMKHFCNLLCILMFCNQQSVCDPPSQNNAANISMVQAASAGPPSLRKDSTPVIANVVSLASAPAAQPTVNSNSVLQGAVPTVTAKIIGDASTQTDALKLPPSQPPRLLKNKALLCKPITQTKATSCKPHTQNKECQTDTPSQPQIIVVPVPVPVFVPIPLHLYTQYAPVPFGIPVPMPVPMLIPSSMDSEDKVTESIEDIKEKLPTHPFEADLLEMAEMIAEDEEKKTLSQGESQTSEHELFLDTKIFEKDQGSTYSGDLESEAVSTPHSWEEELNHYALKSNAVQEADSELKQFSKGETEQDLEADFPSDSFDPLNKGQGIQARSRTRRRHRDGFPQPRRRGRKKSIVAVEPRSLIQGAFQGCSVSGMTLKYMYGVNAWKNWVQWKNAKEEQGDLKCGGVEQASSSPRSDPLGSTQDHALSQESSEPGCRVRSIKLKEDILSCTFAELSLGLCQFIQEVRRPNGEKYDPDSILYLCLGIQQYLFENGRIDNIFTEPYSRFMIELTKLLKIWEPTILPNGYMFSRIEEEHLWECKQLGAYSPIVLLNTLLFFNTKYFQLKNVTEHLKLSFAHVMRRTRTLKYSTKMTYLRFFPPLQKQESEPDKLTVGKRKRNEDDEVPVGVEMAENTDNPLRCPVRLYEFYLSKCSESVKQRNDVFYLQPERSCVPNSPMWYSTFPIDPGTLDTMLTRILMVREVHEELAKAKSEDSDVELSD

SEQ ID NO: 102181 - protein, 669 aa, Homo sapiens
  Payload ID: 20365
  Gene Name: zinc finger, MYM-type 5
  Uniprot ID: Q9UJ78
  ENSP ID: ENSP00000337034
MEKCSVGGLELTEQTPALLGNMAMATSLMDIGDSFGHPACPLVSRSRNSPVEDDDDDDDVVFIESIQPPSISAPAIADQRNFIFASSKNEKPQGNYSVIPPSSRDLASQKGNISETIVIDDEEDIETNGGAEKKSSCFIEWGLPGTKNKTNDLDFSTSSLSRSKTKTGVRPFNPGRMNVAGDLFQNGEFATHHSPDSWISQSASFPSNQKQPGVDSLSPVALLRKQNFQPTAQQQLTKPAKITCANCKKPLQKGQTAYQRKGSAHLFCSTTCLSSFSHKRTQNTRSIICKKDASTKKANVILPVESSKSFQEFYSTSCLSPCENNWNLKKGVFNKSRCTICSKLAEIRHEVSVNNVTHKLCSNHCFNKYRLANGLIMNCCEHCGEYMPSKSTGNNILVIGGQQKRFCCQSCINEYKQMMETKSKKLTASENRKRNAFREENEKQLYGSSNTLLKKIEGIPEKKEKTSQLQLSVECGTDTLLIQENVNLPPSSTSTIADTFQEQLEEKNFEDSIVPVVLSADPGTWPRILNIKQRDTLVENVPPQVRNFNFPKDNTGRKFSETYYTRILPNGEKTTRSWLLYSTSKDSVFCLYCKLFGEGKNQLKNENGCKDWQHLSHILSKHEESEMHVNNSVKYSKLKSDLKKNKAIDAAEHRLYENEKNDGVLLLYT

SEQ ID NO: 102182 - protein, 382 aa, Homo sapiens
  Payload ID: 20365
  Gene Name: zinc finger, MYM-type 5
  Uniprot ID: Q9UJ78
  ENSP ID: ENSP00000372361
MEKCSVGGLELTEQTPALLGNMAMATSLMDIGDSFGHPACPLVSRSRNSPVEDDDDDDDVVFIESIQPPSISAPAIADQRNFIFASSKNEKPQGNYSVIPPSSRDLASQKGNISETIVIDDEEDIETNGGAEKKSSCFIEWGLPGTKNKTNDLDFSTSSLSRSKTKTGVRPFNPGRMNVAGDLFQNGEFATHHSPDSWISQSASFPSNQKQPGVDSLSPVALLRKQNFQPTAQQQLTKPAKITCANCKKPLQKGQTAYQRKGSAHLFCSTTCLSSFSHKRTQNTRSIICKKDASTKKANVILPVESSKSFQEFYSTSCLSPCENNWNLKKGVFNKSRCTICSKLAEVWIFIPKLLFRLTVIILTFKCYYVLFHLHNARVLDV

SEQ ID NO: 102183 - protein, 208 aa, Homo sapiens
  Payload ID: 20365
  Gene Name: zinc finger, MYM-type 5
  Uniprot ID: Q9UJ78
  ENSP ID: ENSP00000372364
MEKCSVGGLELTEQTPALLGNMAMATSLMDIGDSFGHPACPLVSRSRNSPVEDDDDDDDVVFIESIQPPSISAPAIADQRNFIFASSKNEKPQGNYSVIPPSSRDLASQKGNISETIVIDDEEDIETNGGAEKKSSCFIEWGLPGTKNKTNDLDFSTSSLSRSKTKTGVRPFNPGRMNVAGDLFQNGEFATHHSPEMHLQRRLMSFFQ

SEQ ID NO: 102184 - protein, 659 aa, Homo sapiens
  Payload ID: 20365
  Gene Name: zinc finger, MYM-type 5
  ENSP ID: ENSP00000445779
LTEQTPALLGNMAMATSLMDIGDSFGHPACPLVSRSRNSPVEDDDDDDDVVFIESIQPPSISAPAIADQRNFIFASSKNEKPQGNYSVIPPSSRDLASQKGNISETIVIDDEEDIETNGGAEKKSSCFIEWGLPGTKNKTNDLDFSTSSLSRSKTKTGVRPFNPGRMNVAGDLFQNGEFATHHSPDSWISQSASFPSNQKQPGVDSLSPVALLRKQNFQPTAQQQLTKPAKITCANCKKPLQKGQTAYQRKGSAHLFCSTTCLSSFSHKRTQNTRSIICKKDASTKKANVILPVESSKSFQEFYSTSCLSPCENNWNLKKGVFNKSRCTICSKLAEIRHEVSVNNVTHKLCSNHCFNKYRLANGLIMNCCEHCGEYMPSKSTGNNILVIGGQQKRFCCQSCINEYKQMMETKSKKLTASENRKRNAFREENEKQLYGSSNTLLKKIEGIPEKKEKTSQLQLSVECGTDTLLIQENVNLPPSSTSTIADTFQEQLEEKNFEDSIVPVVLSADPGTWPRILNIKQRDTLVENVPPQVRNFNFPKDNTGRKFSETYYTRILPNGEKTTRSWLLYSTSKDSVFCLYCKLFGEGKNQLKNENGCKDWQHLSHILSKHEESEMHVNNSVKYSKLKSDLKKNKAIDAAEHRLYENEKNDGVLLLYT

SEQ ID NO: 102185 - protein, 170 aa, Homo sapiens
  Payload ID: 20366
  Gene Name: zinc finger, MYM-type 6
  Uniprot ID: O95789
  ENSP ID: ENSP00000326695
MKEPLDGECGKAVVPQQELLDKIKEEPDNAQEYGCVQQPKTQESKLKIGGVSSVNERPIAQQLNPGFQLSFASSGPSVLLPSVPAVAIKVFCSGCKKMLYKGQTAYHKTGSTQLFCSTRCITRHSSPACLPPPPKKTCTNCSKYKILNIPFYFTFFLVCILFSSNILLIL

SEQ ID NO: 102186 - protein, 1325 aa, Homo sapiens
  Payload ID: 20366
  Gene Name: zinc finger, MYM-type 6
  Uniprot ID: O95789
  ENSP ID: ENSP00000349708
MKEPLDGECGKAVVPQQELLDKIKEEPDNAQEYGCVQQPKTQESKLKIGGVSSVNERPIAQQLNPGFQLSFASSGPSVLLPSVPAVAIKVFCSGCKKMLYKGQTAYHKTGSTQLFCSTRCITRHSSPACLPPPPKKTCTNCSKDILNPKDVITTRFENSYPSKDFCSQSCLSSYELKKKPVVTIYTKSISTKCSMCQKNADTRFEVKYQNVVHGLCSDACFSKFHSTNNLTMNCCENCGSYCYSSSGPCQSQKVFSSTSVTAYKQNSAQIPPYALGKSLRPSAEMIETTNDSGKTELFCSINCLSAYRVKTVTSSGVQVSCHSCKTSAIPQYHLAMSNGTIYSFCSSSCVVAFQNVFSKPKGTNSSAVPLSQGQVVVSPPSSRSAVSIGGGNTSAVSPSSIRGSAAASLQPLAEQSQQVALTHTVVKLKCQHCNHLFATKPELLFYKGKMFLFCGKNCSDEYKKKNKVVAMCDYCKLQKIIKETVRFSGVDKPFCSEVCKFLSARDFGERWGNYCKMCSYCSQTSPNLVENRLEGKLEEFCCEDCMSKFTVLFYQMAKCDGCKRQGKLSESIKWRGNIKHFCNLFCVLEFCHQQIMNDCLPQNKVNISKAKTAVTELPSARTDTTPVITSVMSLAKIPATLSTGNTNSVLKGAVTKEAAKIIQDESTQEDAMKFPSSQSSQPSRLLKNKGISCKPVTQTKATSCKPHTQHKECQTDLPMPNEKNDAELDSPPSKKKRLGFFQTYDTEYLKVGFIICPGSKESSPRPQCVICGEILSSENMKPANLSHHLKTKHSELENKPVDFFEQKSLEMECQNSSLKKCLLVEKSLVKASYLIAFQTAASKKPFSIAEELIKPYLVEMCSEVLGSSAGDKMKTIPLSNVTIQHRIDELSADIEDQLIQKVRESKWFALQIDESSEISNITLLLCYIRFIDYDCRDVKEELLFCIEMPTQITGFEIFELINKYIDSKSLNWKHCVGLCTDGAASMTGRYSGLKAKIQEVAMNTAAFTHCFIHRERLVAEKLSPCLHKILLQSAQILSFIKSNALNSRMLTILCEEMGSEHVSLPLHAEVRWISRGRMLKRLFELRHEIEIFLSQKHSDLAKYFHDEEWVGKLAYLSDIFSLINELNLSLQGTLTTFFNLCNKIDVFKRKLKMWLKRTQENDYDMFPSFSEFSNSSGLNMTDITRIIFEHLEGLSQVFSDCFPPEQDLRSGNLWIIHPFMNHQNNNLTDFEEEKLTELSSDLGLQALFKSVSVTQFWINAKTSYPELHERAMKFLLPFSTVYLCDAAFSALTESKQKNLLGSGPALRLAVTSLIPRIEKLVKEKE

SEQ ID NO: 102187 - protein, 170 aa, Homo sapiens; identical to SEQ ID NO: 102185
  Payload ID: 20366
  Gene Name: zinc finger, MYM-type 6
  Uniprot ID: O95789
  ENSP ID: ENSP00000362430

SEQ ID NO: 102188 - protein, 208 aa, Homo sapiens
  Payload ID: 20366
  Gene Name: zinc finger, MYM-type 6
  ENSP ID: ENSP00000391337
MKEPLDGECGKAVVPQQELLDKIKEEPDNAQEYGCVQQPKTQESKLKIGGVSSVNERPIAQQLNPGFQLSFASSGPSVLLPSVPAVAIKVFCSGCKKMLYKGQTAYHKTGSTQLFCSTRCITRHSSPACLPPPPKKTCTNCSKDILNPKDVITTRFENSYPSKDFCSQSCLSSYELKKKPVVTIYTKSISTKCSMCQKNADTRFEVKY

SEQ ID NO: 102189 - protein, 440 aa, Homo sapiens
  Payload ID: 20367
  Gene Name: zinc finger, MYND-type containing 10
  Uniprot ID: O75800
  ENSP ID: ENSP00000231749
MGDLELLLPGEAEVLVRGLRSFPLREMGSEGWNQQHENLEKLNMQAILDATVSQGEPIQELLVTHGKVPTLVEELIAVEMWKQKVFPVFCRVEDFKPQNTFPIYMVVHHEASIINLLETVFFHKEVCESAEDTVLDLVDYCHRKLTLLVAQSGCGGPPEGEGSQDSNPMQELQKQAELMEFEIALKALSVLRYITDCVDSLSLSTLSRMLSTHNLPCLLVELLEHSPWSRREGGKLQQFEGSRWHTVAPSEQQKLSKLDGQVWIALYNLLLSPEAQARYCLTSFAKGRLLKLRAFLTDTLLDQLPNLAHLQSFLAHLTLTETQPPKKDLVLEQIPEIWERLERENRGKWQAIAKHQLQHVFSPSEQDLRLQARRWAETYRLDVLEAVAPERPRCAYCSAEASKRCSRCQNEWYCCRECQVKHWEKHGKTCVLAAQGDRAK

SEQ ID NO: 102190 - protein, 435 aa, Homo sapiens
  Payload ID: 20367
  Gene Name: zinc finger, MYND-type containing 10
  Uniprot ID: O75800
  ENSP ID: ENSP00000353289
MGDLELLLPGEAEVLVRGLRSFPLREMGSEGWNQQHENLEKLNMQAILDATVSQGEPIQELLVTHGKVPTLVEELIAVEMWKQKVFPVFCRVEDFKPQNTFPIYMVVHHEASIINLLETVFFHKEVCESAEDTVLDLVDYCHRKLTLLVAQSGCGGPPEGEGSQDSNPMQELQKQAELMEFEIALKALSVLRYITDCVDRQWSVSQPPQLAHLKRIQRLHPVCWFLSPGKLQQFEGSRWHTVAPSEQQKLSKLDGQVWIALYNLLLSPEAQARYCLTSFAKGRLLKLRAFLTDTLLDQLPNLAHLQSFLAHLTLTETQPPKKDLVLEQIPEIWERLERENRGKWQAIAKHQLQHVFSPSEQDLRLQARRWAETYRLDVLEAVAPERPRCAYCSAEASKRCSRCQNEWYCCRECQVKHWEKHGKTCVLAAQGDRAK

SEQ ID NO: 102191 - protein, 37 aa, Homo sapiens
  Payload ID: 20367
  Gene Name: zinc finger, MYND-type containing 10
  ENSP ID: ENSP00000391545
MGDLELLLPGEAEVLVRGLRSFPLREMGSEGQVEPAA

SEQ ID NO: 102192 - protein, 282 aa, Homo sapiens
  Payload ID: 20367
  Gene Name: zinc finger, MYND-type containing 10
  ENSP ID: ENSP00000393687
MQAILDATVSQGEPIQELLVTHGKVPTLVEELIAVEMWKQKVFPVFCRVEDFKPQNTFPIYMVVHHEASIINLLETVFFHKEVCESAEDTVLDLVDYCHRKLTLLVAQSGCGGPPEGEGSQDSNPMQELQKQAELMEFEIALKALSVLRYITDCVDSLSLSTLSRMLSTHNLPCLLVELLEHSPWSRREGGKLQQFEGSRWHTVAPSEQQKLSKLDGQVWIALYNLLLSPEAQARYCLTSFAKGRLLKLRAFLTDTLLDQLPNLAHLQSFLAHLTLTETQPP

SEQ ID NO: 102193 - protein, 37 aa, Homo sapiens; identical to SEQ ID NO: 102191
  Payload ID: 20367
  Gene Name: zinc finger, MYND-type containing 10
  ENSP ID: ENSP00000415661

SEQ ID NO: 102194 - protein, 547 aa, Homo sapiens
  Payload ID: 20368
  Gene Name: zinc finger, MYND-type containing 11
  ENSP ID: ENSP00000309992
MARLTKRRQADTKAIQHLWAAIEIIRNQKQIANIDRITKYMSRVHGMHPKETTRQLSLAVKDGLIVETLTVGCKGSKAGIEQEGYWLPGDEISIKKKNTNKQEMGTYLRFIVSRMKERAIDLNKKGKDNKHPMYRRLVHSAVDVPTIQEKVNEGKYRSYEEFKADAQLLLHNTVIFYGDSEQADIARMLYKDTCHELDELQLCKNCFYLSNARPDNWFCYPCIPNHELVWAKMKGFGFWPAKVMQKEDNQVDVRFFGHHHQRAWIPSENIQDITVNIHRLHVKRSMGWKKACDELELHQRFLREGRFWKSKNEDRGEEEAESSISSTSNEQLKVTQEPRAKKGRRNQSVEPKKEEPEPETEAVSSSQEIPTMPQPIEKVSVSTQTKKLSASSPRMLHRSTQTTNDGVCQSMCHDKYTKIFNDFKDRMKSDHKRETERVVREALEKLRSEMEEEKRQAVNKAVANMQGEMDRKCKQVKEKCKEEFVEEIKKLATQHKQLISQTKKKQWCYNCEEEAMYHCCWNTSYCSIKCQQEHWHAEHKRTCRRKR

SEQ ID NO: 102195 - protein, 585 aa, Homo sapiens
  Payload ID: 20368
  Gene Name: zinc finger, MYND-type containing 11
  ENSP ID: ENSP00000370996
MVIFTSLHRYVIFISCIIVINWYMSRVHGMHPKETTRQLSLAVKDGLIVETLTVGCKGSKAGIEQEGYWLPGDEIDWETENHDWYCFECHLPGEVLICDLCFRVYHSKCLSDEFRLRDSSSPWQCPVCRSIKKKNTNKQEMGTYLRFIVSRMKERAIDLNKKGKDNKHPMYRRLVHSAVDVPTIQEKVNEGKYRSYEEFKADAQLLLHNTVIFYGADSEQADIARMLYKDTCHELDELQLCKNCFYLSNARPDNWFCYPCIPNHELVWAKMKGFGFWPAKVMQKEDNQVDVRFFGHHHQRAWIPSENIQDITVNIHRLHVKRSMGWKKACDELELHQRFLREGRFWKSKNEDRGEEEAESSISSTSNEQLKVTQEPRAKKGRRNQSVEPKKEEPEPETEAVSSSQEIPTMPQPIEKVSVSTQTKKLSASSPRMLHRSTQTTNDGVCQSMCHDKYTKIFNDFKDRMKSDHKRETERVVREALEKLRSEMEEEKRQAVNKAVANMQGEMDRKCKQVKEKCKEEFVEEIKKLATQHKQLISQTKKKQWCYNCEEEAMYHCCWNTSYCSIKCQQEHWHAEHKRTCRRKR

SEQ ID NO: 102196 - protein, 602 aa, Homo sapiens
  Payload ID: 20368
  Gene Name: zinc finger, MYND-type containing 11
  Uniprot ID: Q15326
  ENSP ID: ENSP00000371003
MARLTKRRQADTKAIQHLWAAIEIIRNQKQIANIDRITKYMSRVHGMHPKETTRQLSLAVKDGLIVETLTVGCKGSKAGIEQEGYWLPGDEIDWETENHDWYCFECHLPGEVLICDLCFRVYHSKCLSDEFRLRDSSSPWQCPVCRSIKKKNTNKQEMGTYLRFIVSRMKERAIDLNKKGKDNKHPMYRRLVHSAVDVPTIQEKVNEGKYRSYEEFKADAQLLLHNTVIFYGADSEQADIARMLYKDTCHELDELQLCKNCFYLSNARPDNWFCYPCIPNHELVWAKMKGFGFWPAKVMQKEDNQVDVRFFGHHHQRAWIPSENIQDITVNIHRLHVKRSMGWKKACDELELHQRFLREGRFWKSKNEDRGEEEAESSISSTSNEQLKVTQEPRAKKGRRNQSVEPKKEEPEPETEAVSSSQEIPTMPQPIEKVSVSTQTKKLSASSPRMLHRSTQTTNDGVCQSMCHDKYTKIFNDFKDRMKSDHKRETERVVREALEKLRSEMEEEKRQAVNKAVANMQGEMDRKCKQVKEKCKEEFVEEIKKLATQHKQLISQTKKKQWCYNCEEEAMYHCCWNTSYCSIKCQQEHWHAEHKRTCRRKR

SEQ ID NO: 102197 - protein, 482 aa, Homo sapiens
  Payload ID: 20368
  Gene Name: zinc finger, MYND-type containing 11
  ENSP ID: ENSP00000371017
MSRVHGMHPKETTRQLSLAVKDGLIVETLTVGCKGSKAGIEQEGYWLPGDEISIKKKNTNKQEMGTYLRFIVSRMKERAIDLNKKGKDNKHPMYRRLVHSAVDVPTIQEKVNEGKYRSYEEFKADAQLLLHNTVIFYGADSEQADIARMLYKDTCHEIPNHELVWAKMKGFGFWPAKVMQKEDNQVDVRFFGHHHQRAWIPSENIQDITVNIHRLHVKRSMGWKKACDELELHQRFLREGRFWKSKNEDRGEEEAESSISSTSNEQLKVTQEPRAKKGRRNQSVEPKKEEPEPETEAVSSSQEIPTMPQPIEKVSVSTQTKKLSASSPRMLHRSTQTTNDGVCQSMCHDKYTKIFNDFKDRMKSDHKRETERVVREALEKLRSEMEEEKRQAVNKAVANMQGEMDRKCKQVKEKCKEEFVEEIKKLATQHKQLISQTKKKQWCYNCEEEAMYHCCWNTSYCSIKCQQEHWHAEHKRTCRRKR

SEQ ID NO: 102198 - protein, 548 aa, Homo sapiens
  Payload ID: 20368
  Gene Name: zinc finger, MYND-type containing 11
  Uniprot ID: Q15326
  ENSP ID: ENSP00000371020
MARLTKRRQADTKAIQHLWAAIEIIRNQKQIANIDRITKYMSRVHGMHPKETTRQLSLAVKDGLIVETLTVGCKGSKAGIEQEGYWLPGDEISIKKKNTNKQEMGTYLRFIVSRMKERAIDLNKKGKDNKHPMYRRLVHSAVDVPTIQEKVNEGKYRSYEEFKADAQLLLHNTVIFYGADSEQADIARMLYKDTCHELDELQLCKNCFYLSNARPDNWFCYPCIPNHELVWAKMKGFGFWPAKVMQKEDNQVDVRFFGHHHQRAWIPSENIQDITVNIHRLHVKRSMGWKKACDELELHQRFLREGRFWKSKNEDRGEEEAESSISSTSNEQLKVTQEPRAKKGRRNQSVEPKKEEPEPETEAVSSSQEIPTMPQPIEKVSVSTQTKKLSASSPRMLHRSTQTTNDGVCQSMCHDKYTKIFNDFKDRMKSDHKRETERVVREALEKLRSEMEEEKRQAVNKAVANMQGEMDRKCKQVKEKCKEEFVEEIKKLATQHKQLISQTKKKQWCYNCEEEAMYHCCWNTSYCSIKCQQEHWHAEHKRTCRRKR

SEQ ID NO: 102199 - protein, 213 aa, Homo sapiens
  Payload ID: 20368
  Gene Name: zinc finger, MYND-type containing 11
  ENSP ID: ENSP00000381046
MARLTKRRQADTKAIQHLWAAIEIIRNQKQIANIDRITKYMSRVHGMHPKETTRQLSLAVKDGLIVETLTVGCKGSKAGIEQEGYWLPGDEIAYSMQPFSRTAAPNKDWETENHDWYCFECHLPGEVLICDLCFRVYHSKCLSDEFRLRDSSSPWQCPVCRSIKKKNTNKQEMGTYLRFIVSRMKERAIDLNKKGKDNKHPMYRRLVHSAVDV

SEQ ID NO: 102200 - protein, 517 aa, Homo sapiens
  Payload ID: 20368
  Gene Name: zinc finger, MYND-type containing 11
  Uniprot ID: Q15326
  ENSP ID: ENSP00000381050
MARLTKRRQADTKAIQHLWAAIEIIRNQKQIANIDRITKYMSRVHGMHPKETTRQLSLAVKDGLIVETLTVGCKGSKAGIEQEGYWLPGDEISIKKKNTNKQEMGTYLRFIVSRMKERKVNEGKYRSYEEFKADAQLLLHNTVIFYGADSEQADIARMLYKDTCHELDELQLCKNCFYLSNARPDNWFCYPCIPNHELVWAKMKGFGFWPAKVMQKEDNQVDVRFFGHHHQRAWIPSENIQDITVNIHRLHVKRSMGWKKACDELELHQRFLREGRFWKSKNEDRGEEEAESSISSTSNEQLKVTQEPRAKKGRRNQSVEPKKEEPEPETEAVSSSQEIPTMPQPIEKVSVSTQTKKLSASSPRMLHRSTQTTNDGVCQSMCHDKYTKIFNDFKDRMKSDHKRETERVVREALEKLRSEMEEEKRQAVNKAVANMQGEMDRKCKQVKEKCKEEFVEEIKKLATQHKQLISQTKKKQWCYNCEEEAMYHCCWNTSYCSIKCQQEHWHAEHKRTCRRKR

SEQ ID NO: 102201 - protein, 602 aa, Homo sapiens; identical to SEQ ID NO: 102196
  Payload ID: 20368
  Gene Name: zinc finger, MYND-type containing 11
  Uniprot ID: Q15326
  ENSP ID: ENSP00000381053

SEQ ID NO: 102202 - protein, 522 aa, Homo sapiens
  Payload ID: 20368
  Gene Name: zinc finger, MYND-type containing 11
  ENSP ID: ENSP00000385484
MARLTKRRQADTKAIQHLWAAIEIIRNQKQIANIDRITKYMSRVHGMHPKETTRQLSLAVKDGLIVETLTVGCKGSKAGIEQEGYWLPGDEISIKKKNTNKQEMGTYLRFIVSRMKERAIDLNKKGKDNKHPMYRRLVHSAVDVPTIQEKVNEGKYRSYEEFKADAQLLLHNTVIFYGADSEQADIARMLYKDTCHEIPNHELVWAKMKGFGFWPAKVMQKEDNQVDVRFFGHHHQRAWIPSENIQDITVNIHRLHVKRSMGWKKACDELELHQRFLREGRFWKSKNEDRGEEEAESSISSTSNEQLKVTQEPRAKKGRRNQSVEPKKEEPEPETEAVSSSQEIPTMPQPIEKVSVSTQTKKLSASSPRMLHRSTQTTNDGVCQSMCHDKYTKIFNDFKDRMKSDHKRETERVVREALEKLRSEMEEEKRQAVNKAVANMQGEMDRKCKQVKEKCKEEFVEEIKKLATQHKQLISQTKKKQWCYNCEEEAMYHCCWNTSYCSIKCQQEHWHAEHKRTCRRKR

SEQ ID NO: 102203 - protein, 571 aa, Homo sapiens
  Payload ID: 20368
  Gene Name: zinc finger, MYND-type containing 11
  ENSP ID: ENSP00000386010
MARLTKRRQADTKAIQHLWAAIEIIRNQKQIANIDRITKYMSRVHGMHPKETTRQLSLAVKDGLIVETLTVGCKGSKAGIEQEGYWLPGDEIDWETENHDWYCFECHLPGEVLICDLCFRVYHSKCLSDEFRLRDSSSPWQCPVCRSIKKKNTNKQEMGTYLRFIVSRMKERKVNEGKYRSYEEFKADAQLLLHNTVIFYGADSEQADIARMLYKDTCHELDELQLCKNCFYLSNARPDNWFCYPCIPNHELVWAKMKGFGFWPAKVMQKEDNQVDVRFFGHHHQRAWIPSENIQDITVNIHRLHVKRSMGWKKACDELELHQRFLREGRFWKSKNEDRGEEEAESSISSTSNEQLKVTQEPRAKKGRRNQSVEPKKEEPEPETEAVSSSQEIPTMPQPIEKVSVSTQTKKLSASSPRMLHRSTQTTNDGVCQSMCHDKYTKIFNDFKDRMKSDHKRETERVVREALEKLRSEMEEEKRQAVNKAVANMQGEMDRKCKQVKEKCKEEFVEEIKKLATQHKQLISQTKKKQWCYNCEEEAMYHCCWNTSYCSIKCQQEHWHAEHKRTCRRKR

SEQ ID NO: 102204 - protein, 140 aa, Homo sapiens
  Payload ID: 20368
  Gene Name: zinc finger, MYND-type containing 11
  ENSP ID: ENSP00000397072
MARLTKRRQADTKAIQHLWAAIEIIRNQKQIANIDRITKYMSRVHGMHPKETTRQLSLAVKDGLIVETLTVGCKGSKAGIEQEGYWLPGDEISIKKKNTNKQEMGTYLRFIVSRMKERAIDLNKKGKDNKHPMYRRLVHS

SEQ ID NO: 102205 - protein, 567 aa, Homo sapiens
  Payload ID: 20368
  Gene Name: zinc finger, MYND-type containing 11
  Uniprot ID: Q15326
  ENSP ID: ENSP00000424205
MARLTKRRQADTKAIQHLWAAIEIIRNQKQIANIDRITKYMSRVHGMHPKETTRQLSLAVKDGLIVETLTVGCKGSKAGIEQEGYWLPGDEIDWETENHDWYCFECHLPGEVLICDLCFRVYHSKCLSDEFRLRDSSSPWQCPVCRSIKKKNTNKQEMGTYLRFIVSRMKERAIDLNKKGKDNKHPMYRRLVHSAVDVPTIQEKVNEGKYRSYEEFKADAQLLLHNTVIFYGDSEQADIARMLYKDTCHELDELQLCKNCFYLSNARPDNWFCYPCIPNHELVWAKMKGFGFWPAKVMQKEDNQVDVRFFGHHHQRAWIPSENIQDITVNIHRLHVKRSMGWKKACDELELHQRFLREGRFWKSKNEDRGEEEAESSISSTSNEQLKVTQEPRAKKGRRNQSVEPKKEEPEPETEAVSSSQEIPTMPQPIEKVSVSTQTKKLSASSPRMLHRSTQTTNDGVCQSMCHDKYTKIFNDFKDRMKSDHKRETERVVREALEKLRSEMEEEKRQAVNKAVANMQGEMDRKCKQVKEKCKEEFVEEIKKLATQHKQLISQTKKKQWVNTSLF

SEQ ID NO: 102206 - protein, 568 aa, Homo sapiens
  Payload ID: 20368
  Gene Name: zinc finger, MYND-type containing 11
  Uniprot ID: Q15326
  ENSP ID: ENSP00000452959
MARLTKRRQADTKAIQHLWAAIEIIRNQKQIANIDRITKYMSRVHGMHPKETTRQLSLAVKDGLIVETLTVGCKGSKAGIEQEGYWLPGDEIDWETENHDWYCFECHLPGEVLICDLCFRVYHSKCLSDEFRLRDSSSPWQCPVCRSIKKKNTNKQEMGTYLRFIVSRMKERAIDLNKKGKDNKHPMYRRLVHSAVDVPTIQEKVNEGKYRSYEEFKADAQLLLHNTVIFYGADSEQADIARMLYKDTCHELDELQLCKNCFYLSNARPDNWFCYPCIPNHELVWAKMKGFGFWPAKVMQKEDNQVDVRFFGHHHQRAWIPSENIQDITVNIHRLHVKRSMGWKKACDELELHQRFLREGRFWKSKNEDRGEEEAESSISSTSNEQLKVTQEPRAKKGRRNQSVEPKKEEPEPETEAVSSSQEIPTMPQPIEKVSVSTQTKKLSASSPRMLHRSTQTTNDGVCQSMCHDKYTKIFNDFKDRMKSDHKRETERVVREALEKLRSEMEEEKRQAVNKAVANMQGEMDRKCKQVKEKCKEEFVEEIKKLATQHKQLISQTKKKQWVNTSLF

SEQ ID NO: 102207 - protein, 517 aa, Homo sapiens; identical to SEQ ID NO: 102200
  Payload ID: 20368
  Gene Name: zinc finger, MYND-type containing 11
  Uniprot ID: Q15326
  ENSP ID: ENSP00000473321

SEQ ID NO: 102208 - protein, 585 aa, Homo sapiens; identical to SEQ ID NO: 102195
  Payload ID: 20368
  Gene Name: zinc finger, MYND-type containing 11
  ENSP ID: ENSP00000487386

SEQ ID NO: 102209 - protein, 365 aa, Homo sapiens
  Payload ID: 20369
  Gene Name: zinc finger, MYND-type containing 12
  Uniprot ID: Q9H0C1
  ENSP ID: ENSP00000361646
MNVIYPLAVPKGRRLCCEVCEAPAERVCAACTVTYYCGVVHQKADWDSIHEKICQLLIPLRTSMPFYNSEEERQHGLQQLQQRQKYLIEFCYTIAQKYLFEGKHEDAVPAALQSLRFRVKLYGLSSVELVPAYLLLAEASLGLGRIVQAEEYLFQAQWTVLKSTDCSNATHSLLHRNLGLLYIAKKNYEEARYHLANDIYFASCAFGTEDIRTSGGYFHLANIFYDLKKLDLADTLYTKVSEIWHAYLNNHYQVLSQAHIQQMDLLGKLFENDTGLDEAQEAEAIRILTSILNIRESTSDKAPQKTIFVLKILVMFYYLMMNSSKAQEYGMRALSLAKEQQLDVHEQSTIQELLSLISTEDHPIT

SEQ ID NO: 102210 - protein, 125 aa, Homo sapiens
  Payload ID: 20369
  Gene Name: zinc finger, MYND-type containing 12
  ENSP ID: ENSP00000478789
MNVIYPLAVPKGRRLCCEVCEAPAERVCAACTVTYYCGVVHQKADWDSIHEKICQLLIPLRTSMPFYNSEEERQHGLQQLQQRQVWAESFRLKNIYSKPSGQSSNQLTVVMPPTLYCIGIWDFSI

SEQ ID NO: 102211 - protein, 44 aa, Homo sapiens
  Payload ID: 20369
  Gene Name: zinc finger, MYND-type containing 12
  ENSP ID: ENSP00000482602
MNVIYPLAVPKGRRLCCEVCEAPAERVCAACTVTYYWSGPNRSG

SEQ ID NO: 102212 - protein, 750 aa, Homo sapiens
  Payload ID: 20370
  Gene Name: zinc finger, MYND-type containing 15
  Uniprot ID: Q9H091
  ENSP ID: ENSP00000269289
MEFVSGYRDEFLDFTALLFGWFRKFVAERGAVGTSLEGRCRQLEAQIRRLPQDPALWVLHVLPNHSVGISLGQGAEPGPGPGLGTAWLLGDNPPLHLRDLSPYISFVSLEDGEEGEEEEEEDEEEEKREDGGAGSTEKVEPEEDRELAPTSRESPQETNPPGESEEAAREAGGGKDGCREDRVENETRPQKRKGQRSEAAPLHVSCLLLVTDEHGTILGIDLLVDGAQGTASWGSGTKDLAPWAYALLCHSMACPMGSGDPRKPRQLTVGDARLHRELESLVPRLGVKLAKTPMRTWGPRPGFTFASLRARTCHVCHRHSFEAKLTPCPQCSAVLYCGEACLRADWQRCPDDVSHRFWCPRLAAFMERAGELATLPFTYTAEVTSETFNKEAFLASRGLTRGYWTQLSMLIPGPGFSRHPRGNTPSLSLLRGGDPYQLLQGDGTALMPPVPPHPPRGVFGSWQDYYTWRGLSLDSPIAVLLTYPLTVYYVITHLVPQSFPELNIQNKQSLKIHVVEAGKEFDLVMVFWELLVLLPHVALELQFVGDGLPPESDEQHFTLQRDSLEVSVRPGSGISARPSSGTKEKGGRRDLQIKVSARPYHLFQGPKPDLVIASPSSLSAGFNSGFALKDTWLRSLPRLQSLRVPAFFTESSEYSCVMDGQTMAVATGGGTSPPQPNPFRSPFRLRAADNCMSWYCNAFIFHLVYKPAQGSGARPAPGPPPPSPTPSAPPAPTRRRRGEKKPGRGARRRK

SEQ ID NO: 102213 - protein, 742 aa, Homo sapiens
  Payload ID: 20370
  Gene Name: zinc finger, MYND-type containing 15
  Uniprot ID: Q9H091
  ENSP ID: ENSP00000391742
MEFVSGYRDEFLDFTALLFGWFRKFVAERGAVGTSLEGRCRQLEAQIRRLPQDPALWVLHVLPNHSVGISLGQGAEPGPGPGLGTAWLLGDNPPLHLRDLSPYISFVSLEDGEEGEEEEEEDEEEEKREDGGAGSTEKVEPEEDRELAPTSRESPQETNPPGESEEAAREAGGGKDGCREDRVENETRPQKRKGQRSEAAPLHVSCLLLVTDEHGTILGIDLLVDGAQGTASWGSGTKDLAPWAYALLCHSMACPMGSGDPRKPRQLTVGDARLHRELESLVPRLGVKLAKTPMRTWGPRPGFTFASLRARTCHVCHRHSFEAKLTPCPQCSAVLYCGEACLRADWQRCPDDVSHRFWCPRLAAFMERAGELATLPFTYTAEVTSETFNKEAFLASRGLTRGYWTQLSMLIPGPGFSRHPRGNTPSLSLLRGGDPYQLLQGDGTALMPPVPPHPPRGVFGSWQDYYTWRGLSLDSPIAVLLTYPLTVYYVITHLVPQSFPELNIQNKQSLKIHVVEAGKEFDLVMVFWELLVLLPHVALELQFVGDGLPPESDEQHFTLQRDSLEVSVRPGSGISARPSSGTKEKGGRRDLQIKVSARPYHLFQGPKPDLVIGFNSGFALKDTWLRSLPRLQSLRVPAFFTESSEYSCVMDGQTMAVATGGGTSPPQPNPFRSPFRLRAADNCMSWYCNAFIFHLVYKPAQGSGARPAPGPPPPSPTPSAPPAPTRRRRGEKKPGRGARRRK

SEQ ID NO: 102214 - protein, 750 aa, Homo sapiens; identical to SEQ ID NO: 102212
  Payload ID: 20370
  Gene Name: zinc finger, MYND-type containing 15
  Uniprot ID: Q9H091
  ENSP ID: ENSP00000459501

SEQ ID NO: 102215 - protein, 703 aa, Homo sapiens
  Payload ID: 20370
  Gene Name: zinc finger, MYND-type containing 15
  Uniprot ID: Q9H091
  ENSP ID: ENSP00000465435
MEFVSGYRDEFLDFTALLFGWFRKFVAERGAVGTSLEGRCRQLEAQIRRLPQDPALWVLHVLPNHSVGISLGQGAEPGPGPGLGTAWLLGDNPPLHLRDLSPYISFVSLEDGEEGEEEEEEDEEEEKREDGGAGSTEKVEPEEDRELAPTSRESPQETNPPGESEEAAREAGGGKDGCREDRVENETRPQKRKGQRSEAAPLHVSCLLLVTDEHGTILGIDLLVDGAQGTASWGSGTKDLAPWAYALLCHSMACPMGSGDPRKPRQLTVGDARLHRELESLVPRLGVKLAKTPMRTWGPRPGFTFASLRARTCHVCHRHSFEAKLTPCPQCSAVLYCGEACLRADWQRCPDDVSHRFWCPRLAAFMERAGELATLPFTYTAEVTSETFNKEAFLASRGLTRGYWTQLSMLIPGPGFSRHPRGNTPSLSLLRGGDPYQLLQGDGTALMPPVPPHPPRGVFVPELNIQNKQSLKIHVVEAGKEFDLVMVFWELLVLLPHVALELQFVGDGLPPESDEQHFTLQRDSLEVSVRPGSGISARPSSGTKEKGGRRDLQIKVSARPYHLFQGPKPDLVIGFNSGFALKDTWLRSLPRLQSLRVPAFFTESSEYSCVMDGQTMAVATGGGTSPPQPNPFRSPFRLRAADNCMSWYCNAFIFHLVYKPAQGSGARPAPGPPPPSPTPSAPPAPTRRRRGEKKPGRGARRRK

SEQ ID NO: 102216 - protein, 227 aa, Homo sapiens
  Payload ID: 20371
  Gene Name: zinc finger, MYND-type containing 19
  Uniprot ID: Q96E35
  ENSP ID: ENSP00000298585
MTDFKLGIVRLGRVAGKTKYTLIDEQDIPLVESYSFEARMEVDADGNGAKIFAYAFDKNRGRGSGRLLHELLWERHRGGVAPGFQVVHLNAVTVDNRLDNLQLVPWGWRPKAEETSSKQREQSLYWLAIQQLPTDPIEEQFPVLNVTRYYNANGDVVEEEENSCTYYECHYPPCTVIEKQLREFNICGRCQVARYCGSQCQQKDWPAHKKHCRERKRPFQHELEPER

SEQ ID NO: 102217 - protein, 1168 aa, Homo sapiens
  Payload ID: 20372
  Gene Name: zinc finger, MYND-type containing 8
  Uniprot ID: Q9ULU4
  ENSP ID: ENSP00000262975
MDISTRSKDPGSAERTAQKRKFPSPPHSSNGHSPQDTSTSPIKKKKKPGLLNSNNKEQSELRHGPFYYMKQPLTTDPVDVVPQDGRNDFYCWVCHREGQVLCCELCPRVYHAKCLRLTSEPEGDWFCPECEKITVAECIETQSKAMTMLTIEQLSYLLKFAIQKMKQPGTDAFQKPVPLEQHPDYAEYIFHPMDLCTLEKNAKKKMYGCTEAFLADAKWILHNCIIYNGGNHKLTQIAKVVIKICEHEMNEIEVCPECYLAACQKRDNWFCEPCSNPHPLVWAKLKGFPFWPAKALRDKDGQVDARFFGQHDRAWVPINNCYLMSKEIPFSVKKTKSIFNSAMQEMEVYVENIRRKFGVFNYSPFRTPYTPNSQYQMLLDPTNPSAGTAKIDKQEKVKLNFDMTASPKILMSKPVLSGGTGRRISLSDMPRSPMSTNSSVHTGSDVEQDAEKKATSSHFSASEESMDFLDKSTASPASTKTGQAGSLSGSPKPFSPQLSAPITTKTDKTSTTGSILNLNLDRSKAEMDLKELSESVQQQSTPVPLISPKRQIRSRFQLNLDKTIESCKAQLGINEISEDVYTAVEHSDSEDSEKSDSSDSEYISDDEQKSKNEPEDTEDKEGCQMDKEPSAVKKKPKPTNPVEIKEELKSTSPASEKADPGAVKDKASPEPEKDFSEKAKPSPHPIKDKLKGKDETDSPTVHLGLDSDSESELVIDLGEDHSGREGRKNKKEPKEPSPKQDVVGKTPPSTTVGSHSPPETPVLTRSSAQTSAAGATATTSTSSTVTVTAPAPAATGSPVKKQRPLLPKETAPAVQRVVWNSSTVQQKEITQSPSTSTITLVTSTQSSPLVTSSGSMSTLVSSVNADLPIATASADVAADIAKYTSKMMDAIKGTMTEIYNDLSKNTTGSTIAEIRRLRIEIEKLQWLHQQELSEMKHNLELTMAEMRQSLEQERDRLIAEVKKQLELEKQQAVDETKKKQWCANCKKEAIFYCCWNTSYCDYPCQQAHWPEHMKSCTQSATAPQQEADAEVNTETLNKSSQGSSSSTQSAPSETASASKEKETSAEKSKESGSTLDLSGSRETPSSILLGSNQGSVSKRCDKQPAYAPTTTDHQPHPNYPAQKYHSRSNKSSWSSSDEKRGSTRSDHNTSTSTKSLLPKESRLDTFWD

SEQ ID NO: 102218 - protein, 1186 aa, Homo sapiens
  Payload ID: 20372
  Gene Name: zinc finger, MYND-type containing 8
  Uniprot ID: Q9ULU4
  ENSP ID: ENSP00000312237
MDISTRSKDPGSAERTAQKRKFPSPPHSSNGHSPQDTSTSPIKKKKKPGLLNSNNKEQSELRHGPFYYMKQPLTTDPVDVVPQDGRNDFYCWVCHREGQVLCCELCPRVYHAKCLRLTSEPEGDWFCPECEKITVAECIETQSKAMTMLTIEQLSYLLKFAIQKMKQPGTDAFQKPVPLEQHPDYAEYIFHPMDLCTLEKNAKKKMYGCTEAFLADAKWILHNCIIYNGGNHKLTQIAKVVIKICEHEMNEIEVCPECYLAACQKRDNWFCEPCSNPHPLVWAKLKGFPFWPAKALRDKDGQVDARFFGQHDRAWVPINNCYLMSKEIPFSVKKTKSIFNSAMQEMEVYVENIRRKFGVFNYSPFRTPYTPNSQYQMLLDPTNPSAGTAKIDKQEKVKLNFDMTASPKILMSKPVLSGGTGRRISLSDMPRSPMSTNSSVHTGSDVEQDAEKKATSSHFSASEESMDFLDKSTASPASTKTGQAGSLSGSPKPFSPQLSAPITTKTDKTSTTGSILNLNLDRSKAEMDLKELSESVQQQSTPVPLISPKRQIRSRFQLNLDKTIESCKAQLGINEISEDVYTAVEHSDSEDSEKSDSSDSEYISDDEQKSKNEPEDTEDKEGCQMDKEPSAVKKKPKPTNPVEIKEELKSTSPASEKADPGAVKDKASPEPEKDFSEKAKPSPHPIKDKLKGKDETDSPTVHLGLDSDSESELVIDLGEDHSGREGRKNKKEPKEPSPKQDVVGKTPPSTTVGSHSPPETPVLTRSSAQTSAAGATATTSTSSTVTVTAPAPAATGSPVKKQRPLLPKETAPAVQRVVWNSSSKFQTSSQKWHMQKMQRQQQQQQQQNQQQQPQSSQGTRYQTRQAVKAVQQKEITQSPSTSTITLVTSTQSSPLVTSSGSMSTLVSSVNADLPIATASADVAADIAKYTSKMMDAIKGTMTEIYNDLSKNTTGSTIAEIRRLRIEIEKLQWLHQQELSEMKHNLELTMAEMRQSLEQERDRLIAEVKKQLELEKQQAVDETKKKQWCANCKKEAIFYCCWNTSYCDYPCQQAHWPEHMKSCTQSATAPQQEADAEVNTETLNKSSQGSSSSTQSAPSETASASKEKETSAEKSKESGSTLDLSGSRETPSSILLGSNQGSDHSRSNKSSWSSSDEKRGSTRSDHNTSTSTKSLLPKESRLDTFWD

SEQ ID NO: 102219 - protein, 1160 aa, Homo sapiens
  Payload ID: 20372
  Gene Name: zinc finger, MYND-type containing 8
  Uniprot ID: Q9ULU4
  ENSP ID: ENSP00000335537
MHPQSLAEEEIKTEQEVVEGMDISTRSKDPGSAERTAQKRKFPSPPHSSNGHSPQDTSTSPIKKKKKPGLLNSNNKEQSELRHGPFYYMKQPLTTDPVDVVPQDGRNDFYCWVCHREGQVLCCELCPRVYHAKCLRLTSEPEGDWFCPECEKITVAECIETQSKAMTMLTIEQLSYLLKFAIQKMKQPGTDAFQKPVPLEQHPDYAEYIFHPMDLCTLEKNAKKKMYGCTEAFLADAKWILHNCIIYNGGNHKLTQIAKVVIKICEHEMNEIEVCPECYLAACQKRDNWFCEPCSNPHPLVWAKLKGFPFWPAKALRDKDGQVDARFFGQHDRAWVPINNCYLMSKEIPFSVKKTKSIFNSAMQEMEVYVENIRRKFGVFNYSPFRTPYTPNSQYQMLLDPTNPSAGTAKIDKQEKVKLNFDMTASPKILMSKPVLSGGTGRRISLSDMPRSPMSTNSSVHTGSDVEQDAEKKATSSHFSASEESMDFLDKSTASPASTKTGQAGSLSGSPKPFSPQLSAPITTKTDKTSTTGSILNLNLDRSKAEMDLKELSESVQQQSTPVPLISPKRQIRSRFQLNLDKTIESCKAQLGINEISEDVYTAVEHSDSEDSEKSDSSDSEYISDDEQKSKNEPEDTEDKEGCQMDKEPSAVKKKPKPTNPVEIKEELKSTSPASEKADPGAVKDKASPEPEKDFSEKAKPSPHPIKDKLKGKDETDSPTVHLGLDSDSESELVIDLGEDHSGREGRKNKKEPKEPSPKQDVVGKTPPSTTVGSHSPPETPVLTRSSAQTSAAGATATTSTSSTVTVTAPAPAATGSPVKKQRPLLPKETAPAVQRVVWNSSTVQQKEITQSPSTSTITLVTSTQSSPLVTSSGSMSTLVSSVNADLPIATASADVAADIAKYTSKMMDAIKGTMTEIYNDLSKNTTGSTIAEIRRLRIEIEKLQWLHQQELSEMKHNLELTMAEMRQSLEQERDRLIAEVKKQLELEKQQAVDETKKKQWCANCKKEAIFYCCWNTSYCDYPCQQAHWPEHMKSCTQSATAPQQEADAEVNTETLNKSSQGSSSSTQSAPSETASASKEKETSAEKSKESGSTLDLSGSRETPSSILLGSNQGSDHSRSNKSSWSSSDEKRGSTRSDHNTSTSTKSLLPKESRLDTFWD

SEQ ID NO: 102220 - protein, 1214 aa, Homo sapiens
  Payload ID: 20372
  Gene Name: zinc finger, MYND-type containing 8
  Uniprot ID: Q9ULU4
  ENSP ID: ENSP00000348246
MDISTRSKDPGSAERTAQKRKFPSPPHSSNGHSPQDTSTSPIKKKKKPGLLNSNNKEQSELRHGPFYYMKQPLTTDPVDVVPQDGRNDFYCWVCHREGQVLCCELCPRVYHAKCLRLTSEPEGDWFCPECEKITVAECIETQSKAMTMLTIEQLSYLLKFAIQKMKQPGTDAFQKPVPLEQHPDYAEYIFHPMDLCTLEKNAKKKMYGCTEAFLADAKWILHNCIIYNGGNHKLTQIAKVVIKICEHEMNEIEVCPECYLAACQKRDNWFCEPCSNPHPLVWAKLKGFPFWPAKALRDKDGQVDARFFGQHDRAWVPINNCYLMSKEIPFSVKKTKSIFNSAMQEMEVYVENIRRKFGVFNYSPFRTPYTPNSQYQMLLDPTNPSAGTAKIDKQEKVKLNFDMTASPKILMSKPVLSGGTGRRISLSDMPRSPMSTNSSVHTGSDVEQDAEKKATSSHFSASEESMDFLDKSTASPASTKTGQAGSLSGSPKPFSPQLSAPITTKTDKTSTTGSILNLNLDRSKAEMDLKELSESVQQQSTPVPLISPKRQIRSRFQLNLDKTIESCKAQLGINEISEDVYTAVEHSDSEDSEKSDSSDSEYISDDEQKSKNEPEDTEDKEGCQMDKEPSAVKKKPKPTNPVEIKEELKSTSPASEKADPGAVKDKASPEPEKDFSEKAKPSPHPIKDKLKGKDETDSPTVHLGLDSDSESELVIDLGEDHSGREGRKNKKEPKEPSPKQDVVGKTPPSTTVGSHSPPETPVLTRSSAQTSAAGATATTSTSSTVTVTAPAPAATGSPVKKQRPLLPKETAPAVQRVVWNSSSKFQTSSQKWHMQKMQRQQQQQQQQNQQQQPQSSQGTRYQTRQAVKAVQQKEITQSPSTSTITLVTSTQSSPLVTSSGSMSTLVSSVNADLPIATASADVAADIAKYTSKMMDAIKGTMTEIYNDLSKNTTGSTIAEIRRLRIEIEKLQWLHQQELSEMKHNLELTMAEMRQSLEQERDRLIAEVKKQLELEKQQAVDETKKKQWCANCKKEAIFYCCWNTSYCDYPCQQAHWPEHMKSCTQSATAPQQEADAEVNTETLNKSSQGSSSSTQSAPSETASASKEKETSAEKSKESGSTLDLSGSRETPSSILLGSNQGSVSKRCDKQPAYAPTTTDHQPHPNYPAQKYHSRSNKSSWSSSDEKRGSTRSDHNTSTSTKSLLPKESRLDTFWD

SEQ ID NO: 102221 - protein, 1135 aa, Homo sapiens
  Payload ID: 20372
  Gene Name: zinc finger, MYND-type containing 8
  Uniprot ID: Q9ULU4
  ENSP ID: ENSP00000354166
MHPQSLAEEEIKTEQEVVEGMDISTRSKDPGSAERTAQKRKFPSPPHSSNGHSPQDTSTSPIKKKKKPGLLNSNNKEQDGRNDFYCWVCHREGQVLCCELCPRVYHAKCLRLTSEPEGDWFCPECEKITVAECIETQSKAMTMLTIEQLSYLLKFAIQKMKQPGTDAFQKPVPLEQHPDYAEYIFHPMDLCTLEKNAKKKMYGCTEAFLADAKWILHNCIIYNGGNHKLTQIAKVVIKICEHEMNEIEVCPECYLAACQKRDNWFCEPCSNPHPLVWAKLKGFPFWPAKALRDKDGQVDARFFGQHDRAWVPINNCYLMSKEIPFSVKKTKSIFNSAMQEMEVYVENIRRKFGVFNYSPFRTPYTPNSQYQMLLDPTNPSAGTAKIDKQEKVKLNFDMTASPKILMSKPVLSGGTGRRISLSDMPRSPMSTNSSVHTGSDVEQDAEKKATSSHFSASEESMDFLDKSTASPASTKTGQAGSLSGSPKPFSPQLSAPITTKTDKTSTTGSILNLNLDRSKAEMDLKELSESVQQQSTPVPLISPKRQIRSRFQLNLDKTIESCKAQLGINEISEDVYTAVEHSDSEDSEKSDSSDSEYISDDEQKSKNEPEDTEDKEGCQMDKEPSAVKKKPKPTNPVEIKEELKSTSPASEKADPGAVKDKASPEPEKDFSEKAKPSPHPIKDKLKGKDETDSPTVHLGLDSDSESELVIDLGEDHSGREGRKNKKEPKEPSPKQDVVGKTPPSTTVGSHSPPETPVLTRSSAQTSAAGATATTSTSSTVTVTAPAPAATGSPVKKQRPLLPKETAPAVQRVVWNSSTVQQKEITQSPSTSTITLVTSTQSSPLVTSSGSMSTLVSSVNADLPIATASADVAADIAKYTSKMMDAIKGTMTEIYNDLSKNTTGSTIAEIRRLRIEIEKLQWLHQQELSEMKHNLELTMAEMRQSLEQERDRLIAEVKKQLELEKQQAVDETKKKQWCANCKKEAIFYCCWNTSYCDYPCQQAHWPEHMKSCTQSATAPQQEADAEVNTETLNKSSQGSSSSTQSAPSETASASKEKETSAEKSKESGSTLDLSGSRETPSSILLGSNQGSDHSRSNKSSWSSSDEKRGSTRSDHNTSTSTKSLLPKESRLDTFWD

SEQ ID NO: 102222 - protein, 1105 aa, Homo sapiens
  Payload ID: 20372
  Gene Name: zinc finger, MYND-type containing 8
  Uniprot ID: Q9ULU4
  ENSP ID: ENSP00000361093
MDISTRSKDPGSAERTAQKRKFPSPPHSSNGHSPQDTSTSPIKKKKKPGLLNSNNKEQDGRNDFYCWVCHREGQVLCCELCPRVYHAKCLRLTSEPEGDWFCPECETDAFQKPVPLEQHPDYAEYIFHPMDLCTLEKNAKKKMYGCTEAFLADAKWILHNCIIYNGGNHKLTQIAKVVIKICEHEMNEIEVCPECYLAACQKRDNWFCEPCSNPHPLVWAKLKGFPFWPAKALRDKDGQVDARFFGQHDRAWVPINNCYLMSKEIPFSVKKTKSIFNSAMQEMEVYVENIRRKFGVFNYSPFRTPYTPNSQYQMLLDPTNPSAGTAKIDKQEKVKLNFDMTASPKILMSKPVLSGGTGRRISLSDMPRSPMSTNSSVHTGSDVEQDAEKKATSSHFSASEESMDFLDKSTASPASTKTGQAGSLSGSPKPFSPQLSAPITTKTDKTSTTGSILNLNLDRSKAEMDLKELSESVQQQSTPVPLISPKRQIRSRFQLNLDKTIESCKAQLGINEISEDVYTAVEHSDSEDSEKSDSSDSEYISDDEQKSKNEPEDTEDKEGCQMDKEPSAVKKKPKPTNPVEIKEELKSTSPASEKADPGAVKDKASPEPEKDFSEKAKPSPHPIKDKLKGKDETDSPTVHLGLDSDSESELVIDLGEDHSGREGRKNKKEPKEPSPKQDVVGKTPPSTTVGSHSPPETPVLTRSSAQTSAAGATATTSTSSTVTVTAPAPAATGSPVKKQRPLLPKETAPAVQRVVWNSSTVQQKEITQSPSTSTITLVTSTQSSPLVTSSGSMSTLVSSVNADLPIATASADVAADIAKYTSKMMDAIKGTMTEIYNDLSKNTTGSTIAEIRRLRIEIEKLQWLHQQELSEMKHNLELTMAEMRQSLEQERDRLIAEVKKQLELEKQQAVDETKKKQWCANCKKEAIFYCCWNTSYCDYPCQQAHWPEHMKSCTQSATAPQQEADAEVNTETLNKSSQGSSSSTQSAPSETASASKEKETSAEKSKESGSTLDLSGSRETPSSILLGSNQGSVSKRCDKQPAYAPTTTDHQPHPNYPAQKYHSRSNKSSWSSSDEKRGSTRSDHNTSTSTKSLLPKESRLDTFWD

SEQ ID NO: 102223 - protein, 1186 aa, Homo sapiens
  Payload ID: 20372
  Gene Name: zinc finger, MYND-type containing 8
  Uniprot ID: Q9ULU4
  ENSP ID: ENSP00000379577
MFSSLQKSFNLAEEEIKTEQEVVEGMDISTRSKDPGSAERTAQKRKFPSPPHSSNGHSPQDTSTSPIKKKKKPGLLNSNNKEQDGRNDFYCWVCHREGQVLCCELCPRVYHAKCLRLTSEPEGDWFCPECEKITVAECIETQSKAMTMLTIEQLSYLLKFAIQKMKQPGTDAFQKPVPLEQHPDYAEYIFHPMDLCTLEKNAKKKMYGCTEAFLADAKWILHNCIIYNGGNHKLTQIAKVVIKICEHEMNEIEVCPECYLAACQKRDNWFCEPCSNPHPLVWAKLKGFPFWPAKALRDKDGQVDARFFGQHDRAWVPINNCYLMSKEIPFSVKKTKSIFNSAMQEMEVYVENIRRKFGVFNYSPFRTPYTPNSQYQMLLDPTNPSAGTAKIDKQEKVKLNFDMTASPKILMSKPVLSGGTGRRISLSDMPRSPMSTNSSVHTGSDVEQDAEKKATSSHFSASEESMDFLDKSTASPASTKTGQAGSLSGSPKPFSPQLSAPITTKTDKTSTTGSILNLNLDRSKAEMDLKELSESVQQQSTPVPLISPKRQIRSRFQLNLDKTIESCKAQLGINEISEDVYTAVEHSDSEDSEKSDSSDSEYISDDEQKSKNEPEDTEDKEGCQMDKEPSAVKKKPKPTNPVEIKEELKSTSPASEKADPGAVKDKASPEPEKDFSEKAKPSPHPIKDKLKGKDETDSPTVHLGLDSDSESELVIDLGEDHSGREGRKNKKEPKEPSPKQDVVGKTPPSTTVGSHSPPETPVLTRSSAQTSAAGATATTSTSSTVTVTAPAPAATGSPVKKQRPLLPKETAPAVQRVVWNSSSKFQTSSQKWHMQKMQRQQQQQQQQNQQQQPQSSQGTRYQTRQAVKAVQQKEITQSPSTSTITLVTSTQSSPLVTSSGSMSTLVSSVNADLPIATASADVAADIAKYTSKMMDAIKGTMTEIYNDLSKNTTGSTIAEIRRLRIEIEKLQWLHQQELSEMKHNLELTMAEMRQSLEQERDRLIAEVKKQLELEKQQAVDETKKKQWCANCKKEAIFYCCWNTSYCDYPCQQAHWPEHMKSCTQSATAPQQEADAEVNTETLNKSSQGSSSSTQSAPSETASASKEKETSAEKSKESGSTLDLSGSRETPSSILLGSNQGSDHSRSNKSSWSSSDEKRGSTRSDHNTSTSTKSLLPKESRLDTFWD

SEQ ID NO: 102224 - protein, 1054 aa, Homo sapiens
  Payload ID: 20372
  Gene Name: zinc finger, MYND-type containing 8
  Uniprot ID: Q9ULU4
  ENSP ID: ENSP00000392964
MHPQSLAEEEIKTEQEVVEGMDISTRSKDPGSAERTAQKRKFPSPPHSSNGHSPQDTSTSPIKKKKKPGLLNSNNKEQDGRNDFYCWVCHREGQVLCCELCPRVYHAKCLRLTSEPEGDWFCPECEKITVAECIETQSKAMTMLTIEQLSYLLKFAIQKMKQPGTDAFQKPVPLEQHPDYAEYIFHPMDLCTLEKNAKKKMYGCTEAFLADAKWILHNCIIYNGGNHKLTQIAKVVIKICEHEMNEIEVCPECYLAACQKRDNWFCEPCSNPHPLVWAKLKGFPFWPAKALRDKDGQVDARFFGQHDRAWVPINNCYLMSKEIPFSVKKTKSIFNSAMQEMEVYVENIRRKFGVFNYSPFRTPYTPNSQYQMLLDPTNPSAGTAKIDKQEKVKLNFDMTASPKILMSKPVLSGGTGRRISLSDMPRSPMSTNSSVHTGSDVEQDAEKKATSSHFSASEESMDFLDKSTASPASTKTGQAGSLSGSPKPFSPQLSAPITTKTDKTSTTGSILNLNLDRSKAEMDLKELSESVQQQSTPVPLISPKRQIRSRFQLNLDKTIESCKAQLGINEISEDVYTAVEHSDSEDSEKSDSSDSEYISDDEQKSKNEPEDTEDKEGCQMDKEPSAVKKKPKPTNPVEIKEELKSTSPASEKADPGAVKDKASPEPEKDFSEKAKPSPHPIKDKLKGKDETDSPTVHLGLDSDSESELVIDLGEDHSGREGRKNKKEPKEPSPKQDAVQQKEITQSPSTSTITLVTSTQSSPLVTSSGSMSTLVSSVNADLPIATASADVAADIAKYTSKMMDAIKGTMTEIYNDLSKNTTGSTIAEIRRLRIEIEKLQWLHQQELSEMKHNLELTMAEMRQSLEQERDRLIAEVKKQLELEKQQAVDETKKKQWCANCKKEAIFYCCWNTSYCDYPCQQAHWPEHMKSCTQSATAPQQEADAEVNTETLNKSSQGSSSSTQSAPSETASASKEKETSAEKSKESGSTLDLSGSRETPSSILLGSNQGSDHSRSNKSSWSSSDEKRGSTRSDHNTSTSTKSLLPKESRLDTFWD

SEQ ID NO: 102225 - protein, 24 aa, Homo sapiens
  Payload ID: 20372
  Gene Name: zinc finger, MYND-type containing 8
  ENSP ID: ENSP00000393806
MDISTRSKDPGSAERTAQKRKFPS

SEQ ID NO: 102226 - protein, 42 aa, Homo sapiens
  Payload ID: 20372
  Gene Name: zinc finger, MYND-type containing 8
  ENSP ID: ENSP00000394379
MDISTRSKDPGSAERTAQKRKFPSPPHSSNGHSPQDTSTSPI

SEQ ID NO: 102227 - protein, 1214 aa, Homo sapiens; identical to SEQ ID NO: 102220
  Payload ID: 20372
  Gene Name: zinc finger, MYND-type containing 8
  Uniprot ID: Q9ULU4
  ENSP ID: ENSP00000396725

SEQ ID NO: 102228 - protein, 175 aa, Homo sapiens
  Payload ID: 20372
  Gene Name: zinc finger, MYND-type containing 8
  ENSP ID: ENSP00000413727
MDISTRSKDPGSAERTAQKRKFPSPPHSSNGHSPQDTSTSPIKKKKKPGLLNSNNKEQDGRNDFYCWVCHREGQVLCCELCPRVYHAKCLRLTSEPEGDWFCPECEKITVAECIETQSKAMTMLTIEQLSYLLKFAIQKMKQPGTDAFQKPVPLEQHPDYAEYIFHPMDLCTLEK

SEQ ID NO: 102229 - protein, 1188 aa, Homo sapiens
  Payload ID: 20372
  Gene Name: zinc finger, MYND-type containing 8
  Uniprot ID: Q9ULU4
  ENSP ID: ENSP00000418210
MHPQSLAEEEIKTEQEVVEGMDISTRSKDPGSAERTAQKRKFPSPPHSSNGHSPQDTSTSPIKKKKKPGLLNSNNKEQSELRHGPFYYMKQPLTTDPVDVVPQDGRNDFYCWVCHREGQVLCCELCPRVYHAKCLRLTSEPEGDWFCPECEKITVAECIETQSKAMTMLTIEQLSYLLKFAIQKMKQPGTDAFQKPVPLEQHPDYAEYIFHPMDLCTLEKNAKKKMYGCTEAFLADAKWILHNCIIYNGGNHKLTQIAKVVIKICEHEMNEIEVCPECYLAACQKRDNWFCEPCSNPHPLVWAKLKGFPFWPAKALRDKDGQVDARFFGQHDRAWVPINNCYLMSKEIPFSVKKTKSIFNSAMQEMEVYVENIRRKFGVFNYSPFRTPYTPNSQYQMLLDPTNPSAGTAKIDKQEKVKLNFDMTASPKILMSKPVLSGGTGRRISLSDMPRSPMSTNSSVHTGSDVEQDAEKKATSSHFSASEESMDFLDKSTASPASTKTGQAGSLSGSPKPFSPQLSAPITTKTDKTSTTGSILNLNLDRSKAEMDLKELSESVQQQSTPVPLISPKRQIRSRFQLNLDKTIESCKAQLGINEISEDVYTAVEHSDSEDSEKSDSSDSEYISDDEQKSKNEPEDTEDKEGCQMDKEPSAVKKKPKPTNPVEIKEELKSTSPASEKADPGAVKDKASPEPEKDFSEKAKPSPHPIKDKLKGKDETDSPTVHLGLDSDSESELVIDLGEDHSGREGRKNKKEPKEPSPKQDVVGKTPPSTTVGSHSPPETPVLTRSSAQTSAAGATATTSTSSTVTVTAPAPAATGSPVKKQRPLLPKETAPAVQRVVWNSSTVQQKEITQSPSTSTITLVTSTQSSPLVTSSGSMSTLVSSVNADLPIATASADVAADIAKYTSKMMDAIKGTMTEIYNDLSKNTTGSTIAEIRRLRIEIEKLQWLHQQELSEMKHNLELTMAEMRQSLEQERDRLIAEVKKQLELEKQQAVDETKKKQWCANCKKEAIFYCCWNTSYCDYPCQQAHWPEHMKSCTQSATAPQQEADAEVNTETLNKSSQGSSSSTQSAPSETASASKEKETSAEKSKESGSTLDLSGSRETPSSILLGSNQGSVSKRCDKQPAYAPTTTDHQPHPNYPAQKYHSRSNKSSWSSSDEKRGSTRSDHNTSTSTKSLLPKESRLDTFWD

SEQ ID NO: 102230 - protein, 1095 aa, Homo sapiens
  Payload ID: 20372
  Gene Name: zinc finger, MYND-type containing 8
  ENSP ID: ENSP00000418495
  MOD_RES (1)..(1): Any amino acid
XTDPVDVVPQDGRNDFYCWVCHREGQVLCCELCPRVYHAKCLRLTSEPEGDWFCPECEKITVAECIETQSKAMTMLTIEQLSYLLKFAIQKMKQPGTDAFQKPVPLEQHPDYAEYIFHPMDLCTLEKNAKKKMYGCTEAFLADAKWILHNCIIYNGGNHKLTQIAKVVIKICEHEMNEIEVCPECYLAACQKRDNWFCEPCSNPHPLVWAKLKGFPFWPAKALRDKDGQVDARFFGQHDRAWVPINNCYLMSKEIPFSVKKTKSIFNSAMQEMEVYVENIRRKFGVFNYSPFRTPYTPNSQYQMLLDPTNPSAGTAKIDKQEKVKLNFDMTASPKILMSKPVLSGGTGRRISLSDMPRSPMSTNSSVHTGSDVEQDAEKKATSSHFSASEESMDFLDKSTASPASTKTGQAGSLSGSPKPFSPQLSAPITTKTDKTSTTGSILNLNLDRSKAEMDLKELSESVQQQSTPVPLISPKRQIRSRFQLNLDKTIESCKAQLGINEISEDVYTAVEHSDSEDSEKSDSSDSEYISDDEQKSKNEPEDTEDKEGCQMDKEPSAVKKKPKPTNPVEIKEELKSTSPASEKADPGAVKDKASPEPEKDFSEKAKPSPHPIKDKLKGKDETDSPTVHLGLDSDSESELVIDLGEDHSGREGRKNKKEPKEPSPKQDVVGKTPPSTTVGSHSPPETPVLTRSSAQTSAAGATATTSTSSTVTVTAPAPAATGSPVKKQRPLLPKETAPAVQRVVWNSSTVQQKEITQSPSTSTITLVTSTQSSPLVTSSGSMSTLVSSVNADLPIATASADVAADIAKYTSKMMDAIKGTMTEIYNDLSKNTTGSTIAEIRRLRIEIEKLQWLHQQELSEMKHNLELTMAEMRQSLEQERDRLIAEVKKQLELEKQQAVDETKKKQWCANCKKEAIFYCCWNTSYCDYPCQQAHWPEHMKSCTQSATAPQQEADAEVNTETLNKSSQGSSSSTQSAPSETASASKEKETSAEKSKESGSTLDLSGSRETPSSILLGSNQGSVSKRCDKQPAYAPTTTDHQPHPNYPAQKYHSRSNKSSWSSSDEKRGSTRSDHNTSTSTKSLLPKESRLDTFWD

SEQ ID NO: 102231 - protein, 1234 aa, Homo sapiens
  Payload ID: 20372
  Gene Name: zinc finger, MYND-type containing 8
  Uniprot ID: Q9ULU4
  ENSP ID: ENSP00000420095
MHPQSLAEEEIKTEQEVVEGMDISTRSKDPGSAERTAQKRKFPSPPHSSNGHSPQDTSTSPIKKKKKPGLLNSNNKEQSELRHGPFYYMKQPLTTDPVDVVPQDGRNDFYCWVCHREGQVLCCELCPRVYHAKCLRLTSEPEGDWFCPECEKITVAECIETQSKAMTMLTIEQLSYLLKFAIQKMKQPGTDAFQKPVPLEQHPDYAEYIFHPMDLCTLEKNAKKKMYGCTEAFLADAKWILHNCIIYNGGNHKLTQIAKVVIKICEHEMNEIEVCPECYLAACQKRDNWFCEPCSNPHPLVWAKLKGFPFWPAKALRDKDGQVDARFFGQHDRAWVPINNCYLMSKEIPFSVKKTKSIFNSAMQEMEVYVENIRRKFGVFNYSPFRTPYTPNSQYQMLLDPTNPSAGTAKIDKQEKVKLNFDMTASPKILMSKPVLSGGTGRRISLSDMPRSPMSTNSSVHTGSDVEQDAEKKATSSHFSASEESMDFLDKSTASPASTKTGQAGSLSGSPKPFSPQLSAPITTKTDKTSTTGSILNLNLDRSKAEMDLKELSESVQQQSTPVPLISPKRQIRSRFQLNLDKTIESCKAQLGINEISEDVYTAVEHSDSEDSEKSDSSDSEYISDDEQKSKNEPEDTEDKEGCQMDKEPSAVKKKPKPTNPVEIKEELKSTSPASEKADPGAVKDKASPEPEKDFSEKAKPSPHPIKDKLKGKDETDSPTVHLGLDSDSESELVIDLGEDHSGREGRKNKKEPKEPSPKQDVVGKTPPSTTVGSHSPPETPVLTRSSAQTSAAGATATTSTSSTVTVTAPAPAATGSPVKKQRPLLPKETAPAVQRVVWNSSSKFQTSSQKWHMQKMQRQQQQQQQQNQQQQPQSSQGTRYQTRQAVKAVQQKEITQSPSTSTITLVTSTQSSPLVTSSGSMSTLVSSVNADLPIATASADVAADIAKYTSKMMDAIKGTMTEIYNDLSKNTTGSTIAEIRRLRIEIEKLQWLHQQELSEMKHNLELTMAEMRQSLEQERDRLIAEVKKQLELEKQQAVDETKKKQWCANCKKEAIFYCCWNTSYCDYPCQQAHWPEHMKSCTQSATAPQQEADAEVNTETLNKSSQGSSSSTQSAPSETASASKEKETSAEKSKESGSTLDLSGSRETPSSILLGSNQGSVSKRCDKQPAYAPTTTDHQPHPNYPAQKYHSRSNKSSWSSSDEKRGSTRSDHNTSTSTKSLLPKESRLDTFWD

SEQ ID NO: 102232 - protein, 1241 aa, Homo sapiens
  Payload ID: 20372
  Gene Name: zinc finger, MYND-type containing 8
  Uniprot ID: Q9ULU4
  ENSP ID: ENSP00000439800
MVFLEEFEARSCLAEEEIKTEQEVVEGMDISTRSKDPGSAERTAQKRKFPSPPHSSNGHSPQDTSTSPIKKKKKPGLLNSNNKEQSELRHGPFYYMKQPLTTDPVDVVPQDGRNDFYCWVCHREGQVLCCELCPRVYHAKCLRLTSEPEGDWFCPECEKITVAECIETQSKAMTMLTIEQLSYLLKFAIQKMKQPGTDAFQKPVPLEQHPDYAEYIFHPMDLCTLEKNAKKKMYGCTEAFLADAKWILHNCIIYNGGNHKLTQIAKVVIKICEHEMNEIEVCPECYLAACQKRDNWFCEPCSNPHPLVWAKLKGFPFWPAKALRDKDGQVDARFFGQHDRAWVPINNCYLMSKEIPFSVKKTKSIFNSAMQEMEVYVENIRRKFGVFNYSPFRTPYTPNSQYQMLLDPTNPSAGTAKIDKQEKVKLNFDMTASPKILMSKPVLSGGTGRRISLSDMPRSPMSTNSSVHTGSDVEQDAEKKATSSHFSASEESMDFLDKSTASPASTKTGQAGSLSGSPKPFSPQLSAPITTKTDKTSTTGSILNLNLDRSKAEMDLKELSESVQQQSTPVPLISPKRQIRSRFQLNLDKTIESCKAQLGINEISEDVYTAVEHSDSEDSEKSDSSDSEYISDDEQKSKNEPEDTEDKEGCQMDKEPSAVKKKPKPTNPVEIKEELKSTSPASEKADPGAVKDKASPEPEKDFSEKAKPSPHPIKDKLKGKDETDSPTVHLGLDSDSESELVIDLGEDHSGREGRKNKKEPKEPSPKQDVVGKTPPSTTVGSHSPPETPVLTRSSAQTSAAGATATTSTSSTVTVTAPAPAATGSPVKKQRPLLPKETAPAVQRVVWNSSSKFQTSSQKWHMQKMQRQQQQQQQQNQQQQPQSSQGTRYQTRQAVKAVQQKEITQSPSTSTITLVTSTQSSPLVTSSGSMSTLVSSVNADLPIATASADVAADIAKYTSKMMDAIKGTMTEIYNDLSKNTTGSTIAEIRRLRIEIEKLQWLHQQELSEMKHNLELTMAEMRQSLEQERDRLIAEVKKQLELEKQQAVDETKKKQWCANCKKEAIFYCCWNTSYCDYPCQQAHWPEHMKSCTQSATAPQQEADAEVNTETLNKSSQGSSSSTQSAPSETASASKEKETSAEKSKESGSTLDLSGSRETPSSILLGSNQGSVSKRCDKQPAYAPTTTDHQPHPNYPAQKYHSRSNKSSWSSSDEKRGSTRSDHNTSTSTKSLLPKESRLDTFWD

SEQ ID NO: 102233 - protein, 1134 aa, Homo sapiens
  Payload ID: 20372
  Gene Name: zinc finger, MYND-type containing 8
  Uniprot ID: Q9ULU4
  ENSP ID: ENSP00000443086
MHPQSLAEEEIKTEQEVVEGMDISTRSKDPGSAERTAQKRKFPSPPHSSNGHSPQDTSTSPIKKKKKPGLLNSNNKEQDGRNDFYCWVCHREGQVLCCELCPRVYHAKCLRLTSEPEGDWFCPECEKITVAECIETQSKAMTMLTIEQLSYLLKFAIQKMKQPGTDAFQKPVPLEQHPDYAEYIFHPMDLCTLEKNAKKKMYGCTEAFLADAKWILHNCIIYNGGNHKLTQIAKVVIKICEHEMNEIEVCPECYLAACQKRDNWFCEPCSNPHPLVWAKLKGFPFWPAKALRDKDGQVDARFFGQHDRAWVPINNCYLMSKEIPFSVKKTKSIFNSAMQEMEVYVENIRRKFGVFNYSPFRTPYTPNSQYQMLLDPTNPSAGTAKIDKQEKVKLNFDMTASPKILMSKPVLSGGTGRRISLSDMPRSPMSTNSSVHTGSDVEQDAEKKATSSHFSASEESMDFLDKSTDRSKAEMDLKELSESVQQQSTPVPLISPKRQIRSRFQLNLDKTIESCKAQLGINEISEDVYTAVEHSDSEDSEKSDSSDSEYISDDEQKSKNEPEDTEDKEGCQMDKEPSAVKKKPKPTNPVEIKEELKSTSPASEKADPGAVKDKASPEPEKDFSEKAKPSPHPIKDKLKGKDETDSPTVHLGLDSDSESELVIDLGEDHSGREGRKNKKEPKEPSPKQDVVGKTPPSTTVGSHSPPETPVLTRSSAQTSAAGATATTSTSSTVTVTAPAPAATGSPVKKQRPLLPKETAPAVQRVVWNSSSKFQTSSQKWHMQKMQRQQQQQQQQNQQQQPQSSQGTRYQTRQAVKAVQQKEITQSPSTSTITLVTSTQSSPLVTSSGSMSTLVSSVNADLPIATASADVAADIAKYTSKMMDAIKGTMTEIYNDLSKNTTGSTIAEIRRLRIEIEKLQWLHQQELSEMKHNLELTMAEMRQSLEQERDRLIAEVKKQLELEKQQAVDETKKKQWCANCKKEAIFYCCWNTSYCDYPCQQAHWPEHMKSCTQSATAPQQEADAEVNTETLNKSSQGSSSSTQSAPSETASASKEKETSAEKSKESGSTLDLSGSRETPSSILLGSNQGSDHSRSNKSSWSSSDEKRGSTRSDHNTSTSTKSLLPKESRLDTFWD

SEQ ID NO: 102234 - protein, 767 aa, Homo sapiens
  Payload ID: 20372
  Gene Name: zinc finger, MYND-type containing 8
  ENSP ID: ENSP00000479197
MDISTRSKDPGSAERTAQKRKFPSPPHSSNGHSPQDTSTSPIKKKKKPGLLNSNNKEQDGRNDFYCWVCHREGQVLCCELCPRVYHAKCLRLTSEPEGDWFCPECEKITVAECIETQSKAMTMLTIEQLSYLLKFAIQKMKQPGTDAFQKPVPLEQHPDYAEYIFHPMDLCTLEKNAKKKMYGCTEAFLADAKWILHNCIIYNGGNHKLTQIAKVVIKICEHEMNEIEVCPECYLAACQKRDNWFCEPCSNPHPLVWAKLKGFPFWPAKALRDKDGQVDARFFGQHDRAWVPINNCYLMSKEIPFSVKKTKSIFNSAMQEMEVYVENIRRKFGVFNYSPFRTPYTPNSQYQMLLDPTNPSAGTAKIDKQEKVKLNFDMTASPKILMSKPVLSGGTGRRISLSDMPRSPMSTNSSVHTGSDVEQDAEKKATSSHFSASEESMDFLDKSTASPASTKTGQAGSLSGSPKPFSPQLSAPITTKTDKTSTTGSILNLNLDRSKAEMDLKELSESVQQQSTPVPLISPKRQIRSRFQLNLDKTIESCKAQLGINEISEDVYTAVEHSDSEDSEKSDSSDSEYISDDEQKSKNEPEDTEDKEGCQMDKEPSAVKKKPKPTNPVEIKEELKSTSPASEKADPGAVKDKASPEPEKDFSEKAKPSPHPIKDKLKGKDETDSPTVHLGLDSDSESELTIPGVINPVGAAVMRRGDRHVPITTPVPARRASSRKSLGWTPSGTSSESGHKPPTPLGEKPRRQEKKKQQRQENSHFQT

SEQ ID NO: 102235 - protein, 1136 aa, Homo sapiens
  Payload ID: 20372
  Gene Name: zinc finger, MYND-type containing 8
  ENSP ID: ENSP00000479806
MHPQSLAEEEIKTEQEVVEGMDISTRSKDPGSAERTAQKRKFPSPPHSSNGHSPQDTSTSPIKKKKKPGLLNSNNKEQDGRNDFYCWVCHREGQVLCCELCPRVYHAKCLRLTSEPEGDWFCPECEKITVAECIETQSKAMTMLTIEQLSYLLKFAIQKMKQPGTDAFQKPVPLEQHPDYAEYIFHPMDLCTLEKNAKKKMYGCTEAFLADAKWILHNCIIYNGGNHKLTQIAKVVIKICEHEMNEIEVCPECYLAACQKRDNWFCEPCSNPHPLVWAKLKGFPFWPAKALRDKDGQVDARFFGQHDRAWVPINNCYLMSKEIPFSVKKTKSIFNSAMQEMEVYVENIRRKFGVFNYSPFRTPYTPNSQYQMLLDPTNPSAGTAKIDKQEKVKLNFDMTASPKILMSKPVLSGGTGRRISLSDMPRSPMSTNSSVHTGSDVEQDAEKKATSSHFSASEESMDFLDKSTASPASTKTGQAGSLSGSPKPFSPQLSAPITTKTDKTSTTGSILNLNLDRSKAEMDLKELSESVQQQSTPVPLISPKRQIRSRFQLNLDKTIESCKAQLGINEISEDVYTAVEHSDSEDSEKSDSSDSEYISDDEQKSKNEPEDTEDKEGCQMDKEPSAVKKKPKPTNPVEIKEELKSTSPASEKADPGAVKDKASPEPEKDFSEKAKPSPHPIKDKLKGKDETDSPTVHLGLDSDSESELVIDLGEDHSGREGRKNKKEPKEPSPKQDVVGKTPPSTTVGSHSPPETPVLTRSSAQTSAAGATATTSTSSTVTVTAPAPAATGSPVKKQRPLLPKETAPAVQRVVWNSSTVQQKEITQSPSTSTITLVTSTQSSPLVTSSGSMSTLVSSVNADLPIATASADVAADIAKYTSKIRRLRIEIEKLQWLHQQELSEMKHNLELTMAEMRQSLEQERDRLIAEVKKQLELEKQQAVDETKKKQWCANCKKEAIFYCCWNTSYCDYPCQQAHWPEHMKSCTQSATAPQQEADAEVNTETLNKSSQGSSSSTQSAPSETASASKEKETSAEKSKESGSTLDLSGSRETPSSILLGSNQGSVSKRCDKQPAYAPTTTDHQPHPNYPAQKYHSRSNKSSWSSSDEKRGSTRSDHNTSTSTKSLLPKESRLDTFWD

SEQ ID NO: 102236 - protein, 1087 aa, Homo sapiens
  Payload ID: 20372
  Gene Name: zinc finger, MYND-type containing 8
  ENSP ID: ENSP00000482048
MDISTRSKDPGSAERTAQKRKFPSPPHSSNGHSPQDTSTSPIKKKKKPGLLNSNNKEQSELRHGPFYYMKQPLTTDPVDVVPQDGRNDFYCWVCHREGQVLCCELCPRVYHAKCLRLTSEPEGDWFCPECEKITVAECIETQSKAMTMLTIEQLSYLLKFAIQKMKQPGTDAFQKPVPLEQHPDYAEYIFHPMDLCTLEKNAKKKMYGCTEAFLADAKWILHNCIIYNGGNHKLTQIAKVVIKICEHEMNEIEVCPECYLAACQKRDNWFCEPCSNPHPLVWAKLKGFPFWPAKALRDKDGQVDARFFGQHDRAWVPINNCYLMSKEIPFSVKKTKSIFNSAMQEMEVYVENIRRKFGVFNYSPFRTPYTPNSQYQMLLDPTNPSAGTAKIDKQEKVKLNFDMTASPKILMSKPVLSGGTGRRISLSDMPRSPMSTNSSVHTGSDVEQDAEKKATSSHFSASEESMDFLDKSTASPASTKTGQAGSLSGSPKPFSPQLSAPITTKTDKTSTTGSILNLNLDRSKAEMDLKELSESVQQQSTPVPLISPKRQIRSRFQLNLDKTIESCKAQLGINEISEDVYTAVEHSDSEDSEKSDSSDSEYISDDEQKSKNEPEDTEDKEGCQMDKEPSAVKKKPKPTNPVEIKEELKSTSPASEKADPGAVKDKASPEPEKDFSEKAKPSPHPIKDKLKGKDETDSPTVHLGLDSDSESELVIDLGEDHSGREGRKNKKEPKEPSPKQDAVQQKEITQSPSTSTITLVTSTQSSPLVTSSGSMSTLVSSVNADLPIATASADVAADIAKYTSKMMDAIKGTMTEIYNDLSKNTTGSTIAEIRRLRIEIEKLQWLHQQELSEMKHNLELTMAEMRQSLEQERDRLIAEVKKQLELEKQQAVDETKKKQWCANCKKEAIFYCCWNTSYCDYPCQQAHWPEHMKSCTQSATAPQQEADAEVNTETLNKSSQGSSSSTQSAPSETASASKEKETSAEKSKESGSTLDLSGSRETPSSILLGSNQGSVSKRCDKQPAYAPTTTDHQPHPNYPAQKYHSRSNKSSWSSSDEKRGSTRSDHNTSTSTKSLLPKESRLDTFWD

SEQ ID NO: 102237 - protein, 934 aa, Homo sapiens
  Payload ID: 20373
  Gene Name: zinc finger, NFX1-type containing 1
  ENSP ID: ENSP00000360809
MEERRPHLDARPRNSHTNHRGPVDGELPPRARNQANNPPANALRGGASHPGRHPRANNHPAAYWQREERFRAMGRNPHQGRRNQEGHASDEARDQRHDQENDTRWRNGNQDCRNRRPPWSNDNFQQWRTPHQKPTEQPQQAKKLGYKFLESLLQKDPSEVVITLATSLGLKELLSHSSMKSNFLELICQVLRKACSSKMDRQSVLHVLGILKNSKFLKVCLPAYVVGMITEPIPDIRNQYPEHISNIISLLQDLVSVFPASSVQETSMLVSLLPTSLNALRASGVDIEEETEKNLEKVQTIIEHLQEKRREGTLRVDTYTLVQPEAEDHVESYRTMPIYPTYNEVHLDERPFLRPNIISGKYDSTAIYLDTHFRLLREDFVRPLREGILELLQSFEDQGLRKRKFDDIRIYFDTRIITPMCSSSGIVYKVQFDTKPLKFVRWQNSKRLLYGSLVCMSKDNFETFLFATVSNREQEDLCRGIVQLCFNEQSQQLLAEVQPSDSFLMVETTAYFEAYRHVLEGLQEVQEEDVPFQRNIVECNSHVKEPRYLLMGGRYDFTPLIENPSATGEFLRNVEGLRHPRINVLDPGQWPSKEALKLDDSQMEALQFALTRELAIIQGPPGTGKTYVGLKIVQALLTNESVWQISLQKFPILVVCYTNHALDQFLEGIYNCQKTSIVRVGGRSNSEILKQFTLRELRNKREFRRNLPMHLRRAYMSIMTQMKESEQELHEGAKTLECTMRGVLREQYLQKYISPQHWESLMNGPVQDSEWICFQHWKHSMMLEWLGLGVGSFTQSVSPAGPENTAQAEGDEEEEGEEESSLIEIAEEADLIQADRVIEEEEVVRPQRRKKEESGADQELAKMLLAMRLDHCGTGTAAGQEQATGEWQTQRNQKKKMKKRVKDELRKLNTMTAAEANEIEDVWQLDLSSRWQLY

SEQ ID NO: 102238 - protein, 1918 aa, Homo sapiens
  Payload ID: 20373
  Gene Name: zinc finger, NFX1-type containing 1
  Uniprot ID: Q9P2E3
  ENSP ID: ENSP00000360817
MEERRPHLDARPRNSHTNHRGPVDGELPPRARNQANNPPANALRGGASHPGRHPRANNHPAAYWQREERFRAMGRNPHQGRRNQEGHASDEARDQRHDQENDTRWRNGNQDCRNRRPPWSNDNFQQWRTPHQKPTEQPQQAKKLGYKFLESLLQKDPSEVVITLATSLGLKELLSHSSMKSNFLELICQVLRKACSSKMDRQSVLHVLGILKNSKFLKVCLPAYVVGMITEPIPDIRNQYPEHISNIISLLQDLVSVFPASSVQETSMLVSLLPTSLNALRASGVDIEEETEKNLEKVQTIIEHLQEKRREGTLRVDTYTLVQPEAEDHVESYRTMPIYPTYNEVHLDERPFLRPNIISGKYDSTAIYLDTHFRLLREDFVRPLREGILELLQSFEDQGLRKRKFDDIRIYFDTRIITPMCSSSGIVYKVQFDTKPLKFVRWQNSKRLLYGSLVCMSKDNFETFLFATVSNREQEDLCRGIVQLCFNEQSQQLLAEVQPSDSFLMVETTAYFEAYRHVLEGLQEVQEEDVPFQRNIVECNSHVKEPRYLLMGGRYDFTPLIENPSATGEFLRNVEGLRHPRINVLDPGQWPSKEALKLDDSQMEALQFALTRELAIIQGPPGTGKTYVGLKIVQALLTNESVWQISLQKFPILVVCYTNHALDQFLEGIYNCQKTSIVRVGGRSNSEILKQFTLRELRNKREFRRNLPMHLRRAYMSIMTQMKESEQELHEGAKTLECTMRGVLREQYLQKYISPQHWESLMNGPVQDSEWICFQHWKHSMMLEWLGLGVGSFTQSVSPAGPENTAQAEGDEEEEGEEESSLIEIAEEADLIQADRVIEEEEVVRPQRRKKEESGADQELAKMLLAMRLDHCGTGTAAGQEQATGEWQTQRNQKKKMKKRVKDELRKLNTMTAAEANEIEDVWQLDLSSRWQLYRLWLQLYQADTRRKILSYERQYRTSAERMAELRLQEDLHILKDAQVVGMTTTGAAKYRQILQKVEPRIVIVEEAAEVLEAHTIATLSKACQHLILIGDHQQLRPSANVYDLAKNFNLEVSLFERLVKVNIPFVRLNYQHRMCPEIARLLTPHIYQDLENHPSVLKYEKIKGVSSNLFFVEHNFPEQEIQEGKSHQNQHEAHFVVELCKYFLCQEYLPSQITILTTYTGQLFCLRKLMPAKTFAGVRVHVVDKYQGEENDIILLSLVRSNQEGKVGFLQISNRICVALSRAKKGMYCIGNMQMLAKVPLWSKIIHTLRENNQIGPMLRLCCQNHPETHTLVSKASDFQKVPEGGCSLPCEFRLGCGHVCTRACHPYDSSHKEFQCMKPCQKVICQEGHRCPLVCFQECQPCQVKVPKTIPRCGHEQMVPCSVPESDFCCQEPCSKSLRCGHRCSHPCGEDCVQLCSEMVTIKLKCGHSQPVKCGHVEGLLYGGLLVKCTTKCGTILDCGHPCPGSCHSCFEGRFHERCQQPCKRLLICSHKCQEPCIGECPPCQRTCQNRCVHSQCKKKCGELCSPCVEPCVWRCQHYQCTKLCSEPCNRPPCYVPCTKLLVCGHPCIGLCGEPCPKKCRICHMDEVTQIFFGFEDEPDARFVQLEDCSHIFEVQALDRYMNEQKDDEVAIRLKVCPICQVPIRKNLRYGTSIKQRLEEIEIIKEKIQGSAGEIATSQERLKALLERKSLLHQLLPEDFLMLKEKLAQKNLSVKDLGLVENYISFYDHLASLWDSLKKMHVLEEKRVRTRLEQVHEWLAKKRLSFTSQELSDLRSEIQRLTYLVNLLTRYKIAEKKVKDSIAVEVYSVQNILEKTCKFTQEDEQLVQEKMEALKATLPCSGLGISEEERVQIVSAIGYPRGHWFKCRNGHIYVIGDCGGAMERGTCPDCKEVIGGTNHTLERSNQLASEMDGAQHAAWSDTANNLMNFEEIQGMM

SEQ ID NO: 102239 - protein, 1270 aa, Homo sapiens
  Payload ID: 20373
  Gene Name: zinc finger, NFX1-type containing 1
  ENSP ID: ENSP00000360819
MEERRPHLDARPRNSHTNHRGPVDGELPPRARNQANNPPANALRGGASHPGRHPRANNHPAAYWQREERFRAMGRNPHQGRRNQEGHASDEARDQRHDQENDTRWRNGNQDCRNRRPPWSNDNFQQWRTPHQKPTEQPQQAKKLGYKFLESLLQKDPSEVVITLATSLGLKELLSHSSMKSNFLELICQVLRKACSSKMDRQSVLHVLGILKNSKFLKVCLPAYVVGMITEPIPDIRNQYPEHISNIISLLQDLVSVFPASSVQETSMLVSLLPTSLNALRASGVDIEEETEKNLEKVQTIIEHLQEKRREGTLRVDTYTLVQPEAEDHVESYRTMPIYPTYNEVHLDERPFLRPNIISGKYDSTAIYLDTHFRLLREDFVRPLREGILELLQSFEDQGLRKRKFDDIRIYFDTRIITPMCSSSGIVYKVQFDTKPLKFVRWQNSKRLLYGSLVCMSKDNFETFLFATVSNREQEDLCRGIVQLCFNEQSQQLLAEVQPSDSFLMVETTAYFEAYRHVLEGLQEVQEEDVPFQRNIVECNSHVKEPRYLLMGGRYDFTPLIENPSATGEFLRNVEGLRHPRINVLDPGQWPSKEALKLDDSQMEALQFALTRELAIIQGPPGTGKTYVGLKIVQALLTNESVWQISLQKFPILVVCYTNHALDQFLEGIYNCQKTSIVRVGGRSNSEILKQFTLRELRNKREFRRNLPMHLRRAYMSIMTQMKESEQELHEGAKTLECTMRGVLREQYLQKYISPQHWESLMNGPVQDSEWICFQHWKHSMMLEWLGLGVGSFTQSVSPAGPENTAQAEGDEEEEGEEESSLIEIAEEADLIQADRVIEEEEVVRPQRRKKEESGADQELAKMLLAMRLDHCGTGTAAGQEQATGEWQTQRNQKKKMKKRVKDELRKLNTMTAAEANEIEDVWQLDLSSRWQLYRLWLQLYQADTRRKILSYERQYRTSAERMAELRLQEDLHILKDAQVVGMTTTGAAKYRQILQKVEPRIVIVEEAAEVLEAHTIATLSKACQHLILIGDHQQLRPSANVYDLAKNFNLEVSLFERLVKVNIPFVRLNYQHRMCPEIARLLTPHIYQDLENHPSVLKYEKIKAKSNSCRALATGMRRKHKISGMILSFFKLTIRSARFQLLLSGSWTTASFPFSRSRFAVLICRDNKRMPAVKPVSTNTGSHGLQMPGALMGETFQKGSTSRDAAACLLSSLVNKIPPRSLTWASDCCISFSSASSCRTAYTSFSIFSILSRNLRMTSQWEKIKRIYK

SEQ ID NO: 102240 - protein, 1918 aa, Homo sapiens; identical to SEQ ID NO: 102238
  Payload ID: 20373
  Gene Name: zinc finger, NFX1-type containing 1
  Uniprot ID: Q9P2E3
  ENSP ID: ENSP00000379412

SEQ ID NO: 102241 - protein, 707 aa, Homo sapiens
  Payload ID: 20373
  Gene Name: zinc finger, NFX1-type containing 1
  ENSP ID: ENSP00000413800
SKMDRQSVLHVLGILKNSKFLKVCLPAYVVGMITEPIPDIRNQYPEHISNIISLLQDLVSVFPASSVQETSMLVSLLPTSLNALRASGVDIEEETEKNLEKVQTIIEHLQEKRREGTLRVDTYTLVQPEAEDHVESYRTMPIYPTYNEVHLDERPFLRPNIISGKYDSTAIYLDTHFRLLREDFVRPLREGILELLQSFEDQGLRKRKFDDIRIYFDTRIITPMCSSSGIVYKVQFDTKPLKFVRWQNSKRLLYGSLVCMSKDNFETFLFATVSNREQEDLCRGIVQLCFNEQSQQLLAEVQPSDSFLMVETTAYFEAYRHVLEGLQEVQEEDVPFQRNIVECNSHVKEPRYLLMGGRYDFTPLIENPSATGEFLRNVEGLRHPRINVLDPGQWPSKEALKLDDSQMEALQFALTRELAIIQGPPGTGKTYVGLKIVQALLTNESVWQISLQKFPILVVCYTNHALDQFLEGIYNCQKTSIVRVGGRSNSEILKQFTLRELRNKREFRRNLPMHLRRAYMSIMTQMKESEQELHEGAKTLECTMRGVLREQYLQKYISPQHWESLMNGPVQDSEWICFQHWKHSMMLEWLGLGVGSFTQSVSPAGPENTAQAEGDEEEEGEEESSLIEIAEEADLIQADRVIEEEEVVRPQRRKKEESGADQELAKMLLAMRLDHCGTGTAAGQEQATGEWQTVPCLVLMSADPAQP

SEQ ID NO: 102242 - protein, 708 aa, Homo sapiens
  Payload ID: 20374
  Gene Name: zinc finger, RAN-binding domain containing 1
  Uniprot ID: Q9UGI0
  ENSP ID: ENSP00000352676
MSERGIKWACEYCTYENWPSAIKCTMCRAQRPSGTIITEDPFKSGSSDVGRDWDPSSTEGGSSPLICPDSSARPRVKSSYSMENANKWSCHMCTYLNWPRAIRCTQCLSQRRTRSPTESPQSSGSGSRPVAFSVDPCEEYNDRNKLNTRTQHWTCSVCTYENWAKAKRCVVCDHPRPNNIEAIELAETEEASSIINEQDRARWRGSCSSGNSQRRSPPATKRDSEVKMDFQRIELAGAVGSKEELEVDFKKLKQIKNRMKKTDWLFLNACVGVVEGDLAAIEAYKSSGGDIARQLTADEVRLLNRPSAFDVGYTLVHLAIRFQRQDMLAILLTEVSQQAAKCIPAMVCPELTEQIRREIAASLHQRKGDFACYFLTDLVTFTLPADIEDLPPTVQEKLFDEVLDRDVQKELEEESPIINWSLELATRLDSRLYALWNRTAGDCLLDSVLQATWGIYDKDSVLRKALHDSLHDCSHWFYTRWKDWESWYSQSFGLHFSLREEQWQEDWAFILSLASQPGASLEQTHIFVLAHILRRPIIVYGVKYYKSFRGETLGYTRFQGVYLPLLWEQSFCWKSPIALGYTRGHFSALVAMENDGYGNRGAGANLNTDDDVTITFLPLVDSERKLLHVHFLSAQELGNEEQQEKLLREWLDCCVTEGGVLVAMQKSSRRRNHPLVTQMVEKWLDRYRQIRPCTSLSDGEEDEDDEDE

SEQ ID NO: 102243 - protein, 320 aa, Homo sapiens
  Payload ID: 20375
  Gene Name: zinc finger, RAN-binding domain containing 2
  Uniprot ID: O95218
  ENSP ID: ENSP00000254821
MSTKNFRVSDGDWICPDKKCGNVNFARRTSCNRCGREKTTEAKMMKAGGTEIGKTLAEKSRGLFSANDWQCKTCSNVNWARRSECNMCNTPKYAKLEERTGYGGGFNERENVEYIEREESDGEYDEFGRKKKKYRGKAVGPASILKEVEDKESEGEEEDEDEDLSKYKLDEDEDEDDADLSKYNLDASEEEDSNKKKSNRRSRSKSRSSHSRSSSRSSSPSSSRSRSRSRSRSSSSSQSRSRSSSRERSRSRGSKSRSSSRSHRGSSSPRKRSYSSSSSSPERNRKRSRSRSSSSGDRKKRRTRSRSPESQVIGENTKQP

SEQ ID NO: 102244 - protein, 330 aa, Homo sapiens
  Payload ID: 20375
  Gene Name: zinc finger, RAN-binding domain containing 2
  Uniprot ID: O95218
  ENSP ID: ENSP00000359958
MSTKNFRVSDGDWICPDKKCGNVNFARRTSCNRCGREKTTEAKMMKAGGTEIGKTLAEKSRGLFSANDWQCKTCSNVNWARRSECNMCNTPKYAKLEERTGYGGGFNERENVEYIEREESDGEYDEFGRKKKKYRGKAVGPASILKEVEDKESEGEEEDEDEDLSKYKLDEDEDEDDADLSKYNLDASEEEDSNKKKSNRRSRSKSRSSHSRSSSRSSSPSSSRSRSRSRSRSSSSSQSRSRSSSRERSRSRGSKSRSSSRSHRGSSSPRKRSYSSSSSSPERNRKRSRSRSSSSGDRKKRRTRSRSPERRHRSSSGSSHSGSRSSSKKK

SEQ ID NO: 102245 - protein, 337 aa, Homo sapiens
  Payload ID: 20375
  Gene Name: zinc finger, RAN-binding domain containing 2
  ENSP ID: ENSP00000480576
MSTKNFRVSDGDWICPDKKCGNVNFARRTSCNRCGREKTTEAKMMKAGGTEIGKTLAEKSRGLFSANDWQCKTCSNVNWARRSECNMCNTPKYAKLEERTGYGGGFNERENVEYIEREESDGEYDEFGRKKKKYRGKAVGPASILKEVEDKESEGEEEDEDEDLSKYKLDEDEDEDDADLSKYNLDASEEEDSNKKKSNRRSRSKSRSSHSRSSSRSSSPSSSRSRSRSRSRSSSSSQSRSRSSSRERSRSRGSKSRSSSRSTGALLPHEKDLIQVHHLLLRGTEREVVLDLLHLVIAKKDEQDHGHPKDATGHHLDHPILVPVQVQKRNNVLKFTS

SEQ ID NO: 102246 - protein, 320 aa, Homo sapiens; identical to SEQ ID NO: 102243
  Payload ID: 20375
  Gene Name: zinc finger, RAN-binding domain containing 2
  Uniprot ID: O95218
  ENSP ID: ENSP00000482026

SEQ ID NO: 102247 - protein, 1079 aa, Homo sapiens
  Payload ID: 20376
  Gene Name: zinc finger, RAN-binding domain containing 3
  Uniprot ID: Q5FWF4
  ENSP ID: ENSP00000264159
MPRVHNIKKSLTPHISCVTNESDNLLDFLPDRLRAKLLPFQKDGIIFALKRNGRCMVADEMGLGKTIQAIGITYFYKEEWPLLIVVPSSLRYPWTEEIEKWIPELSPEEINVIQNKTDVRRMSTSKVTVLGYGLLTADAKTLIDALNNQNFKVVIVDESHYMKSRNATRSRILLPIVQKARRAILLTGTPALGRPEELFMQIEALFPQKFGRWTDYAKRYCNAHIRYFGKRPQWDCRGASNLNELHQLLSDIMIRRLKTEVLTQLPPKVRQRIPFDLPSAAAKELNTSFEEWEKIMRTPNSGAMETVMGLITRMFKQTAIAKAGAVKDYIKMMLQNDSLKFLVFAHHLSMLQACTEAVIENKTRYIRIDGSVSSSERIHLVNQFQKDPDTRVAILSIQAAGQGLTFTAASHVVFAELYWDPGHIKQAEDRAHRIGQCSSVNIHYLIANGTLDTLMWGMLNRKAQVTGSTLNGRKEKIQAEEGDKEKWDFLQFAEAWTPNDSSEELRKEALFTHFEKEKQHDIRSFFVPQPKKRQLMTSCDESKRFREENTVVSSDPTKTAARDIIDYESDVEPETKRLKLAASEDHCSPSEETPSQSKQIRTPLVESVQEAKAQLTTPAFPVEGWQCSLCTYINNSELPYCEMCETPQGSAVMQIDSLNHIQDKNEKDDSQKDTSKKVQTISDCEKQALAQSEPGQLADSKEETPKIEKEDGLTSQPGNEQWKSSDTLPVYDTLMFCASRNTDRIHIYTKDGKQMSCNFIPLDIKLDLWEDLPASFQLKQYRSLILRFVREWSSLTAMKQRIIRKSGQLFCSPILALEEITKQQTKQNCTKRYITKEDVAVASMDKVKNVGGHVRLITKESRPRDPFTKKLLEDGACVPFLNPYTVQADLTVKPSTSKGYLQAVDNEGNPLCLRCQQPTCQTKQACKANSWDSRFCSLKCQEEFWIRSNNSYLRAKVFETEHGVCQLCNVNAQELFLRLRDAPKSQRKNLLYATWTSKLPLEQLNEMIRNPGEGHFWQVDHIKPVYGGGGQCSLDNLQTLCTVCHKERTARQAKERSQVRRQSLASKHGSDITRFLVKK

SEQ ID NO: 102248 - protein, 1077 aa, Homo sapiens
  Payload ID: 20376
  Gene Name: zinc finger, RAN-binding domain containing 3
  Uniprot ID: Q5FWF4
  ENSP ID: ENSP00000383979
MPRVHNIKKSLTPHISCVTNESDNLLDFLPDRLRAKLLPFQKDGIIFALKRNGRCMVADEMGLGKTIQAIGITYFYKEEWPLLIVVPSSLRYPWTEEIEKWIPELSPEEINVIQNKTDVRRMSTSKVTVLGYGLLTADAKTLIDALNNQNFKVVIVDESHYMKSRNATRSRILLPIVQKARRAILLTGTPALGRPEELFMQIEALFPQKFGRWTDYAKRYCNAHIRYFGKRPQWDCRGASNLNELHQLLSDIMIRRLKTEVLTQLPPKVRQRIPFDLPSAAAKELNTSFEEWEKIMRTPNSGAMETVMGLITRMFKQTAIAKAGAVKDYIKMMLQNDSLKFLVFAHHLSMLQACTEAVIENKTRYIRIDGSVSSSERIHLVNQFQKDPDTRVAILSIQAAGQGLTFTAASHVVFAELYWDPGHIKQAEDRAHRIGQCSSVNIHYLIANGTLDTLMWGMLNRKAQVTGSTLNGRKEKIQAEEGDKEKWDFLQFAEAWTPNDSSEELRKEALFTHFEKEKQHDIRSFFVPQPKKRQLMTSCDESKRFREENTVVSSDPTKTAARDIIDYESDVEPETKRLKLAASEDHCSPSEETPSQSKQIRTPLVESVQEAKAQLTTPAFPVEGWQCSLCTYINNSELPYCEMCETPQGSAVMQIDSLNHIQDKNEKDDSQKDTSKKVQTISDCEKQALAQSEPGQLADSKEETPKIEKEDGLTSQPEQWKSSDTLPVYDTLMFCASRNTDRIHIYTKDGKQMSCNFIPLDIKLDLWEDLPASFQLKQYRSLILRFVREWSSLTAMKQRIIRKSGQLFCSPILALEEITKQQTKQNCTKRYITKEDVAVASMDKVKNVGGHVRLITKESRPRDPFTKKLLEDGACVPFLNPYTVQADLTVKPSTSKGYLQAVDNEGNPLCLRCQQPTCQTKQACKANSWDSRFCSLKCQEEFWIRSNNSYLRAKVFETEHGVCQLCNVNAQELFLRLRDAPKSQRKNLLYATWTSKLPLEQLNEMIRNPGEGHFWQVDHIKPVYGGGGQCSLDNLQTLCTVCHKERTARQAKERSQVRRQSLASKHGSDITRFLVKK

SEQ ID NO: 102249 - protein, 428 aa, Homo sapiens
  Payload ID: 20376
  Gene Name: zinc finger, RAN-binding domain containing 3
  ENSP ID: ENSP00000384245
MPRVHNIKKSLTPHISCVTNESDNLLDFLPDRLRAKLLPFQKDGIIFALKRNGRCMVADEMGLGKTIQAIGITYFYKEEWPLLIVVPSSLRYPWTEEIEKWIPELSPEEINVIQNKTDVRRMSTSKVTVLGYGLLTADAKTLIDALNNQNFKVVIVDESHYMKSRNATRSRILLPIVQKARRAILLTGTPALGRPEELFMQIEALFPQKFGRWTDYAKRYCNAHIRYFGKRPQWDCRGASNLNELHQLLSDIMIRRLKTEVLTQLPPKVRQRIPFDLPSAAAKELNTSFEEWEKIMRTPNSGAMETVMGLITRMFKQTAIAKAGAVKDYIKMMLQNDSLKFLVFAHHLSMLQACTEAVIENKTRYIRIDGSVSSSERIHLVNQFQKDPDTRVAILSIQAAGQDLYDKVAWGKRTLVSGLFMECFCFVP

SEQ ID NO: 102250 - protein, 625 aa, Homo sapiens
  Payload ID: 20376
  Gene Name: zinc finger, RAN-binding domain containing 3
  ENSP ID: ENSP00000441320
MWGMLNRKAQVTGSTLNGRKEKIQAEEGDKEKWDFLQFAEAWTPNDSSEELRKEALFTHFEKEKQHDIRSFFVPQPKKRQLMTSCDESKRFREENTVVSSDPTKTAARDIIDYESDVEPETKRLKLAASEDHCSPSEETPSQSKQIRTPLVESVQEAKAQLTTPAFPVEGWQCSLCTYINNSELPYCEMCETPQGSAVMQIDSLNHIQDKNEKDDSQKDTSKKVQTISDCEKQALAQSEPGQLADSKEETPKIEKEDGLTSQPGNEQWKSSDTLPVYDTLMFCASRNTDRIHIYTKDGKQMSCNFIPLDIKLDLWEDLPASFQLKQYRSLILRFVREWSSLTAMKQRIIRKSGQLFCSPILALEEITKQQTKQNCTKRYITKEDVAVASMDKVKNVGGHVRLITKESRPRDPFTKKLLEDGACVPFLNPYTVQADLTVKPSTSKGYLQAVDNEGNPLCLRCQQPTCQTKQACKANSWDSRFCSLKCQEEFWIRSNNSYLRAKVFETEHGVCQLCNVNAQELFLRLRDAPKSQRKNLLYATWTSKLPLEQLNEMIRNPGEGHFWQVDHIKPVYGGGGQCSLDNLQTLCTVCHKERTARQAKERSQVRRQSLASKHGSDITRFLVKK

SEQ ID NO: 102251 - protein, 598 aa, Homo sapiens
  Payload ID: 20376
  Gene Name: zinc finger, RAN-binding domain containing 3
  Uniprot ID: Q5FWF4
  ENSP ID: ENSP00000480120
MTSCDESKRFREENTVVSSDPTKTAARDIIDYESDVEPETKRLKLAASEDHCSPSEETPSQSKQIRTPLVESVQEAKAQLTTPAFPVEGWQCSLCTYINNSELPYCEMCETPQGSAVMQIDSLNHIQDKNEKDDSQKDTSKKVQTISDCEKQALAQSEPGQLADSKEETPKIEKEDGLTSQPEQWKSSDTLPVYDTLMFCASRNTDRIHIYTKDGKQMSCNFIPLDIKLDLWEDLPASFQLKQYRSLILRFVREWSSLTAMKQRIIRKSGQLFCSPILALEEITKQQTKQNCTKRYITKEDVAVASMDKVKNVGGHVRLITKESRPRDPFTKKLLEDGACVPFLNPYTVQADLTVKPSTSKGYLQAVDNEGNPLCLRCQQPTCQTKQACKANSWDSRFCSLKCQEEFWIRSNNSYLRAKVFETEHGVCQLCNVNAQELFLRLRDAPKSQRKNLLYATWTSKLPLEQLNEMIRNPGEGHFWQVDHIKPVYGGGGQCSLDNLQTLCTVCHKERTARQAKERSQVRRQSLASKHGSDITRFLETSKLHESHKVTGAEQGLQVSGLPDSAAPEGGAAHTNDQRRCQRMKQPLTEVQILSHSS

SEQ ID NO: 102252 - protein, 485 aa, Homo sapiens
  Payload ID: 20377
  Gene Name: zinc finger, SWIM-type containing 1
  Uniprot ID: Q9BR11
  ENSP ID: ENSP00000361598
MLERLKAPWSAALQRKYFDLGIWTAPISPMALTMLNGLLIKDSSPPMLLHQVNKTAQLDTFNYQSCFMQSVFDHFPEILFIHRTYNPRGKVLYTFLVDGPRVQLEGHLARAVYFAIPAKEDTEGLAQMFQVFKKFNPAWERVCTILVDPHFLPLPILAMEFPTAEVLLSAFHICKFLQAKFYQLSLERPVERLLLTSLQSTMCSATAGNLRKLYTLLSNCIPPAKLPELHSHWLLNDRIWLAHRWRSRAESSHYFQSLEVTTHILSQFFGTTPSEKQGMASLFRYMQQNSADKANFNQGLCAQNNHAPSDTIPESPKLEQLVESHIQHSLNAICTGPAAQLCLGELAVVQKSTHLIGSGSEKMNIQILEDTHKVQPQPPASCSCYFNQAFHLPCRHILAMLSARRQVLQPDMLPAQWTAGCATSLDSILGSKWSETLDKHLAVTHLTEEVGQLLQHCTKEEFERRYSTLRELADSWIGPYEQVQL

SEQ ID NO: 102253 - protein, 485 aa, Homo sapiens; identical to SEQ ID NO: 102252
  Payload ID: 20377
  Gene Name: zinc finger, SWIM-type containing 1
  Uniprot ID: Q9BR11
  ENSP ID: ENSP00000361601

SEQ ID NO: 102254 - protein, 633 aa, Homo sapiens
  Payload ID: 20378
  Gene Name: zinc finger, SWIM-type containing 2
  Uniprot ID: Q8NEG5
  ENSP ID: ENSP00000295131
MLRRGYKASERRRHLSERLSWHQDQALSSSIYLLREMGPTGFLLREEEPEYMDFRVFLGNPHVCNCSTFPKGGELCKHICWVLLKKFKLPRNHESALQLGLGEREISDLLRGIHRVQTPQPGTNDENEHVEEDGYIKQKEIDSEDICSICQELLLEKKLPVTFCRFGCGNSIHIKCMKILANYQSTSNTSMLKCPLCRKEFAPLKLILEEFKNSSKLVAAAEKERLDKHLGIPCNNCKQFPIEGKCYKCTECIEYHLCQECFDSCCHLSHTFTFREKRNQKWRSLEKRADEVVKYIDTKNEIEEKMSHFQEKQGQVYTPKHIVRSLPLQLITKNSKLLAPGYQCLLCLKAFHLGQHTRLLPCTHKFHRKCIDNWLFHKCNSCPIDGQVIYNPLTWKNSAVNGQAHQSVSNRDIIHLSKQKEPDLFIPGTGLVLKQNRLGILPSIPQCNFDELNTPQSPKDAYENTTIDNLCSIKLDNSNSKKLTYDYKISQHFPRYLQDLPTVSFGKIPSQTLLPPIVHKNIVCPTAMESPCISGKFHTSLSRMTKGCKCNNHNLKKTPATKIREDNKRSTLLPEDFNLIVNWSTAKLSLSKRYSNCMGEITRKCSHLSRQPVSHSVNTKSTELSLIIEGVQL

SEQ ID NO: 102255 - protein, 81 aa, Homo sapiens
  Payload ID: 20378
  Gene Name: zinc finger, SWIM-type containing 2
  ENSP ID: ENSP00000400595
MLRRGYKASERRRHLSERLSWHQDQALSSSIYLLREMGPTGFLLREEEPEYMDFRVTTAPTAPSWPSSPPTRFPHWHTQCA

SEQ ID NO: 102256 - protein, 696 aa, Homo sapiens
  Payload ID: 20379
  Gene Name: zinc finger, SWIM-type containing 3
  Uniprot ID: Q96MP5
  ENSP ID: ENSP00000255152
MELGSCFKTYEDFKECFSAYKRENRCSFILRDCVSVRFHNLNHGTSIREDILYVQVKFVCIRTQSNRKRTREADMCPAYLLLRYNERLDRLFISELNTQHIHGDSKVASPGGDTTGKSQKTMCLQRLQPVQPTTKKDLDTAEKSLVEPSFCLDKVQVSSKPEQEGITPSDLAKIAKVMKNFLKVDEGSMASFSVGDSQHLDRLSFQSSKMTDLFIRFPENLLLHRVENTQGHILYAFLVENKERESRVVHFAVLKAETVTSVAKMLSIFTEFNSDWPKVKVVFVDPSFHYRAILQEIFPAARILLSIYHTTRLLEKKLHRSSANPSFKRLMKEALREAVFVTSEASLKNLCQMSQAVLDEDLFNFLQAHWFTCELLWYMHVRKGLLACNTYMDSLDIVTSKVSSLFREQQSLLDCILCFVDYIDFFNTKGLKNLPTPPPKLKRARPASMPLKSKKAFGICGESLTSLPAEETKPDAQQVQVQQQSQVPPSQVGMLDTLHQSGSELAYKLCHNEWEVVQNSTHLVDMAGSSVDVQLLEDSHQVSKDGCSCSCSFQQWYHLPCRHILALLHTSQQPVGEAMVCRRWQKKYQYLLGPNGELQDRGMVPNTGQPEKQGRNDMIQDLSRELANLLMQTEGPELEERYSTLRKIVDIWAGPSQPSELFQQPGDFKDVGRLPFLWGKQEEGEGFPPATAVMHY

SEQ ID NO: 102257 - protein, 989 aa, Homo sapiens
  Payload ID: 20380
  Gene Name: zinc finger, SWIM-type containing 4
  Uniprot ID: Q9H7M6
  ENSP ID: ENSP00000254323
MEPPAAKRSRGCPAGPEERDAGAGAARGRGRPEALLDLSAKRVAESWAFEQVEERFSRVPEPVQKRIVFWSFPRSEREICMYSSLGYPPPEGEHDARVPFTRGLHLLQSGAVDRVLQVGFHLSGNIREPGSPGEPERLYHVSISFDRCKITSVSCGCDNRDLFYCAHVVALSLYRIRHAHQVELRLPISETLSQMNRDQLQKFVQYLISAHHTEVLPTAQRLADEILLLGSEINLVNGAPDPTAGAGIEDANCWHLDEEQIQEQVKQLLSNGGYYGASQQLRSMFSKVREMLRMRDSNGARMLILMTEQFLQDTRLALWRQQGAGMTDKCRQLWDELGALWVCVVLSPHCKPEERAGWLQLLSRWDKLDVCPLEEGNYSFDGPSLQPTMAPAPELLQKGSTCITNTEGWVGHPLDPIGCLCRALLEACRLEEETLTLYPDSGPEKRKVAYQHVPVPGSPGESYLVLALEVALLGLGQQRALPEGLYAQDKVVRNEEQLLALLEEVELDERLVQVLRKQAGLLLEGGPFSGFGEVLFRESVPMHTCARYLFTALLPHDPDLAYRLALRAMRLPILETAFPAGEPHPSPLDSIMSNRFPRWFILGHLETRQCELASTMLTAAKGDPKWLHTVLGSIQQNIHSPALLFKLAQDACKTATPVSAPPDTTLLGIALELGLQVMRMTLNVMTWRRREMVRWLVSCATEIGPQALMNIMQNWYSLFTPVEAATIVAVTGTTHATLLRLQLDTSRREELWACARTLALQCAMKDPQNCALPALTLCEKNHSAFEAAYQIVLDAAAGGLGHAHLFTVARYMEHRGLPLRAYKLATLALAQLSIAFNQDSHPAVNDVLWACSLSHSLGRHELSAIVPLIIRSIHCAPMLSDILRRWTLSAPGLGPLGARRAAKPLGADRAPLCQLLDAAVTAYITTSHSRLTHISPRHYGDFIEFLGKARETFLLAPDGHLQFSQFLENLKQTYKGKKKLMLLVRERFG

SEQ ID NO: 102258 - protein, 240 aa, Homo sapiens
  Payload ID: 20380
  Gene Name: zinc finger, SWIM-type containing 4
  ENSP ID: ENSP00000465180
  MOD_RES (1)..(1): Any amino acid
XALALSPPDSGPEKRKVAYQHVPVPGSPGESYLVLALEVALLGLGQQRALPEGLYAQDKVVRNEEQLLTRQCELASTMLTAAKGDPKWLHTVLGSIQQNIHSPALLFKLAQDACKTATPVSAPPDTTLLGIALELGLQVMRMTLNVMTWRRREMVRWLVSCATEIGPQALMNIMQNWYSLFTPVEAATIVAVTGTTHATLLRLQLDTSRREELWACARTLALQCAMKDPQNCALPALTLC

SEQ ID NO: 102259 - protein, 898 aa, Homo sapiens
  Payload ID: 20380
  Gene Name: zinc finger, SWIM-type containing 4
  ENSP ID: ENSP00000468285
SAHHTEVLPTAQRLADEILLLGSEINLVNGAPDPTAGAGIEDANCWHLDEEQIQEQVKQLLSNGGYYGASQQLRSMFSKVREMLRMRDSNGARMLILMTEQFLQDTRLALWRQQGAGMTDKCRQLWDELGALWVCVVLSPHCKPEERAGWLQLLSRWDKLDVCPLEEGNYSFDGPSLQPTMAPAPGSEEEEEVAATSPRHTVFGRALLAGELHWNDAYLQRILASDSYGPSLTGSVGGDKPTFDPQGRPLWLGEPFPTACARVDTLRAHGYPRQALRLASAIINTLRLQQRHQLESYKQQKKELLQKGSTCITNTEGWVGHPLDPIGCLCRALLEACRLEEETLTLYPDSGPEKRKVAYQHVPVPGSPGESYLVLALEVALLGLGQQRALPEGLYAQDKVVRNEEQLLALLEEVELDERLVQVLRKQAGLLLEGGPFSGFGEVLFRESVPMHTCARYLFTALLPHDPDLAYRLALRAMRLPILETAFPAGEPHPSPLDSIMSNRFPRWFILGHLETRQCELASTMLTAAKGDPKWLHTVLGSIQQNIHSPALLFKLAQDACKTATPVSAPPDTTLLGIALELGLQVMRMTLNVMTWRRREMVRWLVSCATEIGPQALMNIMQNWYSLFTPVEAATIVAVTGTTHATLLRLQLDTSRREELWACARTLALQCAMKDPQNCALPALTLCEKNHSAFEAAYQIVLDAAAGGLGHAHLFTVARYMEHRGLPLRAYKLATLALAQLSIAFNQDSHPAVNDVLWACSLSHSLGRHELSAIVPLIIRSIHCAPMLSDILRRWTLSAPGLGPLGARRAAKPLGADRAPLCQLLDAAVTAYITTSHSRLTHISPRHYGDFIEFLGKARETFLLAPDGHLQFSQFLENLKQTYKGKKKLMLLVRERFG

SEQ ID NO: 102260 - protein, 1185 aa, Homo sapiens
  Payload ID: 20381
  Gene Name: zinc finger, SWIM-type containing 5
  Uniprot ID: Q9P217
  ENSP ID: ENSP00000352614
MADGGEREELLSPSPVSPAKRQCSWPSPQAHHPRGSPGAAGGGAGGVGSSCLVLGARPHLQPDSLLDCAAKTVAEKWAYERVEERFERIPEPVQRRIVYWSFPRNEREICMYSSFQYRGGPGAGAAGGAAGASPAEEGPQPPPGAAAPAGSAPGGVAAGASPGLGAGAGAAGCGGEGLPFRRGIRLLDSGSVENVLQVGFHLSGTVTELATASEPAVTYKVAISFDRCKITSVTCGCGNKDIFYCAHVVALSLYRIRKPDQVKLRLPISETLFQMNRDQLQKFIQYLITAHHTEVLPTAQKLADEILSSNSEINQVNGAPDPTAGASIDDENCWHLDEEQVKEQVKLFLSQGGYCGSGKQLNSMFAKVREMLRMRDSNGARMLTLITEQFVADPRLTLWRQQGTNMTDKCRQLWDELGALWVCIILNPHCKLEEKSCWLQQLQKWSDLDVCPLEDGNYGHELPNITNALPQSAIHSPDSLSRPRRTVFTRAIEGRELHWQDSHLQRIISSDVYTAPACQRESERLLFNSQGQPLWLEHVPTACARVDALRSHGYPKEALRLTVAIINTLRLQQQRQLEIYKHQKKELLQRGTTTITNLEGWVGHPLDPIDCLFLTLTEACRLNDDGYLEMSDMNESRPPVYQHVPVAAGSPNSSESYLSLALEVALMGLGQQRLMPEGLYAQDKVCRNEEQLLSQLQELQLDDELVQTLQKQCILLLEGGPFSGLGEVIHRESVPMHTFAKYLFSALLPHDPDLSYKLALRAMRLPVLENSASAGDTSHPHHMVSVVPSRYPRWFTLGHLESQQCELASTMLTAAKGDTLRLRTILEAIQKHIHSSSLIFKLAQDAFKIATPTDSSTDSTLLNVALELGLQVMRMTLSTLNWRRREMVRWLVTCATEVGVRALVSILQSWYTLFTPTEATSIVAATAVSHTTILRLSLDYPQREELASCARTLALQCAMKDPQSCALSALTLCEKDHIAFEAAYQIAIDAAAGGMTHSQLFTIARYMELRGYPLRAFKLASLAMSHLNLAYNQDTHPAINDVLWACALSHSLGKNELAALIPLVVKSVHCATVLSDILRRCTVTAPGLAGIPGRRSSGKLMSTDKAPLRQLLDATINAYINTTHSRLTHISPRHYGEFIEFLSKARETFLLPQDGHLQFAQFIDNLKQIYKGKKKLMLLVRERFG

SEQ ID NO: 102261 - protein, 1215 aa, Homo sapiens
  Payload ID: 20382
  Gene Name: zinc finger, SWIM-type containing 6
  Uniprot ID: Q9HCJ5
  ENSP ID: ENSP00000252744
MAERGQQPPPAKRLCCRPGGGGGGGGSSGGGGGAGGGYSSACRPGPRAGGAAAAAACGGGAALGLLPPGKTQSPESLLDIAARRVAEKWPFQRVEERFERIPEPVQRRIVYWSFPRSEREICMYSSFNTGGGAAGGPGDDSGGGGGAGGGGGGGSSSSPAATSAAATSAAAAAAAAAAAAAAAAGAGAPSVGAAGAADGGDETRLPFRRGIALLESGCVDNVLQVGFHLSGTVTEPAIQSEPETVCNVAISFDRCKITSVTCSCGNKDIFYCAHVVALSLYRIRKPDQVKLHLPISETLFQMNRDQLQKFVQYLITVHHTEVLPTAQKLADEILSQNSEINQVHGAPDPTAGASIDDENCWHLDEEQVQEQVKLFLSQGGYHGSGKQLNLLFAKVREMLKMRDSNGARMLTLITEQFMADPRLSLWRQQGTAMTDKYRQLWDELGALWMCIVLNPHCKLEQKASWLKQLKKWNSVDVCPWEDGNHGSELPNLTNALPQGANANQDSSNRPHRTVFTRAIEACDLHWQDSHLQHIISSDLYTNYCYHDDTENSLFDSRGWPLWHEHVPTACARVDALRSHGYPREALRLAIAIVNTLRRQQQKQLEMFRTQKKELPHKNITSITNLEGWVGHPLDPVGTLFSSLMEACRIDDENLSGFSDFTENMGQCKSLEYQHLPAHKFLEEGESYLTLAVEVALIGLGQQRIMPDGLYTQEKVCRNEEQLISKLQEIELDDTLVKIFRKQAVFLLEAGPYSGLGEIIHRESVPMHTFAKYLFTSLLPHDAELAYKIALRAMRLLVLESTAPSGDLTRPHHIASVVPNRYPRWFTLSHIESQQCELASTMLTAAKGDVRRLETVLESIQKNIHSSSHIFKLAQDAFKIATLMDSLPDITLLKVSLELGLQVMRMTLSTLNWRRREMVRWLVTCATEVGVYALDSIMQTWFTLFTPTEATSIVATTVMSNSTIVRLHLDCHQQEKLASSARTLALQCAMKDPQNCALSALTLCEKDHIAFETAYQIVLDAATTGMSYTQLFTIARYMEHRGYPMRAYKLATLAMTHLNLSYNQDTHPAINDVLWACALSHSLGKNELAAIIPLVVKSVKCATVLSDILRRCTLTTPGMVGLHGRRNSGKLMSLDKAPLRQLLDATIGAYINTTHSRLTHISPRHYSEFIEFLSKARETFLMAHDGHIQFTQFIDNLKQIYKGKKKLMMLVRERFG

SEQ ID NO: 102262 - protein, 140 aa, Homo sapiens
  Payload ID: 20383
  Gene Name: zinc finger, SWIM-type containing 7
  Uniprot ID: Q19AV6
  ENSP ID: ENSP00000382218
MAVVLPAVVEELLSEMAAAVQESARIPDEYLLSLKFLFGSSATQALDLVDRQSITLISSPSGRRVYQVLGSSSKTYTCLASCHYCSCPAFAFSVLRKSDSILCKHLLAVYLSQVMRTCQQLSVSDKQLTDILLMEKKQEA

SEQ ID NO: 102263 - protein, 140 aa, Homo sapiens; identical to SEQ ID NO: 102262
  Payload ID: 20383
  Gene Name: zinc finger, SWIM-type containing 7
  Uniprot ID: Q19AV6
  ENSP ID: ENSP00000419138

SEQ ID NO: 102264 - protein, 30 aa, Homo sapiens
  Payload ID: 20383
  Gene Name: zinc finger, SWIM-type containing 7
  ENSP ID: ENSP00000462208
VVLPAVVEELLSEMAAAVQESARSTGPRSS

SEQ ID NO: 102265 - protein, 32 aa, Homo sapiens
  Payload ID: 20383
  Gene Name: zinc finger, SWIM-type containing 7
  ENSP ID: ENSP00000462590
MAVVLPAVVEELLSEMAAAVQESARSTGPRSS

SEQ ID NO: 102266 - protein, 31 aa, Homo sapiens
  Payload ID: 20383
  Gene Name: zinc finger, SWIM-type containing 7
  ENSP ID: ENSP00000462598
MAVVLPAVVEELLSEMAAAVQESARSTGPSS

SEQ ID NO: 102267 - protein, 31 aa, Homo sapiens; identical to SEQ ID NO: 102266
  Payload ID: 20383
  Gene Name: zinc finger, SWIM-type containing 7
  ENSP ID: ENSP00000463327

SEQ ID NO: 102268 - protein, 78 aa, Homo sapiens
  Payload ID: 20383
  Gene Name: zinc finger, SWIM-type containing 7
  ENSP ID: ENSP00000463444
MAVVLPAVVEELLSEMAAAVQESARSTGPRLKFLFGSSATQALDLVDRQSITLISSPSGRRVYQRQGLTMLPRLVSNS

SEQ ID NO: 102269 - protein, 26 aa, Homo sapiens
  Payload ID: 20383
  Gene Name: zinc finger, SWIM-type containing 7
  ENSP ID: ENSP00000463592
MAVVLPAVVEELLSEMAAAVQESARS

SEQ ID NO: 102270 - protein, 31 aa, Homo sapiens; identical to SEQ ID NO: 102266
  Payload ID: 20383
  Gene Name: zinc finger, SWIM-type containing 7
  ENSP ID: ENSP00000464227

SEQ ID NO: 102271 - protein, 66 aa, Homo sapiens
  Payload ID: 20383
  Gene Name: zinc finger, SWIM-type containing 7
  ENSP ID: ENSP00000464371
MAAAVQESARIPDEYLLSLKFLFGSSATQALDLVDRQSITLISSPSGRRVYQRQGLTMLPRLVSNS

SEQ ID NO: 102272 - protein, 32 aa, Homo sapiens; identical to SEQ ID NO: 102265
  Payload ID: 20383
  Gene Name: zinc finger, SWIM-type containing 7
  ENSP ID: ENSP00000464463

SEQ ID NO: 102273 - protein, 31 aa, Homo sapiens; identical to SEQ ID NO: 102266
  Payload ID: 20383
  Gene Name: zinc finger, SWIM-type containing 7
  ENSP ID: ENSP00000464500

SEQ ID NO: 102274 - protein, 31 aa, Homo sapiens; identical to SEQ ID NO: 102266
  Payload ID: 20383
  Gene Name: zinc finger, SWIM-type containing 7
  ENSP ID: ENSP00000464605

SEQ ID NO: 102275 - protein, 1842 aa, Homo sapiens
  Payload ID: 20384
  Gene Name: zinc finger, SWIM-type containing 8
  Uniprot ID: A7E2V4
  ENSP ID: ENSP00000381693
MELMFAEWEDGERFSFEDSDRFEEDSLCSFISEAESLCQNWRGWRKQSAGPNSPTGGGGGGGSGGTRMRDGLVIPLVELSAKQVAFHIPFEVVEKVYPPVPEQLQLRIAFWSFPENEEDIRLYSCLANGSADEFQRGDQLFRMRAVKDPLQIGFHLSATVVPPQMVPPKGAYNVAVMFDRCRVTSCSCTCGAGAKWCTHVVALCLFRIHNASAVCLRAPVSESLSRLQRDQLQKFAQYLISELPQQILPTAQRLLDELLSSQSTAINTVCGAPDPTAGPSASDQSTWYLDESTLTDNIKKTLHKFCGPSPVVFSDVNSMYLSSTEPPAAAEWACLLRPLRGREPEGVWNLLSIVREMFKRRDSNAAPLLEILTDQCLTYEQITGWWYSVRTSASHSSASGHTGRSNGQSEVAAHACASMCDEMVTLWRLAVLDPALSPQRRRELCTQLRQWQLKVIENVKRGQHKKTLERLFPGFRPAVEACYFNWEEAYPLPGVTYSGTDRKLALCWARALPSRPGASRSGGLEESRDRPRPLPTEPAVRPKEPGTKRKGLGEGVPSSQRGPRRLSAEGGDKALHKMGPGGGKAKALGGAGSGSKGSAGGGSKRRLSSEDSSLEPDLAEMSLDDSSLALGAEASTFGGFPESPPPCPLHGGSRGPSTFLPEPPDTYEEDGGVYFSEGPEPPTASVGPPGLLPGDVCTQDDLPSTDESGNGLPKTKEAAPAVGEEDDDYQAYYLNAQDGAGGEEEKAEGGAGEEHDLFAGLKPLEQESRMEVLFACAEALHAHGYSSEASRLTVELAQDLLANPPDLKVEPPPAKGKKNKVSTSRQTWVATNTLSKAAFLLTVLSERPEHHNLAFRVGMFALELQRPPASTKALEVKLAYQESEVAALLKKIPLGPSEMSTMRCRAEELREGTLCDYRPVLPLMLASFIFDVLCAPVVSPTGSRPPSRNWNSETPGDEELGFEAAVAALGMKTTVSEAEHPLLCEGTRREKGDLALALMITYKDDQAKLKKILDKLLDRESQTHKPQTLSSFYSSSRPTTASQRSPSKHGGPSAPGALQPLTSGSAGPAQPGSVAGAGPGPTEGFTEKNVPESSPHSPCEGLPSEAALTPRPEGKVPSRLALGSRGGYNGRGWGSPGRPKKKHTGMASIDSSAPETTSDSSPTLSRRPLRGGWAPTSWGRGQDSDSISSSSSDSLGSSSSSGSRRASASGGARAKTVEVGRYKGRRPESHAPHVPNQPSEAAAHFYFELAKTVLIKAGGNSSTSIFTHPSSSGGHQGPHRNLHLCAFEIGLYALGLHNFVSPNWLSRTYSSHVSWITGQAMEIGSAALTILVECWDGHLTPPEVASLADRASRARDSNMVRAAAELALSCLPHAHALNPNEIQRALVQCKEQDNLMLEKACMAVEEAAKGGGVYPEVLFEVAHQWFWLYEQTAGGSSTAREGATSCSASGIRAGGEAGRGMPEGRGGPGTEPVTVAAAAVTAAATVVPVISVGSSLYPGPGLGHGHSPGLHPYTALQPHLPCSPQYLTHPAHPAHPMPHMPRPAVFPVPSSAYPQGVHPAFLGAQYPYSVTPPSLAATAVSFPVPSMAPITVHPYHTEPGLPLPTSVACELWGQGTVSSVHPASTFPAIQGASLPALTTQPSPLVSGGFPPPEEETHSQPVNPHSLHHLHAAYRVGMLALEMLGRRAHNDHPNNFSRSPPYTDDVKWLLGLAAKLGVNYVHQFCVGAAKGVLSPFVLQEIVMETLQRLSPAHAHNHLRAPAFHQLVQRCQQAYMQYIHHRLIHLTPADYDDFVNAIRSARSAFCLTPMGMMQFNDILQNLKRSKQTKELWQRVSLEMATFSP

SEQ ID NO: 102276 - protein, 1336 aa, Homo sapiens
  Payload ID: 20384
  Gene Name: zinc finger, SWIM-type containing 8
  ENSP ID: ENSP00000387828
MELMFAEWEDGERFSFEDSDRFEEDSLCSFISEAESLCQNWRGWRKQSAGPNSPTGGGGGGGSGGTRMRDGLVIPLVELSAKQVAFHIPFEVVEKVYPPVPEQLQLRIAFWSFPENEEDIRLYSCLANGSADEFQRGDQLFRMRAVKDPLQIGFHLSATVVPPQMVPPKGAYNVAVMFDRCRVTSCSCTCGAGAKWCTHVVALCLFRIHNASAVCLRAPVSESLSRLQRDQLQKFAQYLISELPQQILPTAQRLLDELLSSQSTAINTVCGAPDPTAGPSASDQSTWYLDESTLTDNIKKTLHKFCGPSPVVFSDVNSMYLSSTEPPAAAEWACLLRPLRGREPEGVWNLLSIVREMFKRRDSNAAPLLEILTDQCLTYEQITGWWYSVRTSASHSSASGHTGRSNGQSEVAAHACASMCDEMVTLWRLAVLDPALSPQRRRELCTQLRQWQLKVIENVKRGQHKKTLERLFPGFRPAVEACYFNWEEAYPLPGVTYSGTDRKLALCWARALPSRPGASRSGGLEESRDRPRPLPTEPAVRPKEPGTKRKGLGEGVPSSQRGPRRLSAEGGDKALHKMGPGGGKAKALGGAGSGSKGSAGGGSKRRLSSEDSSLEPDLAEMSLDDSSLALGAEASTFGGFPESPPPCPLHGGSRGPSTFLPEPPDTYEEDGGVYFSEGPEPPTASVGPPGLLPGDVCTQDDLPSTDESGNGLPKTKEAAPAVGEEDDDYQAYYLNAQDGAGGEEEKAEGGAGEEHDLFAGLKPLEQESRMEVLFACAEALHAHGYSSEASRLTVELAQDLLANPPDLKGKKNKVSTSRQTWVATNTLSKAAFLLTVLSERPEHHNLAFRVGMFALELQRPPASTKALEVKLAYQESEVAALLKKIPLGPSEMSTMRCRAEELREGTLCDYRPVLPLMLASFIFDVLCAPVVSPTGSRPPSRNWNSETPGDEELGFEAAVAALGMKTTVSEAEHPLLCEGTRREKGDLALALMITYKDDQAKLKKILDKLLDRESQTHKPQTLSSFYSSSRPTTASQRSPSKHGGPSAPGALQPLTSGSAGPAQPGSVAGAGPGPTEGFTEKNVPESSPHSPCEGLPSEAALTPRPEGKVPSRLALGSRGGYNGRGWGSPGRPKKKHTGMASIDSSAPETTSDSSPTLSRRPLRGGWAPTSWGRGQDSDSISSSSSDSLGSSSSSGSRRASASGGARAKTVEVGRSVQGPPPRESCPSCTQSAIRGSCTLLLRAGEDSADQGRGQQQHFHFHTSIFLRGPPGSSPQPAPLRLRDWALCPWPAQLCFSQLALTYLFFPRFLDYRPGHGDRQRSPDYTGRMLGWAPDTP

SEQ ID NO: 102277 - protein, 1112 aa, Homo sapiens
  Payload ID: 20384
  Gene Name: zinc finger, SWIM-type containing 8
  ENSP ID: ENSP00000415612
  MOD_RES (1)..(1): Any amino acid
XYYLNAQDGAGGEEEKAEGGAGEEHDLFAGLKPLEQESRMEVLFACAEALHAHGYSSEASRLTVELAQDLLANPPDLKVEPPPAKGKKNKVSTSRQTWVATNTLSKAAFLLTVLSERPEHHNLAFRVGMFALELQRPPASTKALEVKLAYQESEVAALLKKIPLGPSEMSTMRCRAEELREGTLCDYRPVLPLMLASFIFDVLCAPVVSPTGSRPPSRNWNSETPGDEELGFEAAVAALGMKTTVSEAEHPLLCEGTRREKGDLALALMITYKDDQAKLKKILDKLLDRESQTHKPQTLSSFYSSSRPTTASQRSPSKHGGPSAPGALQPLTSGSAGPAQPGSVAGAGPGPTEGFTEKNVPESSPHSPCEGLPSEAALTPRPEGKVPSRLALGSRGGYNGRGWGSPGRPKKKHTGMASIDSSAPETTSDSSPTLSRRPLRGGWAPTSWGRGQDSDSISSSSSDSLGSSSSSGSRRASASGGARAKTVEVGRYKGRRPESHAPHVPNQPSEAAAHFYFELAKTVLIKAGGNSSTSIFTHPSSSGGHQGPHRNLHLCAFEIGLYALGLHNFVSPNWLSRTYSSHVSWITGQAMEIGSAALTILVECWDGHLTPPEVASLADRASRARDSNMVRAAAELALSCLPHAHALNPNEIQRALVQCKEQDNLMLEKACMAVEEAAKGGGVYPEVLFEVAHQWFWLYEQTAGGSSTAREGATSCSASGIRAGGEAGRGMPEGRGGPGTEPVTVAAAAVTAAATVVPVISVGSSLYPGPGLGHGHSPGLHPYTALQPHLPCSPQYLTHPAHPAHPMPHMPRPAVFPVPSSAYPQGVHPAFLGAQYPYSVTPPSLAATAVSFPVPSMAPITVHPYHTEPGLPLPTSVACELWGQGTVSSVHPASTFPAIQGASLPALTTQPSPLVSGGFPPPEEETHSQPVNPHSLHHLHAAYRVGMLALEMLGRRAHNDHPNNFSRSPPYTDDVKWLLGLAAKLGVNYVHQFCVGAAKGVLSPFVLQEIVMETLQRLSPAHAHNHLRAPAFHQLVQRCQQAYMQYIHHRLIHLTPADYDDFVNAIRSARSAFCLTPMGMMQFNDILQNLKRSKQTKELWQRVSLEMATFSP

SEQ ID NO: 102278 - protein, 904 aa, Homo sapiens
  Payload ID: 20384
  Gene Name: zinc finger, SWIM-type containing 8
  ENSP ID: ENSP00000432423
ITGWWYSVRTSASHSSASGHTGRSNGQSEVAAHACASMCDEMVTLWRLAVLDPALSPQRRRELCTQLRQWQLKVIENVKRGQHKKTLERLFPGFRPAVEACYFNWEEAYPLPGVTYSGTDRKLALCWARALPSRPGASRSGGLEESRDRPRPLPTEPAVRPKEPGTKRKGLGEGVPSSQRGPRRLSAEGGDKALHKMGPGGGKAKALGGAGSGSKGSAGGGSKRRLSSEDSSLEPDLAEMSLDDSSLALGAEASTFGGFPESPPPCPLHGGSRGPSTFLPEPPDTYEEDGGVYFSEGPEPPTASVGPPGLLPGDVCTQDDLPSTDESGNGLPKTKEAAPAVGEEDDDYQAYYLNAQDGAGGEEEKAEGGAGEEHDLFAGLKPLEQESRMEVLFACAEALHAHGYSSEASRLTVELAQDLLANPPDLKVEPPPAKGKKNKVSTSRQTWVATNTLSKAAFLLTVLSERPEHHNLAFRVGMFALELQRPPASTKALEVKLAYQESEVAALLKKIPLGPSEMSTMRCRAEELREGTLCDYRPVLPLMLASFIFDVLCAPGSRPPSRNWNSETPGDEELGFEAAVAALGMKTTVSEAEHPLLCEGTRREKGDLALALMITYKDDQAKLKKILDKLLDRESQTHKPQTLSSFYSSSRPTTASQRSPSKHGGPSAPGALQPLTSGSAGPAQPGSVAGAGPGPTEGFTEKNVPESSPHSPCEGLPSEAALTPRPEGKVPSRLALGSRGGYNGRGWGSPGRPKKKHTGMASIDSSAPETTSDSSPTLSRRPLRGGWAPTSWGRGQDSDSISSSSSDSLGSSSSSGSRRASASGGARAKTVEVGRGPPGSSPQPAPLRLRDWALCPWPAQLCFSQLALTYLFFPRFLDYRPGHGDRQRSPDYTGRMLGWAPDTP

SEQ ID NO: 102279 - protein, 1796 aa, Homo sapiens
  Payload ID: 20384
  Gene Name: zinc finger, SWIM-type containing 8
  ENSP ID: ENSP00000474043
MELMFAEWEDGERFSFEDSDRFEEDSLCSFISEAESLCQNWRGWRKQSAGPNSPTGGGGGGGSGGTRMRDGLVIPLVELSAKQVAFHIPFEVVEKVYPPVPEQLQLRIAFWSFPENEEDIRLYSCLANGSADEFQRGDQLFRMRAVKDPLQIGFHLSATVVPPQMVPPKGAYNVAVMFDRCRVTSCSCTCGAGAKWCTHVVALCLFRIHNASAVCLRAPVSESLSRLQRDQLQKFAQYLISELPQQILPTAQRLLDELLSSQSTAINTVCGAPDPTAGPSASDQSTWYLDESTLTDNIKKTLHKFCGPSPVVFSDVNSMYLSSTEPPAAAEWACLLRPLRGREPEGVWNLLSIVREMFKRRDSNAAPLLEILTDQCLTYEQITGWWYSVRTSASHSSASGHTGRSNGQSEVAAHACASMCDEMVTLWRLAVLDPALSPQRRRELCTQLRQWQLKVIENVKRGQHKKTLERLFPGFRPAVEACYFNWEEAYPLPGVTYSGTDRKLALCWARALPSRPGASRSGGLEESRDRPRPLPTEPAVRPKEPGTKRKGLGEGVPSSQRGPRRLSAEGGDKALHKMGPGGGKAKALGGAGSGSKGSAGGGSKRRLSSEDSSLEPDLAEMSLDDSSLALGAEASTFGGFPESPPPCPLHASVGPPGLLPGDVCTQDDLPSTDESGNGLPKTKEAAPAVGEEDDDYQAYYLNAQDGAGGEEEKAEGGAGEEHDLFAGLKPLEQESRMEVLFACAEALHAHGYSSEASRLTVELAQDLLANPPDLKVEPPPAKGKKNKVSTSRQTWVATNTLSKAAFLLTVLSERPEHHNLAFRVGMFALELQRPPASTKALEVKLAYQESEVAALLKKIPLGPSEMSTMRCRAEELREGTLCDYRPVLPLMLASFIFDVLCAPGSRPPSRNWNSETPGDEELGFEAAVAALGMKTTVSEAEHPLLCEGTRREKGDLALALMITYKDDQAKLKKILDKLLDRESQTHKPQTLSSFYSSSRPTTASQRSPSKHGGPSAPGALQPLTSGSAGPAQPGSVAGAGPGPTEGFTEKNVPESSPHSPCEGLPSEAALTPRPEGKVPSRLALGSRGGYNGRGWGSPGRPKKKHTGMASIDSSAPETTSDSSPTLSRRPLRGGWAPTSWGRGQDSDSISSSSSDSLGSSSSSGSRRASASGGARAKTVEVGRYKGRRPESHAPHVPNQPSEAAAHFYFELAKTVLIKAGGNSSTSIFTHPSSSGGHQGPHRNLHLCAFEIGLYALGLHNFVSPNWLSRTYSSHVSWITGQAMEIGSAALTILVECWDGHLTPPEVASLADRASRARDSNMVRAAAELALSCLPHAHALNPNEIQRALVQCKEQDNLMLEKACMAVEEAAKGGGVYPEVLFEVAHQWFWLYEQTAGGSSTAREGATSCSASGIRAGGEAGRGMPEGRGGPGTEPVTVAAAAVTAAATVVPVISVGSSLYPGPGLGHGHSPGLHPYTALQPHLPCSPQYLTHPAHPAHPMPHMPRPAVFPVPSSAYPQGVHPAFLGAQYPYSVTPPSLAATAVSFPVPSMAPITVHPYHTEPGLPLPTSVALSSVHPASTFPAIQGASLPALTTQPSPLVSGGFPPPEEETHSQPVNPHSLHHLHAAYRVGMLALEMLGRRAHNDHPNNFSRSPPYTDDVKWLLGLAAKLGVNYVHQFCVGAAKGVLSPFVLQEIVMETLQRLSPAHAHNHLRAPAFHQLVQRCQQAYMQYIHHRLIHLTPADYDDFVNAIRSARSAFCLTPMGMMQFNDILQNLKRSKQTKELWQRVSLEMATFSP

SEQ ID NO: 102280 - protein, 1102 aa, Homo sapiens
  Payload ID: 20384
  Gene Name: zinc finger, SWIM-type containing 8
  ENSP ID: ENSP00000474118
  MOD_RES (1)..(1): Any amino acid
XGGEEEKAEGGAGEEHDLFAGLKPLEQESRMEVLFACAEALHAHGYSSEASRLTVELAQDLLANPPDLKVEPPPAKGKKNKVSTSRQTWVATNTLSKAAFLLTVLSERPEHHNLAFRVGMFALELQRPPASTKALEVKLAYQESEVAALLKKIPLGPSEMSTMRCRAEELREGTLCDYRPVLPLMLASFIFDVLCAPVVSPTGSRPPSRNWNSETPGDEELGFEAAVAALGMKTTVSEAEHPLLCEGTRREKGDLALALMITYKDDQAKLKKVTASVFQILDKLLDRESQTHKPQTLSSFYSSSRPTTASQRSPSKHGGPSAPGALQPLTSGSAGPAQPGSVAGAGPGPTEGFTEKNVPESSPHSPCEGLPSEAALTPRPEGKVPSRLALGSRGGYNGRGWGSPGRPKKKHTGMASIDSSAPETTSDSSPTLSRRPLRGGWAPTSWGRGQDSDSISSSSSDSLGSSSSSGSRRASASGGARAKTVEVGRYKGRRPESHAPHVPNQPSEAAAHFYFELAKTVLIKAGGNSSTSIFTHPSSSGGHQGPHRNLHLCAFEIGLYALGLHNFVSPNWLSRTYSSHVSWITGQAMEIGSAALTILVECWDGHLTPPEVASLADRASRARDSNMVRAAAELALSCLPHAHALNPNEIQRALVQCKEQDNLMLEKACMAVEEAAKGGGVYPEVLFEVAHQWFWLYEQTAGGSSTAREGATSCSASGIRAGGEAGRGMPEGRGGPGTEPVTVAAAAVTAAATVVPVISVGSSLYPGPGLGHGHSPGLHPYTALQPHLPCSPQYLTHPAHPAHPMPHMPRPAVFPVPSSAYPQGVHPAFLGAQYPYSVTPPSLAATAVSFPVPSMAPITVHPYHTEPGLPLPTSVALSSVHPASTFPAIQGASLPALTTQPSPLVSGGFPPPEEETHSQPVNPHSLHHLHAAYRVGMLALEMLGRRAHNDHPNNFSRSPPYTDDVKWLLGLAAKLGVNYVHQFCVGAAKGVLSPFVLQEIVMETLQRLSPAHAHNHLRAPAFHQLVQRCQQAYMQYIHHRLIHLTPADYDDFVNAIRSARSAFCLTPMGMMQFNDILQNLKRSKQTKELWQRVSLEMATFSP

SEQ ID NO: 102281 - protein, 1655 aa, Homo sapiens
  Payload ID: 20384
  Gene Name: zinc finger, SWIM-type containing 8
  ENSP ID: ENSP00000474348
MELMFAEWEDGERFSFEDSDRFEEDSLCSFISEAESLCQNWRGWRKQSAGPNSPTGGGGGGGSGGTRMRDGLVIPLVELSAKQVAFHIPFEVVEKVYPPVPEQLQLRIAFWSFPENEEDIRLYSCLANGSADEFQRGDQLFRMRAVKDPLQIGFHLSATVVPPQMVPPKGAYNVAVMFDRCRVTSCSCTCGAGAKWCTHVVALCLFRIHNASAVCLRAPVSESLSRLQRDQLQKFAQYLISELPQQILPTAQRLLDELLSSQSTAINTVCGAPDPTAGPSASDQSTWYLDESTLTDNIKKTLHKFCGPSPVVFSDVNSMYLSSTEPPAAAEWACLLRPLRGREPEGVWNLLSIVREMFKRRDSNAAPLLEILTDQCLTYEQITGWWYSVRTSASHSSASGHTGRSNGQSEVAAHACASMCDEMVTLWRLAVLDPALSPQRRRELCTQLRQWQLKVIENVKRGQHKKTLERLFPGFRPAVEACYFNWEEAYPLPGVTYSGTDRKLALCWARALPSRPGASRSGGLEESRDRPRPLPTEPAVRPKEPGTKRKGLGEGVPSSQRGPRRLSAEGGDKALHKMGPGGGKAKALGGAGSGSKGSAGGGSKRRLSSEDSSLEPDLAEMSLDDSSLALGAEASTFGGFPESPPPCPLHGGSRGPSTFLPEPPDTYEEDGGVYFSEGPEPPTASVGPPGLLPGDVCTQDDLPSTDESGNGLPKTKEAAPAVGEEDDDYQAYYLNAQDGAGGEEEKAEGGAGEEHDLFAGLKPLEQESRMEVLFACAEALHAHGYSSEASRLTVELAQDLLANPPDLKVEPPPAKGKKNKVSTSRQTWVATNTLSKAAFLLTVLSERPEHHNLAFRVGMFALELQRPPASTKALEVKLAYQESEVAALLKKIPLGPSEMSTMRCRAEELREGTLCDYRPVLPLMLASFIFDVLCAPGSRPPSRNWNSETPGDEELGFEAAVAALGMKTTVSEAEHPLLCEGTRREKGDLALALMITYKDDQAKLKKILDKLLDRESQTHKPQTLSSFYSSSRPTTASQRSPSKHGGPSAPGALQPLTSGSAGPAQPGSVAGAGPGPTEGFTEKNVPESSPHSPCEGLPSEAALTPRPEGKVPSRLALGSRGGYNGRGWGSPGRPKKKHTGMASIDSSAPETTSDSSPTLSRRPLRGGWAPTSWGRGQDSDSISSSSSDSLGSSSSSGSRRASASGGARAKTVEVGRYKGRRPESHAPHVPNQPSEAAAHFYFELAKTVLIKAGGNSSTSIFTHPSSSGGHQGPHRNLHLCAFEIGLYALGLHNFVSPNWLSRTYSSHVSWITGQAMEIGSAALTILVECWDGHLTPPEVASLADRASRARDSNMVRAAAELALSCLPHAHALNPNEIQRALVQCKEQDNLMLEKACMAVEEAAKVHPYHTEPGLPLPTSVACELWGQGTVSSVHPASTFPAIQGASLPALTTQPSPLVSGGFPPPEEETHSQPVNPHSLHHLHAAYRVGMLALEMLGRRAHNDHPNNFSRSPPYTDDVKWLLGLAAKLGVNYVHQFCVGAAKGVLSPFVLQEIVMETLQRLSPAHAHNHLRAPAFHQLVQRCQQAYMQYIHHRLIHLTPADYDDFVNAIRSARSAFCLTPMGMMQFNDILQNLKRSKQTKELWQRVSLEMATFSP

SEQ ID NO: 102282 - protein, 204 aa, Homo sapiens
  Payload ID: 20384
  Gene Name: zinc finger, SWIM-type containing 8
  ENSP ID: ENSP00000474677
  MOD_RES (1)..(1): Any amino acid
XDDVKWLLGLAAKLGDRHGDAAAAESRSCPQPPACPGLPPTGAALPAGIHAVHPPPLDSPDSCGLRRLCECDPECPQRLLPDAHGHDAVQRHPTEPQAQQTDQGAVAAGLTRDGHLLPLSLSPLGSYTGTQACGYGGPSHRGSETWLDRSSSLSSLVAQTDSCSWAIAWGQDVSHPRSLGLGETALSGRGRWVASGIYLAFINI

SEQ ID NO: 102283 - protein, 1837 aa, Homo sapiens
  Payload ID: 20384
  Gene Name: zinc finger, SWIM-type containing 8
  Uniprot ID: A7E2V4
  ENSP ID: ENSP00000474748
MELMFAEWEDGERFSFEDSDRFEEDSLCSFISEAESLCQNWRGWRKQSAGPNSPTGGGGGGGSGGTRMRDGLVIPLVELSAKQVAFHIPFEVVEKVYPPVPEQLQLRIAFWSFPENEEDIRLYSCLANGSADEFQRGDQLFRMRAVKDPLQIGFHLSATVVPPQMVPPKGAYNVAVMFDRCRVTSCSCTCGAGAKWCTHVVALCLFRIHNASAVCLRAPVSESLSRLQRDQLQKFAQYLISELPQQILPTAQRLLDELLSSQSTAINTVCGAPDPTAGPSASDQSTWYLDESTLTDNIKKTLHKFCGPSPVVFSDVNSMYLSSTEPPAAAEWACLLRPLRGREPEGVWNLLSIVREMFKRRDSNAAPLLEILTDQCLTYEQITGWWYSVRTSASHSSASGHTGRSNGQSEVAAHACASMCDEMVTLWRLAVLDPALSPQRRRELCTQLRQWQLKVIENVKRGQHKKTLERLFPGFRPAVEACYFNWEEAYPLPGVTYSGTDRKLALCWARALPSRPGASRSGGLEESRDRPRPLPTEPAVRPKEPGTKRKGLGEGVPSSQRGPRRLSAEGGDKALHKMGPGGGKAKALGGAGSGSKGSAGGGSKRRLSSEDSSLEPDLAEMSLDDSSLALGAEASTFGGFPESPPPCPLHGGSRGPSTFLPEPPDTYEEDGGVYFSEGPEPPTASVGPPGLLPGDVCTQDDLPSTDESGNGLPKTKEAAPAVGEEDDDYQAYYLNAQDGAGGEEEKAEGGAGEEHDLFAGLKPLEQESRMEVLFACAEALHAHGYSSEASRLTVELAQDLLANPPDLKVEPPPAKGKKNKVSTSRQTWVATNTLSKAAFLLTVLSERPEHHNLAFRVGMFALELQRPPASTKALEVKLAYQESEVAALLKKIPLGPSEMSTMRCRAEELREGTLCDYRPVLPLMLASFIFDVLCAPGSRPPSRNWNSETPGDEELGFEAAVAALGMKTTVSEAEHPLLCEGTRREKGDLALALMITYKDDQAKLKKILDKLLDRESQTHKPQTLSSFYSSSRPTTASQRSPSKHGGPSAPGALQPLTSGSAGPAQPGSVAGAGPGPTEGFTEKNVPESSPHSPCEGLPSEAALTPRPEGKVPSRLALGSRGGYNGRGWGSPGRPKKKHTGMASIDSSAPETTSDSSPTLSRRPLRGGWAPTSWGRGQDSDSISSSSSDSLGSSSSSGSRRASASGGARAKTVEVGRYKGRRPESHAPHVPNQPSEAAAHFYFELAKTVLIKAGGNSSTSIFTHPSSSGGHQGPHRNLHLCAFEIGLYALGLHNFVSPNWLSRTYSSHVSWITGQAMEIGSAALTILVECWDGHLTPPEVASLADRASRARDSNMVRAAAELALSCLPHAHALNPNEIQRALVQCKEQDNLMLEKACMAVEEAAKGGGVYPEVLFEVAHQWFWLYEQTAGGSSTAREGATSCSASGIRAGGEAGRGMPEGRGGPGTEPVTVAAAAVTAAATVVPVISVGSSLYPGPGLGHGHSPGLHPYTALQPHLPCSPQYLTHPAHPAHPMPHMPRPAVFPVPSSAYPQGVHPAFLGAQYPYSVTPPSLAATAVSFPVPSMAPITVHPYHTEPGLPLPTSVACELWGQGTVSSVHPASTFPAIQGASLPALTTQPSPLVSGGFPPPEEETHSQPVNPHSLHHLHAAYRVGMLALEMLGRRAHNDHPNNFSRSPPYTDDVKWLLGLAAKLGVNYVHQFCVGAAKGVLSPFVLQEIVMETLQRLSPAHAHNHLRAPAFHQLVQRCQQAYMQYIHHRLIHLTPADYDDFVNAIRSARSAFCLTPMGMMQFNDILQNLKRSKQTKELWQRVSLEMATFSP

SEQ ID NO: 102284 - protein, 1232 aa, Homo sapiens
  Payload ID: 20384
  Gene Name: zinc finger, SWIM-type containing 8
  ENSP ID: ENSP00000474766
  MOD_RES (1)..(1): Any amino acid
XEPPDTYEEDGGVYFSEGPEPPTASVGPPGLLPGDVCTQDDLPSTDESGNGLPKTKEAAPAVGEEDDDYQAYYLNAQDGAGGEEEKAEGGAGEEHDLFAGLKPLEQESRMEVLFACAEALHAHGYSSEASRLTVELAQDLLANPPDLKVEPPPAKGKKNKVSTSRQTWVATNTLSKAAFLLTVLSERPEHHNLAFRVGMFALELQRPPASTKALEVKLAYQESEVAALLKKIPLGPSEMSTMRCRAEELREGTLCDYRPVLPLMLASFIFDVLCAPGSRPPSRNWNSETPGDEELGFEAAVAALGMKTTVSEAEHPLLCEGTRREKGDLALALMITYKDDQAKLKKILDKLLDRESQTHKPQTLSSFYSSSRPTTASQRSPSKHGGPSAPGALQPLTSGSAGPAQPGSVAGAGPGPTEGFTEKNVPESSPHSPCEGLPSEAALTPRPEGKVPSRLALGSRGGYNGRGWGSPGRPKKKHTGMASIDSSAPETTSDSSPTLSRRPLRGGWAPTSWGRGQDSDSISSSSSDSLGSSSSSGSRRASASGGARAKTVEVGRYKGRRPESHAPHVPNQPSEAAAHFYFELAKTVLIKAGGNSSTSIFTHPSSSGGHQGPHRNLHLCAFEIGLYALGLHNFVSPNWLSRTYSSHVSWITGQAMEIGSAALTILVECWDGHLTPPEVASLADRASRARDSNMVRAAAELALSCLPHAHALNPNEIQRALVQCKEQDNLMLEKACMAVEEAAKGGGVYPEVLFEVAHQWFWLYEQTAGGSSTAREGATSCSASGIRAGGEAGRGMPEGRGGPGTEPVTVAAAAVTAAATVVPVISVGSSLYPGPGLGHGHSPGLHPYTALQPHLPCSPQYLTHPAHPAHPMPHMPRPAVFPVPSSAYPQGVHPAFLGAQYPYSVTPPSLAATAVSFPVPSMAPITVHPYHTEPGLPLPTSVALSSVHPASTFPAIQGASLPALTTQPSPLVSGGFPPPEEETHSQPVNPHSLHHLHAAYRVGMLALEMLGRRAHNDHPNNFSRSPPYTDDVKWLLGLAAKLGDRHGDAAAAESRSCPQPPACPGLPPTGAALPAGIHAVHPPPLDSPDSCGLRRLCECDPECPQRLLPDAHGHDAVQRHPTEPQAQQTDQGAVAAGLTRDGHLLPLSLSPLGSYTGTQACGYGGPSHRGSETWLDRSSSLSSLVAQTDSCSWAIAWGQDVSHPRSLGLGETALSGRGRWVASGIYLAFINI

SEQ ID NO: 102285 - protein, 1834 aa, Homo sapiens
  Payload ID: 20384
  Gene Name: zinc finger, SWIM-type containing 8
  ENSP ID: ENSP00000474944
MELMFAEWEDGERFSFEDSDRFEEDSLCSFISEAESLCQNWRGWRKQSAGPNSPTGGGGGGGSGGTRMRDGLVIPLVELSAKQVAFHIPFEVVEKVYPPVPEQLQLRIAFWSFPENEEDIRLYSCLANGSADEFQRGDQLFRMRAVKDPLQIGFHLSATVVPPQMVPPKGAYNVAVMFDRCRVTSCSCTCGAGAKWCTHVVALCLFRIHNASAVCLRAPVSESLSRLQRDQLQKFAQYLISELPQQILPTAQRLLDELLSSQSTAINTVCGAPDPTAGPSASDQSTWYLDESTLTDNIKKTLHKFCGPSPVVFSDVNSMYLSSTEPPAAAEWACLLRPLRGREPEGVWNLLSIVREMFKRRDSNAAPLLEILTDQCLTYEQITGWWYSVRTSASHSSASGHTGRSNGQSEVAAHACASMCDEMVTLWRLAVLDPALSPQRRRELCTQLRQWQLKVIENVKRGQHKKTLERLFPGFRPAVEACYFNWEEAYPLPGVTYSGTDRKLALCWARALPSRPGASRSGGLEESRDRPRPLPTEPAVRPKEPGTKRKGLGEGVPSSQRGPRRLSAEGGDKALHKMGPGGGKAKALGGAGSGSKGSAGGGSKRRLSSEDSSLEPDLAEMSLDDSSLALGAEASTFGGFPESPPPCPLHGGSRGPSTFLPEPPDTYEEDGGVYFSEGPEPPTASVGPPGLLPGDVCTQDDLPSTDESGNGLPKTKEAAPAVGEEDDDYQAYYLNAQDGAGGEEEKAEGGAGEEHDLFAGLKPLEQESRMEVLFACAEALHAHGYSSEASRLTVELAQDLLANPPDLKVEPPPAKGKKNKVSTSRQTWVATNTLSKAAFLLTVLSERPEHHNLAFRVGMFALELQRPPASTKALEVKLAYQESEVAALLKKIPLGPSEMSTMRCRAEELREGTLCDYRPVLPLMLASFIFDVLCAPVVSPTGSRPPSRNWNSETPGDEELGFEAAVAALGMKTTVSEAEHPLLCEGTRREKGDLALALMITYKDDQAKLKKILDKLLDRESQTHKPQTLSSFYSSSRPTTASQRSPSKHGGPSAPGALQPLTSGSAGPAQPGSVAGAGPGPTEGFTEKNVPESSPHSPCEGLPSEAALTPRPEGKVPSRLALGSRGGYNGRGWGSPGRPKKKHTGMASIDSSAPETTSDSSPTLSRRPLRGGWAPTSWGRGQDSDSISSSSSDSLGSSSSSGSRRASASGGARAKTVEVGRYKGRRPESHAPHVPNQPSEAAAHFYFELAKTVLIKAGGNSSTSIFTHPSSSGGHQGPHRNLHLCAFEIGLYALGLHNFVSPNWLSRTYSSHVSWITGQAMEIGSAALTILVECWDGHLTPPEVASLADRASRARDSNMVRAAAELALSCLPHAHALNPNEIQRALVQCKEQDNLMLEKACMAVEEAAKGGGVYPEVLFEVAHQWFWLYEQTAGGSSTAREGATSCSASGIRAGGEAGRGMPEGRGGPGTEPVTVAAAAVTAAATVVPVISVGSSLYPGPGLGHGHSPGLHPYTALQPHLPCSPQYLTHPAHPAHPMPHMPRPAVFPVPSSAYPQGVHPAFLGAQYPYSVTPPSLAATAVSFPVPSMAPITVHPYHTEPGLPLPTSVALSSVHPASTFPAIQGASLPALTTQPSPLVSGGFPPPEEETHSQPVNPHSLHHLHAAYRVGMLALEMLGRRAHNDHPNNFSRSPPYTDDVKWLLGLAAKLGVNYVHQFCVGAAKGVLSPFVLQEIVMETLQRLSPAHAHNHLRAPAFHQLVQRCQQAYMQYIHHRLIHLTPADYDDFVNAIRSARSAFCLTPMGMMQFNDILQNLKRSKQTKELWQRVSLEMATFSP

SEQ ID NO: 102286 - protein, 799 aa, Homo sapiens
  Payload ID: 20385
  Gene Name: zinc finger, X-linked, duplicated A
  Uniprot ID: P98168
  ENSP ID: ENSP00000351530
MEIPKLLPARGTLQGGGGGGIPAGGGRVHRGPDSPAGQVPTRRLLLPRGPQDGGPGRRREEASTASRGPGPSLFAPRPHQPSGGGDDFFLVLLDPVGGDVETAGSGQAAGPVLREEAKAGPGLQGDESGANPAGCSAQGPHCLSAVPTPAPISAPGPAAAFAGTVTIHNQDLLLRFENGVLTLATPPPHAWEPGAAPAQQPRCLIAPQAGFPQAAHPGDCPELRSDLLLAEPAEPAPAPAPQEEAEGLAAALGPRGLLGSGPGVVLYLCPEALCGQTFAKKHQLKMHLLTHSSSQGQRPFKCPLGGCGWTFTTSYKLKRHLQSHDKLRPFGCPAEGCGKSFTTVYNLKAHMKGHEQENSFKCEVCEESFPTQAKLGAHQRSHFEPERPYQCAFSGCKKTFITVSALFSHNRAHFREQELFSCSFPGCSKQYDKACRLKIHLRSHTGERPFLCDFDGCGWNFTSMSKLLRHKRKHDDDRRFMCPVEGCGKSFTRAEHLKGHSITHLGTKPFVCPVAGCCARFSARSSLYIHSKKHLQDVDTWKSRCPISSCNKLFTSKHSMKTHMVKRHKVGQDLLAQLEAANSLTPSSELTSQRQNDLSDAEIVSLFSDVPDSTSAALLDTALVNSGILTIDVASVSSTLAGHLPANNNNSVGQAVDPPSLMATSDPPQSLDTSLFFGTAATGFQQSSLNMDEVSSVSVGPLGSLDSLAMKNSSPEPQALTPSSKLTVDTDTLTPSSTLCENSVSELLTPAKAEWSVHPNSDFFGQEGETQFGFPNAAGNHGSQKERNLITVTGSSFLV

SEQ ID NO: 102287 - protein, 803 aa, Homo sapiens
  Payload ID: 20386
  Gene Name: zinc finger, X-linked, duplicated B
  Uniprot ID: P98169
  ENSP ID: ENSP00000364023
MEIPKLLPARGTLQGGGGGGIPAGGGRVHRGPDSPAGQVPTRRLLLLRGPQDGGPGRRREEASTASRGPGPSLLAPRTDQPSGGGGGGGDDFFLVLLDPVGGDVETAGSGQAAGPVLREEAEEGPGLQGGESGANPAGPTALGPRCLSAVPTPAPISAPGPAAAFAGTVTIHNQDLLLRFENGVLTLATPPPHAWEPGAAPAQQPGCLIAPQAGFPHAAHPGDCPELPPDLLLAEPAEPAPAPAPEEEAEGPAAALGPRGPLGSGPGVVLYLCPEAQCGQTFAKKHQLKVHLLTHSSSQGQRPFKCPLGGCGWTFTTSYKLKRHLQSHDKLRPFGCPAEGCGKSFTTVYNLKAHMKGHEQENSFKCEVCEESFPTQAKLSAHQRSHFEPERPYQCAFSGCKKTFITVSALFSHNRAHFREQELFSCSFPGCSKQYDKACRLKIHLRSHTGERPFLCDFDGCGWNFTSMSKLLRHKRKHDDDRRFMCPVEGCGKSFTRAEHLKGHSITHLGTKPFVCPVAGCCARFSARSSLYIHSKKHLQDVDTWKSRCPISSCNKLFTSKHSMKTHMVKRHKVGQDLLAQLEAANSLTPSSELTSQRQNDLSDAEIVSLFSDVPDSTSAALLDTALVNSGILTIDVASVSSTLAGHLPANNNNSVGQAVDPPSLMATSDPPQSLDTSLFFGTAATGFQQSSLNMDEVSSVSVGPLGSLDSLAMKNSSPEPQALTPSSKLTVDTDALTPSSTLCENSVSELLTPTKAEWNVHPDSDFFGQEGETQFGFPNAAGNHGSQKETDLITVTGSSFLV

SEQ ID NO: 102288 - protein, 409 aa, Homo sapiens
  Payload ID: 20387
  Gene Name: zinc finger, ZZ-type containing 3
  Uniprot ID: Q8IYH5
  ENSP ID: ENSP00000359834
MIDLWLYSYQRLLQTIAVLEAQRSQAVQDLESLGRHQREALKNPIGFVEKLQKKADIGLPYPQRVVQLPEIVWDQYTHSLGNFEREFKNRKRHTRRVKLVFDKVGLPARPKSPLDPKKDGESLSYSMLPLSDGPEGSSSRPQMIRGRLCDDTKPETFNQLWTVEEQKKLEQLLIKYPPEEVESRRWQKIADELGNRTAKQVASRVQKYFIKLTKAGIPVPGRTPNLYIYSKKSSTSRRQHPLNKHLFKPSTFMTSHEPPVYMDEDDDRSCFHSHMNTAVEDASDDESIPIMYRNLPEYKELLQFKKLKKQKLQQMQAESGFVQHVGFKCDNCGIEPIQGVRWHCQDCPPEMSLDFCDSCSDCLHETDIHKEDHQLEPIYRSETFLDRDYCVSQGTSYNYLDPNYFPANR

SEQ ID NO: 102289 - protein, 903 aa, Homo sapiens
  Payload ID: 20387
  Gene Name: zinc finger, ZZ-type containing 3
  Uniprot ID: Q8IYH5
  ENSP ID: ENSP00000359837
MAASRSTRVTRSTVGLNGLDESFCGRTLRNRSIAHPEEISSNSQVRSRSPKKRPEPVPIQKGNNNGRTTDLKQQSTRESWVSPRKRGLSSSEKDNIERQAIENCERRQTEPVSPVLKRIKRCLRSEAPNSSEEDSPIKSDKESVEQRSTVVDNDADFQGTKRACRCLILDDCEKREIKKVNVSEEGPLNSAVVEEITGYLAVNGVDDSDSAVINCDDCQPDGNTKQNSIGSYVLQEKSVAENGDTDTQTSMFLDSRKEDSYIDHKVPCTDSQVQVKLEDHKIVTACLPVEHVNQLTTEPATGPFSETQSSLRDSEEEVDVVGDSSASKEQCKENTNNELDTSLESMPASGEPEPSPVLDCVSAQMMSLSEPQEHRYTLRTSPRRAAPTRGSPTKNSSPYRENGQFEENNLSPNETNATVSDNVSQSPTNPGEISQNEKGICCDSQNNGSEGVSKPPSEARLNIGHLPSAKESASQHITEEEDDDPDVYYFESDHVALKHNKDYQRLLQTIAVLEAQRSQAVQDLESLGRHQREALKNPIGFVEKLQKKADIGLPYPQRVVQLPEIVWDQYTHSLGNFEREFKNRKRHTRRVKLVFDKVGLPARPKSPLDPKKDGESLSYSMLPLSDGPEGSSSRPQMIRGRLCDDTKPETFNQLWTVEEQKKLEQLLIKYPPEEVESRRWQKIADELGNRTAKQVASRVQKYFIKLTKAGIPVPGRTPNLYIYSKKSSTSRRQHPLNKHLFKPSTFMTSHEPPVYMDEDDDRSCFHSHMNTAVEDASDDESIPIMYRNLPEYKELLQFKKLKKQKLQQMQAESGFVQHVGFKCDNCGIEPIQGVRWHCQDCPPEMSLDFCDSCSDCLHETDIHKEDHQLEPIYRSETFLDRDYCVSQGTSYNYLDPNYFPANR

SEQ ID NO: 102290 - protein, 36 aa, Homo sapiens
  Payload ID: 20387
  Gene Name: zinc finger, ZZ-type containing 3
  ENSP ID: ENSP00000392408
MAASRSTRVTRSTVGLNGLDESFCGRTLRNRSIAHP

SEQ ID NO: 102291 - protein, 57 aa, Homo sapiens
  Payload ID: 20387
  Gene Name: zinc finger, ZZ-type containing 3
  ENSP ID: ENSP00000393779
MAASRSTRVTRSTVGLNGLDESFCGRTLRNRSIAHPEEISSNSQVRSRSPKKRPEPV

SEQ ID NO: 102292 - protein, 2961 aa, Homo sapiens
  Payload ID: 20388
  Gene Name: zinc finger, ZZ-type with EF-hand domain 1
  Uniprot ID: O43149
  ENSP ID: ENSP00000371051
MGNAPSHSSEDEAAAAGGEGWGPHQDWAAVSGTTPGPGVAAPALPPAAALLEPARLREAAAALLPTPPCESLVSRHRGALFRWLEERLGRGEESVTLEQFRELLEARGAGCSSEQFEEAFAQFDAEGDGTVDAENMLEALKNSSGANLQGELSHIIRQLQACSLVPGFTDIFSESKEGLDIHSSMILRFLHRNRLSSAVMPYPMLEHCNNMCTMRSSVLKESLDQLVQKEKESPGDLTRSPEMDKLKSVAKCYAYIETSSNSADIDKMTNGETSSYWQSDGSACSHWIRLKMKPDVVLRHLSIAVAATDQSYMPQQVTVAVGRNASDLQEVRDVHIPSNVTGYVTLLENANVSQLYVQINIKRCLSDGCDTRIHGLRAVGFQRVKKSGVSVSDASAIWYWSLLTSLVTASMETNPAFVQTVLHNTQKALRHMPPLSLSPGSTDFSTFLSPNVLEEVDSFLIRITSCCSTPEVELTLLAFALARGSVAKVMSSLCTITDHLDTQYDASSLILSMASVRQNLLLKYGKPLQLTLQACDVKGKEDKSGPENLLVEPWTRDGFLTETGKTRASTIFSTGTESAFQVTQIRIMVRRGGIGAQCGLVFAYNSSSDKFCAEEHFKRFEKYDKWKLQELRQFVKSRIGCSSDDLGEDDPIGWFELEEEWDEADVKLQQCRVAKYLMVKFLCTRQESAERLGVQGLTISGYLRPARAEAEQSVTCAHCRKDTEESVCGATLLLRTLQFIQQLAHDLVQQKESGLKYKSFLDFAGLDLQIFWNFYSKLKQNPREECVSAQTLLLQLLQSCFSVLQGDVLAASEEEKAPIQSPKGVEAAKELYTHLCDVVDKVDGDSVPMEILKQEVRNTLLNGAAIFFPNRQTRRNHLFTMMNVTEQEHKQSLQLTFRSLCTYFSDKDPGGLLLLPEKNDLAKMNISEVLAVMDTLVSVAARECELLMLSGAPGEVGSVLFSLFWSVQGSLLSWCYLQLKSTDSGAKDLAVDLIEKYVGQFLASMRAILESLFSQYSGKTIVERLCNSVFSMAARQLVIFLLDFCTLDIPHCVLLREFSVLTELLKKLCSGPEGGLRKLDVETWQQEQPVVLHTWTKESAHNYENNCHEVSVFVSPGATYFEVEFDDRCETEKRYDYLEFTDARGRKTRYDTKVGTDKWPKKVTFKAGPRLQFLFHSDSSHNEWGYKFTVTACGLPDVAVSWGLDLQLLVSRLMGRLASQCMALKSVRQLGSNMVVPQAKMALVLSSPLWKPVFRHQVCPELELEASWPTHPHRNSKEVKNIPDDPCRHFLLDFAQSEPAQNFCGPYSELFKGFIQACRKQAPKTDIVAGSTIDQAVNATFAALVYRTPDLYEKLQKYVNSGGKIALSEEFAQVYSLADGIRIWMLEMKQKSLMSLGNEAEEKHSSEATEVNPESLAKECIEKSLLLLKFLPTGISSKESCEKLETADETSHLQPLNKRQRTSSVVEEHFQASVSPTEAAPPATGDQSPGLGTQPKLPSSSGLPAADVSPATAEEPLSPSTPTRRPPFTRGRLRLLSFRSMEEARLVPTVKEKYPVLKDVMDFIKDQSLSHRSVVKVLSLRKAQAQSILEVLKITQHCAESLGQPHCFHPPFILFLLELLTCQKDFTNYFGHLEGCGADLHKEIRDTYYQLVLFLVKAVKGFSSLNDRSLLPALSCVQTALLHLLDMGWEPNDLAFFVDIQLPDLLMKMSQENISVHDSVISQWSEEDELADAKQNSEWMDECQDGMFEAWYEKIAQEDPEKQRKMHMFIARYCDLLNVDISCDGCDEIAPWHRYRCLQCSDMDLCKTCFLGGVKPEGHGDDHEMVNMEFTCDHCQGLIIGRRMNCNVCDDFDLCYGCYAAKKYSYGHLPTHSITAHPMVTIRISDRQRLIQPYIHNYSWLLFAALALYSAHLASAEDVDGEKLDPQTRSSATTLRSQCMQLVGDCLMKAHQGKGLKALALLGVLPDGDSSLEDQALPVTVPTGASEEQLEKKAVQGAELSEAGNGKRAVHEEIRPVDFKQRNKADKGVSLSKDPSCQTQISDSPADASPPTGLPDAEDSEVSSQKPIEEKAVTPSPEQVFAECSQKRILGLLAAMLPPLKSGPTVPLIDLEHVLPLMFQVVISNAGHLNETYHLTLGLLGQLIIRLLPAEVDAAVIKVLSAKHNLFAAGDSSIVPDGWKTTHLLFSLGAVCLDSRVGLDWACSMAEILRSLNSAPLWRDVIATFTDHCIKQLPFQLKHTNIFTLLVLVGFPQVLCVGTRCVYMDNANEPHNVIILKHFTEKNRAVIVDVKTRKRKTVKDYQLVQKGGGQECGDSRAQLSQYSQHFAFIASHLLQSSMDSHCPEAVEATWVLSLALKGLYKTLKAHGFEEIRATFLQTDLLKLLVKKCSKGTGFSKTWLLRDLEILSIMLYSSKKEINALAEHGDLELDERGDREEEVERPVSSPGDPEQKKLDPLEGLDEPTRICFLMAHDALNAPLHILRAIYELQMKKTDYFFLEVQKRFDGDELTTDERIRSLAQRWQPSKSLRLEEQSAKAVDTDMIILPCLSRPARCDQATAESNPVTQKLISSTESELQQSYAKQRRSKSAALLHKELNCKSKRAVRDYLFRVNEATAVLYARHVLASLLAEWPSHVPVSEDILELSGPAHMTYILDMFMQLEEKHEWEKILQKVLQGCREDMLGTMALAACQFMEEPGMEVQVRESKHPYNNNTNFEDKVHIPGAIYLSIKFDSQCNTEEGCDELAMSSSSDFQQDRHSFSGSQQKWKDFELPGDTLYYRFTSDMSNTEWGYRFTVTAGHLGRFQTGFEILKQMLSEERVVPHLPLAKIWEWLVGVACRQTGHQRLKAIHLLLRIVRCCGHSDLCDLALLKPLWQLFTHMEYGLFEDVTQPGILLPLHRALTELFFVTENRAQELGVLQDYLLALTTDDHLLRCAAQALQNIAAISLAINYPNKATRLWNVEC

SEQ ID NO: 102293 - protein, 812 aa, Homo sapiens
  Payload ID: 20388
  Gene Name: zinc finger, ZZ-type with EF-hand domain 1
  ENSP ID: ENSP00000458554
  MOD_RES (1)..(1): Any amino acid
XLFLLELLTCQKDFTNYFGHLEGCGADLHKEIRDTYYQLVLFLVKAVKGFSSLNDRSLLPALSCVQTALLHLLDMGWEPNDLAFFVDIQLPDLLMKMSQENISVHDSVISQWSEEDELADAKQNSEWMDECQDGMFEAWYEKIAQEDPEKQRKMHMFIARYCDLLNVDISCDGCDEIAPWHRYRCLQCSDMDLCKTCFLGGVKPEGHGDDHEMVNMEFTCDHCQGLIIGRRMNCNVCDDFDLCYGCYAAKKYSYGHLPTHSITAHPMVTIRISDRQRLIQPYIHNYSWLLFAALALYSAHLASAEDVDGEKLDPQTRSSATTLRSQCMQLVGDCLMKAHQGKGLKALALLGVLPDGDSSLEDQALPVTVPTGASEEQLEKKAVQGAELSEAGNGKRAVHEEIRPVDFKQRNKADKGVSLSKDPSCQTQISDSPADASPPTGLPDAEDSEVSSQKPIEEKAVTPSPEQVFAECSQKRILGLLAAMLPPLKSGPTVPLIDLEHVLPLMFQVVISNAGHLNETYHLTLGLLGQLIIRLLPAEVDAAVIKVLSAKHNLFAAGDSSIVPDGWKTTHLLFSLGAVCLDSRVGLDWACSMAEILRSLNSAPLWRDVIATFTDHCIKQLPFQLKHTNIFTLLVLVGFPQVLCVGTRCVYMDNANEPHNVIILKHFTEKNRAVIVDVKTRKRKTVKDYQLVQKGGGQECGDSRAQLSQYSQHFAFIASHLLQSSMDSHCPEAVEATWVLSLALKGLYKTLKAHGFEEIRATFLQTDLLKLLVKKCSKGTGFSKTWLLRDLEVRDERDSCSSFLVQMCWPRS

SEQ ID NO: 102294 - protein, 219 aa, Homo sapiens
  Payload ID: 20388
  Gene Name: zinc finger, ZZ-type with EF-hand domain 1
  ENSP ID: ENSP00000459023
  MOD_RES (1)..(1): Any amino acid
XPLSPSTPTRRPPFTRGRLRLLSFRSMEEARLVPTVKEKYPVLKDVMDFIKDQSLSHRSVVKVLSLRKAQAQSILEVLKITQHCAESLGQPHCFHPPFILFLLELLTCQKDFTNYFGHLEGCGADLHKEIRDTYYQLVLFLVKAVKGFSSLNDRSLLPALSCVQTALLHLLDMGWEPNDLAFFVDIQLPDLLMKMSQENISVHDSVIRCTCSLLATVTC

SEQ ID NO: 102295 - protein, 66 aa, Homo sapiens
  Payload ID: 20388
  Gene Name: zinc finger, ZZ-type with EF-hand domain 1
  ENSP ID: ENSP00000459796
  MOD_RES (1)..(1): Any amino acid
XASLLAEWPSHVPVSEDILELSGPAHMTYILDMFMQLEEKHEWEKANPPAWLGTPSRTRTLYDWFS

SEQ ID NO: 102296 - protein, 148 aa, Homo sapiens
  Payload ID: 20388
  Gene Name: zinc finger, ZZ-type with EF-hand domain 1
  ENSP ID: ENSP00000460633
RYDYLEFTDARGRKTRYDTKVGTDKWPKKVTFKAGPRLQFLFHSDSSHNEWGYKFTVTACGLPDVAVSWGLDLQLLVSRLMGRLASQCMALKSVRQLGSNMVVPQAKMALVLSSPLWKPVFRHQVCPELELEASWPTHPHRNSKEGEV

SEQ ID NO: 102297 - protein, 873 aa, Homo sapiens
  Payload ID: 20389
  Gene Name: zinc fingers and homeoboxes 1
  Uniprot ID: Q9UKY1
  ENSP ID: ENSP00000297857
MASRRKSTTPCMVLASEQDPDLELISDLDEGPPVLTPVENTRAESISSDEEVHESVDSDNQQNKKVEGGYECKYCTFQTPDLNMFTFHVDSEHPNVVLNSSYVCVECNFLTKRYDALSEHNLKYHPGEENFKLTMVKRNNQTIFEQTINDLTFDGSFVKEENAEQAESTEVSSSGISISKTPIMKMMKNKVENKRIAVHHNSVEDVPEEKENEIKPDREEIVENPSSSASESNTSTSIVNRIHPSTASTVVTPAAVLPGLAQVITAVSAQQNSNLIPKVLIPVNSIPTYNAALDNNPLLLNTYNKFPYPTMSEITVLSAQAKYTEEQIKIWFSAQRLKHGVSWTPEEVEEARRKQFNGTVHTVPQTITVIPTHISTGSNGLPSILQTCQIVGQPGLVLTQVAGTNTLPVTAPIALTVAGVPSQNNIQKSQVPAAQPTAETKPATAAVPTSQSVKHETALVNPDSFGIRAKKTKEQLAELKVSYLKNQFPHDSEIIRLMKITGLTKGEIKKWFSDTRYNQRNSKSNQCLHLNNDSSTTIIIDSSDETTESPTVGTAQPKQSWNPFPDFTPQKFKEKTAEQLRVLQASFLNSSVLTDEELNRLRAQTKLTRREIDAWFTEKKKSKALKEEKMEIDESNAGSSKEEAGETSPADESGAPKSGSTGKICKKTPEQLHMLKSAFVRTQWPSPEEYDKLAKESGLARTDIVSWFGDTRYAWKNGNLKWYYYYQSANSSSMNGLSSLRKRGRGRPKGRGRGRPRGRPRGSKRINNWDRGPSLIKFKTGTAILKDYYLKHKFLNEQDLDELVNKSHMGYEQVREWFAERQRRSELGIELFEENEEEDEVIDDQEEDEEETDDSDTWEPPRHVKRKLSKSDD

SEQ ID NO: 102298 - protein, 873 aa, Homo sapiens; identical to SEQ ID NO: 102297
  Payload ID: 20389
  Gene Name: zinc fingers and homeoboxes 1
  Uniprot ID: Q9UKY1
  ENSP ID: ENSP00000378938

SEQ ID NO: 102299 - protein, 873 aa, Homo sapiens; identical to SEQ ID NO: 102297
  Payload ID: 20389
  Gene Name: zinc fingers and homeoboxes 1
  Uniprot ID: Q9UKY1
  ENSP ID: ENSP00000428821

SEQ ID NO: 102300 - protein, 39 aa, Homo sapiens
  Payload ID: 20389
  Gene Name: zinc fingers and homeoboxes 1
  ENSP ID: ENSP00000475324
  MOD_RES (1)..(1): Any amino acid
XEEEDEVIDDQEEDEEETDDSDTWEPPRHVKRKLSKSDD

SEQ ID NO: 102301 - protein, 837 aa, Homo sapiens
  Payload ID: 20390
  Gene Name: zinc fingers and homeoboxes 2
  Uniprot ID: Q9Y6X8
  ENSP ID: ENSP00000314709
MASKRKSTTPCMVRTSQVVEQDVPEEVDRAKEKGIGTPQPDVAKDSWAAELENSSKENEVIEVKSMGESQSKKLQGGYECKYCPYSTQNLNEFTEHVDMQHPNVILNPLYVCAECNFTTKKYDSLSDHNSKFHPGEANFKLKLIKRNNQTVLEQSIETTNHVVSITTSGPGTGDSDSGISVSKTPIMKPGKPKADAKKVPKKPEEITPENHVEGTARLVTDTAEILSRLGGVELLQDTLGHVMPSVQLPPNINLVPKVPVPLNTTKYNSALDTNATMINSFNKFPYPTQAELSWLTAASKHPEEHIRIWFATQRLKHGISWSPEEVEEARKKMFNGTIQSVPPTITVLPAQLAPTKVTQPILQTALPCQILGQTSLVLTQVTSGSTTVSCSPITLAVAGVTNHGQKRPLVTPQAAPEPKRPHIAQVPEPPPKVANPPLTPASDRKKTKEQIAHLKASFLQSQFPDDAEVYRLIEVTGLARSEIKKWFSDHRYRCQRGIVHITSESLAKDQLAIAASRHGRTYHAYPDFAPQKFKEKTQGQVKILEDSFLKSSFPTQAELDRLRVETKLSRREIDSWFSERRKLRDSMEQAVLDSMGSGKKGQDVGAPNGALSRLDQLSGAQLTSSLPSPSPAIAKSQEQVHLLRSTFARTQWPTPQEYDQLAAKTGLVRTEIVRWFKENRCLLKTGTVKWMEQYQHQPMADDHGYDAVARKATKPMAESPKNGGDVVPQYYKDPKKLCEEDLEKLVTRVKVGSEPAKDCLPAKPSEATSDRSEGSSRDGQGSDENEESSVVDYVEVTVGEEDAISDRSDSWSQAAAEGVSELAESDSDCVPAEAGQA

SEQ ID NO: 102302 - protein, 166 aa, Homo sapiens
  Payload ID: 20390
  Gene Name: zinc fingers and homeoboxes 2
  ENSP ID: ENSP00000452720
MASKRKSTTPCMVRTSQVVEQDVPEEVDRAKEKGIGTPQPDVAKDSWAAELENSSKENEVIEVKSMGESQSKKLQGGYECKYCPYSTQNLNEFTEHVDMQHPNVILNPLYVCAECNFTTKKYDSLSDHNSKFHPGEANFKLKLIKRNNQTVLEQSIETTNHVVSIT

SEQ ID NO: 102303 - protein, 956 aa, Homo sapiens
  Payload ID: 20391
  Gene Name: zinc fingers and homeoboxes 3
  Uniprot ID: Q9H4I2
  ENSP ID: ENSP00000312222
MASKRKSTTPCMIPVKTVVLQDASMEAQPAETLPEGPQQDLPPEASAASSEAAQNPSSTDGSTLANGHRSTLDGYLYSCKYCDFRSHDMTQFVGHMNSEHTDFNKDPTFVCSGCSFLAKTPEGLSLHNATCHSGEASFVWNVAKPDNHVVVEQSIPESTSTPDLAGEPSAEGADGQAEIIITKTPIMKIMKGKAEAKKIHTLKENVPSQPVGEALPKLSTGEMEVREGDHSFINGAVPVSQASASSAKNPHAANGPLIGTVPVLPAGIAQFLSLQQQPPVHAQHHVHQPLPTAKALPKVMIPLSSIPTYNAAMDSNSFLKNSFHKFPYPTKAELCYLTVVTKYPEEQLKIWFTAQRLKQGISWSPEEIEDARKKMFNTVIQSVPQPTITVLNTPLVASAGNVQHLIQAALPGHVVGQPEGTGGGLLVTQPLMANGLQATSSPLPLTVTSVPKQPGVAPINTVCSNTTSAVKVVNAAQSLLTACPSITSQAFLDASIYKNKKSHEQLSALKGSFCRNQFPGQSEVEHLTKVTGLSTREVRKWFSDRRYHCRNLKGSRAMIPGDHSSIIIDSVPEVSFSPSSKVPEVTCIPTTATLATHPSAKRQSWHQTPDFTPTKYKERAPEQLRALESSFAQNPLPLDEELDRLRSETKMTRREIDSWFSERRKKVNAEETKKAEENASQEEEEAAEDEGGEEDLASELRVSGENGSLEMPSSHILAERKVSPIKINLKNLRVTEANGRNEIPGLGACDPEDDESNKLAEQLPGKVSCKKTAQQRHLLRQLFVQTQWPSNQDYDSIMAQTGLPRPEVVRWFGDSRYALKNGQLKWYEDYKRGNFPPGLLVIAPGNRELLQDYYMTHKMLYEEDLQNLCDKTQMSSQQVKQWFAEKMGEETRAVADTGSEDQGPGTGELTAVHKGMGDTYSEVSENSESWEPRVPEASSEPFDTSSPQAGRQLETD

SEQ ID NO: 102304 - protein, 96 aa, Homo sapiens
  Payload ID: 20391
  Gene Name: zinc fingers and homeoboxes 3
  ENSP ID: ENSP00000362358
MASKRKSTTPCMIPVKTVVLQDASMEAQPAETLPEGPQQDLPPEASAASSEAAQNPSSTDGSTLANGHRSTLDGYLYSCKYCDFRSHDMTQFVGHM

SEQ ID NO: 102305 - protein, 118 aa, Homo sapiens
  Payload ID: 20391
  Gene Name: zinc fingers and homeoboxes 3
  ENSP ID: ENSP00000399433
MASKRKSTTPCMIPVKTVVLQDASMEAQPAETLPEGPQQDLPPEASAASSEAAQNPSSTDGSTLANGHRSTLDGYLYSCKYCDFRSHDMTQFVGHMNSEHTDFNKDPTFVCSGCSFLA

SEQ ID NO: 102306 - protein, 46 aa, Homo sapiens
  Payload ID: 20391
  Gene Name: zinc fingers and homeoboxes 3
  ENSP ID: ENSP00000400441
MASKRKSTTPCMIPVKTVVLQDASMEAQPAETLPEGPQQDLPPEAS

SEQ ID NO: 102307 - protein, 47 aa, Homo sapiens
  Payload ID: 20391
  Gene Name: zinc fingers and homeoboxes 3
  ENSP ID: ENSP00000401852
MASKRKSTTPCMIPVKTVVLQDASMEAQPAETLPEGPQQDLPPEASA

SEQ ID NO: 102308 - protein, 89 aa, Homo sapiens
  Payload ID: 20391
  Gene Name: zinc fingers and homeoboxes 3
  ENSP ID: ENSP00000403048
MASKRKSTTPCMIPVKTVVLQDASMEAQPAETLPEGPQQDLPPEASAASSEAAQNPSSTDGSTLANGHRSTLDGYLYSCKYCDFRSHDM

SEQ ID NO: 102309 - protein, 678 aa, Homo sapiens
  Payload ID: 20391
  Gene Name: zinc fingers and homeoboxes 3
  ENSP ID: ENSP00000405421
  MOD_RES (1)..(1): Any amino acid
XAKALPKVMIPLSSIPTYNAAMDSNSFLKNSFHKFPYPTKAELCYLTVVTKYPEEQLKIWFTAQRLKQGISWSPEEIEDARKKMFNTVIQSVPQPTITVLNTPLVASAGNVQHLIQAALPGHVVGQPEGTGGGLLVTQPLMANGLQATSSPLPLTVTSVPKQPGVAPINTVCSNTTSAVKVVNAAQSLLTACPSITSQAFLDASIYKNKKSHEQLSALKGSFCRNQFPGQSEVEHLTKVTGLSTREVRKWFSDRRYHCRNLKGSRAMIPGDHSSIIIDSVPEVSFSPSSKVPEVTCIPTTATLATHPSAKRQSWHQTPDFTPTKYKERAPEQLRALESSFAQNPLPLDEELDRLRSETKMTRREIDSWFSERRKKVNAEETKKAEENASQEEEEAAEDEGGEEDLASELRVSGENGSLEMPSSHILAERKVSPIKINLKNLRVTEANGRNEIPGLGACDPEDDESNKLAEQLPGKVSCKKTAQQRHLLRQLFVQTQWPSNQDYDSIMAQTGLPRPEVVRWFGDSRYALKNGQLKWYEDYKRGNFPPGLLVIAPGNRELLQDYYMTHKMLYEEDLQNLCDKTQMSSQQVKQWFAEKMGEETRAVADTGSEDQGPGTGELTAVHKGMGDTYSEVSENSESWEPRVPEASSEPFDTSSPQAGRQLGSWSLSSQPLPSLLTL

SEQ ID NO: 102310 - protein, 956 aa, Homo sapiens; identical to SEQ ID NO: 102303
  Payload ID: 20391
  Gene Name: zinc fingers and homeoboxes 3
  Uniprot ID: Q9H4I2
  ENSP ID: ENSP00000415498

SEQ ID NO: 102311 - protein, 969 aa, Homo sapiens
  Payload ID: 20391
  Gene Name: zinc fingers and homeoboxes 3
  Uniprot ID: Q9H4I2
  ENSP ID: ENSP00000443783
MASKRKSTTPCMIPVKTVVLQDASMEAQPAETLPEGPQQDLPPEASAASSEAAQNPSSTDGSTLANGHRSTLDGYLYSCKYCDFRSHDMTQFVGHMNSEHTDFNKDPTFVCSGCSFLAKTPEGLSLHNATCHSGEASFVWNVAKPDNHVVVEQSIPESTSTPDLAGEPSAEGADGQAEIIITKTPIMKIMKGKAEAKKIHTLKENVPSQPVGEALPKLSTGEMEVREGDHSFINGAVPVSQASASSAKNPHAANGPLIGTVPVLPAGIAQFLSLQQQPPVHAQHHVHQPLPTAKALPKVMIPLSSIPTYNAAMDSNSFLKNSFHKFPYPTKAELCYLTVVTKYPEEQLKIWFTAQRLKQGISWSPEEIEDARKKMFNTVIQSVPQPTITVLNTPLVASAGNVQHLIQAALPGHVVGQPEGTGGGLLVTQPLMANGLQATSSPLPLTVTSVPKQPGVAPINTVCSNTTSAVKVVNAAQSLLTACPSITSQAFLDASIYKNKKSHEQLSALKGSFCRNQFPGQSEVEHLTKVTGLSTREVRKWFSDRRYHCRNLKGSRAMIPGDHSSIIIDSVPEVSFSPSSKVPEVTCIPTTATLATHPSAKRQSWHQTPDFTPTKYKERAPEQLRALESSFAQNPLPLDEELDRLRSETKMTRREIDSWFSERRKKVNAEETKKAEENASQEEEEAAEDEGGEEDLASELRVSGENGSLEMPSSHILAERKVSPIKINLKNLRVTEANGRNEIPGLGACDPEDDESNKLAEQLPGKVSCKKTAQQRHLLRQLFVQTQWPSNQDYDSIMAQTGLPRPEVVRWFGDSRYALKNGQLKWYEDYKRGNFPPGLLVIAPGNRELLQDYYMTHKMLYEEDLQNLCDKTQMSSQQKQTEFDLINVKDWPVWETACHVEEPNPTLCCHMPFPCPAAGHLGELPESSQTAQSLPLPSACPPPSKQQARWGSHQFFLPQCRTFPLPSNG

SEQ ID NO: 102312 - protein, 956 aa, Homo sapiens; identical to SEQ ID NO: 102303
  Payload ID: 20391
  Gene Name: zinc fingers and homeoboxes 3
  Uniprot ID: Q9H4I2
  ENSP ID: ENSP00000452965

SEQ ID NO: 102313 - protein, 127 aa, Homo sapiens
  Payload ID: 20391
  Gene Name: zinc fingers and homeoboxes 3
  ENSP ID: ENSP00000453310
VIAPGNRELLQDYYMTHKMLYEEDLQNLCDKTQMSSQQTEFDLINVKDWPVWETACHVEEPNPTLCCHMPFPCPAAGHLGELPESSQTAQSLPLPSACPPPSKQQARWGSHQFFLPQCRTFPLPSNG

SEQ ID NO: 102314 - protein, 315 aa, Homo sapiens
  Payload ID: 20391
  Gene Name: zinc fingers and homeoboxes 3
  ENSP ID: ENSP00000453647
MASKRKSTTPCMIPVKTVVLQDASMEAQPAETLPEGPQQDLPPEASAASSEAAQNPSSTDGSTLANGHRSTLDGYLYSCKYCDFRSHDMTQFVGHMNSEHTDFNKDPTFVCSGCSFLAKTPEGLSLHNATCHSGEASFVWNVAKPDNHVVVEQSIPESTSTPDLAGEPSAEGADGQAEIIITKTPIMKIMKGKAEAKKIHTLKENVPSQPVGEALPKLSTGEMEKQTEFDLINVKDWPVWETACHVEEPNPTLCCHMPFPCPAAGHLGELPESSQTAQSLPLPSACPPPSKQQARWGSHQFFLPQCRTFPLPSNG

SEQ ID NO: 102315 - protein, 956 aa, Homo sapiens; identical to SEQ ID NO: 102303
  Payload ID: 20391
  Gene Name: zinc fingers and homeoboxes 3
  Uniprot ID: Q9H4I2
  ENSP ID: ENSP00000454006

SEQ ID NO: 102316 - protein, 315 aa, Homo sapiens; identical to SEQ ID NO: 102314
  Payload ID: 20391
  Gene Name: zinc fingers and homeoboxes 3
  ENSP ID: ENSP00000454208

SEQ ID NO: 102317 - protein, 475 aa, Homo sapiens
  Payload ID: 20392
  Gene Name: zinc metallopeptidase STE24
  Uniprot ID: O75844
  ENSP ID: ENSP00000361845
MGMWASLDALWEMPAEKRIFGAVLLFSWTVYLWETFLAQRQRRIYKTTTHVPPELGQIMDSETFEKSRLYQLDKSTFSFWSGLYSETEGTLILLFGGIPYLWRLSGRFCGYAGFGPEYEITQSLVFLLLATLFSALTGLPWSLYNTFVIEEKHGFNQQTLGFFMKDAIKKFVVTQCILLPVSSLLLYIIKIGGDYFFIYAWLFTLVVSLVLVTIYADYIAPLFDKFTPLPEGKLKEEIEVMAKSIDFPLTKVYVVEGSKRSSHSNAYFYGFFKNKRIVLFDTLLEEYSVLNKDIQEDSGMEPRNEEEGNSEEIKAKVKNKKQGCKNEEVLAVLGHELGHWKLGHTVKNIIISQMNSFLCFFLFAVLIGRKELFAAFGFYDSQPTLIGLLIIFQFIFSPYNEVLSFCLTVLSRRFEFQADAFAKKLGKAKDLYSALIKLNKDNLGFPVSDWLFSMWHYSHPPLLERLQALKTMKQH

SEQ ID NO: 102318 - protein, 126 aa, Homo sapiens
  Payload ID: 20393
  Gene Name: zinc ribbon domain containing 1
  Uniprot ID: Q9P1U0
  ENSP ID: ENSP00000331111
MSVMDLANTCSSFQSDLDFCSDCGSVLPLPGAQDTVTCIRCGFNINVRDFEGKVVKTSVVFHQLGTAMPMSVEEGPECQGPVVDRRCPRCGHEGMAYHTRQMRSADEGQTVFYTCTNCKFQEKEDS

SEQ ID NO: 102319 - protein, 126 aa, Homo sapiens; identical to SEQ ID NO: 102318
  Payload ID: 20393
  Gene Name: zinc ribbon domain containing 1
  Uniprot ID: Q9P1U0
  ENSP ID: ENSP00000352333

SEQ ID NO: 102320 - protein, 126 aa, Homo sapiens; identical to SEQ ID NO: 102318
  Payload ID: 20393
  Gene Name: zinc ribbon domain containing 1
  Uniprot ID: Q9P1U0
  ENSP ID: ENSP00000365978

SEQ ID NO: 102321 - protein, 126 aa, Homo sapiens; identical to SEQ ID NO: 102318
  Payload ID: 20393
  Gene Name: zinc ribbon domain containing 1
  Uniprot ID: Q9P1U0
  ENSP ID: ENSP00000365981

SEQ ID NO: 102322 - protein, 126 aa, Homo sapiens; identical to SEQ ID NO: 102318
  Payload ID: 20393
  Gene Name: zinc ribbon domain containing 1
  Uniprot ID: Q9P1U0
  ENSP ID: ENSP00000373108

SEQ ID NO: 102323 - protein, 126 aa, Homo sapiens; identical to SEQ ID NO: 102318
  Payload ID: 20393
  Gene Name: zinc ribbon domain containing 1
  Uniprot ID: Q9P1U0
  ENSP ID: ENSP00000383500

SEQ ID NO: 102324 - protein, 126 aa, Homo sapiens; identical to SEQ ID NO: 102318
  Payload ID: 20393
  Gene Name: zinc ribbon domain containing 1
  Uniprot ID: Q9P1U0
  ENSP ID: ENSP00000383501

SEQ ID NO: 102325 - protein, 126 aa, Homo sapiens; identical to SEQ ID NO: 102318
  Payload ID: 20393
  Gene Name: zinc ribbon domain containing 1
  Uniprot ID: Q9P1U0
  ENSP ID: ENSP00000383503

SEQ ID NO: 102326 - protein, 126 aa, Homo sapiens; identical to SEQ ID NO: 102318
  Payload ID: 20393
  Gene Name: zinc ribbon domain containing 1
  Uniprot ID: Q9P1U0
  ENSP ID: ENSP00000387914

SEQ ID NO: 102327 - protein, 126 aa, Homo sapiens; identical to SEQ ID NO: 102318
  Payload ID: 20393
  Gene Name: zinc ribbon domain containing 1
  Uniprot ID: Q9P1U0
  ENSP ID: ENSP00000391809

SEQ ID NO: 102328 - protein, 126 aa, Homo sapiens; identical to SEQ ID NO: 102318
  Payload ID: 20393
  Gene Name: zinc ribbon domain containing 1
  Uniprot ID: Q9P1U0
  ENSP ID: ENSP00000393236

SEQ ID NO: 102329 - protein, 126 aa, Homo sapiens; identical to SEQ ID NO: 102318
  Payload ID: 20393
  Gene Name: zinc ribbon domain containing 1
  Uniprot ID: Q9P1U0
  ENSP ID: ENSP00000394779

SEQ ID NO: 102330 - protein, 126 aa, Homo sapiens; identical to SEQ ID NO: 102318
  Payload ID: 20393
  Gene Name: zinc ribbon domain containing 1
  Uniprot ID: Q9P1U0
  ENSP ID: ENSP00000395065

SEQ ID NO: 102331 - protein, 126 aa, Homo sapiens; identical to SEQ ID NO: 102318
  Payload ID: 20393
  Gene Name: zinc ribbon domain containing 1
  Uniprot ID: Q9P1U0
  ENSP ID: ENSP00000395397

SEQ ID NO: 102332 - protein, 126 aa, Homo sapiens; identical to SEQ ID NO: 102318
  Payload ID: 20393
  Gene Name: zinc ribbon domain containing 1
  Uniprot ID: Q9P1U0
  ENSP ID: ENSP00000396661

SEQ ID NO: 102333 - protein, 126 aa, Homo sapiens; identical to SEQ ID NO: 102318
  Payload ID: 20393
  Gene Name: zinc ribbon domain containing 1
  Uniprot ID: Q9P1U0
  ENSP ID: ENSP00000396922

SEQ ID NO: 102334 - protein, 126 aa, Homo sapiens; identical to SEQ ID NO: 102318
  Payload ID: 20393
  Gene Name: zinc ribbon domain containing 1
  Uniprot ID: Q9P1U0
  ENSP ID: ENSP00000397636

SEQ ID NO: 102335 - protein, 126 aa, Homo sapiens; identical to SEQ ID NO: 102318
  Payload ID: 20393
  Gene Name: zinc ribbon domain containing 1
  Uniprot ID: Q9P1U0
  ENSP ID: ENSP00000399302

SEQ ID NO: 102336 - protein, 126 aa, Homo sapiens; identical to SEQ ID NO: 102318
  Payload ID: 20393
  Gene Name: zinc ribbon domain containing 1
  Uniprot ID: Q9P1U0
  ENSP ID: ENSP00000399966

SEQ ID NO: 102337 - protein, 126 aa, Homo sapiens; identical to SEQ ID NO: 102318
  Payload ID: 20393
  Gene Name: zinc ribbon domain containing 1
  Uniprot ID: Q9P1U0
  ENSP ID: ENSP00000402198

SEQ ID NO: 102338 - protein, 126 aa, Homo sapiens; identical to SEQ ID NO: 102318
  Payload ID: 20393
  Gene Name: zinc ribbon domain containing 1
  Uniprot ID: Q9P1U0
  ENSP ID: ENSP00000405264

SEQ ID NO: 102339 - protein, 126 aa, Homo sapiens; identical to SEQ ID NO: 102318
  Payload ID: 20393
  Gene Name: zinc ribbon domain containing 1
  Uniprot ID: Q9P1U0
  ENSP ID: ENSP00000405636

SEQ ID NO: 102340 - protein, 126 aa, Homo sapiens; identical to SEQ ID NO: 102318
  Payload ID: 20393
  Gene Name: zinc ribbon domain containing 1
  Uniprot ID: Q9P1U0
  ENSP ID: ENSP00000407364

SEQ ID NO: 102341 - protein, 126 aa, Homo sapiens; identical to SEQ ID NO: 102318
  Payload ID: 20393
  Gene Name: zinc ribbon domain containing 1
  Uniprot ID: Q9P1U0
  ENSP ID: ENSP00000407715

SEQ ID NO: 102342 - protein, 126 aa, Homo sapiens; identical to SEQ ID NO: 102318
  Payload ID: 20393
  Gene Name: zinc ribbon domain containing 1
  Uniprot ID: Q9P1U0
  ENSP ID: ENSP00000410127

SEQ ID NO: 102343 - protein, 126 aa, Homo sapiens; identical to SEQ ID NO: 102318
  Payload ID: 20393
  Gene Name: zinc ribbon domain containing 1
  Uniprot ID: Q9P1U0
  ENSP ID: ENSP00000410530

SEQ ID NO: 102344 - protein, 126 aa, Homo sapiens; identical to SEQ ID NO: 102318
  Payload ID: 20393
  Gene Name: zinc ribbon domain containing 1
  Uniprot ID: Q9P1U0
  ENSP ID: ENSP00000410954

SEQ ID NO: 102345 - protein, 126 aa, Homo sapiens; identical to SEQ ID NO: 102318
  Payload ID: 20393
  Gene Name: zinc ribbon domain containing 1
  Uniprot ID: Q9P1U0
  ENSP ID: ENSP00000412369

SEQ ID NO: 102346 - protein, 126 aa, Homo sapiens; identical to SEQ ID NO: 102318
  Payload ID: 20393
  Gene Name: zinc ribbon domain containing 1
  Uniprot ID: Q9P1U0
  ENSP ID: ENSP00000413265

SEQ ID NO: 102347 - protein, 126 aa, Homo sapiens; identical to SEQ ID NO: 102318
  Payload ID: 20393
  Gene Name: zinc ribbon domain containing 1
  Uniprot ID: Q9P1U0
  ENSP ID: ENSP00000414110

SEQ ID NO: 102348 - protein, 126 aa, Homo sapiens; identical to SEQ ID NO: 102318
  Payload ID: 20393
  Gene Name: zinc ribbon domain containing 1
  Uniprot ID: Q9P1U0
  ENSP ID: ENSP00000414720

SEQ ID NO: 102349 - protein, 126 aa, Homo sapiens; identical to SEQ ID NO: 102318
  Payload ID: 20393
  Gene Name: zinc ribbon domain containing 1
  Uniprot ID: Q9P1U0
  ENSP ID: ENSP00000416599

SEQ ID NO: 102350 - protein, 154 aa, Homo sapiens
  Payload ID: 20394
  Gene Name: ZMYM6 neighbor
  Uniprot ID: Q8NCS4
  ENSP ID: ENSP00000362435
MALLLSVLRVLLGGFFALVGLAKLSEEISAPVSERMNALFVQFAEVFPLKVFGYQPDPLNYQIAVGFLELLAGLLLVMGPPMLQEISNLFLILLMMGAIFTLAALKESLSTCIPAIVCLGFLLLLNVGQLLAQTKKVVRPTRKKTLSTFKESWK

SEQ ID NO: 102351 - protein, 120 aa, Homo sapiens
  Payload ID: 20395
  Gene Name: ZNF559-ZNF177 readthrough
  ENSP ID: ENSP00000413568
MAAGWLTTWSQNSVTFQEVAVDFSQEEWALLDPAQKNLYKDVMLENFRNLASVGYQLCRHSLISKVDQEQLKTDERGILQGDCADWETQLKPKDTIAMQNIPGGKTSNGINTNPHGREFL

SEQ ID NO: 102352 - protein, 481 aa, Homo sapiens; identical to SEQ ID NO: 99156
  Payload ID: 20395
  Gene Name: ZNF559-ZNF177 readthrough
  ENSP ID: ENSP00000415070

SEQ ID NO: 102353 - protein, 321 aa, Homo sapiens; identical to SEQ ID NO: 99153
  Payload ID: 20395
  Gene Name: ZNF559-ZNF177 readthrough
  ENSP ID: ENSP00000445323

SEQ ID NO: 102354 - protein, 120 aa, Homo sapiens; identical to SEQ ID NO: 102351
  Payload ID: 20395
  Gene Name: ZNF559-ZNF177 readthrough
  ENSP ID: ENSP00000473272

SEQ ID NO: 102355 - protein, 111 aa, Homo sapiens
  Payload ID: 20395
  Gene Name: ZNF559-ZNF177 readthrough
  ENSP ID: ENSP00000473911
MVAGWLTNYSQDSVTFEDVAVDFTQEEWTLLDQTQRNLYRDVMLENYKNLVAVDWESHINTKWSAPQQNFLQGKTSSVVEMRCGLAVLPRLVSNSCSQVILLPQPPEYIYI

SEQ ID NO: 102356 - protein, 82 aa, Homo sapiens
  Payload ID: 20395
  Gene Name: ZNF559-ZNF177 readthrough
  ENSP ID: ENSP00000473968
MRITAAILTARSRWRLRNSISAFLFTVTFAWCPPGLSNLTILSCPGLGISKQEEGLGEESDEQGEGSQGWSEIQEMRSCCVA

SEQ ID NO: 102357 - protein, 47 aa, Homo sapiens
  Payload ID: 20395
  Gene Name: ZNF559-ZNF177 readthrough
  ENSP ID: ENSP00000473974
ILTARSRWRLRNSISAFLFTVTFAWCPPGLSNLTILSCPEMRSCCVA

SEQ ID NO: 102358 - protein, 84 aa, Homo sapiens
  Payload ID: 20395
  Gene Name: ZNF559-ZNF177 readthrough
  ENSP ID: ENSP00000474076
MVAGWLTNYSQDSVTFEDVAVDFTQEEWTLLDQTQRNLYRDVMLENYKNLVAVDWESHINTKWSAPQQNFLQGKTSSVVEMGWV

SEQ ID NO: 102359 - protein, 67 aa, Homo sapiens
  Payload ID: 20395
  Gene Name: ZNF559-ZNF177 readthrough
  ENSP ID: ENSP00000474108
LRNSISAFLFTVTFAWCPPGLSNLTILSCPGLGISKQEEGLGEESDEQGEGSQGWSEIQEMRSCCVA

SEQ ID NO: 102360 - protein, 53 aa, Homo sapiens
  Payload ID: 20395
  Gene Name: ZNF559-ZNF177 readthrough
  ENSP ID: ENSP00000474354
MRITAAILTARSRWRLRNSISAFLFTVTFAWCPPGLSNLTILSCPEMRSCCVA

SEQ ID NO: 102361 - protein, 126 aa, Homo sapiens
  Payload ID: 20395
  Gene Name: ZNF559-ZNF177 readthrough
  ENSP ID: ENSP00000474602
MAAGWLTTWSQNSVTFQEVAVDFSQEEWALLDPAQKNLYKDVMLENFRNLASVGYQLCRHSLISKVDQEQLKTDERGILQGDCADWETQLKPKDTIAMQNIPGGKTSNGINTNCVRTHSGEMPYEC

SEQ ID NO: 102362 - protein, 66 aa, Homo sapiens
  Payload ID: 20395
  Gene Name: ZNF559-ZNF177 readthrough
  ENSP ID: ENSP00000474716
  MOD_RES (1)..(1): Any amino acid
XLTARSRWRLRNSISAFLFTVTFAWCPPGLSNLTILSCPGRSTVVRSRFTAALTSLGSGVAPTSVF

SEQ ID NO: 102363 - protein, 46 aa, Homo sapiens
  Payload ID: 20395
  Gene Name: ZNF559-ZNF177 readthrough
  ENSP ID: ENSP00000474918
  MOD_RES (1)..(1): Any amino acid
XTARSRWRLRNSISAFLFTVTFAWCPPGLSNLTILSCPEMRSCCVA

SEQ ID NO: 102364 - protein, 76 aa, Homo sapiens
  Payload ID: 20395
  Gene Name: ZNF559-ZNF177 readthrough
  ENSP ID: ENSP00000474980
MRITAAILTARSRWRLRNSISAFLFTVTFAWCPPGLSNLTILSCPDWESHINTKWSAPQQNFLQGKTSSVVEMGWV

SEQ ID NO: 102365 - protein, 125 aa, Homo sapiens
  Payload ID: 20396
  Gene Name: ZNF625-ZNF20 readthrough (NMD candidate)
  ENSP ID: ENSP00000457423
MDSVVFEDVDVNFTQEEWALLDPSQKNLYRDVMQETFRNLASVGKKWKDQKIEDEYKNPRRNLSLRKWSWSLYARQTLGLDSPSVAPKRLLSGYQISYSERPRVPLPQLLSLCRLHRDPHYSREP

SEQ ID NO: 102366 - protein, 61 aa, Homo sapiens; identical to SEQ ID NO: 100814
  Payload ID: 20396
  Gene Name: ZNF625-ZNF20 readthrough (NMD candidate)
  ENSP ID: ENSP00000457791

SEQ ID NO: 102367 - protein, 118 aa, Homo sapiens
  Payload ID: 20397
  Gene Name: ZNF670-ZNF695 readthrough (NMD candidate)
  ENSP ID: ENSP00000428036
MGLLAFRDVALEFSPEEWECLDPAQRSLYRDVMLENYRNLISLGLAMSKPELIICLEARKEPWNVNTEKTARHSVETRFRHVGQAGLKLLTSGDPPALASQSAGITGTGHHCQPICVF

SEQ ID NO: 102368 - protein, 137 aa, Homo sapiens
  Payload ID: 20397
  Gene Name: ZNF670-ZNF695 readthrough (NMD candidate)
  ENSP ID: ENSP00000428213
MGLLAFRDVALEFSPEEWECLDPAQRSLYRDVMLENYRNLISLGLAMSKPELIICLEARKEPWNVNTEKTARHSVLSSYLTEDILPEQGLQVSFQKVMLRRYERCCLEKLRLRNDWEIVVETGFHRVSQDGLNLLTS

SEQ ID NO: 102369 - protein, 233 aa, Homo sapiens
  Payload ID: 20398
  Gene Name: ZNF816-ZNF321P readthrough
  Uniprot ID: Q8N8H1
  ENSP ID: ENSP00000375656
MLREEATKKSKEKEPGMALPQGRLTFRDVAIEFSLEEWKCLNPAQRALYRAVMLENYRNLEFVDISSKCMMKEFSSTAQGNTEVIHTGTLQRHESHHIRDFCFQEIEKDIHNFEFQWQEEERNGHEAPMTEIKELTGSTDRHDQRHAGNKPIKDQLGSSFHSHLPELHIFQPEWKIGNQVEKSIINASLILTSQRISCSPKTRISNNYGNNSLHSSLPIQKLGSTHERKIFPM

SEQ ID NO: 102370 - protein, 351 aa, Homo sapiens
  Payload ID: 20399
  Gene Name: zona pellucida binding protein
  Uniprot ID: Q9BS86
  ENSP ID: ENSP00000046087
MEAFALGPARRGRRRTRAAGSLLSRAAILLFISAFLVRVPSSVGHLVRLPRAFRLTKDSVKIVGSTSFPVKAYVMLHQKSPHVLCVTQQLRNAELIDPSFQWYGPKGKVVSVENRTAQITSTGSLVFQNFEESMSGIYTCFLEYKPTVEEIVKRLQLKYAIYAYREPHYYYQFTARYHAAPCNSIYNISFEKKLLQILSKLLLDLSCEISLLKSECHRVKMQRAGLQNELFFAFSVSSLDTEKGPKRCTDHNCEPYKRLFKAKNLIERFFNQQVEILGRRAEQLPQIYYIEGTLQMVWINRCFPGYGMNVQQHPKCPECCVICSPGSYNPRDGIHCLQCNSSLVYGAKTCL

SEQ ID NO: 102371 - protein, 72 aa, Homo sapiens
  Payload ID: 20399
  Gene Name: zona pellucida binding protein
  ENSP ID: ENSP00000390054
MFLVGHLVRLPRAFRLTKDSVKIVGSTSFPVKAYVMLHQKSPHVLCVTQQLRNAELIDPSFQWYGPKGKVVS

SEQ ID NO: 102372 - protein, 350 aa, Homo sapiens
  Payload ID: 20399
  Gene Name: zona pellucida binding protein
  Uniprot ID: Q9BS86
  ENSP ID: ENSP00000402071
MEAFALGPARRGRRRTRAAGSLLSRAAILLFISAFLVRVPSSVGHLVRLPRAFRLTKDSVKIVGSTSFPVKAYVMLHQKSPHVLCVTQQLRNAELIDPSFQWYGPKGKVVSENRTAQITSTGSLVFQNFEESMSGIYTCFLEYKPTVEEIVKRLQLKYAIYAYREPHYYYQFTARYHAAPCNSIYNISFEKKLLQILSKLLLDLSCEISLLKSECHRVKMQRAGLQNELFFAFSVSSLDTEKGPKRCTDHNCEPYKRLFKAKNLIERFFNQQVEILGRRAEQLPQIYYIEGTLQMVWINRCFPGYGMNVQQHPKCPECCVICSPGSYNPRDGIHCLQCNSSLVYGAKTCL

SEQ ID NO: 102373 - protein, 75 aa, Homo sapiens
  Payload ID: 20399
  Gene Name: zona pellucida binding protein
  ENSP ID: ENSP00000414755
MEAFALGPARRGRRRTRAAGSLLSRAAILLFISAFLVRVPSSGEGPRRPAGSAGTTAASPTLRIAFSCVTCIRFI

SEQ ID NO: 102374 - protein, 338 aa, Homo sapiens
  Payload ID: 20400
  Gene Name: zona pellucida binding protein 2
  Uniprot ID: Q6X784
  ENSP ID: ENSP00000335384
MMRTCVLLSAVLWCLTGVQCPRFTLFNKKGFIYGKTGQPDKIYVELHQNSPVLICMDFKLSKKEIVDPTYLWIGPNEKTLTGNNRINITETGQLMVKDFLEPLSGLYTCTLSYKTVKAETQEEKTVKKRYDFMVFAYREPDYSYQMAVRFTTRSCIGRYNDVFFRVLKKILDSLISDLSCHVIEPSYKCHSVEIPEHGLIHELFIAFQVNPFAPGWKGACNGSVDCEDTTNHNILQARDRIEDFFRSQAYIFYHNFNKTLPAMHFVDHSLQVVRLDSCRPGFGKNERLHSNCASCCVVCSPATFSPDVNVTCQTCVSVLTYGAKSCPQTSNKNQQYED

SEQ ID NO: 102375 - protein, 316 aa, Homo sapiens
  Payload ID: 20400
  Gene Name: zona pellucida binding protein 2
  Uniprot ID: Q6X784
  ENSP ID: ENSP00000367174
MMRTCVLLSAVLWCLTGDKIYVELHQNSPVLICMDFKLSKKEIVDPTYLWIGPNEKTLTGNNRINITETGQLMVKDFLEPLSGLYTCTLSYKTVKAETQEEKTVKKRYDFMVFAYREPDYSYQMAVRFTTRSCIGRYNDVFFRVLKKILDSLISDLSCHVIEPSYKCHSVEIPEHGLIHELFIAFQVNPFAPGWKGACNGSVDCEDTTNHNILQARDRIEDFFRSQAYIFYHNFNKTLPAMHFVDHSLQVVRLDSCRPGFGKNERLHSNCASCCVVCSPATFSPDVNVTCQTCVSVLTYGAKSCPQTSNKNQQYED

SEQ ID NO: 102376 - protein, 265 aa, Homo sapiens
  Payload ID: 20400
  Gene Name: zona pellucida binding protein 2
  ENSP ID: ENSP00000462067
MMRTCVLLSAVLWCLTGVQCPRFTLFNKKGFIYGKTGQPDKIYVELHQNSPVLICMDFKLSKKEIVDPTYLWIGPNEKTLTGNNRINITETGQLMVKDFLEPLSGLYTCTLSYKTVKAETQEEKTVKKRYDFMVFVNPFAPGWKGACNGSVDCEDTTNHNILQARDRIEDFFRSQAYIFYHNFNKTLPAMHFVDHSLQVVRLDSCRPGFGKNERLHSNCASCCVVCSPATFSPDVNVTCQTCVSVLTYGAKSCPQTSNKNQQYED

SEQ ID NO: 102377 - protein, 218 aa, Homo sapiens
  Payload ID: 20400
  Gene Name: zona pellucida binding protein 2
  ENSP ID: ENSP00000462463
MMRTCVLLSAVLWCLTGAYREPDYSYQMAVRFTTRSCIGRYNDVFFRVLKKILDSLISDLSCHVIEPSYKCHSVEIPEHGLIHELFIAFQVNPFAPGWKGACNGSVDCEDTTNHNILQARDRIEDFFRSQAYIFYHNFNKTLPAMHFVDHSLQVVRLDSCRPGFGKNERLHSNCASCCVVCSPATFSPDVNVTCQTCVSVLTYGAKSCPQTSNKNQQY

SEQ ID NO: 102378 - protein, 638 aa, Homo sapiens
  Payload ID: 20401
  Gene Name: zona pellucida glycoprotein 1 (sperm receptor)
  Uniprot ID: P60852
  ENSP ID: ENSP00000278853
MAGGSATTWGYPVALLLLVATLGLGRWLQPDPGLPGLRHSYDCGIKGMQLLVFPRPGQTLRFKVVDEFGNRFDVNNCSICYHWVTSRPQEPAVFSADYRGCHVLEKDGRFHLRVFMEAVLPNGRVDVAQDATLICPKPDPSRTLDSQLAPPAMFSVSTPQTLSFLPTSGHTSQGSGHAFPSPLDPGHSSVHPTPALPSPGPGPTLATLAQPHWGTLEHWDVNKRDYIGTHLSQEQCQVASGHLPCIVRRTSKEACQQAGCCYDNTREVPCYYGNTATVQCFRDGYFVLVVSQEMALTHRITLANIHLAYAPTSCSPTQHTEAFVVFYFPLTHCGTTMQVAGDQLIYENWLVSGIHIQKGPQGSITRDSTFQLHVRCVFNASDFLPIQASIFPPPSPAPMTQPGPLRLELRIAKDETFSSYYGEDDYPIVRLLREPVHVEVRLLQRTDPNLVLLLHQCWGAPSANPFQQPQWPILSDGCPFKGDSYRTQMVALDGATPFQSHYQRFTVATFALLDSGSQRALRGLVYLFCSTSACHTSGLETCSTACSTGTTRQRRSSGHRNDTARPQDIVSSPGPVGFEDSYGQEPTLGPTDSNGNSSLRPLLWAVLLLPAVALVLGFGVFVGLSQTWAQKLWESNRQ

SEQ ID NO: 102379 - protein, 40 aa, Homo sapiens
  Payload ID: 20401
  Gene Name: zona pellucida glycoprotein 1 (sperm receptor)
  ENSP ID: ENSP00000441293
  MOD_RES (1)..(1): Any amino acid
XRFDVNNCSICYHWVTSRPQEPAVFSADYRGCHVLEKVPT

SEQ ID NO: 102380 - protein, 330 aa, Homo sapiens
  Payload ID: 20401
  Gene Name: zona pellucida glycoprotein 1 (sperm receptor)
  ENSP ID: ENSP00000480463
MALTHRITLANIHLAYAPTSCSPTQHTEAFVVFYFPLTHCGTTMQVAGDQLIYENWLVSGIHIQKGPQGSITRDSTFQLHVRCVFNASDFLPIQASIFPPPSPAPMTQPGPLRLELRIAKDETFSSYYGEDDYPIVRLLREPVHVEVRLLQRTDPNLVLLLHQCWGAPSANPFQQPQWPILSDGCPFKGDSYRTQMVALDGATPFQSHYQRFTVATFALLDSGSQRALRGLVYLFCSTSACHTSGLETCSTACSTGTTRQRRSSGHRNDTARPQDIVSSPGPVGFEDSYGQEPTLGPTDSNGNSSLRPLLWAVLLLPAVALVLGFGVFVA

SEQ ID NO: 102381 - protein, 736 aa, Homo sapiens
  Payload ID: 20402
  Gene Name: zona pellucida glycoprotein 2 (sperm receptor)
  Uniprot ID: Q05996
  ENSP ID: ENSP00000458991
MACRQRGGSWSPSGWFNAGWSTYRSISLFFALVTSGNSIDVSQLVNPAFPGTVTCDEREITVEFPSSPGTKKWHASVVDPLGLDMPNCTYILDPEKLTLRATYDNCTRRVHGGHQMTIRVMNNSAALRHGAVMYQFFCPAMQVEETQGLSASTICQKDFMSFSLPRVFSGLADDSKGTKVQMGWSIEVGDGARAKTLTLPEAMKEGFSLLIDNHRMTFHVPFNATGVTHYVQGNSHLYMVSLKLTFISPGQKVIFSSQAICAPDPVTCNATHMTLTIPEFPGKLKSVSFENQNIDVSQLHDNGIDLEATNGMKLHFSKTLLKTKLSEKCLLHQFYLASLKLTFLLRPETVSMVIYPECLCESPVSIVTGELCTQDGFMDVEVYSYQTQPALDLGTLRVGNSSCQPVFEAQSQGLVRFHIPLNGCGTRYKFEDDKVVYENEIHALWTDFPPSKISRDSEFRNDMLLNINVESLTPPVASVKLGPFTLILQSYPDNSYQQPYGENEYPLVRFLRQPIYMEVRVLNRDDPNIKLVLDDCWATSTMDPDSFPQWNVVVDGCAYDLDNYQTTFHPVGSSVTHPDHYQRFDMKAFAFVSEAHVLSSLVYFHCSALICNRLSPDSPLCSVTCPVSSRHRRATGATEAEKMTVSLPGPILLLSDDSSFRGVGSSDLKASGSSGEKSRSETGEEVGSRGAMDTKGHKTAGDVGSKAVAAVAAFAGVVATLGFIYYLYEKRTVSNH

SEQ ID NO: 102382 - protein, 745 aa, Homo sapiens
  Payload ID: 20402
  Gene Name: zona pellucida glycoprotein 2 (sperm receptor)
  Uniprot ID: Q05996
  ENSP ID: ENSP00000460971
MACRQRGGSWSPSGWFNAGWSTYRSISLFFALVTSGNSIDVSQLVNPAFPGTVTCDEREITVEFPSSPGTKKWHASVVDPLGLDMPNCTYILDPEKLTLRATYDNCTRRVHGGHQMTIRVMNNSAALRHGAVMYQFFCPAMQVEETQGLSASTICQKDFMSFSLPRVFSGLADDSKGTKVQMGWSIEVGDGARAKTLTLPEAMKEGFSLLIDNHRMTFHVPFNATGVTHYVQGNSHLYMVSLKLTFISPGQKVIFSSQAICAPDPVTCNATHMTLTIPEFPGKLKSVSFENQNIDVSQLHDNGIDLEATNGMKLHFSKTLLKTKLSEKCLLHQFYLASLKLTFLLRPETVSMVIYPECLCESPVSIVTGELCTQDGFMDVEVYSYQTQPALDLGTLRVGNSSCQPVFEAQSQGLVRFHIPLNGCGTRYKFEDDKVVYENEIHALWTDFPPSKISRDSEFRMTVKCSYSRNDMLLNINVESLTPPVASVKLGPFTLILQSYPDNSYQQPYGENEYPLVRFLRQPIYMEVRVLNRDDPNIKLVLDDCWATSTMDPDSFPQWNVVVDGCAYDLDNYQTTFHPVGSSVTHPDHYQRFDMKAFAFVSEAHVLSSLVYFHCSALICNRLSPDSPLCSVTCPVSSRHRRATGATEAEKMTVSLPGPILLLSDDSSFRGVGSSDLKASGSSGEKSRSETGEEVGSRGAMDTKGHKTAGDVGSKAVAAVAAFAGVVATLGFIYYLYEKRTVSNH

SEQ ID NO: 102383 - protein, 373 aa, Homo sapiens
  Payload ID: 20403
  Gene Name: zona pellucida glycoprotein 3 (sperm receptor)
  Uniprot ID: P21754
  ENSP ID: ENSP00000337310
MVMVSKDLFGTGKLIRAADLTLGPEACEPLVSMDTEDVVRFEVGLHECGNSMQVTDDALVYSTFLLHDPRPVGNLSIVRTNRAEIPIECRYPRQGNVSSQAILPTWLPFRTTVFSEEKLTFSLRLMEENWNAEKRSPTFHLGDAAHLQAEIHTGSHVPLRLFVDHCVATPTPDQNASPYHTIVDFHGCLVDGLTDASSAFKVPRPGPDTLQFTVDVFHFANDSRNMIYITCHLKVTLAEQDPDELNKACSFSKPSNSWFPVEGSADICQCCNKGDCGTPSHSRRQPHVMSQWSRSASRNRRHVTEEADVTVGPLIFLDRRGDHEVEQWALPSDTSVVLLGVGLAVVVSLTLTAVILVLTRRCRTASHPVSASE

SEQ ID NO: 102384 - protein, 424 aa, Homo sapiens
  Payload ID: 20403
  Gene Name: zona pellucida glycoprotein 3 (sperm receptor)
  Uniprot ID: P21754
  ENSP ID: ENSP00000378326
MELSYRLFICLLLWGSTELCYPQPLWLLQGGASHPETSVQPVLVECQEATLMVMVSKDLFGTGKLIRAADLTLGPEACEPLVSMDTEDVVRFEVGLHECGNSMQVTDDALVYSTFLLHDPRPVGNLSIVRTNRAEIPIECRYPRQGNVSSQAILPTWLPFRTTVFSEEKLTFSLRLMEENWNAEKRSPTFHLGDAAHLQAEIHTGSHVPLRLFVDHCVATPTPDQNASPYHTIVDFHGCLVDGLTDASSAFKVPRPGPDTLQFTVDVFHFANDSRNMIYITCHLKVTLAEQDPDELNKACSFSKPSNSWFPVEGSADICQCCNKGDCGTPSHSRRQPHVMSQWSRSASRNRRHVTEEADVTVGPLIFLDRRGDHEVEQWALPSDTSVVLLGVGLAVVVSLTLTAVILVLTRRCRTASHPVSASE

SEQ ID NO: 102385 - protein, 258 aa, Homo sapiens
  Payload ID: 20403
  Gene Name: zona pellucida glycoprotein 3 (sperm receptor)
  ENSP ID: ENSP00000378329
  MOD_RES (1)..(1): Any amino acid
XNWNAEKRSPTFHLGDAAHLQAEIHTGSHVPLRLFVDHCVATPTPDQNASPYHTIVDFHGCLVDGLTDASSAFKVPRPGPDTLQFTVDVFHFANDSRNMIYITCHLKVTLAEQDPDELNKACSFSKPSNRQQKSKLLLFHLSWFPVEGSADICQCCNKGDCGTPSHSRRQPHVMSQWSRSASRNRRHVTEEADVTVGPLIFLDRRGDHEVEQWALPSDTSVVLLGVGLAVVVSLTLTAVILVLTRRCRTASHPVSASE

SEQ ID NO: 102386 - protein, 248 aa, Homo sapiens
  Payload ID: 20403
  Gene Name: zona pellucida glycoprotein 3 (sperm receptor)
  ENSP ID: ENSP00000411955
MEENWNAEKRSPTFHLGDAAHLQAEIHTGSHVPLRLFVDHCVATPTPDQNASPYHTIVDFHGCLVDGLTDASSAFKVPRPGPDTLQFTVDVFHFANDSRNMIYITCHLKVTLAEQDPDELNKACSFSKPSNSWFPVEGSADICQCCNKGDCGTPSHSRRQPHVMSQWSRSASRNRRHVTEEADVTVGPLIFLDRRGDHEVEQWALPSDTSVVLLGVGLAVVVSLTLTAVILVLTRRCRTASHPVSASE

SEQ ID NO: 102387 - protein, 540 aa, Homo sapiens
  Payload ID: 20404
  Gene Name: zona pellucida glycoprotein 4
  Uniprot ID: Q12836
  ENSP ID: ENSP00000355529
MWLLRCVLLCVSLSLAVSGQHKPEAPDYSSVLHCGPWSFQFAVNLNQEATSPPVLIAWDNQGLLHELQNDSDCGTWIRKGPGSSVVLEATYSSCYVTEWDSHYIMPVGVEGAGAAEHKVVTERKLLKCPMDLLARDAPDTDWCDSIPARDRLPCAPSPISRGDCEGLGCCYSSEEVNSCYYGNTVTLHCTREGHFSIAVSRNVTSPPLLLDSVRLALRNDSACNPVMATQAFVLFQFPFTSCGTTRQITGDRAVYENELVATRDVKNGSRGSVTRDSIFRLHVSCSYSVSSNSLPINVQVFTLPPPFPETQPGPLTLELQIAKDKNYGSYYGVGDYPVVKLLRDPIYVEVSILHRTDPYLGLLLQQCWATPSTDPLSQPQWPILVKGCPYIGDNYQTQLIPVQKALDLPFPSHHQRFSIFTFSFVNPTVEKQALRGPVHLHCSVSVCQPAETPSCVVTCPDLSRRRNFDNSSQNTTASVSSKGPMILLQATKDPPEKLRVPVDSKVLWVAGLSGTLILGALLVSYLAVKKQKSCPDQMCQ

SEQ ID NO: 102388 - protein, 540 aa, Homo sapiens; identical to SEQ ID NO: 102387
  Payload ID: 20404
  Gene Name: zona pellucida glycoprotein 4
  Uniprot ID: Q12836
  ENSP ID: ENSP00000482304

SEQ ID NO: 102389 - protein, 431 aa, Homo sapiens
  Payload ID: 20405
  Gene Name: zona pellucida-like domain containing 1
  Uniprot ID: Q8TCW7
  ENSP ID: ENSP00000307801
MMLRFSMCRGNDEGFAMEQIWLLLLLTIRVLPGSAQFNGYNCDANLHSRFPAERDISVYCGVQAITMKINFCTVLFSGYSETDLALNGRHGDSHCRGFINNNTFPAVVIFIINLSTLEGCGNNLVVSTIPGVSAYGNATSVQVGNISGYIDTPDPPTIISYLPGLLYKFSCSYPLEYLVNNTQLASSSAAISVRENNGTFVSTLNLLLYNDSTYNQQLIIPSIGLPLKTKVFAAVQATNLDGRWNVLMDYCYTTPSGNPNDDIRYDLFLSCDKDPQTTVIENGRSQRGRFSFEVFRFVKHKNQKMSTVFLHCVTKLCRADDCPFLMPICSHRERRDAGRRTTWSPQSSSGSAVLSAGPIITRSDETPTNNSQLGSPSMPPFQLNAITSALISGMVILGVTSFSLLLCSLALLHRKGPTSLVLNGIRNPVFD

SEQ ID NO: 102390 - protein, 415 aa, Homo sapiens
  Payload ID: 20405
  Gene Name: zona pellucida-like domain containing 1
  Uniprot ID: Q8TCW7
  ENSP ID: ENSP00000418253
MEQIWLLLLLTIRVLPGSAQFNGYNCDANLHSRFPAERDISVYCGVQAITMKINFCTVLFSGYSETDLALNGRHGDSHCRGFINNNTFPAVVIFIINLSTLEGCGNNLVVSTIPGVSAYGNATSVQVGNISGYIDTPDPPTIISYLPGLLYKFSCSYPLEYLVNNTQLASSSAAISVRENNGTFVSTLNLLLYNDSTYNQQLIIPSIGLPLKTKVFAAVQATNLDGRWNVLMDYCYTTPSGNPNDDIRYDLFLSCDKDPQTTVIENGRSQRGRFSFEVFRFVKHKNQKMSTVFLHCVTKLCRADDCPFLMPICSHRERRDAGRRTTWSPQSSSGSAVLSAGPIITRSDETPTNNSQLGSPSMPPFQLNAITSALISGMVILGVTSFSLLLCSLALLHRKGPTSLVLNGIRNPVFD

SEQ ID NO: 102391 - protein, 415 aa, Homo sapiens; identical to SEQ ID NO: 102390
  Payload ID: 20405
  Gene Name: zona pellucida-like domain containing 1
  Uniprot ID: Q8TCW7
  ENSP ID: ENSP00000420265

SEQ ID NO: 102392 - protein, 2601 aa, Homo sapiens
  Payload ID: 20406
  Gene Name: zonadhesin (gene/pseudogene)
  ENSP ID: ENSP00000441117
MVPPVWTLLLLVGAALFRKEKPPDQKLVVRSSRDNYVLTQCDFEDDAKPLCDWSQVSADDEDWVRASGPSPTGSTGAPGGYPNGEGSYLHMESNSFHRGGVARLLSPDLWEQGPLCVHFAHHMFGLSWGAQLRLLLLSGEEGRRPDVLWKHWNTQRPSWMLTTVTVPAGFTLPTRLMFEGTRGSTAYLDIALDALSIRRGSCNRVCMMQTCSFDIPNDLCDWTWIPTASGAKWTQKKGSSGKPGVGPDGDFSSPGSGCYMLLDPKNARPGQKAVLLSPVSLSSGCLSFSFHYILRGQSPGAALHIYASVLGSIRKHTLFSGQPGPNWQAVSVNYTAVGRIQFAVVGVFGKTPEPAVAVDATSIAPCGEGFPQCDFEDNAHPFCDWVQTSGDGGHWALGHKNGPVHGMGPAGGFPNAGGHYIYLEADEFSQAGQSVRLVSRPFCAPGDICVEFAYHMYGLGEGTMLELLLGSPAGSPPIPLWKRVGSQRPYWQNTSVTVPSGHQQPMQLIFKGIQGSNTASVVAMGFILINPGTCPVKVLPELPPVSPVSSTGPSETTGLTENPTISTKKPTVSIEKPSVTTEKPTVPKEKPTIPTEKPTISTEKPTIPSEKPNMPSEKPTIPSEKPTILTEKPTIPSEKPTIPSEKPTISTEKPTVPTEEPTTPTEETTTSMEEPVIPTEKPSIPTEKPSIPTEKPTISMEETIISTEKPTISPEKPTIPTEKPTIPTEKSTISPEKPTTPTEKPTIPTEKPTISPEKPTTPTEKPTISPEKLTIPTEKPTIPTEKPTIPTEKPTISTEEPTTPTEETTISTEKPSIPMEKPTLPTEETTTSVEETTISTEKLTIPMEKPTISTEKPTIPTEKPTISPEKLTIPTEKLTIPTEKPTIPIEETTISTEKLTIPTEKPTISPEKPTISTEKPTIPTEKPTIPTEETTISTEKLTIPTEKPTISPEKLTIPTEKPTISTEKPTIPTEKLTIPTEKPTIPTEKPTIPTEKLTALRPPHPSPTATGLAALVMSPHAPSTPMTSVILGTTTTSRSSTERCPPNARYESCACPASCKSPRPSCGPLCREGCVCNPGFLFSDNHCIQASSCNCFYNNDYYEPGAEWFSPNCTEHCRCWPGSRVECQISQCGTHTVCQLKNGQYGCHPYAGTATCLVYGDPHYVTFDGRHFGFMGKCTYILAQPCGNSTDPFFRVTAKNEEQGQEGVSCLSKVYVTLPESTVTLLKGRRTLVGGQQVTLPAIPSKGVFLGASGRFVELQTEFGLRVRWDGDQQLYVTVSSTYSGKLCGLCGNYDGNSDNDHLKLDGSPAGDKEELGNSWQTDQDEDQECQKYQVVNSPSCDSSLQSSMSGPGFCGRLVDTHGPFETCLLHVKAASFFDSCMLDMCGFQGLQHLLCTHMSTMTTTCQDAGHAVKPWREPHFCPMACPPNSKYSLCAKPCPDTCHSGFSGMFCSDRCVEACECNPGFVLSGLECIPRSQCGCLHPAGSYFKVGERWYKPGCKELCVCESNNRIRCQPWRCRAQEFCGQQDGIYGCHAQGAATCTASGDPHYLTFDGALHHFMGTCTYVLTRPCWSRSQDSYFVVSATNENRGGILEVSYIKAVHVTVFDLSISLLRGCKVMLNGHRVALPVWLAQGRVTIRLSSNLVLLYTNFGLQVRYDGSHLVEVTVPSSYGGQLCGLCGNYNNNSLDDNLRPDRKLAGDSMQLGAAWKLPESSEPGCFLVGGKPSSCQENSMADAWNKNCAILINPQGPFSQCHQVVPPQSSFASCVHGQCGTKGDTTALCRSLQAYASLCAQAGQAPAWRNRTFCPMRCPPGSSYSPCSSPCPDTCSSINNPRDCPKALPCAESCECQKGHILSGTSCVPLGQCGCTDPAGSYHPVGERWYTENTCTRLCTCSVHNNITCFQSTCKPNQICWALDGLLHCRASGVGVCQLPGESHYVSFDGSNHSIPDACTLVLVKVCHPAMALPFFKISAKHEKEEGGTEAFRLHEVYIDIYDAQVTLQKGHRVLINSKQVTLPAISQIPGVSVKSSSIYSIVNIKIGVQVKFDGNHLLEIEIPTTYYGKVCGMCGNFNDEEEDELMMPSDEVANSDSEFVNSWKDKDIDPSCQSLLVDEQQIPAEQQENPSGNCRAADLRRAREKCEAALRAPVWAQCASRIDLTPFLVDCANTLCEFGGLYQALCQALQAFGATCQSQGLKPPLWRNSSFCPLECPAYSSYTNCLPSCSPSCWDLDGRCEGAKVPSACAEGCICQPGYVLSEDKCVPRSQCGCKDAHGGSIPLGKSWVSSGCTEKCVCTGGAIQCGDFRCPSGSHCQLTSDNSNSNCVSDKSEQCSVYGDPRYLTFDGFSYRLQGRMTYVLIKTVDVLPEGVEPLLVEGRNKMDPPRSSIFLQEVITTVYGYKVQLQAGLELVVNNQKMAVPYRPNEHLRVTLWGQRLYLVTDFELVVSFGGRKNAVISLPSMYEGLVSGLCGNYDKNRKNDMMLPSGALTQNLNTFGNSWEVKTEDALLRFPRAIPAEEEGQGAELGLRTGLQVSECSPEQLASNSTQACRVLADPQGPFAACHQTVAPEPFQEHCVLDLCSAQDPREQEELRCQVLSGWAAAF

SEQ ID NO: 102393 - protein, 2689 aa, Homo sapiens
  Payload ID: 20406
  Gene Name: zonadhesin (gene/pseudogene)
  ENSP ID: ENSP00000444427
MVPPVWTLLLLVGAALFRKEKPPDQKLVVRSSRDNYVLTQCDFEDDAKPLCDWSQVSADDEDWVRASGPSPTGSTGAPGGYPNGEGSYLHMESNSFHRGGVARLLSPDLWEQGPLCVHFAHHMFGLSWGAQLRLLLLSGEEGRRPDVLWKHWNTQRPSWMLTTVTVPAGFTLPTRLMFEGTRGSTAYLDIALDALSIRRGSCNRVCMMQTCSFDIPNDLCDWTWIPTASGAKWTQKKGSSGKPGVGPDGDFSSPGSGCYMLLDPKNARPGQKAVLLSPVSLSSGCLSFSFHYILRGQSPGAALHIYASVLGSIRKHTLFSGQPGPNWQAVSVNYTAVGRIQFAVVGVFGKTPEPAVAVDATSIAPCGEGFPQCDFEDNAHPFCDWVQTSGDGGHWALGHKNGPVHGMGPAGGFPNAGGHYIYLEADEFSQAGQSVRLVSRPFCAPGDICVEFAYHMYGLGEGTMLELLLGSPAGSPPIPLWKRVGSQRPYWQNTSVTVPSGHQQPMQLIFKGIQGSNTASVVAMGFILINPGTCPVKVLPELPPVSPVSSTGPSETTGLTENPTISTKKPTVSIEKPSVTTEKPTVPKEKPTIPTEKPTISTEKPTIPSEKPNMPSEKPTIPSEKPTILTEKPTIPSEKPTIPSEKPTISTEKPTVPTEEPTTPTEETTTSMEEPVIPTEKPSIPTEKPSIPTEKPTISMEETIISTEKPTISPEKPTIPTEKPTIPTEKSTISPEKPTTPTEKPTIPTEKPTISPEKPTTPTEKPTISPEKLTIPTEKPTIPTEKPTIPTEKPTISTEEPTTPTEETTISTEKPSIPMEKPTLPTEETTTSVEETTISTEKLTIPMEKPTISTEKPTIPTEKPTISPEKLTIPTEKLTIPTEKPTIPIEETTISTEKLTIPTEKPTISPEKPTISTEKPTIPTEKPTIPTEETTISTEKLTIPTEKPTISPEKLTIPTEKPTISTEKPTIPTEKLTIPTEKPTIPTEKPTIPTEKLTALRPPHPSPTATGLAALVMSPHAPSTPMTSVILGTTTTSRSSTERCPPNARYESCACPASCKSPRPSCGPLCREGCVCNPGFLFSDNHCIQASSCNCFYNNDYYEPGAEWFSPNCTEHCRCWPGSRVECQISQCGTHTVCQLKNGQYGCHPYAGTATCLVYGDPHYVTFDGRHFGFMGKCTYILAQPCGNSTDPFFRVTAKNEEQGQEGVSCLSKVYVTLPESTVTLLKGRRTLVGGQQVTLPAIPSKGVFLGASGRFVELQTEFGLRVRWDGDQQLYVTVSSTYSGKLCGLCGNYDGNSDNDHLKLDGSPAGDKEELGNSWQTDQDEDQECQKYQVVNSPSCDSSLQSSMSGPGFCGRLVDTHGPFETCLLHVKAASFFDSCMLDMCGFQGLQHLLCTHMSTMTTTCQDAGHAVKPWREPHFCPMACPPNSKYSLCAKPCPDTCHSGFSGMFCSDRCVEACECNPGFVLSGLECIPRSQCGCLHPAGSYFKVGERWYKPGCKELCVCESNNRIRCQPWRCRAQEFCGQQDGIYGCHAQGAATCTASGDPHYLTFDGALHHFMGTCTYVLTRPCWSRSQDSYFVVSATNENRGGILEVSYIKAVHVTVFDLSISLLRGCKVMLNGHRVALPVWLAQGRVTIRLSSNLVLLYTNFGLQVRYDGSHLVEVTVPSSYGGQLCGLCGNYNNNSLDDNLRPDRKLAGDSMQLGAAWKLPESSEPGCFLVGGKPSSCQENSMADAWNKNCAILINPQGPFSQCHQVVPPQSSFASCVHGQCGTKGDTTALCRSLQAYASLCAQAGQAPAWRNRTFCPMRCPPGSSYSPCSSPCPDTCSSINNPRDCPKALPCAESCECQKGHILSGTSCVPLGQCGCTDPAGSYHPVGERWYTENTCTRLCTCSVHNNITCFQSTCKPNQICWALDGLLHCRASGVGVCQLPGESHYVSFDGSNHSIPDACTLVLVKVCHPAMALPFFKISAKHEKEEGGTEAFRLHEVYIDIYDAQVTLQKGHRVLINSKQVTLPAISQIPGVSVKSSSIYSIVNIKIGVQVKFDGNHLLEIEIPTTYYGKVCGMCGNFNDEEEDELMMPSDEVANSDSEFVNSWKDKDIDPSCQSLLVDEQQIPAEQQENPSGNCRAADLRRAREKCEAALRAPVWAQCASRIDLTPFLVDCANTLCEFGGLYQALCQALQAFGATCQSQGLKPPLWRNSSFCPLECPAYSSYTNCLPSCSPSCWDLDGRCEGAKVPSACAEGCICQPGYVLSEDKCVPRSQCGCKDAHGGSIPLGKSWVSSGCTEKCVCTGGAIQCGDFRCPSGSHCQLTSDNSNSNCVSDKSEQCSVYGDPRYLTFDGFSYRLQGRMTYVLIKTVDVLPEGVEPLLVEGRNKMDPPRSSIFLQEVITTVYGYKVQLQAGLELVVNNQKMAVPYRPNEHLRVTLWGQRLYLVTDFELVVSFGGRKNAVISLPSMYEGLVSGLCGNYDKNRKNDMMLPSGALTQNLNTFGNSWEVKTEDALLRFPRAIPAEEEGQGAELGLRTGLQVSECSPEQLASNSTQACRVLADPQGPFAACHQTVAPEPFQEHCVLDLCSAQDPREQEELRCQVLSGYAILCQEAGAALAGWRDRTLCAMECPAGTIYQSCMTPCPASCANLADPGDCEGPCVEGCASIPGYAYSGTQSLPWLTVAAPAMASTTSWAAAF

SEQ ID NO: 102394 - protein, 2624 aa, Homo sapiens
  Payload ID: 20406
  Gene Name: zonadhesin (gene/pseudogene)
  ENSP ID: ENSP00000445091
MVPPVWTLLLLVGAALFRKEKPPDQKLVVRSSRDNYVLTQCDFEDDAKPLCDWSQVSADDEDWVRASGPSPTGSTGAPGGYPNGEGSYLHMESNSFHRGGVARLLSPDLWEQGPLCVHFAHHMFGLSWGAQLRLLLLSGEEGRRPDVLWKHWNTQRPSWMLTTVTVPAGFTLPTRLMFEGTRGSTAYLDIALDALSIRRGSCNRVCMMQTCSFDIPNDLCDWTWIPTASGAKWTQKKGSSGKPGVGPDGDFSSPGSGCYMLLDPKNARPGQKAVLLSPVSLSSGCLSFSFHYILRGQSPGAALHIYASVLGSIRKHTLFSGQPGPNWQAVSVNYTAVGRIQFAVVGVFGKTPEPAVAVDATSIAPCGEGFPQCDFEDNAHPFCDWVQTSGDGGHWALGHKNGPVHGMGPAGGFPNAGGHYIYLEADEFSQAGQSVRLVSRPFCAPGDICVEFAYHMYGLGEGTMLELLLGSPAGSPPIPLWKRVGSQRPYWQNTSVTVPSGHQQPMQLIFKGIQGSNTASVVAMGFILINPGTCPVKVLPELPPVSPVSSTGPSETTGLTENPTISTKKPTVSIEKPSVTTEKPTVPKEKPTIPTEKPTISTEKPTIPSEKPNMPSEKPTIPSEKPTILTEKPTIPSEKPTIPSEKPTISTEKPTVPTEEPTTPTEETTTSMEEPVIPTEKPSIPTEKPSIPTEKPTISMEETIISTEKPTISPEKPTIPTEKPTIPTEKSTISPEKPTTPTEKPTIPTEKPTISPEKPTTPTEKPTISPEKLTIPTEKPTIPTEKPTIPTEKPTISTEEPTTPTEETTISTEKPSIPMEKPTLPTEETTTSVEETTISTEKLTIPMEKPTISTEKPTIPTEKPTISPEKLTIPTEKLTIPTEKPTIPIEETTISTEKLTIPTEKPTISPEKPTISTEKPTIPTEKPTIPTEETTISTEKLTIPTEKPTISPEKLTIPTEKPTISTEKPTIPTEKLTIPTEKPTIPTEKPTIPTEKLTALRPPHPSPTATGLAALVMSPHAPSTPMTSVILGTTTTSRSSTERCPPNARYESCACPASCKSPRPSCGPLCREGCVCNPGFLFSDNHCIQASSCNCFYNNDYYEPGAEWFSPNCTEHCRCWPGSRVECQISQCGTHTVCQLKNGQYGCHPYAGTATCLVYGDPHYVTFDGRHFGFMGKCTYILAQPCGNSTDPFFRVTAKNEEQGQEGVSCLSKVYVTLPESTVTLLKGRRTLVGGQQVTLPAIPSKGVFLGASGRFVELQTEFGLRVRWDGDQQLYVTVSSTYSGKLCGLCGNYDGNSDNDHLKLDGSPAGDKEELGNSWQTDQDEDQECQKYQVVNSPSCDSSLQSSMSGPGFCGRLVDTHGPFETCLLHVKAASFFDSCMLDMCGFQGLQHLLCTHMSTMTTTCQDAGHAVKPWREPHFCPMACPPNSKYSLCAKPCPDTCHSGFSGMFCSDRCVEACECNPGFVLSGLECIPRSQCGCLHPAGSYFKVGERWYKPGCKELCVCESNNRIRCQPWRCRAQEFCGQQDGIYGCHAQGAATCTASGDPHYLTFDGALHHFMGTCTYVLTRPCWSRSQDSYFVVSATNENRGGILEVSYIKAVHVTVFDLSISLLRGCKVMLNGHRVALPVWLAQGRVTIRLSSNLVLLYTNFGLQVRYDGSHLVEVTVPSSYGGQLCGLCGNYNNNSLDDNLRPDRKLAGDSMQLGAAWKLPESSEPGCFLVGGKPSSCQENSMADAWNKNCAILINPQGPFSQCHQVVPPQSSFASCVHGQCGTKGDTTALCRSLQAYASLCAQAGQAPAWRNRTFCPMRCPPGSSYSPCSSPCPDTCSSINNPRDCPKALPCAESCECQKGHILSGTSCVPLGQCGCTDPAGSYHPVGERWYTENTCTRLCTCSVHNNITCFQSTCKPNQICWALDGLLHCRASGVGVCQLPGESHYVSFDGSNHSIPDACTLVLVKVCHPAMALPFFKISAKHEKEEGGTEAFRLHEVYIDIYDAQVTLQKGHRVLINSKQVTLPAISQIPGVSVKSSSIYSIVNIKIGVQVKFDGNHLLEIEIPTTYYGKVCGMCGNFNDEEEDELMMPSDEVANSDSEFVNSWKDKDIDPSCQSLLVDEQQIPAEQQENPSGNCRAADLRRAREKCEAALRAPVWAQCASRIDLTPFLVDCANTLCEFGGLYQALCQALQAFGATCQSQGLKPPLWRNSSFCPLECPAYSSYTNCLPSCSPSCWDLDGRCEGAKVPSACAEGCICQPGYVLSEDKCVPRSQCGCKDAHGGSIPLGKSWVSSGCTEKCVCTGGAIQCGDFRCPSGSHCQLTSDNSNSNCVSDKSEQCSVYGDPRYLTFDGFSYRLQGRMTYVLIKTVDVLPEGVEPLLVEGRNKMDPPRSSIFLQEVITTVYGYKVQLQAGLELVVNNQKMAVPYRPNEHLRVTLWGQRLYLVTDFELVVSFGGRKNAVISLPSMYEGLVSGLCGNYDKNRKNDMMLPSGALTQNLNTFGNSWEVKTEDALLRFPRAIPAEEEGQGAELGLRTGLQVSECSPEQLASNSTQACRVLADPQGPFAACHQTVAPEPFQEHCVLDLCSAQDPREQEELRCQVLSGYAILCQEAGAALAGWRDRTLCAGQQLSD

SEQ ID NO: 102395 - protein, 2721 aa, Homo sapiens
  Payload ID: 20406
  Gene Name: zonadhesin (gene/pseudogene)
  ENSP ID: ENSP00000445943
MVPPVWTLLLLVGAALFRKEKPPDQKLVVRSSRDNYVLTQCDFEDDAKPLCDWSQVSADDEDWVRASGPSPTGSTGAPGGYPNGEGSYLHMESNSFHRGGVARLLSPDLWEQGPLCVHFAHHMFGLSWGAQLRLLLLSGEEGRRPDVLWKHWNTQRPSWMLTTVTVPAGFTLPTRLMFEGTRGSTAYLDIALDALSIRRGSCNRVCMMQTCSFDIPNDLCDWTWIPTASGAKWTQKKGSSGKPGVGPDGDFSSPGSGCYMLLDPKNARPGQKAVLLSPVSLSSGCLSFSFHYILRGQSPGAALHIYASVLGSIRKHTLFSGQPGPNWQAVSVNYTAVGRIQFAVVGVFGKTPEPAVAVDATSIAPCGEGFPQCDFEDNAHPFCDWVQTSGDGGHWALGHKNGPVHGMGPAGGFPNAGGHYIYLEADEFSQAGQSVRLVSRPFCAPGDICVEFAYHMYGLGEGTMLELLLGSPAGSPPIPLWKRVGSQRPYWQNTSVTVPSGHQQPMQLIFKGIQGSNTASVVAMGFILINPGTCPVKVLPELPPVSPVSSTGPSETTGLTENPTISTKKPTVSIEKPSVTTEKPTVPKEKPTIPTEKPTISTEKPTIPSEKPNMPSEKPTIPSEKPTILTEKPTIPSEKPTIPSEKPTISTEKPTVPTEEPTTPTEETTTSMEEPVIPTEKPSIPTEKPSIPTEKPTISMEETIISTEKPTISPEKPTIPTEKPTIPTEKSTISPEKPTTPTEKPTIPTEKPTISPEKPTTPTEKPTISPEKLTIPTEKPTIPTEKPTIPTEKPTISTEEPTTPTEETTISTEKPSIPMEKPTLPTEETTTSVEETTISTEKLTIPMEKPTISTEKPTIPTEKPTISPEKLTIPTEKLTIPTEKPTIPIEETTISTEKLTIPTEKPTISPEKPTISTEKPTIPTEKPTIPTEETTISTEKLTIPTEKPTISPEKLTIPTEKPTISTEKPTIPTEKLTIPTEKPTIPTEKPTIPTEKLTALRPPHPSPTATGLAALVMSPHAPSTPMTSVILGTTTTSRSSTERCPPNARYESCACPASCKSPRPSCGPLCREGCVCNPGFLFSDNHCIQASSCNCFYNNDYYEPGAEWFSPNCTEHCRCWPGSRVECQISQCGTHTVCQLKNGQYGCHPYAGTATCLVYGDPHYVTFDGRHFGFMGKCTYILAQPCGNSTDPFFRVTAKNEEQGQEGVSCLSKVYVTLPESTVTLLKGRRTLVGGQQVTLPAIPSKGVFLGASGRFVELQTEFGLRVRWDGDQQLYVTVSSTYSGKLCGLCGNYDGNSDNDHLKLDGSPAGDKEELGNSWQTDQDEDQECQKYQVVNSPSCDSSLQSSMSGPGFCGRLVDTHGPFETCLLHVKAASFFDSCMLDMCGFQGLQHLLCTHMSTMTTTCQDAGHAVKPWREPHFCPMACPPNSKYSLCAKPCPDTCHSGFSGMFCSDRCVEACECNPGFVLSGLECIPRSQCGCLHPAGSYFKVGERWYKPGCKELCVCESNNRIRCQPWRCRAQEFCGQQDGIYGCHAQGAATCTASGDPHYLTFDGALHHFMGTCTYVLTRPCWSRSQDSYFVVSATNENRGGILEVSYIKAVHVTVFDLSISLLRGCKVMLNGHRVALPVWLAQGRVTIRLSSNLVLLYTNFGLQVRYDGSHLVEVTVPSSYGGQLCGLCGNYNNNSLDDNLRPDRKLAGDSMQLGAAWKLPESSEPGCFLVGGKPSSCQENSMADAWNKNCAILINPQGPFSQCHQVVPPQSSFASCVHGQCGTKGDTTALCRSLQAYASLCAQAGQAPAWRNRTFCPMRCPPGSSYSPCSSPCPDTCSSINNPRDCPKALPCAESCECQKGHILSGTSCVPLGQCGCTDPAGSYHPVGERWYTENTCTRLCTCSVHNNITCFQSTCKPNQICWALDGLLHCRASGVGVCQLPGESHYVSFDGSNHSIPDACTLVLVKVCHPAMALPFFKISAKHEKEEGGTEAFRLHEVYIDIYDAQVTLQKGHRVLINSKQVTLPAISQIPGVSVKSSSIYSIVNIKIGVQVKFDGNHLLEIEIPTTYYGKVCGMCGNFNDEEEDELMMPSDEVANSDSEFVNSWKDKDIDPSCQSLLVDEQQIPAEQQENPSGNCRAADLRRAREKCEAALRAPVWAQCASRIDLTPFLVDCANTLCEFGGLYQALCQALQAFGATCQSQGLKPPLWRNSSFCPLECPAYSSYTNCLPSCSPSCWDLDGRCEGAKVPSACAEGCICQPGYVLSEDKCVPRSQCGCKDAHGGSIPLGKSWVSSGCTEKCVCTGGAIQCGDFRCPSGSHCQLTSDNSNSNCVSDKSEQCSVYGDPRYLTFDGFSYRLQGRMTYVLIKTVDVLPEGVEPLLVEGRNKMDPPRSSIFLQEVITTVYGYKVQLQAGLELVVNNQKMAVPYRPNEHLRVTLWGQRLYLVTDFELVVSFGGRKNAVISLPSMYEGLVSGLCGNYDKNRKNDMMLPSGALTQNLNTFGNSWEVKTEDALLRFPRAIPAEEEGQGAELGLRTGLQVSECSPEQLASNSTQACRVLADPQGPFAACHQTVAPEPFQEHCVLDLCSAQDPREQEELRCQVLSGYAILCQEAGAALAGWRDRTLCESPCLQNPCQNDGQCREQGATFTCECEVGYGGGLCMEPRDAPPPRKPASNLVGVLLGLLVPVVVVLLAVTRECIYRTRRKREKTQEGDRLARLVDTDTVLDCAC

SEQ ID NO: 102396 - protein, 2812 aa, Homo sapiens
  Payload ID: 20406
  Gene Name: zonadhesin (gene/pseudogene)
  ENSP ID: ENSP00000478371
MVPPVWTLLLLVGAALFRKEKPPDQKLVVRSSRDNYVLTQCDFEDDAKPLCDWSQVSADDEDWVRASGPSPTGSTGAPGGYPNGEGSYLHMESNSFHRGGVARLLSPDLWEQGPLCVHFAHHMFGLSWGAQLRLLLLSGEEGRRPDVLWKHWNTQRPSWMLTTVTVPAGFTLPTRLMFEGTRGSTAYLDIALDALSIRRGSCNRVCMMQTCSFDIPNDLCDWTWIPTASGAKWTQKKGSSGKPGVGPDGDFSSPGSGCYMLLDPKNARPGQKAVLLSPVSLSSGCLSFSFHYILRGQSPGAALHIYASVLGSIRKHTLFSGQPGPNWQAVSVNYTAVGRIQFAVVGVFGKTPEPAVAVDATSIAPCGEGFPQCDFEDNAHPFCDWVQTSGDGGHWALGHKNGPVHGMGPAGGFPNAGGHYIYLEADEFSQAGQSVRLVSRPFCAPGDICVEFAYHMYGLGEGTMLELLLGSPAGSPPIPLWKRVGSQRPYWQNTSVTVPSGHQQPMQLIFKGIQGSNTASVVAMGFILINPGTCPVKVLPELPPVSPVSSTGPSETTGLTENPTISTKKPTVSIEKPSVTTEKPTVPKEKPTIPTEKPTISTEKPTIPSEKPNMPSEKPTIPSEKPTILTEKPTIPSEKPTIPSEKPTISTEKPTVPTEEPTTPTEETTTSMEEPVIPTEKPSIPTEKPSIPTEKPTISMEETIISTEKPTISPEKPTIPTEKPTIPTEKSTISPEKPTTPTEKPTIPTEKPTISPEKPTTPTEKPTISPEKLTIPTEKPTIPTEKPTIPTEKPTISTEEPTTPTEETTISTEKPSIPMEKPTLPTEETTTSVEETTISTEKLTIPMEKPTISTEKPTIPTEKPTISPEKLTIPTEKLTIPTEKPTIPIEETTISTEKLTIPTEKPTISPEKPTISTEKPTIPTEKPTIPTEETTISTEKLTIPTEKPTISPEKLTIPTEKPTISTEKPTIPTEKLTIPTEKPTIPTEKPTIPTEKLTALRPPHPSPTATGLAALVMSPHAPSTPMTSVILGTTTTSRSSTERCPPNARYESCACPASCKSPRPSCGPLCREGCVCNPGFLFSDNHCIQASSCNCFYNNDYYEPGAEWFSPNCTEHCRCWPGSRVECQISQCGTHTVCQLKNGQYGCHPYAGTATCLVYGDPHYVTFDGRHFGFMGKCTYILAQPCGNSTDPFFRVTAKNEEQGQEGVSCLSKVYVTLPESTVTLLKGRRTLVGGQQVTLPAIPSKGVFLGASGRFVELQTEFGLRVRWDGDQQLYVTVSSTYSGKLCGLCGNYDGNSDNDHLKLDGSPAGDKEELGNSWQTDQDEDQECQKYQVVNSPSCDSSLQSSMSGPGFCGRLVDTHGPFETCLLHVKAASFFDSCMLDMCGFQGLQHLLCTHMSTMTTTCQDAGHAVKPWREPHFCPMACPPNSKYSLCAKPCPDTCHSGFSGMFCSDRCVEACECNPGFVLSGLECIPRSQCGCLHPAGSYFKVGERWYKPGCKELCVCESNNRIRCQPWRCRAQEFCGQQDGIYGCHAQGAATCTASGDPHYLTFDGALHHFMGTCTYVLTRPCWSRSQDSYFVVSATNENRGGILEVSYIKAVHVTVFDLSISLLRGCKVMLNGHRVALPVWLAQGRVTIRLSSNLVLLYTNFGLQVRYDGSHLVEVTVPSSYGGQLCGLCGNYNNNSLDDNLRPDRKLAGDSMQLGAAWKLPESSEPGCFLVGGKPSSCQENSMADAWNKNCAILINPQGPFSQCHQVVPPQSSFASCVHGQCGTKGDTTALCRSLQAYASLCAQAGQAPAWRNRTFCPMRCPPGSSYSPCSSPCPDTCSSINNPRDCPKALPCAESCECQKGHILSGTSCVPLGQCGCTDPAGSYHPVGERWYTENTCTRLCTCSVHNNITCFQSTCKPNQICWALDGLLHCRASGVGVCQLPGESHYVSFDGSNHSIPDACTLVLVKVCHPAMALPFFKISAKHEKEEGGTEAFRLHEVYIDIYDAQVTLQKGHRVLINSKQVTLPAISQIPGVSVKSSSIYSIVNIKIGVQVKFDGNHLLEIEIPTTYYGKVCGMCGNFNDEEEDELMMPSDEVANSDSEFVNSWKDKDIDPSCQSLLVDEQQIPAEQQENPSGNCRAADLRRAREKCEAALRAPVWAQCASRIDLTPFLVDCANTLCEFGGLYQALCQALQAFGATCQSQGLKPPLWRNSSFCPLECPAYSSYTNCLPSCSPSCWDLDGRCEGAKVPSACAEGCICQPGYVLSEDKCVPRSQCGCKDAHGGSIPLGKSWVSSGCTEKCVCTGGAIQCGDFRCPSGSHCQLTSDNSNSNCVSDKSEQCSVYGDPRYLTFDGFSYRLQGRMTYVLIKTVDVLPEGVEPLLVEGRNKMDPPRSSIFLQEVITTVYGYKVQLQAGLELVVNNQKMAVPYRPNEHLRVTLWGQRLYLVTDFELVVSFGGRKNAVISLPSMYEGLVSGLCGNYDKNRKNDMMLPSGALTQNLNTFGNSWEVKTEDALLRFPRAIPAEEEGQGAELGLRTGLQVSECSPEQLASNSTQACRVLADPQGPFAACHQTVAPEPFQEHCVLDLCSAQDPREQEELRCQVLSGHGVSSRYHISELYDTLPSILCQPGRPRGLRGPLRGRLRQHPRLCLQWHPEPPLADCGCTSNGIYYQLGSSFLTEDCSQRCTCASSRILLCEPFSCRAGEVCTLGNHTQGCFPESPCLQNPCQNDGQCREQGATFTCECEVGYGGGLCMEPRDAPPPRKPASNLVGVLLGLLVPVVVVLLAVTRECIYRTRRKREKTQEGDRLARLVDTDTVLDCAC

SEQ ID NO: 102397 - protein, 2812 aa, Homo sapiens; identical to SEQ ID NO: 102396
  Payload ID: 20406
  Gene Name: zonadhesin (gene/pseudogene)
  ENSP ID: ENSP00000480750

SEQ ID NO: 102398 - protein, 2721 aa, Homo sapiens; identical to SEQ ID NO: 102395
  Payload ID: 20406
  Gene Name: zonadhesin (gene/pseudogene)
  ENSP ID: ENSP00000481742

SEQ ID NO: 102399 - protein, 459 aa, Homo sapiens
  Payload ID: 20407
  Gene Name: ZPR1 zinc finger
  Uniprot ID: O75312
  ENSP ID: ENSP00000227322
MAASGAVEPGPPGAAVAPSPAPAPPPAPDHLFRPISAEDEEQQPTEIESLCMNCYCNGMTRLLLTKIPFFREIIVSSFSCEHCGWNNTEIQSAGRIQDQGVRYTLSVRALEDMNREVVKTDSAATRIPELDFEIPAFSQKGALTTVEGLITRAISGLEQDQPARRANKDATAERIDEFIVKLKELKQVASPFTLIIDDPSGNSFVENPHAPQKDDALVITHYNRTRQQEEMLGLQEEAPAEKPEEEDLRNEVLQFSTNCPECNAPAQTNMKLVQIPHFKEVIIMATNCENCGHRTNEVKSGGAVEPLGTRITLHITDASDMTRDLLKSETCSVEIPELEFELGMAVLGGKFTTLEGLLKDIRELVTKNPFTLGDSSNPGQTERLQEFSQKMDQIIEGNMKAHFIMDDPAGNSYLQNVYAPEDDPEMKVERYKRTFDQNEELGLNDMKTEGYEAGLAPQR

SEQ ID NO: 102400 - protein, 430 aa, Homo sapiens
  Payload ID: 20407
  Gene Name: ZPR1 zinc finger
  ENSP ID: ENSP00000390391
  MOD_RES (1)..(1): Any amino acid
XAASGAVEPGPPGAAVAPSPAPAPPPAPDHLFRPISAEDEEQQPTEIESLCMNCYCNGMTRLLLTKIPFFREIIVSSFSCEHCGWNNTEIQSAGRIQDQGVRYTLSVRALEDMNREVVKTDSAATRIPELDFEIPAFSQKGALTTVEGLITRAISGLEQDQPARRANKDATAERIDEFIVKLKELKQVASPFTLIIDDPSGNSFVENPHAPQKDDALVITHYNRTRQQEEMLGLQEEAPAEKPEEEDLRNEVLQFSTNCPECNAPAQTNMKLVQIPHFKEVIIMATNCENCGHRTNEVKSGGAVEPLGTRITLHITDASDMTRDLLKSETCSVEIPELEFELGMAVLGGKFTTLEGLLKDIRELIIEGNMKAHFIMDDPAGNSYLQNVYAPEDDPEMKVERYKRTFDQNEELGLNDMKTEGYEAGLAPQR

SEQ ID NO: 102401 - protein, 76 aa, Homo sapiens
  Payload ID: 20407
  Gene Name: ZPR1 zinc finger
  ENSP ID: ENSP00000391077
  MOD_RES (1)..(1): Any amino acid
XFRPISAEDEEQQPTEIESLCMNCYCNRNNSELLFLRALWLEQHGDPVGRQDPGPGSALHFVCQGSGGHEQRSGED

SEQ ID NO: 102402 - protein, 386 aa, Homo sapiens
  Payload ID: 20407
  Gene Name: ZPR1 zinc finger
  ENSP ID: ENSP00000394495
  MOD_RES (1)..(1): Any amino acid
XGAVEPGPPGAAVAPSPAPAPPPAPDHLFRPISAEDEEQQPTEIESLCMNCYCNDMNREVVKTDSAATRIPELDFEIPAFSQKGALTTVEGLITRAISGLEQDQPARRANKDATAERIDEFIVKLKELKQVASPFTLIIDDPSGNSFVENPHAPQKDDALVITHYNRTRQQEEMLGLQVLQFSTNCPECNAPAQTNMKLVQIPHFKEVIIMATNCENCGHRTNEVKSGGAVEPLGTRITLHITDASDMTRDLLKSETCSVEIPELEFELGMAVLGGKFTTLEGLLKDIRELVTKNPFTLGDSSNPGQTERLQEFSQKMDQIIEGNMKAHFIMDDPAGNSYLQNVYAPEDDPEMKVERYKRTFDQNEELGLNDMKTEGYEAGLAPQR

SEQ ID NO: 102403 - protein, 49 aa, Homo sapiens
  Payload ID: 20407
  Gene Name: ZPR1 zinc finger
  ENSP ID: ENSP00000410141
MAASGAVEPGPPGAAVAPSPAPAPPPAPDHLFRPISAEDEEQQPTEIEA

SEQ ID NO: 102404 - protein, 102 aa, Homo sapiens
  Payload ID: 20407
  Gene Name: ZPR1 zinc finger
  ENSP ID: ENSP00000415505
IVKLKELKQVASPFTLIIDDPSGNSFVENPHAPQKDDALVITHYNRTRQQEEMLGLQEEAPAEKPEEEDLRNEVLQFSTNCPECNAPAQTNMKLMVVLFAWK

SEQ ID NO: 102405 - protein, 157 aa, Homo sapiens
  Payload ID: 20408
  Gene Name: ZW10 interacting kinetochore protein
  ENSP ID: ENSP00000322850
MEEAQRKRTQLREAFEQLQAKKQMAMEKRRAVQNQWQLQQEKHLQHLAEVSAEVRERKTGTQQELDRVFQKLGNLKQQAEQERDKLQRYQTFLQLLYTLQGKLLFPEAEAEAENLPDDKPQQPTRPQEQSTGDTMGRDPGVSFKAVGLQPAGDVNLP

SEQ ID NO: 102406 - protein, 230 aa, Homo sapiens
  Payload ID: 20408
  Gene Name: ZW10 interacting kinetochore protein
  Uniprot ID: O95229
  ENSP ID: ENSP00000354921
MEAAETEAEAAALEVLAEVAGILEPVGLQEEAELPAKILVEFVVDSQKKDKLLCSQLQVADFLQNILAQEDTAKGLDPLASEDTSRQKAIAAKEQWKELKATYREHVEAIKIGLTKALTQMEEAQRKRTQLREAFEQLQAKKQMAMEKRRAVQNQWQLQQEKHLQHLAEVSAEGKLLFPEAEAEAENLPDDKPQQPTRPQEQSTGDTMGRDPGVSFKAVGLQPAGDVNLP

SEQ ID NO: 102407 - protein, 277 aa, Homo sapiens
  Payload ID: 20408
  Gene Name: ZW10 interacting kinetochore protein
  Uniprot ID: O95229
  ENSP ID: ENSP00000363055
MEAAETEAEAAALEVLAEVAGILEPVGLQEEAELPAKILVEFVVDSQKKDKLLCSQLQVADFLQNILAQEDTAKGLDPLASEDTSRQKAIAAKEQWKELKATYREHVEAIKIGLTKALTQMEEAQRKRTQLREAFEQLQAKKQMAMEKRRAVQNQWQLQQEKHLQHLAEVSAEVRERKTGTQQELDRVFQKLGNLKQQAEQERDKLQRYQTFLQLLYTLQGKLLFPEAEAEAENLPDDKPQQPTRPQEQSTGDTMGRDPGVSFKAVGLQPAGDVNLP

SEQ ID NO: 102408 - protein, 277 aa, Homo sapiens; identical to SEQ ID NO: 102407
  Payload ID: 20408
  Gene Name: ZW10 interacting kinetochore protein
  Uniprot ID: O95229
  ENSP ID: ENSP00000378801

SEQ ID NO: 102409 - protein, 48 aa, Homo sapiens
  Payload ID: 20408
  Gene Name: ZW10 interacting kinetochore protein
  ENSP ID: ENSP00000473330
MEAAETEAEAAALEVLAEVAGILEPVGLQEEAELPAKILVEFVVVCTR

SEQ ID NO: 102410 - protein, 779 aa, Homo sapiens
  Payload ID: 20409
  Gene Name: zw10 kinetochore protein
  Uniprot ID: O43264
  ENSP ID: ENSP00000200135
MASFVTEVLAHSGRLEKEDLGTRISRLTRRVEEIKGEVCNMISKKYSEFLPSMQSAQGLITQVDKLSEDIDLLKSRIESEVRRDLHVSTGEFTDLKQQLERDSVVLSLLKQLQEFSTAIEEYNCALTEKKYVTGAQRLEEAQKCLKLLKSRKCFDLKILKSLSMELTIQKQNILYHLGEEWQKLIVWKFPPSKDTSSLESYLQTELHLYTEQSHKEEKTPMPPISSVLLAFSVLGELHSKLKSFGQMLLKYILRPLASCPSLHAVIESQPNIVIIRFESIMTNLEYPSPSEVFTKIRLVLEVLQKQLLDLPLDTDLENEKTSTVPLAEMLGDMIWEDLSECLIKNCLVYSIPTNSSKLQQYEEIIQSTEEFENALKEMRFLKGDTTDLLKYARNINSHFANKKCQDVIVAARNLMTSEIHNTVKIIPDSKINVPELPTPDEDNKLEVQKVSNTQYHEVMNLEPENTLDQHSFSLPTCRISESVKKLMELAYQTLLEATTSSDQCAVQLFYSVRNIFHLFHDVVPTYHKENLQKLPQLAAIHHNNCMYIAHHLLTLGHQFRLRLAPILCDGTATFVDLVPGFRRLGTECFLAQMRAQKGELLERLSSARNFSNMDDEENYSAASKAVRQVLHQLKRLGIVWQDVLPVNIYCKAMGTLLNTAISEVIGKITALEDISTEDGDRLYSLCKTVMDEGPQVFAPLSEESKNKKYQEEVPVYVPKWMPFKELMMMLQASLQEIGDRWADGKGPLAAAFSSSEVKALIRALFQNTERRAAALAKIK

SEQ ID NO: 102411 - protein, 135 aa, Homo sapiens
  Payload ID: 20409
  Gene Name: zw10 kinetochore protein
  ENSP ID: ENSP00000439197
MASFVTEVLAHSGRLEKEDLGTRISRLTRRVEEIKGEVCNMISKKYSEFLPSMQSAQGLITQVDKLSEDIDLLKSRIESEIPAVWNLTYKLNFIYTLNNRTKRRRPLCHPSVLSSWHFLFLENYTASLNHLVRCC

SEQ ID NO: 102412 - protein, 672 aa, Homo sapiens
  Payload ID: 20409
  Gene Name: zw10 kinetochore protein
  Uniprot ID: O43264
  ENSP ID: ENSP00000440879
MASFVTEVLAHSGRLEKEDLGTRISRLTRRVEEIKGEVCNMISKKYSEFLPSMQSAQGLITQVDKLSEDIDLLKSRIESEVRRDLHVSTGEFTDLKQQLERDSVVLSLLKQLQEFSTAIEEYNCALTEKKYVTGAQRLEEAQKCLKLLKSRKCFDLKILKSLSMELTIQKQNILYHLGEEWQKLIVWKFPPSKDTSSLESYLQTELHLYTEQSHKEEKTPMPPISSVLLAFSVLGELHSKLKSFGQMLLKYILRPLASCPSLHAVIESQPNIVIIRFESIMTNLEYPSPSEVFTKIRLVLEVLQKQLLDLPLDTDLENEKTSTVPLAEMLGDMIWEDLSECLIKNCLVYSIPTNSSKLQQYEEIIQSTEEFENALKEMRFLKGDTTDLLKYARNINSHFANKKCQDVIVAARNLMTSEIHNTVKIIPDSKINVPELPTPDEDNKLEVQKVSNTQYHEVMNLEPENTLDQHSFSLPTCRISESVKKLMELAYQTLLEATTSSDQCAVQLFYSVRNIFHLFHDVVPTYHKENLQKLPQLAAIHHNNCMYIAHHLLTLGHQFRLRLAPILCDGTATFVDLVPGFRRLGTECFLAQMRAQKGELLERLSSARNFSNMDDEENYSAASKAVRQVLHQLKRLGIVWQDVLPVNIYCKAMGTLLNTAISEVIGKITALE

SEQ ID NO: 102413 - protein, 591 aa, Homo sapiens
  Payload ID: 20410
  Gene Name: zwilch kinetochore protein
  Uniprot ID: Q9H900
  ENSP ID: ENSP00000311429
MWERLNCAAEDFYSRLLQKFNEEKKGIRKDPFLYEADVQVQLISKGQPNPLKNILNENDIVFIVEKVPLEKEETSHIEELQSEETAISDFSTGENVGPLALPVGKARQLIGLYTMAHNPNMTHLKINLPVTALPPLWVRCDSSDPEGTCWLGAELITTNNSITGIVLYVVSCKADKNYSVNLENLKNLHKKRHHLSTVTSKGFAQYELFKSSALDDTITASQTAIALDISWSPVDEILQIPPLSSTATLNIKVESGEPRGPLNHLYRELKFLLVLADGLRTGVTEWLEPLEAKSAVELVQEFLNDLNKLDGFGDSTKKDTEVETLKHDTAAVDRSVKRLFKVRSDLDFAEQLWCKMSSSVISYQDLVKCFTLIIQSLQRGDIQPWLHSGSNSLLSKLIHQSYHGTMDTVSLSGTIPVQMLLEIGLDKLKKDYISFFIGQELASLNHLEYFIAPSVDIQEQVYRVQKLHHILEILVSCMPFIKSQHELLFSLTQICIKYYKQNPLDEQHIFQLPVRPTAVKNLYQSEKPQKWRVEIYSGQKKIKTVWQLSDSSPIDHLNFHKPDFSELTLNGSLEERIFFTNMVTCSQVHFK

SEQ ID NO: 102414 - protein, 477 aa, Homo sapiens
  Payload ID: 20410
  Gene Name: zwilch kinetochore protein
  Uniprot ID: Q9H900
  ENSP ID: ENSP00000402217
MAHNPNMTHLKINLPVTALPPLWVRCDSSDPEGTCWLGAELITTNNSITGIVLYVVSCKADKNYSVNLENLKNLHKKRHHLSTVTSKGFAQYELFKSSALDDTITASQTAIALDISWSPVDEILQIPPLSSTATLNIKVESGEPRGPLNHLYRELKFLLVLADGLRTGVTEWLEPLEAKSAVELVQEFLNDLNKLDGFGDSTKKDTEVETLKHDTAAVDRSVKRLFKVRSDLDFAEQLWCKMSSSVISYQDLVKCFTLIIQSLQRGDIQPWLHSGSNSLLSKLIHQSYHGTMDTVSLSGTIPVQMLLEIGLDKLKKDYISFFIGQELASLNHLEYFIAPSVDIQEQVYRVQKLHHILEILVSCMPFIKSQHELLFSLTQICIKYYKQNPLDEQHIFQLPVRPTAVKNLYQSEKPQKWRVEIYSGQKKIKTVWQLSDSSPIDHLNFHKPDFSELTLNGSLEERIFFTNMVTCSQVHFK

SEQ ID NO: 102415 - protein, 477 aa, Homo sapiens; identical to SEQ ID NO: 102414
  Payload ID: 20410
  Gene Name: zwilch kinetochore protein
  Uniprot ID: Q9H900
  ENSP ID: ENSP00000437749

SEQ ID NO: 102416 - protein, 477 aa, Homo sapiens; identical to SEQ ID NO: 102414
  Payload ID: 20410
  Gene Name: zwilch kinetochore protein
  Uniprot ID: Q9H900
  ENSP ID: ENSP00000454737

SEQ ID NO: 102417 - protein, 48 aa, Homo sapiens
  Payload ID: 20410
  Gene Name: zwilch kinetochore protein
  ENSP ID: ENSP00000455336
TVWQLSDSSPIDHLNFHKPDFSELTLNGSLEERIFFTNMVTCSQVHFK

SEQ ID NO: 102418 - protein, 98 aa, Homo sapiens
  Payload ID: 20410
  Gene Name: zwilch kinetochore protein
  ENSP ID: ENSP00000455548
ICIKYYKQNPLDEQHIFQLPVRPTAVKNLYQSEKPQKWRVEIYSGQKKIKTVWQLSDSSPIDHLNFHKPDFSELTLNGSLEERIFFTNMVTCSQVHFK

SEQ ID NO: 102419 - protein, 84 aa, Homo sapiens
  Payload ID: 20410
  Gene Name: zwilch kinetochore protein
  ENSP ID: ENSP00000456689
MAHNPNMTHLKINLPVTALPPLWVRCDSSDPEGTCWLGAELITTNNSITGIVLYVVSCKADKNYSVNLENLKNLHKKRHHLSTV

SEQ ID NO: 102420 - protein, 477 aa, Homo sapiens; identical to SEQ ID NO: 102414
  Payload ID: 20410
  Gene Name: zwilch kinetochore protein
  Uniprot ID: Q9H900
  ENSP ID: ENSP00000477955

SEQ ID NO: 102421 - protein, 710 aa, Homo sapiens
  Payload ID: 20411
  Gene Name: ZXD family zinc finger C
  Uniprot ID: Q2QGD7
  ENSP ID: ENSP00000337694
MDLPALLPAPTARGGQHGGGPGPLRRAPAPLGASPARRRLLLVRGPEDGGPGARPGEASGPSPPPAEDDSDGDSFLVLLEVPHGGAAAEAAGSQEAEPGSRVNLASRPEQGPSGPAAPPGPGVAPAGAVTISSQDLLVRLDRGVLALSAPPGPATAGAAAPRRAPQASGPSTPGYRCPEPQCALAFAKKHQLKVHLLTHGGGQGRRPFKCPLEGCGWAFTTSYKLKRHLQSHDKLRPFGCPVGGCGKKFTTVYNLKAHMKGHEQESLFKCEVCAERFPTHAKLSSHQRSHFEPERPYKCDFPGCEKTFITVSALFSHNRAHFREQELFSCSFPGCSKQYDKACRLKIHLRSHTGERPFICDSDSCGWTFTSMSKLLRHRRKHDDDRRFTCPVEGCGKSFTRAEHLKGHSITHLGTKPFECPVEGCCARFSARSSLYIHSKKHVQDVGAPKSRCPVSTCNRLFTSKHSMKAHMVRQHSRRQDLLPQLEAPSSLTPSSELSSPGQSELTNMDLAALFSDTPANASGSAGGSDEALNSGILTIDVTSVSSSLGGNLPANNSSLGPMEPLVLVAHSDIPPSLDSPLVLGTAATVLQQGSFSVDDVQTVSAGALGCLVALPMKNLSDDPLALTSNSNLAAHITTPTSSSTPRENASVPELLAPIKVEPDSPSRPGAVGQQEGSHGLPQSTLPSPAEQHGAQDTELSAGTGNFYLV

SEQ ID NO: 102422 - protein, 858 aa, Homo sapiens
  Payload ID: 20411
  Gene Name: ZXD family zinc finger C
  Uniprot ID: Q2QGD7
  ENSP ID: ENSP00000374359
MDLPALLPAPTARGGQHGGGPGPLRRAPAPLGASPARRRLLLVRGPEDGGPGARPGEASGPSPPPAEDDSDGDSFLVLLEVPHGGAAAEAAGSQEAEPGSRVNLASRPEQGPSGPAAPPGPGVAPAGAVTISSQDLLVRLDRGVLALSAPPGPATAGAAAPRRAPQASGPSTPGYRCPEPQCALAFAKKHQLKVHLLTHGGGQGRRPFKCPLEGCGWAFTTSYKLKRHLQSHDKLRPFGCPVGGCGKKFTTVYNLKAHMKGHEQESLFKCEVCAERFPTHAKLSSHQRSHFEPERPYKCDFPGCEKTFITVSALFSHNRAHFREQELFSCSFPGCSKQYDKACRLKIHLRSHTGERPFICDSDSCGWTFTSMSKLLRHRRKHDDDRRFTCPVEGCGKSFTRAEHLKGHSITHLGTKPFECPVEGCCARFSARSSLYIHSKKHVQDVGAPKSRCPVSTCNRLFTSKHSMKAHMVRQHSRRQDLLPQLEAPSSLTPSSELSSPGQSELTNMDLAALFSDTPANASGSAGGSDEALNSGILTIDVTSVSSSLGGNLPANNSSLGPMEPLVLVAHSDIPPSLDSPLVLGTAATVLQQGSFSVDDVQTVSAGALGCLVALPMKNLSDDPLALTSNSNLAAHITTPTSSSTPRENASVPELLAPIKVEPDSPSRPGAVGQQEGSHGLPQSTLPSPAEQHGAQDTELSAGTGNFYLESGGSARTDYRAIQLAKEKKQRGAGSNAGASQSTQRKIKEGKMSPPHFHASQNSWLCGSLVVPSGGRPGPAPAAGVQCGAQGVQVQLVQDDPSGEGVLPSARGPATFLPFLTVDLPVYVLQEVLPSSGGPAGPEATQFPGSTINLQDLQ

SEQ ID NO: 102423 - protein, 418 aa, Homo sapiens
  Payload ID: 20411
  Gene Name: ZXD family zinc finger C
  ENSP ID: ENSP00000426532
  MOD_RES (1)..(1): Any amino acid
XERPYKCDFPGCEKTFITVSALFSHNRAHFREQELFSCSFPGCSKQYDKACRLKIHLRSHTGERPFICDSDSCGWTFTSMSKLLRHRRKHDDDRRFTCPVEGCGKSFTRAEHLKGHSITHLGTKPFECPVEGCCARFSARSSLYIHSKKHVQDVGAPKSRCPVSTCNRLFTSKHSMKAHMVRQHSRRQDLLPQLEAPSSLTPSSELSSPGQSELTNMDLAALFSDTPANASGSAGGSDEALNSGILTIDVTSVSSSLGGNLPANNSSLGPMEPLVLVAHSDIPPSLDSPLVLGTAATVLQQGSFSVDDVQTVSAGALGCLVALPMKNLSDDPLALTSNSNLAAHITTPTSSSTPRENASVPELLAPIKVEPDSPSRPGAVGQQEGSHGLPQSTLPSPAEQHGAQDTELSAGTGNFYLV

SEQ ID NO: 102424 - protein, 759 aa, Homo sapiens
  Payload ID: 20412
  Gene Name: zyg-11 family member A, cell cycle regulator
  Uniprot ID: Q6WRX3
  ENSP ID: ENSP00000360583
MVHFLHPGHTPRNIVPPDAQKDALGCCVVQEEASPYTLVNICLNVLIANLEKLCSERPDGTLCLPEHWSFPQEVAERFLRVMTWQGKLTDRTASIFRGNQMKLKLVNIQKAKISTAAFIKAFCRHKLIELNATAVHADLPVPDIISGLCSNRWIQQNLQCLLLDSTSIPQNSRLLFFSQLTGLRILSVFNVCFHTEDLANVSQLPRLESLDISNTLVTDISALLTCKDRLKSLTMHYLKCLAMTKSQILAVIRELKCLLHLDISDHRQLKSDLAFHLLQQKDILPNVVSLDISGGNCITDEAVELFIRLRPAMQFVGLLATDAGSSDFFTTKQGLRVAGGASMSQISEALSRYRNRSCFVKEALHRLFTETFSMEVTMPAILKLVAIGMRNHPLDLRVQFTASACALNLTRQGLAKGMPVRLLSEVTCLLFKALKNFPHYQQLQKNCLLSLTNSRILVDVPFDRFDAAKFVMRWLCKHENPKMQTMAVSVTSILALQLSPEQTAQLEELFMAVKELLAIVKQKTTENLDDVTFLFTLKALWNLTDGSPAACKHFIENQGLQIFIQVLETFSESAIQSKVLGLLNNIAEVRELSSKLVTEDVLKHINSLLCSREMEVSYFAAGIIAHLTSDRQLWISRDFQRRTLLQDLHATIQNWPSSSCKMTALVTYRSFKTFFPLLGNFSQPEVQLWALWAMYHVCSKNPSKYCKMLVEEEGLQLLCDIQEHSEATPKAQQIAASILDDFRMHFMNYQRPTLCQMPF

SEQ ID NO: 102425 - protein, 417 aa, Homo sapiens
  Payload ID: 20412
  Gene Name: zyg-11 family member A, cell cycle regulator
  Uniprot ID: Q6WRX3
  ENSP ID: ENSP00000360587
MSQISEALSRYRNRSCFVKEALHRLFTETFSMEVTMPAILKLVAIGMRNHPLDLRVQFTASACALNLTRQGLAKGMPVRLLSEVTCLLFKALKNFPHYQQLQKNCLLSLTNSRILVDVPFDRFDAAKFVMRWLCKHENPKMQTMAVSVTSILALQLSPEQTAQLEELFMAVKELLAIVKQKTTENLDDVTFLFTLKALWNLTDGSPAACKHFIENQGLQIFIQVLETFSESAIQSKVLGLLNNIAEVRELSSKLVTEDVLKHINSLLCSREMEVSYFAAGIIAHLTSDRQLWISRDFQRRTLLQDLHATIQNWPSSSCKMTALVTYRSFKTFFPLLGNFSQPEVQLWALWAMYHVCSKNPSKYCKMLVEEEGLQLLCDIQEHSEATPKAQQIAASILDDFRMHFMNYQRPTLCQMPF

SEQ ID NO: 102426 - protein, 417 aa, Homo sapiens; identical to SEQ ID NO: 102425
  Payload ID: 20412
  Gene Name: zyg-11 family member A, cell cycle regulator
  Uniprot ID: Q6WRX3
  ENSP ID: ENSP00000482761

SEQ ID NO: 102427 - protein, 744 aa, Homo sapiens
  Payload ID: 20413
  Gene Name: zyg-11 family member B, cell cycle regulator
  Uniprot ID: Q9C0D3
  ENSP ID: ENSP00000294353
MPEDQAGAAMEEASPYSLLDICLNFLTTHLEKFCSARQDGTLCLQEPGVFPQEVADRLLRTMAFHGLLNDGTVGIFRGNQMRLKRACIRKAKISAVAFRKAFCHHKLVELDATGVNADITITDIISGLGSNKWIQQNLQCLVLNSLTLSLEDPYERCFSRLSGLRALSITNVLFYNEDLAEVASLPRLESLDISNTSITDITALLACKDRLKSLTMHHLKCLKMTTTQILDVVRELKHLNHLDISDDKQFTSDIALRLLEQKDILPNLVSLDVSGRKHVTDKAVEAFIQQRPSMQFVGLLATDAGYSEFLTGEGHLKVSGEANETQIAEALKRYSERAFFVREALFHLFSLTHVMEKTKPEILKLVVTGMRNHPMNLPVQLAASACVFNLTKQDLAAGMPVRLLADVTHLLLKAMEHFPNHQQLQKNCLLSLCSDRILQDVPFNRFEAAKLVMQWLCNHEDQNMQRMAVAIISILAAKLSTEQTAQLGTELFIVRQLLQIVKQKTNQNSVDTTLKFTLSALWNLTDESPTTCRHFIENQGLELFMRVLESFPTESSIQQKVLGLLNNIAEVQELHSELMWKDFIDHISSLLHSVEVEVSYFAAGIIAHLISRGEQAWTLSRSQRNSLLDDLHSAILKWPTPECEMVAYRSFNPFFPLLGCFTTPGVQLWAVWAMQHVCSKNPSRYCSMLIEEGGLQHLYNIKDHEHTDPHVQQIAVAILDSLEKHIVRHGRPPPCKKQPQARLN

SEQ ID NO: 102428 - protein, 566 aa, Homo sapiens
  Payload ID: 20413
  Gene Name: zyg-11 family member B, cell cycle regulator
  ENSP ID: ENSP00000441315
MPEDQAGAAMEEASPYSLLDICLNFLTTHLEKFCSARQDGTLCLQEPGVFPQEVADRLLRTMAFHGLLNDGTVGIFRGNQMRLKRACIRKAKISAVAFRKAFCHHKLVELDATGVNADITITDIISGLGSNKWIQQNLQCLVLNSLTLSLEDPYERCFSRLSGLRALSITNVLFYNEDLAEVASLPRLESLDISNTSITDITALLACKDRLKSLTMHHLKCLKMTTTQILDVVRELKHLNHLDISDDKQFTSDIALRLLEQKDILPNLVSLDVSGRKHVTDKAVEAFIQQRPSMQFVGLLATDAGYSEFLTGEGHLKVSGEANETQIAEALKRYSERAFFVREALFHLFSLTHVMEKTKPEILKLVVTGMRNHPMNLPVQLAASACVFNLTKQDLAAGMPVRLLADVTHLLLKAMEHFPNHQQLQKNCLLSLCSDRILQDVPFNRFEAAKLVMQWLCNHEDQNMQRMAVAIISILAAKLSTEQTAQLGTELFIVRQLLQIVKQKTNQNSVDTTLKFTLSALWNLTDESPTTCRHFIENQGLELFMRVLESFPTESSIQQKVLGLLG

SEQ ID NO: 102429 - protein, 766 aa, Homo sapiens
  Payload ID: 20414
  Gene Name: zyg-11 related, cell cycle regulator
  Uniprot ID: Q7Z7L7
  ENSP ID: ENSP00000291900
MASDTPESLMALCTDFCLRNLDGTLGYLLDKETLRLHPDIFLPSEICDRLVNEYVELVNAACNFEPHESFFSLFSDPRSTRLTRIHLREDLVQDQDLEAIRKQDLVELYLTNCEKLSAKSLQTLRSFSHTLVSLSLFGCTNIFYEEENPGGCEDEYLVNPTCQVLVKDFTFEGFSRLRFLNLGRMIDWVPVESLLRPLNSLAALDLSGIQTSDAAFLTQWKDSLVSLVLYNMDLSDDHIRVIVQLHKLRHLDISRDRLSSYYKFKLTREVLSLFVQKLGNLMSLDISGHMILENCSISKMEEEAGQTSIEPSKSSIIPFRALKRPLQFLGLFENSLCRLTHIPAYKVSGDKNEEQVLNAIEAYTEHRPEITSRAINLLFDIARIERCNQLLRALKLVITALKCHKYDRNIQVTGSAALFYLTNSEYRSEQSVKLRRQVIQVVLNGMESYQEVTVQRNCCLTLCNFSIPEELEFQYRRVNELLLSILNPTRQDESIQRIAVHLCNALVCQVDNDHKEAVGKMGFVVTMLKLIQKKLLDKTCDQVMEFSWSALWNITDETPDNCEMFLNFNGMKLFLDCLKEFPEKQELHRNMLGLLGNVAEVKELRPQLMTSQFISVFSNLLESKADGIEVSYNACGVLSHIMFDGPEAWGVCEPQREEVEERMWAAIQSWDINSRRNINYRSFEPILRLLPQGISPVSQHWATWALYNLVSVYPDKYCPLLIKEGGMPLLRDIIKMATARQETKEMARKVIEHCSNFKEENMDTSR

SEQ ID NO: 102430 - protein, 101 aa, Homo sapiens
  Payload ID: 20414
  Gene Name: zyg-11 related, cell cycle regulator
  ENSP ID: ENSP00000389271
MASDTPESLMALCTDFCLRNLDGTLGYLLDKETLRLHPDIFLPSEICDRLVNEYVELVNAACNFEPHESFFSLFSDPRSTRLTRIHLREDLVQDQDLEAIR

SEQ ID NO: 102431 - protein, 164 aa, Homo sapiens
  Payload ID: 20414
  Gene Name: zyg-11 related, cell cycle regulator
  ENSP ID: ENSP00000393051
MASDTPESLMALCTDFCLRNLDGTLGYLLDKETLRLHPDIFLPSEICDRLVNEYVELVNAACNFEPHESFFSLFSDPRSTRLTRIHLREDLVQDQDLEAIRKQDLVELYLTNCEKLSAKSLQTLRSFSHTLVSLSLFGCTNIFYEEENPGGCEDEYLVNPTCQV

SEQ ID NO: 102432 - protein, 424 aa, Homo sapiens
  Payload ID: 20415
  Gene Name: zygote arrest 1
  Uniprot ID: Q86SH2
  ENSP ID: ENSP00000329803
MAALGDEVLDGYVFPACPPCSYRYPYPAATKGKGAAGGSWQQRGRGCLPASSPCSAGAASLSFPGCGRLTAAEYFDSYQRERLMALLAQVGPGLGPRARRAGSCDVAVQVSPRIDAAVQCSLGRRTLQRRARDPESPAGPGAEGTTGGGSFSQQPSRRGLEQGSPQNGAPRPMRFPRTVAVYSPLALRRLTAFLEGPGPAAGEQRSGASDGERGPPPARLQGPEEGEVWTKKAPRRPQSDDDGEAQAAVRASWEQPADGPELPPREAQEGEAAPRSALRSPGQPPSAGRARDGGDGREAAVAGEGPSPRSPELGKERLRFQFLEQKYGYYHCKDCNIRWESAYVWCVQGTNKVYFKQFCRTCQKSYNPYRVEDITCQSCKQTRCSCPVKLRHVDPKRPHRQDLCGRCKGKRLSCDSTFSFKYII

SEQ ID NO: 102433 - protein, 321 aa, Homo sapiens
  Payload ID: 20416
  Gene Name: zygote arrest 1-like
  Uniprot ID: A6NP61
  ENSP ID: ENSP00000344616
MERFVRVPYGLYQGYGSTVPLGQPGLSGHKQPDWRQNMGPPTFLARPGLLVPANAPDYCIDPYKRAQLKAILSQMNPSLSPRLCKPNTKEVGVQVSPRVDKAVQCSLGPRTLSSCSPWDGRDPQEPLPACGVTSPATGRRGLIRLRRDGDEAESKALPGPAEASQPQPPSRRSGADRQEEPGQLEESGEKDAPCPQETKSKQVPGDAASEPLRRPNFQFLEPKYGYFHCKDCKTRWESAYVWCISGTNKVYFKQLCCKCQKSFNPYRVEAIQCQTCSKSHCSCPQKKRHIDLRRPHRQELCGRCKDKRFSCGNIYSFKYVM

SEQ ID NO: 102434 - protein, 321 aa, Homo sapiens; identical to SEQ ID NO: 102433
  Payload ID: 20416
  Gene Name: zygote arrest 1-like
  Uniprot ID: A6NP61
  ENSP ID: ENSP00000437289

SEQ ID NO: 102435 - protein, 167 aa, Homo sapiens
  Payload ID: 20417
  Gene Name: zymogen granule protein 16
  Uniprot ID: O60844
  ENSP ID: ENSP00000383563
MLTVALLALLCASASGNAIQARSSSYSGEYGGGGGKRFSHSGNQLDGPITALRVRVNTYYIVGLQVRYGKVWSDYVGGRNGDLEEIFLHPGESVIQVSGKYKWYLKKLVFVTDKGRYLSFGKDSGTSFNAVPLHPNTVLRFISGRSGSLIDAIGLHWDVYPSSCSRC

SEQ ID NO: 102436 - protein, 208 aa, Homo sapiens
  Payload ID: 20418
  Gene Name: zymogen granule protein 16B
  Uniprot ID: Q96DA0
  ENSP ID: ENSP00000371715
MGAQGAQESIKAMWRVPGTTRRPVTGESPGMHRPEAMLLLLTLALLGGPTWAGKMYGPGGGKYFSTTEDYDHEITGLRVSVGLLLVKSVQVKLGDSWDVKLGALGGNTQEVTLQPGEYITKVFVAFQAFLRGMVMYTSKDRYFYFGKLDGQISSAYPSQEGQVLVGIYGQYQLLGIKSIGFEWNYPLEEPTTEPPVNLTYSANSPVGR

SEQ ID NO: 102437 - protein, 69 aa, Homo sapiens
  Payload ID: 20418
  Gene Name: zymogen granule protein 16B
  ENSP ID: ENSP00000458847
  MOD_RES (1)..(1): Any amino acid
XRRPVTGESPGMHRPEAMLLLLTLALLGGPTWAGKMYGPGGGKYFSTTEDYDHEITGLRVSVGLLLVKR

SEQ ID NO: 102438 - protein, 95 aa, Homo sapiens
  Payload ID: 20418
  Gene Name: zymogen granule protein 16B
  ENSP ID: ENSP00000460793
  MOD_RES (1)..(1): Any amino acid
XAQGAQESIKAMWRVPGTTRRPVTGESPGMHRPEAMLLLLTLALLGGPTWAGKMYGPGGGKYFSTTEDYDHEITGLRVSVGLLLVKRFLEGVIYE

SEQ ID NO: 102439 - protein, 178 aa, Homo sapiens
  Payload ID: 20418
  Gene Name: zymogen granule protein 16B
  ENSP ID: ENSP00000461740
MHRPEAMLLLLTLALLGGPTWAGKMYGPGGGKYFSTTEDYDHEITGLRVSVGLLLVKSVQVKLGDSWDVKLGALGGNTQEVTLQPGEYITKVFVAFQAFLRGMVMYTSKDRYFYFGKLDGQISSAYPSQEGQVLVGIYGQYQLLGIKSIGFEWNYPLEEPTTEPPVNLTYSANSPVGR

SEQ ID NO: 102440 - protein, 95 aa, Homo sapiens; identical to SEQ ID NO: 102438
  Payload ID: 20418
  Gene Name: Zymogen granule protein 16B
  ENSP ID: ENSP00000488971
  MOD_RES (1)..(1): Any amino acid

SEQ ID NO: 102441 - protein, 208 aa, Homo sapiens; identical to SEQ ID NO: 102436
  Payload ID: 20418
  Gene Name: Zymogen granule protein 16B
  ENSP ID: ENSP00000489035

SEQ ID NO: 102442 - protein, 178 aa, Homo sapiens; identical to SEQ ID NO: 102439
  Payload ID: 20418
  Gene Name: Zymogen granule protein 16B
  ENSP ID: ENSP00000489251

SEQ ID NO: 102443 - protein, 69 aa, Homo sapiens; identical to SEQ ID NO: 102437
  Payload ID: 20418
  Gene Name: Zymogen granule protein 16B
  ENSP ID: ENSP00000489599
  MOD_RES (1)..(1): Any amino acid

SEQ ID NO: 102444 - protein, 572 aa, Homo sapiens
  Payload ID: 20419
  Gene Name: zyxin
  Uniprot ID: Q15942
  ENSP ID: ENSP00000324422
MAAPRPSPAISVSVSAPAFYAPQKKFGPVVAPKPKVNPFRPGDSEPPPAPGAQRAQMGRVGEIPPPPPEDFPLPPPPLAGDGDDAEGALGGAFPPPPPPIEESFPPAPLEEEIFPSPPPPPEEEGGPEAPIPPPPQPREKVSSIDLEIDSLSSLLDDMTKNDPFKARVSSGYVPPPVATPFSSKSSTKPAAGGTAPLPPWKSPSSSQPLPQVPAPAQSQTQFHVQPQPQPKPQVQLHVQSQTQPVSLANTQPRGPPASSPAPAPKFSPVTPKFTPVASKFSPGAPGGSGSQPNQKLGHPEALSAGTGSPQPPSFTYAQQREKPRVQEKQHPVPPPAQNQNQVRSPGAPGPLTLKEVEELEQLTQQLMQDMEHPQRQNVAVNELCGRCHQPLARAQPAVRALGQLFHIACFTCHQCAQQLQGQQFYSLEGAPYCEGCYTDTLEKCNTCGEPITDRMLRATGKAYHPHCFTCVVCARPLEGTSFIVDQANRPHCVPDYHKQYAPRCSVCSEPIMPEPGRDETVRVVALDKNFHMKCYKCEDCGKPLSIEADDNGCFPLDGHVLCRKCHTARAQT

SEQ ID NO: 102445 - protein, 540 aa, Homo sapiens
  Payload ID: 20419
  Gene Name: zyxin
  ENSP ID: ENSP00000346417
AAPRPSPAISVSVSAPAFYAPQKKFGPVVAPKPKVNPFRPGDSEPPPAPGAQRAQMGRVGEIPPPPPEDFPLPPPPLAGDGDDAEGALGGAFPPPPPPIEESFPPAPLEEEIFPSPPPPPEEEGGPEAPIPPPPQVSSGYVPPPVATPFSSKSSTKPAAGGTAPLPPWKSPSSSQPLPQVPAPAQSQTQFHVQPQPQPKPQVQLHVQSQTQPVSLANTQPRGPPASSPAPAPKFSPVTPKFTPVASKFSPGAPGGSGSQPNQKLGHPEALSAGTGSPQPPSFTYAQQREKPRVQEKQHPVPPPAQNQNQVRSPGAPGPLTLKEVEELEQLTQQLMQDMEHPQRQNVAVNELCGRCHQPLARAQPAVRALGQLFHIACFTCHQCAQQLQGQQFYSLEGAPYCEGCYTDTLEKCNTCGEPITDRMLRATGKAYHPHCFTCVVCARPLEGTSFIVDQANRPHCVPDYHKQYAPRCSVCSEPIMPEPGRDETVRVVALDKNFHMKCYKCEDCGKPLSIEADDNGCFPLDGHVLCRKCHTARAQT

SEQ ID NO: 102446 - protein, 415 aa, Homo sapiens
  Payload ID: 20419
  Gene Name: zyxin
  Uniprot ID: Q15942
  ENSP ID: ENSP00000376642
MTKNDPFKARVSSGYVPPPVATPFSSKSSTKPAAGGTAPLPPWKSPSSSQPLPQVPAPAQSQTQFHVQPQPQPKPQVQLHVQSQTQPVSLANTQPRGPPASSPAPAPKFSPVTPKFTPVASKFSPGAPGGSGSQPNQKLGHPEALSAGTGSPQPPSFTYAQQREKPRVQEKQHPVPPPAQNQNQVRSPGAPGPLTLKEVEELEQLTQQLMQDMEHPQRQNVAVNELCGRCHQPLARAQPAVRALGQLFHIACFTCHQCAQQLQGQQFYSLEGAPYCEGCYTDTLEKCNTCGEPITDRMLRATGKAYHPHCFTCVVCARPLEGTSFIVDQANRPHCVPDYHKQYAPRCSVCSEPIMPEPGRDETVRVVALDKNFHMKCYKCEDCGKPLSIEADDNGCFPLDGHVLCRKCHTARAQT

SEQ ID NO: 102447 - protein, 164 aa, Homo sapiens
  Payload ID: 20419
  Gene Name: zyxin
  ENSP ID: ENSP00000400537
MAAPRPSPAISVSVSAPAFYAPQKKFGPVVAPKPKVNPFRPGDSEPPPAPGAQRAQMGRVGEIPPPPPEDFPLPPPPLAGDGDDAEGALGGAFPPPPPPIEESFPPAPLEEEIFPSPPPPPEEEGGPEAPIPPPPQPREKVSSIDLEIDSLSSLLDDMTKNDPF

SEQ ID NO: 102448 - protein, 171 aa, Homo sapiens
  Payload ID: 20419
  Gene Name: zyxin
  ENSP ID: ENSP00000403714
MSTYTRTQHRKKCQGPVSFAESWAAQQQAGRVRSPGAPGPLTLKEVEELEQLTQQLMQDMEHPQRQNVAVNELCGRCHQPLARAQPAVRALGQLFHIACFTCHQCAQQLQGQQFYSLEGAPYCEGCYTDTLEKCNTCGEPITDRMLRATGKAYHPHCFTCVVCARPLEGTS

SEQ ID NO: 102449 - protein, 176 aa, Homo sapiens
  Payload ID: 20419
  Gene Name: zyxin
  ENSP ID: ENSP00000411230
  MOD_RES (1)..(1): Any amino acid
XSSTKPAAGGTAPLPPWKSPSSSQPLPQVPAPAQSQTQFHVQPQPQPKPQVQLHVQSQTQPVSLANTQPRGPPASSPAPAPKFSPVTPKFTPVASKFSPGAPGGSGSQPNQKLGHPEALSAGTGSPQPPSFTYAQQREKPRVQEKQHPVPPPAQNQNQGLLSSRQAGCAPLGPQGP

SEQ ID NO: 102450 - protein, 177 aa, Homo sapiens
  Payload ID: 20419
  Gene Name: zyxin
  ENSP ID: ENSP00000413467
PSVCPSPPGWRLLRTGTQSLRTRRRGGHPRRGAHAPACDFPLPPPPLAGDGDDAEGALGGAFPPPPPPIEESFPPAPLEEEIFPSPPPPPEEEGGPEAPIPPPPQPREKVSSIDLEIDSLSSLLDDMTKNDPFKARVSSGYVPPPVATPFSSKSSTKPAAGGTAPLPPWKSPSSSQP

SEQ ID NO: 102451 - DNA, 1781 bp, Homo sapiens
  Payload ID: 1
  Gene Symbol: SEP15
  Gene Name: 15 kDa selenoprotein
  ENST ID: ENST00000331835
  CDS Start-End: 255-752
gtcgtgaataaaagaaaggagaccgcagaagtaaagaagtggggagtttaggcaagtgcctgatttgggtaatcgaaagcacccagtgattgtatttgatgacttttaagctttcatatgccgttatttaatacctgtcacttccaaatgagagatgtaagggcaacggccgttagcgttctgttttggatcaggctctggagtggacgcccctagcttaggggtccttctaggcagccagaaacctgcggaaaatggtagcgatggcggctgggccgagtgggtgtctggtgccggcgtttgggctacggttgttgttggcgactgtgcttcaagcggtgtctgcttttggggcagagttttcatcggaggcatgcagagagttaggcttttctagcaacttgctttgcagctcttgtgatcttctcggacagttcaacctgcttcagctggatcctgattgcagaggatgctgtcaggaggaagcacaatttgaaaccaaaaagctgtatgcaggagctattcttgaagtttgtggatgaaaattgggaaggttccctcaagtccaagcttttgttaggagtgataaacccaaactgttcagaggactgcaaatcaagtatgtccgtggttcagaccctgtattaaagcttttggacgacaatgggaacattgctgaagaactgagcattctcaaatggaacacagacagtgtagaagaattcctgagtgaaaagttggaacgcatataaatcttgcttaaattttgtcctatccttttgttaccttatcaaatgaaatattacagcacctagaaaataatttagttttgcttgcttccattgatcagtcttttacttgaggcattaaatatctaattaaatcgtgaaatggcagtatagtccatgatatctaaggagttggcaagcttaacaaaacccattttttataaatgtccatcctcctgcatttgttgataccactaacaaaatgctttgtaacagacttgcggttaattatgcaaatgatagtttgtgataattggtccagttttacgaacaacagatttctaaattagagaggttaacaagacagatgattactatgcctcatgtgctgtgtgctctttgaaaggaatgacagcagactacaaagcaaataagatatactgagcctcaacagattgcctgctcctcagagtctctcctatttttgtattacccagctttctttttaatacaaatgttatttatagtttacaatgaatgcactgcataaaaactttgtagcttcattattgtaaaacatattcaagatcctacagtaagagtgaaacattcacaaagatttgcgttaatgaagactacacagaaaacctttctagggatttgtgtggatcagatacatacttggcaaatttttgagttttacattcttacagaaaagtccatttaaaagtgatcatttgtaagaccaaaatataaataaaaagtttcaaaaatctatctgaatttggaattcttctggtttgttctttcatgtttaaaaatgatgtttttcaatgcatttttttcatgtaagccctttttttagccaaaatgtaaaaatggctgtaatatttaaaacttataacatcttattgttggtaatagtgctttatatttgtctgattttatttttcaaagttttttcatttatgaacacattttcattggtatattatttaaggaatatctcttgatatagaatttttatattaaaaatgatttttctttgcttaa

SEQ ID NO: 102452 - DNA, 1220 bp, Homo sapiens
  Payload ID: 1
  Gene Symbol: SEP15
  Gene Name: 15 kDa selenoprotein
  ENST ID: ENST00000370554
  CDS Start-End: 24-398
aggcagccagaaacctgcggaaaatggtagcgatggcggctgggccgagtgggtgtctggtgccggcgtttgggctacggttgttgttggcgactgtgcttcaagcggtgtctgcttttggggcagagttttcatcggaggcatgcagagagttaggcttttctagcaacttgctttgcagctcttgtgatcttctcggacagttcaacctgcttcagctggatcctgattgcagaggatgctgtcaggaggaagcacaatttgaaaccaaaaagctgtatgcaggagctattcttgaagtttgtggatgaaaattgggaaggttccctcaagtccaagtatgtccgtggttcagaccctgtattaaagcttttggacgacaatgggaacattgctgaagaactgagcattctcaaatggaacacagacagtgtagaagaattcctgagtgaaaagttggaacgcatataaatcttgcttaaattttgtcctatccttttgttaccttatcaaatgaaatattacagcacctagaaaataatttagttttgcttgcttccattgatcagtcttttacttgaggcattaaatatctaattaaatcgtgaaatggcagtatagtccatgatatctaaggagttggcaagcttaacaaaacccattttttataaatgtccatcctcctgcatttgttgataccactaacaaaatgctttgtaacagacttgcggttaattatgcaaatgatagtttgtgataattggtccagttttacgaacaacagatttctaaattagagaggttaacaagacagatgattactatgcctcatgtgctgtgtgctctttgaaaggaatgacagcagactacaaagcaaataagatatactgagcctcaacagattgcctgctcctcagagtctctcctatttttgtattacccagctttctttttaatacaaatgttatttatagtttacaatgaatgcactgcataaaaactttgtagcttcattattgtaaaacatattcaagatcctacagtaagagtgaaacattcacaaagatttgcgttaatgaagactacacagaaaacctttctagggatttgtgtggatcagatacatacttggcaaatttttgagttttacattcttacagaaaagtccatttaaaagtgatcatttgtaagaccaaaatataaataaaaagtttcaaaaa

SEQ ID NO: 102453 - DNA, 727 bp, Homo sapiens
  Payload ID: 1
  Gene Symbol: SEP15
  Gene Name: 15 kDa selenoprotein
  ENST ID: ENST00000401030
  CDS Start-End: 16-450
agaaacctgcggaaaatggtagcgatggcggctgggccgagtgggtgtctggtgccggcgtttgggctacggttgttgttggcgactgtgcttcaagcggtgtctgcttttggggcagagttttcatcggaggcatgcagagagttaggcttttctagcaacttgctttgcagctcttgtgatcttctcggacagttcaacctgcttcagctggatcctgattgcagaggatgctgtcaggaggaagcacaatttgaaaccaaaaagtattcatccattgtttctaagcaagaatgccatcactcaaactgtatgcaggagctattcttgaagtttgtggatgaaaattgggaaggttccctcaagtccaagcttttgttaggagtgataaacccaaactgttcagaggactgcaaatcaagtatgtccgtggttcagaccctgtattaaagcttttggacgacaatgggaacattgctgaagaactgagcattctcaaatggaacacagacagtgtagaagaattcctgagtgaaaagttggaacgcatataaatcttgcttaaattttgtcctatccttttgttaccttatcaaatgaaatattacagcacctagaaaataatttagttttgcttgcttccattgatcagtcttttacttgaggcattaaatatctaattaaatcgtgaaatggcagtatagtccatgatatctaaggagttggc

SEQ ID NO: 102454 - DNA, 1785 bp, Homo sapiens
  Payload ID: 1
  Gene Symbol: SEP15
  Gene Name: 15 kDa selenoprotein
  ENST ID: ENST00000611507
  CDS Start-End: 314-685
ggagaagaaggcggggctaaaactggcgaaggcgtggcttcttggctgcttgacgaagtgtcgtgaataaaagaaaggagaccgcagaagtaaagaagtggggagtttaggcaagtgcctgatttgggtaatcgaaagcacccagtgattgtatttgatgacttttaagctttcatatgccgttatttaatacctgtcacttccaaatgagagatgtaagggcaacggccgttagcgttctgttttggatcaggctctggagtggacgcccctagcttaggggtccttctaggcagccagaaacctgcggaaaatggtagcgatggcggctgggccgagtgggtgtctggtgccggcgtttgggctacggttgttgttggcgactgtgcttcaagcggtgtctgcttttggggcagagttttcatcggaggcatgcagagagttaggcttttctagcaacttgctttgcagctcttgtgatcttctcggacagttcaacctgcttcagctggatcctgattgcagaggatgctgtcaggaggaagcacaatttgaaaccaaaaagctgtatgcaggagctattcttgaagtttgtggaaaattgggaaggttccctcaagtccaagtatgtccgtggttcagaccctgtattaaagcttttggacgacaatgggaacattgctgaagaactgagcattctcaaatggaacacagacagtgtagaagaattcctgagtgaaaagttggaacgcatataaatcttgcttaaattttgtcctatccttttgttaccttatcaaatgaaatattacagcacctagaaaataatttagttttgcttgcttccattgatcagtcttttacttgaggcattaaatatctaattaaatcgtgaaatggcagtatagtccatgatatctaaggagttggcaagcttaacaaaacccattttttataaatgtccatcctcctgcatttgttgataccactaacaaaatgctttgtaacagacttgcggttaattatgcaaatgatagtttgtgataattggtccagttttacgaacaacagatttctaaattagagaggttaacaagacagatgattactatgcctcatgtgctgtgtgctctttgaaaggaatgacagcagactacaaagcaaataagatatactgagcctcaacagattgcctgctcctcagagtctctcctatttttgtattacccagctttctttttaatacaaatgttatttatagtttacaatgaatgcactgcataaaaactttgtagcttcattattgtaaaacatattcaagatcctacagtaagagtgaaacattcacaaagatttgcgttaatgaagactacacagaaaacctttctagggatttgtgtggatcagatacatacttggcaaatttttgagttttacattcttacagaaaagtccatttaaaagtgatcatttgtaagaccaaaatataaataaaaagtttcaaaaatctatctgaatttggaattcttctggtttgttctttcatgtttaaaaatgatgtttttcaatgcatttttttcatgtaagccctttttttagccaaaatgtaaaaatggctgtaatatttaaaacttataacatcttattgttggtaatagtgctttatatttgtctgattttatttttcaaagttttttcatttatgaacacattttcattggtatattatttaaggaatatctcttgatatagaatttttatattaaaaatgatttttctttgctt

SEQ ID NO: 102455 - DNA, 1835 bp, Homo sapiens
  Payload ID: 1
  Gene Symbol: SEP15
  Gene Name: 15 kDa selenoprotein
  ENST ID: ENST00000616787
  CDS Start-End: 314-808
ggagaagaaggcggggctaaaactggcgaaggcgtggcttcttggctgcttgacgaagtgtcgtgaataaaagaaaggagaccgcagaagtaaagaagtggggagtttaggcaagtgcctgatttgggtaatcgaaagcacccagtgattgtatttgatgacttttaagctttcatatgccgttatttaatacctgtcacttccaaatgagagatgtaagggcaacggccgttagcgttctgttttggatcaggctctggagtggacgcccctagcttaggggtccttctaggcagccagaaacctgcggaaaatggtagcgatggcggctgggccgagtgggtgtctggtgccggcgtttgggctacggttgttgttggcgactgtgcttcaagcggtgtctgcttttggggcagagttttcatcggaggcatgcagagagttaggcttttctagcaacttgctttgcagctcttgtgatcttctcggacagttcaacctgcttcagctggatcctgattgcagaggatgctgtcaggaggaagcacaatttgaaaccaaaaagctgtatgcaggagctattcttgaagtttgtggaaaattgggaaggttccctcaagtccaagcttttgttaggagtgataaacccaaactgttcagaggactgcaaatcaagtatgtccgtggttcagaccctgtattaaagcttttggacgacaatgggaacattgctgaagaactgagcattctcaaatggaacacagacagtgtagaagaattcctgagtgaaaagttggaacgcatataaatcttgcttaaattttgtcctatccttttgttaccttatcaaatgaaatattacagcacctagaaaataatttagttttgcttgcttccattgatcagtcttttacttgaggcattaaatatctaattaaatcgtgaaatggcagtatagtccatgatatctaaggagttggcaagcttaacaaaacccattttttataaatgtccatcctcctgcatttgttgataccactaacaaaatgctttgtaacagacttgcggttaattatgcaaatgatagtttgtgataattggtccagttttacgaacaacagatttctaaattagagaggttaacaagacagatgattactatgcctcatgtgctgtgtgctctttgaaaggaatgacagcagactacaaagcaaataagatatactgagcctcaacagattgcctgctcctcagagtctctcctatttttgtattacccagctttctttttaatacaaatgttatttatagtttacaatgaatgcactgcataaaaactttgtagcttcattattgtaaaacatattcaagatcctacagtaagagtgaaacattcacaaagatttgcgttaatgaagactacacagaaaacctttctagggatttgtgtggatcagatacatacttggcaaatttttgagttttacattcttacagaaaagtccatttaaaagtgatcatttgtaagaccaaaatataaataaaaagtttcaaaaatctatctgaatttggaattcttctggtttgttctttcatgtttaaaaatgatgtttttcaatgcatttttttcatgtaagccctttttttagccaaaatgtaaaaatggctgtaatatttaaaacttataacatcttattgttggtaatagtgctttatatttgtctgattttatttttcaaagttttttcatttatgaacacattttcattggtatattatttaaggaatatctcttgatatagaatttttatattaaaaatgatttttctttgctt

SEQ ID NO: 102456 - DNA, 266 bp, Homo sapiens
  Payload ID: 1
  Gene Symbol: SEP15
  Gene Name: 15 kDa selenoprotein
  ENST ID: ENST00000497861
  CDS Start-End: 1-266
ttcaacctgcttcagctggatcctgattgcagaggatgctgtcaggaggaagcacaatttgaaaccaaaaagtattcatccattgtttctaagcaagaatgccatcactcaaactgtatgcaggagctattcttgaagtttgtggatgaaaattgggaaggttccctcaagtccaagtatgtccgtggttcagaccctgtattaaagcttttggacgacaatgggaacattgctgaagaactgagcattctcaaatggaacacaga

SEQ ID NO: 102457 - DNA, 499 bp, Homo sapiens
  Payload ID: 1
  Gene Symbol: SEP15
  Gene Name: 15 kDa selenoprotein
  ENST ID: ENST00000467557
  CDS Start-End: 1-95
ttgggctacggttgttgttggcgactgtgcttcaagcggtgagtgtagatcaccttcgcagctgccacagggagagtaggagtgattgcagctgagaaagacgcaacattcggtcctggttgaaaagggtggggaggactgcgcttccttaatgactgctgcggccagaatgcaacgtggcttaatttctcggttgatccttctccttccccgccttgggtttctagcagcagttttctcttgatttcagattgtcttgggtgtctgcttttggggcagagttttcatcggaggcatgcagagagttaggcttttctagcaacttgctttgcagctcttgtgatcttctcggacagttcaacctgcttcagctggatcctgattgcagaggatgctgtcaggaggaagcacaatttgaaaccaaaaagctgtatgcaggagctattcttgaagtttgtggatgaaaattgggaaggttccctcaagtccaagcttttgt

SEQ ID NO: 102458 - DNA, 2021 bp, Homo sapiens
  Payload ID: 2
  Gene Symbol: AGPAT1
  Gene Name: 1-acylglycerol-3-phosphate O-acyltransferase 1
  Uniprot ID: Q99943
  ENST ID: ENST00000336984
  CDS Start-End: 106-957
tcctcttttagagaatgtccggattgctattggactttggagcgtatggctccaaatcaactcattggctaaaacttgacggaaaatggtggttaggtggccagaatggatttgtggccaggggcatggatgctgctgctgctgctcttcctgctgctgctcttcctgctgcccaccctgtggttctgcagccccagtgccaagtacttcttcaagatggccttctacaatggctggatcctcttcctggctgtgctcgccatccctgtgtgtgccgtgcgaggacgcaacgtcgagaacatgaagatcttgcgtctaatgctgctccacatcaaatacctgtacgggatccgagtggaggtgcgaggggctcaccacttccctccctcgcagccctatgttgttgtctccaaccaccagagctctctcgatctgcttgggatgatggaggtactgccaggccgctgtgtgcccattgccaagcgcgagctactgtgggctggctctgccgggctggcctgctggctggcaggagtcatcttcatcgaccggaagcgcacgggggatgccatcagtgtcatgtctgaggtcgcccagaccctgctcacccaggacgtgagggtctgggtgtttcctgagggaacgagaaaccacaatggctccatgctgcccttcaaacgtggcgccttccatcttgcagtgcaggcccaggttcccattgtccccatagtcatgtcctcctaccaagacttctactgcaagaaggagcgtcgcttcacctcgggacaatgtcaggtgcgggtgctgcccccagtgcccacggaagggctgacaccagatgacgtcccagctctggctgacagagtccggcactccatgctcactgttttccgggaaatctccactgatggccggggtggtggtgactatctgaagaagcctgggggcggtgggtgaaccctggctctgagctctcctcccatctgtccccatcttcctccccacacctacccacccagtgggccctgaagcagggccaaaccctcttccttgtctcccctctccccacttattctcctctttggaatcttcaacttctgaagtgaatgtggatacagcgccactcctgccccctcttggccccatccatggactcttgcctcggtgcagtctccactcttgacccccacctcctactgtcttgtctgtgggacagttgcctccccctcatctccagtgactcagcctacacaagggaggggaacattccatccccagtggagtctcttcctatgtggtcttctctacccctctaccccacattggccagtggactcatccattctttggaacaaatcccccccactccaaagtccatggattcaatggactcatccatttgtgaggaggacttctcgccctctggctggaagctgatacctgaagcactcccaggctcatcatgggagctttcctcagcaccttcaccttccctcccagtgtagcctcctgtcagtgggggctggacccttctaattcagaggtctcatgcctgcccttgcccagatgcccagggtcgtgcactctctgggataccagttcagtctccacatttctggttttctgtccccatagtacagttcttcagtggacatgaccccacccagccccctgcagccctgctgcaccatctcaccagacacaaggggaagaagcagacatcaggtgctgcactcacttctgccccctggggagttggggaaaggaacgaaccctggctggaggggataggagggcttttaatttatttctttttctgttgaggcttccccctctctgagccagttttcatttcttcctggtggcattagccactccctgcctctcactccagacctgttcccacaactggggaggtaggctgggagcaaaaggagagggtgggacccagttttgcgtggttggtttttattaattatctggataacagcaaaaaaactgaaaataaagagagagagaga

SEQ ID NO: 102459 - DNA, 2017 bp, Homo sapiens
  Payload ID: 2
  Gene Symbol: AGPAT1
  Gene Name: 1-acylglycerol-3-phosphate O-acyltransferase 1
  Uniprot ID: Q99943
  ENST ID: ENST00000375104
  CDS Start-End: 102-953
gaaatagggtcttcttcccaggttggaccccggggagtttgggcttttcctacaatcactgaccctcactgtgactaaaggagcagaattaggtggccagaatggatttgtggccaggggcatggatgctgctgctgctgctcttcctgctgctgctcttcctgctgcccaccctgtggttctgcagccccagtgccaagtacttcttcaagatggccttctacaatggctggatcctcttcctggctgtgctcgccatccctgtgtgtgccgtgcgaggacgcaacgtcgagaacatgaagatcttgcgtctaatgctgctccacatcaaatacctgtacgggatccgagtggaggtgcgaggggctcaccacttccctccctcgcagccctatgttgttgtctccaaccaccagagctctctcgatctgcttgggatgatggaggtactgccaggccgctgtgtgcccattgccaagcgcgagctactgtgggctggctctgccgggctggcctgctggctggcaggagtcatcttcatcgaccggaagcgcacgggggatgccatcagtgtcatgtctgaggtcgcccagaccctgctcacccaggacgtgagggtctgggtgtttcctgagggaacgagaaaccacaatggctccatgctgcccttcaaacgtggcgccttccatcttgcagtgcaggcccaggttcccattgtccccatagtcatgtcctcctaccaagacttctactgcaagaaggagcgtcgcttcacctcgggacaatgtcaggtgcgggtgctgcccccagtgcccacggaagggctgacaccagatgacgtcccagctctggctgacagagtccggcactccatgctcactgttttccgggaaatctccactgatggccggggtggtggtgactatctgaagaagcctgggggcggtgggtgaaccctggctctgagctctcctcccatctgtccccatcttcctccccacacctacccacccagtgggccctgaagcagggccaaaccctcttccttgtctcccctctccccacttattctcctctttggaatcttcaacttctgaagtgaatgtggatacagcgccactcctgccccctcttggccccatccatggactcttgcctcggtgcagtctccactcttgacccccacctcctactgtcttgtctgtgggacagttgcctccccctcatctccagtgactcagcctacacaagggaggggaacattccatccccagtggagtctcttcctatgtggtcttctctacccctctaccccacattggccagtggactcatccattctttggaacaaatcccccccactccaaagtccatggattcaatggactcatccatttgtgaggaggacttctcgccctctggctggaagctgatacctgaagcactcccaggctcatcatgggagctttcctcagcaccttcaccttccctcccagtgtagcctcctgtcagtgggggctggacccttctaattcagaggtctcatgcctgcccttgcccagatgcccagggtcgtgcactctctgggataccagttcagtctccacatttctggttttctgtccccatagtacagttcttcagtggacatgaccccacccagccccctgcagccctgctgcaccatctcaccagacacaaggggaagaagcagacatcaggtgctgcactcacttctgccccctggggagttggggaaaggaacgaaccctggctggaggggataggagggcttttaatttatttctttttctgttgaggcttccccctctctgagccagttttcatttcttcctggtggcattagccactccctgcctctcactccagacctgttcccacaactggggaggtaggctgggagcaaaaggagagggtgggacccagttttgcgtggttggtttttattaattatctggataacagcaaaaaaactgaaaataaagagagagagaga

SEQ ID NO: 102460 - DNA, 2234 bp, Homo sapiens
  Payload ID: 2
  Gene Symbol: AGPAT1
  Gene Name: 1-acylglycerol-3-phosphate O-acyltransferase 1
  Uniprot ID: Q99943
  ENST ID: ENST00000375107
  CDS Start-End: 319-1170
ggaaaccagcaggcgttggggaggggtggcgggggaatagcggcggcagcagccccagccctcagagagacagcagaaagggagggagggagggtgctggggggacagccccccaccattcctaccgctatgggcccaacctcccactcccacctcccctccatcggccggggctaggacacccccaaatcccgtcgcccccttggcaccgacaccccgacagagacagagacacagccatccgccaccaccgctgccgcagcctggctggggagggggccagccccccaggccccctacccctctgaggtggccagaatggatttgtggccaggggcatggatgctgctgctgctgctcttcctgctgctgctcttcctgctgcccaccctgtggttctgcagccccagtgccaagtacttcttcaagatggccttctacaatggctggatcctcttcctggctgtgctcgccatccctgtgtgtgccgtgcgaggacgcaacgtcgagaacatgaagatcttgcgtctaatgctgctccacatcaaatacctgtacgggatccgagtggaggtgcgaggggctcaccacttccctccctcgcagccctatgttgttgtctccaaccaccagagctctctcgatctgcttgggatgatggaggtactgccaggccgctgtgtgcccattgccaagcgcgagctactgtgggctggctctgccgggctggcctgctggctggcaggagtcatcttcatcgaccggaagcgcacgggggatgccatcagtgtcatgtctgaggtcgcccagaccctgctcacccaggacgtgagggtctgggtgtttcctgagggaacgagaaaccacaatggctccatgctgcccttcaaacgtggcgccttccatcttgcagtgcaggcccaggttcccattgtccccatagtcatgtcctcctaccaagacttctactgcaagaaggagcgtcgcttcacctcgggacaatgtcaggtgcgggtgctgcccccagtgcccacggaagggctgacaccagatgacgtcccagctctggctgacagagtccggcactccatgctcactgttttccgggaaatctccactgatggccggggtggtggtgactatctgaagaagcctgggggcggtgggtgaaccctggctctgagctctcctcccatctgtccccatcttcctccccacacctacccacccagtgggccctgaagcagggccaaaccctcttccttgtctcccctctccccacttattctcctctttggaatcttcaacttctgaagtgaatgtggatacagcgccactcctgccccctcttggccccatccatggactcttgcctcggtgcagtctccactcttgacccccacctcctactgtcttgtctgtgggacagttgcctccccctcatctccagtgactcagcctacacaagggaggggaacattccatccccagtggagtctcttcctatgtggtcttctctacccctctaccccacattggccagtggactcatccattctttggaacaaatcccccccactccaaagtccatggattcaatggactcatccatttgtgaggaggacttctcgccctctggctggaagctgatacctgaagcactcccaggctcatcatgggagctttcctcagcaccttcaccttccctcccagtgtagcctcctgtcagtgggggctggacccttctaattcagaggtctcatgcctgcccttgcccagatgcccagggtcgtgcactctctgggataccagttcagtctccacatttctggttttctgtccccatagtacagttcttcagtggacatgaccccacccagccccctgcagccctgctgcaccatctcaccagacacaaggggaagaagcagacatcaggtgctgcactcacttctgccccctggggagttggggaaaggaacgaaccctggctggaggggataggagggcttttaatttatttctttttctgttgaggcttccccctctctgagccagttttcatttcttcctggtggcattagccactccctgcctctcactccagacctgttcccacaactggggaggtaggctgggagcaaaaggagagggtgggacccagttttgcgtggttggtttttattaattatctggataacagcaaaaaaactgaaaataaagagagagagaga

SEQ ID NO: 102461 - DNA, 2021 bp, Homo sapiens
  Payload ID: 2
  Gene Symbol: AGPAT1
  Gene Name: 1-acylglycerol-3-phosphate O-acyltransferase 1
  Uniprot ID: Q99943
  ENST ID: ENST00000383294
  CDS Start-End: 106-957
tcctcttttagagaatgtccggattgctattggactttggagcgtatggctccaaatcaactcattggctaaaacttgacggaaaatggtggttaggtggccagaatggatttgtggccaggggcatggatgctgctgctgctgctcttcctgctgctgctcttcctgctgcccaccctgtggttctgcagccccagtgccaagtacttcttcaagatggccttctacaatggctggatcctcttcctggctgtgctcgccatccctgtgtgtgccgtgcgaggacgcaacgtcgagaacatgaagatcttgcgtctaatgctgctccacatcaaatacctgtacgggatccgagtggaggtgcgaggggctcaccacttccctccctcgcagccctatgttgttgtctccaaccaccagagctctctcgatctgcttgggatgatggaggtactgccaggccgctgtgtgcccattgccaagcgcgagctactgtgggctggctctgccgggctggcctgctggctggcaggagtcatcttcatcgaccggaagcgcacgggggatgccatcagtgtcatgtctgaggtcgcccagaccctgctcacccaggacgtgagggtctgggtgtttcctgagggaacgagaaaccacaatggctccatgctgcccttcaaacgtggcgccttccatcttgcagtgcaggcccaggttcccattgtccccatagtcatgtcctcctaccaagacttctactgcaagaaggagcgtcgcttcacctcgggacaatgtcaggtgcgggtgctgcccccagtgcccacggaagggctgacaccagatgacgtcccagctctggctgacagagtccggcactccatgctcactgttttccgggaaatctccactgatggccggggtggtggtgactatctgaagaagcctgggggcggtgggtgaaccctggctctgagctctcctcccatctgtccccatcttcctccccacacctacccacccagtgggccctgaagcagggccaaaccctcttccttgtctcccctctccccacttattctcctctttggaatcttcaacttctgaagtgaatgtggatacagcgccactcctgccccctcttggccccatccatggactcttgcctcggtgcagtctccactcttgacccccacctcctactgtcttgtctgtgggacagttgcctccccctcatctccagtgactcagcctacacaagggaggggaacattccatccccagtggagtctcttcctatgtggtcttctctacccctctaccccacattggccagtggactcatccattctttggaacaaatcccccccactccaaagtccatggattcaatggactcatccatttgtgaggaggacttctcgccctctggctggaagctgatacctgaagcactcccaggctcatcctgggagctttcctcagcaccttcaccttccctcccagtgtagcctcctgtcagtgggggctggacccttctaattcagaggtctcatgcctgcccttgcccagatgcccagggtcgtgcactctctgggataccagttcagtctccacatttctggttttctgtccccatagtacagttcttcagtggacatgaccccacccagccccctgcagccctgctgcaccatctcaccagacacaaggggaagaagcagacatcaggtgctgcactcacttctgccccctggggagttggggaaaggaacgaaccctggctggaggggataggagggcttttaatttatttctttttctgttgaggcttccccctctctgagccagttttcatttcttcctggtggcattagccactccctgcctctcactccagacctgttcccacaactggggaggtaggctgggagcaaaaggagagggtgggacccagttttgcgtggttggtttttattaattatctggataacagcaaaaaaactgaaaataaagagagagagaga

SEQ ID NO: 102462 - DNA, 2103 bp, Homo sapiens
  Payload ID: 2
  Gene Symbol: AGPAT1
  Gene Name: 1-acylglycerol-3-phosphate O-acyltransferase 1
  Uniprot ID: Q99943
  ENST ID: ENST00000395496
  CDS Start-End: 188-1039
ctttcctctcccagggcaagtgctgttaggtcacctttactccattccctccttttttcacttggtgaggcctcacacactgtacctgcccacgcaaagtgtcactagaaggaagggaaagggtagtaggattcgtttgcctgtctggaggtaggattggtctttgtagctattccaggtggccagaatggatttgtggccaggggcatggatgctgctgctgctgctcttcctgctgctgctcttcctgctgcccaccctgtggttctgcagccccagtgccaagtacttcttcaagatggccttctacaatggctggatcctcttcctggctgtgctcgccatccctgtgtgtgccgtgcgaggacgcaacgtcgagaacatgaagatcttgcgtctaatgctgctccacatcaaatacctgtacgggatccgagtggaggtgcgaggggctcaccacttccctccctcgcagccctatgttgttgtctccaaccaccagagctctctcgatctgcttgggatgatggaggtactgccaggccgctgtgtgcccattgccaagcgcgagctactgtgggctggctctgccgggctggcctgctggctggcaggagtcatcttcatcgaccggaagcgcacgggggatgccatcagtgtcatgtctgaggtcgcccagaccctgctcacccaggacgtgagggtctgggtgtttcctgagggaacgagaaaccacaatggctccatgctgcccttcaaacgtggcgccttccatcttgcagtgcaggcccaggttcccattgtccccatagtcatgtcctcctaccaagacttctactgcaagaaggagcgtcgcttcacctcgggacaatgtcaggtgcgggtgctgcccccagtgcccacggaagggctgacaccagatgacgtcccagctctggctgacagagtccggcactccatgctcactgttttccgggaaatctccactgatggccggggtggtggtgactatctgaagaagcctgggggcggtgggtgaaccctggctctgagctctcctcccatctgtccccatcttcctccccacacctacccacccagtgggccctgaagcagggccaaaccctcttccttgtctcccctctccccacttattctcctctttggaatcttcaacttctgaagtgaatgtggatacagcgccactcctgccccctcttggccccatccatggactcttgcctcggtgcagtctccactcttgacccccacctcctactgtcttgtctgtgggacagttgcctccccctcatctccagtgactcagcctacacaagggaggggaacattccatccccagtggagtctcttcctatgtggtcttctctacccctctaccccacattggccagtggactcatccattctttggaacaaatcccccccactccaaagtccatggattcaatggactcatccatttgtgaggaggacttctcgccctctggctggaagctgatacctgaagcactcccaggctcatcatgggagctttcctcagcaccttcaccttccctcccagtgtagcctcctgtcagtgggggctggacccttctaattcagaggtctcatgcctgcccttgcccagatgcccagggtcgtgcactctctgggataccagttcagtctccacatttctggttttctgtccccatagtacagttcttcagtggacatgaccccacccagccccctgcagccctgctgcaccatctcaccagacacaaggggaagaagcagacatcaggtgctgcactcacttctgccccctggggagttggggaaaggaacgaaccctggctggaggggataggagggcttttaatttatttctttttctgttgaggcttccccctctctgagccagttttcatttcttcctggtggcattagccactccctgcctctcactccagacctgttcccacaactggggaggtaggctgggagcaaaaggagagggtgggacccagttttgcgtggttggtttttattaattatctggataacagcaaaaaaactgaaaataaagagagagagaga

SEQ ID NO: 102463 - DNA, 2168 bp, Homo sapiens
  Payload ID: 2
  Gene Symbol: AGPAT1
  Gene Name: 1-acylglycerol-3-phosphate O-acyltransferase 1
  Uniprot ID: Q99943
  ENST ID: ENST00000395497
  CDS Start-End: 253-1104
tggccgacatcgggaaagacggcgaagagctaggaaaagagggaaaacactagggtcgcagggttcaaaatggctccaacctcctttggtgacgtagagagcagaacttgggtctgcccctcccttttagttaagggagcagaactgggattagcccgacgtttggatagtgggaacatcgatctgcggcgctggtgttaacccaactcattcggctggacgactcagccctccccatattaggtggccagaatggatttgtggccaggggcatggatgctgctgctgctgctcttcctgctgctgctcttcctgctgcccaccctgtggttctgcagccccagtgccaagtacttcttcaagatggccttctacaatggctggatcctcttcctggctgtgctcgccatccctgtgtgtgccgtgcgaggacgcaacgtcgagaacatgaagatcttgcgtctaatgctgctccacatcaaatacctgtacgggatccgagtggaggtgcgaggggctcaccacttccctccctcgcagccctatgttgttgtctccaaccaccagagctctctcgatctgcttgggatgatggaggtactgccaggccgctgtgtgcccattgccaagcgcgagctactgtgggctggctctgccgggctggcctgctggctggcaggagtcatcttcatcgaccggaagcgcacgggggatgccatcagtgtcatgtctgaggtcgcccagaccctgctcacccaggacgtgagggtctgggtgtttcctgagggaacgagaaaccacaatggctccatgctgcccttcaaacgtggcgccttccatcttgcagtgcaggcccaggttcccattgtccccatagtcatgtcctcctaccaagacttctactgcaagaaggagcgtcgcttcacctcgggacaatgtcaggtgcgggtgctgcccccagtgcccacggaagggctgacaccagatgacgtcccagctctggctgacagagtccggcactccatgctcactgttttccgggaaatctccactgatggccggggtggtggtgactatctgaagaagcctgggggcggtgggtgaaccctggctctgagctctcctcccatctgtccccatcttcctccccacacctacccacccagtgggccctgaagcagggccaaaccctcttccttgtctcccctctccccacttattctcctctttggaatcttcaacttctgaagtgaatgtggatacagcgccactcctgccccctcttggccccatccatggactcttgcctcggtgcagtctccactcttgacccccacctcctactgtcttgtctgtgggacagttgcctccccctcatctccagtgactcagcctacacaagggaggggaacattccatccccagtggagtctcttcctatgtggtcttctctacccctctaccccacattggccagtggactcatccattctttggaacaaatcccccccactccaaagtccatggattcaatggactcatccatttgtgaggaggacttctcgccctctggctggaagctgatacctgaagcactcccaggctcatcatgggagctttcctcagcaccttcaccttccctcccagtgtagcctcctgtcagtgggggctggacccttctaattcagaggtctcatgcctgcccttgcccagatgcccagggtcgtgcactctctgggataccagttcagtctccacatttctggttttctgtccccatagtacagttcttcagtggacatgaccccacccagccccctgcagccctgctgcaccatctcaccagacacaaggggaagaagcagacatcaggtgctgcactcacttctgccccctggggagttggggaaaggaacgaaccctggctggaggggataggagggcttttaatttatttctttttctgttgaggcttccccctctctgagccagttttcatttcttcctggtggcattagccactccctgcctctcactccagacctgttcccacaactggggaggtaggctgggagcaaaaggagagggtgggacccagttttgcgtggttggtttttattaattatctggataacagcaaaaaaactgaaaataaagagagagagaga

SEQ ID NO: 102464 - DNA, 2496 bp, Homo sapiens
  Payload ID: 2
  Gene Symbol: AGPAT1
  Gene Name: 1-acylglycerol-3-phosphate O-acyltransferase 1
  Uniprot ID: Q99943
  ENST ID: ENST00000395499
  CDS Start-End: 581-1432
ggcagatgaggattcaggaagcttgaggtttaggaaggaagatattgagagggaaaggtggaaatgaaggagagtgaagtgatggaatgatcctagtaaagggataatgggagtggaggaagagaagagggggtggaaaactagatacatggctaccaaattaaggaggcacgcgcattccagaggaatcggcattcttcctcactttttatttttctagaaagcacccctgaagccaaatttccattggaagaaaagatgtacccatattgtatgttgtgagaaggggttgtctcagcttgggcaagtaaggagactgatacgaaggaagtaggaaagaaaaggtacagaggtaaaagagcatggaaaaggaaagggtcagggataaggccaaagagatctcttctctttaaaggccagagaaggcaggtggaggggggagctggactgctgggagatagtgagggacaaagggcaaaggaaaccagaccagaggactggagagtgagatggagtgagatggagtcctggagagaaaaagaagagaggtgaacttaatgcttgtcatatggtggccagaatggatttgtggccaggggcatggatgctgctgctgctgctcttcctgctgctgctcttcctgctgcccaccctgtggttctgcagccccagtgccaagtacttcttcaagatggccttctacaatggctggatcctcttcctggctgtgctcgccatccctgtgtgtgccgtgcgaggacgcaacgtcgagaacatgaagatcttgcgtctaatgctgctccacatcaaatacctgtacgggatccgagtggaggtgcgaggggctcaccacttccctccctcgcagccctatgttgttgtctccaaccaccagagctctctcgatctgcttgggatgatggaggtactgccaggccgctgtgtgcccattgccaagcgcgagctactgtgggctggctctgccgggctggcctgctggctggcaggagtcatcttcatcgaccggaagcgcacgggggatgccatcagtgtcatgtctgaggtcgcccagaccctgctcacccaggacgtgagggtctgggtgtttcctgagggaacgagaaaccacaatggctccatgctgcccttcaaacgtggcgccttccatcttgcagtgcaggcccaggttcccattgtccccatagtcatgtcctcctaccaagacttctactgcaagaaggagcgtcgcttcacctcgggacaatgtcaggtgcgggtgctgcccccagtgcccacggaagggctgacaccagatgacgtcccagctctggctgacagagtccggcactccatgctcactgttttccgggaaatctccactgatggccggggtggtggtgactatctgaagaagcctgggggcggtgggtgaaccctggctctgagctctcctcccatctgtccccatcttcctccccacacctacccacccagtgggccctgaagcagggccaaaccctcttccttgtctcccctctccccacttattctcctctttggaatcttcaacttctgaagtgaatgtggatacagcgccactcctgccccctcttggccccatccatggactcttgcctcggtgcagtctccactcttgacccccacctcctactgtcttgtctgtgggacagttgcctccccctcatctccagtgactcagcctacacaagggaggggaacattccatccccagtggagtctcttcctatgtggtcttctctacccctctaccccacattggccagtggactcatccattctttggaacaaatcccccccactccaaagtccatggattcaatggactcatccatttgtgaggaggacttctcgccctctggctggaagctgatacctgaagcactcccaggctcatcatgggagctttcctcagcaccttcaccttccctcccagtgtagcctcctgtcagtgggggctggacccttctaattcagaggtctcatgcctgcccttgcccagatgcccagggtcgtgcactctctgggataccagttcagtctccacatttctggttttctgtccccatagtacagttcttcagtggacatgaccccacccagccccctgcagccctgctgcaccatctcaccagacacaaggggaagaagcagacatcaggtgctgcactcacttctgccccctggggagttggggaaaggaacgaaccctggctggaggggataggagggcttttaatttatttctttttctgttgaggcttccccctctctgagccagttttcatttcttcctggtggcattagccactccctgcctctcactccagacctgttcccacaactggggaggtaggctgggagcaaaaggagagggtgggacccagttttgcgtggttggtttttattaattatctggataacagcaaaaaaactgaaaataaagagagagagaga

SEQ ID NO: 102465 - DNA, 2496 bp, Homo sapiens
  Payload ID: 2
  Gene Symbol: AGPAT1
  Gene Name: 1-acylglycerol-3-phosphate O-acyltransferase 1
  Uniprot ID: Q99943
  ENST ID: ENST00000399825
  CDS Start-End: 581-1432
ggcagatgaggattcaggaagcttgaggtttaggaaggaagatattgagagggaaaggtggaaatgaaggagagtgaagtgatggaatgatcctagtaaagggataatgggagtggaggaagagaagagggggtggaaaactagatacatggctaccaaattaaggaggcacgcgcattccagaggaatcggcattcttcctcactttttatttttctagaaagcacccctgaagccaaatttccattggaagaaaagatgtacccatattgtatgttgtgagaaggggttgtctcagcttgggcaagtaaggagactgatacgaaggaagtaggaaagaaaaggtacagaggtaaaagagcatggaaaaggaaagggtcagggataaggccaaagagatctcttctctttaaaggccagagaaggcaggtggaggggggagctggactgctgggagatagtgagggacaaagggcaaaggaaaccagaccagaggactggagagtgagatggagtgagatggagtcctggagagaaaaagaagagaggtgaacttaatgcttgtcatatggtggccagaatggatttgtggccaggggcatggatgctgctgctgctgctcttcctgctgctgctcttcctgctgcccaccctgtggttctgcagccccagtgccaagtacttcttcaagatggccttctacaatggctggatcctcttcctggctgtgctcgccatccctgtgtgtgccgtgcgaggacgcaacgtcgagaacatgaagatcttgcgtctaatgctgctccacatcaaatacctgtacgggatccgagtggaggtgcgaggggctcaccacttccctccctcgcagccctatgttgttgtctccaaccaccagagctctctcgatctgcttgggatgatggaggtactgccaggccgctgtgtgcccattgccaagcgcgagctactgtgggctggctctgccgggctggcctgctggctggcaggagtcatcttcatcgaccggaagcgcacgggggatgccatcagtgtcatgtctgaggtcgcccagaccctgctcacccaggacgtgagggtctgggtgtttcctgagggaacgagaaaccacaatggctccatgctgcccttcaaacgtggcgccttccatcttgcagtgcaggcccaggttcccattgtccccatagtcatgtcctcctaccaagacttctactgcaagaaggagcgtcgcttcacctcgggacaatgtcaggtgcgggtgctgcccccagtgcccacggaagggctgacaccagatgacgtcccagctctggctgacagagtccggcactccatgctcactgttttccgggaaatctccactgatggccggggtggtggtgactatctgaagaagcctgggggcggtgggtgaaccctggctctgagctctcctcccatctgtccccatcttcctccccacacctacccacccagtgggccctgaagcagggccaaaccctcttccttgtctcccctctccccacttattctcctctttggaatcttcaacttctgaagtgaatgtggatacagcgccactcctgccccctcttggccccatccatggactcttgcctcggtgcagtctccactcttgacccccacctcctactgtcttgtctgtgggacagttgcctccccctcatctccagtgactcagcctacacaagggaggggaacattccatccccagtggagtctcttcctatgtggtcttctctacccctctaccccacattggccagtggactcatccattctttggaacaaatcccccccactccaaagtccatggattcaatggactcatccatttgtgaggaggacttctcgccctctggctggaagctgatacctgaagcactcccaggctcatcctgggagctttcctcagcaccttcaccttccctcccagtgtagcctcctgtcagtgggggctggacccttctaattcagaggtctcatgcctgcccttgcccagatgcccagggtcgtgcactctctgggataccagttcagtctccacatttctggttttctgtccccatagtacagttcttcagtggacatgaccccacccagccccctgcagccctgctgcaccatctcaccagacacaaggggaagaagcagacatcaggtgctgcactcacttctgccccctggggagttggggaaaggaacgaaccctggctggaggggataggagggcttttaatttatttctttttctgttgaggcttccccctctctgagccagttttcatttcttcctggtggcattagccactccctgcctctcactccagacctgttcccacaactggggaggtaggctgggagcaaaaggagagggtgggacccagttttgcgtggttggtttttattaattatctggataacagcaaaaaaactgaaaataaagagagagagaga

SEQ ID NO: 102466 - DNA, 2103 bp, Homo sapiens
  Payload ID: 2
  Gene Symbol: AGPAT1
  Gene Name: 1-acylglycerol-3-phosphate O-acyltransferase 1
  Uniprot ID: Q99943
  ENST ID: ENST00000399827
  CDS Start-End: 188-1039
ctttcctctcccagggcaagtgctgttaggtcacctttactccattccctccttttttcacttggtgaggcctcacacactgtacctgcccacgcaaagtgtcactagaaggaagggaaagggtagtaggattcgtttgcctgtctggaggtaggattggtctttgtagctattccaggtggccagaatggatttgtggccaggggcatggatgctgctgctgctgctcttcctgctgctgctcttcctgctgcccaccctgtggttctgcagccccagtgccaagtacttcttcaagatggccttctacaatggctggatcctcttcctggctgtgctcgccatccctgtgtgtgccgtgcgaggacgcaacgtcgagaacatgaagatcttgcgtctaatgctgctccacatcaaatacctgtacgggatccgagtggaggtgcgaggggctcaccacttccctccctcgcagccctatgttgttgtctccaaccaccagagctctctcgatctgcttgggatgatggaggtactgccaggccgctgtgtgcccattgccaagcgcgagctactgtgggctggctctgccgggctggcctgctggctggcaggagtcatcttcatcgaccggaagcgcacgggggatgccatcagtgtcatgtctgaggtcgcccagaccctgctcacccaggacgtgagggtctgggtgtttcctgagggaacgagaaaccacaatggctccatgctgcccttcaaacgtggcgccttccatcttgcagtgcaggcccaggttcccattgtccccatagtcatgtcctcctaccaagacttctactgcaagaaggagcgtcgcttcacctcgggacaatgtcaggtgcgggtgctgcccccagtgcccacggaagggctgacaccagatgacgtcccagctctggctgacagagtccggcactccatgctcactgttttccgggaaatctccactgatggccggggtggtggtgactatctgaagaagcctgggggcggtgggtgaaccctggctctgagctctcctcccatctgtccccatcttcctccccacacctacccacccagtgggccctgaagcagggccaaaccctcttccttgtctcccctctccccacttattctcctctttggaatcttcaacttctgaagtgaatgtggatacagcgccactcctgccccctcttggccccatccatggactcttgcctcggtgcagtctccactcttgacccccacctcctactgtcttgtctgtgggacagttgcctccccctcatctccagtgactcagcctacacaagggaggggaacattccatccccagtggagtctcttcctatgtggtcttctctacccctctaccccacattggccagtggactcatccattctttggaacaaatcccccccactccaaagtccatggattcaatggactcatccatttgtgaggaggacttctcgccctctggctggaagctgatacctgaagcactcccaggctcatcctgggagctttcctcagcaccttcaccttccctcccagtgtagcctcctgtcagtgggggctggacccttctaattcagaggtctcatgcctgcccttgcccagatgcccagggtcgtgcactctctgggataccagttcagtctccacatttctggttttctgtccccatagtacagttcttcagtggacatgaccccacccagccccctgcagccctgctgcaccatctcaccagacacaaggggaagaagcagacatcaggtgctgcactcacttctgccccctggggagttggggaaaggaacgaaccctggctggaggggataggagggcttttaatttatttctttttctgttgaggcttccccctctctgagccagttttcatttcttcctggtggcattagccactccctgcctctcactccagacctgttcccacaactggggaggtaggctgggagcaaaaggagagggtgggacccagttttgcgtggttggtttttattaattatctggataacagcaaaaaaactgaaaataaagagagagagaga

SEQ ID NO: 102467 - DNA, 2168 bp, Homo sapiens
  Payload ID: 2
  Gene Symbol: AGPAT1
  Gene Name: 1-acylglycerol-3-phosphate O-acyltransferase 1
  Uniprot ID: Q99943
  ENST ID: ENST00000399829
  CDS Start-End: 253-1104
tggccgacatcgggaaagacggcgaagagctaggaaaagagggaaaacactagggtcgcagggttcaaaatggctccaacctcctttggtgacgtagagagcagaacttgggtctgcccctcccttttagttaagggagcagaactgggattagcccgacgtttggatagtgggaacatcgatctgcggcgctggtgttaacccaactcattcggctggacgactcagccctccccatattaggtggccagaatggatttgtggccaggggcatggatgctgctgctgctgctcttcctgctgctgctcttcctgctgcccaccctgtggttctgcagccccagtgccaagtacttcttcaagatggccttctacaatggctggatcctcttcctggctgtgctcgccatccctgtgtgtgccgtgcgaggacgcaacgtcgagaacatgaagatcttgcgtctaatgctgctccacatcaaatacctgtacgggatccgagtggaggtgcgaggggctcaccacttccctccctcgcagccctatgttgttgtctccaaccaccagagctctctcgatctgcttgggatgatggaggtactgccaggccgctgtgtgcccattgccaagcgcgagctactgtgggctggctctgccgggctggcctgctggctggcaggagtcatcttcatcgaccggaagcgcacgggggatgccatcagtgtcatgtctgaggtcgcccagaccctgctcacccaggacgtgagggtctgggtgtttcctgagggaacgagaaaccacaatggctccatgctgcccttcaaacgtggcgccttccatcttgcagtgcaggcccaggttcccattgtccccatagtcatgtcctcctaccaagacttctactgcaagaaggagcgtcgcttcacctcgggacaatgtcaggtgcgggtgctgcccccagtgcccacggaagggctgacaccagatgacgtcccagctctggctgacagagtccggcactccatgctcactgttttccgggaaatctccactgatggccggggtggtggtgactatctgaagaagcctgggggcggtgggtgaaccctggctctgagctctcctcccatctgtccccatcttcctccccacacctacccacccagtgggccctgaagcagggccaaaccctcttccttgtctcccctctccccacttattctcctctttggaatcttcaacttctgaagtgaatgtggatacagcgccactcctgccccctcttggccccatccatggactcttgcctcggtgcagtctccactcttgacccccacctcctactgtcttgtctgtgggacagttgcctccccctcatctccagtgactcagcctacacaagggaggggaacattccatccccagtggagtctcttcctatgtggtcttctctacccctctaccccacattggccagtggactcatccattctttggaacaaatcccccccactccaaagtccatggattcaatggactcatccatttgtgaggaggacttctcgccctctggctggaagctgatacctgaagcactcccaggctcatcctgggagctttcctcagcaccttcaccttccctcccagtgtagcctcctgtcagtgggggctggacccttctaattcagaggtctcatgcctgcccttgcccagatgcccagggtcgtgcactctctgggataccagttcagtctccacatttctggttttctgtccccatagtacagttcttcagtggacatgaccccacccagccccctgcagccctgctgcaccatctcaccagacacaaggggaagaagcagacatcaggtgctgcactcacttctgccccctggggagttggggaaaggaacgaaccctggctggaggggataggagggcttttaatttatttctttttctgttgaggcttccccctctctgagccagttttcatttcttcctggtggcattagccactccctgcctctcactccagacctgttcccacaactggggaggtaggctgggagcaaaaggagagggtgggacccagttttgcgtggttggtttttattaattatctggataacagcaaaaaaactgaaaataaagagagagagaga

SEQ ID NO: 102468 - DNA, 2017 bp, Homo sapiens
  Payload ID: 2
  Gene Symbol: AGPAT1
  Gene Name: 1-acylglycerol-3-phosphate O-acyltransferase 1
  Uniprot ID: Q99943
  ENST ID: ENST00000399830
  CDS Start-End: 102-953
gaaatagggtcttcttcccaggttggaccccggggagtttgggcttttcctacaatcactgaccctcactgtgactaaaggagcagaattaggtggccagaatggatttgtggccaggggcatggatgctgctgctgctgctcttcctgctgctgctcttcctgctgcccaccctgtggttctgcagccccagtgccaagtacttcttcaagatggccttctacaatggctggatcctcttcctggctgtgctcgccatccctgtgtgtgccgtgcgaggacgcaacgtcgagaacatgaagatcttgcgtctaatgctgctccacatcaaatacctgtacgggatccgagtggaggtgcgaggggctcaccacttccctccctcgcagccctatgttgttgtctccaaccaccagagctctctcgatctgcttgggatgatggaggtactgccaggccgctgtgtgcccattgccaagcgcgagctactgtgggctggctctgccgggctggcctgctggctggcaggagtcatcttcatcgaccggaagcgcacgggggatgccatcagtgtcatgtctgaggtcgcccagaccctgctcacccaggacgtgagggtctgggtgtttcctgagggaacgagaaaccacaatggctccatgctgcccttcaaacgtggcgccttccatcttgcagtgcaggcccaggttcccattgtccccatagtcatgtcctcctaccaagacttctactgcaagaaggagcgtcgcttcacctcgggacaatgtcaggtgcgggtgctgcccccagtgcccacggaagggctgacaccagatgacgtcccagctctggctgacagagtccggcactccatgctcactgttttccgggaaatctccactgatggccggggtggtggtgactatctgaagaagcctgggggcggtgggtgaaccctggctctgagctctcctcccatctgtccccatcttcctccccacacctacccacccagtgggccctgaagcagggccaaaccctcttccttgtctcccctctccccacttattctcctctttggaatcttcaacttctgaagtgaatgtggatacagcgccactcctgccccctcttggccccatccatggactcttgcctcggtgcagtctccactcttgacccccacctcctactgtcttgtctgtgggacagttgcctccccctcatctccagtgactcagcctacacaagggaggggaacattccatccccagtggagtctcttcctatgtggtcttctctacccctctaccccacattggccagtggactcatccattctttggaacaaatcccccccactccaaagtccatggattcaatggactcatccatttgtgaggaggacttctcgccctctggctggaagctgatacctgaagcactcccaggctcatcctgggagctttcctcagcaccttcaccttccctcccagtgtagcctcctgtcagtgggggctggacccttctaattcagaggtctcatgcctgcccttgcccagatgcccagggtcgtgcactctctgggataccagttcagtctccacatttctggttttctgtccccatagtacagttcttcagtggacatgaccccacccagccccctgcagccctgctgcaccatctcaccagacacaaggggaagaagcagacatcaggtgctgcactcacttctgccccctggggagttggggaaaggaacgaaccctggctggaggggataggagggcttttaatttatttctttttctgttgaggcttccccctctctgagccagttttcatttcttcctggtggcattagccactccctgcctctcactccagacctgttcccacaactggggaggtaggctgggagcaaaaggagagggtgggacccagttttgcgtggttggtttttattaattatctggataacagcaaaaaaactgaaaataaagagagagagaga

SEQ ID NO: 102469 - DNA, 2234 bp, Homo sapiens
  Payload ID: 2
  Gene Symbol: AGPAT1
  Gene Name: 1-acylglycerol-3-phosphate O-acyltransferase 1
  Uniprot ID: Q99943
  ENST ID: ENST00000399833
  CDS Start-End: 319-1170
ggaaaccagcaggcgttggggaggggtggcgggggaatagcggcggcagcagccccagccctcagagagacagcagaaagggagggagggagggtgctggggggacagccccccaccattcctaccgctatgggcccaacctcccactcccacctcccctccatcggccggggctaggacacccccaaatcccgtcgcccccttggcaccgacaccccgacagagacagagacacagccatccgccaccaccgctgccgcagcctggctggggagggggccagccccccaggccccctacccctctgaggtggccagaatggatttgtggccaggggcatggatgctgctgctgctgctcttcctgctgctgctcttcctgctgcccaccctgtggttctgcagccccagtgccaagtacttcttcaagatggccttctacaatggctggatcctcttcctggctgtgctcgccatccctgtgtgtgccgtgcgaggacgcaacgtcgagaacatgaagatcttgcgtctaatgctgctccacatcaaatacctgtacgggatccgagtggaggtgcgaggggctcaccacttccctccctcgcagccctatgttgttgtctccaaccaccagagctctctcgatctgcttgggatgatggaggtactgccaggccgctgtgtgcccattgccaagcgcgagctactgtgggctggctctgccgggctggcctgctggctggcaggagtcatcttcatcgaccggaagcgcacgggggatgccatcagtgtcatgtctgaggtcgcccagaccctgctcacccaggacgtgagggtctgggtgtttcctgagggaacgagaaaccacaatggctccatgctgcccttcaaacgtggcgccttccatcttgcagtgcaggcccaggttcccattgtccccatagtcatgtcctcctaccaagacttctactgcaagaaggagcgtcgcttcacctcgggacaatgtcaggtgcgggtgctgcccccagtgcccacggaagggctgacaccagatgacgtcccagctctggctgacagagtccggcactccatgctcactgttttccgggaaatctccactgatggccggggtggtggtgactatctgaagaagcctgggggcggtgggtgaaccctggctctgagctctcctcccatctgtccccatcttcctccccacacctacccacccagtgggccctgaagcagggccaaaccctcttccttgtctcccctctccccacttattctcctctttggaatcttcaacttctgaagtgaatgtggatacagcgccactcctgccccctcttggccccatccatggactcttgcctcggtgcagtctccactcttgacccccacctcctactgtcttgtctgtgggacagttgcctccccctcatctccagtgactcagcctacacaagggaggggaacattccatccccagtggagtctcttcctatgtggtcttctctacccctctaccccacattggccagtggactcatccattctttggaacaaatcccccccactccaaagtccatggattcaatggactcatccatttgtgaggaggacttctcgccctctggctggaagctgatacctgaagcactcccaggctcatcctgggagctttcctcagcaccttcaccttccctcccagtgtagcctcctgtcagtgggggctggacccttctaattcagaggtctcatgcctgcccttgcccagatgcccagggtcgtgcactctctgggataccagttcagtctccacatttctggttttctgtccccatagtacagttcttcagtggacatgaccccacccagccccctgcagccctgctgcaccatctcaccagacacaaggggaagaagcagacatcaggtgctgcactcacttctgccccctggggagttggggaaaggaacgaaccctggctggaggggataggagggcttttaatttatttctttttctgttgaggcttccccctctctgagccagttttcatttcttcctggtggcattagccactccctgcctctcactccagacctgttcccacaactggggaggtaggctgggagcaaaaggagagggtgggacccagttttgcgtggttggtttttattaattatctggataacagcaaaaaaactgaaaataaagagagagagaga

SEQ ID NO: 102470 - DNA, 2234 bp, Homo sapiens; identical to SEQ ID NO: 102469
  Payload ID: 2
  Gene Symbol: AGPAT1
  Gene Name: 1-acylglycerol-3-phosphate O-acyltransferase 1
  Uniprot ID: Q99943
  ENST ID: ENST00000452427
  CDS Start-End: 319-1170

SEQ ID NO: 102471 - DNA, 2234 bp, Homo sapiens
  Payload ID: 2
  Gene Symbol: AGPAT1
  Gene Name: 1-acylglycerol-3-phosphate O-acyltransferase 1
  Uniprot ID: Q99943
  ENST ID: ENST00000433376
  CDS Start-End: 319-1170
ggaaaccagcaggcgttggggaggggtggcgggggaatagcggcggcagcagccccagccctcagagagacagcagaaagggagggagggagggtgctggggggacagccccccaccattcctaccgctatgggcccaacctcccactcccacctcccctccatcggccggggctaggacacccccaaatcccgtcgcccccttggcaccgacaccccgacagagacagagacacagccatccgccaccaccgctgccgcagcctggctggggagggggccagccccccaggccccctacccctctgaggtggccagaatggatttgtggccaggggcatggatgctgctgctgctgctcttcctgctgctgctcttcctgctgcccaccctgtggttctgcagccccagtgccaagtacttcttcaagatggccttctacaatggctggatcctcttcctggctgtgctcgccatccctgtgtgtgccgtgcgaggacgcaacgtcgagaacatgaagatcttgcgtctaatgctgctccacatcaaatacctgtacgggatccgagtggaggtgcgaggggctcaccacttccctccctcgcagccctatgttgttgtctccaaccaccagagctctctcgatctgcttgggatgatggaggtactgccaggccgctgtgtgcccattgccaagcgcgagctactgtgggctggctctgccgggctggcctgctggctggcaggagtcatcttcatcgaccggaagcgcacgggggatgccatcagtgtcatgtctgaggtcgcccagaccctgctcacccaggacgtgagggtctgggtgtttcctgagggaacgagaaaccacaatggctccatgctgcccttcaaacgtggcgccttccatcttgcagtgcaggcccaggttcccattgtccccatagtcatgtcctcctaccaagacttctactgcaagaaggagcgtcgcttcacctcgggacaatgtcaggtgcgggtgctgcccccagtgcccacggaagggctgacaccagatgacgtcccagctctggctgacagagtccggcactccatgctcactgttttccgggaaatctccactgatggccggggtggtggtgactatctgaagaagcctgggggcggtgggtgaaccctggctctgagctctcctcccatctgtccccatcttcctccccacacctacccacccagtgggccctgaagcagggccaaaccctcttccttgtctcccctctccccacttattctcctctttggaatcttcaacttctgaagtgaatgtggatacagcgccactcctgccccctcttggccccatccatggactcttgcctcggtgcagtttccactcttgacccccacctcctactgtcttgtctgtgggacagttgcctccccctcatctccagtgactcagcctacacaagggaggggaacattccatccccagtggagtctcttcctatgtggtcttctctacccctctaccccacattggccagtggactcatccattctttggaacaaatcccccccactccaaagtccatggattcaatggactcatccatttgtgaggaggacttctcgccctctggctggaagctgatacctgaagcactcccaggctcatcctgggagctttcctcagcaccttcaccttccctcccagtgtagcctcctgtcagtgggggctggacccttctaattcagaggtctcatgcctgcccttgcccagatgcccagggtcgtgcactctctgggataccagttcagtctccacatttctggttttctgtccccatagtacagttcttcagtggacatgaccccacccagccccctgcagccctgctgcaccatctcaccagacacaaggggaagaagcagacatcaggtgctgcactcacttctgccccctggggagttggggaaaggaacgaaccctggctggaggggataggagggcttttaatttatttctttttctgttgaggcttccccctctctgagccagttttcatttcttcctggtggcattagccactccctgcctctcactccagacctgttcccacaactggggaggtaggctgggagcaaaaggagagggtgggacccagttttgcgtggttggtttttattaattatctggataacagcaaaaaaactgaaaataaagagagagagaga

SEQ ID NO: 102472 - DNA, 2168 bp, Homo sapiens; identical to SEQ ID NO: 102467
  Payload ID: 2
  Gene Symbol: AGPAT1
  Gene Name: 1-acylglycerol-3-phosphate O-acyltransferase 1
  Uniprot ID: Q99943
  ENST ID: ENST00000436149
  CDS Start-End: 253-1104

SEQ ID NO: 102473 - DNA, 2021 bp, Homo sapiens; identical to SEQ ID NO: 102461
  Payload ID: 2
  Gene Symbol: AGPAT1
  Gene Name: 1-acylglycerol-3-phosphate O-acyltransferase 1
  Uniprot ID: Q99943
  ENST ID: ENST00000425204
  CDS Start-End: 106-957

SEQ ID NO: 102474 - DNA, 2021 bp, Homo sapiens
  Payload ID: 2
  Gene Symbol: AGPAT1
  Gene Name: 1-acylglycerol-3-phosphate O-acyltransferase 1
  Uniprot ID: Q99943
  ENST ID: ENST00000456679
  CDS Start-End: 106-957
tcctcttttagagaatgtccggattgctattggactttggagcgtatggctccaaatcaactcattggctaaaacttgacggaaaatggtggttaggtggccagaatggatttgtggccaggggcatggatgctgctgctgctgctcttcctgctgctgctcttcctgctgcccaccctgtggttctgcagccccagtgccaagtacttcttcaagatggccttctacaatggctggatcctcttcctggctgtgctcgccatccctgtgtgtgccgtgcgaggacgcaacgtcgagaacatgaagatcttgcgtctaatgctgctccacatcaaatacctgtacgggatccgagtggaggtgcgaggggctcaccacttccctccctcgcagccctatgttgttgtctccaaccaccagagctctctcgatctgcttgggatgatggaggtactgccaggccgctgtgtgcccattgccaagcgcgagctactgtgggctggctctgccgggctggcctgctggctggcaggagtcatcttcatcgaccggaagcgcacgggggatgccatcagtgtcatgtctgaggtcgcccagaccctgctcacccaggacgtgagggtctgggtgtttcctgagggaacgagaaaccacaatggctccatgctgcccttcaaacgtggcgccttccatcttgcagtgcaggcccaggttcccattgtccccatagtcatgtcctcctaccaagacttctactgcaagaaggagcgtcgcttcacctcgggacaatgtcaggtgcgggtgctgcccccagtgcccacggaagggctgacaccagatgacgtcccagctctggctgacagagtccggcactccatgctcactgttttccgggaaatctccactgatggccggggtggtggtgactatctgaagaagcctgggggcggtgggtgaaccctggctctgagctctcctcccatctgtccccatcttcctccccacacctacccacccagtgggccctgaagcagggccaaaccctcttccttgtctcccctctccccacttattctcctatttggaatcttcaacttctgaagtgaatgtggatacagcgccactcctgccccctcttggccccatccatggactcttgcctcggtgcagtctccactcttgacccccacctcctactgtcttgtctgtgggacagttgcctccccctcatctccagtgactcagcctacacaagggaggggaacattccatccccagtggagtctcttcctatgtggtcttctctacccctctaccccacattggccagtggactcatccattctttggaacaaatcccccccactccaaagtccatggattcaatggactcatccatttgtgaggaggacttctcgccctctggctggaagctgatacctgaagcactcccaggctcatcctgggagctttcctcagcaccttcaccttccctcccagtgtagcctcctgtcagtgggggctggacccttctaattcagaggtctcatgcctgcccttgcccagatgcccagggtcgtgcactctctgggataccagttcagtctccacatttctggttttctgtccccatagtacagttcttcagtggacatgaccccacccagccccctgcagccctgctgcaccatctcaccagacacaaggggaagaagcagacatcaggtgctgcactcacttctgccccctggggagttggggaaaggaacgaaccctggctggaggggataggagggcttttaatttatttctttttctgttgaggcttccccctctctgagccagttttcatttcttcctggtggcattagccactccctgcctctcactccagacctgttcccacaactggggaggtaggctgggagcaaaaggagagggtgggacccagttttgcgtggttggtttttattaattatctggataacagcaaaaaaactgaaaataaagagagagagaga

SEQ ID NO: 102475 - DNA, 2234 bp, Homo sapiens
  Payload ID: 2
  Gene Symbol: AGPAT1
  Gene Name: 1-acylglycerol-3-phosphate O-acyltransferase 1
  Uniprot ID: Q99943
  ENST ID: ENST00000414933
  CDS Start-End: 319-1170
ggaaaccagcaggcgttggggaggggtggcgggggaatagcggcggcagcagccccagccctcagagagacagcagaaagggagggagggagggtgctggggggacagccccccaccattcctaccgctatgggcccaacctcccactcccacctcccctccatcggccggggctaggacacccccaaatcccgtcgcccccttggcaccgacaccccgacagagacagagacacagccatccgccaccaccgctgccgcagcctggctggggagggggccagccccccaggccccctacccctctgaggtggccagaatggatttgtggccaggggcatggatgctgctgctgctgctcttcctgctgctgctcttcctgctgcccaccctgtggttctgcagccccagtgccaagtacttcttcaagatggccttctacaatggctggatcctcttcctggctgtgctcgccatccctgtgtgtgccgtgcgaggacgcaacgtcgagaacatgaagatcttgcgtctaatgctgctccacatcaaatacctgtacgggatccgagtggaggtgcgaggggctcaccacttccctccctcgcagccctatgttgttgtctccaaccaccagagctctctcgatctgcttgggatgatggaggtactgccaggccgctgtgtgcccattgccaagcgcgagctactgtgggctggctctgccgggctggcctgctggctggcaggagtcatcttcatcgaccggaagcgcacgggggatgccatcagtgtcatgtctgaggtcgcccagaccctgctcacccaggacgtgagggtctgggtgtttcctgagggaacgagaaaccacaatggctccatgctgcccttcaaacgtggcgccttccatcttgcagtgcaggcccaggttcccattgtccccatagtcatgtcctcctaccaagacttctactgcaagaaggagcgtcgcttcacctcgggacaatgtcaggtgcgggtgctgcccccagtgcccacggaagggctgacaccagatgacgtcccagctctggctgacagagtccggcactccatgctcactgttttccgggaaatctccactgatggccggggtggtggtgactatctgaagaagcctgggggcggtgggtgaaccctggctctgagctctcctcccatctgtccccatcttcctccccacacctacccacccagtgggccctgaagcagggccaaaccctcttccttgtctcccctctccccacttattctcctatttggaatcttcaacttctgaagtgaatgtggatacagcgccactcctgccccctcttggccccatccatggactcttgcctcggtgcagtctccactcttgacccccacctcctactgtcttgtctgtgggacagttgcctccccctcatctccagtgactcagcctacacaagggaggggaacattccatccccagtggagtctcttcctatgtggtcttctctacccctctaccccacattggccagtggactcatccattctttggaacaaatcccccccactccaaagtccatggattcaatggactcatccatttgtgaggaggacttctcgccctctggctggaagctgatacctgaagcactcccaggctcatcctgggagctttcctcagcaccttcaccttccctcccagtgtagcctcctgtcagtgggggctggacccttctaattcagaggtctcatgcctgcccttgcccagatgcccagggtcgtgcactctctgggataccagttcagtctccacatttctggttttctgtccccatagtacagttcttcagtggacatgaccccacccagccccctgcagccctgctgcaccatctcaccagacacaaggggaagaagcagacatcaggtgctgcactcacttctgccccctggggagttggggaaaggaacgaaccctggctggaggggataggagggcttttaatttatttctttttctgttgaggcttccccctctctgagccagttttcatttcttcctggtggcattagccactccctgcctctcactccagacctgttcccacaactggggaggtaggctgggagcaaaaggagagggtgggacccagttttgcgtggttggtttttattaattatctggataacagcaaaaaaactgaaaataaagagagagagaga

SEQ ID NO: 102476 - DNA, 2017 bp, Homo sapiens
  Payload ID: 2
  Gene Symbol: AGPAT1
  Gene Name: 1-acylglycerol-3-phosphate O-acyltransferase 1
  Uniprot ID: Q99943
  ENST ID: ENST00000456421
  CDS Start-End: 102-953
gaaatagggtcttcttcccaggttggaccccggggagtttgggcttttcctacaatcactgaccctcactgtgactaaaggagcagaattaggtggccagaatggatttgtggccaggggcatggatgctgctgctgctgctcttcctgctgctgctcttcctgctgcccaccctgtggttctgcagccccagtgccaagtacttcttcaagatggccttctacaatggctggatcctcttcctggctgtgctcgccatccctgtgtgtgccgtgcgaggacgcaacgtcgagaacatgaagatcttgcgtctaatgctgctccacatcaaatacctgtacgggatccgagtggaggtgcgaggggctcaccacttccctccctcgcagccctatgttgttgtctccaaccaccagagctctctcgatctgcttgggatgatggaggtactgccaggccgctgtgtgcccattgccaagcgcgagctactgtgggctggctctgccgggctggcctgctggctggcaggagtcatcttcatcgaccggaagcgcacgggggatgccatcagtgtcatgtctgaggtcgcccagaccctgctcacccaggacgtgagggtctgggtgtttcctgagggaacgagaaaccacaatggctccatgctgcccttcaaacgtggcgccttccatcttgcagtgcaggcccaggttcccattgtccccatagtcatgtcctcctaccaagacttctactgcaagaaggagcgtcgcttcacctcgggacaatgtcaggtgcgggtgctgcccccagtgcccacggaagggctgacaccagatgacgtcccagctctggctgacagagtccggcactccatgctcactgttttccgggaaatctccactgatggccggggtggtggtgactatctgaagaagcctgggggcggtgggtgaaccctggctctgagctctcctcccatctgtccccatcttcctccccacacctacccacccagtgggccctgaagcagggccaaaccctcttccttgtctcccctctccccacttattctcctatttggaatcttcaacttctgaagtgaatgtggatacagcgccactcctgccccctcttggccccatccatggactcttgcctcggtgcagtctccactcttgacccccacctcctactgtcttgtctgtgggacagttgcctccccctcatctccagtgactcagcctacacaagggaggggaacattccatccccagtggagtctcttcctatgtggtcttctctacccctctaccccacattggccagtggactcatccattctttggaacaaatcccccccactccaaagtccatggattcaatggactcatccatttgtgaggaggacttctcgccctctggctggaagctgatacctgaagcactcccaggctcatcctgggagctttcctcagcaccttcaccttccctcccagtgtagcctcctgtcagtgggggctggacccttctaattcagaggtctcatgcctgcccttgcccagatgcccagggtcgtgcactctctgggataccagttcagtctccacatttctggttttctgtccccatagtacagttcttcagtggacatgaccccacccagccccctgcagccctgctgcaccatctcaccagacacaaggggaagaagcagacatcaggtgctgcactcacttctgccccctggggagttggggaaaggaacgaaccctggctggaggggataggagggcttttaatttatttctttttctgttgaggcttccccctctctgagccagttttcatttcttcctggtggcattagccactccctgcctctcactccagacctgttcccacaactggggaggtaggctgggagcaaaaggagagggtgggacccagttttgcgtggttggtttttattaattatctggataacagcaaaaaaactgaaaataaagagagagagaga

SEQ ID NO: 102477 - DNA, 2168 bp, Homo sapiens
  Payload ID: 2
  Gene Symbol: AGPAT1
  Gene Name: 1-acylglycerol-3-phosphate O-acyltransferase 1
  Uniprot ID: Q99943
  ENST ID: ENST00000454929
  CDS Start-End: 253-1104
tggccgacatcgggaaagacggcgaagagctaggaaaagagggaaaacactagggtcgcagggttcaaaatggctccaacctcctttggtgacgtagagagcagaacttgggtctgcccctcccttttagttaagggagcagaactgggattagcccgacgtttggatagtgggaacatcgatctgcggcgctggtgttaacccaactcattcggctggacgactcagccctccccatattaggtggccagaatggatttgtggccaggggcatggatgctgctgctgctgctcttcctgctgctgctcttcctgctgcccaccctgtggttctgcagccccagtgccaagtacttcttcaagatggccttctacaatggctggatcctcttcctggctgtgctcgccatccctgtgtgtgccgtgcgaggacgcaacgtcgagaacatgaagatcttgcgtctaatgctgctccacatcaaatacctgtacgggatccgagtggaggtgcgaggggctcaccacttccctccctcgcagccctatgttgttgtctccaaccaccagagctctctcgatctgcttgggatgatggaggtactgccaggccgctgtgtgcccattgccaagcgcgagctactgtgggctggctctgccgggctggcctgctggctggcaggagtcatcttcatcgaccggaagcgcacgggggatgccatcagtgtcatgtctgaggtcgcccagaccctgctcacccaggacgtgagggtctgggtgtttcctgagggaacgagaaaccacaatggctccatgctgcccttcaaacgtggcgccttccatcttgcagtgcaggcccaggttcccattgtccccatagtcatgtcctcctaccaagacttctactgcaagaaggagcgtcgcttcacctcgggacaatgtcaggtgcgggtgctgcccccagtgcccacggaagggctgacaccagatgacgtcccagctctggctgacagagtccggcactccatgctcactgttttccgggaaatctccactgatggccggggtggtggtgactatctgaagaagcctgggggcggtgggtgaaccctggctctgagctctcctcccatctgtccccatcttcctccccacacctacccacccagtgggccctgaagcagggccaaaccctcttccttgtctcccctctccccacttattctcctatttggaatcttcaacttctgaagtgaatgtggatacagcgccactcctgccccctcttggccccatccatggactcttgcctcggtgcagtctccactcttgacccccacctcctactgtcttgtctgtgggacagttgcctccccctcatctccagtgactcagcctacacaagggaggggaacattccatccccagtggagtctcttcctatgtggtcttctctacccctctaccccacattggccagtggactcatccattctttggaacaaatcccccccactccaaagtccatggattcaatggactcatccatttgtgaggaggacttctcgccctctggctggaagctgatacctgaagcactcccaggctcatcctgggagctttcctcagcaccttcaccttccctcccagtgtagcctcctgtcagtgggggctggacccttctaattcagaggtctcatgcctgcccttgcccagatgcccagggtcgtgcactctctgggataccagttcagtctccacatttctggttttctgtccccatagtacagttcttcagtggacatgaccccacccagccccctgcagccctgctgcaccatctcaccagacacaaggggaagaagcagacatcaggtgctgcactcacttctgccccctggggagttggggaaaggaacgaaccctggctggaggggataggagggcttttaatttatttctttttctgttgaggcttccccctctctgagccagttttcatttcttcctggtggcattagccactccctgcctctcactccagacctgttcccacaactggggaggtaggctgggagcaaaaggagagggtgggacccagttttgcgtggttggtttttattaattatctggataacagcaaaaaaactgaaaataaagagagagagaga

SEQ ID NO: 102478 - DNA, 2168 bp, Homo sapiens; identical to SEQ ID NO: 102467
  Payload ID: 2
  Gene Symbol: AGPAT1
  Gene Name: 1-acylglycerol-3-phosphate O-acyltransferase 1
  Uniprot ID: Q99943
  ENST ID: ENST00000446323
  CDS Start-End: 253-1104

SEQ ID NO: 102479 - DNA, 2021 bp, Homo sapiens
  Payload ID: 2
  Gene Symbol: AGPAT1
  Gene Name: 1-acylglycerol-3-phosphate O-acyltransferase 1
  Uniprot ID: Q99943
  ENST ID: ENST00000430777
  CDS Start-End: 106-957
tcctcttttagagaatgtccggattgctattggactttggagcgtatggctccaaatcaactcattggctaaaacttgacggaaaatggtggttaggtggccagaatggatttgtggccaggggcatggatgctgctgctgctgctcttcctgctgctgctcttcctgctgcccaccctgtggttctgcagccccagtgccaagtacttcttcaagatggccttctacaatggctggatcctcttcctggctgtgctcgccatccctgtgtgtgccgtgcgaggacgcaacgtcgagaacatgaagatcttgcgtctaatgctgctccacatcaaatacctgtacgggatccgagtggaggtgcgaggggctcaccacttccctccctcgcagccctatgttgttgtctccaaccaccagagctctctcgatctgcttgggatgatggaggtactgccaggccgctgtgtgcccattgccaagcgcgagctactgtgggctggctctgccgggctggcctgctggctggcaggagtcatcttcatcgaccggaagcgcacgggggatgccatcagtgtcatgtctgaggtcgcccagaccctgctcacccaggacgtgagggtctgggtgtttcctgagggaacgagaaaccacaatggctccatgctgcccttcaaacgtggcgccttccatcttgcagtgcaggcccaggttcccattgtccccatagtcatgtcctcctaccaagacttctactgcaagaaggagcgtcgcttcacctcgggacaatgtcaggtgcgggtgctgcccccagtgcccacggaagggctgacaccagatgacgtcccagctctggctgacagagtccggcactccatgctcactgttttccgggaaatctccactgatggccggggtggtggtgactatctgaagaagcctgggggcggtgggtgaaccctggctctgagctctcctcccatctgtccccatcttcctccccacacctacccacccagtgggccctgaagcagggccaaaccctcttccttgtctcccctctccccacttattctcctctttggaatcttcaacttctgaagtgaatgtggatacagcgccactcctgccccctcttggccccatccatggactcttgcctcggtgcagtttccactcttgacccccacctcctactgtcttgtctgtgggacagttgcctccccctcatctccagtgactcagcctacacaagggaggggaacattccatccccagtggagtctcttcctatgtggtcttctctacccctctaccccacattggccagtggactcatccattctttggaacaaatcccccccactccaaagtccatggattcaatggactcatccatttgtgaggaggacttctcgccctctggctggaagctgatacctgaagcactcccaggctcatcctgggagctttcctcagcaccttcaccttccctcccagtgtagcctcctgtcagtgggggctggacccttctaattcagaggtctcatgcctgcccttgcccagatgcccagggtcgtgcactctctgggataccagttcagtctccacatttctggttttctgtccccatagtacagttcttcagtggacatgaccccacccagccccctgcagccctgctgcaccatctcaccagacacaaggggaagaagcagacatcaggtgctgcactcacttctgccccctggggagttggggaaaggaacgaaccctggctggaggggataggagggcttttaatttatttctttttctgttgaggcttccccctctctgagccagttttcatttcttcctggtggcattagccactccctgcctctcactccagacctgttcccacaactggggaggtaggctgggagcaaaaggagagggtgggacccagttttgcgtggttggtttttattaattatctggataacagcaaaaaaactgaaaataaagagagagagaga

SEQ ID NO: 102480 - DNA, 2017 bp, Homo sapiens; identical to SEQ ID NO: 102468
  Payload ID: 2
  Gene Symbol: AGPAT1
  Gene Name: 1-acylglycerol-3-phosphate O-acyltransferase 1
  Uniprot ID: Q99943
  ENST ID: ENST00000425572
  CDS Start-End: 102-953

SEQ ID NO: 102481 - DNA, 2017 bp, Homo sapiens
  Payload ID: 2
  Gene Symbol: AGPAT1
  Gene Name: 1-acylglycerol-3-phosphate O-acyltransferase 1
  Uniprot ID: Q99943
  ENST ID: ENST00000455898
  CDS Start-End: 102-953
gaaatagggtcttcttcccaggttggaccccggggagtttgggcttttcctacaatcactgaccctcactgtgactaaaggagcagaattaggtggccagaatggatttgtggccaggggcatggatgctgctgctgctgctcttcctgctgctgctcttcctgctgcccaccctgtggttctgcagccccagtgccaagtacttcttcaagatggccttctacaatggctggatcctcttcctggctgtgctcgccatccctgtgtgtgccgtgcgaggacgcaacgtcgagaacatgaagatcttgcgtctaatgctgctccacatcaaatacctgtacgggatccgagtggaggtgcgaggggctcaccacttccctccctcgcagccctatgttgttgtctccaaccaccagagctctctcgatctgcttgggatgatggaggtactgccaggccgctgtgtgcccattgccaagcgcgagctactgtgggctggctctgccgggctggcctgctggctggcaggagtcatcttcatcgaccggaagcgcacgggggatgccatcagtgtcatgtctgaggtcgcccagaccctgctcacccaggacgtgagggtctgggtgtttcctgagggaacgagaaaccacaatggctccatgctgcccttcaaacgtggcgccttccatcttgcagtgcaggcccaggttcccattgtccccatagtcatgtcctcctaccaagacttctactgcaagaaggagcgtcgcttcacctcgggacaatgtcaggtgcgggtgctgcccccagtgcccacggaagggctgacaccagatgacgtcccagctctggctgacagagtccggcactccatgctcactgttttccgggaaatctccactgatggccggggtggtggtgactatctgaagaagcctgggggcggtgggtgaaccctggctctgagctctcctcccatctgtccccatcttcctccccacacctacccacccagtgggccctgaagcagggccaaaccctcttccttgtctcccctctccccacttattctcctctttggaatcttcaacttctgaagtgaatgtggatacagcgccactcctgccccctcttggccccatccatggactcttgcctcggtgcagtttccactcttgacccccacctcctactgtcttgtctgtgggacagttgcctccccctcatctccagtgactcagcctacacaagggaggggaacattccatccccagtggagtctcttcctatgtggtcttctctacccctctaccccacattggccagtggactcatccattctttggaacaaatcccccccactccaaagtccatggattcaatggactcatccatttgtgaggaggacttctcgccctctggctggaagctgatacctgaagcactcccaggctcatcctgggagctttcctcagcaccttcaccttccctcccagtgtagcctcctgtcagtgggggctggacccttctaattcagaggtctcatgcctgcccttgcccagatgcccagggtcgtgcactctctgggataccagttcagtctccacatttctggttttctgtccccatagtacagttcttcagtggacatgaccccacccagccccctgcagccctgctgcaccatctcaccagacacaaggggaagaagcagacatcaggtgctgcactcacttctgccccctggggagttggggaaaggaacgaaccctggctggaggggataggagggcttttaatttatttctttttctgttgaggcttccccctctctgagccagttttcatttcttcctggtggcattagccactccctgcctctcactccagacctgttcccacaactggggaggtaggctgggagcaaaaggagagggtgggacccagttttgcgtggttggtttttattaattatctggataacagcaaaaaaactgaaaataaagagagagagaga

SEQ ID NO: 102482 - DNA, 2168 bp, Homo sapiens
  Payload ID: 2
  Gene Symbol: AGPAT1
  Gene Name: 1-acylglycerol-3-phosphate O-acyltransferase 1
  Uniprot ID: Q99943
  ENST ID: ENST00000440840
  CDS Start-End: 253-1104
tggccgacatcgggaaagacggcgaagagctaggaaaagagggaaaacactagggtcgcagggttcaaaatggctccaacctcctttggtgacgtagagagcagaacttgggtctgcccctcccttttagttaagggagcagaactgggattagcccgacgtttggatagtgggaacatcgatctgcggcgctggtgttaacccaactcattcggctggacgactcagccctccccatattaggtggccagaatggatttgtggccaggggcatggatgctgctgctgctgctcttcctgctgctgctcttcctgctgcccaccctgtggttctgcagccccagtgccaagtacttcttcaagatggccttctacaatggctggatcctcttcctggctgtgctcgccatccctgtgtgtgccgtgcgaggacgcaacgtcgagaacatgaagatcttgcgtctaatgctgctccacatcaaatacctgtacgggatccgagtggaggtgcgaggggctcaccacttccctccctcgcagccctatgttgttgtctccaaccaccagagctctctcgatctgcttgggatgatggaggtactgccaggccgctgtgtgcccattgccaagcgcgagctactgtgggctggctctgccgggctggcctgctggctggcaggagtcatcttcatcgaccggaagcgcacgggggatgccatcagtgtcatgtctgaggtcgcccagaccctgctcacccaggacgtgagggtctgggtgtttcctgagggaacgagaaaccacaatggctccatgctgcccttcaaacgtggcgccttccatcttgcagtgcaggcccaggttcccattgtccccatagtcatgtcctcctaccaagacttctactgcaagaaggagcgtcgcttcacctcgggacaatgtcaggtgcgggtgctgcccccagtgcccacggaagggctgacaccagatgacgtcccagctctggctgacagagtccggcactccatgctcactgttttccgggaaatctccactgatggccggggtggtggtgactatctgaagaagcctgggggcggtgggtgaaccctggctctgagctctcctcccatctgtccccatcttcctccccacacctacccacccagtgggccctgaagcagggccaaaccctcttccttgtctcccctctccccacttattctcctctttggaatcttcaacttctgaagtgaatgtggatacagcgccactcctgccccctcttggccccatccatggactcttgcctcggtgcagtttccactcttgacccccacctcctactgtcttgtctgtgggacagttgcctccccctcatctccagtgactcagcctacacaagggaggggaacattccatccccagtggagtctcttcctatgtggtcttctctacccctctaccccacattggccagtggactcatccattctttggaacaaatcccccccactccaaagtccatggattcaatggactcatccatttgtgaggaggacttctcgccctctggctggaagctgatacctgaagcactcccaggctcatcctgggagctttcctcagcaccttcaccttccctcccagtgtagcctcctgtcagtgggggctggacccttctaattcagaggtctcatgcctgcccttgcccagatgcccagggtcgtgcactctctgggataccagttcagtctccacatttctggttttctgtccccatagtacagttcttcagtggacatgaccccacccagccccctgcagccctgctgcaccatctcaccagacacaaggggaagaagcagacatcaggtgctgcactcacttctgccccctggggagttggggaaaggaacgaaccctggctggaggggataggagggcttttaatttatttctttttctgttgaggcttccccctctctgagccagttttcatttcttcctggtggcattagccactccctgcctctcactccagacctgttcccacaactggggaggtaggctgggagcaaaaggagagggtgggacccagttttgcgtggttggtttttattaattatctggataacagcaaaaaaactgaaaataaagagagagagaga

SEQ ID NO: 102483 - DNA, 2496 bp, Homo sapiens
  Payload ID: 2
  Gene Symbol: AGPAT1
  Gene Name: 1-acylglycerol-3-phosphate O-acyltransferase 1
  Uniprot ID: Q99943
  ENST ID: ENST00000424030
  CDS Start-End: 581-1432
ggcagatgaggattcaggaagcttgaggtttaggaaggaagatattgagagggaaaggtggaaatgaaggagagtgaagtgatggaatgatcctagtaaagggataatgggagtggaggaagagaagagggggtggaaaactagatacatggctaccaaattaaggaggcacgcgcattccagaggaatcggcattcttcctcactttttatttttctagaaagcacccctgaagccaaatttccattggaagaaaagatgtacccatattgtatgttgtgagaaggggttgtctcagcttgggcaagtaaggagactgatacgaaggaagtaggaaagaaaaggtacagaggtaaaagagcatggaaaaggaaagggtcagggataaggccaaagagatctcttctctttaaaggccagagaaggcaggtggaggggggagctggactgctgggagatagtgagggacaaagggcaaaggaaaccagaccagaggactggagagtgagatggagtgagatggagtcctggagagaaaaagaagagaggtgaacttaatgcttgtcatatggtggccagaatggatttgtggccaggggcatggatgctgctgctgctgctcttcctgctgctgctcttcctgctgcccaccctgtggttctgcagccccagtgccaagtacttcttcaagatggccttctacaatggctggatcctcttcctggctgtgctcgccatccctgtgtgtgccgtgcgaggacgcaacgtcgagaacatgaagatcttgcgtctaatgctgctccacatcaaatacctgtacgggatccgagtggaggtgcgaggggctcaccacttccctccctcgcagccctatgttgttgtctccaaccaccagagctctctcgatctgcttgggatgatggaggtactgccaggccgctgtgtgcccattgccaagcgcgagctactgtgggctggctctgccgggctggcctgctggctggcaggagtcatcttcatcgaccggaagcgcacgggggatgccatcagtgtcatgtctgaggtcgcccagaccctgctcacccaggacgtgagggtctgggtgtttcctgagggaacgagaaaccacaatggctccatgctgcccttcaaacgtggcgccttccatcttgcagtgcaggcccaggttcccattgtccccatagtcatgtcctcctaccaagacttctactgcaagaaggagcgtcgcttcacctcgggacaatgtcaggtgcgggtgctgcccccagtgcccacggaagggctgacaccagatgacgtcccagctctggctgacagagtccggcactccatgctcactgttttccgggaaatctccactgatggccggggtggtggtgactatctgaagaagcctgggggcggtgggtgaaccctggctctgagctctcctcccatctgtccccatcttcctccccacacctacccacccagtgggccctgaagcagggccaaaccctcttccttgtctcccctctccccacttattctcctctttggaatcttcaacttctgaagtgaatgtggatacagcgccactcctgccccctcttggccccatccatggactcttgcctcggtgcagtttccactcttgacccccacctcctactgtcttgtctgtgggacagttgcctccccctcatctccagtgactcagcctacacaagggaggggaacattccatccccagtggagtctcttcctatgtggtcttctctacccctctaccccacattggccagtggactcatccattctttggaacaaatcccccccactccaaagtccatggattcaatggactcatccatttgtgaggaggacttctcgccctctggctggaagctgatacctgaagcactcccaggctcatcctgggagctttcctcagcaccttcaccttccctcccagtgtagcctcctgtcagtgggggctggacccttctaattcagaggtctcatgcctgcccttgcccagatgcccagggtcgtgcactctctgggataccagttcagtctccacatttctggttttctgtccccatagtacagttcttcagtggacatgaccccacccagccccctgcagccctgctgcaccatctcaccagacacaaggggaagaagcagacatcaggtgctgcactcacttctgccccctggggagttggggaaaggaacgaaccctggctggaggggataggagggcttttaatttatttctttttctgttgaggcttccccctctctgagccagttttcatttcttcctggtggcattagccactccctgcctctcactccagacctgttcccacaactggggaggtaggctgggagcaaaaggagagggtgggacccagttttgcgtggttggtttttattaattatctggataacagcaaaaaaactgaaaataaagagagagagaga

SEQ ID NO: 102484 - DNA, 2017 bp, Homo sapiens; identical to SEQ ID NO: 102481
  Payload ID: 2
  Gene Symbol: AGPAT1
  Gene Name: 1-acylglycerol-3-phosphate O-acyltransferase 1
  Uniprot ID: Q99943
  ENST ID: ENST00000439774
  CDS Start-End: 102-953

SEQ ID NO: 102485 - DNA, 2103 bp, Homo sapiens; identical to SEQ ID NO: 102466
  Payload ID: 2
  Gene Symbol: AGPAT1
  Gene Name: 1-acylglycerol-3-phosphate O-acyltransferase 1
  Uniprot ID: Q99943
  ENST ID: ENST00000434614
  CDS Start-End: 188-1039

SEQ ID NO: 102486 - DNA, 2017 bp, Homo sapiens; identical to SEQ ID NO: 102468
  Payload ID: 2
  Gene Symbol: AGPAT1
  Gene Name: 1-acylglycerol-3-phosphate O-acyltransferase 1
  Uniprot ID: Q99943
  ENST ID: ENST00000427763
  CDS Start-End: 102-953

SEQ ID NO: 102487 - DNA, 2021 bp, Homo sapiens; identical to SEQ ID NO: 102461
  Payload ID: 2
  Gene Symbol: AGPAT1
  Gene Name: 1-acylglycerol-3-phosphate O-acyltransferase 1
  Uniprot ID: Q99943
  ENST ID: ENST00000448196
  CDS Start-End: 106-957

SEQ ID NO: 102488 - DNA, 2103 bp, Homo sapiens; identical to SEQ ID NO: 102466
  Payload ID: 2
  Gene Symbol: AGPAT1
  Gene Name: 1-acylglycerol-3-phosphate O-acyltransferase 1
  Uniprot ID: Q99943
  ENST ID: ENST00000457923
  CDS Start-End: 188-1039

SEQ ID NO: 102489 - DNA, 2234 bp, Homo sapiens; identical to SEQ ID NO: 102469
  Payload ID: 2
  Gene Symbol: AGPAT1
  Gene Name: 1-acylglycerol-3-phosphate O-acyltransferase 1
  Uniprot ID: Q99943
  ENST ID: ENST00000446463
  CDS Start-End: 319-1170

SEQ ID NO: 102490 - DNA, 2168 bp, Homo sapiens; identical to SEQ ID NO: 102482
  Payload ID: 2
  Gene Symbol: AGPAT1
  Gene Name: 1-acylglycerol-3-phosphate O-acyltransferase 1
  Uniprot ID: Q99943
  ENST ID: ENST00000451833
  CDS Start-End: 253-1104

SEQ ID NO: 102491 - DNA, 2103 bp, Homo sapiens
  Payload ID: 2
  Gene Symbol: AGPAT1
  Gene Name: 1-acylglycerol-3-phosphate O-acyltransferase 1
  Uniprot ID: Q99943
  ENST ID: ENST00000452393
  CDS Start-End: 188-1039
ctttcctctcccagggcaagtgctgttaggtcacctttactccattccctccttttttcacttggtgaggcctcacacactgtacctgcccacgcaaagtgtcactagaaggaagggaaagggtagtaggattcgtttgcctgtctggaggtaggattggtctttgtagctattccaggtggccagaatggatttgtggccaggggcatggatgctgctgctgctgctcttcctgctgctgctcttcctgctgcccaccctgtggttctgcagccccagtgccaagtacttcttcaagatggccttctacaatggctggatcctcttcctggctgtgctcgccatccctgtgtgtgccgtgcgaggacgcaacgtcgagaacatgaagatcttgcgtctaatgctgctccacatcaaatacctgtacgggatccgagtggaggtgcgaggggctcaccacttccctccctcgcagccctatgttgttgtctccaaccaccagagctctctcgatctgcttgggatgatggaggtactgccaggccgctgtgtgcccattgccaagcgcgagctactgtgggctggctctgccgggctggcctgctggctggcaggagtcatcttcatcgaccggaagcgcacgggggatgccatcagtgtcatgtctgaggtcgcccagaccctgctcacccaggacgtgagggtctgggtgtttcctgagggaacgagaaaccacaatggctccatgctgcccttcaaacgtggcgccttccatcttgcagtgcaggcccaggttcccattgtccccatagtcatgtcctcctaccaagacttctactgcaagaaggagcgtcgcttcacctcgggacaatgtcaggtgcgggtgctgcccccagtgcccacggaagggctgacaccagatgacgtcccagctctggctgacagagtccggcactccatgctcactgttttccgggaaatctccactgatggccggggtggtggtgactatctgaagaagcctgggggcggtgggtgaaccctggctctgagctctcctcccatctgtccccatcttcctccccacacctacccacccagtgggccctgaagcagggccaaaccctcttccttgtctcccctctccccacttattctcctctttggaatcttcaacttctgaagtgaatgtggatacagcgccactcctgccccctcttggccccatccatggactcttgcctcggtgcagtttccactcttgacccccacctcctactgtcttgtctgtgggacagttgcctccccctcatctccagtgactcagcctacacaagggaggggaacattccatccccagtggagtctcttcctatgtggtcttctctacccctctaccccacattggccagtggactcatccattctttggaacaaatcccccccactccaaagtccatggattcaatggactcatccatttgtgaggaggacttctcgccctctggctggaagctgatacctgaagcactcccaggctcatcctgggagctttcctcagcaccttcaccttccctcccagtgtagcctcctgtcagtgggggctggacccttctaattcagaggtctcatgcctgcccttgcccagatgcccagggtcgtgcactctctgggataccagttcagtctccacatttctggttttctgtccccatagtacagttcttcagtggacatgaccccacccagccccctgcagccctgctgcaccatctcaccagacacaaggggaagaagcagacatcaggtgctgcactcacttctgccccctggggagttggggaaaggaacgaaccctggctggaggggataggagggcttttaatttatttctttttctgttgaggcttccccctctctgagccagttttcatttcttcctggtggcattagccactccctgcctctcactccagacctgttcccacaactggggaggtaggctgggagcaaaaggagagggtgggacccagttttgcgtggttggtttttattaattatctggataacagcaaaaaaactgaaaataaagagagagagaga

SEQ ID NO: 102492 - DNA, 2103 bp, Homo sapiens
  Payload ID: 2
  Gene Symbol: AGPAT1
  Gene Name: 1-acylglycerol-3-phosphate O-acyltransferase 1
  Uniprot ID: Q99943
  ENST ID: ENST00000414520
  CDS Start-End: 188-1039
ctttcctctcccagggcaagtgctgttaggtcacctttactccattccctccttttttcacttggtgaggcctcacacactgtacctgcccacgcaaagtgtcactagaaggaagggaaagggtagtaggattcgtttgcctgtctggaggtaggattggtctttgtagctattccaggtggccagaatggatttgtggccaggggcatggatgctgctgctgctgctcttcctgctgctgctcttcctgctgcccaccctgtggttctgcagccccagtgccaagtacttcttcaagatggccttctacaatggctggatcctcttcctggctgtgctcgccatccctgtgtgtgccgtgcgaggacgcaacgtcgagaacatgaagatcttgcgtctaatgctgctccacatcaaatacctgtacgggatccgagtggaggtgcgaggggctcaccacttccctccctcgcagccctatgttgttgtctccaaccaccagagctctctcgatctgcttgggatgatggaggtactgccaggccgctgtgtgcccattgccaagcgcgagctactgtgggctggctctgccgggctggcctgctggctggcaggagtcatcttcatcgaccggaagcgcacgggggatgccatcagtgtcatgtctgaggtcgcccagaccctgctcacccaggacgtgagggtctgggtgtttcctgagggaacgagaaaccacaatggctccatgctgcccttcaaacgtggcgccttccatcttgcagtgcaggcccaggttcccattgtccccatagtcatgtcctcctaccaagacttctactgcaagaaggagcgtcgcttcacctcgggacaatgtcaggtgcgggtgctgcccccagtgcccacggaagggctgacaccagatgacgtcccagctctggctgacagagtccggcactccatgctcactgttttccgggaaatctccactgatggccggggtggtggtgactatctgaagaagcctgggggcggtgggtgaaccctggctctgagctctcctcccatctgtccccatcttcctccccacacctacccacccagtgggccctgaagcagggccaaaccctcttccttgtctcccctctccccacttattctcctatttggaatcttcaacttctgaagtgaatgtggatacagcgccactcctgccccctcttggccccatccatggactcttgcctcggtgcagtctccactcttgacccccacctcctactgtcttgtctgtgggacagttgcctccccctcatctccagtgactcagcctacacaagggaggggaacattccatccccagtggagtctcttcctatgtggtcttctctacccctctaccccacattggccagtggactcatccattctttggaacaaatcccccccactccaaagtccatggattcaatggactcatccatttgtgaggaggacttctcgccctctggctggaagctgatacctgaagcactcccaggctcatcctgggagctttcctcagcaccttcaccttccctcccagtgtagcctcctgtcagtgggggctggacccttctaattcagaggtctcatgcctgcccttgcccagatgcccagggtcgtgcactctctgggataccagttcagtctccacatttctggttttctgtccccatagtacagttcttcagtggacatgaccccacccagccccctgcagccctgctgcaccatctcaccagacacaaggggaagaagcagacatcaggtgctgcactcacttctgccccctggggagttggggaaaggaacgaaccctggctggaggggataggagggcttttaatttatttctttttctgttgaggcttccccctctctgagccagttttcatttcttcctggtggcattagccactccctgcctctcactccagacctgttcccacaactggggaggtaggctgggagcaaaaggagagggtgggacccagttttgcgtggttggtttttattaattatctggataacagcaaaaaaactgaaaataaagagagagagaga

SEQ ID NO: 102493 - DNA, 2234 bp, Homo sapiens; identical to SEQ ID NO: 102471
  Payload ID: 2
  Gene Symbol: AGPAT1
  Gene Name: 1-acylglycerol-3-phosphate O-acyltransferase 1
  Uniprot ID: Q99943
  ENST ID: ENST00000416363
  CDS Start-End: 319-1170

SEQ ID NO: 102494 - DNA, 2496 bp, Homo sapiens
  Payload ID: 2
  Gene Symbol: AGPAT1
  Gene Name: 1-acylglycerol-3-phosphate O-acyltransferase 1
  Uniprot ID: Q99943
  ENST ID: ENST00000444369
  CDS Start-End: 581-1432
ggcagatgaggattcaggaagcttgaggtttaggaaggaagatattgagagggaaaggtggaaatgaaggagagtgaagtgatggaatgatcctagtaaagggataatgggagtggaggaagagaagagggggtggaaaactagatacatggctaccaaattaaggaggcacgcgcattccagaggaatcggcattcttcctcactttttatttttctagaaagcacccctgaagccaaatttccattggaagaaaagatgtacccatattgtatgttgtgagaaggggttgtctcagcttgggcaagtaaggagactgatacgaaggaagtaggaaagaaaaggtacagaggtaaaagagcatggaaaaggaaagggtcagggataaggccaaagagatctcttctctttaaaggccagagaaggcaggtggaggggggagctggactgctgggagatagtgagggacaaagggcaaaggaaaccagaccagaggactggagagtgagatggagtgagatggagtcctggagagaaaaagaagagaggtgaacttaatgcttgtcatatggtggccagaatggatttgtggccaggggcatggatgctgctgctgctgctcttcctgctgctgctcttcctgctgcccaccctgtggttctgcagccccagtgccaagtacttcttcaagatggccttctacaatggctggatcctcttcctggctgtgctcgccatccctgtgtgtgccgtgcgaggacgcaacgtcgagaacatgaagatcttgcgtctaatgctgctccacatcaaatacctgtacgggatccgagtggaggtgcgaggggctcaccacttccctccctcgcagccctatgttgttgtctccaaccaccagagctctctcgatctgcttgggatgatggaggtactgccaggccgctgtgtgcccattgccaagcgcgagctactgtgggctggctctgccgggctggcctgctggctggcaggagtcatcttcatcgaccggaagcgcacgggggatgccatcagtgtcatgtctgaggtcgcccagaccctgctcacccaggacgtgagggtctgggtgtttcctgagggaacgagaaaccacaatggctccatgctgcccttcaaacgtggcgccttccatcttgcagtgcaggcccaggttcccattgtccccatagtcatgtcctcctaccaagacttctactgcaagaaggagcgtcgcttcacctcgggacaatgtcaggtgcgggtgctgcccccagtgcccacggaagggctgacaccagatgacgtcccagctctggctgacagagtccggcactccatgctcactgttttccgggaaatctccactgatggccggggtggtggtgactatctgaagaagcctgggggcggtgggtgaaccctggctctgagctctcctcccatctgtccccatcttcctccccacacctacccacccagtgggccctgaagcagggccaaaccctcttccttgtctcccctctccccacttattctcctatttggaatcttcaacttctgaagtgaatgtggatacagcgccactcctgccccctcttggccccatccatggactcttgcctcggtgcagtctccactcttgacccccacctcctactgtcttgtctgtgggacagttgcctccccctcatctccagtgactcagcctacacaagggaggggaacattccatccccagtggagtctcttcctatgtggtcttctctacccctctaccccacattggccagtggactcatccattctttggaacaaatcccccccactccaaagtccatggattcaatggactcatccatttgtgaggaggacttctcgccctctggctggaagctgatacctgaagcactcccaggctcatcctgggagctttcctcagcaccttcaccttccctcccagtgtagcctcctgtcagtgggggctggacccttctaattcagaggtctcatgcctgcccttgcccagatgcccagggtcgtgcactctctgggataccagttcagtctccacatttctggttttctgtccccatagtacagttcttcagtggacatgaccccacccagccccctgcagccctgctgcaccatctcaccagacacaaggggaagaagcagacatcaggtgctgcactcacttctgccccctggggagttggggaaaggaacgaaccctggctggaggggataggagggcttttaatttatttctttttctgttgaggcttccccctctctgagccagttttcatttcttcctggtggcattagccactccctgcctctcactccagacctgttcccacaactggggaggtaggctgggagcaaaaggagagggtgggacccagttttgcgtggttggtttttattaattatctggataacagcaaaaaaactgaaaataaagagagagagaga

SEQ ID NO: 102495 - DNA, 2103 bp, Homo sapiens; identical to SEQ ID NO: 102491
  Payload ID: 2
  Gene Symbol: AGPAT1
  Gene Name: 1-acylglycerol-3-phosphate O-acyltransferase 1
  Uniprot ID: Q99943
  ENST ID: ENST00000433896
  CDS Start-End: 188-1039

SEQ ID NO: 102496 - DNA, 2496 bp, Homo sapiens; identical to SEQ ID NO: 102465
  Payload ID: 2
  Gene Symbol: AGPAT1
  Gene Name: 1-acylglycerol-3-phosphate O-acyltransferase 1
  Uniprot ID: Q99943
  ENST ID: ENST00000449776
  CDS Start-End: 581-1432

SEQ ID NO: 102497 - DNA, 2496 bp, Homo sapiens; identical to SEQ ID NO: 102465
  Payload ID: 2
  Gene Symbol: AGPAT1
  Gene Name: 1-acylglycerol-3-phosphate O-acyltransferase 1
  Uniprot ID: Q99943
  ENST ID: ENST00000430226
  CDS Start-End: 581-1432

SEQ ID NO: 102498 - DNA, 2496 bp, Homo sapiens; identical to SEQ ID NO: 102483
  Payload ID: 2
  Gene Symbol: AGPAT1
  Gene Name: 1-acylglycerol-3-phosphate O-acyltransferase 1
  Uniprot ID: Q99943
  ENST ID: ENST00000415173
  CDS Start-End: 581-1432

SEQ ID NO: 102499 - DNA, 2021 bp, Homo sapiens; identical to SEQ ID NO: 102479
  Payload ID: 2
  Gene Symbol: AGPAT1
  Gene Name: 1-acylglycerol-3-phosphate O-acyltransferase 1
  Uniprot ID: Q99943
  ENST ID: ENST00000417388
  CDS Start-End: 106-957

SEQ ID NO: 102500 - DNA, 1391 bp, Homo sapiens
  Payload ID: 3
  Gene Symbol: AGPAT2
  Gene Name: 1-acylglycerol-3-phosphate O-acyltransferase 2
  Uniprot ID: O15120
  ENST ID: ENST00000371694
  CDS Start-End: 42-782
cgggagcgagctggcggcgccgtcgggcgccgggccgggccatggagctgtggccgtgtctggccgcggcgctgctgttgctgctgctgctggtgcagctgagccgcgcggccgagttctacgccaaggtcgccctgtactgcgcgctgtgcttcacggtgtccgccgtggcctcgctcgtctgcctgctgcgccacggcggccggacggtggagaacatgagcatcatcggctggttcgtgcgaagcttcaagtacttttacgggctccgcttcgaggtgcgggacccgcgcaggctgcaggaggcccgtccctgtgtcatcgtctccaaccaccagagcatcctggacatgatgggcctcatggaggtccttccggagcgctgcgtgcagatcgccaagcgggagctgctcttcctggggcccgtgggcctcatcatgtacctcgggggcgtcttcttcatcaaccggcagcgctctagcactgccatgacagtgatggccgacctgggcgagcgcatggtcagggagaacgtgcccatcgtccccgtggtgtactcttccttctcctccttctacaacaccaagaagaagttcttcacttcaggaacagtcacagtgcaggtgctggaagccatccccaccagcggcctcactgcggcggacgtccctgcgctcgtggacacctgccaccgggccatgaggaccaccttcctccacatctccaagaccccccaggagaacggggccactgcggggtctggcgtgcagccggcccagtagcccagaccacggcagggcatgacctggggagggcaggtggaagccgatggctggaggatgggcagaggggactcctcccggcttccaaataccactctgtccggctcccccagctctcactcagcccgggaagcaggaagccccttctgtcactggcctcagacacaggcccctggtgtcccctgcagggggctcagctggaccctccccgggctcgagggcagggactcgcgcccacggcacctctgggagctgggatgataaagatgaggcttgcggctgtggcccgctggtgggctgagccacaaggcccccgatggcccaggagcagatgggaggaccccgaggccagacgcacactgtccgagccctctgctcagccgcctgggacccaccagggtgcagctgggctccagggtccagcccacaagctgcatcaggctctctgggagaggaggggcctggagggccaggagtcccagactcacgcaccctgggccacagggagccgggaatcggggcctgctgctcctgctggcctggaagactctgtggggtcagcactgtactccgttgctgtttttttataaacacactcttggaagtggc

SEQ ID NO: 102501 - DNA, 1512 bp, Homo sapiens
  Payload ID: 3
  Gene Symbol: AGPAT2
  Gene Name: 1-acylglycerol-3-phosphate O-acyltransferase 2
  Uniprot ID: O15120
  ENST ID: ENST00000371696
  CDS Start-End: 67-903
cgcgggggagaagcgggagcgggagcgggagcgagctggcggcgccgtcgggcgccgggccgggccatggagctgtggccgtgtctggccgcggcgctgctgttgctgctgctgctggtgcagctgagccgcgcggccgagttctacgccaaggtcgccctgtactgcgcgctgtgcttcacggtgtccgccgtggcctcgctcgtctgcctgctgcgccacggcggccggacggtggagaacatgagcatcatcggctggttcgtgcgaagcttcaagtacttttacgggctccgcttcgaggtgcgggacccgcgcaggctgcaggaggcccgtccctgtgtcatcgtctccaaccaccagagcatcctggacatgatgggcctcatggaggtccttccggagcgctgcgtgcagatcgccaagcgggagctgctcttcctggggcccgtgggcctcatcatgtacctcgggggcgtcttcttcatcaaccggcagcgctctagcactgccatgacagtgatggccgacctgggcgagcgcatggtcagggagaacctcaaagtgtggatctatcccgagggtactcgcaacgacaatggggacctgctgccttttaagaagggcgccttctacctggcagtccaggcacaggtgcccatcgtccccgtggtgtactcttccttctcctccttctacaacaccaagaagaagttcttcacttcaggaacagtcacagtgcaggtgctggaagccatccccaccagcggcctcactgcggcggacgtccctgcgctcgtggacacctgccaccgggccatgaggaccaccttcctccacatctccaagaccccccaggagaacggggccactgcggggtctggcgtgcagccggcccagtagcccagaccacggcagggcatgacctggggagggcaggtggaagccgatggctggaggatgggcagaggggactcctcccggcttccaaataccactctgtccggctcccccagctctcactcagcccgggaagcaggaagccccttctgtcactggcctcagacacaggcccctggtgtcccctgcagggggctcagctggaccctccccgggctcgagggcagggactcgcgcccacggcacctctgggagctgggatgataaagatgaggcttgcggctgtggcccgctggtgggctgagccacaaggcccccgatggcccaggagcagatgggaggaccccgaggccagacgcacactgtccgagccctctgctcagccgcctgggacccaccagggtgcagctgggctccagggtccagcccacaagctgcatcaggctctctgggagaggaggggcctggagggccaggagtcccagactcacgcaccctgggccacagggagccgggaatcggggcctgctgctcctgctggcctggaagactctgtggggtcagcactgtactccgttgctgtttttttataaacacactcttggaagtggc

SEQ ID NO: 102502 - DNA, 1357 bp, Homo sapiens
  Payload ID: 3
  Gene Symbol: AGPAT2
  Gene Name: 1-acylglycerol-3-phosphate O-acyltransferase 2
  Uniprot ID: O15120
  ENST ID: ENST00000538402
  CDS Start-End: 40-876
ggagcgagctggcggcgccgtcgggcgccgggccgggccatggagctgtggccgtgtctggccgcggcgctgctgttgctgctgctgctggtgcagctgagccgcgcggccgagttctacgccaaggtcgccctgtactgcgcgctgtgcttcacggtgtccgccgtggcctcgctcgtctgcctgctgcgccacggcggccggacggtggagaacatgagcatcatcggctggttcgtgcgaagcttcaagtacttttacgggctccgcttcgaggtgcgggacccgcgcaggctgcaggaggcccgtccctgtgtcatcgtctccaaccaccagagcatcctggacatgatgggcctcatggaggtccttccggagcgctgcgtgcagatcgccaagcgggagctgctcttcctggggcccgtgggcctcatcatgtacctcgggggcgtcttcttcatcaaccggcagcgctctagcactgccatgacagtgatggccgacctgggcgagcgcatggtcagggagaacctcaaagtgtggatctatcccgagggtactcgcaacgacaatggggacctgctgccttttaagaagggcgccttctacctggcagtccaggcacaggtgcccatcgtccccgtggtgtactcttccttctcctccttctacaacaccaagaagaagttcttcacttcaggaacagtcacagtgcaggtgctggaagccatccccaccagcggcctcactgcggcggacgtccctgcgctcgtggacacctgccaccgggccatgaggaccaccttcctccacatctccaagaccccccaggagaacggggccactgcggggtctggcgtgcagccggcccagtagcccagaccacggcagggcatgacctggggagggcaggtggaagccgatggctggaggatgggcagaggggactcctcccggcttccaaataccactctgtccggctcccccagctctcactcagcccgggaagcaggaagccccttctgtcactggcctcagacacaggcccctggtgtcccctgcagggggctcagctggaccctccccgggctcgagggcagggactcgcgcccacggcacctctgggagctgggatgataaagatgaggcttgcggctgtggcccgctggtgggctgagccacaaggcccccgatggcccaggagcagatgggaggaccccgaggccaggagtcccagactcacgcaccctgggccacagggagccgggaatcggggcctgctgctcctgctggcctggaagactctgtggggtcagcactgtactccgttgctgtttttttataaacacactcttgg

SEQ ID NO: 102503 - DNA, 5546 bp, Homo sapiens
  Payload ID: 4
  Gene Symbol: AGPAT3
  Gene Name: 1-acylglycerol-3-phosphate O-acyltransferase 3
  Uniprot ID: Q9NRZ7
  ENST ID: ENST00000291572
  CDS Start-End: 272-1402
gggcggcgggatgggggccgggggcggcgggcgccgcactcgctgaggccccgacgcagggccgggccgggcccagggccgaggagcgcggcggccagagcggggccgcggaggcgacgccggggacgcccgcgcgacgagcaggtggcggcggctgcaggcttgtccagccggaagccctgagggcagctgttcccactggctctgctgaccttgtgccttggacggctgtcctcagcgaggggccgtgcacccgctcctgagcagcgccatgggcctgctggccttcctgaagacccagttcgtgctgcacctgctggtcggctttgtcttcgtggtgagtggtctggtcatcaacttcgtccagctgtgcacgctggcgctctggccggtcagcaagcagctctaccgccgcctcaactgccgcctcgcctactcactctggagccaactggtcatgctgctggagtggtggtcctgcacggagtgtacactgttcacggaccaggccacggtagagcgctttgggaaggagcacgcagtcatcatcctcaaccacaacttcgagatcgacttcctctgtgggtggaccatgtgtgagcgcttcggagtgctggggagctccaaggtcctcgctaagaaggagctgctctacgtgcccctcatcggctggacgtggtactttctggagattgtgttctgcaagcggaagtgggaggaggaccgggacaccgtggtcgaagggctgaggcgcctgtcggactaccccgagtacatgtggtttctcctgtactgcgaggggacgcgcttcacggagaccaagcaccgcgttagcatggaggtggcggctgctaaggggcttcctgtcctcaagtaccacctgctgccgcggaccaagggcttcaccaccgcagtcaagtgcctccgggggacagtcgcagctgtctatgatgtaaccctgaacttcagaggaaacaagaacccgtccctgctggggatcctctacgggaagaagtacgaggcggacatgtgcgtgaggagatttcctctggaagacatcccgctggatgaaaaggaagcagctcagtggcttcataaactgtaccaggagaaggacgcgctccaggagatatataatcagaagggcatgtttccaggggagcagtttaagcctgcccggaggccgtggaccctcctgaacttcctgtcctgggccaccattctcctgtctcccctcttcagttttgtcttgggcgtctttgccagcggatcacctctcctgatcctgactttcttggggtttgtgggagcagcttcctttggagttcgcagactgataggagtaactgagatagaaaaaggctccagctacggaaaccaagagtttaagaaaaaggaataattaatggctgtgactgaacacacgcggccctgacggtggtatccagttaactcaaaaccaacacacagagtgcaggaaaagacaattagaaactatttttcttattaactggtgactaatattaacaaaacttgagccaagagtaaagaattcagaaggcctgtcaggtgaagtcttcagcctcccacagcgcagggtcccagcatctccacgcgcgcccgtgggaggtgggtccggccggagaggcctcccgcggacgccgtctctccagaactccgcttccaagagggagcctttggctgctttctctccttaaacttagatcaaattttttggtttttaatcagttatcttgggaacttaacctggcccctcacctcttctgcaccccccgcccccgaaactgtctcgtaatgaatttctgctgtcctcctgggagtggacggccgggtcccgtcccccgggagcatcgctcggctcagcaccttggctcccagtgggggccccgtggagggcgcccgtagtgataagcacaccggcacgaacgtcaggtccattcctcgaagtcggagccctcactctgccctgtcctggggctggctgagggcgaacgccccacctcactttctagagccctgtctgtcctagctcctatctgaccttgtgtgtaaatacgtacatctgtttttaaagtggatgggcccctgagaactcagtgaaatgcagagttctccatgcacctaaagctcctttgtcgctctcatggctgtcagatcctggtccctccacactgggtgctggggagggaggaccctcggggctaccgcgcgcccccccatcccacagatcaggagccaaggagggagaacagggcagcctgtgggactctaggatgcttcagaagaagcgacggcaccgtcaaccctctgttttttaaaggtggttggagactgttaacactgagctcattgacttctagagattttatttttactggttgatctcttggtggttttcaacttcctgctggaaactagaggtggggcaccccccaccccccagcctcgcactgtgtccttggggaaggcccgcccccatcctggccggtgtcactgtggcccggccacccctgagcgcccagctccctacctcctggacgtctctgagagtccaggcagagcagagggcagcgctcggccggtcatgctggctcccttggccttgcagcgagcccctggcccacgccgagcgagggatgcttctccctacagcatgtccactcccccggcatggccaggtggggcccctggggcaatggcagtggtagaacgctcaacttggttgcggtaccatcagcccacctgcatttggctttcgacttgcttgttctaagtcacagcgccctcatctttttagcaaggtaaaaaaaccaaaatgggtgttatctctgatatcttgaaaccagcgttctgaatagaggtaggttgagttttctaggggaaaacaaatggagaaaagaggcatgaagaaaagtaaaccgagaacataattaggcatcgggcctaagtgtcctggggagattggaggggacggcagcgttctgcatgatggaggcgctgccgggccccgggtctgtgggggccgtgctctcagggcgtgtgcgggacgccacctgtgcacacctgctcagagcacggctcctcgcaggggtgaaggggcagaccaacgaaaccagatgagaccaacgacaccatgcgagacacgcttgcagacactgttgttttggaaatgtgcttccctccatctgaaatctcatccctccacccgcccactcgggcagctgtgccgtgggcagggcatgcgctcccctggctgagcaccccagagattctcctgcaccttcctcatgccgcacgctgctcatccgtctccatgtgtgtttagatccatgccattcactgactcactaacacctgcaaaatctttaaggaaaaaagctgaagggtacgaccatgcacatatgtgacctggaaaatgcaaatttagatcttttatgatttaattattattgtttcccatagaagttccctccctttgaaattaatatataatgtataaattctgcactgagccatggcggagctgggcagcccctaggttagagtggagacggaggcccaggcgcaggggtcacacctcatctggtttccttcccatctcacagcttagcttgtgcttctcaacaccaagtctttaagagcaataaaaactacaccatgaatgtttgaattttttttttttgggggggggagggtggattttgcttttcatccagaaggaaaaggggaggagagctcctttacattttttaaattaaattcataaatcccagaacagtcttttttttttctttttcctttacaccctacttctgagcttaattcagttgatgttatgtccaaattcaggctgagtgctcaggctgaagcaactctgtagcccacagtccgtgctggccactgtcggggtgaggcacattctaggcctggcatcgctgatgccctctgcacccagtccttgagccaggccgaggacaggaagggcattgctggcctgtagctcctgttacccacccagagccaggcgccacactggaggctcccaggcgggagggcccaggcccacccacgggcgtctggccggtcaagctcccagcctgggccgtggtctcctggggacgccgctggcctcccagcttaggcccaggtgccaggtgtcatggggtctcctgcccatcttcccaaggatgccattgctgtcttcatcgtcttcccccgtgtgagacactggttgtctggtactcggcgacagtgtaccagacgcgcaccctatgtgaggtgctttaaggtccctgtcctcaggaagcgcagtctggtggaagagatgagcgctgaacaaatcactaaataacacaaaacaacaatgtaagcagcactttcttgtgtaaaaaaaaaaaaaaagcacgtcctgtcgatgaattttgagtctctctgccttgcctgtcccgactccctttcgcgcaccgtggcatgagaatctttcctcacgctgttcgttgcggtattgctgagcattgatgttgatttgaaggaaaagccgtggttggacccagctgtgtgtttcactcacgtgcaattgagtagctgttgccaggctgtccatgcctgttgtgactaccggttggggtcagatttggggtgaagaatgagtaagtttctgcatgctttgtctctacctgagacacttctacaacaagccaagtataatctctccagccctgcagattttcacctgacttgttcagccccatgcgtagactcccgctgcaggcctctggcctgtggctcactgcatgcagcccctggcgtgcaatactagtgctccacggcgcgatgtgcttctagcccttgcactgcacctaggctcagggttcaaacggccagcccgaaaagcctgcctgccttctttctggaaacagcacgtccccggccgtgtgcctgcccctttctctactgagctagtccccaaaccaaaggcaagccccctcgggcctcgggggatggggccggccacacccctgactccgccctggctctgccccatacccctgccgtggggccgacctgggggatgcagacatccggctccgtattcctgcctatcggggccaggatgcaaaaacaatttttgcgtaaaagatgtcacactgatctgctggagtggggtggacacatgaattcagttttatcatgaacactcgccactggctgcttgttaattcagggataatggtggcattcttacaaactgctcgggaaatagaatgacgggaacacttttagggagcccaggaagttaccagggacattggtgtcgccggcccaggcaacagcagcgtacgcttttcaaagatcattgagttgtcttagaatttgaagctgtgtaatgacaatgtcacctggagttcgtctccatttcttaactttttgttgcacaagtatttggacagaagtcgaactgtgaatgagatactgaaatgcactaaattgtattacattaaactggagttacttgatacaatgaa

SEQ ID NO: 102504 - DNA, 3589 bp, Homo sapiens
  Payload ID: 4
  Gene Symbol: AGPAT3
  Gene Name: 1-acylglycerol-3-phosphate O-acyltransferase 3
  Uniprot ID: Q9NRZ7
  ENST ID: ENST00000327505
  CDS Start-End: 178-1308
atttggtcacacggcgtctctccagtcctgcgcaagcacgttgacatgtgtgcctttcactttcaggcttgtccagccggaagccctgagggcagctgttcccactggctctgctgaccttgtgccttggacggctgtcctcagcgaggggccgtgcacccgctcctgagcagcgccatgggcctgctggccttcctgaagacccagttcgtgctgcacctgctggtcggctttgtcttcgtggtgagtggtctggtcatcaacttcgtccagctgtgcacgctggcgctctggccggtcagcaagcagctctaccgccgcctcaactgccgcctcgcctactcactctggagccaactggtcatgctgctggagtggtggtcctgcacggagtgtacactgttcacggaccaggccacggtagagcgctttgggaaggagcacgcagtcatcatcctcaaccacaacttcgagatcgacttcctctgtgggtggaccatgtgtgagcgcttcggagtgctggggagctccaaggtcctcgctaagaaggagctgctctacgtgcccctcatcggctggacgtggtactttctggagattgtgttctgcaagcggaagtgggaggaggaccgggacaccgtggtcgaagggctgaggcgcctgtcggactaccccgagtacatgtggtttctcctgtactgcgaggggacgcgcttcacggagaccaagcaccgcgttagcatggaggtggcggctgctaaggggcttcctgtcctcaagtaccacctgctgccgcggaccaagggcttcaccaccgcagtcaagtgcctccgggggacagtcgcagctgtctatgatgtaaccctgaacttcagaggaaacaagaacccgtccctgctggggatcctctacgggaagaagtacgaggcggacatgtgcgtgaggagatttcctctggaagacatcccgctggatgaaaaggaagcagctcagtggcttcataaactgtaccaggagaaggacgcgctccaggagatatataatcagaagggcatgtttccaggggagcagtttaagcctgcccggaggccgtggaccctcctgaacttcctgtcctgggccaccattctcctgtctcccctcttcagttttgtcttgggcgtctttgccagcggatcacctctcctgatcctgactttcttggggtttgtgggagcagcttcctttggagttcgcagactgataggagtaactgagatagaaaaaggctccagctacggaaaccaagagtttaagaaaaaggaataattaatggctgtgactgaacacacgcggccctgacggtggtatccagttaactcaaaaccaacacacagagtgcaggaaaagacaattagaaactatttttcttattaactggtgactaatattaacaaaacttgagccaagagtaaagaattcagaaggcctgtcaggtgaagtcttcagcctcccacagcgcagggtcccagcatctccacgcgcgcccgtgggaggtgggtccggccggagaggcctcccgcggacgccgtctctccagaactccgcttccaagagggagcctttggctgctttctctccttaaacttagatcaaattttttggtttttaatcagttatcttgggaacttaacctggcccctcacctcttctgcaccccccgcccccgaaactgtctcgtaatgaatttctgctgtcctcctgggagtggacggccgggtcccgtcccccgggagcatcgctcggctcagcaccttggctcccagtgggggccccgtggagggcgcccgtagtgataagcacaccggcacgaacgtcaggtccattcctcgaagtcggagccctcactctgccctgtcctggggctggctgagggcgaacgccccacctcactttctagagccctgtctgtcctagctcctatctgaccttgtgtgtaaatacgtacatctgtttttaaagtggatgggcccctgagaactcagtgaaatgcagagttctccatgcacctaaagctcctttgtcgctctcatggctgtcagatcctggtccctccacactgggtgctggggagggaggaccctcggggctaccgcgcgcccccccatcccacagatcaggagccaaggagggagaacagggcagcctgtgggactctaggatgcttcagaagaagcgacggcaccgtcaaccctctgttttttaaaggtggttggagactgttaacactgagctcattgacttctagagattttatttttactggttgatctcttggtggttttcaacttcctgctggaaactagaggtggggcaccccccaccccccagcctcgcactgtgtccttggggaaggcccgcccccatcctggccggtgtcactgtggcccggccacccctgagcgcccagctccctacctcctggacgtctctgagagtccaggcagagcagagggcagcgctcggccggtcatgctggctcccttggccttgcagcgagcccctggcccacgccgagcgagggatgcttctccctacagcatgtccactcccccggcatggccaggtggggcccctggggcaatggcagtggtagaacgctcaacttggttgcggtaccatcagcccacctgcatttggctttcgacttgcttgttctaagtcacagcgccctcatctttttagcaaggtaaaaaaaccaaaatgggtgttatctctgatatcttgaaaccagcgttctgaatagaggtaggttgagttttctaggggaaaacaaatggagaaaagaggcatgaagaaaagtaaaccgagaacataattaggcatcgggcctaagtgtcctggggagattggaggggacggcagcgttctgcatgatggaggcgctgccgggccccgggtctgtgggggccgtgctctcagggcgtgtgcgggacgccacctgtgcacacctgctcagagcacggctcctcgcaggggtgaaggggcagaccaacgaaaccagatgagaccaacgacaccatgcgagacacgcttgcagacactgttgttttggaaatgtgcttccctccatctgaaatctcatccctccacccgcccactcgggcagctgtgccgtgggcagggcatgcgctcccctggctgagcaccccagagattctcctgcaccttcctcatgccgcacgctgctcatccgtctccatgtgtgtttagatccatgccattcactgactcactaacacctgcaaaatctttaaggaaaaaagctgaagggtacgaccatgcacatatgtgacctggaaaatgcaaatttagatcttttatgatttaattattattgtttcccatagaagttccctccctttgaaattaatatataatgtataaattctgcactgagccatggcggagctgggcagcccctaggttagagtggagacggaggcccaggcgcaggggtcacacctcatctggtttccttcccatctcacagcttagcttgtgcttctcaacaccaagtctttaagagcaataaaaactacaccatgaa

SEQ ID NO: 102505 - DNA, 4338 bp, Homo sapiens
  Payload ID: 4
  Gene Symbol: AGPAT3
  Gene Name: 1-acylglycerol-3-phosphate O-acyltransferase 3
  Uniprot ID: Q9NRZ7
  ENST ID: ENST00000398058
  CDS Start-End: 927-2057
attgtgcagtcatcaggccctgggagctttccacatccctccacctcccacccaacatcaccactctccggccagtgagaccatcacagcaccccagaggagacaaattctggagctcagagagctgggtggctcctgcaccttcagacactgcctcctcaccgagggagggaagaacgacaaaggacctccaggacgtagaggttgatgatccgggcaggtggccttcagcgagggagcacgtcaaaaggctgtgggccgtgcagacagctgggggacaccgtcccgggtgtgaccttgggccacacggcagggtggtggacttgctcctagaattgggctccagggctgaagccagcccctctgatctggcactggccggctccattcaccctttttggggcttactgccgcagagacttcctttgaggagagctggacccaagacgccagagttccgggggcactgagtgctgtgtggcacccgggccaggagaaacatgtgccagagggcaggcgtgggctctccggggagtctctgcgtagactttctagcccagaggttcaggtgatggaccagagactggccgctttgtgacaccgaggacggttgataaagtggattctcgaggggaagctgcatccacacagaggctgggacgtgaatgtgcatcacggctctatctgtggcccccaaaggctgggtgccagctgcctgtcggcagggagcgtatcaccgtggcacgtccatgccgtgggggtcactcagcagccacggatgcgccctgggtgctgtcccggggccgtctcagaagcaccgcgctggaccggctgggccagatgccatgggattctgtgtttgtgaacctctagaaaaggacggctgtcctcagcgaggggccgtgcacccgctcctgagcagcgccatgggcctgctggccttcctgaagacccagttcgtgctgcacctgctggtcggctttgtcttcgtggtgagtggtctggtcatcaacttcgtccagctgtgcacgctggcgctctggccggtcagcaagcagctctaccgccgcctcaactgccgcctcgcctactcactctggagccaactggtcatgctgctggagtggtggtcctgcacggagtgtacactgttcacggaccaggccacggtagagcgctttgggaaggagcacgcagtcatcatcctcaaccacaacttcgagatcgacttcctctgtgggtggaccatgtgtgagcgcttcggagtgctggggagctccaaggtcctcgctaagaaggagctgctctacgtgcccctcatcggctggacgtggtactttctggagattgtgttctgcaagcggaagtgggaggaggaccgggacaccgtggtcgaagggctgaggcgcctgtcggactaccccgagtacatgtggtttctcctgtactgcgaggggacgcgcttcacggagaccaagcaccgcgttagcatggaggtggcggctgctaaggggcttcctgtcctcaagtaccacctgctgccgcggaccaagggcttcaccaccgcagtcaagtgcctccgggggacagtcgcagctgtctatgatgtaaccctgaacttcagaggaaacaagaacccgtccctgctggggatcctctacgggaagaagtacgaggcggacatgtgcgtgaggagatttcctctggaagacatcccgctggatgaaaaggaagcagctcagtggcttcataaactgtaccaggagaaggacgcgctccaggagatatataatcagaagggcatgtttccaggggagcagtttaagcctgcccggaggccgtggaccctcctgaacttcctgtcctgggccaccattctcctgtctcccctcttcagttttgtcttgggcgtctttgccagcggatcacctctcctgatcctgactttcttggggtttgtgggagcagcttcctttggagttcgcagactgataggagtaactgagatagaaaaaggctccagctacggaaaccaagagtttaagaaaaaggaataattaatggctgtgactgaacacacgcggccctgacggtggtatccagttaactcaaaaccaacacacagagtgcaggaaaagacaattagaaactatttttcttattaactggtgactaatattaacaaaacttgagccaagagtaaagaattcagaaggcctgtcaggtgaagtcttcagcctcccacagcgcagggtcccagcatctccacgcgcgcccgtgggaggtgggtccggccggagaggcctcccgcggacgccgtctctccagaactccgcttccaagagggagcctttggctgctttctctccttaaacttagatcaaattttttggtttttaatcagttatcttgggaacttaacctggcccctcacctcttctgcaccccccgcccccgaaactgtctcgtaatgaatttctgctgtcctcctgggagtggacggccgggtcccgtcccccgggagcatcgctcggctcagcaccttggctcccagtgggggccccgtggagggcgcccgtagtgataagcacaccggcacgaacgtcaggtccattcctcgaagtcggagccctcactctgccctgtcctggggctggctgagggcgaacgccccacctcactttctagagccctgtctgtcctagctcctatctgaccttgtgtgtaaatacgtacatctgtttttaaagtggatgggcccctgagaactcagtgaaatgcagagttctccatgcacctaaagctcctttgtcgctctcatggctgtcagatcctggtccctccacactgggtgctggggagggaggaccctcggggctaccgcgcgcccccccatcccacagatcaggagccaaggagggagaacagggcagcctgtgggactctaggatgcttcagaagaagcgacggcaccgtcaaccctctgttttttaaaggtggttggagactgttaacactgagctcattgacttctagagattttatttttactggttgatctcttggtggttttcaacttcctgctggaaactagaggtggggcaccccccaccccccagcctcgcactgtgtccttggggaaggcccgcccccatcctggccggtgtcactgtggcccggccacccctgagcgcccagctccctacctcctggacgtctctgagagtccaggcagagcagagggcagcgctcggccggtcatgctggctcccttggccttgcagcgagcccctggcccacgccgagcgagggatgcttctccctacagcatgtccactcccccggcatggccaggtggggcccctggggcaatggcagtggtagaacgctcaacttggttgcggtaccatcagcccacctgcatttggctttcgacttgcttgttctaagtcacagcgccctcatctttttagcaaggtaaaaaaaccaaaatgggtgttatctctgatatcttgaaaccagcgttctgaatagaggtaggttgagttttctaggggaaaacaaatggagaaaagaggcatgaagaaaagtaaaccgagaacataattaggcatcgggcctaagtgtcctggggagattggaggggacggcagcgttctgcatgatggaggcgctgccgggccccgggtctgtgggggccgtgctctcagggcgtgtgcgggacgccacctgtgcacacctgctcagagcacggctcctcgcaggggtgaaggggcagaccaacgaaaccagatgagaccaacgacaccatgcgagacacgcttgcagacactgttgttttggaaatgtgcttccctccatctgaaatctcatccctccacccgcccactcgggcagctgtgccgtgggcagggcatgcgctcccctggctgagcaccccagagattctcctgcaccttcctcatgccgcacgctgctcatccgtctccatgtgtgtttagatccatgccattcactgactcactaacacctgcaaaatctttaaggaaaaaagctgaagggtacgaccatgcacatatgtgacctggaaaatgcaaatttagatcttttatgatttaattattattgtttcccatagaagttccctccctttgaaattaatatataatgtataaattctgcactgagccatggcggagctgggcagcccctaggttagagtggagacggaggcccaggcgcaggggtcacacctcatctggtttccttcccatctcacagcttagcttgtgcttctcaacaccaagtctttaagagcaataaaaactacaccatgaa

SEQ ID NO: 102506 - DNA, 3595 bp, Homo sapiens
  Payload ID: 4
  Gene Symbol: AGPAT3
  Gene Name: 1-acylglycerol-3-phosphate O-acyltransferase 3
  Uniprot ID: Q9NRZ7
  ENST ID: ENST00000398061
  CDS Start-End: 184-1314
tctatgaaaccaacatacatggcgtttgcatcacagttggagtcagatgtgagcccggagggcaggtgtctggcttgtccagccggaagccctgagggcagctgttcccactggctctgctgaccttgtgccttggacggctgtcctcagcgaggggccgtgcacccgctcctgagcagcgccatgggcctgctggccttcctgaagacccagttcgtgctgcacctgctggtcggctttgtcttcgtggtgagtggtctggtcatcaacttcgtccagctgtgcacgctggcgctctggccggtcagcaagcagctctaccgccgcctcaactgccgcctcgcctactcactctggagccaactggtcatgctgctggagtggtggtcctgcacggagtgtacactgttcacggaccaggccacggtagagcgctttgggaaggagcacgcagtcatcatcctcaaccacaacttcgagatcgacttcctctgtgggtggaccatgtgtgagcgcttcggagtgctggggagctccaaggtcctcgctaagaaggagctgctctacgtgcccctcatcggctggacgtggtactttctggagattgtgttctgcaagcggaagtgggaggaggaccgggacaccgtggtcgaagggctgaggcgcctgtcggactaccccgagtacatgtggtttctcctgtactgcgaggggacgcgcttcacggagaccaagcaccgcgttagcatggaggtggcggctgctaaggggcttcctgtcctcaagtaccacctgctgccgcggaccaagggcttcaccaccgcagtcaagtgcctccgggggacagtcgcagctgtctatgatgtaaccctgaacttcagaggaaacaagaacccgtccctgctggggatcctctacgggaagaagtacgaggcggacatgtgcgtgaggagatttcctctggaagacatcccgctggatgaaaaggaagcagctcagtggcttcataaactgtaccaggagaaggacgcgctccaggagatatataatcagaagggcatgtttccaggggagcagtttaagcctgcccggaggccgtggaccctcctgaacttcctgtcctgggccaccattctcctgtctcccctcttcagttttgtcttgggcgtctttgccagcggatcacctctcctgatcctgactttcttggggtttgtgggagcagcttcctttggagttcgcagactgataggagtaactgagatagaaaaaggctccagctacggaaaccaagagtttaagaaaaaggaataattaatggctgtgactgaacacacgcggccctgacggtggtatccagttaactcaaaaccaacacacagagtgcaggaaaagacaattagaaactatttttcttattaactggtgactaatattaacaaaacttgagccaagagtaaagaattcagaaggcctgtcaggtgaagtcttcagcctcccacagcgcagggtcccagcatctccacgcgcgcccgtgggaggtgggtccggccggagaggcctcccgcggacgccgtctctccagaactccgcttccaagagggagcctttggctgctttctctccttaaacttagatcaaattttttggtttttaatcagttatcttgggaacttaacctggcccctcacctcttctgcaccccccgcccccgaaactgtctcgtaatgaatttctgctgtcctcctgggagtggacggccgggtcccgtcccccgggagcatcgctcggctcagcaccttggctcccagtgggggccccgtggagggcgcccgtagtgataagcacaccggcacgaacgtcaggtccattcctcgaagtcggagccctcactctgccctgtcctggggctggctgagggcgaacgccccacctcactttctagagccctgtctgtcctagctcctatctgaccttgtgtgtaaatacgtacatctgtttttaaagtggatgggcccctgagaactcagtgaaatgcagagttctccatgcacctaaagctcctttgtcgctctcatggctgtcagatcctggtccctccacactgggtgctggggagggaggaccctcggggctaccgcgcgcccccccatcccacagatcaggagccaaggagggagaacagggcagcctgtgggactctaggatgcttcagaagaagcgacggcaccgtcaaccctctgttttttaaaggtggttggagactgttaacactgagctcattgacttctagagattttatttttactggttgatctcttggtggttttcaacttcctgctggaaactagaggtggggcaccccccaccccccagcctcgcactgtgtccttggggaaggcccgcccccatcctggccggtgtcactgtggcccggccacccctgagcgcccagctccctacctcctggacgtctctgagagtccaggcagagcagagggcagcgctcggccggtcatgctggctcccttggccttgcagcgagcccctggcccacgccgagcgagggatgcttctccctacagcatgtccactcccccggcatggccaggtggggcccctggggcaatggcagtggtagaacgctcaacttggttgcggtaccatcagcccacctgcatttggctttcgacttgcttgttctaagtcacagcgccctcatctttttagcaaggtaaaaaaaccaaaatgggtgttatctctgatatcttgaaaccagcgttctgaatagaggtaggttgagttttctaggggaaaacaaatggagaaaagaggcatgaagaaaagtaaaccgagaacataattaggcatcgggcctaagtgtcctggggagattggaggggacggcagcgttctgcatgatggaggcgctgccgggccccgggtctgtgggggccgtgctctcagggcgtgtgcgggacgccacctgtgcacacctgctcagagcacggctcctcgcaggggtgaaggggcagaccaacgaaaccagatgagaccaacgacaccatgcgagacacgcttgcagacactgttgttttggaaatgtgcttccctccatctgaaatctcatccctccacccgcccactcgggcagctgtgccgtgggcagggcatgcgctcccctggctgagcaccccagagattctcctgcaccttcctcatgccgcacgctgctcatccgtctccatgtgtgtttagatccatgccattcactgactcactaacacctgcaaaatctttaaggaaaaaagctgaagggtacgaccatgcacatatgtgacctggaaaatgcaaatttagatcttttatgatttaattattattgtttcccatagaagttccctccctttgaaattaatatataatgtataaattctgcactgagccatggcggagctgggcagcccctaggttagagtggagacggaggcccaggcgcaggggtcacacctcatctggtttccttcccatctcacagcttagcttgtgcttctcaacaccaagtctttaagagcaataaaaactacaccatgaa

SEQ ID NO: 102507 - DNA, 5767 bp, Homo sapiens
  Payload ID: 4
  Gene Symbol: AGPAT3
  Gene Name: 1-acylglycerol-3-phosphate O-acyltransferase 3
  Uniprot ID: Q9NRZ7
  ENST ID: ENST00000398063
  CDS Start-End: 493-1623
cgccgacacatggtcgttcgacttctggcttggcctcttttgtgagtgtggggcctggtcatatcctcttggtcagtgtctctgtgatgatgagaacgggaagacggccacggtgcccaccctggcaggactctctcccctcgctggcgctggctcagctgccgtgagcggccgtaggcactgtcccgggccctcctgtggttgctcccagccatgctgctggctgcttctgccgtcctggcttgcagagactctgggtcatgcggggaagagggcagagtcctcctccctgctcaggcaagagaggatccagcaagatttcttcctccccaccctcctgcccctcccagtctgggcagcagataaaagccagggccccacacttctgccacctcctgctgctcacacactccagccagggacctgcccccggggtccaacaaggacggctgtcctcagcgaggggccgtgcacccgctcctgagcagcgccatgggcctgctggccttcctgaagacccagttcgtgctgcacctgctggtcggctttgtcttcgtggtgagtggtctggtcatcaacttcgtccagctgtgcacgctggcgctctggccggtcagcaagcagctctaccgccgcctcaactgccgcctcgcctactcactctggagccaactggtcatgctgctggagtggtggtcctgcacggagtgtacactgttcacggaccaggccacggtagagcgctttgggaaggagcacgcagtcatcatcctcaaccacaacttcgagatcgacttcctctgtgggtggaccatgtgtgagcgcttcggagtgctggggagctccaaggtcctcgctaagaaggagctgctctacgtgcccctcatcggctggacgtggtactttctggagattgtgttctgcaagcggaagtgggaggaggaccgggacaccgtggtcgaagggctgaggcgcctgtcggactaccccgagtacatgtggtttctcctgtactgcgaggggacgcgcttcacggagaccaagcaccgcgttagcatggaggtggcggctgctaaggggcttcctgtcctcaagtaccacctgctgccgcggaccaagggcttcaccaccgcagtcaagtgcctccgggggacagtcgcagctgtctatgatgtaaccctgaacttcagaggaaacaagaacccgtccctgctggggatcctctacgggaagaagtacgaggcggacatgtgcgtgaggagatttcctctggaagacatcccgctggatgaaaaggaagcagctcagtggcttcataaactgtaccaggagaaggacgcgctccaggagatatataatcagaagggcatgtttccaggggagcagtttaagcctgcccggaggccgtggaccctcctgaacttcctgtcctgggccaccattctcctgtctcccctcttcagttttgtcttgggcgtctttgccagcggatcacctctcctgatcctgactttcttggggtttgtgggagcagcttcctttggagttcgcagactgataggagtaactgagatagaaaaaggctccagctacggaaaccaagagtttaagaaaaaggaataattaatggctgtgactgaacacacgcggccctgacggtggtatccagttaactcaaaaccaacacacagagtgcaggaaaagacaattagaaactatttttcttattaactggtgactaatattaacaaaacttgagccaagagtaaagaattcagaaggcctgtcaggtgaagtcttcagcctcccacagcgcagggtcccagcatctccacgcgcgcccgtgggaggtgggtccggccggagaggcctcccgcggacgccgtctctccagaactccgcttccaagagggagcctttggctgctttctctccttaaacttagatcaaattttttggtttttaatcagttatcttgggaacttaacctggcccctcacctcttctgcaccccccgcccccgaaactgtctcgtaatgaatttctgctgtcctcctgggagtggacggccgggtcccgtcccccgggagcatcgctcggctcagcaccttggctcccagtgggggccccgtggagggcgcccgtagtgataagcacaccggcacgaacgtcaggtccattcctcgaagtcggagccctcactctgccctgtcctggggctggctgagggcgaacgccccacctcactttctagagccctgtctgtcctagctcctatctgaccttgtgtgtaaatacgtacatctgtttttaaagtggatgggcccctgagaactcagtgaaatgcagagttctccatgcacctaaagctcctttgtcgctctcatggctgtcagatcctggtccctccacactgggtgctggggagggaggaccctcggggctaccgcgcgcccccccatcccacagatcaggagccaaggagggagaacagggcagcctgtgggactctaggatgcttcagaagaagcgacggcaccgtcaaccctctgttttttaaaggtggttggagactgttaacactgagctcattgacttctagagattttatttttactggttgatctcttggtggttttcaacttcctgctggaaactagaggtggggcaccccccaccccccagcctcgcactgtgtccttggggaaggcccgcccccatcctggccggtgtcactgtggcccggccacccctgagcgcccagctccctacctcctggacgtctctgagagtccaggcagagcagagggcagcgctcggccggtcatgctggctcccttggccttgcagcgagcccctggcccacgccgagcgagggatgcttctccctacagcatgtccactcccccggcatggccaggtggggcccctggggcaatggcagtggtagaacgctcaacttggttgcggtaccatcagcccacctgcatttggctttcgacttgcttgttctaagtcacagcgccctcatctttttagcaaggtaaaaaaaccaaaatgggtgttatctctgatatcttgaaaccagcgttctgaatagaggtaggttgagttttctaggggaaaacaaatggagaaaagaggcatgaagaaaagtaaaccgagaacataattaggcatcgggcctaagtgtcctggggagattggaggggacggcagcgttctgcatgatggaggcgctgccgggccccgggtctgtgggggccgtgctctcagggcgtgtgcgggacgccacctgtgcacacctgctcagagcacggctcctcgcaggggtgaaggggcagaccaacgaaaccagatgagaccaacgacaccatgcgagacacgcttgcagacactgttgttttggaaatgtgcttccctccatctgaaatctcatccctccacccgcccactcgggcagctgtgccgtgggcagggcatgcgctcccctggctgagcaccccagagattctcctgcaccttcctcatgccgcacgctgctcatccgtctccatgtgtgtttagatccatgccattcactgactcactaacacctgcaaaatctttaaggaaaaaagctgaagggtacgaccatgcacatatgtgacctggaaaatgcaaatttagatcttttatgatttaattattattgtttcccatagaagttccctccctttgaaattaatatataatgtataaattctgcactgagccatggcggagctgggcagcccctaggttagagtggagacggaggcccaggcgcaggggtcacacctcatctggtttccttcccatctcacagcttagcttgtgcttctcaacaccaagtctttaagagcaataaaaactacaccatgaatgtttgaattttttttttttgggggggggagggtggattttgcttttcatccagaaggaaaaggggaggagagctcctttacattttttaaattaaattcataaatcccagaacagtcttttttttttctttttcctttacaccctacttctgagcttaattcagttgatgttatgtccaaattcaggctgagtgctcaggctgaagcaactctgtagcccacagtccgtgctggccactgtcggggtgaggcacattctaggcctggcatcgctgatgccctctgcacccagtccttgagccaggccgaggacaggaagggcattgctggcctgtagctcctgttacccacccagagccaggcgccacactggaggctcccaggcgggagggcccaggcccacccacgggcgtctggccggtcaagctcccagcctgggccgtggtctcctggggacgccgctggcctcccagcttaggcccaggtgccaggtgtcatggggtctcctgcccatcttcccaaggatgccattgctgtcttcatcgtcttcccccgtgtgagacactggttgtctggtactcggcgacagtgtaccagacgcgcaccctatgtgaggtgctttaaggtccctgtcctcaggaagcgcagtctggtggaagagatgagcgctgaacaaatcactaaataacacaaaacaacaatgtaagcagcactttcttgtgtaaaaaaaaaaaaaaagcacgtcctgtcgatgaattttgagtctctctgccttgcctgtcccgactccctttcgcgcaccgtggcatgagaatctttcctcacgctgttcgttgcggtattgctgagcattgatgttgatttgaaggaaaagccgtggttggacccagctgtgtgtttcactcacgtgcaattgagtagctgttgccaggctgtccatgcctgttgtgactaccggttggggtcagatttggggtgaagaatgagtaagtttctgcatgctttgtctctacctgagacacttctacaacaagccaagtataatctctccagccctgcagattttcacctgacttgttcagccccatgcgtagactcccgctgcaggcctctggcctgtggctcactgcatgcagcccctggcgtgcaatactagtgctccacggcgcgatgtgcttctagcccttgcactgcacctaggctcagggttcaaacggccagcccgaaaagcctgcctgccttctttctggaaacagcacgtccccggccgtgtgcctgcccctttctctactgagctagtccccaaaccaaaggcaagccccctcgggcctcgggggatggggccggccacacccctgactccgccctggctctgccccatacccctgccgtggggccgacctgggggatgcagacatccggctccgtattcctgcctatcggggccaggatgcaaaaacaatttttgcgtaaaagatgtcacactgatctgctggagtggggtggacacatgaattcagttttatcatgaacactcgccactggctgcttgttaattcagggataatggtggcattcttacaaactgctcgggaaatagaatgacgggaacacttttagggagcccaggaagttaccagggacattggtgtcgccggcccaggcaacagcagcgtacgcttttcaaagatcattgagttgtcttagaatttgaagctgtgtaatgacaatgtcacctggagttcgtctccatttcttaactttttgttgcacaagtatttggacagaagtcgaactgtgaatgagatactgaaatgcactaaattgtattacattaaactggagttacttgatacaatgaa

SEQ ID NO: 102508 - DNA, 454 bp, Homo sapiens
  Payload ID: 4
  Gene Symbol: AGPAT3
  Gene Name: 1-acylglycerol-3-phosphate O-acyltransferase 3
  ENST ID: ENST00000448287
  CDS Start-End: 217-454
cggaacggcagggccgcctttaggcttacatccctggaactcccacctccacagacccgtccgggtgctgaaagtccacggatgctatccctggtcaaatcagaggcttgtccagccggaagccctgagggcagctgttcccactggctctgctgaccttgtgccttggacggctgtcctcagcgaggggccgtgcacccgctcctgagcagcgccatgggcctgctggccttcctgaagacccagttcgtgctgcacctgctggtcggctttgtcttcgtggtgagtggtctggtcatcaacttcgtccagctgtgcacgctggcgctctggccggtcagcaagcagctctaccgccgcctcaactgccgcctcgcctactcactctggagccaactggtcatgctgctggagtggtggtcctgcacggagtgtacactgttcacggaccagg

SEQ ID NO: 102509 - DNA, 392 bp, Homo sapiens
  Payload ID: 4
  Gene Symbol: AGPAT3
  Gene Name: 1-acylglycerol-3-phosphate O-acyltransferase 3
  ENST ID: ENST00000448845
  CDS Start-End: 278-392
gagaccatcacagcaccccagaggagacaaattctggagctcagagagctgggagggcagctgctggtgtgacctcagctgctccccagaccctaaggggatctgggaccttccaccttctaccaacggtgttggtcttctgtcctcacgcctatggtttcacgctcccacagtggctcctgcaccttcagacactgcctcctcaccgagggagggaagaacgacaaaggacggctgtcctcagcgaggggccgtgcacccgctcctgagcagcgccatgggcctgctggccttcctgaagacccagttcgtgctgcacctgctggtcggctttgtcttcgtggtgagtggtctggtcatcaacttcgtccagctgtgcacgctggcgctct

SEQ ID NO: 102510 - DNA, 582 bp, Homo sapiens
  Payload ID: 4
  Gene Symbol: AGPAT3
  Gene Name: 1-acylglycerol-3-phosphate O-acyltransferase 3
  ENST ID: ENST00000445582
  CDS Start-End: 199-582
atatgtctgacagccttgtgtgcttatttcttgcccgcgtgttctgtctcgggttggaagggacacgcacgtctcctgccttcacatgctgagatgggtttctgtagcatccccagaatttctgctgaatgaagtgtgtcgggttatttggacggctgtcctcagcgaggggccgtgcacccgctcctgagcagcgccatgggcctgctggccttcctgaagacccagttcgtgctgcacctgctggtcggctttgtcttcgtggtgagtggtctggtcatcaacttcgtccagctgtgcacgctggcgctctggccggtcagcaagcagctctaccgccgcctcaactgccgcctcgcctactcactctggagccaactggtcatgctgctggagtggtggtcctgcacggagtgtacactgttcacggaccaggccacggtagagcgctttgggaaggagcacgcagtcatcatcctcaaccacaacttcgagatcgacttcctctgtgggtggaccatgtgtgagcgcttcggagtgctggggagctccaaggtcctcgctaagaaggagctgctctac

SEQ ID NO: 102511 - DNA, 924 bp, Homo sapiens
  Payload ID: 4
  Gene Symbol: AGPAT3
  Gene Name: 1-acylglycerol-3-phosphate O-acyltransferase 3
  ENST ID: ENST00000457068
  CDS Start-End: 158-924
tgggagctttccacatccctccacctcccacccaacatcaccactctccggccagtgagaccatcacagcaccccagaggagacaaattctggagctcagagagctggggacggctgtcctcagcgaggggccgtgcacccgctcctgagcagcgccatgggcctgctggccttcctgaagacccagttcgtgctgcacctgctggtcggctttgtcttcgtggtgagtggtctggtcatcaacttcgtccagctgtgcacgctggcgctctggccggtcagcaagcagctctaccgccgcctcaactgccgcctcgcctactcactctggagccaactggtcatgctgctggagtggtggtcctgcacggagtgtacactgttcacggaccaggccacggtagagcgctttgggaaggagcacgcagtcatcatcctcaaccacaacttcgagatcgacttcctctgtgggtggaccatgtgtgagcgcttcggagtgctggggagctccaaggtcctcgctaagaaggagctgctctacgtgcccctcatcggctggacgtggtactttctggagattgtgttctgcaagcggaagtgggaggaggaccgggacaccgtggtcgaagggctgaggcgcctgtcggactaccccgagtacatgtggtttctcctgtactgcgaggggacgcgcttcacggagaccaagcaccgcgttagcatggaggtggcggctgctaaggggcttcctgtcctcaagtaccacctgctgccgcggaccaagggcttcaccaccgcagtcaagtgcctccgggggacagtcgcagctgtctatgatgtaaccctgaacttcagaggaaacaagaacccgtccctgctggggatcctctacgggaagaagtacgaggcggacatgtgcgtgag

SEQ ID NO: 102512 - DNA, 1003 bp, Homo sapiens
  Payload ID: 4
  Gene Symbol: AGPAT3
  Gene Name: 1-acylglycerol-3-phosphate O-acyltransferase 3
  ENST ID: ENST00000422850
  CDS Start-End: 237-1003
tcctgggctcgtttctgccccaggtagtgctgtcagcggcatgcctgccttctgcaagcccctcttccctgttccccagcccgcacttccaatgagctgtgggccaggaaaccagcccgtcacacttgtccacgctgcgtttaaagcgggaggaaggaggacccaatgcagggcccgaaaggtccactgacggctgtcctcagcgaggggccgtgcacccgctcctgagcagcgccatgggcctgctggccttcctgaagacccagttcgtgctgcacctgctggtcggctttgtcttcgtggtgagtggtctggtcatcaacttcgtccagctgtgcacgctggcgctctggccggtcagcaagcagctctaccgccgcctcaactgccgcctcgcctactcactctggagccaactggtcatgctgctggagtggtggtcctgcacggagtgtacactgttcacggaccaggccacggtagagcgctttgggaaggagcacgcagtcatcatcctcaaccacaacttcgagatcgacttcctctgtgggtggaccatgtgtgagcgcttcggagtgctggggagctccaaggtcctcgctaagaaggagctgctctacgtgcccctcatcggctggacgtggtactttctggagattgtgttctgcaagcggaagtgggaggaggaccgggacaccgtggtcgaagggctgaggcgcctgtcggactaccccgagtacatgtggtttctcctgtactgcgaggggacgcgcttcacggagaccaagcaccgcgttagcatggaggtggcggctgctaaggggcttcctgtcctcaagtaccacctgctgccgcggaccaagggcttcaccaccgcagtcaagtgcctccgggggacagtcgcagctgtctatgatgtaaccctgaacttcagaggaaacaagaacccgtccctgctggggatcctctacgggaagaagtacgaggcggacatgtgcgtgag

SEQ ID NO: 102513 - DNA, 2199 bp, Homo sapiens
  Payload ID: 4
  Gene Symbol: AGPAT3
  Gene Name: 1-acylglycerol-3-phosphate O-acyltransferase 3
  Uniprot ID: Q9NRZ7
  ENST ID: ENST00000546158
  CDS Start-End: 744-1874
aggacctccaggacgtagaggttgatgatccgggcaggtggccttcagcgagggagcacgtcaaaaggctgtgggccgtgcagacagctgggggacaccgtcccgggtgtgaccttgggccacacggcagggtggtggacttgctcctagaattgggctccagggctgaagccagcccctctgatctggcactggccggctccattcaccctttttggggcttactgccgcagagacttcctttgaggagagctggacccaagacgccagagttccgggggcactgagtgctgtgtggcacccgggccaggagaaacatgtgccagagggcaggcgtgggctctccggggagtctctgcgtagactttctagcccagaggttcaggtgatggaccagagactggccgctttgtgacaccgaggacggttgataaagtggattctcgaggggaagctgcatccacacagaggctgggacgtgaatgtgcatcacggctctatctgtggcccccaaaggctgggtgccagctgcctgtcggcagggagcgtatcaccgtggcacgtccatgccgtgggggtcactcagcagccacggatgcgccctgggtgctgtcccggggccgtctcagaagcaccgcgctggaccggctgggccagatgccatgggattctgtgtttgtgaacctctagaaaaggacggctgtcctcagcgaggggccgtgcacccgctcctgagcagcgccatgggcctgctggccttcctgaagacccagttcgtgctgcacctgctggtcggctttgtcttcgtggtgagtggtctggtcatcaacttcgtccagctgtgcacgctggcgctctggccggtcagcaagcagctctaccgccgcctcaactgccgcctcgcctactcactctggagccaactggtcatgctgctggagtggtggtcctgcacggagtgtacactgttcacggaccaggccacggtagagcgctttgggaaggagcacgcagtcatcatcctcaaccacaacttcgagatcgacttcctctgtgggtggaccatgtgtgagcgcttcggagtgctggggagctccaaggtcctcgctaagaaggagctgctctacgtgcccctcatcggctggacgtggtactttctggagattgtgttctgcaagcggaagtgggaggaggaccgggacaccgtggtcgaagggctgaggcgcctgtcggactaccccgagtacatgtggtttctcctgtactgcgaggggacgcgcttcacggagaccaagcaccgcgttagcatggaggtggcggctgctaaggggcttcctgtcctcaagtaccacctgctgccgcggaccaagggcttcaccaccgcagtcaagtgcctccgggggacagtcgcagctgtctatgatgtaaccctgaacttcagaggaaacaagaacccgtccctgctggggatcctctacgggaagaagtacgaggcggacatgtgcgtgaggagatttcctctggaagacatcccgctggatgaaaaggaagcagctcagtggcttcataaactgtaccaggagaaggacgcgctccaggagatatataatcagaagggcatgtttccaggggagcagtttaagcctgcccggaggccgtggaccctcctgaacttcctgtcctgggccaccattctcctgtctcccctcttcagttttgtcttgggcgtctttgccagcggatcacctctcctgatcctgactttcttggggtttgtgggagcagcttcctttggagttcgcagactgataggagtaactgagatagaaaaaggctccagctacggaaaccaagagtttaagaaaaaggaataattaatggctgtgactgaacacacgcggccctgacggtggtatccagttaactcaaaaccaacacacagagtgcaggaaaagacaattagaaactatttttcttattaactggtgactaatattaacaaaacttgagccaagagtaaagaattcagaaggcctgtcaggtgaagtcttcagcctcccacagcgcagggtcccagcatctccacgcgcgcccgtgggaggtgggtccggccggagaggcctcccgcggacgccgtctctccagaactccgcttccaagagggagcctttggctgctttctctccttaaacttagatc

SEQ ID NO: 102514 - DNA, 7865 bp, Homo sapiens
  Payload ID: 5
  Gene Symbol: AGPAT4
  Gene Name: 1-acylglycerol-3-phosphate O-acyltransferase 4
  Uniprot ID: Q9NRZ5
  ENST ID: ENST00000320285
  CDS Start-End: 214-1350
gctttttctttccagtgttggctgacttacagctcttataaactagtggcaatttctgaacccagccggctccatctcagcttctggtttctaagtccatgtgccaaaggctgccaggaaggagacgccttcctgagtcctggatctttcttccttctggaaatctttgactgtgggtagttatttatttctgaataagagcgtccacgcatcatggacctcgcgggactgctgaagtctcagttcctgtgccacctggtcttctgctacgtctttattgcctcagggctaatcatcaacaccattcagctcttcactctcctcctctggcccattaacaagcagctcttccggaagatcaactgcagactgtcctattgcatctcaagccagctggtgatgctgctggagtggtggtcgggcacggaatgcaccatcttcacggacccgcgcgcctacctcaagtatgggaaggaaaatgccatcgtggttctcaaccacaagtttgaaattgactttctgtgtggctggagcctgtccgaacgctttgggctgttagggggctccaaggtcctggccaagaaagagctggcctatgtcccaattatcggctggatgtggtacttcaccgagatggtcttctgttcgcgcaagtgggagcaggatcgcaagacggttgccaccagtttgcagcacctccgggactaccccgagaagtattttttcctgattcactgtgagggcacacggttcacggagaagaagcatgagatcagcatgcaggtggcccgggccaaggggctgcctcgcctcaagcatcacctgttgccacgaaccaagggcttcgccatcaccgtgaggagcttgagaaatgtagtttcagctgtatatgactgtacactcaatttcagaaataatgaaaatccaacactgctgggagtcctaaacggaaagaaataccatgcagatttgtatgttaggaggatcccactggaagacatccctgaagacgatgacgagtgctcggcctggctgcacaagctctaccaggagaaggatgcctttcaggaggagtactacaggacgggcaccttcccagagacgcccatggtgcccccccggcggccctggaccctcgtgaactggctgttttgggcctcgctggtgctctaccctttcttccagttcctggtcagcatgatcaggagcgggtcttccctgacgctggccagcttcatcctcgtcttctttgtggcctccgtgggagttcgatggatgattggtgtgacggaaattgacaagggctctgcctacggcaactctgacagcaagcagaaactgaatgactgactcagggaggtgtcaccatccgaagggaaccttggggaactggtggcctctgcatatcctccttagtgggacacggtgacaaaggctgggtgagcccctgctgggcacggcggaagtcacgacctctccagccagggagtctggtctcaaggccggatggggaggaagatgttttgtaatctttttttccccatgtgctttagtgggctttggttttctttttgtgcgagtgtgtgtgagaatggctgtgtggtgagtgtgaactttgttctgtgatcatagaaagggtattttaggctgcaggggagggcagggctggggaccgaaggggacaagttcccctttcatcctttggtgctgagttttctgtaacccttggttgccagagataaagtgaaaagtgctttaggtgagatgactaaattatgcctccaagaaaaaaaaattaaagtgcttttctgggtcatctgtggtgtatgttgacatggaccgctgcccctccatcctgcccttgcccgtggctttggtgtttcagatcctactcacgggaggcagctgccgcggaggtgtgggcagctgagaggggtgggcaggccagcacagctcctggcaggagacacaggtccaggagcccgtgagcatttgtgagagcagagatggcaagcacgtgcgtggagaccaacgaagcgtgtccctggcacacagcaagggagagtttcgctcggtctctgcagtgcagtctcctggcgtaagtcttgaagatggacccaactccctgaagaaatggatcttgaaattgaacacaaacatcatgaacgtacagcctgggcattctgcagtgatttgtgagatgagcttgcatcgactgttcctctcagcagtgacagccaaagtcacccctgataaaatgcagtttcactttataaaatgcctcgccccttcccagcatgtagagcttgtctgcagccctaaaggagccaggtcctgctctgatgagggtcaaatcagagccgacatcccatgtacaaaaaacccccaggcttctgccttccttccgggctcctgtctgctcccattttactccacggaatagttctgccctgtagcatctccagcggcctttgcagactgctgtcagccaacaggtgccaaaaatgcaaaagaagaagaaactaaaagcagtgctatttttgcagaacaaatgctagctattaaatcatcttaggccaagacaccaatggcacttggaccgataggtatttggagcatgagttaggaaggatatgtctttctccaggtgcgcagctgaaagttgctgagaaaagctgcctgtgttgctgtggtaacatgagaaggaatgaacagctctatacaaaaactggccacacattataaggcctattctatgcagttatgtttttggctatttgctcatttagtcattgtttatcaaccaaactaggtaagccaaggagttacaagacagctctagagaagctccctctgcttacaggacaataatgcattgtttgtttgttgatacaaatgaattatttgaatccacagaagtgaaaaagggaaaaaatcctggctgacttgtgggaagagcgtactgcagagcctagggcctgagttaactcgctggcggccctgcaggcaggcttgatgggagcgcccagcacatctgcccaccctgcacagggcatgaagcaccgtgtgcagagatctgtgggcaaaagcccaggacgtgaccttaggcaagaggggtccttggagaagtggaggtgtgcatggtgtgtagccttgcgtgtctgtgagcacgccctagtggacctgcgcctggattatcgggccagtctctcggaggggtccgtgatgctgagttacgccattcacctgaactctgcagctcatcggctgtaggatttgggtgagacacttttccttgctgactcatttccccatctgcaaaatgggggtgacgatatctacctcttggggtgtgtcaagggtaaaagagcacactttaagaatcctaaagcactaagccaaggatgaaagactagaaagctgcctctatgttgctactctcaaaaatgctcagaaattttcttgtcgtactaaaaatgtgttatttttctcattttcattcttccattcaacacagaagtaatctaagtaagttctaaaaacatagatccgggggcccacagacattcaattttcttctgaattggctctggtatcacacaacacacaagcaagcaaacagcctgcctgctagggccttgggttccaggctggaggaatgcaggcagaaatctcttaggaaataactaagtgagcgccaagttttgaattgccttagagccgaaagagaatgtggcgtgctggggagagatctggacctctttctcatcagtcatttgacctgtccacgaagaacaattttgttatgcagcctgggaacctggtttccttacaccctgcgcccttaatgacacagacaaccacgggtactcctggacggaagctcatcacgcctcctcaaataccttcacccatgttcaggtcacacggaggtcaccatctcctcagcacacaacaactgctttggttcccagggttattttttctacgagttgaaaacccacggagcctaagccatctttttgtcccctaaggagagccccatagactaagagctacacttcctgtctgtctttcccacctttccatctcattctagcttaaagcttatcacgctactgagagcctgttctgtagttcaaggtggcagagaaaaatacgaaccttgagtgaaatctggagagcagtgcagggtcatccccagacgtgacgggccatatcctaggcgactcctgcagcttatagaagcagggaatttaatggacttcttccaggaaagccagcccacggggactcttaaaaagacaccaaccatttggaagatgcagcttgaggtctgggggactggactgattctgccaccatatagtgaacacgattaatcgggaggaagaagtaaggcactctgtgagttagtctaccaccctattgactttgacagagagaaaaccaacttttttcatatgatcacacagtagtactggaatatctcgactgcaatatcctctaaacaaatgcatgcaaagctttgtaaaagcagctgatgattaaaaaaattttaaaacattagggtttttctaatatatccatatgtgggacagtgatttaaatgtcattaattgtccagccacaacttgtaacagtgatgtgaaagacacaaaaaaggccccactggagtggaggagtggtctggctggtccccaagcaaaacagaatgggcttcgcataggctttagaacttattcataaatattgaccaaagtgtgaagcaaggtatccagtgaagattctctagggtctctacttctgctcaagagatttaatccagctttctctaaagcagtggtccagacttgccacatactaggttaaagataaagtgagaaaaacaaatactttggtttgcacgtctcttgaggggccctaggctgtatggaggaatatttagaggaatatttgtgagctgccatttgtgtttaaaagaacatgaaagcaagacgggccctaacccgcctgtgtctgtagctgaccaggaggccactgcttccttcccccagagcttctaggagagccccccaaaatgcaactctccaaggtcctgtggagtagtcccctcataatgcctccaccacacctgtgtctcacgatgccttaactgacgtagctcctaagtgatgttcacagagaaggaaatacttaggcaagcccatgtgtaacatgctcacagatgtgctggctttgccaatgctttcggactccaccatgctttctgattcttctggtcctagtcacgccttggcacggggcagaagcggccgagctatgctgacaggtgctgctgagagccaacagccattcagccgagaaggcgtttctaggtgagggcatgagagctggcattccaggctgctgagtgcggcatctgcaggtgcaccacattgctccacggtgtgttcagaagagaccagcatcttgaatctcaggctctgggctcattctttgcctctgccaagggaccattcaggggcttcaagccagctgctgaaaatcccccttttctggatttttccccatctatataaggatatggtggctgtgtggacaagaaattggtttcatctcagaagggtgcttccctacaaagatcttcagaaatttaattgaaaacaattttttgaactttttttgtttggccaggatgaatgaagctgaagtcacatcctgaatgtgcatgccagacaaagggtaagcaagcagtctttacaaatgccaatccctctgcactccaaaaccggagcccgtaatgaaggcccaggttccagtcatcacaggatcccccaagccagcacagtgcctgatgcctccctaggcattagcacatcccagcactctaattcacatcctcagcatccctgcctcctgcatccagggcttaggttgagtgtttccagagtgtcaagtacatttaaacacaaaccaaatactccagggttttgacctgtcacaatggcttttgaaaacaacagacgtacaatttgagagaaggactcgatggacttcttaggctgaggactaaggacatgttgctgttcctcttggtccaggacattcaataccattcacagcattcatcaccaactgacatagtatcgatcacgacattcaactgtttgaaattactgctattttggtcaaaaactaagaaatcagaaattgcacctacatagtgtgtctcctcattggagtcccatctctctgagcacagggatgggctcctgagctcacagccctgccctgcccccccagcagggcctcaccctcatggccctcagtgaatagtgactacatgaagggggcacttactagaggcctgagtaatggaatttcaattagcttctgcttcccttttctaaaaaagaaccacctttcttaagaataattaggccaaaataaacttgagtaatttgtacagtcaatattttgaagtttcggagttaccagtgaaatagcaaagctgttctccaggaaaggacatccaggttcccacccaggccttccttcctcagctcctgcagcctcatcctagtttaatatgaaggttgtgaatgggttaaaaagcagttcttaagcacctacttagatcttttcagtatctggaaatagcacccagggctgtgttagtaaagcttttcactgggtaagagtcatacaatttttacatttaatttgtttttttaaaacaaggcagtcttgttttacatattggaatgactagatattttttgacatttctggcacctctggttctgctgaattttaagggaggtgagtggtatgtacacaaagttaagattgctgcataataattcctttgcatttccaaaataaattacacaaatgtcacttttccttttctattccatagtactagttttagccagatctttgccaaacattctaggacattcagaaaagtcatccatggaattttggaatgccattctctctgtatctttgcagatcatgaggaaggaaagttgatgaactagtacgggatggctcagacttgtaaagtgtctaagtcacaacgctgcagagccagcttccgggtagcaatggcatggcctcagctgtgccaaggctacaactggagcttccttactcgcatctgaggcaaacacagcaaggctggcccaggccgcccacagtcaacagatgttcacgggagatggatcagcccctcttttgcttgttctatcaaggaaagagatctaaccatgggcaagggtggaacacacccggttcaggtcagggaatgagttgctctaagtgaacagtgaattcttacttctcagcctgtatcaattgtacccagggttcatgattactgtgacccactaagggatgatctttgaggaaacagacctggagggaggtaatttaaggagggaaagcgagtgggttttacagactgctttgtggcgacattcaggaacagaccattcaatggatgacttttcagtacataaaagcaagcagtaatggccaggagagagcaaagatgccctaagaatgacatcagactgaccaaatgtgccttttcaaataagttatgagaacgaatgaattggaattagagcaaggtattggacagaaccatgctagtctttgagagaacgtgtggattgggtggatgtttggaccgaatgaatggtaactttttaatgtgaaacagagaactgatatatgggctgtcatgtcaccctagggtactgtcgctctgtcatgtgtagcaatctttccaaatttttgttggtgggctgaacaaagataaaactaataaagtatgtgtggataccactaga

SEQ ID NO: 102515 - DNA, 942 bp, Homo sapiens
  Payload ID: 5
  Gene Symbol: AGPAT4
  Gene Name: 1-acylglycerol-3-phosphate O-acyltransferase 4
  ENST ID: ENST00000366905
  CDS Start-End: 185-664
cagctcttataaactagtggcaatttctgaacccagccggctccatctcagcttctggtttctaagtccatgtgccaaaggctgccaggaaggagacgccttcctgagtcctggatctttcttccttctggaaatctttgactgtgggtagttatttatttctgaataagagcgtccacgcatcatggacctcgcgggactgctgaagtctcagttcctgtgccacctggtcttctgctacgtctttattgcctcagggctaatcatcaacaccattcagctcttcactctcctcctctggcccattaacaagcagctcttccggaagatcaactgcagactgtcctattgcatctcaagccagctggtgatgctgctggagtggtggtcgggcacggaatgcaccatcttcacggacccgcgcgcctacctcaagtatgggaaggaaaatgccatcgtggttctcaaccacaagtttgaaattgactttctgtgtggctggagcctgtccgaacgctttgggctgttaggggtaagtcagaagtgcattcccccctgcctcacacatttctctggttcagccccaccacttgtctttttgctcctggtcattcagaacttgcagaagaatcaacagagtttctacttgatgaaatggtcctaataaactgctttttattcttgctgggagtcagtcttaacagcttcttatgggcaatcataagaggtactcaacaattgctacctgccggccattttacatatgattcatttatttaatccttacagcaacatgaatagatgatgtgccacactccattttttaaaaactaagttatatagagcttaatattcggctcagagtcacacagctgtaattagatttggatttcactcccatccatatttcttaattccatgctctactgcctccttggctaa

SEQ ID NO: 102516 - DNA, 7705 bp, Homo sapiens
  Payload ID: 5
  Gene Symbol: AGPAT4
  Gene Name: 1-acylglycerol-3-phosphate O-acyltransferase 4
  ENST ID: ENST00000366911
  CDS Start-End: 178-534
tataaactagtggcaatttctgaacccagccggctccatctcagcttctggtttctaagtccatgtgccaaaggctgccaggaaggagacgccttcctgagtcctggatctttcttccttctggaaatctttgactgtgggtagttatttatttctgaataagagcgtccacgcatcatggacctcgcgggactgctgaagtctcagttcctgtgccacctggtcttctgctacgtctttattgcctcagggctaatcatcaacaccattcagctcttcactctcctcctctggcccattaacaagcagctcttccggaagatcaactgcagactgtcctattgcatctcaagccggctccaaggtcctggccaagaaagagctggcctatgtcccaattatcggctggatgtggtacttcaccgagatggtcttctgttcgcgcaagtgggagcaggatcgcaagacggttgccaccagtttgcagcacctccgggactaccccgagaagtattttttcctgattcactgtgagggcacacggttcacggagaagaagcatgagatcagcatgcaggtggcccgggccaaggggctgcctcgcctcaagcatcacctgttgccacgaaccaagggcttcgccatcaccgtgaggagcttgagaaatgtagtttcagctgtatatgactgtacactcaatttcagaaataatgaaaatccaacactgctgggagtcctaaacggaaagaaataccatgcagatttgtatgttaggaggatcccactggaagacatccctgaagacgatgacgagtgctcggcctggctgcacaagctctaccaggagaaggatgcctttcaggaggagtactacaggacgggcaccttcccagagacgcccatggtgcccccccggcggccctggaccctcgtgaactggctgttttgggcctcgctggtgctctaccctttcttccagttcctggtcagcatgatcaggagcgggtcttccctgacgctggccagcttcatcctcgtcttctttgtggcctccgtgggagttcgatggatgattggtgtgacggaaattgacaagggctctgcctacggcaactctgacagcaagcagaaactgaatgactgactcagggaggtgtcaccatccgaagggaaccttggggaactggtggcctctgcatatcctccttagtgggacacggtgacaaaggctgggtgagcccctgctgggcacggcggaagtcacgacctctccagccagggagtctggtctcaaggccggatggggaggaagatgttttgtaatctttttttccccatgtgctttagtgggctttggttttctttttgtgcgagtgtgtgtgagaatggctgtgtggtgagtgtgaactttgttctgtgatcatagaaagggtattttaggctgcaggggagggcagggctggggaccgaaggggacaagttcccctttcatcctttggtgctgagttttctgtaacccttggttgccagagataaagtgaaaagtgctttaggtgagatgactaaattatgcctccaagaaaaaaaaattaaagtgcttttctgggtcatctgtggtgtatgttgacatggaccgctgcccctccatcctgcccttgcccgtggctttggtgtttcagatcctactcacgggaggcagctgccgcggaggtgtgggcagctgagaggggtgggcaggccagcacagctcctggcaggagacacaggtccaggagcccgtgagcatttgtgagagcagagatggcaagcacgtgcgtggagaccaacgaagcgtgtccctggcacacagcaagggagagtttcgctcggtctctgcagtgcagtctcctggcgtaagtcttgaagatggacccaactccctgaagaaatggatcttgaaattgaacacaaacatcatgaacgtacagcctgggcattctgcagtgatttgtgagatgagcttgcatcgactgttcctctcagcagtgacagccaaagtcacccctgataaaatgcagtttcactttataaaatgcctcgccccttcccagcatgtagagcttgtctgcagccctaaaggagccaggtcctgctctgatgagggtcaaatcagagccgacatcccatgtacaaaaaacccccaggcttctgccttccttccgggctcctgtctgctcccattttactccacggaatagttctgccctgtagcatctccagcggcctttgcagactgctgtcagccaacaggtgccaaaaatgcaaaagaagaagaaactaaaagcagtgctatttttgcagaacaaatgctagctattaaatcatcttaggccaagacaccaatggcacttggaccgataggtatttggagcatgagttaggaaggatatgtctttctccaggtgcgcagctgaaagttgctgagaaaagctgcctgtgttgctgtggtaacatgagaaggaatgaacagctctatacaaaaactggccacacattataaggcctattctatgcagttatgtttttggctatttgctcatttagtcattgtttatcaaccaaactaggtaagccaaggagttacaagacagctctagagaagctccctctgcttacaggacaataatgcattgtttgtttgttgatacaaatgaattatttgaatccacagaagtgaaaaagggaaaaaatcctggctgacttgtgggaagagcgtactgcagagcctagggcctgagttaactcgctggcggccctgcaggcaggcttgatgggagcgcccagcacatctgcccaccctgcacagggcatgaagcaccgtgtgcagagatctgtgggcaaaagcccaggacgtgaccttaggcaagaggggtccttggagaagtggaggtgtgcatggtgtgtagccttgcgtgtctgtgagcacgccctagtggacctgcgcctggattatcgggccagtctctcggaggggtccgtgatgctgagttacgccattcacctgaactctgcagctcatcggctgtaggatttgggtgagacacttttccttgctgactcatttccccatctgcaaaatgggggtgacgatatctacctcttggggtgtgtcaagggtaaaagagcacactttaagaatcctaaagcactaagccaaggatgaaagactagaaagctgcctctatgttgctactctcaaaaatgctcagaaattttcttgtcgtactaaaaatgtgttatttttctcattttcattcttccattcaacacagaagtaatctaagtaagttctaaaaacatagatccgggggcccacagacattcaattttcttctgaattggctctggtatcacacaacacacaagcaagcaaacagcctgcctgctagggccttgggttccaggctggaggaatgcaggcagaaatctcttaggaaataactaagtgagcgccaagttttgaattgccttagagccgaaagagaatgtggcgtgctggggagagatctggacctctttctcatcagtcatttgacctgtccacgaagaacaattttgttatgcagcctgggaacctggtttccttacaccctgcgcccttaatgacacagacaaccacgggtactcctggacggaagctcatcacgcctcctcaaataccttcacccatgttcaggtcacacggaggtcaccatctcctcagcacacaacaactgctttggttcccagggttattttttctacgagttgaaaacccacggagcctaagccatctttttgtcccctaaggagagccccatagactaagagctacacttcctgtctgtctttcccacctttccatctcattctagcttaaagcttatcacgctactgagagcctgttctgtagttcaaggtggcagagaaaaatacgaaccttgagtgaaatctggagagcagtgcagggtcatccccagacgtgacgggccatatcctaggcgactcctgcagcttatagaagcagggaatttaatggacttcttccaggaaagccagcccacggggactcttaaaaagacaccaaccatttggaagatgcagcttgaggtctgggggactggactgattctgccaccatatagtgaacacgattaatcgggaggaagaagtaaggcactctgtgagttagtctaccaccctattgactttgacagagagaaaaccaacttttttcatatgatcacacagtagtactggaatatctcgactgcaatatcctctaaacaaatgcatgcaaagctttgtaaaagcagctgatgattaaaaaaattttaaaacattagggtttttctaatatatccatatgtgggacagtgatttaaatgtcattaattgtccagccacaacttgtaacagtgatgtgaaagacacaaaaaaggccccactggagtggaggagtggtctggctggtccccaagcaaaacagaatgggcttcgcataggctttagaacttattcataaatattgaccaaagtgtgaagcaaggtatccagtgaagattctctagggtctctacttctgctcaagagatttaatccagctttctctaaagcagtggtccagacttgccacatactaggttaaagataaagtgagaaaaacaaatactttggtttgcacgtctcttgaggggccctaggctgtatggaggaatatttagaggaatatttgtgagctgccatttgtgtttaaaagaacatgaaagcaagacgggccctaacccgcctgtgtctgtagctgaccaggaggccactgcttccttcccccagagcttctaggagagccccccaaaatgcaactctccaaggtcctgtggagtagtcccctcataatgcctccaccacacctgtgtctcacgatgccttaactgacgtagctcctaagtgatgttcacagagaaggaaatacttaggcaagcccatgtgtaacatgctcacagatgtgctggctttgccaatgctttcggactccaccatgctttctgattcttctggtcctagtcacgccttggcacggggcagaagcggccgagctatgctgacaggtgctgctgagagccaacagccattcagccgagaaggcgtttctaggtgagggcatgagagctggcattccaggctgctgagtgcggcatctgcaggtgcaccacattgctccacggtgtgttcagaagagaccagcatcttgaatctcaggctctgggctcattctttgcctctgccaagggaccattcaggggcttcaagccagctgctgaaaatcccccttttctggatttttccccatctatataaggatatggtggctgtgtggacaagaaattggtttcatctcagaagggtgcttccctacaaagatcttcagaaatttaattgaaaacaattttttgaactttttttgtttggccaggatgaatgaagctgaagtcacatcctgaatgtgcatgccagacaaagggtaagcaagcagtctttacaaatgccaatccctctgcactccaaaaccggagcccgtaatgaaggcccaggttccagtcatcacaggatcccccaagccagcacagtgcctgatgcctccctaggcattagcacatcccagcactctaattcacatcctcagcatccctgcctcctgcatccagggcttaggttgagtgtttccagagtgtcaagtacatttaaacacaaaccaaatactccagggttttgacctgtcacaatggcttttgaaaacaacagacgtacaatttgagagaaggactcgatggacttcttaggctgaggactaaggacatgttgctgttcctcttggtccaggacattcaataccattcacagcattcatcaccaactgacatagtatcgatcacgacattcaactgtttgaaattactgctattttggtcaaaaactaagaaatcagaaattgcacctacatagtgtgtctcctcattggagtcccatctctctgagcacagggatgggctcctgagctcacagccctgccctgcccccccagcagggcctcaccctcatggccctcagtgaatagtgactacatgaagggggcacttactagaggcctgagtaatggaatttcaattagcttctgcttcccttttctaaaaaagaaccacctttcttaagaataattaggccaaaataaacttgagtaatttgtacagtcaatattttgaagtttcggagttaccagtgaaatagcaaagctgttctccaggaaaggacatccaggttcccacccaggccttccttcctcagctcctgcagcctcatcctagtttaatatgaaggttgtgaatgggttaaaaagcagttcttaagcacctacttagatcttttcagtatctggaaatagcacccagggctgtgttagtaaagcttttcactgggtaagagtcatacaatttttacatttaatttgtttttttaaaacaaggcagtcttgttttacatattggaatgactagatattttttgacatttctggcacctctggttctgctgaattttaagggaggtgagtggtatgtacacaaagttaagattgctgcataataattcctttgcatttccaaaataaattacacaaatgtcacttttccttttctattccatagtactagttttagccagatctttgccaaacattctaggacattcagaaaagtcatccatggaattttggaatgccattctctctgtatctttgcagatcatgaggaaggaaagttgatgaactagtacgggatggctcagacttgtaaagtgtctaagtcacaacgctgcagagccagcttccgggtagcaatggcatggcctcagctgtgccaaggctacaactggagcttccttactcgcatctgaggcaaacacagcaaggctggcccaggccgcccacagtcaacagatgttcacgggagatggatcagcccctcttttgcttgttctatcaaggaaagagatctaaccatgggcaagggtggaacacacccggttcaggtcagggaatgagttgctctaagtgaacagtgaattcttacttctcagcctgtatcaattgtacccagggttcatgattactgtgacccactaagggatgatctttgaggaaacagacctggagggaggtaatttaaggagggaaagcgagtgggttttacagactgctttgtggcgacattcaggaacagaccattcaatggatgacttttcagtacataaaagcaagcagtaatggccaggagagagcaaagatgccctaagaatgacatcagactgaccaaatgtgccttttcaaataagttatgagaacgaatgaattggaattagagcaaggtattggacagaaccatgctagtctttgagagaacgtgtggattgggtggatgtttggaccgaatgaatggtaactttttaatgtgaaacagagaactgatatatgggctgtcatgtcaccctagggtactgtcgctctgtcatgtgtagcaatctttccaaatttttgttggtgggctgaacaaagataaaactaataaagtatgtgtggataccactagacagcacagcttactggactggatgtaataaaactgactgaaacttt

SEQ ID NO: 102517 - DNA, 490 bp, Homo sapiens
  Payload ID: 5
  Gene Symbol: AGPAT4
  Gene Name: 1-acylglycerol-3-phosphate O-acyltransferase 4
  ENST ID: ENST00000437165
  CDS Start-End: 1-317
tttcagctgtatatgactgtacactcaatttcagaaataatgaaaatccaacactgctgggagtcctaaacggaaagaaataccatgcagatttgtatgttaggaggatcccactggaagacatccctgaagacgatgacgagtgctcggcctggctgcacaagctctaccaggagaagggctggggcgacaccgagttctctaagcagtatgtgtctgtgagcaggcctgggaggctggccctttgcccttccgagaagatcgctgagcagcaagtggaagtggtgcatggtttctccaagcagagtggtgaatagacatcaagggacaattcctttctgtatcagcctattttgctaggagcctagatctaaagctttacgtgccccaaatctgggtgcccgacccagtttgtcaaagtgggatttcattttaatgatcaaccttgcagtcagaagtgtggtgtatgtcaaaagacagttctgttgat

SEQ ID NO: 102518 - DNA, 875 bp, Homo sapiens
  Payload ID: 5
  Gene Symbol: AGPAT4
  Gene Name: 1-acylglycerol-3-phosphate O-acyltransferase 4
  ENST ID: ENST00000436279
  CDS Start-End: 24-425
ctgaataagagcgtccacgcatcatggacctcgcgggactgctgaagtctcagttcctgtgccacctggtcttctgctacgtctttattgcctcagggctaatcatcaacaccattcagctcttcactctcctcctctggcccattaacaagcagctcttccggaagatcaactgcagactgtcctattgcatctcaagccagctggtgatgctgctggagtggtggtcgggcacggaatgcaccatcttcacggacccgcgcgcctacctcaagtatgggaaggaaaatgccatcgtggttctcaaccacaagtttgaaattgactttctgtgtggctggagcctgtccgaacgctttgggctgttagggtttgacctcttgcacgtagcttgcatgcctttggaactgggtctcttcagttgacttttgtcgtcttcaacacactgcagcgtgtagcggttgagcctgtgtcacatagctgaatcagagtcatctgcggtactcagggctccaaggtcctggccaagaaagagctggcctatgtcccaattatcggctggatgtggtacttcaccgagatggtcttctgttcgcgcaagtgggagcaggatcgcaagacggttgccaccagtttgcagcacctccgggactaccccgagaagtattttttcctgattcactgtgagggcacacggttcacggagaagaagcatgagatcagcatgcaggtggcccgggccaaggggctgcctcgcctcaagcatcacctgttgccacgaaccaagggcttcgccatcaccgtgaggagcttgagaaatgtagaaataatgaaaatccaacactgctgggagtcctaaacggaaagaaatacca

SEQ ID NO: 102519 - DNA, 3685 bp, Homo sapiens
  Payload ID: 6
  Gene Symbol: AGPAT5
  Gene Name: 1-acylglycerol-3-phosphate O-acyltransferase 5
  Uniprot ID: Q9NUQ2
  ENST ID: ENST00000285518
  CDS Start-End: 313-1407
cggagccccctgccccggcagggggatgtggcgatgggtgagggtcatggggtgtgagcatccctgagccatcgatccgggagggccgcgggttcccttgctttgccgccgggagcggcgcacgcagccccgcactcgcctacccggccccgggcggcggcgcggcccatgcggctgggggcggaggctgggagcgggtggcgggcgcggcggcccgggcccgggcggtgattggccgcctgctggccgcgactgaggcccgggaggcgggcggggagcgcaggcggagctcgctgccgccgagctgagaagatgctgctgtccctggtgctccacacgtactccatgcgctacctgctgcccagcgtcgtgctcctgggcacggcgcccacctacgtgttggcctggggggtctggcggctgctctccgccttcctgcccgcccgcttctaccaagcgctggacgaccggctctactgcgtctaccagagcatggtgctcttcttcttcgagaattacaccggggtccagatattgctatatggagatttgccaaaaaataaagaaaatataatatatttagcaaatcatcaaagcacagttgactggattgttgctgacatcttggccatcaggcagaatgcgctaggacatgtgcgctacgtgctgaaagaagggttaaaatggctgccattgtatgggtgttactttgctcagcatggaggaatctatgtaaagcgcagtgccaaatttaacgagaaagagatgcgaaacaagttgcagagctacgtggacgcaggaactccaatgtatcttgtgatttttccagaaggtacaaggtataatccagagcaaacaaaagtcctttcagctagtcaggcatttgctgcccaacgtggccttgcagtattaaaacatgtgctaacaccacgaataaaggcaactcacgttgcttttgattgcatgaagaattatttagatgcaatttatgatgttacggtggtttatgaagggaaagacgatggagggcagcgaagagagtcaccgaccatgacggaatttctctgcaaagaatgtccaaaaattcatattcacattgatcgtatcgacaaaaaagatgtcccagaagaacaagaacatatgagaagatggctgcatgaacgtttcgaaatcaaagataagatgcttatagaattttatgagtcaccagatccagaaagaagaaaaagatttcctgggaaaagtgttaattccaaattaagtatcaagaagactttaccatcaatgttgatcttaagtggtttgactgcaggcatgcttatgaccgatgctggaaggaagctgtatgtgaacacctggatatatggaaccctacttggctgcctgtgggttactattaaagcatagacaagtagctgtctccagacagtgggatgtgctacattgtctatttttggcggctgcacatgacatcaaattgtttcctgaatttattaaggagtgtaaataaagccttgttgattgaagattggataatagaatttgtgacgaaagctgatatgcaatggtcttgggcaaacatacctggttgtacaactttagcatcggggctgctggaagggtaaaagctaaatggagtttctcctgctctgtccatttcctatgaactaatgacaacttgagaaggctgggaggattgtgtattttgcaagtcagatggctgcatttttgagcattaatttgcagcgtatttcactttttctgttattttcaatttattacaacttgacagctccaagctcttattactaaagtatttagtatcttgcagctagttaatatttcatcttttgcttatttctacaagtcagtgaaataaattgtatttaggaagtgtcaggatgttcaaaggaaagggtaaaaagtgttcatggggaaaaagctctgtttagcacatgattttattgtattgcgttattagctgattttactcattttatatttgcaaaataaatttctaatatttattgaaattgcttaatttgcacaccctgtacacacagaaaatggtataaaatatgagaacgaagtttaaaattgtgactctgattcattatagcagaactttaaatttcccagctttttgaagatttaagctacactattagtacttccctttgtctgtgccataagtgcttgaaaacgttaaggttttctgttttgttttgtttttttaatatcaaaagagtcggtgtgaaccttggttggaccccaagttcacaagatttttaaggtgatgagagcctgcagacattctgcctagatttactagcgtgtgccttttgcctgcttctctttgatttcacagaatattcattcagaagtcgcgtttctgtagtgtggtggattcccactgggctctggtccttcccttggatcccgtcagtggtgctgctcagcggcttgcacgcagacttgctaggaagaaatgcagagccagcctgtgctgcccactttcagagttgaactctttaagcccttgtgagtgggcttcaccagctactgcagaggcattttgcatttgtctgtgtcaagaagttcaccttctcaagccagtgaaatacagacttaatttgtcatgactgaacgaatttgtttatttcccattaggtttagtggagctacacattaatatgtatcgccttagagcaagagctgtgttccaggaaccagatcacgatttttagccatggaacaatatatcccatgggagaagacctttcagtgtgaactgttctatttttgtgttataatttaaacttcgatttcctcatagtcctttaagttgacatttctgcttactgctactggatttttgctgcagaaatatatcagtggcccacattaaacataccagttggatcatgataagcaaaatgaaagaaataatgattaagggaaaattaagtgactgtgttacactgcttctcccatgccagagaataaactctttcaagcatcatctttgaagagtcgtgtggtgtgaattggtttgtgtacattagaatgtatgcacacatccatggacactcaggatatagttggcctaataatcggggcatgggtaaaacttatgaaaatttcctcatgctgaattgtaattttctcttacctgtaaagtaaaatttagatcaattccatgtctttgttaagtacagggatttaatatattttgaatataatgggtatgttctaaatttgaactttgagaggcaatactgttggaattatgtggattctaactcattttaacaaggtagcctgacctgcataagatcacttgaatgttaggtttcatagaactatactaatcttctcacaaaaggtctataaaatacagtcgttgaaaaaaattttgtatcaaaatgtttggaaaattagaagcttctccttaacctgtattgatactgacttgaattattttctaaaattaagagccgtatacctacctgtaagtcttttcacatatcatttaaacttttgtttgtattattactgatttacagcttagttattaatttttctttataagaatgccgtcgatgtgcatgcttttatgtttttcagaaaagggtgtgtttggatgaaagtaaaaaaaaaaataaaatctttcactgtctctaat

SEQ ID NO: 102520 - DNA, 468 bp, Homo sapiens
  Payload ID: 6
  Gene Symbol: AGPAT5
  Gene Name: 1-acylglycerol-3-phosphate O-acyltransferase 5
  ENST ID: ENST00000523586
  CDS Start-End: 1-214
cttcttcgagaattacaccggggtccaggtgagccgcctcccgctcccgggtctcggcgtccacccgagctcccgggggcgcggacctctccgctcccccacagctggcgagggtcacccggccggcccggcggacccagcacggagagcacgtgccgcctccccgccttcctctccgcatgcttcctgccgttctgccgagatcgctctctaggaagctgtggctgcgtcgtcctgaggctacgagtgggacccgccgcccctttccccgcccctcgcctgggtctgatgctgcttagcaaaagattggattcgtagattaaacttgagaaacaaaccataaaagtggaaggccctctttaacaatattgctatatggagatttgccaaaaaataaagaaaatataatatatttagcaaatcatcaaagcacagttgactggattgttgctgacatcttggccatca

SEQ ID NO: 102521 - DNA, 2525 bp, Homo sapiens
  Payload ID: 6
  Gene Symbol: AGPAT5
  Gene Name: 1-acylglycerol-3-phosphate O-acyltransferase 5
  ENST ID: ENST00000523234
  CDS Start-End: 4-270
aagatgctgctgtccctggtgctccacacgtactccatgcgctacctgctgcccagcgtcgtgctcctgggcacggcgcccacctacgtgttggcctggggggtctggcggctgctctccgccttcctgcccgcccgcttctaccaagcgctggacgaccggctctactgcgtctaccagagcatggtgctcttcttcttcgagaattacaccggggtccagttgactggattgttgctgacatcttggccatcaggcagaatgcgctaggacatgtgcgctacgtgctgaaagaagggttaaaatggctgccattgtatgggtgttactttgctcagcatggaggaatctatgtaaagcgcagtgccaaatttaacgagaaagagatgcgaaacaagttgcagagctacgtggacgcaggaactccaatgtatcttgtgatttttccagaaggtacaaggtataatccagagcaaacaaaagtcctttcagctagtcaggcatttgctgcccaacgtggccttgcagtattaaaacatgtgctaacaccacgaataaaggcaactcacgttgcttttgattgcatgaagaattatttagatgcaatttatgatgttacggtggtttatgaagggaaagacgatggagggcagcgaagagagtcaccgaccatgacggaatttctctgcaaagaatgtccaaaaattcatattcacattgatcgtatcgacaaaaaagatgtcccagaagaacaagaacatatgagaagatggctgcatgaacgtttcgaaatcaaagataagatgcttatagaattttatgagtcaccagatccagaaagaagaaaaagatttcctgggaaaagtgttaattccaaattaagtatcaagaagactttaccatcaatgttgatcttaagtggtttgactgcaggcatgcttatgaccgatgctggaaggaagctgtatgtgaacacctggatatatggaaccctacttggctgcctgtgggttactattaaagcatagacaagtagctgtctccagacagtgggatgtgctacattgtctatttttggcggctgcacatgacatcaaattgtttcctgaatttattaaggagtgtaaataaagccttgttgattgaagattggataatagaatttgtgacgaaagctgatatgcaatggtcttgggcaaacatacctggttgtacaactttagcatcggggctgctggaagggtaaaagctaaatggagtttctcctgctctgtccatttcctatgaactaatgacaacttgagaaggctgggaggattgtgtattttgcaagtcagatggctgcatttttgagcattaatttgcagcgtatttcactttttctgttattttcaatttattacaacttgacagctccaagctcttattactaaagtatttagtatcttgcagctagttaatatttcatcttttgcttatttctacaagtcagtgaaataaattgtatttaggaagtgtcaggatgttcaaaggaaagggtaaaaagtgttcatggggaaaaagctctgtttagcacatgattttattgtattgcgttattagctgattttactcattttatatttgcaaaataaatttctaatatttattgaaattgcttaatttgcacaccctgtacacacagaaaatggtataaaatatgagaacgaagtttaaaattgtgactctgattcattatagcagaactttaaatttcccagctttttgaagatttaagctacactattagtacttccctttgtctgtgccataagtgcttgaaaacgttaaggttttctgttttgttttgtttttttaatatcaaaagagtcggtgtgaaccttggttggaccccaagttcacaagatttttaaggtgatgagagcctgcagacattctgcctagatttactagcgtgtgccttttgcctgcttctctttgatttcacagaatattcattcagaagtcgcgtttctgtagtgtggtggattcccactgggctctggtccttcccttggatcccgtcagtggtgctgctcagcggcttgcacgcagacttgctaggaagaaatgcagagccagcctgtgctgcccactttcagagttgaactctttaagcccttgtgagtgggcttcaccagctactgcagaggcattttgcatttgtctgtgtcaagaagttcaccttctcaagccagtgaaatacagacttaatttgtcatgactgaacgaatttgtttatttcccattaggtttagtggagctacacattaatatgtatcgccttagagcaagagctgtgttccaggaaccagatcacgatttttagccatggaacaatatatcccatgggagaagacctttcagtgtgaactgttctatttttgtgttataatttaaacttcgatttcctcatagtcctttaagttgacatttctgcttactgctactggatttttgctgcagaaatatatcagtggcccaca

SEQ ID NO: 102522 - DNA, 852 bp, Homo sapiens
  Payload ID: 6
  Gene Symbol: AGPAT5
  Gene Name: 1-acylglycerol-3-phosphate O-acyltransferase 5
  ENST ID: ENST00000518327
  CDS Start-End: 1-545
acgtactccatgcgctacctgctgcccagcgtcgtgctcctgggcacggcgcccacctacgtgttggcctggggggtctggcggctgctctccgccttcctgcccgcccgcttctaccaagcgctggacgaccggctctactgcgtctaccagagcatggtgctcttcttcttcgagaattacaccggggtccagaatttctctgcaaagaatgtccaaaaattcatattcacattgatcgtatcgacaaaaaagatgtcccagaagaacaagaacatatgagaagatggctgcatgaacgtttcgaaatcaaagataagatgcttatagaattttatgagtcaccagatccagaaagaagaaaaagatttcctgggaaaagtgttaattccaaattaagtatcaagaagactttaccatcaatgttgatcttaagtggtttgactgcaggcatgcttatgaccgatgctggaaggaagctgtatgtgaacacctggatatatggaaccctacttggctgcctgtgggttactattaaagcatagacaagtagctgtctccagacagtgggatgtgctacattgtctatttttggcggctgcacatgacatcaaattgtttcctgaatttattaaggagtgtaaataaagccttgttgattgaagattggataatagaatttgtgacgaaagctgatatgcaatggtcttgggcaaacatacctggttgtacaactttagcatcggggctgctggaagggtaaaagctaaatggagtttctcctgctctgtccatttcctatgaactaatgacaacttgagaaggctgggaggattgtgtattttgcaagtc

SEQ ID NO: 102523 - DNA, 2362 bp, Homo sapiens
  Payload ID: 7
  Gene Symbol: ACCS
  Gene Name: 1-aminocyclopropane-1-carboxylate synthase homolog (Arabidopsis)(non-functional)
  Uniprot ID: Q96QU6
  ENST ID: ENST00000263776
  CDS Start-End: 435-1940
ctacacgtgatgggcgcccaccgagtgccagcaccgcctcctccagctccgccaagtaggtgggatccactactttgcagaggaggaagccgttcaggcctccctctgtgcactttgcaaaagcctctgcccttccatctcgaatcccttggcgccgatcacacttcctctgcctggaaacctggagccgtctctcgcgagacgtcctccgccctgtagaaggccgtttcggttcttcgtgcgcggtagccgccccacttgcgggattccaaggcctcatcgagtgcgggtatctggctgtggattcgccgccgtcctgctggacgcctggaggctcgaaccccgccgcccccctaccccaggctttactcccaccccggcttccgcccactgtgctgcccttcctcggacctgggctgtcgggagagctggagatgttcacccttcctcaaaaggacttcagggctcccaccacctgtctgggccccacctgcatgcaggacctgggcagtagccatggggaagatctggaaggagaatgctccagaaaactggaccagaagctgccagagctccgtggagtgggtgatcctgccatgatctcctctgatacctcctacctgtcctctagaggaagaatgattaaatggttctgggattcagctgaggagggctacaggacctaccacatggatgagtatgatgaggacaagaaccccagtggcatcattaacttgggcaccagtgagaacaaactctgctttgacctgctgtcctggcggctgagtcagcgcgacatgcagagggtggagccatccctgctgcagtatgctgactggaggggacatctgttcctccgggaggaagtggccaagttcctgtctttctactgcaagagcccagtacccctcagaccagagaatgtggttgtcctgaatggtggtgcctcgctcttctctgctctggccacggtgctgtgtgaggccggggaggctttcctgatccccaccccttactatggcgctatcacacagcacgtgtgtctctatggcaacatccggctggcctatgtctacctggacagtgaggtcactgggctagacacacgccccttccagctcacagtggagaagctggagatggccctgagagaagctcactctgagggtgtgaaggtcaaaggcctcatcctcatcagcccccagaaccctctgggtgatgtatactcccctgaagagctacaggagtacctggtatttgccaagaggcacaggctgcatgtgattgtggatgaggtctacatgctgtccgtgtttgagaagtctgttgggtaccgcagtgtcctaagcctggaaaggctccctgacccccagaggacccatgtgatgtgggcaaccagcaaggacttcgggatgtctgggctccgctttggcacgctgtacacagaaaaccaggatgtggccactgccgtggcttccctctgccgctaccacggcctcagtggcttggtccagtaccagatggcacagctgctccgggaccgtgactggatcaaccaggtgtacctgccggaaaaccatgcccggctcaaggctgcccacacctatgtctcagaagagcttagggcattggggatccccttcttgagtcgtggggctggcttcttcatctgggttgacttgagaaagtacctgcccaagggcacctttgaggaggaaatgctgctctggcgccgctttttggacaacaaggtgctgctgtcctttggcaaggccttcgagtgtaaagagcctggttggtttcgctttgtcttctcagaccaggtccaccggctttgcctggggatgcagagggtccagcaggtgcttgcaggcaaatcccaagtggcagaagacccccgtccctctcagagccaggagccaagtgaccaacgcaggtgagctggtcattgtctcgtggccagagggcccagcagccactgtggacctggggcgttctggggctgcagaagactgactgtggatgtgccatttgccaggaaggtatctaacttggctttgtgcctgaagaactgtttcttgtctttcgctgtagcagtgggaaactccttaagctgtggttcagcctgggccctccctctctcctattaaacaaaactaggagagtccatatgtctccattgtgagttatttagaatggaggagtcgtgactgcttctaaccagagcctcagcccccctgaggatgtgaaaagaaaacaaacaacttgtaccttctttctgatatcaccgtcattcctctttctttgtcaccaaggaaacgagtcaaaggaacagcacatacaggagagtttgtagaaaaat

SEQ ID NO: 102524 - DNA, 563 bp, Homo sapiens
  Payload ID: 7
  Gene Symbol: ACCS
  Gene Name: 1-aminocyclopropane-1-carboxylate synthase homolog (Arabidopsis)(non-functional)
  ENST ID: ENST00000524990
  CDS Start-End: 145-563
agtctcctagtccgggcgcgctgagcgcaggggggcgctgtcctcacccacgcgtaagtcgccgcagggcgtttccgggcggagaaaacctacacgtgatgggcgcccaccgagtgccagcaccgcctcctccagctccgccaaatgttcacccttcctcaaaaggacttcagggctcccaccacctgtctgggccccacctgcatgcaggacctgggcagtagccatggggaagatctggaaggagaatgctccagaaaactggaccagaagctgccagagctccgtggagtgggtgatcctgccatgatctcctctgatacctcctacctgtcctctagaggaagaatgattaaatggttctgggattcagctgaggagggctacaggacctaccacatggatgagtatgatgaggacaagaaccccagtggcatcattaacttgggcaccagtgagaacaaactctgctttgacctgctgtcctggcggctgagtcagcgcgacatgcagagggtggagccatccctgctgcagtatgctgactggaggggacatctgtt

SEQ ID NO: 102525 - DNA, 400 bp, Homo sapiens
  Payload ID: 7
  Gene Symbol: ACCS
  Gene Name: 1-aminocyclopropane-1-carboxylate synthase homolog (Arabidopsis)(non-functional)
  ENST ID: ENST00000533404
  CDS Start-End: 169-400
ctgcacttgtggaggttcccattcctcccttccctcagttcctacccgccatctgcctcagaacaccacataatctcatcctaccctttacaccacaagacccccaggactcccaggcaatactctgctttaactcaggaaattttaacctggcatttggtaattgagatgttcacccttcctcaaaaggacttcagggctcccaccacctgtctgggccccacctgcatgcaggacctgggcagtagccatggggaagatctggaaggagaatgctccagaaaactggaccagaagctgccagagctccgtggagtgggtgatcctgccatgatctcctctgatacctcctacctgtcctctagaggaagaatgattaaatggttctgggattcagctg

SEQ ID NO: 102526 - DNA, 1820 bp, Homo sapiens
  Payload ID: 8
  Gene Symbol: ACCSL
  Gene Name: 1-aminocyclopropane-1-carboxylate synthase homolog (Arabidopsis)(non-functional)-like
  Uniprot ID: Q4AC99
  ENST ID: ENST00000378832
  CDS Start-End: 57-1763
tctctttctccataggtgccaggcagccttcagaggccagtaaagatacccggagtatgagtcatcggtcagacacccttcctgtgccctctggtcagaggagaggccgggtccccagagaccacagcatctatacccagctgttggagataacgctgcacttgcagcaggccatgacggagcacttcgtgcagctgacgagcagacagggcctgtcgctggaggaaaggaggcacactgaggccatctgtgagcatgaagcccttctgagtcgcttaatatgccggatgatcaacctcctacagtctggggccgcgagtggcctggagctccaagtgcctcttccttctgaggactctaggggtgatgtcagatatgggcagagggcccaactctctgggcagcctgatccagttccccaactgagtgattgtgaagctgcctttgtcaaccgcgacctatccatccgtgggattgacatctctgtcttttatcagtcgagcttccaggactacaatgcctaccaaaaagataaatatcataaggacaagaacaccttgggtttcattaaccttggcaccagtgagaacaagctctgcatggatctgatgactgaaagattgcaagaaagtgacatgaactgcattgaggacaccttgcttcagtaccctgattggagagggcagccattcctgcgggaagaagtggcccggttcctgacctactactgcagggcacctacccgacttgacccagaaaatgtggtggttctaaatggctgctgctctgtcttctgtgccctggccatggttctgtgtgatccaggcgaggccttcctggtccctgctcccttctatggtggctttgcctttagctcccgcctgtatgcaaaggttgagttgattcctgtccacctggagagtgaggtcactgttacaaacacccatcctttccagctcactgtggacaagttagaggaagccctgcttgaagctaggcttgaggggaaaaaggtccgaggccttgtgctaatcaaccctcagaatcctctgggtgacatctactccccagactcactgatgaaatacctggaatttgccaagaggtataacctacatgtgatcatagatgagatttacatgctgtctgtgtttgatgaatccatcacattccacagcattctgagcatgaaaagtttgcctgatagcaacaggacccatgtgatctggggtaccagtaaggattttggcatctctggcttccgctttggtgctctgtatacccacaacaaggaggtggcctctgctgtgagtgcctttggctacctccacagtatttctggcatcacccagcacaagctgtgtcaactgctccagaacacagaatggattgacaaagtatacctacccaccaattgctaccggctccgggaagctcacaagtacatcactgctgagctgaaggcattggagatcccttttcacaaccgcagctctggcctctatgtctggatcaacttgaaaaagtacctggatccctgtacatttgaagaagaacggctcctctattgccgcttcctggacaacaagctattgttatcccgtggcaaaacctacatgtgtaaggagccaggctggttctgcctcatctttgcagatgagctcccccggctaaaattggctatgcgtcggttctgtgatgtgctgcaggagcagaaggaggctttgatagtgaagcagttggaggatgcaatgagggagtaggccgtctgcctcccaaccagcagttccagcccatcacttgctcagggaccccctaat

SEQ ID NO: 102527 - DNA, 1806 bp, Homo sapiens
  Payload ID: 8
  Gene Symbol: ACCSL
  Gene Name: 1-aminocyclopropane-1-carboxylate synthase homolog (Arabidopsis)(non-functional)-like
  ENST ID: ENST00000527145
  CDS Start-End: 23-550
ggccagtaaagatacccggagtatgagtcatcggtcagacacccttcctgtgccctctggtcagaggagaggccgggtccccagagaccacagcatctatacccagctgttggagataacgctgcacttgcagcaggccatgacggagcacttcgtgcagctgacgagcagacagggcctgtcgctggaggaaaggaggcacactgaggccatctgtgagcatgaagcccttctgagtcgcttaatatgccggatgatcaacctcctacagtctggggccgcgagtggcctggagctccaagtgcctcttccttctgaggactctaggggtgatgtcagatatgggcagagggcccaactctctgggcagcctgatccagttccccaactgagtgattgtgaagctgcctttgtcaaccgcgacctatccatccgtgggattgacatctctgtcttttatcagtcgagcttccaggactacaatgcctaccaaaaagataaatatcataaggacaagaacaccttgggtggagcaagaggactgacctgatcttggattccttccatctccagggtttcattaaccttggcaccagtgagaacaagctctgcatggatctgatgactgaaagattgcaagaaagtgacatgaactgcattgaggacaccttgcttcagtaccctgattggagagggcagccattcctgcgggaagaagtggcccggttcctgacctactactgcagggcacctacccgacttgacccagaaaatgtggtggttctaaatggctgctgctctgtcttctgtgccctggccatggttctgtgtgatccaggcgaggccttcctggtccctgctcccttctatggtggctttgcctttagctcccgcctgtatgcaaaggttgagttgattcctgtccacctggagagtgaggtcactgttacaaacacccatcctttccagctcactgtggacaagttagaggaagccctgcttgaagctaggcttgaggggaaaaaggtccgaggccttgtgctaatcaaccctcagaatcctctgggtgacatctactccccagactcactgatgaaatacctggaatttgccaagaggtataacctacatgtgatcatagatgagatttacatgctgtctgtgtttgatgaatccatcacattccacagcattctgagcatgaaaagtttgcctgatagcaacaggacccatgtgatctggggtaccagtaaggattttggcatctctggcttccgctttggtgctctgtatacccacaacaaggaggtggcctctgctgtgagtgcctttggctacctccacagtatttctggcatcacccagcacaagctgtgtcaactgctccagaacacagaatggattgacaaagtatacctacccaccaattgctaccggctccgggaagctcacaagtacatcactgctgagctgaaggcattggagatcccttttcacaaccgcagctctggcctctatgtctggatcaacttgaaaaagtacctggatccctgtacatttgaagaagaacggctcctctattgccgcttcctggacaacaagctattgttatcccgtggcaaaacctacatgtgtaaggagccaggctggttctgcctcatctttgcagatgagctcccccggctaaaattggctatgcgtcggttctgtgatgtgctgcaggagcagaaggaggctttgatagtgaagcagttggaggatgcaatgagggagtaggccgtctgcctcccaaccagcagttccagc

SEQ ID NO: 102528 - DNA, 1753 bp, Homo sapiens
  Payload ID: 9
  Gene Symbol: BPGM
  Gene Name: 2,3-bisphosphoglycerate mutase
  Uniprot ID: P07738
  ENST ID: ENST00000344924
  CDS Start-End: 192-971
cgtctggttcaggggctagaaaagagcgtcgatgccggcggcagtgatgagtcctaggaggcgctggctctttggcggctcggaggagcggctgctgctgctgctgctgctgctggtggcccctttgcagatgtattgctgtccttgaatattagcccatttgaaaacgcctgggaagttcagccatcagtatgtccaagtacaaacttattatgttaagacatggagagggtgcttggaataaggagaaccgtttttgtagctgggtggatcagaaactcaacagcgaaggaatggaggaagctcggaactgtgggaagcaactcaaagcgttaaactttgagtttgatcttgtattcacatctgtccttaatcggtccattcacacagcctggctgatcctggaagagctaggccaggaatgggtgcctgtggaaagctcctggcgtctaaatgagcgtcactatggggccttgatcggtctcaacagggagcagatggctttgaatcatggtgaagaacaagtgaggctctggagaagaagctacaatgtaaccccgcctcccattgaggagtctcatccttactaccaagaaatctacaacgaccggaggtataaagtatgcgatgtgcccttggatcaactgccacggtcggaaagcttaaaggatgttctggagagactccttccctattggaatgaaaggattgctcccgaagtattacgtggcaaaaccattctgatatctgctcatggaaatagcagtagggcactcctaaaacacctggaaggtatctcagatgaagacatcatcaacattactcttcctactggagtccccattcttctggaattggatgaaaacctgcgtgctgttgggcctcatcagttcctgggtgaccaagaggcgatccaagcagccattaagaaagtagaagatcaaggaaaagtgaaacaagctaaaaaatagtctttctcaactgttggctaagaagaaatgcaaaagaagtggcataggagtgtgttatgggtgctgaactctctctctttttccccgattttccagagctaggctgtggagtagagtttgtataggtaactaggtaacttattgtggcccagataaggctttaggatgcctcagtgcttatgtcatagccttatgagttagctttcttgctagccccctagtcggtcaccaaactagtaactagtggggcttaatgaaggtcataagtttctgagatgggagagcaacaagtagagatgaagttaaaggtatttatcattcaagaaatcattattgagtcaccattgacaggcactattctaatcagtagttcactttaatatttaataagattttctgggataacagtaagggatattagataatataccgtatgtatttattactagtcttttcctctaggaaaagggatactttgataattaaggccagaggcccattagttgagaaagtcacagatatatttctccaagaaagccaacaaccaccaccacaatgacagaaatgacaacaaggccctttaacttgtcttctagtttagagacatccttcatttgacatttagtagaattcctctttggccacaagaataagcagcaaataaacaactatggctgttgaggttctcattttggtttgttttaattttttgaactttgggtacctgtaattagtttaaaaataaagttcctgataataaagtgactgaaaatggcatcccc

SEQ ID NO: 102529 - DNA, 2051 bp, Homo sapiens
  Payload ID: 9
  Gene Symbol: BPGM
  Gene Name: 2,3-bisphosphoglycerate mutase
  Uniprot ID: P07738
  ENST ID: ENST00000393132
  CDS Start-End: 490-1269
gagcgtcgatgccggcggcagtgatgagtcctaggaggcgctggctctttggcggctcggaggagcggctgctgctgctgctgctgctgctggtggcccctttgcagaaaagttctaagaacagtgctgttggctcagtgagatgaggttatcggaaaactttctgtttacacaagagttgcctccttcaaagaagcatgcatggtccttgcaggtcactgtgcccatcactctgcatagtccagctgcactctgcttcacacagctgcctgcccattgcaggcatttgagtttgcaatccatgccttaaactttaaatcacactggctacagcgttgtgtgtttcttggtaaacactgggtaaatcagctcctgtggatgttgactgaagtttctatgtttgcaagctaatcctcagcagtttctttatgtattgctgtccttgaatattagcccatttgaaaacgcctgggaagttcagccatcagtatgtccaagtacaaacttattatgttaagacatggagagggtgcttggaataaggagaaccgtttttgtagctgggtggatcagaaactcaacagcgaaggaatggaggaagctcggaactgtgggaagcaactcaaagcgttaaactttgagtttgatcttgtattcacatctgtccttaatcggtccattcacacagcctggctgatcctggaagagctaggccaggaatgggtgcctgtggaaagctcctggcgtctaaatgagcgtcactatggggccttgatcggtctcaacagggagcagatggctttgaatcatggtgaagaacaagtgaggctctggagaagaagctacaatgtaaccccgcctcccattgaggagtctcatccttactaccaagaaatctacaacgaccggaggtataaagtatgcgatgtgcccttggatcaactgccacggtcggaaagcttaaaggatgttctggagagactccttccctattggaatgaaaggattgctcccgaagtattacgtggcaaaaccattctgatatctgctcatggaaatagcagtagggcactcctaaaacacctggaaggtatctcagatgaagacatcatcaacattactcttcctactggagtccccattcttctggaattggatgaaaacctgcgtgctgttgggcctcatcagttcctgggtgaccaagaggcgatccaagcagccattaagaaagtagaagatcaaggaaaagtgaaacaagctaaaaaatagtctttctcaactgttggctaagaagaaatgcaaaagaagtggcataggagtgtgttatgggtgctgaactctctctctttttccccgattttccagagctaggctgtggagtagagtttgtataggtaactaggtaacttattgtggcccagataaggctttaggatgcctcagtgcttatgtcatagccttatgagttagctttcttgctagccccctagtcggtcaccaaactagtaactagtggggcttaatgaaggtcataagtttctgagatgggagagcaacaagtagagatgaagttaaaggtatttatcattcaagaaatcattattgagtcaccattgacaggcactattctaatcagtagttcactttaatatttaataagattttctgggataacagtaagggatattagataatataccgtatgtatttattactagtcttttcctctaggaaaagggatactttgataattaaggccagaggcccattagttgagaaagtcacagatatatttctccaagaaagccaacaaccaccaccacaatgacagaaatgacaacaaggccctttaacttgtcttctagtttagagacatccttcatttgacatttagtagaattcctctttggccacaagaataagcagcaaataaacaactatggctgttgaggttctcattttggtttgttttaattttttgaactttgggtacctgtaattagtttaaaaataaagttcctgataataaagtgactgaaaatggcatcccc

SEQ ID NO: 102530 - DNA, 1870 bp, Homo sapiens
  Payload ID: 9
  Gene Symbol: BPGM
  Gene Name: 2,3-bisphosphoglycerate mutase
  Uniprot ID: P07738
  ENST ID: ENST00000418040
  CDS Start-End: 314-1093
ctggttcaggggctagaaaagagcgtcgatgccggcggcagtgatgagtcctaggaggcgctggctctttggcggctcggaggagcggctgctgctgctgctgctgctgctggtggcccctttgcagaatgagcctcgcaggcagtcaccgttctgtcaactgagaggaggagcccgctttggtagtgctgtccttatggcaagaatatatagaagttggagggaagataaactctcttctggatgtctgagatgtattgctgtccttgaatattagcccatttgaaaacgcctgggaagttcagccatcagtatgtccaagtacaaacttattatgttaagacatggagagggtgcttggaataaggagaaccgtttttgtagctgggtggatcagaaactcaacagcgaaggaatggaggaagctcggaactgtgggaagcaactcaaagcgttaaactttgagtttgatcttgtattcacatctgtccttaatcggtccattcacacagcctggctgatcctggaagagctaggccaggaatgggtgcctgtggaaagctcctggcgtctaaatgagcgtcactatggggccttgatcggtctcaacagggagcagatggctttgaatcatggtgaagaacaagtgaggctctggagaagaagctacaatgtaaccccgcctcccattgaggagtctcatccttactaccaagaaatctacaacgaccggaggtataaagtatgcgatgtgcccttggatcaactgccacggtcggaaagcttaaaggatgttctggagagactccttccctattggaatgaaaggattgctcccgaagtattacgtggcaaaaccattctgatatctgctcatggaaatagcagtagggcactcctaaaacacctggaaggtatctcagatgaagacatcatcaacattactcttcctactggagtccccattcttctggaattggatgaaaacctgcgtgctgttgggcctcatcagttcctgggtgaccaagaggcgatccaagcagccattaagaaagtagaagatcaaggaaaagtgaaacaagctaaaaaatagtctttctcaactgttggctaagaagaaatgcaaaagaagtggcataggagtgtgttatgggtgctgaactctctctctttttccccgattttccagagctaggctgtggagtagagtttgtataggtaactaggtaacttattgtggcccagataaggctttaggatgcctcagtgcttatgtcatagccttatgagttagctttcttgctagccccctagtcggtcaccaaactagtaactagtggggcttaatgaaggtcataagtttctgagatgggagagcaacaagtagagatgaagttaaaggtatttatcattcaagaaatcattattgagtcaccattgacaggcactattctaatcagtagttcactttaatatttaataagattttctgggataacagtaagggatattagataatataccgtatgtatttattactagtcttttcctctaggaaaagggatactttgataattaaggccagaggcccattagttgagaaagtcacagatatatttctccaagaaagccaacaaccaccaccacaatgacagaaatgacaacaaggccctttaacttgtcttctagtttagagacatccttcatttgacatttagtagaattcctctttggccacaagaataagcagcaaataaacaactatggctgttgaggttctcattttggtttgttttaattttttgaactttgggtacctgtaattagtttaaaaataaagttcctgataataaagtgactgaaaatggca

SEQ ID NO: 102531 - DNA, 635 bp, Homo sapiens
  Payload ID: 9
  Gene Symbol: BPGM
  Gene Name: 2,3-bisphosphoglycerate mutase
  ENST ID: ENST00000443095
  CDS Start-End: 402-635
acaaggagagagagaggcgggctgagcagccatgtcagcagattctccgaggatggagtgggcccagcagatcttcaggccagcagcttaaatgtaaggagttcagcatagcttgagagttgctggtctccctttactagattctccccctgctaagacgtagctggtgtgtgtaggatatctggagggctggggaggaggaggtggggcctctttatcagtgtggttcctctcactcctgcctaccagatctgtttgtacaggcagcatccctcagctgcttgcatttgatagcttattttgcatctggatttattcctgctgaaaactctatcttgagatgtattgctgtccttgaatattagcccatttgaaaacgcctgggaagttcagccatcagtatgtccaagtacaaacttattatgttaagacatggagagggtgcttggaataaggagaaccgtttttgtagctgggtggatcagaaactcaacagcgaaggaatggaggaagctcggaactgtgggaagcaactcaaagcgttaaactttgagtttgatcttgtattcacatctgtccttaatcggtccattcacacagcctggctgatcctggaagagctaggccaggaatgg

SEQ ID NO: 102532 - DNA, 2583 bp, Homo sapiens
  Payload ID: 10
  Gene Symbol: CNP
  Gene Name: 2',3'-cyclic nucleotide 3' phosphodiesterase
  Uniprot ID: P09543
  ENST ID: ENST00000393888
  CDS Start-End: 126-1331
ctccgcgcaggcgggcggccccggagcgctggtgccggcagaggcggcgacggtggcgcccctcctcatcatgaggcttctcccgaaaaagccacacattcctgcccaagatcttcttccgcaagatgtcatcctcaggggccaaggacaagcctgagctgcagtttcccttccttcaggatgaggacacagtggccacgctgctagagtgcaagacgctcttcatcttgcgcggcctgccaggaagcggcaagtccacgctggcacgggtcatcgtggacaagtaccgtgatggcaccaagatggtgtcggctgacgcttacaagatcacccccggcgctcgaggagccttctccgaggagtacaagcggctcgatgaggacctggctgcctactgccgccgccgggacatcagaattcttgtgcttgatgacaccaaccacgaacgggaacggctggagcagctctttgaaatggccgaccagtaccagtaccaggtggtgctggtggagcccaagacggcgtggcggctggactgtgcccagctcaaggagaagaaccagtggcagctgtcggctgatgacctgaagaagctgaagcctgggctggagaaggacttcctgccgctctacttcggctggttcctgaccaagaagagctctgagaccctccgcaaagccggccaggtcttcctggaagagctggggaaccacaaggccttcaagaaggagctgcgacaattcgtccctggggatgagcccagggagaagatggacttggtcacctactttggaaagagacccccaggcgtgctgcattgcacaaccaagttttgtgactacgggaaggctcccggggcagaggagtacgctcaacaagatgtgttaaagaaatcttactccaaggccttcacgctgaccatctctgccctctttgtgacacccaagacgactggggcccgggtggagttaagcgagcagcaactgcagttgtggccgagtgatgtggacaagctgtcacccactgacaacctgccgcgggggagccgcgcccacatcaccctcggctgtgcagctgacgtagaggccgtgcagacgggccttgacctcttagagattctgcggcaggagaaggggggcagccgaggcgaggaggtgggcgagctaagccggggcaagctctattccttgggcaatgggcgctggatgctgaccctggccaagaacatggaggtcagggccatcttcacggggtactacgggaaaggcaaacctgtgcccacgcaaggtagccggaaggggggcgccttgcagtcctgcaccatcatatgagtgttctcaccaccacttatgcccctagaagggaaggggagagggaaacgtgccctctgtttgatccttgttttgtgacattttttttttttttttttttactcaaagttaacctacctgtaactttttaaaaacttgtaaaataactgaccctcccttcctgtccgccctcttcccctctaatgctcacgctcccaacacaaggtgggcagggaggcaccattcaggaacctggaccaaagctgacgaggctgggccaagccagggatggggccacagccagaaccccgagccctacttccaggttctggttagctcagccccagcccagcccagctgctctgcccagagctgggtgagtggggagacacctcagagccccgcaaaacccactgaccggaggcaaaaggcagtggggctgggggtagttttccatggtcacagagaactagtggtggctctgagaaggggaggacctctgggctttgattccatctccttgtcttttttctttgtttttagagacagggtcctgctatttcccaagctggagtgcagtggtgcgatcatggctcactgcagcctcgaactcctgggctcaagcaatcctcctgagtgatcccatttcttaatcagtgtagccccaagaaggctggggctatttaccagggtagaaaaaggagcttacctcccacctttggtcctaagtccctgccccctccccttcacaccataactaggtaacagtttgataactagggaagaaagcagaacagttaagcagccgccacatccccgctggctgggggcctcactccaggaaggggctggactggctgtcctttccagtggcctggctccgctgtgtggatggggagatcggggccagaggcagaaccctggtgaggaagctccagtcctgctctctacccagcccatcttgcctccatggtgcctctggaggcctctgggcctcctctaacaggggctggtgggcaccaagagccaatggagtagacccctggctggtaagggccaagtcccaccggttgcttctgggaaggggtttctaacactagtctgtgtgctgtggttcctggggtgccctccactgccctctgttcagtaacagggccttgctaatcgggttgtcactcaacaaaagtgctttggatttaagttactatcctggctttgcccaacctcagcaacctgtaagactgataatgaaataaatcatgttaatcctagc

SEQ ID NO: 102533 - DNA, 5217 bp, Homo sapiens
  Payload ID: 10
  Gene Symbol: CNP
  Gene Name: 2',3'-cyclic nucleotide 3' phosphodiesterase
  Uniprot ID: P09543
  ENST ID: ENST00000393892
  CDS Start-End: 145-1410
gggtgcccgctccgccccccgggctatgtaaagcggccgggctcgggtcgtgccaccgctggactcccgtgtccctccgcgcaggcgggcggccccggagcgctggtgccggcagaggcggcgacggtggcgcccctcctcatcatgaacagaggcttctcccgaaaaagccacacattcctgcccaagatcttcttccgcaagatgtcatcctcaggggccaaggacaagcctgagctgcagtttcccttccttcaggatgaggacacagtggccacgctgctagagtgcaagacgctcttcatcttgcgcggcctgccaggaagcggcaagtccacgctggcacgggtcatcgtggacaagtaccgtgatggcaccaagatggtgtcggctgacgcttacaagatcacccccggcgctcgaggagccttctccgaggagtacaagcggctcgatgaggacctggctgcctactgccgccgccgggacatcagaattcttgtgcttgatgacaccaaccacgaacgggaacggctggagcagctctttgaaatggccgaccagtaccagtaccaggtggtgctggtggagcccaagacggcgtggcggctggactgtgcccagctcaaggagaagaaccagtggcagctgtcggctgatgacctgaagaagctgaagcctgggctggagaaggacttcctgccgctctacttcggctggttcctgaccaagaagagctctgagaccctccgcaaagccggccaggtcttcctggaagagctggggaaccacaaggccttcaagaaggagctgcgacaattcgtccctggggatgagcccagggagaagatggacttggtcacctactttggaaagagacccccaggcgtgctgcattgcacaaccaagttttgtgactacgggaaggctcccggggcagaggagtacgctcaacaagatgtgttaaagaaatcttactccaaggccttcacgctgaccatctctgccctctttgtgacacccaagacgactggggcccgggtggagttaagcgagcagcaactgcagttgtggccgagtgatgtggacaagctgtcacccactgacaacctgccgcgggggagccgcgcccacatcaccctcggctgtgcagctgacgtagaggccgtgcagacgggccttgacctcttagagattctgcggcaggagaaggggggcagccgaggcgaggaggtgggcgagctaagccggggcaagctctattccttgggcaatgggcgctggatgctgaccctggccaagaacatggaggtcagggccatcttcacggggtactacgggaaaggcaaacctgtgcccacgcaaggtagccggaaggggggcgccttgcagtcctgcaccatcatatgagtgttctcaccaccacttatgcccctagaagggaaggggagagggaaacgtgccctctgtttgatccttgttttgtgacattttttttttttttttttttactcaaagttaacctacctgtaactttttaaaaacttgtaaaataactgaccctcccttcctgtccgccctcttcccctctaatgctcacgctcccaacacaaggtgggcagggaggcaccattcaggaacctggaccaaagctgacgaggctgggccaagccagggatggggccacagccagaaccccgagccctacttccaggttctggttagctcagccccagcccagcccagctgctctgcccagagctgggtgagtggggagacacctcagagccccgcaaaacccactgaccggaggcaaaaggcagtggggctgggggtagttttccatggtcacagagaactagtggtggctctgagaaggggaggacctctgggctttgattccatctccttgtcttttttctttgtttttagagacagggtcctgctatttcccaagctggagtgcagtggtgcgatcatggctcactgcagcctcgaactcctgggctcaagcaatcctcctgagtgatcccatttcttaatcagtgtagccccaagaaggctggggctatttaccagggtagaaaaaggagcttacctcccacctttggtcctaagtccctgccccctccccttcacaccataactaggtaacagtttgataactagggaagaaagcagaacagttaagcagccgccacatccccgctggctgggggcctcactccaggaaggggctggactggctgtcctttccagtggcctggctccgctgtgtggatggggagatcggggccagaggcagaaccctggtgaggaagctccagtcctgctctctacccagcccatcttgcctccatggtgcctctggaggcctctgggcctcctctaacaggggctggtgggcaccaagagccaatggagtagacccctggctggtaagggccaagtcccaccggttgcttctgggaaggggtttctaacactagtctgtgtgctgtggttcctggggtgccctccactgccctctgttcagtaacagggccttgctaatcgggttgtcactcaacaaaagtgctttggatttaagttactatcctggctttgcccaacctcagcaacctgtaagactgataatgaaataaatcatgttaatcctagctgtgtgcagtctctcttacccttctgtgcccagctcagtcttccctagggctgggtgtattaggactggctttgtcccacagcttggggccatcggtcctgtctcccctctgctggccgggcacagctgtggtgaggttgggcagctgaacagtgttggctttcatgaggaggcagaaagcagaggctggcctcagactcatacagaaggtgggggttggctgggtacgagggatgtggagcacaaaagcctctcatcccccattaaccagggcaccaagcccacaggtgtccccagcccactggatcagaaagagttcagtaagaccggaagctcctggtatgggtttctcccagttctctagggaaggccacctgcaggtcactgaaacttcaagcaccagggaagatctaacatttgagtcccttccaggccatcagaggcctagtcagccacatgggaaacttccaagacctgactcaggcatcattccaccatggctaaggcaccagccggggaagacttgaaagaaaggggcaggagctcagatgaagagaaatcctaagttacctttctaggtcaaggcctgtccctggccatctctgaacttcagctagagcttcaagtctgtgcctggagctcctgggaaggctactcaccttgaacaccacgcttgacaggacagcatggtgcatgccgctgcatccgtgagcagtgtgtctcctgcatgcagaaagggagcagagaaggccaggggcttttgctaaaaatagtggccagaccagagctctggagccacctgtcccacctcaaatgggtctgggggtcaggaggcagggttttatctctgtctaccatctccctcgaacccacactgcaacaggaactgtgagagtctttgtaagtaaactgccctgtctaggtcagtacccacctgagctttggacgcacacagcttttagtacccacctgagctttggacacacacagcttctagtgatttctggggccccaccgtaaagtgagcatgctttctgaactcgcttctctgtgactgatgttaggctgggcccagaggcacagccggggcctgcctagcactcacatgctggacaggtctgggagaggcagagtgccccacctgccactaggctgggtgcccacagcccgcatgcagcagcttgctgcaccccaagtccaggtcgggctcagctctggctcacagactggagacaatgcagatgccagagcaaagggccaggaagggtcaaaacattttattctcttttttttttcttttttaataaagttaaacagtaaaacaaaaattcacaagctgcctccctgtccacccccgcctccctcccctgccctcggtcttcggcattggttccctttgctccaccccactcacagagacacagggcatccaactgagaaaacgaaactgctctaagcacacggagacgtgatgaagggaggaggtgaactgtttccacattcaagattaaactgagtgaatctgcattttctgggttctgggtggttgcccttcattagccaaattgaaaaaagaaattccctggaccagatgctgaaagagaaaagaggggttggtagttggctatggattttctaaggaagatcactttgctctgattatggaaaagtcttcaagggctgcttcaaactcaaacacagagagaaactctatgggtatcaaacagctcaggctgtttttgggtgcaagagggagcacgtgactgtattatacatgggtagcttctgacctcagcattatctatatagtacctttgctcttgcagagaagccttggtactaggcagttagagatgcctccctgaccctgcagagatgcggtggctaaaggtcccaaggcaaggggtgcctgggaaccttcctgtcttcatccttagcaacagccgagtggatagatgccctgctagatgagaattcagctgcccccgctcatgggcccctctgactcccaaagagctgcctaagaggcaatgagtgtgttggcttgtgatctgggaactcccaagaacagcaggcccacctaccttcaaagctgaagccgccaggaccgccaaagaatgccttgaagatattgtttggatcaaaatctgtagagcagggcaagtaacatggaagggaagaaaaggtgaaaaattagaaatgttcgaagagaactgatgacactgagaacagatctccaaagctttcctggagagtctcactcccctcctttcccaacacttcagactgcaagtgagcaaacctgccccatcccgtgcaaaacatgctacctgatcccactcctaggacatgttcccttctccttccaactgctgccccaaaggaagctttctctgcttcagcttgcttcattgggctgttttctcaacaaatggaatgccatttgcacttacacaagactttccccatactctgtctccctataatgctggagcggctactaaaaaggataaaatgtatcacttaaatgttaccaaaaataaatataagagcaa

SEQ ID NO: 102534 - DNA, 622 bp, Homo sapiens
  Payload ID: 10
  Gene Symbol: CNP
  Gene Name: 2',3'-cyclic nucleotide 3' phosphodiesterase
  ENST ID: ENST00000441615
  CDS Start-End: 190-622
atcatggtgagaggccgggcggggccgggcacggggtagcaccagggcgggaaacgagtgtcggggcccctcgggaggaagcgtcttgcaaacgaggacccggggctccgggttcgacttccagttttcttgaacagaggcttctcccgaaaaagccacacattcctgcccaagatcttcttccgcaagatgtcatcctcaggggccaaggacaagcctgagctgcagtttcccttccttcaggatgaggacacagtggccacgctgctagagtgcaagacgctcttcatcttgcgcggcctgccaggaagcggcaagtccacgctggcacgggtcatcgtggacaagtaccgtgatggcaccaagatggtgtcggctgacgcttacaagatcacccccggcgctcgaggagccttctccgaggagtacaagcggctcgatgaggacctggctgcctactgccgccgccgggacatcagaattcttgtgcttgatgacaccaaccacgaacgggaacggctggagcagctctttgaaatggccgaccagtaccagtaccaggtggtgctggtggagcccaagacggcgtggcggctggactgtgcccagctcaaggagaaga

SEQ ID NO: 102535 - DNA, 516 bp, Homo sapiens
  Payload ID: 10
  Gene Symbol: CNP
  Gene Name: 2',3'-cyclic nucleotide 3' phosphodiesterase
  ENST ID: ENST00000589772
  CDS Start-End: 155-516
gtcccttgtggcttctagaagataggaaaacaagtggctccgagaggcgcttctgacacacagcacagcggcgggtagagctggatcctaattgcagaacagaggcttctcccgaaaaagccacacattcctgcccaagatcttcttccgcaagatgtcatcctcaggggccaaggacaagcctgagctgcagtttcccttccttcaggatgaggacacagtggccacgctgctagagtgcaagacgctcttcatcttgcgcggcctgccaggaagcggcaagtccacgctggcacgggtcatcgtggacaagtaccgtgatggcaccaagatggtgtcggctgacgcttacaagatcacccccggcgctcgaggagccttctccgaggagtacaagcggctcgatgaggacctggctgcctactgccgccgccgggacatcagaattcttgtgcttgatgacaccaaccacgaacgggaacggctggagcagctctttgaaatggccgaccagta

SEQ ID NO: 102536 - DNA, 1019 bp, Homo sapiens
  Payload ID: 10
  Gene Symbol: CNP
  Gene Name: 2',3'-cyclic nucleotide 3' phosphodiesterase
  ENST ID: ENST00000472031
  CDS Start-End: 123-272
gctatgtaaagcggccgggctcgggtcgtgccaccgctggactcccgtgtccctccgcgcaggcgggcggccccggagcgctggtgccggcagaggcggcgacggtggcgcccctcctcatcatgtcgtccctggggatgagcccagggagaagatggacttggtcacctactttggaaagagacccccaggcgtgctgcattgcacaaccaagttttgtgactacgggaaggctcccggggcagaggagtacgctcaacaagatgtgttaaagaaatcttactccaaggccttcacgctgaccatctctgccctctttgtgacacccaagacgactggggcccgggtggagttaagcgagcagcaactgcagttgtggccgagtgatgtggacaagctgtcacccactgacaacctgccgcgggggagccgcgcccacatcaccctcggctgtgcagctgacgtagaggccgtgcagacgggccttgacctcttagagattctgcggcaggagaaggggggcagccgaggcgaggaggtgggcgagctaagccggggcaagctctattccttgggcaatgggcgctggatgctgaccctggccaagaacatggaggtcagggccatcttcacggggtactacgggaaaggcaaacctgtgcccacgcaaggtagccggaaggggggcgccttgcagtcctgcaccatcatatgagtgttctcaccaccacttatgcccctagaagggaaggggagagggaaacgtgccctctgtttgatccttgttttgtgacattttttttttttttttttttactcaaagttaacctacctgtaactttttaaaaacttgtaaaataactgaccctcccttcctgtccgccctcttcccctctaatgctcacgctcccaacacaaggtgggcagggaggcaccattcaggaacctggaccaaagctgacgaggctgggccaagccagggatggggccacagccagaaccccgagccctacttccag

SEQ ID NO: 102537 - DNA, 581 bp, Homo sapiens
  Payload ID: 10
  Gene Symbol: CNP
  Gene Name: 2',3'-cyclic nucleotide 3' phosphodiesterase
  ENST ID: ENST00000587679
  CDS Start-End: 88-581
gctggactcccgtgtccctccgcgcaggcgggcggccccggagcgctggtgccggcagaggcggcgacggtggcgcccctcctcatcatggatgaggacacagtggccacgctgctagagtgcaagacgctcttcatcttgcgcggcctgccaggaagcggcaagtccacgctggcacgggtcatcgtggacaagtaccgtgatggcaccaagatggtgtcggctgacgcttacaagatcacccccggcgctcgaggagccttctccgaggagtacaagcggctcgatgaggacctggctgcctactgccgccgccgggacatcagaattcttgtgcttgatgacaccaaccacgaacgggaacggctggagcagctctttgaaatggccgaccagtaccagtaccaggtggtgctggtggagcccaagacggcgtggcggctggactgtgcccagctcaaggagaagaaccagtggcagctgtcggctgatgacctgaagaagctgaagcctgggctggagaaggacttcctgccgctctacttcggctggttcctgaccaagaagagctctgagaccct

SEQ ID NO: 102538 - DNA, 689 bp, Homo sapiens
  Payload ID: 10
  Gene Symbol: CNP
  Gene Name: 2',3'-cyclic nucleotide 3' phosphodiesterase
  ENST ID: ENST00000585452
  CDS Start-End: 229-689
agtcccagaaccgcaggctcctggcgcgccccgcatgcctccagcacgtttacctttccgaagtggcaggaatggggaaagcgcacgcttaggagagcttcagacaagcttccctcttcctcctccacgaccagaagcggaaaggtgctcccggaccgaaagggaaagaagaacagaggcttctcccgaaaaagccacacattcctgcccaagatcttcttccgcaagatgtcatcctcaggggccaaggacaagcctgagctgcagtttcccttccttcaggatgaggacacagtggccacgctgctagagtgcaagacgctcttcatcttgcgcggcctgccaggaagcggcaagtccacgctggcacgggtcatcgtggacaagtaccgtgatggcaccaagatggtgtcggctgacgcttacaagatcacccccggcgctcgaggagccttctccgaggagtacaagcggctcgatgaggacctggctgcctactgccgccgccgggacatcagaattcttgtgcttgatgacaccaaccacgaacgggaacggctggagcagctctttgaaatggccgaccagtaccagtaccaggtggtgctggtggagcccaagacggcgtggcggctggactgtgcccagctcaaggagaagaaccagtggcagctgtcggctgatgacct

SEQ ID NO: 102539 - DNA, 1207 bp, Homo sapiens
  Payload ID: 11
  Gene Symbol: DECR1
  Gene Name: 2,4-dienoyl CoA reductase 1, mitochondrial
  Uniprot ID: Q16698
  ENST ID: ENST00000220764
  CDS Start-End: 89-1096
tccagccccgagaactttgttctttttgtcccgccccctgcgcccaaccgcctgcgccgccttccggcccgagttctggagactcaacatgaagctaccggccagggttttctttactctggggtcccggctgccctgtggcctcgctcctcggaggtttttcagttatgggacaaaaatattatatcaaaacactgaagctttgcaatctaaattcttttcacctcttcaaaaagcgatgctaccacctaatagttttcaaggaaaagtggcattcattactgggggaggtactggccttggtaaaggaatgacaactcttctgtccagcctaggtgctcagtgcgtgatagccagccggaagatggatgttttgaaagctaccgcagaacaaatttcttctcaaactggaaataaggttcatgcaattcagtgtgatgtgagggatcctgatatggttcaaaacactgtgtcagaactgatcaaagttgcaggacatcctaatattgtgataaacaatgcagcagggaattttatttctcctactgaaagactttctcctaatgcttggaaaaccataactgacatagttctaaatggcacagccttcgtgacactagaaattggaaaacaactaattaaagcacagaaaggagcagcatttctttctattactactatctatgctgagactggttcaggttttgtagtaccaagtgcttctgccaaagcaggtgtggaagccatgagcaagtctcttgcagctgaatggggtaaatatggaatgcgattcaatgtgattcaaccagggcctataaaaaccaaaggtgcctttagccgtctggacccaactggaacatttgagaaagaaatgattggcagaattccctgtggtcgcctggggactgtagaagaactcgcaaatcttgctgctttcctttgtagtgattatgcttcttggattaatggagcagtcattaaatttgacggtggagaggaagtacttatttcaggggaattcaacgacctgagaaaggtcaccaaggagcagtgggacaccatagaagaactcatcaggaagacaaaaggttcctaagaccactttggccttcatcttggttacagaaaagggaatagaaatgaaacaaattatctctcatcttttgactatttcaagtctaataaattcttaattaacaaacattca

SEQ ID NO: 102540 - DNA, 774 bp, Homo sapiens
  Payload ID: 11
  Gene Symbol: DECR1
  Gene Name: 2,4-dienoyl CoA reductase 1, mitochondrial
  ENST ID: ENST00000517761
  CDS Start-End: 159-774
tcaacatgaagctaccggccagggttttctttactctggggtcccggctgccctgtggcctcgctcctcggagggtgatgaacagcctccttctaaatcattgaccacatttcttattctttcctgaggataaatttcaagatatcctgaaccaactgatgacagcctatttagctacaggaatactctggaaggaaatgtttttcagttatgggacaaaaatattatatcaaaacactgaagctttgcaatctaaattcttttcacctcttcaaaaagcgatgctaccacctaatagttttcaaggaaaagtggcattcattactgggggaggtactggccttggtaaaggaatgacaactcttctgtccagcctaggtgctcagtgcgtgatagccagccggaagatggatgttttgaaagctaccgcagaacaaatttcttctcaaactggaaataaggttcatgcaattcagtgtgatgtgagggatcctgatatggttcaaaacactgtgtcagaactgatcaaagttgcaggacatcctaatattgtgataaacaatgcagcagggaattttatttctcctactgaaagactttctcctaatgcttggaaaaccataactgacatagttctaaatggcacagccttcgtgacactagaaattggaaaacaactaattaaagcacagaaaggagcagcatttctttctattactactatctatgctgagactggttcaggttttgtagtaccaagtgcttctgccaaag

SEQ ID NO: 102541 - DNA, 441 bp, Homo sapiens
  Payload ID: 11
  Gene Symbol: DECR1
  Gene Name: 2,4-dienoyl CoA reductase 1, mitochondrial
  ENST ID: ENST00000520148
  CDS Start-End: 1-131
ttgcagctgaatggggtaaatatggaatgcgattcaatgtgattcaaccagggcctataaaaaccaaagagtgtgtttggggcagggaggtctgttgtggaaccaatcctgacaatgctgaatgtcattaaatttgacggtggagaggaagtacttatttcaggggaattcaacgacctgagaaaggtcaccaaggagcagtgggacaccatagaagaactcatcaggaagacaaaaggttcctaagaccactttggccttcatcttggttacagaaaagggaatagaaatgaaacaaattatctctcatcttttgactatttcaagtctaataaattcttaattaacaaacattcattgaatatgtattatgtgccaggccagtgatagccattgtatattcaaagataaataaaatgaaatatagtccttcaaaacatt

SEQ ID NO: 102542 - DNA, 654 bp, Homo sapiens
  Payload ID: 11
  Gene Symbol: DECR1
  Gene Name: 2,4-dienoyl CoA reductase 1, mitochondrial
  ENST ID: ENST00000517314
  CDS Start-End: 48-194
gcccaaccgcctgcgccgccttccggcccgagttctggagactcaacatgaagctaccggccagggttttctttactctggggtcccggctgccctgtggcctcgctcctcggaggcgatgctaccacctaatagttttcaaggaaaagtggcattcattactgggggaggtactggccttggtaaaggaatgacaactcttctgtccagcctaggtgctcagtgcgtgatagccagccggaagatggatgttttgaaagctaccgcagaacaaatttcttctcaaactggaaataaggttcatgcaattcagtgtgatgtgagggatcctgatatggttcaaaacactgtgtcagaactgatcaaagttgcaggacatcctaatattgtgataaacaatgcagcagggaattttatttctcctactgaaagactttctcctaatgcttggaaaaccataactgacatagttctaaatggcacagccttcgtgacactagaaattggaaaacaactaattaaagcacagaaaggagcagcatttctttctattactactatctatgctgagactggttcaggttttgtagtaccaagtgcttctgccaaagcaggtgtggaagccatgagcaagtctcttgcagctgaatgggg

SEQ ID NO: 102543 - DNA, 578 bp, Homo sapiens
  Payload ID: 11
  Gene Symbol: DECR1
  Gene Name: 2,4-dienoyl CoA reductase 1, mitochondrial
  ENST ID: ENST00000521603
  CDS Start-End: 36-161
gcgccgccttccggcccgagttctggagactcaacatgaagctaccggccagggttttctttactctggggtcccggctgccctgtggcctcgctcctcggagggaagatggatgttttgaaagctaccgcagaacaaatttcttctcaaactggaaataaggttcatgcaattcagtgtgatgtgagggatcctgatatggttcaaaacactgtgtcagaactgatcaaagttgcaggacatcctaatattgtgataaacaatgcagcagggaattttatttctcctactgaaagactttctcctaatgcttggaaaaccataactgacatagttctaaatggcacagccttcgtgacactagaaattggaaaacaactaattaaagcacagaaaggagcagcatttctttctattactactatctatgctgagactggttcaggttttgtagtaccaagtgcttctgccaaagcaggtgtggaagccatgagcaagtaagtacttccttgtcaatcctgttgctgaacataactaatacagttggtggctcagggaactgtattcctgctttctgg

SEQ ID NO: 102544 - DNA, 864 bp, Homo sapiens
  Payload ID: 11
  Gene Symbol: DECR1
  Gene Name: 2,4-dienoyl CoA reductase 1, mitochondrial
  ENST ID: ENST00000520227
  CDS Start-End: 411-864
tttactctggggtcccggctgccctgtggcctcgctcctcggaggtctgaaaaatgagtaaagatggaagccaaagtatcacttttattgtggtttgtgagaggaagctgggcctatcagctggatctcccgaagtaggcggacttacataactctggaggagggcagaacattgtcctctgaaggcagctggctcccaaaaggaagaagaccaaggagaactgttcatacccaacgatcctgtcaaaatttaccagtcatatcaactgtctctgcacagacagattgtacctcagtctgtgttgctataaaggaatacctgaggctggtttttcagttatgggacaaaaatattatatcaaaacactgaagctttgcaatctaaattcttttcacctcttcaaaaagcgatgctaccacctaatagttttcaaggaaaagtggcattcattactgggggaggtactggccttggtaaaggaatgacaactcttctgtccagcctaggtgctcagtgcgtgatagccagccggaagatggatgttttgaaagctaccgcagaacaaatttcttctcaaactggaaataaggttcatgcaattcagtgtgatgtgagggatcctgatatggttcaaaacactgtgtcagaactgatcaaagttgcaggacatcctaatattgtgataaacaatgcagcagggaattttatttctcctactgaaagactttctcctaatgcttggaaaaccataactgacatagttctaaatggcacagccttcgtgacactagaaattggaaaacaactaattaaagcacagaaaggagcagcatttctttctattactactatctatgctgaga

SEQ ID NO: 102545 - DNA, 897 bp, Homo sapiens
  Payload ID: 11
  Gene Symbol: DECR1
  Gene Name: 2,4-dienoyl CoA reductase 1, mitochondrial
  ENST ID: ENST00000517597
  CDS Start-End: 18-143
agttctggagactcaacatgaagctaccggccagggttttctttactctggggtcccggctgccctgtggcctcgctcctcggagggaagatggatgttttgaaagctaccgcagaacaaatttcttctcaaactggaaataaggttcatgcaattcagtgtgatgtgagggatcctgatatggttcaaaacactgtgtcagaactgatcaaagttgcaggacatcctaatattgtgataaacaatgcagcagggaattttatttctcctactgaaagactttctcctaatgcttggaaaaccataactgacatagttctaaatggcacagccttcgtgacactagaaattggaaaacaactaattaaagcacagaaaggagcagcatttctttctattactactatctatgctgagactggttcaggttttgtagtaccaagtgcttctgccaaagcaggtgtggaagccatgagcaagtctcttgcagctgaatggggtaaatatggaatgcgattcaatgtgattcaaccagggcctataaaaaccaaaggtgcctttagccgtctggacccaactggaacatttgagaaagaaatgattggcagaattccctgtggtcgcctggggactgtagaagaactcgcaaatcttgctgctttcctttgtagtgattatgcttcttggattaatggagcagtcattaaatttgacggtggagaggaagtacttatttcaggggaattcaacgacctgagaaaggtcaccaaggagcagtgggacaccatagaagaactcatcaggaagacaaaaggttcctaagaccactttggccttcatcttggttacagaaaagggaatagaaatgaaacaaattatctctcatcttttgactat

SEQ ID NO: 102546 - DNA, 1766 bp, Homo sapiens
  Payload ID: 11
  Gene Symbol: DECR1
  Gene Name: 2,4-dienoyl CoA reductase 1, mitochondrial
  Uniprot ID: Q16698
  ENST ID: ENST00000522161
  CDS Start-End: 684-1664
gttctggagactcaacatgaagctaccggccagggttttctttactctggggtcccggctgccctgtggcctcgctcctcggaggtctgaaaaatgagtaaagatggaagccaaagtatcacttttattgtggtttgtgagaggaagctgggcctatcagctggatctcccgaagtaggcggacttacataactctggaggagggcagaacattgtcctctgaaggcagctggctcccaaaaggaagaagaccaaggagaactgttcatacccaacgatcctgtcaaaatttaccagtcatatcaactgtctctgcacagacagattgtacctcagtctgtgttgctataaaggaatacctgaggctgggtaatttataaagaaaagggtttgtttgactcatgattctgatgcctggacaagttcaagactgggcatctgcatctggtgacggcctaaggctgcttgcacttgtggcagaaggatgaagatggtactacgacattcatgatggatctgccaccataacccaggcacctcccattagaccccacctccaacattggggatcacatttcaacatgagttttcaagggacaaacatccaaacatccttagcaggttgactaaggggacagaaagaagcctggagttgtactacctgaacttctcacagtagggagatgtcaggactggggaagaagcatctcctgctcatgggggagtttttcagttatgggacaaaaatattatatcaaaacactgaagctttgcaatctaaattcttttcacctcttcaaaaagcgatgctaccacctaatagttttcaaggaaaagtggcattcattactgggggaggtactggccttggtaaaggaatgacaactcttctgtccagcctaggtgctcagtgcgtgatagccagccggaagatggatgttttgaaagctaccgcagaacaaatttcttctcaaactggaaataaggttcatgcaattcagtgtgatgtgagggatcctgatatggttcaaaacactgtgtcagaactgatcaaagttgcaggacatcctaatattgtgataaacaatgcagcagggaattttatttctcctactgaaagactttctcctaatgcttggaaaaccataactgacatagttctaaatggcacagccttcgtgacactagaaattggaaaacaactaattaaagcacagaaaggagcagcatttctttctattactactatctatgctgagactggttcaggttttgtagtaccaagtgcttctgccaaagcaggtgtggaagccatgagcaagtctcttgcagctgaatggggtaaatatggaatgcgattcaatgtgattcaaccagggcctataaaaaccaaaggtgcctttagccgtctggacccaactggaacatttgagaaagaaatgattggcagaattccctgtggtcgcctggggactgtagaagaactcgcaaatcttgctgctttcctttgtagtgattatgcttcttggattaatggagcagtcattaaatttgacggtggagaggaagtacttatttcaggggaattcaacgacctgagaaaggtcaccaaggagcagtgggacaccatagaagaactcatcaggaagacaaaaggttcctaagaccactttggccttcatcttggttacagaaaagggaatagaaatgaaacaaattatctctcatcttttgactatttcaagtctaataaattcttaattaac

SEQ ID NO: 102547 - DNA, 705 bp, Homo sapiens
  Payload ID: 11
  Gene Symbol: DECR1
  Gene Name: 2,4-dienoyl CoA reductase 1, mitochondrial
  ENST ID: ENST00000519410
  CDS Start-End: 162-705
agttctggagactcaacatgaagctaccggccagggttttctttactctggggtcccggctgccctgtggcctcgctcctcggagggcaccttactagggatatgaaggtgagaagaagagctgattcctgctgtcaagaagcatagagtccaatggcattatgtttttcagttatgggacaaaaatattatatcaaaacactgaagctttgcaatctaaattcttttcacctcttcaaaaagcgatgctaccacctaatagttttcaaggaaaagtggcattcattactgggggaggtactggccttggtaaaggaatgacaactcttctgtccagcctaggtgctcagtgcgtgatagccagccggaagatggatgttttgaaagctaccgcagaacaaatttcttctcaaactggaaataaggttcatgcaattcagtgtgatgtgagggatcctgatatggttcaaaacactgtgtcagaactgatcaaagttgcaggacatcctaatattgtgataaacaatgcagcagggaattttatttctcctactgaaagactttctcctaatgcttggaaaaccataactgacatagttctaaatggcacagccttcgtgacactagaaattggaaaacaactaattaaagcacagaaaggagcagcatttctttctattactactatctatgctgagactggtt

SEQ ID NO: 102548 - DNA, 527 bp, Homo sapiens
  Payload ID: 11
  Gene Symbol: DECR1
  Gene Name: 2,4-dienoyl CoA reductase 1, mitochondrial
  ENST ID: ENST00000518725
  CDS Start-End: 14-301
ctggagactcaacatgaagctaccggccagggttttctttactctggggtcccggctgccctgtggcctcgctcctcggaggtttttcagttatgggacaaaaatattatatcaaaacactgaagctttgcaatctaaattcttttcacctcttcaaaaagcgatgctaccacctaatagttttcaaggaaaagtggcattcattactgggggaggtactggccttggtaaaggaatgacaactcttctgtccagcctaggtgctcagtgcgtgatagccagccgaaatgcttttctttaagctatggattctctgtattcttcaatttatgaaattgaaaaatataatatgaagtcatacaaggtgtttatttctaggaagatggatgttttgaaagctaccgcagaacaaatttcttctcaaactggaaataaggttcatgcaattcagtgtgatgtgagggatcctgatatggttcaaaacactgtgtcagaactgatcaaagttgcaggacatcctaatattg

SEQ ID NO: 102549 - DNA, 816 bp, Homo sapiens
  Payload ID: 11
  Gene Symbol: DECR1
  Gene Name: 2,4-dienoyl CoA reductase 1, mitochondrial
  ENST ID: ENST00000519328
  CDS Start-End: 89-214
tccagccccgagaactttgttctttttgtcccgccccctgcgcccaaccgcctgcgccgccttccggcccgagttctggagactcaacatgaagctaccggccagggttttctttactctggggtcccggctgccctgtggcctcgctcctcggagggaagatggatgttttgaaagctaccgcagaacaaatttcttctcaaactggaaataaggttcatgcaattcagtgtgatgtgagggatcctgatatggttcaaaacactgtgtcagaactgatcaaagttgcaggacatcctaatattgtgataaacaatgcagcagggaattttatttctcctactgaaagactttctcctaatgcttggaaaaccataactgacatagttctaaatggcacagccttcgtgacactagaaattggaaaacaactaattaaagcacagaaaggtctcttgcagctgaatggggtaaatatggaatgcgattcaatgtgattcaaccagggcctataaaaaccaaaggtgcctttagccgtctggacccaactggaacatttgagaaagaaatgattggcagaattccctgtggtcgcctggggactgtagaagaactcgcaaatcttgctgctttcctttgtagtgattatgcttcttggattaatggagcagtcattaaatttgacggtggagaggaagtacttatttcaggggaattcaacgacctgagaaaggtcaccaaggagcagtgggacaccatagaagaactcatcaggaagacaaaaggttcctaagaccactttggccttcatcttgg

SEQ ID NO: 102550 - DNA, 1615 bp, Homo sapiens
  Payload ID: 12
  Gene Symbol: DECR2
  Gene Name: 2,4-dienoyl CoA reductase 2, peroxisomal
  Uniprot ID: Q9NUI1
  ENST ID: ENST00000219481
  CDS Start-End: 139-1017
aagcaatcagggcaggggcggggcgtccggggagtggggcggggctcccggttccaggcgagttcgcagctgcgcgccgggtcctggaggccgaggccgctcccgcccgttgtccccgcagtccccgacgggagcgccatggcccagccgccgcccgacgtggagggggacgactgtctccccgcgtaccgccacctcttctgcccggacctgctgcgggacaaagtggccttcatcacaggaggcggctctgggattgggttccggattgctgagattttcatgcggcacggctgccatacggtgattgccagtaggagcctgccgcgagtgctgacggccgccaggaagctggctggggccaccggccggcgctgcctccctctctctatggacgtccgagcgcccccagctgtcatggccgccgtggaccaggctctgaaggagtttggcagaatcgacattctcattaactgtgcggccgggaacttcctgtgccccgctggcgccttgtccttcaacgccttcaagaccgtgatggacatcgataccagcggcaccttcaatgtgtctcgtgtgctctatgagaagttcttccgggaccacggaggggtgatcgtgaacatcactgccaccctggggaaccgggggcaggcgctccaggtgcatgcaggctccgccaaggccgctgtggacgcgatgacgcggcacttggctgtggagtggggtccccaaaacatccgcgtcaacagcctcgcccctggccccatcagtggcacagaggggctccggcgactgggtggccctcaggccagcctgagcaccaaggtcactgccagcccgctgcagaggctggggaacaagaccgagatcgcccacagcgtgctctacctggccagccctctggcttcctacgtgacgggggccgtgctggtggccgatggcggggcatggttgacgttcccaaacggtgtcaaagggctgccggatttcgcatccttctctgctaagctctaggaatcttccggccgctgcttcctgccgcctcactcagccaggtggagagcaccaatctgaaccagcaatgcctgcagcccagcccctcctctgaacactcagctattactgcgctttccctccccacggccccaactccagggcaggagcaactggacagtgggcctggcccgtggagctgccacgcaggtgcctgagggccaggtgccacgcaggtgtctgaggaccaggtgccacgcaggtggtgggggtacagacaagatgctgggatgtcccctgccccatggtcaagggtgtcctgcctgcctgggtccagggcctgagggagccacatggatcccgagacttgtgttctcttggctgaaaacactgaggtgctcccatctgtgcgtggcccatgagctgggatggtcctccagctgcccacaaggtccgcccctctgtctctgcaccacctgtttgcataaacacactttgctacaatcttgctagtgcgttttcttaaaagataatctatttactgtaaaaataaattggactttgcaaaagcttttagaaggaaaagaaagaggattaaagagaattgctggtgatccta

SEQ ID NO: 102551 - DNA, 721 bp, Homo sapiens
  Payload ID: 12
  Gene Symbol: DECR2
  Gene Name: 2,4-dienoyl CoA reductase 2, peroxisomal
  ENST ID: ENST00000429116
  CDS Start-End: 1-283
cgccaggaagctggctggggccaccggccggcgctgcctccctctctctatggacgtccgagcgcccccagctgtcatggccgccgtggaccaggctctgaaggagtttggcagaatcgacattctcattaactgtgcggccgggaacttcctgtgccccgctggcgccttgtccttcaacgccttcaagaccgtgatggacatcgataccagcggcaccttcaatgtgtctcgtgtgctctatgagaagttcttccgggtgggtgcctcgtgcgctctgtgagaagttcttccgggaccacggaggggtgatcgtgaacatcactgccaccctggggaaccgggggcaggcgctccagacgcgatgacgcggcacttggctgtggagtggggtccccaaaacatccgcgtcaacagcctcgcccctggccccatcagtggcacagaggggctccggcgactgggtggccctcaggccagcctgagcaccaaggtcactgccagcccgctgcagaggctggggaacaagaccgagatcgcccacagcgtgctctacctggccagccctctggcttcctacgtgacgggggccgtgctggtggccgatggcggggcatggttgacgttcccaaacggtgtcaaagggctgccggatttcgcatccttctctgctaagctctaggaatcttccggccgctgcttcctgccgcctcactcagcc

SEQ ID NO: 102552 - DNA, 1078 bp, Homo sapiens
  Payload ID: 12
  Gene Symbol: DECR2
  Gene Name: 2,4-dienoyl CoA reductase 2, peroxisomal
  ENST ID: ENST00000445291
  CDS Start-End: 39-284
tcccgcccgttgtccccgcagtccccgacgggagcgccatggcccagccgccgcccgacgtggagggggacgactgtctccccgcgtaccgccacctcttctgcccggacctgctgcgggacaaagtggccttcatcacaggaggcggctctgggattgggttccggattgctgagattttcatgcggcacggctgccatacggtgattgccagtaggagcctgccgcgagtgctgacgagatgggttttcaccacgttgaccaggctggtctcgaattcctgacctcaggtgatccgcccacctcagcctcccaaagtgccaggattacaggtgtgaaccactgtgcccggccggcacctcagcctcccaaagtgccaggattacaggtgtgaatcactgtgcccggccggcacctcagcctcccaaagtgccaggattacaggtgtgaaccactgtgcccagccggcaccaaaacttgcacctatcctaaatatggagcttcagtgccgccaggaagctggctggggccaccggccggcgctgcctccctctctctatggacgtccgagcgcccccagctgtcatggccgccgtggaccaggctctgaaggagtttggcagaatcgacattctcattaactgtgcggccgggaacttcctgtgccccgctggcgccttgtccttcaacgccttcaagaccgtgatggacatcgataccagcggcaccttcaatgtgtctcgtgtgctctatgagaagttcttccgggaccacggaggggtgatcgtgaacatcactgccaccctggggaaccgggggcaggcgctccaggtgcatgcaggctccgccaaggccgctgtggacgcgatgacgcggcacttggctgtggagtggggtccccaaaacatccgcgtcaacagcctcgcccctggccccatcagtggcacagaggggctccggcgactgggtggccctcaggccagcctgagcaccaaggtcactgccagcccgctgcagaggctggggaacaagaccgagatcgcccacagcgtgctctacctggccagccctctggctt

SEQ ID NO: 102553 - DNA, 1618 bp, Homo sapiens
  Payload ID: 12
  Gene Symbol: DECR2
  Gene Name: 2,4-dienoyl CoA reductase 2, peroxisomal
  Uniprot ID: Q9NUI1
  ENST ID: ENST00000439661
  CDS Start-End: 72-707
agctgcgcgccgggtcctggaggccgaggccgctcccgcccgttgtccccgcagtccccgacgggagcgccatggcccagccgccgcccgacgtggagggggacgactgtctccccgcgtaccgccacctcttctgcccggacctgctgcgggacaaagtggccttcatcacaggaggcggctctgggattgggttccggattgctgagattttcatgcgggcatctgaggaccagatgggacattgcagctccagtgggacctgcctagcaggggtagctacctttatggttattgtgggcaagcaacccccgaaccagaagagccgagaaaccaaagaacaaggcagacagatcccgtttgtctgtgtcaggcacggctgccatacggtgattgccagtaggagcctgccgcgagtgctgacggccgccaggaagctggctggggccaccggccggcgctgcctccctctctctatggacgtccgagcgcccccagctgtcatggccgccgtggaccaggctctgaaggagtttggcagaatcgacattctcattaactgctccagcagctcctgcggtctcccattctgcaggtgcggccgggaacttcctgtgccccgctggcgccttgtccttcaacgccttcaagaccgtgatggacatcgataccagcggcaccttcaatgtgtctcgtgtgctctatgagaagttcttccgggaccacggaggggtgatcgtgaacatcactgccaccctggggaaccgggggcaggcgctccaggtgcatgcaggctccgccaaggccgctgtggacgcgatgacgcggcacttggctgtggagtggggtccccaaaacatccgcgtcaacagcctcgcccctggccccatcagtggcacagaggggctccggcgactgggtggccctcaggccagcctgagcaccaaggtcactgccagcccgctgcagaggctggggaacaagaccgagatcgcccacagcgtgctctacctggccagccctctggcttcctacgtgacgggggccgtgctggtggccgatggcggggcatggttgacgttcccaaacggtgtcaaagggctgccggatttcgcatccttctctgctaagctctaggaatcttccggccgctgcttcctgccgcctcactcagccaggtggagagcaccaatctgaaccagcaatgcctgcagcccagcccctcctctgaacactcagctattactgcgctttccctccccacggccccaactccagggcaggagcaactggacagtgggcctggcccgtggagctgccacgcaggtgcctgagggccaggtgccacgcaggtgtctgaggaccaggtgccacgcaggtggtgggggtacagacaagatgctgggatgtcccctgccccatggtcaagggtgtcctgcctgcctgggtccagggcctgagggagccacatggatcccgagacttgtgttctcttggctgaaaacactgaggtgctcccatctgtgcgtggcccatgagctgggatggtcctccagctgcccacaaggtccgcccctctgtctctgcaccacctgtttgcataaacacactttgctac

SEQ ID NO: 102554 - DNA, 1012 bp, Homo sapiens
  Payload ID: 12
  Gene Symbol: DECR2
  Gene Name: 2,4-dienoyl CoA reductase 2, peroxisomal
  ENST ID: ENST00000424398
  CDS Start-End: 83-925
ggcgagttcgcagctgcgcgccgggtcctggaggccgaggccgctcccgcccgttgtccccgcagtccccgacgggagcgccatggcccagccgccgcccgacgtggagggggacgactgtctccccgcgtaccgccacctcttctgcccggacctgctgcgggacaaagtggccttcatcacaggaggcggctctgggattgggttccggattgctgagattttcatgcggcacggctgccatacggccgccaggaagctggctggggccaccggccggcgctgcctccctctctctatggacgtccgagcgcccccagctgtcatggccgccgtggaccaggctctgaaggagtttggcagaatcgacattctcattaactgtgcggccgggaacttcctgtgccccgctggcgccttgtccttcaacgccttcaagaccgtgatggacatcgataccagcggcaccttcaatgtgtctcgtgtgctctatgagaagttcttccgggaccacggaggggtgatcgtgaacatcactgccaccctggggaaccgggggcaggcgctccaggtgcatgcaggctccgccaaggccgctgtggacgcgatgacgcggcacttggctgtggagtggggtccccaaaacatccgcgtcaacagcctcgcccctggccccatcagtggcacagaggggctccggcgactgggtggccctcaggccagcctgagcaccaaggtcactgccagcccgctgcagaggctggggaacaagaccgagatcgcccacagcgtgctctacctggccagccctctggcttcctacgtgacgggggccgtgctggtggccgatggcggggcatggttgacgttcccaaacggtgtcaaagggctgccggatttcgcatccttctctgctaagctctaggaatcttccggccgctgcttcctgccgcctcactcagccaggtggagagcaccaatctgaaccagcaatgcctgcagcccagcccct

SEQ ID NO: 102555 - DNA, 1738 bp, Homo sapiens
  Payload ID: 12
  Gene Symbol: DECR2
  Gene Name: 2,4-dienoyl CoA reductase 2, peroxisomal
  ENST ID: ENST00000437024
  CDS Start-End: 50-295
gccgaggccgctcccgcccgttgtccccgcagtccccgacgggagcgccatggcccagccgccgcccgacgtggagggggacgactgtctccccgcgtaccgccacctcttctgcccggacctgctgcgggacaaagtggccttcatcacaggaggcggctctgggattgggttccggattgctgagattttcatgcggcacggctgccatacggtgattgccagtaggagcctgccgcgagtgctgacgagatgggttttcaccacgttgaccaggctggtctcgaattcctgacctcaggtgatccgcccacctcagcctcccaaagtgccaggattacaggtgtgaaccactgtgcccggccggcacctcagcctcccaaagtgccaggattacaggtgtgaaccactgtgcccagccggcaccaaaacttgcacctatcctaaatatggagcttcagtgccgccaggaagctggctggggccaccggccggcgctgcctccctctctctatggacgtccgagcgcccccagctgtcatggccgccgtggaccaggctctgaaggagtttggcagaatcgacattctcattaactgtgcggccgggaacttcctgtgccccgctggcgccttgtccttcaacgccttcaagaccgtgatggacatcgataccagcggcaccttcaatgtgtctcgtgtgctctatgagaagttcttccgggaccacggaggggtgatcgtgaacatcactgccaccctggggaaccgggggcaggcgctccaggtgcatgcaggctccgccaaggccgctgtggacgcgatgacgcggcacttggctgtggagtggggtccccaaaacatccgcgtcaacagcctcgcccctggccccatcagtggcacagaggggctccggcgactgggtggccctcaggccagcctgagcaccaaggtcactgccagcccgctgcagaggctggggaacaagaccgagatcgcccacagcgtgctctacctggccagccctctggcttcctacgtgacgggggccgtgctggtggccgatggcggggcatggttgacgttcccaaacggtgtcaaagggctgccggatttcgcatccttctctgctaagctctaggaatcttccggccgctgcttcctgccgcctcactcagccaggtggagagcaccaatctgaaccagcaatgcctgcagcccagcccctcctctgaacactcagctattactgcgctttccctccccacggccccaactccagggcaggagcaactggacagtgggcctggcccgtggagctgccacgcaggtgcctgagggccaggtgccacgcaggtgtctgaggaccaggtgccacgcaggtggtgggggtacagacaagatgctgggatgtcccctgccccatggtcaagggtgtcctgcctgcctgggtccagggcctgagggagccacatggatcccgagacttgtgttctcttggctgaaaacactgaggtgctcccatctgtgcgtggcccatgagctgggatggtcctccagctgcccacaaggtccgcccctctgtctctgcaccacctgtttgcataaacacactttgctacaatcttgctagtgcgttttcttaaaagataatctatttactgtaaaaataaattggactttgcaaaagcttttagaaggaaaagaaagaggattaaagagaattgctggtgatccta

SEQ ID NO: 102556 - DNA, 1615 bp, Homo sapiens; identical to SEQ ID NO: 102550
  Payload ID: 12
  Gene Symbol: DECR2
  Gene Name: 2,4-dienoyl CoA reductase 2, peroxisomal
  Uniprot ID: Q9NUI1
  ENST ID: ENST00000613476
  CDS Start-End: 139-1017

SEQ ID NO: 102557 - DNA, 352 bp, Homo sapiens
  Payload ID: 12
  Gene Symbol: DECR2
  Gene Name: 2,4-dienoyl CoA reductase 2, peroxisomal
  ENST ID: ENST00000627716
  CDS Start-End: 107-352
agtggggcggggctcccggttccaggcgagttcgcagctgcgcgccgggtcctggaggccgaggccgctcccgcccgttgtccccgcagtccccgacgggagcgccatggcccagccgccgcccgacgtggagggggacgactgtctccccgcgtaccgccacctcttctgcccggacctgctgcgggacaaagtggccttcatcacaggaggcggctctgggattgggttccggattgctgagattttcatgcggcacggctgccatacggtgattgccagtaggagcctgccgcgagtgctgacgagatgggttttcaccacgttgaccaggctggtctcgaattcctga

SEQ ID NO: 102558 - DNA, 352 bp, Homo sapiens; identical to SEQ ID NO: 102557
  Payload ID: 12
  Gene Symbol: DECR2
  Gene Name: 2,4-dienoyl CoA reductase 2, peroxisomal
  ENST ID: ENST00000630165
  CDS Start-End: 107-352

SEQ ID NO: 102559 - DNA, 1012 bp, Homo sapiens; identical to SEQ ID NO: 102554
  Payload ID: 12
  Gene Symbol: DECR2
  Gene Name: 2,4-dienoyl CoA reductase 2, peroxisomal
  ENST ID: ENST00000633596
  CDS Start-End: 83-925

SEQ ID NO: 102560 - DNA, 509 bp, Homo sapiens
  Payload ID: 12
  Gene Symbol: DECR2
  Gene Name: 2,4-dienoyl CoA reductase 2, peroxisomal
  ENST ID: ENST00000633923
  CDS Start-End: 82-509
gcgagttcgcagctgcgcgccgggtcctggaggccgaggccgctcccgcccgttgtccccgcagtccccgacgggagcgccatggcccagccgccgcccgacgtggagggggacgactgtctccccgcgtaccgccacctcttctgcccggacctgctgcgggacaaagtggccttcatcacaggaggcggctctgggattgggttccggattgctgagattttcatgcggatccaggtgcctgccagagggactggggagcggtcgaggattgccctggggggagtcaggacttcaaggcccctacaggccgccaggaagctggctggggccaccggccggcgctgcctccctctctctatggacgtccgagcgcccccagctgtcatggccgccgtggaccaggctctgaaggagtttggcagaatcgacattctcattaactgtgcggccgggaacttcctgtgccccgctggcgccttgtccttcaacgccttcaagaccgtgat

SEQ ID NO: 102561 - DNA, 1078 bp, Homo sapiens; identical to SEQ ID NO: 102552
  Payload ID: 12
  Gene Symbol: DECR2
  Gene Name: 2,4-dienoyl CoA reductase 2, peroxisomal
  ENST ID: ENST00000632042
  CDS Start-End: 39-284

SEQ ID NO: 102562 - DNA, 561 bp, Homo sapiens
  Payload ID: 12
  Gene Symbol: DECR2
  Gene Name: 2,4-dienoyl CoA reductase 2, peroxisomal
  ENST ID: ENST00000633624
  CDS Start-End: 4-249
gccatggcccagccgccgcccgacgtggagggggacgactgtctccccgcgtaccgccacctcttctgcccggacctgctgcgggacaaagtggccttcatcacaggaggcggctctgggattgggttccggattgctgagattttcatgcggcacggctgccatacggtgattgccagtaggagcctgccgcgagtgctgacgagatgggttttcaccacgttgaccaggctggtctcgaattcctgacctcaggtgatccgcccacctcagcctcccaaagtgccaggattacaggtgtgaaccactgtgcccggccggcacctcagcctcccaaagtgccaggattacaggtgtgaatcactgtgcccggccggcacctcagcctcccaaagtgccaggattacaggccgaggctgcagggctgctgtctgcctctttacctggcttctaggccgccaggaagctggctggggccaccggccggcgctgcctccctctctctatggacgtccgagcgcccccagctgtcatggccgccgtggaccaggctctgaagga

SEQ ID NO: 102563 - DNA, 762 bp, Homo sapiens
  Payload ID: 12
  Gene Symbol: DECR2
  Gene Name: 2,4-dienoyl CoA reductase 2, peroxisomal
  ENST ID: ENST00000633559
  CDS Start-End: 48-762
cgaggccgctcccgcccgttgtccccgcagtccccgacgggagcgccatggcccagccgccgcccgacgtggagggggacgactgtctccccgcgtaccgccacctcttctgcccggacctgctgcgggacaaagtggccttcatcacaggaggcggctctgggattgggttccggattgctgagattttcatgcggcacggctgccatacggtgattgccagtaggagcctgccgcgagtgctgacggccgccaggaagctggctggggccaccggccggcgctgcctccctctctctatggacgtccgagcgcccccagctgtcatggccgccgtggaccaggctctgaaggagtttggcagaatcgacattctcattaactgtgagtcggtgctgagtgaggctccagcagctcctgcggtctcccattctgcaggtgcggccgggaacttcctgtgccccgctggcgccttgtccttcaacgccttcaagaccgtgatggacatcgataccagcggcaccttcaatgtgtctcgtgtgctctatgagaagttcttccgggaccacggaggggtgatcgtgaacatcactgccaccctggggaaccgggggcaggcgctccaggtgcatgcaggctccgccaaggccgctgtggacgcgatgacgcggcacttggctgtggagtggggtccccaaaacatccgcgtcaacagcctcgcccctggccccatcagtggcacagaggggctccggcgactgg

SEQ ID NO: 102564 - DNA, 561 bp, Homo sapiens; identical to SEQ ID NO: 102562
  Payload ID: 12
  Gene Symbol: DECR2
  Gene Name: 2,4-dienoyl CoA reductase 2, peroxisomal
  ENST ID: ENST00000633025
  CDS Start-End: 4-249

SEQ ID NO: 102565 - DNA, 762 bp, Homo sapiens; identical to SEQ ID NO: 102563
  Payload ID: 12
  Gene Symbol: DECR2
  Gene Name: 2,4-dienoyl CoA reductase 2, peroxisomal
  ENST ID: ENST00000633348
  CDS Start-End: 48-762

SEQ ID NO: 102566 - DNA, 558 bp, Homo sapiens
  Payload ID: 12
  Gene Symbol: DECR2
  Gene Name: 2,4-dienoyl CoA reductase 2, peroxisomal
  ENST ID: ENST00000633148
  CDS Start-End: 80-328
gagttcgcagctgcgcgccgggtcctggaggccgaggccgctcccgcccgttgtccccgcagtccccgacgggagcgccatggcccagccgccgcccgacgtggagggggacgactgtctccccgcgtaccgccacctcttctgcccggacctgctgcgggacaaagtggccttcatcacaggaggcggctctgggattgggttccggattgctgagattttcatgcggcacggctgccatacggtgattgccagtaggagcctgccgcgagtgctgacggtgatccgcccacctcagcctcccaaagtgccaggattacaggtgtgaaccactgtgcccggccggcacctcagcctcccaaagtgccaggattacaggtgtgaaccactgtgcccagccggcaccaaaacttgcacctatcctaaatatggagcttcagtgtaagtggcctcccagagacatctttgactttttaaaaaatctagttattgggttctgggagggaccttcctgtttgggggtaatgtggccccaagaaagacctctgggctcacctg

SEQ ID NO: 102567 - DNA, 1738 bp, Homo sapiens; identical to SEQ ID NO: 102555
  Payload ID: 12
  Gene Symbol: DECR2
  Gene Name: 2,4-dienoyl CoA reductase 2, peroxisomal
  ENST ID: ENST00000633143
  CDS Start-End: 50-295

SEQ ID NO: 102568 - DNA, 509 bp, Homo sapiens; identical to SEQ ID NO: 102560
  Payload ID: 12
  Gene Symbol: DECR2
  Gene Name: 2,4-dienoyl CoA reductase 2, peroxisomal
  ENST ID: ENST00000631983
  CDS Start-End: 82-509

SEQ ID NO: 102569 - DNA, 1618 bp, Homo sapiens; identical to SEQ ID NO: 102553
  Payload ID: 12
  Gene Symbol: DECR2
  Gene Name: 2,4-dienoyl CoA reductase 2, peroxisomal
  Uniprot ID: Q9NUI1
  ENST ID: ENST00000631856
  CDS Start-End: 72-707

SEQ ID NO: 102570 - DNA, 721 bp, Homo sapiens; identical to SEQ ID NO: 102551
  Payload ID: 12
  Gene Symbol: DECR2
  Gene Name: 2,4-dienoyl CoA reductase 2, peroxisomal
  ENST ID: ENST00000632810
  CDS Start-End: 1-283

SEQ ID NO: 102571 - DNA, 558 bp, Homo sapiens; identical to SEQ ID NO: 102566
  Payload ID: 12
  Gene Symbol: DECR2
  Gene Name: 2,4-dienoyl CoA reductase 2, peroxisomal
  ENST ID: ENST00000631605
  CDS Start-End: 80-328

SEQ ID NO: 102572 - DNA, 4250 bp, Homo sapiens
  Payload ID: 13
  Gene Symbol: DHCR24
  Gene Name: 24-dehydrocholesterol reductase
  Uniprot ID: Q15392
  ENST ID: ENST00000371269
  CDS Start-End: 100-1650
cccgggctgtgggctacaggcgcagagcgggccaggcgcggagctggcggcagtgacaggaggcgcgaacccgcagcgcttaccgcgcggcgccgcaccatggagcccgccgtgtcgctggccgtgtgcgcgctgctcttcctgctgtgggtgcgcctgaaggggctggagttcgtgctcatccaccagcgctgggtgttcgtgtgcctcttcctcctgccgctctcgcttatcttcgatatctactactacgtgcgcgcctgggtggtgttcaagctcagcagcgctccgcgcctgcacgagcagcgcgtgcgggacatccagaagcaggtgcgggaatggaaggagcagggtagcaagaccttcatgtgcacggggcgccctggctggctcactgtctcactacgtgtcgggaagtacaagaagacacacaaaaacatcatgatcaacctgatggacattctggaagtggacaccaagaaacagattgtccgtgtggagcccttggtgaccatgggccaggtgactgccctgctgacctccattggctggactctccccgtgttgcctgagcttgatgacctcacagtggggggcttgatcatgggcacaggcatcgagtcatcatcccacaagtacggcctgttccaacacatctgcactgcttacgagctggtcctggctgatggcagctttgtgcgatgcactccgtccgaaaactcagacctgttctatgccgtaccctggtcctgtgggacgctgggtttcctggtggccgctgagatccgcatcatccctgccaagaagtacgtcaagctgcgtttcgagccagtgcggggcctggaggctatctgtgccaagttcacccacgagtcccagcggcaggagaaccacttcgtggaagggctgctctactccctggatgaggctgtcattatgacaggggtcatgacagatgaggcagagcccagcaagctgaatagcattggcaattactacaagccgtggttctttaagcatgtggagaactatctgaagacaaaccgagagggcctggagtacattcccttgagacactactaccaccgccacacgcgcagcatcttctgggagctccaggacattatcccctttggcaacaaccccatcttccgctacctctttggctggatggtgcctcccaagatctccctcctgaagctgacccagggtgagaccctgcgcaagctgtacgagcagcaccacgtggtgcaggacatgctggtgcccatgaagtgcctgcagcaggccctgcacaccttccaaaacgacatccacgtctaccccatctggctgtgtccgttcatcctgcccagccagccaggcctagtgcaccccaaaggaaatgaggcagagctctacatcgacattggagcatatggggagccgcgtgtgaaacactttgaagccaggtcctgcatgaggcagctggagaagtttgtccgcagcgtgcatggcttccagatgctgtatgccgactgctacatgaaccgggaggagttctgggagatgtttgatggctccttgtaccacaagctgcgagagaagctgggttgccaggacgccttccccgaggtgtacgacaagatctgcaaggccgccaggcactgagctggagcccgcctggagagacagacacgtgtgagtggtcaggcatcttcccttcactcaagcttggctgctttcctagatccacactttcaaagagaaacccctccagaactcccaccctgacagcccaacaccaccttcctcctggcttccagggggcagcccagtggaatggaaagaatgtgggatttggagtcagacaagcctgagtccagttccccgtttagaactcattagctgtgtgactctgggtgagtcccttaacccctctgagcccgggtctcttcattagttgaaagggatagtaatacctacttgcaggttgttgtcatctgagttgagcactggtcacattgaaggtgctgggtaagtggtagctcttgttgcttcccgttcagcgtcacatctgcagtggagcctgaaaaggctccacattaggtcacctgtgcacagccatggctggaatgatgaaggggatacgctggagttgccctgccatcgcctccatcagccagacgaggtcctcacaggagaaggacagctcttccccaccctgggatctcaggagggcagccacggagtggggaggccccagatgcgctgtgccaaagccaggtccgaggccaaagttctccctgccatccttggtgccgtcctgccccttcctccttcatgcctgggcctgcaggcccaccccagccaccactgagtccactcggagtgccctgtgttcctggagaaggcattccagggttgaatcttgtcccagcctcagcctgggacacctaggtggagagagtggtctccgctctgaattggatccaggggacctgggctcattcttcttggctcaccaaccctgcaggcctcatctttcccaaaacccactttgtcttggtgggagtgggtccgcgctgctctgcagcaggggctggggagtggacagcatcaggtgggaaagtggagtccaccctcatgtttctgtaggattctcaccgtggggctggaagaaaagagcatcgacttgatttctccaaccactcatccctctttttctttcttccaccactccccaccccagctgtagttaatttcagtgccttacaaatcctaagctcagagaaagttccatttccgttccagagggaagggaacctccctaggtccttccctggcttgttataacgcaaagcttggttgtttatgcaactctatcttaagaactgcccagcctcagctgaaaacccgaatctgagaaggaattgcgtcatgtaagggaagctggaattaagggagctgagccagtcatggttgtggcgtgtgagtcaggagacctaggtttcagcccctctctactgtcagcgagctgtgcaacgtgggcaagtcattgtcctctgagctgcagtttcctcatctgtcacatcgctacagacaagacctccctggaacccttctgattgtcttagacactgtggttgcaaaacccacggaaagcctcatttgtgtggaaagtcagaggaaaaatgatccagtggacacttggggattatctgtcattcaagatccttccttcaaccccaaggtcagctcccatctcatttccagaaaggctcatacctggcttgcagggaagcatctgtcttgtcattccaggtgccagaatcctctcagagtcattgaagggtgttcacccatcccacccaaggcttggcacactgccagtgtcttagcagggtcttgtgagggctgggggcatccaggcactcagaaggcaaaggaaccaccctacccatttggcctctggagggggcagaagaaagaaataaacctcatcctatattttacaaagcatgtgaattctggcattagctctcataggagacccatgtgcttccttgctcagtgcaaaactgatgattctacttgctgtagatgaatggttaacacgagctagttaaacagtgccattgttttgccagtgaagcctccaaccctaagccactgggacggtggccagagatgccagcagcctctgtcgcccttagtcatataaccaaaatccagaccttatccacaacccggggcttggaaaggaaggtattttggaatcacaccctccggttatgttgctccagtaaaatcttgcctggaaagaggcagtcttcttagcatggtgagctgagttcatggcttttttttgtagccagtcctgtccctggccatccatgtgatggttttggatggagttaaacttgatgccagtgggcagtgcatgtggaaagtatcagagtaaggctctcccctccagagccctgagtttcttggctgcatgaaggttttctttagaatcagaattgtagccagtttctttggccagaaggatgaatacttggatattactgaaagggaggggtggagatgggtgtggcagtgtatggtgtgtgatttttattttcttctttggtcatgggggccaaggagaaaggcatgaatcttccctgtcaggctcttacagccacaggcactgtgtctactgtctggaagacatgtccccatggctgtggggccgctgcttctgtttaaataaaagtggcctggaa

SEQ ID NO: 102573 - DNA, 863 bp, Homo sapiens
  Payload ID: 13
  Gene Symbol: DHCR24
  Gene Name: 24-dehydrocholesterol reductase
  ENST ID: ENST00000436604
  CDS Start-End: 1-463
ctccctcctgaagctgacccagggtgagaccctgcgcaagctgtacgagcagcaccacgtggtgcaggacatgctggtgcccatgaagtgcctgcagcaggccctgcacaccttccaaaacgacatccacgtctaccccatctggctgtgtccgttcatcctgcccagccagccaggcctagtgcaccccaaaggaaatgaggcagagctctacatcgacattggagcatatggggagccgcgtgtgaaacactttgaagccaggtcctgcatgaggcagctggagaagtttgtccgcagcgtgcatggcttccagatgctgtatgccgactgctacatgaaccgggaggagttctgggagatgtttgatggctccttgtaccacaagctgcgagagaagctgggttgccaggacgccttccccgaggtgtacgacaagatctgcaaggccgccaggcactgagctggagcccgcctggagagacagacacgtgattctcaccgtggggctggaagaaaagagcatcgacttgatttctccaaccactcatccctctttttctttcttccaccactccccaccccagctgtagttaatttcagtgccttacaaatcctaagctcagagaaagttccatttccgttccagagggaagggaacctccctaggtccttccctggcttgttataacgcaaagcttggttgtttatgcaactctatcttaagaactgcccagcctcagctgaaaacccgaatctgagaaggaattgcgtcatgtaagggaagctggaattaagggagctgagccagtcatggttgtggcgtgtgagtcaggagacctaggtttcagcccctctctact

SEQ ID NO: 102574 - DNA, 4153 bp, Homo sapiens
  Payload ID: 13
  Gene Symbol: DHCR24
  Gene Name: 24-dehydrocholesterol reductase
  ENST ID: ENST00000535035
  CDS Start-End: 272-1555
gctggcggcagtgacaggaggcgcgaacccgcagcgcttaccgcgcggcgccgcaccatggagcccgccgtgtcgctggccgtgtgcgcgctgctcttcctgctgtgggtgcgcctgaaggggctggagttcgcttatcttcgatatctactactacgtgcgcgcctgggtggtgttcaagctcagcagcgctccgcgcctgcacgagcagcgcgtgcgggacatccagaagcaggtgcgggaatggaaggagcagggtagcaagaccttcatgtgcacggggcgccctggctggctcactgtctcactacgtgtcgggaagtacaagaagacacacaaaaacatcatgatcaacctgatggacattctggaagtggacaccaagaaacagattgtccgtgtggagcccttggtgaccatgggccaggtgactgccctgctgacctccattggctggactctccccgtgttgcctgagcttgatgacctcacagtggggggcttgatcatgggcacaggcatcgagtcatcatcccacaagtacggcctgttccaacacatctgcactgcttacgagctggtcctggctgatggcagctttgtgcgatgcactccgtccgaaaactcagacctgttctatgccgtaccctggtcctgtgggacgctgggtttcctggtggccgctgagatccgcatcatccctgccaagaagtacgtcaagctgcgtttcgagccagtgcggggcctggaggctatctgtgccaagttcacccacgagtcccagcggcaggagaaccacttcgtggaagggctgctctactccctggatgaggctgtcattatgacaggggtcatgacagatgaggcagagcccagcaagctgaatagcattggcaattactacaagccgtggttctttaagcatgtggagaactatctgaagacaaaccgagagggcctggagtacattcccttgagacactactaccaccgccacacgcgcagcatcttctgggagctccaggacattatcccctttggcaacaaccccatcttccgctacctctttggctggatggtgcctcccaagatctccctcctgaagctgacccagggtgagaccctgcgcaagctgtacgagcagcaccacgtggtgcaggacatgctggtgcccatgaagtgcctgcagcaggccctgcacaccttccaaaacgacatccacgtctaccccatctggctgtgtccgttcatcctgcccagccagccaggcctagtgcaccccaaaggaaatgaggcagagctctacatcgacattggagcatatggggagccgcgtgtgaaacactttgaagccaggtcctgcatgaggcagctggagaagtttgtccgcagcgtgcatggcttccagatgctgtatgccgactgctacatgaaccgggaggagttctgggagatgtttgatggctccttgtaccacaagctgcgagagaagctgggttgccaggacgccttccccgaggtgtacgacaagatctgcaaggccgccaggcactgagctggagcccgcctggagagacagacacgtgtgagtggtcaggcatcttcccttcactcaagcttggctgctttcctagatccacactttcaaagagaaacccctccagaactcccaccctgacagcccaacaccaccttcctcctggcttccagggggcagcccagtggaatggaaagaatgtgggatttggagtcagacaagcctgagtccagttccccgtttagaactcattagctgtgtgactctgggtgagtcccttaacccctctgagcccgggtctcttcattagttgaaagggatagtaatacctacttgcaggttgttgtcatctgagttgagcactggtcacattgaaggtgctgggtaagtggtagctcttgttgcttcccgttcagcgtcacatctgcagtggagcctgaaaaggctccacattaggtcacctgtgcacagccatggctggaatgatgaaggggatacgctggagttgccctgccatcgcctccatcagccagacgaggtcctcacaggagaaggacagctcttccccaccctgggatctcaggagggcagccacggagtggggaggccccagatgcgctgtgccaaagccaggtccgaggccaaagttctccctgccatccttggtgccgtcctgccccttcctccttcatgcctgggcctgcaggcccaccccagccaccactgagtccactcggagtgccctgtgttcctggagaaggcattccagggttgaatcttgtcccagcctcagcctgggacacctaggtggagagagtggtctccgctctgaattggatccaggggacctgggctcattcttcttggctcaccaaccctgcaggcctcatctttcccaaaacccactttgtcttggtgggagtgggtccgcgctgctctgcagcaggggctggggagtggacagcatcaggtgggaaagtggagtccaccctcatgtttctgtaggattctcaccgtggggctggaagaaaagagcatcgacttgatttctccaaccactcatccctctttttctttcttccaccactccccaccccagctgtagttaatttcagtgccttacaaatcctaagctcagagaaagttccatttccgttccagagggaagggaacctccctaggtccttccctggcttgttataacgcaaagcttggttgtttatgcaactctatcttaagaactgcccagcctcagctgaaaacccgaatctgagaaggaattgcgtcatgtaagggaagctggaattaagggagctgagccagtcatggttgtggcgtgtgagtcaggagacctaggtttcagcccctctctactgtcagcgagctgtgcaacgtgggcaagtcattgtcctctgagctgcagtttcctcatctgtcacatcgctacagacaagacctccctggaacccttctgattgtcttagacactgtggttgcaaaacccacggaaagcctcatttgtgtggaaagtcagaggaaaaatgatccagtggacacttggggattatctgtcattcaagatccttccttcaaccccaaggtcagctcccatctcatttccagaaaggctcatacctggcttgcagggaagcatctgtcttgtcattccaggtgccagaatcctctcagagtcattgaagggtgttcacccatcccacccaaggcttggcacactgccagtgtcttagcagggtcttgtgagggctgggggcatccaggcactcagaaggcaaaggaaccaccctacccatttggcctctggagggggcagaagaaagaaataaacctcatcctatattttacaaagcatgtgaattctggcattagctctcataggagacccatgtgcttccttgctcagtgcaaaactgatgattctacttgctgtagatgaatggttaacacgagctagttaaacagtgccattgttttgccagtgaagcctccaaccctaagccactgggacggtggccagagatgccagcagcctctgtcgcccttagtcatataaccaaaatccagaccttatccacaacccggggcttggaaaggaaggtattttggaatcacaccctccggttatgttgctccagtaaaatcttgcctggaaagaggcagtcttcttagcatggtgagctgagttcatggcttttttttgtagccagtcctgtccctggccatccatgtgatggttttggatggagttaaacttgatgccagtgggcagtgcatgtggaaagtatcagagtaaggctctcccctccagagccctgagtttcttggctgcatgaaggttttctttagaatcagaattgtagccagtttctttggccagaaggatgaatacttggatattactgaaagggaggggtggagatgggtgtggcagtgtatggtgtgtgatttttattttcttctttggtcatgggggccaaggagaaaggcatgaatcttccctgtcaggctcttacagccacaggcactgtgtctactgtctggaagacatgtccccatggctgtggggccgctgcttctgtttaaataaaagtggcctgg

SEQ ID NO: 102575 - DNA, 1816 bp, Homo sapiens
  Payload ID: 14
  Gene Symbol: OAS1
  Gene Name: 2'-5'-oligoadenylate synthetase 1, 40/46kDa
  Uniprot ID: P00973
  ENST ID: ENST00000202917
  CDS Start-End: 264-1466
gcatttccagagcagagttcagagaaaggctgggctgcttgttgctggctaaaggacaaagggtaagtttcaggaagcagaagagtgagcagatgaaattcagcactgggatcaggggagtgtctgatttgcaaaaggaaagtgcaaagacagctcctcccttctgaggaaacgaaaccaacagcagtccaagctcagtcagcagaagagataaaagcaaacaggtctgggaggcagttctgttgccactctctctcctgtcaatgatggatctcagaaataccccagccaaatctctggacaagttcattgaagactatctcttgccagacacgtgtttccgcatgcaaatcaaccatgccattgacatcatctgtgggttcctgaaggaaaggtgcttccgaggtagctcctaccctgtgtgtgtgtccaaggtggtaaagggtggctcctcaggcaagggcaccaccctcagaggccgatctgacgctgacctggttgtcttcctcagtcctctcaccacttttcaggatcagttaaatcgccggggagagttcatccaggaaattaggagacagctggaagcctgtcaaagagagagagcattttccgtgaagtttgaggtccaggctccacgctggggcaacccccgtgcgctcagcttcgtactgagttcgctccagctcggggagggggtggagttcgatgtgctgcctgcctttgatgccctgggtcagttgactggcggctataaacctaacccccaaatctatgtcaagctcatcgaggagtgcaccgacctgcagaaagagggcgagttctccacctgcttcacagaactacagagagacttcctgaagcagcgccccaccaagctcaagagcctcatccgcctagtcaagcactggtaccaaaattgtaagaagaagcttgggaagctgccacctcagtatgccctggagctcctgacggtctatgcttgggagcgagggagcatgaaaacacatttcaacacagcccagggatttcggacggtcttggaattagtcataaactaccagcaactctgcatctactggacaaagtattatgactttaaaaaccccattattgaaaagtacctgagaaggcagctcacgaaacccaggcctgtgatcctggacccggcggaccctacaggaaacttgggtggtggagacccaaagggttggaggcagctggcacaagaggctgaggcctggctgaattacccatgctttaagaattgggatgggtccccagtgagctcctggattctgctggctgaaagcaacagtgcagacgatgagaccgacgatcccaggaggtatcagaaatatggttacattggaacacatgagtaccctcatttctctcatagacccagcacactccaggcagcatccaccccacaggcagaagaggactggacctgcaccatcctctgaatgccagtgcatcttgggggaaagggctccagtgttatctggaccagttccttcattttcaggtgggactcttgatccagagaggacaaagctcctcagtgagctggtgtataatccaggacagaacccaggtctcctgactcctggccttctatgccctctatcctatcatagataacattctccacagcctcacttcattccacctattctctgaaaatattccctgagagagaacagagagatttagataagagaatgaaattccagccttgactttcttctgtgcacctgatgggagggtaatgtctaatgtattatcaataacaataaaaataaagcaaatacca

SEQ ID NO: 102576 - DNA, 1684 bp, Homo sapiens
  Payload ID: 14
  Gene Symbol: OAS1
  Gene Name: 2'-5'-oligoadenylate synthetase 1, 40/46kDa
  Uniprot ID: P00973
  ENST ID: ENST00000445409
  CDS Start-End: 258-1502
ccagagcagagttcagagaaaggctgggctgcttgttgctggctaaaggacaaagggtaagtttcaggaagcagaagagtgagcagatgaaattcagcactgggatcaggggagtgtctgatttgcaaaaggaaagtgcaaagacagctcctcccttctgaggaaacgaaaccaacagcagtccaagctcagtcagcagaagagataaaagcaaacaggtctgggaggcagttctgttgccactctctctcctgtcaatgatggatctcagaaataccccagccaaatctctggacaagttcattgaagactatctcttgccagacacgtgtttccgcatgcaaatcaaccatgccattgacatcatctgtgggttcctgaaggaaaggtgcttccgaggtagctcctaccctgtgtgtgtgtccaaggtggtaaagggtggctcctcaggcaagggcaccaccctcagaggccgatctgacgctgacctggttgtcttcctcagtcctctcaccacttttcaggatcagttaaatcgccggggagagttcatccaggaaattaggagacagctggaagcctgtcaaagagagagagcattttccgtgaagtttgaggtccaggctccacgctggggcaacccccgtgcgctcagcttcgtactgagttcgctccagctcggggagggggtggagttcgatgtgctgcctgcctttgatgccctgggtcagttgactggcggctataaacctaacccccaaatctatgtcaagctcatcgaggagtgcaccgacctgcagaaagagggcgagttctccacctgcttcacagaactacagagagacttcctgaagcagcgccccaccaagctcaagagcctcatccgcctagtcaagcactggtaccaaaattgtaagaagaagcttgggaagctgccacctcagtatgccctggagctcctgacggtctatgcttgggagcgagggagcatgaaaacacatttcaacacagcccagggatttcggacggtcttggaattagtcataaactaccagcaactctgcatctactggacaaagtattatgactttaaaaaccccattattgaaaagtacctgagaaggcagctcacgaaacccaggcctgtgatcctggacccggcggaccctacaggaaacttgggtggtggagacccaaagggttggaggcagctggcacaagaggctgaggcctggctgaattacccatgctttaagaattgggatgggtccccagtgagctcctggattctgctgacccagcacactccaggcagcatccaccccacaggcagaagaggactggacctgcaccatcctctgaatgccagtgcatcttgggggaaagggctccagtgttatctggaccagttccttcattttcaggtgggactcttgatccagagaggacaaagctcctcagtgagctggtgtataatccaggacagaacccaggtctcctgactcctggccttctatgccctctatcctatcatagataacattctccacagcctcacttcattccacctattctctgaaaatattccctgagagagaacagagagatttagataagagaatgaaattccagccttgactttcttctgtgcacctgatgggagggtaatgtctaatgtattatc

SEQ ID NO: 102577 - DNA, 1990 bp, Homo sapiens
  Payload ID: 14
  Gene Symbol: OAS1
  Gene Name: 2'-5'-oligoadenylate synthetase 1, 40/46kDa
  Uniprot ID: P00973
  ENST ID: ENST00000452357
  CDS Start-End: 191-1285
gaagcagaagagtgagcagatgaaattcagcactgggatcaggggagtgtctgatttgcaaaaggaaagtgcaaagacagctcctcccttctgaggaaacgaaaccaacagcagtccaagctcagtcagcagaagagataaaagcaaacaggtctgggaggcagttctgttgccactctctctcctgtcaatgatggatctcagaaataccccagccaaatctctggacaagttcattgaagactatctcttgccagacacgtgtttccgcatgcaaatcaaccatgccattgacatcatctgtgggttcctgaaggaaaggtgcttccgaggtagctcctaccctgtgtgtgtgtccaaggtggtaaagggtggctcctcaggcaagggcaccaccctcagaggccgatctgacgctgacctggttgtcttcctcagtcctctcaccacttttcaggatcagttaaatcgccggggagagttcatccaggaaattaggagacagctggaagcctgtcaaagagagagagcattttccgtgaagtttgaggtccaggctccacgctggggcaacccccgtgcgctcagcttcgtactgagttcgctccagctcggggagggggtggagttcgatgtgctgcctgcctttgatgccctgggtcagttgactggcggctataaacctaacccccaaatctatgtcaagctcatcgaggagtgcaccgacctgcagaaagagggcgagttctccacctgcttcacagaactacagagagacttcctgaagcagcgccccaccaagctcaagagcctcatccgcctagtcaagcactggtaccaaaattgtaagaagaagcttgggaagctgccacctcagtatgccctggagctcctgacggtctatgcttgggagcgagggagcatgaaaacacatttcaacacagcccagggatttcggacggtcttggaattagtcataaactaccagcaactctgcatctactggacaaagtattatgactttaaaaaccccattattgaaaagtacctgagaaggcagctcacgaaacccaggcctgtgatcctggacccggcggaccctacaggaaacttgggtggtggagacccaaagggttggaggcagctggcacaagaggctgaggcctggctgaattacccatgctttaagaattgggatgggtccccagtgagctcctggattctgctggtgagacctcctgcttcctccctgccattcatccctgcccctctccatgaagcttgagacatatagctggagaccattctttccaaagaacttacctcttgccaaaggccatttatattcatatagtgacaggctgtgctccatattttacagtcattttggtcacaatcgagggtttctggaattttcacatcccttgtccagaattcattcccctaagagtaataataaataatctctaacaccatttattgactgtctgcttcgggctcaggttctgtcctaagccctttaatatgcactctctcattaaatagtcacaacaatcccatgaggcatttttaaaaattttttattattttagattcagagggcacatgtgccatttgttacacagctatattgtgtaatggtggggtttgggcctctattgatcctgtcgcccaaatagtgaacagagtacccaaaaagaattttttcaacctttgcctttctcccttcctcctccctgttggagtccctagtgtctattgttcccatctttagcagatgttaagtatttgattttctgtttctgggttaattcacttcggataatggcctccagctgcaaccatgatttcattctttcttatggctgcataatactccatggtgtagatataccacactttctttatccagttcacactgatgggcacttaagttgattccatgactttgctattgtgaatcgtactgcgataaacatacgagtgccgg

SEQ ID NO: 102578 - DNA, 664 bp, Homo sapiens
  Payload ID: 14
  Gene Symbol: OAS1
  Gene Name: 2'-5'-oligoadenylate synthetase 1, 40/46kDa
  ENST ID: ENST00000553185
  CDS Start-End: 3-536
caatgatggatctcagaaataccccagccaaatctctggacaagttcattgaagactatctcttgccagacacgtgtttccgcatgcaaatcaaccatgccattgacatcatctgtgggttcctgaaggaaaggtgcttccgaggtagctcctaccctgtgtgtgtgtccaaggtggtaaagggtggctcctcaggcaagggcaccaccctcagaggccgatctgacgctgacctggttgtcttcctcagtcctctcaccacttttcaggatcagttaaatcgccggggagagttcatccaggaaattaggagacagctggaagcctgtcaaagagagagagcattttccgtgaagtttgaggtccaggctccacgctggggcaacccccgtgcgctcagcttcgtactgagttcgctccagctcggggagggggtggagttcgatgtgctgcctgcctttgatgccctgggtgagagctcccagcttctttttctccctcttcccatttctgagcagaaatctcccacagtttgagagctttttgccccaacagggcatctctctaaagcagggtgggaggagatcttaggatctgtcccggggcaagaatgaatacggtcatgatctatcacaggagagacattaaacagcaaattggcata

SEQ ID NO: 102579 - DNA, 950 bp, Homo sapiens
  Payload ID: 14
  Gene Symbol: OAS1
  Gene Name: 2'-5'-oligoadenylate synthetase 1, 40/46kDa
  ENST ID: ENST00000550689
  CDS Start-End: 1-909
agaaataccccagccaaatctctggacaagttcattgaagactatctcttgccagacacgtgtttccgcatgcaaatcaaccatgccattgacatcatctgtgggttcctgaaggaaaggtgcttccgaggtagctcctaccctgtgtgtgtgtccaaggtggtaaagggtggctcctcaggcaagggcaccaccctcagaggccgatctgacgctgacctggttgtcttcctcagtcctctcaccacttttcaggatcagttaaatcgccggggagagttcatccaggaaattaggagacagctggaagcctgtcaaagagagagagcattttccgtgaagtttgaggtccaggctccacgctggggcaacccccgtgcgctcagcttcgtactgagttcgctccagctcggggagggggtggagttcgatgtgctgcctgcctttgatgccctgggtcagttgactggcggctataaacctaacccccaaatctatgtcaagctcatcgaggagtgcaccgacctgcagaaagagggcgagttctccacctgcttcacagaactacagagagacttcctgaagcagcgccccaccaagctcaagagcctcatccgcctagtcaagcactggtaccaaaattgtaagaagaagcttgggaagctgccacctcagtatgccctggagctcctgacggtctatgcttgggagcgagggagcatgaaaacacatttcaacacagcccagggatttcggacggtcttggaattagtcataaactaccagcaactctgcatctactggacaaagtattatgactttaaaaaccccattattgaaaagtacctgagaaggcagctcacgaaacccaggtatgctatccccacatggcttagctcccctatgtaaatgaacacctggatacaggtacagtgccttggaaatggagg

SEQ ID NO: 102580 - DNA, 2416 bp, Homo sapiens
  Payload ID: 14
  Gene Symbol: OAS1
  Gene Name: 2'-5'-oligoadenylate synthetase 1, 40/46kDa
  ENST ID: ENST00000551241
  CDS Start-End: 34-1116
gaggcagttctgttgccactctctctcctgtcaatgatggatctcagaaataccccagccaaatctctggacaagttcattgaagactatctcttgccagacacgtgtttccgcatgcaaatcaaccatgccattgacatcatctgtgggttcctgaaggaaaggtgcttccgaggtagctcctaccctgtgtgtgtgtccaaggtggtaaagggtggctcctcaggcaagggcaccaccctcagaggccgatctgacgctgacctggttgtcttcctcagtcctctcaccacttttcaggatcagttaaatcgccggggagagttcatccaggaaattaggagacagctggaagcctgtcaaagagagagagcattttccgtgaagtttgaggtccaggctccacgctggggcaacccccgtgcgctcagcttcgtactgagttcgctccagctcggggagggggtggagttcgatgtgctgcctgcctttgatgccctgggtcagttgactggcggctataaacctaacccccaaatctatgtcaagctcatcgaggagtgcaccgacctgcagaaagagggcgagttctccacctgcttcacagaactacagagagacttcctgaagcagcgccccaccaagctcaagagcctcatccgcctagtcaagcactggtaccaaaattgtaagaagaagcttgggaagctgccacctcagtatgccctggagctcctgacggtctatgcttgggagcgagggagcatgaaaacacatttcaacacagcccagggatttcggacggtcttggaattagtcataaactaccagcaactctgcatctactggacaaagtattatgactttaaaaaccccattattgaaaagtacctgagaaggcagctcacgaaacccaggcctgtgatcctggacccggcggaccctacaggaaacttgggtggtggagacccaaagggttggaggcagctggcacaagaggctgaggcctggctgaattacccatgctttaagaattgggatgggtccccagtgagctcctggattctgctggtaaacctcacactggttggcagaaggaactataccaataattagtgaacatgcggtgaatttgcaacagacaagaggagcctcattatcctatagtttccaggttgcttagggaggcagaaatcacagcaaggaaaaccttcaataataaacagacgtctcataaaattaattgcaacccaacctctctctctacttaaaattagcatctatttccagctctgctttcaatgccccatatgaatacatgtgaactccctccctctcttcctccctgtctccttctctctctctctgtccctcattaaaaaataaaatttaagaaaaaaatacaaggtagatttacacaaatagtgggatctcagtcttgagttagctgtgtatgactgaaaaggatgctgtggttaataattatcataaaaacaatgacatggccgggcacagtggctcacgcctgtaatcccagaactttgggaggccgaggcaggcagatcacttgaggccaggagtttgagaccagcctggccaacatggtgaaactgcatctctactaaaaatacaaaaattagccgggcatcaatggccagcccctgtaatcccagctaatcaggagtctgaggcaggcgaatcacttgaacctgggggctggtggttgcagtgagccgagctcacaccactgcactccagcctgggcgacagagtgagactacatctcaaaaaaacaaaaacaaacaagcaaaaaaaaccccacagtaacacaaaagtaataaaactgctgctatttactcagtgcttatctgatgccagccactttgctaagcctatgaatgcattatttccccgttgctacagatgagagaattgaggttcagacaggttgaaatcattgctcccaaagtcacacaactggtgagtggcagagctgggatgcaaaccctaaactgccagccctcaaagcctgtgctcttaatctccaccctgctgtgcttccttgtccatttaattaagctccacaggcacacattccacgccctcctttgctgtacaatcccaggcaagtcgctcagcttctctgagcctcagtttcataatctgtcaaatggaggtaacacaaataattcctagttgtgaccaagaatcatcatagaaatctgccatttccagcctattgtgcaattcctcaagcactgtgactccaagtggcatcagctcctggaagaacacactgtcttactgttgtttcctcctttgtcaactgatccccccttgaacctcactctacctctgctctcaatgccccatctactgccacctgattaaataaaatcttttttgaaaatcataa

SEQ ID NO: 102581 - DNA, 890 bp, Homo sapiens
  Payload ID: 14
  Gene Symbol: OAS1
  Gene Name: 2'-5'-oligoadenylate synthetase 1, 40/46kDa
  ENST ID: ENST00000553152
  CDS Start-End: 1-393
tttcggacggtcttggaattagtcataaactaccagcaactctgcatctactggacaaagtattatgactttaaaaaccccattattgaaaagtacctgagaaggcagctcacgaaacccaggcctgtgatcctggacccggcggaccctacaggaaacttgggtggtggagacccaaagggttggaggcagctggcacaagaggctgaggcctggctgaattacccatgctttaagaattgggatgggtccccagtgagctcctggattctgctgatgagacaaaggctcagagaggtgaggtcacttgctcaaggacatcagctaacaagtggtggaaatggaattcaagctcagtggactctaaagccagtgctcatgtcactgtgctaaacagcctgccttgtcacatccccacctctcatctgaccaatgggagactctgagcagctgagtgacttgggttgtcacacagctaaacaggggcaaaggacccagtcttggatctttccacctccaagcaggaatctgtctgattccaggggattgatgatgttgcagatggctaggaagcagactccaggatggaatttagtatgcaggatgttctgggggagagccactggaaccagcactcagggaaaggggggaagaaaggataggaaggaagcatgaaagagaatagggagaagtgaacagggatgcagagcgaatgccagtttcagccaactccaaggacagccctggagctggaatggcctttagagctgccccatggtgacagaggtggccaggcttctatacccctacgtggatcactcactgtgcttgggcaccttgggaaagggcatggctttgagcaaaaggctctctgcagctgaggcaacccc

SEQ ID NO: 102582 - DNA, 324 bp, Homo sapiens
  Payload ID: 14
  Gene Symbol: OAS1
  Gene Name: 2'-5'-oligoadenylate synthetase 1, 40/46kDa
  ENST ID: ENST00000550883
  CDS Start-End: 75-324
caagctcagtcagcagaagagataaaagcaaacaggtctgggaggcagttctgttgccactctctctcctgtcaatgatggatctcagaaataccccagccaaatctctggacaagttcattgaagactatctcttgccagacacgtgtttccgcatgcaaatcaaccatgccattgacatcatctgtgggttcctgaaggaaaggtgcttccgaggtagctcctaccctgtgtgtgtgtccaaggtggtaaagtgtaagaagaagcttgggaagctgccacctcagtatgccctggagctcctgacggtctatgcttgggagc

SEQ ID NO: 102583 - DNA, 395 bp, Homo sapiens
  Payload ID: 14
  Gene Symbol: OAS1
  Gene Name: 2'-5'-oligoadenylate synthetase 1, 40/46kDa
  ENST ID: ENST00000540589
  CDS Start-End: 1-68
gacccagcacactccaggcagcatccaccccacaggcagaagaggactggacctgcaccatcctctgaatgccagtgcatcttgggggaaagggctccagtgttatctggaccagttccttcattttcaggtaaacctcacactggttggcagaaggaactataccaataattagtgaacatgcggtgaatttgcaacagacaagaggagcctcattatcctatagtttccaggttgcttagggaggcagaaatcacagcaaggaaaaccttcaataataaacagacgtctcataaaattaattgcaacccaacctctctctctacttaaaattagcatctatttccagctctgctttcaatgccccatatgaatacatgtgaactccctccctc

SEQ ID NO: 102584 - DNA, 309 bp, Homo sapiens
  Payload ID: 14
  Gene Symbol: OAS1
  Gene Name: 2'-5'-oligoadenylate synthetase 1, 40/46kDa
  ENST ID: ENST00000552526
  CDS Start-End: 1-48
gctgaaagcaacagtgcagacgatgagaccgacgatcccaggaggtaaacctcacactggttggcagaaggaactataccaataattagtgaacatgcggtgaatttgcaacagacaagaggagcctcattatcctatagtttccaggttgcttagggaggcagaaatcacagcaaggaaaaccttcaataataaacagacgtctcataaaattaattgcaacccaacctctctctctacttaaaattagcatctatttccagctctgctttcaatgccccatatgaatacatgtgaactccctccctc

SEQ ID NO: 102585 - DNA, 3613 bp, Homo sapiens
  Payload ID: 15
  Gene Symbol: OAS2
  Gene Name: 2'-5'-oligoadenylate synthetase 2, 69/71kDa
  Uniprot ID: P29728
  ENST ID: ENST00000342315
  CDS Start-End: 215-2374
agttggtaaactcactgcaaggggcagggcagagcctctgagcttaagttagttttgtttccctgtcccggatacaagagttggtaagctcgctgcagtgggtggagagaggcctctagacttcagtttcagtttcctggctctgggcagcagcaagaattcctctgcctcccatcctaccattcactgtcttgccggcagccagctgagagcaatgggaaatggggagtcccagctgtcctcggtgcctgctcagaagctgggttggtttatccaggaatacctgaagccctacgaagaatgtcagacactgatcgacgagatggtgaacaccatctgtgacgtcctgcaggaacccgaacagttccccctggtgcagggagtggccataggtggctcctatggacggaaaacagtcttaagaggcaactccgatggtacccttgtcctcttcttcagtgacttaaaacaattccaggatcagaagagaagccaacgtgacatcctcgataaaactggggataagctgaagttctgtctgttcacgaagtggttgaaaaacaatttcgagatccagaagtcccttgatgggttcaccatccaggtgttcacaaaaaatcagagaatctctttcgaggtgctggccgccttcaacgctctgagcttaaatgataatcccagcccctggatctatcgagagctcaaaagatccttggataagacaaatgccagtcctggtgagtttgcagtctgcttcactgaactccagcagaagttttttgacaaccgtcctggaaaactaaaggatttgatcctcttgataaagcactggcatcaacagtgccagaaaaaaatcaaggatttaccctcgctgtctccgtatgccctggagctgcttacggtgtatgcctgggaacaggggtgcagaaaagacaactttgacattgctgaaggcgtcagaaccgtactggagctgatcaaatgccaggagaagctgtgtatctattggatggtcaactacaactttgaagatgagaccatcaggaacatcctgctgcaccagctccaatcagcgaggccagtaatcttggatccagttgacccaaccaataatgtgagtggagataaaatatgctggcaatggctgaaaaaagaagctcaaacctggttgacttctcccaacctggataatgagttacctgcaccatcttggaatgttctgcctgcaccactcttcacgaccccaggccaccttctggataagttcatcaaggagtttctccagcccaacaaatgcttcctagagcagattgacagtgctgttaacatcatccgtacattccttaaagaaaactgcttccgacaatcaacagccaagatccagattgtccggggaggatcaaccgccaaaggcacagctctgaagactggctctgatgccgatctcgtcgtgttccataactcacttaaaagctacacctcccaaaaaaacgagcggcacaaaatcgtcaaggaaatccatgaacagctgaaagccttttggagggagaaggaggaggagcttgaagtcagctttgagcctcccaagtggaaggctcccagggtgctgagcttctctctgaaatccaaagtcctcaacgaaagtgtcagctttgatgtgcttcctgcctttaatgcactgggtcagctgagttctggctccacacccagccccgaggtttatgcagggctcattgatctgtataaatcctcggacctcccgggaggagagttttctacctgtttcacagtcctgcagcgaaacttcattcgctcccggcccaccaaactaaaggatttaattcgcctggtgaagcactggtacaaagagtgtgaaaggaaactgaagccaaaggggtctttgcccccaaagtatgccttggagctgctcaccatctatgcctgggagcaggggagtggagtgccggattttgacactgcagaaggtttccggacagtcctggagctggtcacacaatatcagcagctctgcatcttctggaaggtcaattacaactttgaagatgagaccgtgaggaagtttctactgagccagttgcagaaaaccaggcctgtgatcttggacccagccgaacccacaggtgacgtgggtggaggggaccgttggtgttggcatcttctggcaaaagaagcaaaggaatggttatcctctccctgcttcaaggatgggactggaaacccaataccaccttggaaagtgccgacaatgcagacaccaggaagttgtggagctaggatccatcctattgtcaatgagatgttctcatccagaagccatagaatcctgaataataattctaaaagaaacttctagagatcatctggcaatcgcttttaaagactcggctcaccgtgagaaagagtcactcacatccattcttcccttgatggtccctattcctccttcccttgcttcttggacttcttgaaatcaatcaagactgcaaaccctttcataaagtcttgccttgctgaactccctctctgcaggcagcctgcctttaaaaatagttgctgtcatccactttatgtgcatcttatttctgtcaacttgtattttttttcttgtatttttccaattagctcctcctttttccttccagtctaaaaaaggaatcctctgtgtcttcaaagcaaagctctttactttccccttggttctcataactctgtgatcttgctctcggtgcttccaactcatccacgtcctgtctgtttcctctgtatacaaaaccctttctgcccctgctgacacagacatcctctatgccagcagccagccaaccctttcattagaacttcaagctctccaaaggctcagattataactgttgtcatatttatatgaggctgttgtcttttccttctgagcctgcctttctcccccccacccaggagtatcctcttgccaaatcaaaagactttttccttgggctttagccttaaagatacttgaaggtctaggtgctttaacctcacataccctcacttaaacttttatcactgttgcatataccagttgtgatacaataaagaatgtatctggattttgtgcctagttcctagcacacagcttcaaaaattctagagtttcctgataggagtgtcttttgtattcataacaagcccttttcacccatgcctgggtttatgctaacaaggttacccatggtgggcccttagtttcaaggaaggagttggccaagccagaaagaccaagcatgtggttaaagcattggaattttcagccccatcccacccccaatctccaaggaggtgatggggctggaaattgagttcaattttaacatggccagtgatttaagcaatgctgcctatgtaaagaaaccccaataaaaactctggacagtgaggcttggggagcttcctgattggcagacattccaatgtactaggaaggtagcgcatcttgattccacagggacaaaggctcctgagctctgggcccttccagtgcttgccaccctacatactctttgtctggctcttcatttgtattctttataataaaatggtgattgtaagtagagca

SEQ ID NO: 102586 - DNA, 4734 bp, Homo sapiens
  Payload ID: 15
  Gene Symbol: OAS2
  Gene Name: 2'-5'-oligoadenylate synthetase 2, 69/71kDa
  Uniprot ID: P29728
  ENST ID: ENST00000392583
  CDS Start-End: 208-2271
aaactcactgcaaggggcagggcagagcctctgagcttaagttagttttgtttccctgtcccggatacaagagttggtaagctcgctgcagtgggtggagagaggcctctagacttcagtttcagtttcctggctctgggcagcagcaagaattcctctgcctcccatcctaccattcactgtcttgccggcagccagctgagagcaatgggaaatggggagtcccagctgtcctcggtgcctgctcagaagctgggttggtttatccaggaatacctgaagccctacgaagaatgtcagacactgatcgacgagatggtgaacaccatctgtgacgtcctgcaggaacccgaacagttccccctggtgcagggagtggccataggtggctcctatggacggaaaacagtcttaagaggcaactccgatggtacccttgtcctcttcttcagtgacttaaaacaattccaggatcagaagagaagccaacgtgacatcctcgataaaactggggataagctgaagttctgtctgttcacgaagtggttgaaaaacaatttcgagatccagaagtcccttgatgggttcaccatccaggtgttcacaaaaaatcagagaatctctttcgaggtgctggccgccttcaacgctctgagcttaaatgataatcccagcccctggatctatcgagagctcaaaagatccttggataagacaaatgccagtcctggtgagtttgcagtctgcttcactgaactccagcagaagttttttgacaaccgtcctggaaaactaaaggatttgatcctcttgataaagcactggcatcaacagtgccagaaaaaaatcaaggatttaccctcgctgtctccgtatgccctggagctgcttacggtgtatgcctgggaacaggggtgcagaaaagacaactttgacattgctgaaggcgtcagaaccgtactggagctgatcaaatgccaggagaagctgtgtatctattggatggtcaactacaactttgaagatgagaccatcaggaacatcctgctgcaccagctccaatcagcgaggccagtaatcttggatccagttgacccaaccaataatgtgagtggagataaaatatgctggcaatggctgaaaaaagaagctcaaacctggttgacttctcccaacctggataatgagttacctgcaccatcttggaatgttctgcctgcaccactcttcacgaccccaggccaccttctggataagttcatcaaggagtttctccagcccaacaaatgcttcctagagcagattgacagtgctgttaacatcatccgtacattccttaaagaaaactgcttccgacaatcaacagccaagatccagattgtccggggaggatcaaccgccaaaggcacagctctgaagactggctctgatgccgatctcgtcgtgttccataactcacttaaaagctacacctcccaaaaaaacgagcggcacaaaatcgtcaaggaaatccatgaacagctgaaagccttttggagggagaaggaggaggagcttgaagtcagctttgagcctcccaagtggaaggctcccagggtgctgagcttctctctgaaatccaaagtcctcaacgaaagtgtcagctttgatgtgcttcctgcctttaatgcactgggtcagctgagttctggctccacacccagccccgaggtttatgcagggctcattgatctgtataaatcctcggacctcccgggaggagagttttctacctgtttcacagtcctgcagcgaaacttcattcgctcccggcccaccaaactaaaggatttaattcgcctggtgaagcactggtacaaagagtgtgaaaggaaactgaagccaaaggggtctttgcccccaaagtatgccttggagctgctcaccatctatgcctgggagcaggggagtggagtgccggattttgacactgcagaaggtttccggacagtcctggagctggtcacacaatatcagcagctctgcatcttctggaaggtcaattacaactttgaagatgagaccgtgaggaagtttctactgagccagttgcagaaaaccaggcctgtgatcttggacccagccgaacccacaggtgacgtgggtggaggggaccgttggtgttggcatcttctggcaaaagaagcaaaggaatggttatcctctccctgcttcaaggatgggactggaaacccaataccaccttggaaagtgccggtaaaagtcatctaaaggaggcgttgtctggaaatagccctgtaacaggcttgaatcaaagaacttctcctactgtagcaacctgaaattaactcagacacaaataaaggaaacccagctcacaggagcttaaacagctggtcagccccctaagcccccactacaagtgatcctcaggcaggtaaccccagattcatgcactgtagggtgctgcgcagcatccctagtctctacccagtagatgccactagccctcctctcccagtgacaaccaaaagtcttcagacattgtcaaacgttcccctgggttcacagatctttctgcctttggcttttggctccaccctctttagctgttaatttgagtacttatggccctgaaagcggccacggtgcctccagatggcaggtttgcaatccaagcaggaagaaggaaaagatacccaaaggtcaagaacacagtgattttattagaagtttcatccgcaaattttcttccatttcattgctcagaaatgtcatgtggctacctgtaacttgaaggtggctacaaagatgactgtggacgtgggttgcactggccacccaaggatgtctgccacacctctccaaagccctccctacctaccaagatatacctgatatattccaccaggatatcctccctccagatatacttggttctctccaccaggttctttctttaaagcaggatttctcaactttgatacttactcacatttggggctagacagttctttgtttggaggctctcttgtgcattgtaggatgttgagcagcatctctggcctgtacccagtagatgccacccagttgtgacaattaaaagtgtcttgagactttatcatgtgtcttctgccctaggtgagaacccttgcactagaggaaccctacaccccaaccctggggggaatgtagggaagaggtggccaagccaaccgtggggttagctctaattattaagatatgcattataaataaataccaaaaaattgtctctggcaatagttaccttcccagatacaggtccccccttttttcccctaactcttttaagcaatgattgtaactattaggagacattgctctcccacgtatgtttttctttttagacaatgcagacaccaggaagttgtggagctaggatccatcctattgtcaatgagatgttctcatccagaagccatagaatcctgaataataattctaaaagaaacttctagagatcatctggcaatcgcttttaaagactcggctcaccgtgagaaagagtcactcacatccattcttcccttgatggtccctattcctccttcccttgcttcttggacttcttgaaatcaatcaagactgcaaaccctttcataaagtcttgccttgctgaactccctctctgcaggcagcctgcctttaaaaatagttgctgtcatccactttatgtgcatcttatttctgtcaacttgtattttttttcttgtatttttccaattagctcctcctttttccttccagtctaaaaaaggaatcctctgtgtcttcaaagcaaagctctttactttccccttggttctcataactctgtgatcttgctctcggtgcttccaactcatccacgtcctgtctgtttcctctgtatacaaaaccctttctgcccctgctgacacagacatcctctatgccagcagccagccaaccctttcattagaacttcaagctctccaaaggctcagattataactgttgtcatatttatatgaggctgttgtcttttccttctgagcctgcctttctcccccccacccaggagtatcctcttgccaaatcaaaagactttttccttgggctttagccttaaagatacttgaaggtctaggtgctttaacctcacataccctcacttaaacttttatcactgttgcatataccagttgtgatacaataaagaatgtatctggattttgtgcctagttcctagcacacagcttcaaaaattctagagtttcctgataggagtgtcttttgtattcataacaagcccttttcacccatgcctgggtttatgctaacaaggttacccatggtgggcccttagtttcaaggaaggagttggccaagccagaaagaccaagcatgtggttaaagcattggaattttcagccccatcccacccccaatctccaaggaggtgatggggctggaaattgagttcaattttaacatggccagtgatttaagcaatgctgcctatgtaaagaaaccccaataaaaactctggacagtgaggcttggggagcttcctgattggcagacattccaatgtactaggaaggtagcgcatcttgattccacagggacaaaggctcctgagctctgggcccttccagtgcttgccaccctacatactctttgtctggctcttcatttgtattctttataataaaatggtgattgtaagta

SEQ ID NO: 102587 - DNA, 2072 bp, Homo sapiens
  Payload ID: 15
  Gene Symbol: OAS2
  Gene Name: 2'-5'-oligoadenylate synthetase 2, 69/71kDa
  Uniprot ID: P29728
  ENST ID: ENST00000449768
  CDS Start-End: 128-646
gctcgctgcagtgggtggagagaggcctctagacttcagtttcagtttcctggctctgggcagcagcaagaattcctctgcctcccatcctaccattcactgtcttgccggcagccagctgagagcaatgggaaatggggagtcccagctgtcctcggtgcctgctcagaagctgggttggtttatccaggaatacctgaagccctacgaagaatgtcagacactgatcgacgagatggtgaacaccatctgtgacgtcctgcaggaacccgaacagttccccctggtgcagggagtggccataggtggctcctatggacggaaaacagtcttaagaggcaactccgatggtacccttgtcctcttcttcagtgacttaaaacaattccaggatcagaagagaagccaacgtgacatcctcgataaaactggggataagctgaagttctgtctgttcacgaagtggttgaaaaacaatttcgagatccagaagtcccttgatgggttcaccatccaggtgttcacaaaaaatcagagaatctctttcgaggtgctggccgccttcaacgctctgagtaagcattgctgggtgtcaggagagaaaagccaaagaagcgggtgccagacagctctgtgcaacctctaggccatgagtgggatagataccactgctgctttaaaaaatgggagaccatagaccctcaggagagaagaatcccttctaccctggactcgctctcttctctggaactaacttctcccccataccctgattgtctttggagaaaatgttctggattctagaatctaaggcagagccttttaagccatactgtacacataaatcacctggaaccttgttaaaatgcagatcctgactcaggaggtctgagttagagcccaggatttcatatttctagccagctccatgatgagctgctggtccgcagatcatgcttgcaggttttgaccagagtcagtgttggttagagtaagaggatgaggcagacatctgggaaaagtccagctggggcaagcatttgaagtctgccttcctaccaggtcaaaatcaaggcaacgaccttccatagataactatcaaagcttgagggggtgccttgaacccaactcctaaatccctaagacctgcccacctcttgtgtctcctgtctcagcaaacattcccacactcttgcatattgttaaagtaacctctgcttaccaggcttctggtttaataaaagatggctagagtgactccatcttaaagcaagtagctaggcactcaaaaggaacctacaggcttaatacttgggtctgaaaatagccacagtctaagctgaccaccaattataattgcagaatatttaaggccatacaaaacatctcccactaagcctacaaaatgtccaggtgtcctaaaagttcagcccacttaaaggcagcattaatgagcaggtttaggttgaaggattaatggtcatcaataccactgttaagaagaaaattcttggccaaattgaatttaatggagtttaactgagcagacaattcacaaatctagaagcctcctgagccagagtaggttcagagagtcttgaacacagccacgtggtggaagaagatttatggacaggaaaaggaaaatgatgtactgaaaatgaaagtgaggtacagaaacagccagactggttatagctcagcattggccttatttgaacgagatttgaacagttggccacctttgattggccgaaactcagtgattggcacaagagtaggttgcagtctgtttacacatccttttaggttatagttcaccatgtacagagaaattttaggccaaacttaaaatatgtaaggaggcagctttaggctaaacttgatttaacagcaccaataccccctacctttagtgagcacatctgcacattccaattttaatgacagctccttagaatttcttatcaacgaagacactaacaaagaatggcgcattcctccttctcctttctgaggatgccctaccctgtaacaaagtcgtttctaataaatttgcttctttcaccata

SEQ ID NO: 102588 - DNA, 879 bp, Homo sapiens
  Payload ID: 15
  Gene Symbol: OAS2
  Gene Name: 2'-5'-oligoadenylate synthetase 2, 69/71kDa
  ENST ID: ENST00000552756
  CDS Start-End: 70-879
ggcagcagcaagaattcctctgcctcccatcctaccattcactgtcttgccggcagccagctgagagcaatgggaaatggggagtcccagctgtcctcggtgcctgctcagaagctgggttggtttatccaggaatacctgaagccctacgaagaatgtcagacactgatcgacgagatggtgaacaccatctgtgacgtcctgcaggaacccgaacagttccccctggtgcagggagtggccataggtggctcctatggacggaaaacagtcttaagaggcaactccgatggcttaaatgataatcccagcccctggatctatcgagagctcaaaagatccttggataagacaaatgccagtcctggtgagtttgcagtctgcttcactgaactccagcagaagttttttgacaaccgtcctggaaaactaaaggatttgatcctcttgataaagcactggcatcaacagtgccagaaaaaaatcaaggatttaccctcgctgtctccgtatgccctggagctgcttacggtgtatgcctgggaacaggggtgcagaaaagacaactttgacattgctgaaggcgtcagaaccgtactggagctgatcaaatgccaggagaagctgtgtatctattggatggtcaactacaactttgaagatgagaccatcaggaacatcctgctgcaccagctccaatcagcgaggccagtaatcttggatccagttgacccaaccaataatgtgagtggagataaaatatgctggcaatggctgaaaaaagaagctcaaacctggttgacttctcccaacctggataatgagttacctgcaccatcttggaatgttctgcctgcaccactcttcacgaccccaggc

SEQ ID NO: 102589 - DNA, 744 bp, Homo sapiens
  Payload ID: 15
  Gene Symbol: OAS2
  Gene Name: 2'-5'-oligoadenylate synthetase 2, 69/71kDa
  ENST ID: ENST00000551603
  CDS Start-End: 8-190
gagagcaatgggaaatggggagtcccagctgtcctcggtgcctgctcagaagctgggttggtttatccaggaatacctgaagccctacgaagaatgtcagacactgatcgacgagatggtgaacaccatctgtgacgtcctgcaggaacccgaacagttccccctggtgcagggagtggccatagcttaaatgataatcccagcccctggatctatcgagagctcaaaagatccttggataagacaaatgccagtcctggtgagtttgcagtctgcttcactgaactccagcagaagttttttgacaaccgtcctggaaaactaaaggatttgatcctcttgataaagcactggcatcaacagtgccagaaaaaaatcaaggatttaccctcgctgtctccgtatgccctggagctgcttacggtgtatgcctgggaacaggggtgcagaaaagacaactttgacattgctgaaggcgtcagaaccgtactggagctgatcaaatgccaggagaagctgtgtatctattggatggtcaactacaactttgaagatgagaccatcaggaacatcctgctgcaccagctccaatcagcgaggccagtaatcttggatccagttgacccaaccaataatgtgagtggagataaaatatgctggcaatggctgaaaaaagaagctcaaacctggttgacttctcccaacctggataatgagttacctgcaccatcttggaatgttctg

SEQ ID NO: 102590 - DNA, 2908 bp, Homo sapiens
  Payload ID: 15
  Gene Symbol: OAS2
  Gene Name: 2'-5'-oligoadenylate synthetase 2, 69/71kDa
  ENST ID: ENST00000620097
  CDS Start-End: 20-2200
cggcagccagctgagagcaatgggaaatggggagtcccagctgtcctcggtgcctgctcagaagctgggttggtttatccaggaatacctgaagccctacgaagaatgtcagacactgatcgacgagatggtgaacaccatctgtgacgtcctgcaggaacccgaacagttccccctggtgcagggagtggccataggtggctcctatggacggaaaacagtcttaagaggcaactccgatggtacccttgtcctcttcttcagtgacttaaaacaattccaggatcagaagagaagccaacgtgacatcctcgataaaactggggataagctgaagttctgtctgttcacgaagtggttgaaaaacaatttcgagatccagaagtcccttgatgggttcaccatccaggtgttcacaaaaaatcagagaatctctttcgaggtgctggccgccttcaacgctctgagcttaaatgataatcccagcccctggatctatcgagagctcaaaagatccttggataagacaaatgccagtcctggtgagtttgcagtctgcttcactgaactccagcagaagttttttgacaaccgtcctggaaaactaaaggatttgatcctcttgataaagcactggcatcaacagtgccagaaaaaaatcaaggatttaccctcgctgtctccgtatgccctggagctgcttacggtgtatgcctgggaacaggggtgcagaaaagacaactttgacattgctgaaggcgtcagaaccgtactggagctgatcaaatgccaggagaagctgtgtatctattggatggtcaactacaactttgaagatgagaccatcaggaacatcctgctgcaccagctccaatcagcgaggccagtaatcttggatccagttgacccaaccaataatgtgagtggagataaaatatgctggcaatggctgaaaaaagaagctcaaacctggttgacttctcccaacctggataatgagttacctgcaccatcttggaatgttctgcctgcaccactcttcacgaccccaggccaccttctggataagttcatcaaggagtttctccagcccaacaaatgcttcctagagcagattgacagtgctgttaacatcatccgtacattccttaaagaaaactgcttccgacaatcaacagccaagatccagattgtccggggaggatcaaccgccaaaggcacagctctgaagactggctctgatgccgatctcgtcgtgttccataactcacttaaaagctacacctcccaaaaaaacgagcggcacaaaatcgtcaaggaaatccatgaacagctgaaagccttttggagggagaaggaggaggagcttgaagtcagctttgagcctcccaagtggaaggctcccagggtgctgagcttctctctgaaatccaaagtcctcaacgaaagtgtcagctttgatgtgcttcctgcctttaatgcactgggtcagctgagttctggctccacacccagccccgaggtttatgcagggctcattgatctgtataaatcctcggacctcccgggaggagagttttctacctgtttcacagtcctgcagcgaaacttcattcgctcccggcccaccaaactaaaggatttaattcgcctggtgaagcactggtacaaagagtgtgaaaggaaactgaagccaaaggggtctttgcccccaaagtatgccttggagctgctcaccatctatgcctgggagcaggggagtggagtgccggattttgacactgcagaaggtttccggacagtcctggagctggtcacacaatatcagcagctctgcatcttctggaaggtcaattacaactttgaagatgagaccgtgaggaagtttctactgagccagttgcagaaaaccaggcctgtgatcttggacccagccgaacccacaggtgacgtgggtggaggggaccgttggtgttggcatcttctggcaaaagaagcaaaggaatggttatcctctccctgcttcaaggatgggactggaaacccaataccaccttggaaagtgccgacaatgcagacaccaggaagttgtggagctaggatccatcctattgtcaatgagatgttctcatccagaagccatagaatcctgaataataattctaaaagaaacttcagatcatctggcaatcgcttttaaagactcggctcaccgtgagaaagagtcactcacatccattcttcccttgatggtccctattcctccttcccttgcttcttggacttcttgaaatcaatcaagactgcaaaccctttcataaagtcttgccttgctgaactccctctctgcaggcagcctgcctttaaaaatagttgctgtcatccactttatgtgcatcttatttctgtcaacttgtattttttttcttgtatttttccaattagctcctcctttttccttccagtctaaaaaaggaatcctctgtgtcttcaaagcaaagctctttactttccccttggttctcataactctgtgatcttgctctcggtgcttccaactcatccacgtcctgtctgtttcctctgtatacaaaaccctttctgcccctgctgacacagacatcctctatgccagcagccagccaaccctttcattagaacttcaagctctccaaaggctcagattataactgttgtcatatttatatgaggctgttgtcttttccttctgagcctgcctttctcccccccacccaggagtatcctcttgccaaatcaaaagactttttccttgggctttagccttaaagatacttgaaggtctaggtgctttaacctcacataccctcacttaaacttttatcactgttgcatataccagttgtgatacaataaagaatgtatctgg

SEQ ID NO: 102591 - DNA, 6719 bp, Homo sapiens
  Payload ID: 16
  Gene Symbol: OAS3
  Gene Name: 2'-5'-oligoadenylate synthetase 3, 100kDa
  Uniprot ID: Q9Y6K5
  ENST ID: ENST00000228928
  CDS Start-End: 180-3443
cccaagtttggggaagacaggaactgcagcgcccctccccgtttcacgccacgcgcgggaccgaggacctaggacctggccagctgggcgtggttcggagagccgggcgggaaaacgaaaccagaaatccgaaggccgcgccagagccctgcttccccttgcacctgcgccgggcggccatggacttgtacagcaccccggccgctgcgctggacaggttcgtggccagaaggctgcagccgcggaaggagttcgtagagaaggcgcggcgcgctctgggcgccctggccgctgccctgagggagcgcgggggccgcctcggtgctgctgccccgcgggtgctgaaaactgtcaagggaggctcctcgggccggggcacagctctcaagggtggctgtgattctgaacttgtcatcttcctcgactgcttcaagagctatgtggaccagagggcccgccgtgcagagatcctcagtgagatgcgggcatcgctggaatcctggtggcagaacccagtccctggtctgagactcacgtttcctgagcagagcgtgcctggggccctgcagttccgcctgacatccgtagatcttgaggactggatggatgttagcctggtgcctgccttcaatgtcctgggtcaggccggctccggcgtcaaacccaagccacaagtctactctaccctcctcaacagtggctgccaagggggcgagcatgcggcctgcttcacagagctgcggaggaactttgtgaacattcgcccagccaagttgaagaacctaatcttgctggtgaagcactggtaccaccaggtgtgcctacaggggttgtggaaggagacgctgcccccggtctatgccctggaattgctgaccatcttcgcctgggagcagggctgtaagaaggatgctttcagcctagccgaaggcctccgaactgtcctgggcctgatccaacagcatcagcacctgtgtgttttctggactgtcaactatggcttcgaggaccctgcagttgggcagttcttgcagcggcagcttaagagacccaggcctgtgatcctggacccagctgaccccacatgggacctggggaatggggcagcctggcactgggatttgctagcccaggaggcagcatcctgctatgaccacccatgctttctgagggggatgggggacccagtgcagtcttggaaggggccgggccttccacgtgctggatgctcaggtttgggccaccccatccagctagaccctaaccagaagacccctgaaaacagcaagagcctcaatgctgtgtacccaagagcagggagcaaacctccctcatgcccagctcctggccccactggggcagccagcatcgtcccctctgtgccgggaatggccttggacctgtctcagatccccaccaaggagctggaccgcttcatccaggaccacctgaagccgagcccccagttccaggagcaggtgaaaaaggccattgacatcatcttgcgctgcctccatgagaactgtgttcacaaggcctcaagagtcagtaaagggggctcatttggccggggcacagacctaagggatggctgtgatgttgaactcatcatcttcctcaactgcttcacggactacaaggaccaggggccccgccgcgcagagatccttgatgagatgcgagcgcagctagaatcctggtggcaggaccaggtgcccagcctgagccttcagtttcctgagcagaatgtgcctgaggctctgcagttccagctggtgtccacagccctgaagagctggacggatgttagcctgctgcctgccttcgatgctgtggggcagctcagttctggcaccaaaccaaatccccaggtctactcgaggctcctcaccagtggctgccaggagggcgagcataaggcctgcttcgcagagctgcggaggaacttcatgaacattcgccctgtcaagctgaagaacctgattctgctggtgaagcactggtaccgccaggttgcggctcagaacaaaggaaaaggaccagcccctgcctctctgcccccagcctatgccctggagctcctcaccatctttgcctgggagcagggctgcaggcaggattgtttcaacatggcccaaggcttccggacggtgctggggctcgtgcaacagcatcagcagctctgtgtctactggacggtcaactatagcactgaggacccagccatgagaatgcaccttcttggccagcttcgaaaacccagacccctggtcctggaccccgctgatcccacctggaacgtgggccacggtagctgggagctgttggcccaggaagcagcagcgctggggatgcaggcctgctttctgagtagagacgggacatctgtgcagccctgggatgtgatgccagccctcctttaccaaaccccagctggggaccttgacaagttcatcagtgaatttctccagcccaaccgccagttcctggcccaggtgaacaaggccgttgataccatctgttcatttttgaaggaaaactgcttccggaattctcccatcaaagtgatcaaggtggtcaagggtggctcttcagccaaaggcacagctctgcgaggccgctcagatgccgacctcgtggtgttcctcagctgcttcagccagttcactgagcagggcaacaagcgggccgagatcatctccgagatccgagcccagctggaggcatgtcaacaggagcggcagttcgaggtcaagtttgaagtctccaaatgggagaatccccgcgtgctgagcttctcactgacatcccagacgatgctggaccagagtgtggactttgatgtgctgccagcctttgacgccctaggccagctggtctctggctccaggcccagctctcaagtctacgtcgacctcatccacagctacagcaatgcgggcgagtactccacctgcttcacagagctacaacgggacttcatcatctctcgccctaccaagctgaagagcctgatccggctggtgaagcactggtaccagcagtgtaccaagatctccaaggggagaggctccctacccccacagcacgggctggaactcctgactgtgtatgcctgggagcagggcgggaaggactcccagttcaacatggctgagggcttccgcacggtcctggagctggtcacccagtaccgccagctctgtatctactggaccatcaactacaacgccaaggacaagactgttggagacttcctgaaacagcagcttcagaagcccaggcctatcatcctggatccggctgacccgacaggcaacctgggccacaatgcccgctgggacctgctggccaaggaagctgcagcctgcacatctgccctgtgctgcatgggacggaatggcatccccatccagccatggccagtgaaggctgctgtgtgaagttgagaaaatcagcggtcctactggatgaagagaagatggacaccagccctcagcatgaggaaattcagggtcccctaccagatgagagagattgtgtacatgtgtgtgtgagcacatgtgtgcatgtgtgtgcacacgtgtgcatgtgtgtgttttagtgaatctgctctcccagctcacacactcccctgcctcccatggcttacacactaggatccagactccatggtttgacaccagcctgcgtttgcagcttctctgtcacttccatgactctatcctcataccaccactgctgcttcccacccagctgagaatgccccctcctccctgactcctctctgcccatgcaaattagctcacatctttcctcctgctgcaatccatcccttcctcccattggcctctccttgccaaatctaaatagtttatatagggatggcagagagttcccatctcatctgtcagccacagtcatttggtactggctacctggagccttatcttctgaagggttttaaagaatggccaattagctgagaagaattatctaatcaattagtgatgtctgccatggatgcagtagaggaaagtggtggtacaagtgccatgattgattagcaatgtctgcactggatacggaaaaaagaaggtgcttgcaggtttacagtgtatatgtgggctattgaagagccctctgagctcggttgctagcaggagagcatgcccatattggcttactttgtctgccacagacacagacagagggagttgggacatgcatgctatggggaccctcttgttggacacctaattggatgcctcttcatgagaggcctccttttcttcaccttttatgctgcactcctcccctagtttacacatcttgatgctgtggctcagtttgccttcctgaatttttattgggtccctgttttctctcctaacatgctgagattctgcatccccacagcctaaactgagccagtggccaaacaaccgtgctcagcctgtttctctctgccctctagagcaaggcccaccaggtccatccaggaggctctcctgacctcaagtccaacaacagtgtccacactagtcaaggttcagcccagaaaacagaaagcactctaggaatcttaggcagaaagggattttatctaaatcactggaaaggctggaggagcagaaggcagaggccaccactggactattggtttcaatattagaccactgtagccgaatcagaggccagagagcagccactgctactgctaatgccaccactacccctgccatcactgccccacatggacaaaactggagtcgagacctaggttagattcctgcaaccacaaacatccatcagggatggccagctgccagagctgcgggaagacggatcccacctccctttcttagcagaatctaaattacagccagacctctggctgcagaggagtctgagacatgtatgattgaatgggtgccaagtgccagggggcggagtccccagcagatgcatcctggccatctgttgcgtggatgagggagtgggtctatctcagaggaaggaacaggaaacaaagaaaggaagccactgaacatcccttctctgctccacaggagtgccttagacagcctgactctccacaaaccactgttaaaacttacctgctaggaatgctagattgaatgggatgggaagagccttccctcattattgtcattcttggagagaggtgagcaaccaagggaagctcctctgattcacctagaacctgttctctgccgtctttggctcagcctacagagactagagtaggtgaagggacagaggacagggcttctaatacctgtgccatattgacagcctccatccctgtcccccatcttggtgctgaaccaacgctaagggcaccttcttagactcacctcatcgatactgcctggtaatccaaagctagaactctcaggaccccaaactccacctcttggattggccctggctgctgccacacacatatccaagagctcagggccagttctggtgggcagcagagacctgctctgccaagttgtccagcagcagagtggccctggcctgggcatcacaagccagtgatgctcctgggaagaccaggtggcaggtcgcagttgggtaccttccattcccaccacacagactctgggcctccccgcaaaatggctccagaattagagtaattatgagatggtgggaaccagagcaactcaggtgcatgatacaaggagaggttgtcatctgggtagggcagagaggagggcttgctcatctgaacaggggtgtatttcattccaggccctcagtctttggcaatggccaccctggtgttggcatattggccccactgtaacttttgggggcttcccggtctagccacaccctcggatggaaagacttgactgcataaagatgtcagttctccctgagttgattgataggcttaatggtcaccctaaaaacacccacatatgcttttcgatggaaccaggtaagttgacgctaaagttcttatggaaaaatacacacgcaatagctaggaaaacacagggaaagaagagttctgagcagggcctagtcttagccaatattaaaacatactatgaagcctctgatacttaaacagcatggcgctggtacgtaaatagaccaatgcagttaggtggctctttccaagactctggggaaaaaagtagtaaaaagctaaatgcaatcaatcagcaattgaaagctaagtgagagagccagagggcctccttggtggtaaaagagggttgcatttcttgcagccagaaggcagagaaagtgaagaccaagtccagaactgaatcctaagaaatgcaggactgcaaagaaattggtgtgtgtgtgtgtgtgtgtgtgtgtgtgtgtgtttaatttttaaaaagtttttattgagatacaagtcaataccataaagctctcacccttctaaagtgtacaattcagtggtgtgagtatattcataagatttatacttggtgtctattcataagacttatatccagcatattcataactagagccatatcacagatgcattcatcataataattccagacattttcatcaccctaaaaggaaaccctgaaacccattagcagtcattccccattcctccaacccattctctccctaatccctagaaaccaccaatctgctgtgtatttcatctattgccaacatttcatataaatggcatcatacaa

SEQ ID NO: 102592 - DNA, 499 bp, Homo sapiens
  Payload ID: 16
  Gene Symbol: OAS3
  Gene Name: 2'-5'-oligoadenylate synthetase 3, 100kDa
  ENST ID: ENST00000546973
  CDS Start-End: 1-499
ataccatctgttcatttttgaaggaaaactgcttccggaattctcccatcaaagtgatcaaggtggtcaaggagcggcagttcgaggtcaagtttgaagtctccaaatgggagaatccccgcgtgctgagcttctcactgacatcccagacgatgctggaccagagtgtggactttgatgtgctgccagcctttgacgccctaggccagctggtctctggctccaggcccagctctcaagtctacgtcgacctcatccacagctacagcaatgcgggcgagtactccacctgcttcacagagctacaacgggacttcatcatctctcgccctaccaagctgaagagcctgatccggctggtgaagcactggtaccagcagtgtaccaagatctccaaggggagaggctccctacccccacagcacgggctggaactcctgactgtgtatgcctgggagcagggcgggaaggactcccagttcaacatggctgagggctt

SEQ ID NO: 102593 - DNA, 1392 bp, Homo sapiens
  Payload ID: 16
  Gene Symbol: OAS3
  Gene Name: 2'-5'-oligoadenylate synthetase 3, 100kDa
  ENST ID: ENST00000548514
  CDS Start-End: 72-743
gggaaaacgaaaccagaaatccgaaggccgcgccagagccctgcttccccttgcacctgcgccgggcggccatggacttgtacagcaccccggccgctgcgctggacaggttcgtggccagaaggctgcagccgcggaaggagttcgtagagaaggcgcggcgcgctctgggcgccctggccgctgccctgagggagcgcgggggccgcctcggtgctgctgccccgcgggtgctgaaaactgtcaagggaggctcctcgggccggggcacagctctcaagggtggctgtgattctgaacttgtcatcttcctcgactgcttcaagagctatgtggaccagagggcccgccgtgcagagatcctcagtgagatgcgggcatcgctggaatcctggtggcagaacccagtccctggtctgagactcacgtttcctgagcagagcgtgcctggggccctgcagttccgcctgacatccgtagatcttgaggactggatggatgttagcctggtgcctgccttcaatgtcctgggtcaggccggctccggcgtcaaacccaagccacaagtctactctaccctcctcaacagtggctgccaagggggcgagcatgcggcctgcttcacagagctgcggaggaactttgtgaacattcgcccagccaagttgaagaacctaatcttgctggtgaagcactggtaccaccaggtgaagccacttggaagggtttctccagacatgtgactgtttgctttgtgctttcatagtcgtgaaactgttgtcttacatttagtggccattcatgttctctctctgggaattgtctgtttatgtcccttgtgcattattttctcttgggttagctgtcttgttactgatttgttgaagctctttatatattgtggatactgatccttatttagttaatataatgcattcttccaatagtcttccagtctgtgtcttgggcttttgctttgtttaaaggttatttgtaggacaaaatatctacagtttaatgtactcagatatatcctttgaaaaatgagttattctttgtgtgtcttaagaagtctttccctatcctgccaggtgcagtggctcatggctggaatcccagcactttgagtggccgaggcaggtggatcacttgaggtcaggagttcaagaccagcctggccaacatggtgaaaccctgtctctactaaaaatacaaaatgtagccgggcgtggtggtacacacctgtaattccagttactcgggaggctgaggcaggagaatctcttgaacccaggaggcagaggttgcagtaagccaagattgcaccactgcactccagcctgggtgacagagccagactccatctcaaggaaaaaaaaaaaaaaaaaaaaa

SEQ ID NO: 102594 - DNA, 998 bp, Homo sapiens
  Payload ID: 16
  Gene Symbol: OAS3
  Gene Name: 2'-5'-oligoadenylate synthetase 3, 100kDa
  ENST ID: ENST00000551007
  CDS Start-End: 88-621
gttcggagagccgggcgggaaaacgaaaccagaaatccgaaggccgcgccagagccctgcttccccttgcacctgcgccgggcggccatggacttgtacagcaccccggccgctgcgctggacaggttcgtggccagaaggctgcagccgcggaaggagttcgtagagaaggcgcggcgcgctctgggcgccctggccgctgccctgagggagcgcgggggccgcctcggtgctgctgccccgcgggtgctgaaaactgtcaagggaggctcctcgggccggggcacagctctcaagggtggctgtgattctgaacttgtcatcttcctcgactgcttcaagagctatgtggaccagagggcccgccgtgcagagatcctcagtgagatgcgggcatcgctggaatcctggtggcagaacccagtccctggtctgagactcacgtttcctgagcagagcgtgcctggggccctgcagttccgcctgacatccgtagatcttgaggactggatggatgttagcctggtgcctgccttcaatgtcctgggtgaggggttcctagaccattccagggttgggggcaaaagatcattgggaacaacacaggacttccaattctagcccagccaccaacttgctgtttgacctgggccagcctctacccctctctcagcctcagtctggggactaaacatattggacttgtgccagacaaaggcagagaaaccccagttcctcctggatctgtggtcctgctgtcaagatgcttggccctcccacaggcatctgggagtttccctcagccactgcctggagcggttactgctcagcccttccacaaatactcccgaaagctaagccaagtggacatgtggctagcagtaggggcctggggacgaaaccagaattctgcaaaatcttgtattttatgttgaaaacatcaatgtgatttttgtgttctccttcgtaatacacgtatgcttgagttaagataaaaa

SEQ ID NO: 102595 - DNA, 3266 bp, Homo sapiens
  Payload ID: 17
  Gene Symbol: OASL
  Gene Name: 2'-5'-oligoadenylate synthetase-like
  Uniprot ID: Q15646
  ENST ID: ENST00000257570
  CDS Start-End: 272-1816
tgactagacggccagcctgttaaggtggccccagatattccagcctcagcccagagtcctcctgtgcccctactgcagcaagggtgtctccaagaagggggacctggagtcagcccgtcacacctggtttcctctctgctagggtccctcctcccacagagcactggagggcagctgaggaggagctaccttaaaaaaggaggtgtgtgccagggagctgggtaggagcctggctatatatctgcccagcagcggtactctcgggacagagatggcactgatgcaggaactgtatagcacaccagcctccaggctggactccttcgtggctcagtggctgcagccccaccgggagtggaaggaagaggtgctagacgctgtgcggaccgtggaggagtttctgaggcaggagcatttccaggggaagcgtgggctggaccaggatgtgcgggtgctgaaggtagtcaaggtgggctccttcgggaatggcacggttctcaggagcaccagagaggtggagctggtggcgtttctgagctgtttccacagcttccaggaggcagccaagcatcacaaagatgttctgaggctgatatggaaaaccatgtggcaaagccaggacctgctggacctcgggctcgaggacctgaggatggagcagagagtccccgatgctctcgtcttcaccatccagaccagggggactgcggagcccatcacggtcaccattgtgcctgcctacagagccctggggccttctcttcccaactcccagccaccccctgaggtctatgtgagcctgatcaaggcctgcggtggtcctggaaatttctgcccatccttcagcgagctgcagagaaatttcgtgaaacatcggccaactaagctgaagagcctcctgcgcctggtgaaacactggtaccagcagtatgtgaaagccaggtcccccagagccaatctgccccctctctatgctcttgaacttctaaccatctatgcctgggaaatgggtactgaagaagacgagaatttcatgttggacgaaggcttcaccactgtgatggacctgctcctggagtatgaagtcatctgtatctactggaccaagtactacacactccacaatgcaatcattgaggattgtgtcagaaaacagctcaaaaaagagaggcccatcatcctggatccggccgaccccaccctcaacgtggcagaagggtacagatgggacatcgttgctcagagggcctcccagtgcctgaaacaggactgttgctatgacaacagggagaaccccatctccagctggaacgtgaagagggcacgagacatccacttgacagtggagcagaggggttacccagatttcaacctcatcgtgaacccttatgagcccataaggaaggttaaagagaaaatccggaggaccaggggctactctggcctgcagcgtctgtccttccaggttcctggcagtgagaggcagcttctcagcagcaggtgctccttagccaaatatgggatcttctcccacactcacatctatctgctggagaccatcccctccgagatccaggtcttcgtgaagaatcctgatggtgggagctacgcctatgccatcaaccccaacagcttcatcctgggtctgaagcagcagattgaagaccagcaggggcttcctaaaaagcagcagcagctggaattccaaggccaagtcctgcaggactggttgggtctggggatctatggcatccaagacagtgacactctcatcctctcgaagaagaaaggagaggctctgtttccagccagttagttttctctgggagacttctctgtacatttctgccatgtactccagaactcatcctgtcaatcactctgtcccattgtctactgggaaggtcccaggtcttcaccagttttacaatgagttatcccaggccagacgtggtagctcacacctgtaatcccagaactttgggaggccgaggtgggaggagcgcttgagccgaggagttcaagaccagcctgggtatcacagggagaccccgtctctacaaaataaaaaaataattcactgggtgtggttgtgcacatttgtagtctcaggcactcaagaagctgaggcagaagaatcacttgagcccaggaggctgaagctgcagtgagctgtgatcacaccgctacactcctgcccaggccacagagcaagaccctgtgtctaaaaactaaaacataaaaataagtaaatccgtttaaaaaaaggattatcccagccctgccagggggaggatgaggaggggtgtgaggactaaatatacaaataaatagtgtggtcacatgacgcacagcaacagaattcggacccacagccttctgcagcaatcaaccccaaaccatcaggacttgggcgataactggcagcatctctaactccccaccctactcccatcctgcttcctatttatgaccaacccaagaaacccaaataagctccccagaccaatcacatggttagccccacttctggtgagtgcacttccagcttccccataccaacagcctcaatcacggcatccctgaagccttcccattttcctgcctgtctttaaatctctgtcaaaagcgagagatgggtggctggttcctttgctatagcaagttgggaataaatcgcctttgttagttctcatttgggggctgtttatttccacagggcctaatgctgtcctaatggttattgcttgatcatttgagcttctcaactctaagaaatgaggactggggaaactgaggcaaaaagagacaaagaatgggagattgaggatgatgcagtgtaaaaaaaaatcacctcaactcctaaaacccatacacaaacagtacataatagtcaggaaactgtaggaaagtaatagcatctttattatcaaaggacgtcatgtgatcaggtttactccaagcaataaaaagtttccttttgcccccctgttttgcctagttttctggtgggctactctcctaccatagcatagaaaatgcacactgcaattggttatcaacagcctctggtcaatttagcaatcataatctgtgtatctcccacctctgtttgccttcagggacagaaaaagtgcctcctttccaggaggtagacaggctgttccagtccccatctttgtgtccttcataatgcccagcacagcccacattgtaggtggtgggaaaattcttgtttaaaataaaaaaaagaatgaaaaatgcaa

SEQ ID NO: 102596 - DNA, 1492 bp, Homo sapiens
  Payload ID: 17
  Gene Symbol: OASL
  Gene Name: 2'-5'-oligoadenylate synthetase-like
  Uniprot ID: Q15646
  ENST ID: ENST00000339275
  CDS Start-End: 186-953
tctccaagaagggggacctggagtcagcccgtcacacctggtttcctctctgctagggtccctcctcccacagagcactggagggcagctgaggaggagctaccttaaaaaaggaggtgtgtgccagggagctgggtaggagcctggctatatatctgcccagcagcggtactctcgggacagagatggcactgatgcaggaactgtatagcacaccagcctccaggctggactccttcgtggctcagtggctgcagccccaccgggagtggaaggaagaggtgctagacgctgtgcggaccgtggaggagtttctgaggcaggagcatttccaggggaagcgtgggctggaccaggatgtgcgggtgctgaaggtagtcaaggtgggctccttcgggaatggcacggttctcaggagcaccagagaggtggagctggtggcgtttctgagctgtttccacagcttccaggaggcagccaagcatcacaaagatgttctgaggctgatatggaaaaccatgtggcaaagccaggacctgctggacctcgggctcgaggacctgaggatggagcagagagtccccgatgctctcgtcttcaccatccagaccagggggactgcggagcccatcacggtcaccattgtgcctgcctacagagccctggggccttctcttcccaactcccagccaccccctgaggtctatgtgagcctgatcaaggcctgcggtggtcctggaaatttctgcccatccttcagcgagctgcagagaaatttcgtgaaacatcggccaactaagctgaagagcctcctgcgcctggtgaaacactggtaccagcaggcccatcatcctggatccggccgaccccaccctcaacgtggcagaagggtacagatgggacatcgttgctcagagggcctcccagtgcctgaaacaggactgttgctatgacaacagggagaaccccatctccagctggaacgtgaagagggcacgagacatccacttgacagtggagcagaggggttacccagatttcaacctcatcgtgaacccttatgagcccataaggaaggttaaagagaaaatccggaggaccaggggctactctggcctgcagcgtctgtccttccaggttcctggcagtgagaggcagcttctcagcagcaggtgctccttagccaaatatgggatcttctcccacactcacatctatctgctggagaccatcccctccgagatccaggtcttcgtgaagaatcctgatggtgggagctacgcctatgccatcaaccccaacagcttcatcctgggtctgaagcagcagattgaagaccagcaggggcttcctaaaaagcagcagcagctggaattccaaggccaagtcctgcaggactggttgggtctggggatctatggcatccaagacagtgacactctcatcctctcgaagaagaaaggagaggctctgtttccagccagttagtttt

SEQ ID NO: 102597 - DNA, 749 bp, Homo sapiens
  Payload ID: 17
  Gene Symbol: OASL
  Gene Name: 2'-5'-oligoadenylate synthetase-like
  ENST ID: ENST00000543677
  CDS Start-End: 1-461
agcacaccagcctccaggctggactccttcgtggctcagtggctgcagccccaccgggagtggaaggaagaggtgctagacgctgtgcggaccgtggaggagtttctgaggcaggagcatttccaggggaagcgtgggctggaccaggatgtgcgggtgctgaaggtagtcaagggccttctcttcccaactcccagccaccccctgaggtctatgtgagcctgatcaaggcctgcggtggtcctggaaatttctgcccatccttcagcgagctgcagagaaatttcgtgaaacatcggccaactaagctgaagagcctcctgcgcctggtgaaacactggtaccagcaggcccatcatcctggatccggccgaccccaccctcaacgtggcagaagggtacagatgggacatcgttgctcagagggcctcccagtgcctgaaacaggactgttgctatgacaacagggagaaccccatctccagctggaacgtgaaggtaatggctcctctctgggctgtcaagggcttgaaggtcagaacgacagataaactactcagtatttactcattcagttctgtgttgatggagaacagaactttagagtcaccgtttaagggccagctgcaccacccatgggctccgtgaacttggacaaattctttggctctcagagccttgggtttcttaccttcaaattcttgttctcctttcctttctttttcccataatttactggagaatcagtt

SEQ ID NO: 102598 - DNA, 1695 bp, Homo sapiens
  Payload ID: 17
  Gene Symbol: OASL
  Gene Name: 2'-5'-oligoadenylate synthetase-like
  Uniprot ID: Q15646
  ENST ID: ENST00000620239
  CDS Start-End: 272-1426
tgactagacggccagcctgttaaggtggccccagatattccagcctcagcccagagtcctcctgtgcccctactgcagcaagggtgtctccaagaagggggacctggagtcagcccgtcacacctggtttcctctctgctagggtccctcctcccacagagcactggagggcagctgaggaggagctaccttaaaaaaggaggtgtgtgccagggagctgggtaggagcctggctatatatctgcccagcagcggtactctcgggacagagatggcactgatgcaggaactgtatagcacaccagcctccaggctggactccttcgtggctcagtggctgcagccccaccgggagtggaaggaagaggtgctagacgctgtgcggaccgtggaggagtttctgaggcaggagcatttccaggggaagcgtgggctggaccaggatgtgcgggtgctgaaggtagtcaaggtgggctccttcgggaatggcacggttctcaggagcaccagagaggtggagctggtggcgtttctgagctgtttccacagcttccaggaggcagccaagcatcacaaagatgttctgaggctgatatggaaaaccatgtggcaaagccaggacctgctggacctcgggctcgaggacctgaggatggagcagagagtccccgatgctctcgtcttcaccatccagaccagggggactgcggagcccatcacggtcaccattgtgcctgcctacagagccctggggccttctcttcccaactcccagccaccccctgaggtctatgtgagcctgatcaaggcctgcggtggtcctggaaatttctgcccatccttcagcgagctgcagagaaatttcgtgaaacatcggccaactaagctgaagagcctcctgcgcctggtgaaacactggtaccagcagagggcacgagacatccacttgacagtggagcagaggggttacccagatttcaacctcatcgtgaacccttatgagcccataaggaaggttaaagagaaaatccggaggaccaggggctactctggcctgcagcgtctgtccttccaggttcctggcagtgagaggcagcttctcagcagcaggtgctccttagccaaatatgggatcttctcccacactcacatctatctgctggagaccatcccctccgagatccaggtcttcgtgaagaatcctgatggtgggagctacgcctatgccatcaaccccaacagcttcatcctgggtctgaagcagcagattgaagaccagcaggggcttcctaaaaagcagcagcagctggaattccaaggccaagtcctgcaggactggttgggtctggggatctatggcatccaagacagtgacactctcatcctctcgaagaagaaaggagaggctctgtttccagccagttagttttctctgggagacttctctgtacatttctgccatgtactccagaactcatcctgtcaatcactctgtcccattgtctactgggaaggtcccaggtcttcaccagttttacaatgagttatcccaggccagacgtggtagctcacacctgtaatcccagaactttgggaggccgaggtgggaggagcgcttgagccgaggagttcaagaccagcctgggtatcacagggagaccccgtctctacaaaataaaaaaataattcactggg

SEQ ID NO: 102599 - DNA, 3627 bp, Homo sapiens
  Payload ID: 18
  Gene Symbol: ADO
  Gene Name: 2-aminoethanethiol (cysteamine) dioxygenase
  Uniprot ID: Q96SZ5
  ENST ID: ENST00000373783
  CDS Start-End: 204-1016
agagggggctcaaggcgagcgcgccgggcagttgcgggcgcgtggctgctgaggttggcggcggtgccgcgcgcccgacgggccggtggttgcggggcctcccgcctcgacccgggctgggggcagccgtggcggccgccggggaccgcaaggggcggaggaaaggagggggccggtcccggcacgcagaggagcagccgaccatgccccgagacaacatggcctccttgatccaacggatcgcccgccaggcttgcctcaccttccggggcagcgggggcggccgcggcgcttccgatcgcgacgcggcttctggcccggaggcgccgatgcagccgggcttccccgagaacctgagcaagctgaagagcctcctgacccagctccgcgccgaggacttgaacatcgccccgcgcaaggccacactgcagccgctgccgcccaacctgccgccagtcacctacatgcacatctacgagacggacggcttcagcctgggcgtgttcctgctcaagagcggcacgtccatcccgctgcacgaccacccgggcatgcacggcatgctcaaggtgctgtacggcaccgtgcgcatcagctgcatggacaagctagacgcgggcggcgggcaacggccgcgggccttgccgcccgagcagcagttcgagccgccgctgcagccccgggagcgagaagccgtgcggccgggcgtgctgcgttcgcgggccgagtacaccgaggccagcggcccctgcatcctcacaccgcaccgggacaacctgcaccagatcgacgccgtggaagggcctgccgccttcctggacatcctggccccgccctacgacccggacgatggccgggactgccactattaccgggtgctggagccggtcaggcccaaggaggcctccagctcggcctgtgacctgcctcgagaggtgtggctcctggagaccccacaggccgatgacttctggtgcgagggagaaccctatccaggtcccaaggtcttcccttgaagccactggcgcccaggagcggtgggccgaagacgtgccctaccctaccacaagggctgtgtctctaccccctagcctgggcgttggatctactggaatgagcagcagccgcttcctcggcagccttgggaagcacgggcgactggacagcagccgccgggcacggttatgggggcggggtgggcggggaggctagattgtttcctggtactgtcactgccactggggctttgatttggaggaatggggcaggggactatctgaagcgcttccatcctaaagccataatgaaaatatcttcctctcttccccattctatacaaaatactaagtggttttcttgctcccactccctaccccttagttaaatagggtttattttccactcatgcccttatgcctttttttcttatagttttttaacttattgactgtgcatgacccagtggtttgaattgtttttagttcaagtcattggtaaaaactaggtttaaggagatgagctactgtttaaagtgagctggcctgcctaattaattccttgtgaaaactaaatgattttttcagtttggggatcattctcacaacataactatgcatgtagaggacaagatttattttctttcctccctttgcccagtagccacatctggtttactcaggcagcatctactaagaaattcagcacctgcatatctctgtgacatggtcacttagagcttatcttccctatgaatctccagatctgtgagtcgagcagatttcatgttgcagattcacctttaatgcaaagactgtattatcctcacatgactttttttcttgtcttactgtaccttaaaaggtgatagagtaattctgtattttctaacgggaagattcaaaggagctgaatgtgttatgcttccaaacaactgaatgtaaaacactcctagccagttgttgcattccctatatttatttacttccaatattttactgtaaaagtagggagaaatattatgttgatagttgtttcatattctctcaggaactttaatgttcccgactcgggtgattccagctgtgttgctggcagtgttgtctcaaccctctccctaaaatgactgagccctgggttcatctaatgtggttttccttaggaagagatagaaggcacagaagatcacagctagagaattgagaattaactatactactagccattttagggcaccaaaacttgggattaaacacttcctacttcccactcccaactcctgaaatgaagtcttgctatctgtgactagttttatttttgtgcttttaatagtccgagcagtcttaccttgtttacacatgtattgacaccatttgcttcaggccatggagcactgtttctccctttttactatttataggattccgttttttcacaagacttttaataaaaagaaattgtagaaataaacacattaaaatttgcccagctgtcgtctaagccctcttgattgacttgcccaagtggcaatagagttctaatatctataataaagggagatttgctattattagtggaatgttgaccccgtatgtagagaaacagtacgtgcctttgcctctttatgcacacagagacccagggtgagggagtatttgttcccagtttttaagatagtataaaaaagcaaatacttggtgagtgatttaaaaataaaaccaaaacaaaacacaaaaagatattccacaggacatgccactttattataaaacctgacacaggcatagtaccaagtatttcctgcattgttgctaaaattgttttattgtagctccacattctggtgtagtttaaaatgcctttgggggcagtttgaagcagttcttcatgccacttagtttgaaaataaaattctagatatgcaaatgattttcttagaaaacttcacaaaataaaagatcttgtttttttttccatagcacagtaatgaatgtggttatcaatcacatacttttttggattatattgtagcaaaaagttgattagcttaccaagattattaatagcaatgtatgtgttataatacaacttagtacattaaagctacgaaaactcatcctggctgtaggatagtaataaaggaagaattatgacttcattatgaaaaaaagaagttttaaagttttcaattacgagcaatttggaagaaaaaacctaaggtgcttttcaaaagagtaactgaaattgttgcaggccaaaacagcaatatgatatctcagatttagttcaataagaacagtgaaacttttggttcactaataaattctgagtaaattagtggtgaagacaaaatataacttgttttagtgagccactgaggaaagaatatgcttattacaaagacaaaatgtggtgcagaaactatcttgcacctgtgtgcataaactgttagtcgtgactgacttggtgtgttgctattgtgtttctatatactccgtccaatatagataatgttttaataacaactgtgggataaaagttatcttccccttggaaagactaatgagcacaatgatattaatcacttttatggtgaataataaatgcaataattgcctcatgggtgagaaa

SEQ ID NO: 102600 - DNA, 657 bp, Homo sapiens
  Payload ID: 19
  Gene Symbol: DNPH1
  Gene Name: 2'-deoxynucleoside 5'-phosphate N-hydrolase 1
  Uniprot ID: O43598
  ENST ID: ENST00000230431
  CDS Start-End: 29-553
ggcgccggagagcgcgggcggctggggaatggctgctgccatggtgccggggcgcagcgagagctgggagcgcggggagcctggccgcccggccctgtacttctgcgggagcattcgcggcggacgcgaggacaggacgctgtacgagcggatcgtgtctcggctgcggcgattcgggacagtgctcaccgagcacgtggcggccgccgagctgggcgcgcgcggggaagaggctgctgggggtgacaggctcatccatgagcaggacctggagtggctgcagcaggcggacgtggtcgtggcagaagtgacacagccatccttgggtgtaggctatgagctgggccgggccgtggcctttaacaagcggatcctgtgcctgttccgcccgcagtctggccgcgtgctttcggccatgatccggggagcagcagatggctctcggttccaggtgtgggactatgaggagggagaggtggaggccctgctggatcgatacttcgaggctgatcctccagggcaggtggctgcctcccctgacccaaccacttgacttaatctcactttcttaaattcttctattctcagacactgctctagtaccattccttcctcttagccccaggagcaaattaaaaggtacagttaaaatcctaa

SEQ ID NO: 102601 - DNA, 796 bp, Homo sapiens
  Payload ID: 19
  Gene Symbol: DNPH1
  Gene Name: 2'-deoxynucleoside 5'-phosphate N-hydrolase 1
  Uniprot ID: O43598
  ENST ID: ENST00000393987
  CDS Start-End: 23-469
ggagagcgcgggcggctggggaatggctgctgccatggtgccggggcgcagcgagagctgggagcgcggggagcctggccgcccggccctgtacttctgcgggagcattcgcggcggacgcgaggacaggacgctgtacgagcggatcgtgtctcggctgcggcgattcgggacagtgctcaccgagcacgtggcggccgccgagctgggcgcgcgcggggaagaggctgctgggggtgacaggctcatccatgagcaggacctggagtggctgcagcaggcggacgtggtcgtggcagaagtgacacagccatccttgggtgtaggctatgagctgggccgggccgtggcctttaacaagcggatcctgtgcctgttccgcccgcagtctggccgcggtgagcaccccaagcctccctcctggctttctatggacccagccctcagctccttccctggtgggctctgagcaccgcgcctctcccaaggggtaagggagctgtgagggtgtggatgggaggcagcttcacctttccctgccctttccagtgctttcggccatgatccggggagcagcagatggctctcggttccaggtgtgggactatgaggagggagaggtggaggccctgctggatcgatacttcgaggctgatcctccagggcaggtggctgcctcccctgacccaaccacttgacttaatctcactttcttaaattcttctattctcagacactgctctagtaccattccttcctcttagccccaggagcaaattaaaaggtacagttaaaa

SEQ ID NO: 102602 - DNA, 834 bp, Homo sapiens
  Payload ID: 19
  Gene Symbol: DNPH1
  Gene Name: 2'-deoxynucleoside 5'-phosphate N-hydrolase 1
  ENST ID: ENST00000509253
  CDS Start-End: 1-732
gctgctgccatggtgccggggcgcagcgagagctgggagcgcggggagcctggccgcccggccctgtacttctgcgggagcattcgcggcggacgcgaggacaggacgctgtacgagcggatcgtgtctcggctgcggcgattcgggacagtgctcaccgagcacgtggcggccgccgagctgggcgcgcgcggtgaggccctggggccgcgggacgcggggacgcgggcgcggacctggctggggtggcagggacccggcctgtccgcccccccgacccccggcagctgcgctcccggcgcccggagcccgccctcctaccccggtgctccatccagcgccccagcccgagaaggaaacgggccggggctcgggctgcgtgggtcccagcaagcctgcgggtgggaagaggctgctgggggtgacaggctcatccatgagcaggacctggagtggctgcagcaggcggacgtggtcgtggcagaagtgacacagccatccttgggtgtaggctatgagctgggccgggccgtggcctttaacaagcggatcctgtgcctgttccgcccgcagtctggccgcgtgctttcggccatgatccggggagcagcagatggctctcggttccaggtgtgggactatgaggagggagaggtggaggccctgctggatcgatacttcgaggctgatcctccagggcaggtggctgcctcccctgacccaaccacttgacttaatctcactttcttaaattcttctattctcagacactgctctagtaccattccttcctcttagccccaggagcaaattaaaaggtacagttaaaatcct

SEQ ID NO: 102603 - DNA, 2266 bp, Homo sapiens
  Payload ID: 20
  Gene Symbol: HACL1
  Gene Name: 2-hydroxyacyl-CoA lyase 1
  Uniprot ID: Q9UJ83
  ENST ID: ENST00000321169
  CDS Start-End: 369-2105
aaacgctccagctggccgactcggagacaatggcgagaggcctcagagttcggcttcttacctgctttgcataggcagcaatctcctgctagtcccgcctccctctggcattctggcgcgcgaatggaggagccgagaagagagcgcagttctgattggagaacgcgcgtgtttacattctcacctctcccgggaagtggacgaatttagaccgcctcttccttcccgttgtttaaggcagttggttgccctcctgtccgtcagaggtgcagtaccagaggtggcgtgctgccgatttcgcgtttgccttgctggatgattccgcttgtttgccggctgcgtgagtgcttagagcttttcggtggaagatgccggacagtaacttcgcagagcgcagcgaggagcaggtgtctggtgctaaagtcatcgctcaggccctgaaaacgcaagatgtggagtacatatttggcatcgtaggcatcccagtgaccgaaatcgccattgctgcccagcagctaggcatcaagtacatcgggatgaggaatgagcaagcggcttgttatgctgcctccgcgattggatatctgacaagcaggccaggagtctgccttgttgtttctggcccaggtctcatccatgccttgggcggtatggcaaatgcaaacatgaactgctggcccttgcttgtgattggtggttcctctgaaagaaaccaagaaacaatgggagctttccaggagtttcctcaggttgaagcttgtagattatataccaagttctctgcccgcccaagcagcatagaagctattccttttgttattgaaaaggcagtgagaagcagtatctatggtcgtccaggtgcttgctatgttgacataccagcagattttgtgaaccttcaggtgaatgtgaattctataaagtacatggaacgctgcatgtcacctcctattagcatggcagaaacctctgctgtgtgcacggcggcttctgttattaggaatgccaaacaaccccttcttatcatcgggaaaggtgctgcttacgctcatgcagaagagagtatcaagaaattggtggagcaatataaactgccatttttgcccacccctatggggaagggtgttgtccctgacaaccatccatactgtgtaggtgcagccagatccagggctttgcaatttgctgatgtaattgtgttatttggtgccagactaaattggattttacattttggactgcctccaagatatcagccagatgtgaagtttatccaggttgatatctgtgcagaagaattggggaataatgtaaagcccgctgttactttgctaggaaacatacatgctgtcactaagcagcttttagaggaacttgataaaacaccatggcagtatcctccagagagcaagtggtggaaaactctgagagaaaaaatgaagagcaatgaagctgcatccaaggaactagcttctaaaaaatccctgcctatgaattattacacagtattctaccatgttcaagaacaactacctagagactgtttcgtggtaagtgaaggagcaaatactatggacattggacggactgtgcttcagaactaccttcctcgtcacaggcttgatgctggtactttcggaacaatgggagttggtttgggatttgctattgcagctgccgtggtggctaaagatagaagccctgggcaatggatcatctgtgtggaaggagacagtgcatttgggttttctggcatggaggtagaaaccatctgcaggtacaacttgccaatcatactgttggtagtgaataacaatggaatttaccaaggttttgatacagatacttggaaagaaatgttaaaatttcaagatgctactgcagtggtccctccaatgtgtttgctgccaaattcacattatgagcaagtcatgactgcatttggaggcaaagggtattttgtacaaacaccagaagaactccaaaaatccctgaggcagagcctagcagacacaactaaaccttctcttatcaacatcatgattgagccacaagccacacggaaggcccaggattttcattggctgacccgctctaatatgtaaataaagacgccagttggtggtcttgagttttctctttcttgcaagatgaaattttattttccacagcaaaattactctactgttaaaattgtgcaaaataaaataaacatttaaaatgacattttacagtaaaggaattgattaaaaacagaaaaagttag

SEQ ID NO: 102604 - DNA, 1771 bp, Homo sapiens
  Payload ID: 20
  Gene Symbol: HACL1
  Gene Name: 2-hydroxyacyl-CoA lyase 1
  ENST ID: ENST00000383779
  CDS Start-End: 95-454
ccagaggtggcgtgctgccgatttcgcgtttgccttgctggatgattccgcttgtttgccggctgcgtgagtgcttagagcttttcggtggaagatgccggacagtaacttcgcagagcgcagcgaggagcaggtgtctggtgctaaagtcatcgctcaggccctgaaaacgcaagatgtggagtacatatttggcatcgtaggcatcccagtgaccgaaatcgccattgctgcccagcagctaggcatcaagtacatcgggatgaggaatgagcaagcggcttgttatgctgcctccgcgattggatatctgacaagcaggccaggagtctgccttgttgtttctggcccaggtctcatccatgccttgggcggtatggcaaatgcaaacatgaactgctggttgaagcttgtagattatataccaagttctctgcccgcccaagcagcatagaagctattccttttgttattgaaaaggcagtgagaagcagtatctatggtcgtccaggtgcttgctatgttgacataccagcagattttgtgaaccttcaggtgaatgtgaattctataaagtacatggaacgctgcatgtcacctcctattagcatggcagaaacctctgctgtgtgcacggcggcttctgttattaggaatgccaaacaaccccttcttatcatcgggaaaggtgctgcttacgctcatgcagaagagagtatcaagaaattggtggagcaatataaactgccatttttgcccacccctatggggaagggtgttgtccctgacaaccatccatactgtgtaggtgcagccagatccaggttgatatctgtgcagaagaattggggaataatgtaaagcccgctgttactttgctaggaaacatacatgctgtcactaagcagcttttagaggaacttgataaaacaccatggcagtatcctccagagagcaagtggtggaaaactctgagagaaaaaatgaagagcaatgaagctgcatccaaggaactagcttctaaaaaatccctgcctatgaattattacacagtattctaccatgttcaagaacaactacctagagactgtttcgtggtaagtgaaggagcaaatactatggacattggacggactgtgcttcagaactaccttcctcgtcacaggcttgatgctggtactttcggaacaatgggagttggtttgggatttgctattgcagctgccgtggtggctaaagatagaagccctgggcaatggatcatctgtgtggaaggagacagtgcatttgggttttctggcatggaggtagaaaccatctgcaggtacaacttgccaatcatactgttggtagtgaataacaatggaatttaccaaggttttgatacagatacttggaaagaaatgttaaaatttcaagatgctactgcagtggtccctccaatgtgtttgctgccaaattcacattatgagcaagtcatgactgcatttggaggcaaagggtattttgtacaaacaccagaagaactccaaaaatccctgaggcagagcctagcagacacaactaaaccttctcttatcaacatcatgattgagccacaagccacacggaaggcccaggattttcattggctgacccgctctaatatgtaaataaagacgccagttggtggtcttgagttttctctttcttgcaagatgaaattttattttccacagcaaaattactctactgttaaaattgtgcaaaataaaataaacatttaaaatga

SEQ ID NO: 102605 - DNA, 1880 bp, Homo sapiens
  Payload ID: 20
  Gene Symbol: HACL1
  Gene Name: 2-hydroxyacyl-CoA lyase 1
  Uniprot ID: Q9UJ83
  ENST ID: ENST00000456194
  CDS Start-End: 107-1762
agaggtgcagtaccagaggtggcgtgctgccgatttcgcgtttgccttgctggatgattccgcttgtttgccggctgcgtgagtgcttagagcttttcggtggaagatgccggacagtaacttcgcagagcgcagcgaggagcaggtgtctggtgctaaagtcatcgctcaggccctgaaaacgcaagatgtggagtacatatttggcatcgtaggcatcccagtgaccgaaatcgccattgctgcccagcagctaggcatcaagtacatcgggatgaggaatgagcaagcggcttgttatgctgcctccgcgattggatatctgacaagcaggcccttgcttgtgattggtggttcctctgaaagaaaccaagaaacaatgggagctttccaggagtttcctcaggttgaagcttgtagattatataccaagttctctgcccgcccaagcagcatagaagctattccttttgttattgaaaaggcagtgagaagcagtatctatggtcgtccaggtgcttgctatgttgacataccagcagattttgtgaaccttcaggtgaatgtgaattctataaagtacatggaacgctgcatgtcacctcctattagcatggcagaaacctctgctgtgtgcacggcggcttctgttattaggaatgccaaacaaccccttcttatcatcgggaaaggtgctgcttacgctcatgcagaagagagtatcaagaaattggtggagcaatataaactgccatttttgcccacccctatggggaagggtgttgtccctgacaaccatccatactgtgtaggtgcagccagatccagggctttgcaatttgctgatgtaattgtgttatttggtgccagactaaattggattttacattttggactgcctccaagatatcagccagatgtgaagtttatccaggttgatatctgtgcagaagaattggggaataatgtaaagcccgctgttactttgctaggaaacatacatgctgtcactaagcagcttttagaggaacttgataaaacaccatggcagtatcctccagagagcaagtggtggaaaactctgagagaaaaaatgaagagcaatgaagctgcatccaaggaactagcttctaaaaaatccctgcctatgaattattacacagtattctaccatgttcaagaacaactacctagagactgtttcgtggtaagtgaaggagcaaatactatggacattggacggactgtgcttcagaactaccttcctcgtcacaggcttgatgctggtactttcggaacaatgggagttggtttgggatttgctattgcagctgccgtggtggctaaagatagaagccctgggcaatggatcatctgtgtggaaggagacagtgcatttgggttttctggcatggaggtagaaaccatctgcaggtacaacttgccaatcatactgttggtagtgaataacaatggaatttaccaaggttttgatacagatacttggaaagaaatgttaaaatttcaagatgctactgcagtggtccctccaatgtgtttgctgccaaattcacattatgagcaagtcatgactgcatttggaggcaaagggtattttgtacaaacaccagaagaactccaaaaatccctgaggcagagcctagcagacacaactaaaccttctcttatcaacatcatgattgagccacaagccacacggaaggcccaggattttcattggctgacccgctctaatatgtaaataaagacgccagttggtggtcttgagttttctctttcttgcaagatgaaattttattttccacagcaaaattactctactgttaaaattgtgcaaaataaaataaacatttaaaatg

SEQ ID NO: 102606 - DNA, 861 bp, Homo sapiens
  Payload ID: 20
  Gene Symbol: HACL1
  Gene Name: 2-hydroxyacyl-CoA lyase 1
  ENST ID: ENST00000421993
  CDS Start-End: 130-861
agttggttgccctcctgtccgtcagaggtgcagtaccagaggtggcgtgctgccgatttcgcgtttgccttgctggatgattccgcttgtttgccggctgcgtgagtgcttagagcttttcggtggaagatgccggacagtaacttcgcagagcgcagcgaggagcaggtgtctggtgctaaagtcatcgctcaggccctgaaaacgcaagatgtggagtacatatttggcatcgtaggcatcccagtgaccgaaatcgccattgctgcccagcagctaggcatcaagtacatcgggatgaggaatgagcaagcggcttgttatgctgcctccgcgattggatatctgacaagcaggcccttgcttgtgattggtggttcctctgaaagaaaccaagaaacaatgggagctttccaggagtttcctcaggttgaagcttgtagattatataccaagttctctgcccgcccaagcagcatagaagctattccttttgttattgaaaaggcagtgagaagcagtatctatggtcgtccaggtgcttgctatgttgacataccagcagattttgtgaaccttcaggtgaatgtgaattctataaagtacatggaacgctgcatgtcacctcctattagcatggcagaaacctctgctgtgtgcacggcggcttctgttattaggaatgccaaacaaccccttcttatcatcgggaaaggtgctgcttacgctcatgcagaagagagtatcaagaaattggtggagcaatataaactgccatttttgcccacccctatggggaagggtgttgtccctgacaaccatccatactgtgtaggtgcagccagatccaggtgtgtggca

SEQ ID NO: 102607 - DNA, 1637 bp, Homo sapiens
  Payload ID: 20
  Gene Symbol: HACL1
  Gene Name: 2-hydroxyacyl-CoA lyase 1
  ENST ID: ENST00000422591
  CDS Start-End: 107-520
agaggtgcagtaccagaggtggcgtgctgccgatttcgcgtttgccttgctggatgattccgcttgtttgccggctgcgtgagtgcttagagcttttcggtggaagatgccggacagtaacttcgcagagcgcagcgaggagcaggtgtctggtgctaaagtcatcgctcaggccctgaaaacgcaagatgtggagtacatatttggcatcgtaggcatcccagtgaccgaaatcgccattgctgcccagcagctaggcatcaagtacatcgggatgaggaatgagcaagcggcttgttatgctgcctccgcgattggatatctgacaagcaggccaggagtctgccttgttgtttctggcccaggtctcatccatgccttgggcggtatggcaaatgcaaacatgaactgctggcccttgcttgtgattggtggttcctctgaaagaaaccaagaaacaatgggagctttccaggagtttcctcaggtacatggaacgctgcatgtcacctcctattagcatggcagaaacctctgctgtgtgcacggcggcttctgttattaggaatgccaaacaaccccttcttatcatcgggaaaggtgctgcttacgctcatgcagaagagagtatcaagaaattggtggagcaatataaactgccatttttgcccacccctatggggaagggtgttgtccctgacaaccatccatactgtgtaggtgcagccagatccagggctttgcaatttgctgatgtaattgtgttatttggtgccagactaaattggattttacattttggactgcctccaagatatcagccagatgtgaagtttatccaggttgatatctgtgcagaagaattggggaataatgtaaagcccgctgttactttgctaggaaacatacatgctgtcactaagcagcttttagaggaacttgataaaacaccatggcagtatcctccagagagcaagtggtggaaaactctgagagaaaaaatgaagagcaatgaagctgcatccaaggaactagcttctaaaaaatccctgcctatgaattattacacagtattctaccatgttcaagaacaactacctagagactgtttcgtggtaagtgaaggagcaaatactatggacattggacggactgtgcttcagaactaccttcctcgtcacaggcttgatgctggtactttcggaacaatgggagttggtttgggatttgctattgcagctgccgtggtggctaaagatagaagccctgggcaatggatcatctgtgtggaaggagacagtgcatttgggttttctggcatggaggtagaaaccatctgcaggtacaacttgccaatcatactgttggtagtgaataacaatggaatttaccaaggttttgatacagatacttggaaagaaatgttaaaatttcaagatgctactgcagtggtccctccaatgtgtttgctgccaaattcacattatgagcaagtcatgactgcatttggaggcaaagggtattttgtacaaacaccagaagaactccaaaaatccctgaggcagagcctagcagacacaactaaaccttctcttatcaacatcatgattgagccacaagccacacggaaggcccag

SEQ ID NO: 102608 - DNA, 1269 bp, Homo sapiens
  Payload ID: 20
  Gene Symbol: HACL1
  Gene Name: 2-hydroxyacyl-CoA lyase 1
  ENST ID: ENST00000435217
  CDS Start-End: 107-1120
agaggtgcagtaccagaggtggcgtgctgccgatttcgcgtttgccttgctggatgattccgcttgtttgccggctgcgtgagtgcttagagcttttcggtggaagatgccggacagtaacttcgcagagcgcagcgaggagcaggtgtctggtgctaaagtcatcgctcaggccctgaaaacgcaagatgtggagtacatatttggcatcgtaggcatcccagtgaccgaaatcgccattgctgcccagcagctaggcatcaagtacatcgggatgaggaatgagcaagcggttgatatctgtgcagaagaattggggaataatgtaaagcccgctgttactttgctaggaaacatacatgctgtcactaagcagcttttagaggaacttgataaaacaccatggcagtatcctccagagagcaagtggtggaaaactctgagagaaaaaatgaagagcaatgaagctgcatccaaggaactagcttctaaaaaatccctgcctatgaattattacacagtattctaccatgttcaagaacaactacctagagactgtttcgtggtaagtgaaggagcaaatactatggacattggacggactgtgcttcagaactaccttcctcgtcacaggcttgatgctggtactttcggaacaatgggagttggtttgggatttgctattgcagctgccgtggtggctaaagatagaagccctgggcaatggatcatctgtgtggaaggagacagtgcatttgggttttctggcatggaggtagaaaccatctgcaggtacaacttgccaatcatactgttggtagtgaataacaatggaatttaccaaggttttgatacagatacttggaaagaaatgttaaaatttcaagatgctactgcagtggtccctccaatgtgtttgctgccaaattcacattatgagcaagtcatgactgcatttggaggcaaagggtattttgtacaaacaccagaagaactccaaaaatccctgaggcagagcctagcagacacaactaaaccttctcttatcaacatcatgattgagccacaagccacacggaaggcccaggattttcattggctgacccgctctaatatgtaaataaagacgccagttggtggtcttgagttttctctttcttgcaagatgaaattttattttccacagcaaaattactctactgttaaaattgtgcaaaataaaataaacatttaaaatgacattttacagtaaaggaattgattaaaaac

SEQ ID NO: 102609 - DNA, 569 bp, Homo sapiens
  Payload ID: 20
  Gene Symbol: HACL1
  Gene Name: 2-hydroxyacyl-CoA lyase 1
  ENST ID: ENST00000414979
  CDS Start-End: 99-569
agtaccagaggtggcgtgctgccgatttcgcgtttgccttgctggatgattccgcttgtttgccggctgcgtgagtgcttagagcttttcggtggaagatgccggacagtaacttcgcagagcgcagcgaggagcaggtgtctggtgctaaagtcatcgctcaggccctgaaaacgcaagatgtggagtacatatttggcatcgtaggcatcccagtgaccgaaatcgccattgctgcccagcagctaggcatcaagtacatcgggatgaggaatgagcaagcggttgaagcttgtagattatataccaagttctctgcccgcccaagcagcatagaagctattccttttgttattgaaaaggcagtgagaagcagtatctatggtcgtccaggtgcttgctatgttgacataccagcagattttgtgaaccttcaggtgaatgtgaattctataaagtacatggaacgctgcatgtcacctcctattagcatggcagaaacctctgctgtgtgcacggcggcttctgttattaggaatgccaaacaaccccttcttatcatcgggaaa

SEQ ID NO: 102610 - DNA, 1734 bp, Homo sapiens
  Payload ID: 20
  Gene Symbol: HACL1
  Gene Name: 2-hydroxyacyl-CoA lyase 1
  Uniprot ID: Q9UJ83
  ENST ID: ENST00000451445
  CDS Start-End: 125-1615
gttgccctcctgtccgtcagaggtgcagtaccagaggtggcgtgctgccgatttcgcgtttgccttgctggatgattccgcttgtttgccggctgcgtgagtgcttagagcttttcggtggaagatgccggacagtaacttcgcagagcgcagcgaggagcaggtgtctggtgctaaagtcatcgctcaggccctgaaaacgcaagatgtggagtacatatttggcatcgtaggcatcccagtgaccgaaatcgccattgctgcccagcagctaggcatcaagtacatcgggatgaggaatgagcaagcggcttgttatgctgcctccgcgattggatatctgacaagcaggccaggagtctgccttgttgtttctggcccaggtctcatccatgccttgggcggtatggcaaatgcaaacatgaactgctggtacatggaacgctgcatgtcacctcctattagcatggcagaaacctctgctgtgtgcacggcggcttctgttattaggaatgccaaacaaccccttcttatcatcgggaaaggtgctgcttacgctcatgcagaagagagtatcaagaaattggtggagcaatataaactgccatttttgcccacccctatggggaagggtgttgtccctgacaaccatccatactgtgtaggtgcagccagatccagggctttgcaatttgctgatgtaattgtgttatttggtgccagactaaattggattttacattttggactgcctccaagatatcagccagatgtgaagtttatccaggttgatatctgtgcagaagaattggggaataatgtaaagcccgctgttactttgctaggaaacatacatgctgtcactaagcagcttttagaggaacttgataaaacaccatggcagtatcctccagagagcaagtggtggaaaactctgagagaaaaaatgaagagcaatgaagctgcatccaaggaactagcttctaaaaaatccctgcctatgaattattacacagtattctaccatgttcaagaacaactacctagagactgtttcgtggtaagtgaaggagcaaatactatggacattggacggactgtgcttcagaactaccttcctcgtcacaggcttgatgctggtactttcggaacaatgggagttggtttgggatttgctattgcagctgccgtggtggctaaagatagaagccctgggcaatggatcatctgtgtggaaggagacagtgcatttgggttttctggcatggaggtagaaaccatctgcaggtacaacttgccaatcatactgttggtagtgaataacaatggaatttaccaaggttttgatacagatacttggaaagaaatgttaaaatttcaagatgctactgcagtggtccctccaatgtgtttgctgccaaattcacattatgagcaagtcatgactgcatttggaggcaaagggtattttgtacaaacaccagaagaactccaaaaatccctgaggcagagcctagcagacacaactaaaccttctcttatcaacatcatgattgagccacaagccacacggaaggcccaggattttcattggctgacccgctctaatatgtaaataaagacgccagttggtggtcttgagttttctctttcttgcaagatgaaattttattttccacagcaaaattactctactgttaaaattgtgcaaaataaaataaacatttaaaatga

SEQ ID NO: 102611 - DNA, 1721 bp, Homo sapiens
  Payload ID: 20
  Gene Symbol: HACL1
  Gene Name: 2-hydroxyacyl-CoA lyase 1
  Uniprot ID: Q9UJ83
  ENST ID: ENST00000457447
  CDS Start-End: 107-1663
agaggtgcagtaccagaggtggcgtgctgccgatttcgcgtttgccttgctggatgattccgcttgtttgccggctgcgtgagtgcttagagcttttcggtggaagatgccggacagtaacttcgcagagcgcagcgaggagcaggtgtctggtgctaaagtcatcgctcaggccctgaaaacgcaagatgtggagtacatatttggcatcgtaggcatcccagtgaccgaaatcgccattgctgcccagcagctaggcatcaagtacatcgggatgaggaatgagcaagcggcttgttatgctgcctccgcgattggatatctgacaagcaggccaggagtctgccttgttgtttctggcccaggtctcatccatgccttgggcggtatggcaaatgcaaacatgaactgctggcccttgcttgtgattggtggttcctctgaaagaaaccaagaaacaatgggagctttccaggagtttcctcaggcagtgagaagcagtatctatggtcgtccaggtgcttgctatgttgacataccagcagattttgtgaaccttcaggtgaatgtgaattctataaagtacatggaacgctgcatgtcacctcctattagcatggcagaaacctctgctgtgtgcacggcggcttctgttattaggaatgccaaacaaccccttcttatcatcgggaaaggtgctgcttacgctcatgcagaagagagtatcaagaaattggtggagcaatataaactgccatttttgcccacccctatggggaagggtgttgtccctgacaaccatccatactgtgtaggtgcagccagatccagggctttgcaatttgctgatgtaattgtgttatttggtgccagactaaattggattttacattttggactgcctccaagatatcagccagatgtgaagtttatccaggttgatatctgtgcagaagaattggggaataatgtaaagcccgctgttactttgctaggaaacatacatgctgtcactaagcaggaactagcttctaaaaaatccctgcctatgaattattacacagtattctaccatgttcaagaacaactacctagagactgtttcgtggtaagtgaaggagcaaatactatggacattggacggactgtgcttcagaactaccttcctcgtcacaggcttgatgctggtactttcggaacaatgggagttggtttgggatttgctattgcagctgccgtggtggctaaagatagaagccctgggcaatggatcatctgtgtggaaggagacagtgcatttgggttttctggcatggaggtagaaaccatctgcaggtacaacttgccaatcatactgttggtagtgaataacaatggaatttaccaaggttttgatacagatacttggaaagaaatgttaaaatttcaagatgctactgcagtggtccctccaatgtgtttgctgccaaattcacattatgagcaagtcatgactgcatttggaggcaaagggtattttgtacaaacaccagaagaactccaaaaatccctgaggcagagcctagcagacacaactaaaccttctcttatcaacatcatgattgagccacaagccacacggaaggcccaggattttcattggctgacccgctctaatatgtaaataaagacgccagttggtggtcttgagttttctctttcttgcaagatgaaattttatt

SEQ ID NO: 102612 - DNA, 2214 bp, Homo sapiens
  Payload ID: 20
  Gene Symbol: HACL1
  Gene Name: 2-hydroxyacyl-CoA lyase 1
  ENST ID: ENST00000628377
  CDS Start-End: 390-749
attctccctttacagccccgaaaacgctccagctggccgactcggagacaatggcgagaggcctcagagttcggcttcttacctgctttgcataggcagcaatctcctgctagtcccgcctccctctggcattctggcgcgcgaatggaggagccgagaagagagcgcagttctgattggagaacgcgcgtgtttacattctcacctctcccgggaagtggacgaatttagaccgcctcttccttcccgttgtttaaggcagttggttgccctcctgtccgtcagaggtgcagtaccagaggtggcgtgctgccgatttcgcgtttgccttgctggatgattccgcttgtttgccggctgcgtgagtgcttagagcttttcggtggaagatgccggacagtaacttcgcagagcgcagcgaggagcaggtgtctggtgctaaagtcatcgctcaggccctgaaaacgcaagatgtggagtacatatttggcatcgtaggcatcccagtgaccgaaatcgccattgctgcccagcagctaggcatcaagtacatcgggatgaggaatgagcaagcggcttgttatgctgcctccgcgattggatatctgacaagcaggccaggagtctgccttgttgtttctggcccaggtctcatccatgccttgggcggtatggcaaatgcaaacatgaactgctggttgaagcttgtagattatataccaagttctctgcccgcccaagcagcatagaagctattccttttgttattgaaaaggcagtgagaagcagtatctatggtcgtccaggtgcttgctatgttgacataccagcagattttgtgaaccttcaggtgaatgtgaattctataaagtacatggaacgctgcatgtcacctcctattagcatggcagaaacctctgctgtgtgcacggcggcttctgttattaggaatgccaaacaaccccttcttatcatcgggaaaggtgctgcttacgctcatgcagaagagagtatcaagaaattggtggagcaatataaactgccatttttgcccacccctatggggaagggtgttgtccctgacaaccatccatactgtgtaggtgcagccagatccagggctttgcaatttgctgatgtaattgtgttatttggtgccagactaaattggattttacattttggactgcctccaagatatcagccagatgtgaagtttatccaggttgatatctgtgcagaagaattggggaataatgtaaagcccgctgttactttgctaggaaacatacatgctgtcactaagcagcttttagaggaacttgataaaacaccatggcagtatcctccagagagcaagtggtggaaaactctgagagaaaaaatgaagagcaatgaagctgcatccaaggaactagcttctaaaaaatccctgcctatgaattattacacagtattctaccatgttcaagaacaactacctagagactgtttcgtggtaagtgaaggagcaaatactatggacattggacggactgtgcttcagaactaccttcctcgtcacaggcttgatgctggtactttcggaacaatgggagttggtttgggatttgctattgcagctgccgtggtggctaaagatagaagccctgggcaatggatcatctgtgtggaaggagacagtgcatttgggttttctggcatggaggtagaaaccatctgcaggtacaacttgccaatcatactgttggtagtgaataacaatggaatttaccaaggttttgatacagatacttggaaagaaatgttaaaatttcaagatgctactgcagtggtccctccaatgtgtttgctgccaaattcacattatgagcaagtcatgactgcatttggaggcaaagggtattttgtacaaacaccagaagaactccaaaaatccctgaggcagagcctagcagacacaactaaaccttctcttatcaacatcatgattgagccacaagccacacggaaggcccaggattttcattggctgacccgctctaatatgtaaataaagacgccagttggtggtcttgagttttctctttcttgcaagatgaaattttattttccacagcaaaattactctactgttaaaattgtgcaaaataaaataaacatttaaaatgacattttacagtaaaggaattgattaaaaacagaaaaagttag

SEQ ID NO: 102613 - DNA, 2415 bp, Homo sapiens
  Payload ID: 21
  Gene Symbol: OGFOD1
  Gene Name: 2-oxoglutarate and iron-dependent oxygenase domain containing 1
  ENST ID: ENST00000336111
  CDS Start-End: 56-175
cacgataaaggggacatgccgggagttgcagtaccctcaggaagaagtcattgtcatggacatggacccttttcttcactgtgtgatcccaaacttcatccaaagccaagacttcttagaagggcttcagaaggaactgatgaacttggacttccatgagaatctgatgatttgaagaagagaagagagcctcacatctccactttaaggaaaattctgtttgaagatttccggtcctggctttctgatatttctaaaattgacctggaatcaaccattgacatgtcctgtgctaaatatgaattcactgatgccctgctgtgccatgatgatgagctggaagggcgccggattgccttcatcctgtacctggttcctccctgggacaggagcatgggtggtaccctggacctgtacagcattgatgaacactttcagccgaagcagattgtcaagtctcttatcccttcgtggaacaaactggttttctttgaagtatctcctgtgtcctttcaccaggtgtctgaagtgctgtctgaagaaaagtcacgtttgtctataagtggctggtttcatggtccatcattgactcggcctcccaactactttgaaccccccatacctcggagccctcacatcccacaagatcatgagattttgtatgattggatcaaccctacttatctggacatggattaccaagttcaaattcaagaagagtttgaagaaagttctgaaattctcctgaaggagtttcttaagcctgagaaattcacgaaagtctgtgaggccttggagcatggacatgtggaatggagcagccgaggtccccctaacaaaaggttttatgagaaagctgaggagagtaagcttcctgagatattgaaggagtgcatgaagttatttcgctctgaggcactattcttgctgctctccaacttcacaggcctgaagcttcatttcttggccccttcggaagaagatgagatgaatgataaaaaagaggcagaaaccactgatatcactgaagaagggactagccatagtcctcctgagccagagaataatcagatggccatcagcaacaacagccaacagagcaatgagcagacagacccagagccagaggaaaatgaaacaaagaaagaatcaagtgttcccatgtgccaaggggaactgaggcattggaagaccggtcactacactttaattcatgaccatagcaaggctgaatttgccctagacttaattctgtactgtggctgtgaaggctgggagccagaatatggcggttttacttcttacattgccaaaggtgaagatgaagagctgctaacagtgaatccagaaagcaattctttggcattggtctacagagacagagagactctgaaatttgtcaagcatattaaccaccgaagcctggaacaaaagaaaaccttcccaaacagaacaggtttctgggacttttcattcatctattatgaatgacagcactgggcaaagctgaacaaaaatgtgacccttcgtaattactgggaagtctgaaagagctaagcatggagtcaaggagaactacatggtagcttgcctgacagtgttcttaaaactggttgtcttttactaggactcataatgattgtcctcaaccgagaccttgagcttgcagctaagtacttatctcttgattaaaaaaaaaaagttggcttttttttttttaacatttagtcctttttccatattggcttcttcagtgaatttttaagttcaatttgtttttattgaggtaaaatatttataacataaaactgaccagcttacccatttttaaatatgcaattcagtggattaagtacattctcattgttgtccagccatcaccatcatccatctccagaagttttccatcttcccaaattctgtgcccattgaacaataactccccacctccccttcccctagcaacagccataccttttgtctctatcatcaacttcactactcatatttctcatgtaagtggaatcatacagtatttgtccttttgtgactggtttcacttagcataaagtctttaagatgcatccatgtttccagtgtttcggtttttttagaaaaactcatacgtgattgcagccgggcatggtggctcacgcctgtaatcccagcacttgggaggccaaggcaggcggatcacctgaggtcaggagttaaagaccagcctgacaaacatggagaaaccccatctctactaaaaatacaaaattagctgggcgtggtggcacatgcctgtaatcccagctactcaggaggctggggcaggagaattggttgaacccaggaggcggaggttgcagtgagccgagattgtgccactgcactccagcctgggcaacaagagtgaaactctgtctc

SEQ ID NO: 102614 - DNA, 474 bp, Homo sapiens
  Payload ID: 21
  Gene Symbol: OGFOD1
  Gene Name: 2-oxoglutarate and iron-dependent oxygenase domain containing 1
  ENST ID: ENST00000569802
  CDS Start-End: 59-199
aaacacgataaaggggacatgccgggagttgcagtaccctcaggaagaagtcattgtcatggacatggacccttttcttcactgtgtgatcccaaacttcatccaaagccaagacttcttagaagggcttcagaaggaactgatgaacttggacttccatgagaagtataatgatttatataagttccagcagagctgattggtcagatggttgtatcctgaccttccccagatctttctgtctttggaccttatacacatgactgaattaaccaggataaatacatgaaagatatgactcttaataattcagaaagctgaaaactaaactgctttccatggaaaattctgtttgaagatttccggtcctggctttctgatatttctaaaattgacctggaatcaaccattgacatgtcctgtgctaaatatgaattcactgatgccctgctgtgccatgatgatgagctggaa

SEQ ID NO: 102615 - DNA, 567 bp, Homo sapiens
  Payload ID: 21
  Gene Symbol: OGFOD1
  Gene Name: 2-oxoglutarate and iron-dependent oxygenase domain containing 1
  ENST ID: ENST00000565682
  CDS Start-End: 91-420
acacgataaaggggacatgccgggagttgcagtaccctcaggaaggtagcgtcttgatctgcgtggcgtggttctgtgccttgggaagagatgaatgggaagcggccagcggagcccggcccagcccgggtgggaaaaaagggaaagaaggaggtgatggcggagttttcggacgctgttacggaagaaaccttgaaaaagcaggtggctgaggcctggagccgcaggacgccgttcagtcacgaagtcattgtcatggacatggacccttttcttcactgtgtgatcccaaacttcatccaaagccaagacttcttagaagggcttcagaaggaactgatgaacttggacttccatgagaagtataatgatttatataagttccagcaggaaatcccttttttttctctattttcatgatcaagtctgatgatttgaagaagagaagagagcctcacatctccactttaaggaaaattctgtttgaagatttccggtcctggctttctgatatttctaaaattgacctggaatcaaccattgacatgtcctgtgctaaatatgaat

SEQ ID NO: 102616 - DNA, 586 bp, Homo sapiens
  Payload ID: 21
  Gene Symbol: OGFOD1
  Gene Name: 2-oxoglutarate and iron-dependent oxygenase domain containing 1
  ENST ID: ENST00000562150
  CDS Start-End: 93-586
aaacacgataaaggggacatgccgggagttgcagtaccctcaggaaggtagcgtcttgatctgcgtggcgtggttctgtgccttgggaagagatgaatgggaagcggccagcggagcccggcccagcccgggtgggaaaaaagggaaagaaggaggtgatggcggagttttcggacgctgttacggaagaaaccttgaaaaagcaggtggctgaggcctggagccgcaggacgccgttcaaagtcattgtcatggacatggacccttttcttcactgtgtgatcccaaacttcatccaaagccaagacttcttagaagggcttcagaaggaactgatgaacttggacttccatgagaagtataatgatttatataagttccagcagtctgatgatttgaagaagagaagagagcctcacatctccactttaaggaaaattctgtttgaagatttccggtcctggctttctgatatttctaaaattgacctggaatcaaccattgacatgtcctgtgctaaatatgaattcactgatgccctgctgtgccatgatgatgagctggaagggcgccggattgccttcat

SEQ ID NO: 102617 - DNA, 4647 bp, Homo sapiens
  Payload ID: 21
  Gene Symbol: OGFOD1
  Gene Name: 2-oxoglutarate and iron-dependent oxygenase domain containing 1
  Uniprot ID: Q8N543
  ENST ID: ENST00000566157
  CDS Start-End: 124-1752
actttggtgcttcccattgggtagggccgggaaacacgataaaggggacatgccgggagttgcagtaccctcaggaaggtagcgtcttgatctgcgtggcgtggttctgtgccttgggaagagatgaatgggaagcggccagcggagcccggcccagcccgggtgggaaaaaagggaaagaaggaggtgatggcggagttttcggacgctgttacggaagaaaccttgaaaaagcaggtggctgaggcctggagccgcaggacgccgttcagtcacgaagtcattgtcatggacatggacccttttcttcactgtgtgatcccaaacttcatccaaagccaagacttcttagaagggcttcagaaggaactgatgaacttggacttccatgagaagtataatgatttatataagttccagcagtctgatgatttgaagaagagaagagagcctcacatctccactttaaggaaaattctgtttgaagatttccggtcctggctttctgatatttctaaaattgacctggaatcaaccattgacatgtcctgtgctaaatatgaattcactgatgccctgctgtgccatgatgatgagctggaagggcgccggattgccttcatcctgtacctggttcctccctgggacaggagcatgggtggtaccctggacctgtacagcattgatgaacactttcagccgaagcagattgtcaagtctcttatcccttcgtggaacaaactggttttctttgaagtatctcctgtgtcctttcaccaggtgtctgaagtgctgtctgaagaaaagtcacgtttgtctataagtggctggtttcatggtccatcattgactcggcctcccaactactttgaaccccccatacctcggagccctcacatcccacaagatcatgagattttgtatgattggatcaaccctacttatctggacatggattaccaagttcaaattcaagaagagtttgaagaaagttctgaaattctcctgaaggagtttcttaagcctgagaaattcacgaaagtctgtgaggccttggagcatggacatgtggaatggagcagccgaggtccccctaacaaaaggttttatgagaaagctgaggagagtaagcttcctgagatattgaaggagtgcatgaagttatttcgctctgaggcactattcttgctgctctccaacttcacaggcctgaagcttcatttcttggccccttcggaagaagatgagatgaatgataaaaaagaggcagaaaccactgatatcactgaagaagggactagccatagtcctcctgagccagagaataatcagatggccatcagcaacaacagccaacagagcaatgagcagacagacccagagccagaggaaaatgaaacaaagaaagaatcaagtgttcccatgtgccaaggggaactgaggcattggaagaccggtcactacactttaattcatgaccatagcaaggctgaatttgccctagacttaattctgtactgtggctgtgaaggctgggagccagaatatggcggttttacttcttacattgccaaaggtgaagatgaagagctgctaacagtgaatccagaaagcaattctttggcattggtctacagagacagagagactctgaaatttgtcaagcatattaaccaccgaagcctggaacaaaagaaaaccttcccaaacagaacaggtttctgggacttttcattcatctattatgaatgacagcactgggcaaagctgaacaaaaatgtgacccttcgtaattactgggaagtctgaaagagctaagcatggagtcaaggagaactacatggtagcttgcctgacagtgttcttaaaactggttgtcttttactaggactcataatgattgtcctcaaccgagaccttgagcttgcagctaagtacttatctcttgattaaaaaaaaaaagttggcttttttttttttaacatttagtcctttttccatattggcttcttcagtgaatttttaagttcaatttgtttttattgaggtaaaatatttataacataaaactgaccagcttacccatttttaaatatgcaattcagtggattaagtacattctcattgttgtccagccatcaccatcatccatctccagaagttttccatcttcccaaattctgtgcccattgaacaataactccccacctccccttcccctagcaacagccataccttttgtctctatcatcaacttcactactcatatttctcatgtaagtggaatcatacagtatttgtccttttgtgactggtttcacttagcataaagtctttaagatgcatccatgtttccagtgtttcggtttttttagaaaaactcatacgtgattgcagccgggcatggtggctcacgcctgtaatcccagcacttgggaggccaaggcaggcggatcacctgaggtcaggagttaaagaccagcctgacaaacatggagaaaccccatctctactaaaaatacaaaattagctgggcgtggtggcacatgcctgtaatcccagctactcaggaggctggggcaggagaattggttgaacccaggaggcggaggttgcagtgagccgagattgtgccactgcactccagcctgggcaacaagagtgaaactctgtctcaaaaaaaaaaaagaagaaaaaaacataagtgattgcagaattttgttcttctcataatttctggtttagaaaattatggagccttacatcctgatcatgctgggccttagaattctgacacagtgagtcatcacatttcctcccactgcctgtggccttgttccaccatgactctcacagtacagtgtaggcttagtgtagtattattcccttggaaagggtctggcctaccatcacatgccccaagaaacttctggttggtaaagaagataggctgcttattgccatgtgtagtcacttccaagtgcccactgcctttccatcctgcaattgtggcctgtgtataattaaatgattttagcctcacgtgttgcttctgttttcctaaatactgtagggtcaactatataactaattgctttttattttaagagacggaatgctaaaaccacatcagaatgccaagaggctgtgcatcttgttaatttttttcttgaactgttccagggagttacatcataattacctgtgtgtgggtatgcatgggtggatgaaagatgctgttctcattccatcccaatagagtcttctgtttcctttctcttttttacatttatttttagcttttgcagtagtgtttagtgtgggttttactaattaatagaaaaagcactgggcctttaaacttcttaactactcttctctttcatctcctaaaacttttgagtattcattcttttctgaagtttgcatttaaatgaaaatgactttcgctttggcttttaggtttagtttcaaaaaggtttaattctgcaccctagccagttaagaaatgttttagcaggtatgcccttgatatggatatttatatattttacacatgtagtaatattatttctataacttactgttataaaacactaatttttaaatgatgagataaaaagaaatatctagaactagttctaacattgtcttcccctatgcatatggtaacgaaccattttacaccatactattttggagaccacaattttttttgcgtttgagatggagtctcactctgtggcccaggctggagtacagtggcatgatatcggctcactgtgacctctgtctcctgggttcaagcaattctcctgcctcagcctcctaagtagctgggattacaggcacctgcctccatacccagctaatttttttatatttttagtagagacagggtttcaccatgttggccaggctggagaccacaattttttaaccacagtgtagcaacactcaagtgggattgcgaatactgttactaatggttaatgtcacagcttgccttttctatattccagctgactaaaggtcatctcactcacttgccttctgatgtgttttcatgagttgaggggaaagggtgtcagtggcataacttcaggaagacccagggaaaagtgcttgggtaggtgaaactgtcatgtgtgccaagcttggaaaatagtttgagactcatggctgtaggcaccatccaaggccaattttccaattctggaaagccaaatctgaatcttagaatacctcacaagtgttaaaatgtgctttttagtgtctcctttatctcagtgtgtttatgatctgtcaacacataatcatcttttatacactacaaaaagggactcgggtgtctgaggggagagaatccctaggagcccaactctgatgttgctgtcagttacatcatctacagcagcacctcttagattgtgaaggatggtgtaacttaaaagattgtgtttctgcactgaagatagatacacagtgatagtgaagtttgttttccttatagtacttcattttgcatcttgattgctttttagggcctggggccaatgtcaacaactcttaggtagcaaaagaagaattagaacatgggcatcttttttatacctctttcagataaaagctatgatgttcacctgt

SEQ ID NO: 102618 - DNA, 584 bp, Homo sapiens
  Payload ID: 21
  Gene Symbol: OGFOD1
  Gene Name: 2-oxoglutarate and iron-dependent oxygenase domain containing 1
  ENST ID: ENST00000561646
  CDS Start-End: 59-584
aaacacgataaaggggacatgccgggagttgcagtaccctcaggaagaagtcattgtcatggacatggacccttttcttcactgtgtgatcccaaacttcatccaaagccaagacttcttagaagggcttcagaaggaactgatgaacttggacttccatgagaagtataatgatttatataagttccagcagtctgatgatttgaagaagagaagagagcctcacatctccactttaaggaaaattctgtttgaagatttccggtcctggctttctgatatttctaaaattgacctggaatcaaccattgacatgtcctgtgctaaatatgaattcactgatgccctgctgtgccatgatgatgagctggaagggcgccggattgccttcatcctgtacctggttcctccctgggacaggagcatgggtggtaccctggacctgtacagcattgatgaacactttcagccgaagcagattgtcaagtctcttatcccttcgtggaacaaactggttttctttgaagtatctcctgtgtcctttcaccaggtgtctgaagtgctgtctgaagaaaagtcacgtt

SEQ ID NO: 102619 - DNA, 1681 bp, Homo sapiens
  Payload ID: 21
  Gene Symbol: OGFOD1
  Gene Name: 2-oxoglutarate and iron-dependent oxygenase domain containing 1
  ENST ID: ENST00000568397
  CDS Start-End: 52-1551
aggaaggtagcgtcttgatctgcgtggcgtggttctgtgccttgggaagagatgaatgggaagcggccagcggagcccggcccagcccgggtgggaaaaaagggaaagaaggaggtgatggcggagttttcggacgctgttacggaagaaaccttgaaaaagcaggtggctgaggcctggagccgcaggacgccgttcagtcacgaagtcattgtcatggacatggacccttttcttcactgtgtgatcccaaacttcatccaaagccaagacttcttagaagggcttcagaaggaactgatgaacttggacttccatgagaagtataatgatttatataagttccagcagtctgatgatttgaagaagagaagagagcctcacatctccactttaaggaaaattctgtttgaagatttccggtcctggctttctgatatttctaaaattgacctggaatcaaccattgacatgtcctgtgctaaatatgaattcactgatgccctgctgtgccatgatgatgagctggaagggcgccggattgccttcatcctgtacctggttcctccctgggacaggagcatgggtggtaccctggacctgtacagcattgatgaacactttcagccgaagcagattgtcaagtctcttatcccttcgtggaacaaactggttttctttgaagtatctcctgtgtcctttcaccagcatgagattttgtatgattggatcaaccctacttatctggacatggattaccaagttcaaattcaagaagagtttgaagaaagttctgaaattctcctgaaggagtttcttaagcctgagaaattcacgaaagtctgtgaggccttggagcatggacatgtggaatggagcagccgaggtccccctaacaaaaggttttatgagaaagctgaggagagtaagcttcctgagatattgaaggagtgcatgaagttatttcgctctgaggcactattcttgctgctctccaacttcacaggcctgaagcttcatttcttggccccttcggaagaagatgagatgaatgataaaaaagaggcagaaaccactgatatcactgaagaagggactagccatagtcctcctgagccagagaataatcagatggccatcagcaacaacagccaacagagcaatgagcagacagacccagagccagaggaaaatgaaacaaagaaagaatcaagtgttcccatgtgccaaggggaactgaggcattggaagaccggtcactacactttaattcatgaccatagcaaggctgaatttgccctagacttaattctgtactgtggctgtgaaggctgggagccagaatatggcggttttacttcttacattgccaaaggtgaagatgaagagctgctaacagtgaatccagaaagcaattctttggcattggtctacagagacagagagactctgaaatttgtcaagcatattaaccaccgaagcctggaacaaaagaaaaccttcccaaacagaacaggtttctgggacttttcattcatctattatgaatgacagcactgggcaaagctgaacaaaaatgtgacccttcgtaattactgggaagtctgaaagagctaagcatggagtcaaggagaactacatggtagcttgcctgacagtgttcttaaaactggttgtcttt

SEQ ID NO: 102620 - DNA, 1780 bp, Homo sapiens
  Payload ID: 22
  Gene Symbol: OGFOD2
  Gene Name: 2-oxoglutarate and iron-dependent oxygenase domain containing 2
  Uniprot ID: Q6N063
  ENST ID: ENST00000228922
  CDS Start-End: 33-1085
acggaagctggtagggctgtgggtgcttcactatggcgacggtgggggctccgcggcacttctgccgctgcgcctgcttctgcaccgataacttgtacgtggcgcgctatgggctgcacgtgcgcttccgaggcgagcagcagctgcgccgggactacggcccgatcctgcgcagccgaggctgtgttagcgccaaggacttccagcagctgttagcagagcttgagcaggaggtggagcggcggcagcggctggggcaggagtcagcagctaggaaagccctcatcgcgagttcctaccacccggcacggcctgaggtctacgactcactgcaggatgcagctctggcccccgagttcctggccgtgactgagtacagcgtgtccccagacgcagacctcaagggccttctccagcggctggagacagtatcggaggagaagcgcatctaccgggtgcctgttttcacagcgcccttctgccaggccctgctggaagagctggagcacttcgagcaatcggacatgcctaaggggaggcccaacaccatgaacaactacggggtgctgctgcacgagctcgggctggacgagccgctgatgacaccactgcgggagcgcttcctgcagccgctgatggccctgctgtaccctgactgtggcgggggccggctcgacagccaccgggcctttgtggtcaaatacgcaccgggccaggacctggagctgggctgccactatgataatgccgagctcaccctcaatgtggccttgggcaaggtcttcacagggggcgccctgtattttgggggcctcttccaggcacccacagccctgacggagcccctggaggtggagcacgtggtgggccagggtgtcctccaccgtggcggccagctgcatggagcccggcccttgggcactggtgagcgttggaaccttgtcgtctggctccgagcctctgctgtgcgcaacagcctctgtcccatgtgctgccgtgagcccgacctggtggacgatgagggcttcggtgatggcttcacccgagaggagcccgccacggtggatgtatgtgcgctcacctgagcttgcttgggcccagtgtgggggtggcaggcaggtgagggctccgttgccttggtctgggggcagaaataaaatccccgcagcctactgcacttcttggctcaacggtgtgccagcttctgggtcattctatgggcaaagatgctgccttagttcaggtttgtcagaagcagggtctggaatggggcttcagcgagggagtcagggaagcaggggaggggagggagcagctgggcaaggaagtggcttcagaggacgtccagcctcagctggccccacggagagctccaggcagagcccacagtaccacagtgtgcccacaccaccggttactggctcctggatgagggggccagagaggagtgaataacttcccagacacttatctccagggcagggtgccttccagtagccaagggaagcctccagagagcacagatgtgaaccctcagcagcaggcatcaccccccagtggactcgggtgggccaccagtagcatcttctagatggcagaggggtgaatggcagggccaggaaccaggctgcccgggttcccattctgcttctgccacttccagctgtgtggctttaggtgagccttcaccttttggtgccttcgtttcctcatttagcacctacctcctagagctgttttgggagtcaaatgcgctgacgtatataaagtgctttgcaag

SEQ ID NO: 102621 - DNA, 2308 bp, Homo sapiens
  Payload ID: 22
  Gene Symbol: OGFOD2
  Gene Name: 2-oxoglutarate and iron-dependent oxygenase domain containing 2
  Uniprot ID: Q6N063
  ENST ID: ENST00000397389
  CDS Start-End: 740-1612
tgcaagagttgtcatttgttggctgcggtgagaccacgccccgtcgccctcccacacctgaccccgccctcccgcgtccattgggaacgccaccggaagtaatgcgagacggagcgttttggtggagacactcactggggcaatctgaggtaatccaacagactgtggcggagggaccggaagcgccaggcagggacccggggtagatgctaaatccaaactgaaacgtacagggctggatgattgaagcaccagcgggaactagtcggacctccgagctctttaaactgtcctcagctcggctggttctccacgagctccgggcagacggcggggggtgggtcggcgtttaagtcaaaggccttggggctccgagtcccttcctctccccgtcctgtgaaggcacgacccagttcagctgtctgtaaagtggagccattagtccctgcctcgtagtgggaaaactgggaggcggaacgaggaggccgccggtcccaacccggcccaggagcatctttctccgcagaccgtttcctggcgagatcctgcgcagccgaggctgtgttagcgccaaggacttccagcagctgttagcagaggctgctgccagggctgctgccccactccctcctcctccttcccctggagtcagtggtgggaagcttcccaggagagtcctcagcaacctctggaacacaggacttggccatgactgtctcctgtccctgtgtgggcccagatggttgagcttgagcaggaggtggagcggcggcagcggctggggcaggagtcagcagctaggaaagccctcatcgcgagttcctaccacccggcacggcctgaggtctacgactcactgcaggatgcagctctggcccccgagttcctggccgtgactgagtacagcgtgtccccagacgcagacctcaagggccttctccagcggctggagacagtatcggaggagaagcgcatctaccgggtgcctgttttcacagcgcccttctgccaggccctgctggaagagctggagcacttcgagcaatcggacatgcctaaggggaggcccaacaccatgaacaactacggggtgctgctgcacgagctcgggctggacgagccgctgatgacaccactgcgggagcgcttcctgcagccgctgatggccctgctgtaccctgactgtggcgggggccggctcgacagccaccgggcctttgtggtcaaatacgcaccgggccaggacctggagctgggctgccactatgataatgccgagctcaccctcaatgtggccttgggcaaggtcttcacagggggcgccctgtattttgggggcctcttccaggcacccacagccctgacggagcccctggaggtggagcacgtggtgggccagggtgtcctccaccgtggcggccagctgcatggagcccggcccttgggcactggtgagcgttggaaccttgtcgtctggctccgagcctctgctgtgcgcaacagcctctgtcccatgtgctgccgtgagcccgacctggtggacgatgagggcttcggtgatggcttcacccgagaggagcccgccacggtggatgtatgtgcgctcacctgagcttgcttgggcccagtgtgggggtggcaggcaggtgagggctccgttgccttggtctgggggcagaaataaaatccccgcagcctactgcacttcttggctcaacggtgtgccagcttctgggtcattctatgggcaaagatgctgccttagttcaggtttgtcagaagcagggtctggaatggggcttcagcgagggagtcagggaagcaggggaggggagggagcagctgggcaaggaagtggcttcagaggacgtccagcctcagctggccccacggagagctccaggcagagcccacagtaccacagtgtgcccacaccaccggttactggctcctggatgagggggccagagaggagtgaataacttcccagacacttatctccagggcagggtgccttccagtagccaagggaagcctccagagagcacagatgtgaaccctcagcagcaggcatcaccccccagtggactcgggtgggccaccagtagcatcttctagatggcagaggggtgaatggcagggccaggaaccaggctgcccgggttcccattctgcttctgccacttccagctgtgtggctttaggtgagccttcaccttttggtgccttcgtttcctcatttagcacctacctcctagagctgttttgggagtcaaatgcgctgacgtatataaagtgctttgcaaga

SEQ ID NO: 102622 - DNA, 1488 bp, Homo sapiens
  Payload ID: 22
  Gene Symbol: OGFOD2
  Gene Name: 2-oxoglutarate and iron-dependent oxygenase domain containing 2
  Uniprot ID: Q6N063
  ENST ID: ENST00000454694
  CDS Start-End: 512-1072
gtcctgtgaaggcacgacccagttcagctgtctgtaaagtggagccattagtccctgcctcgtagtgggaaaactgggaggcggaacgaggaggccgccggtcccaacccggcccaggagcatctttctccgcagaccgtttcctggcgagatcctgcgcagccgaggctgtgttagcgccaaggacttccagcagctgttagcagagcttgagcaggaggtggagcggcggcagcggctggggcaggagtcagcagctaggaaagccctcatcgcgagttcctaccacccggcacggcctgaggtctacgactcactgcaggatgcagctctggcccccgagttcctggccgtgactgagtacagcgtgtccccagacgcagacctcaagggccttctccagcggctggagacagtatcggaggagaagcgcatctaccgggtgcctgttttcacagcgcccttctgccaggccctgctggaagagctggagcacttcgagcaatcggacatgcctaaggggaggcccaacaccatgaacaactacggggtgctgctgcacgagctcgggctggacgagccgctgatgacaccactgcgggagcgcttcctgcagccgctgatggccctgctgtaccctgactgtggcgggggccggctcgacagccaccgggcctttgtggtcaaatacgcaccgggccaggacctggagctgggctgccactatgataatgccgagctcaccctcaatgtggccttgggcaaggtcttcacagggggcgccctgtattttgggggcctcttccaggcacccacagccctgacggagcccctggaggtggagcacgtggtgggccagggtgtcctccaccgtggcggccagctgcatggagcccggcccttgggcactggtgagcgttggaaccttgtcgtctggctccgagcctctgctgtgcgcaacagcctctgtcccatgtgctgccgtgagcccgacctggtggacgatgagggcttcggtgatggcttcacccgagaggagcccgccacggtggatgtatgtgcgctcacctgagcttgcttgggcccagtgtgggggtggcaggcaggtgagggctccgttgccttggtctgggggcagaaataaaatccccgcagcctactgcacttcttggctcaacggtgtgccagcttctgggtcattctatgggcaaagatgctgccttagttcaggtttgtcagaagcagggtctggaatggggcttcagcgagggagtcagggaagcaggggaggggagggagcagctgggcaaggaagtggcttcagaggacgtccagcctcagctggccccacggagagctccaggcagagcccacagtaccacagtgtgcccacaccaccggttactggctcctggatgagggggccagagaggagtgaataacttcccagacacttatctccagggcagggtgccttccagtagccaa

SEQ ID NO: 102623 - DNA, 1426 bp, Homo sapiens
  Payload ID: 22
  Gene Symbol: OGFOD2
  Gene Name: 2-oxoglutarate and iron-dependent oxygenase domain containing 2
  ENST ID: ENST00000536439
  CDS Start-End: 947-1426
caagtagggcaaaaaatgccccacttctcttcggatttcttgctgggctcacttattggctaaacccagcaggaaatgctgggcaagggaggtttgcgtgttgtttaacctctgattcagtttcctcatctgtaaaatgggagcaacagtaaccccctctcttaaggcactgcgacgatcaagtgagttaatctgcatagagtgcctgtcacagggcccgcacgtagtgtttggaaagtgtttcctattcttattggcactgatagcctgggctaggggctcctgtgggaggcagatacaagtttcccctcatggagcctgtgctttgttgggagtcatgggtggaatgaatccccctcctcccagcctgggggtgctctcctcattgccttccactccccggcagctgagatagtgctgaggctgttggctggggcagggcctaggctgcgaggtggccccatcgtgggcacactagccctgcacccctgggcattggtgcgtccgccaagaaatgtttaggtttccattctcagcctggtttcttccccctcagggcccagcaagaaagaacagccccttctggccttcctgctgggggacagaggctcccagagccacttctgagttggggtacagacttcggtggctcatcagatgaaaggaggtgcagagagagcctgaagttggctctgtgatcccgacttggctgtcactggcctgctgggtgtccctgggctacttccttcccctctctgggcctcaggacccatatgtgatgaaacaggaagactgaagcccaggcctggccggcccacggccacattcaggccaacagaccatccctccttccacagaggagaagcgcatctaccgggtgcctgttttcacagcgcccttctgccaggccctgctggaagagctggagcacttcgagcaatcggacatgcctaaggggaggcccaacaccatgaacaactacggggtgctgctgcacgagctcgggctggacgagccgctgatgacaccactgcgggagcgcttcctgcagccgctgatggccctgctgtaccctgactgtggcgggggccggctcgacagccaccgggcctttgtggtcaaatacgcaccgggccaggacctggagctgggctgccactatgataatgccgagctcaccctcaatgtggccttgggcaaggtcttcacagggggcgccctgtattttgggggcctcttccaggcacccacagccctgacggagcccctggaggtggagcacgtggtgggccagggtgtcctccaccgtggcggccagctgcatggagcccggcccttgggcactggtgagcgttggaaccttgtcgtctggctccgagcctctgctgtgcgcaacagcctctgtcccatgtgctgccgtgagccc

SEQ ID NO: 102624 - DNA, 1481 bp, Homo sapiens
  Payload ID: 22
  Gene Symbol: OGFOD2
  Gene Name: 2-oxoglutarate and iron-dependent oxygenase domain containing 2
  Uniprot ID: Q6N063
  ENST ID: ENST00000545317
  CDS Start-End: 829-1389
ggatgattgaagcaccagcgggaactagtcggacctccgagctctttaaactgtcctcagctcggctggttctccacgagctccgggcagacggcggggggtgggtcggcgtttaagtcaaaggccttggggctccgagtcccttcctctccccgtcctgtgaaggcacgacccagttcagctgtctgtaaagtggagccattagtccctgcctcgtagtgggaaaactgggaggcggaacgaggaggccgccggtcccaacccggcccaggagcatctttctccgcagaccgtttcctggcgagatcctgcgcagccgaggctgtgttagcgccaaggacttccagcagctgttagcagagtggcctcaggaggatgggaggccccacctggtaacaaccctgtgccaccccagcttgagcaggaggtggagcggcggcagcggctggggcaggagtcagcagctaggaaagccctcatcgcgagttcctaccacccggcacggcctgaggtctacgactcactgcaggatgcagctctggcccccgagttcctggccgtgactgagtacagcgtgtccccagacgcagacctcaagggccttctccagcggctggagacaccctgaaaagcaaaggcctcatctccatggcacaggtgatgaaacaggaagactgaagcccaggcctggccggcccacggccacattcaggccaacagaccatccctccttccacagaggagaagcgcatctaccgggtgcctgttttcacagcgcccttctgccaggccctgctggaagagctggagcacttcgagcaatcggacatgcctaaggggaggcccaacaccatgaacaactacggggtgctgctgcacgagctcgggctggacgagccgctgatgacaccactgcgggagcgcttcctgcagccgctgatggccctgctgtaccctgactgtggcgggggccggctcgacagccaccgggcctttgtggtcaaatacgcaccgggccaggacctggagctgggctgccactatgataatgccgagctcaccctcaatgtggccttgggcaaggtcttcacagggggcgccctgtattttgggggcctcttccaggcacccacagccctgacggagcccctggaggtggagcacgtggtgggccagggtgtcctccaccgtggcggccagctgcatggagcccggcccttgggcactggtgagcgttggaaccttgtcgtctggctccgagcctctgctgtgcgcaacagcctctgtcccatgtgctgccgtgagcccgacctggtggacgatgagggcttcggtgatggcttcacccgagaggagcccgccacggtggatgtatgtgcgctcacctgagcttgcttgggcccagtgtgggggtggcaggcaggtgagggctccgttgccttggtctgggggcagaaataaaatccccgcagcctactgca

SEQ ID NO: 102625 - DNA, 1956 bp, Homo sapiens
  Payload ID: 22
  Gene Symbol: OGFOD2
  Gene Name: 2-oxoglutarate and iron-dependent oxygenase domain containing 2
  Uniprot ID: Q6N063
  ENST ID: ENST00000536150
  CDS Start-End: 699-1259
aggtaatccaacagactgtggcggagggaccggaagcgccaggcagggacccggggtagatgctaaatccaaactgaaacgtacagggctggatgattgaagcaccagcgggaactagtcggacctccgagctctttaaactgtcctcagctcggctggttctccacgagctccgggcagacggcggggggtgggtcggcgtttaagtcaaaggccttggggctccgagtcccttcctctccccgtcctgtgaaggcacgacccagttcagctgtctgtaaagtggagccattagtccctgcctcgtagtgggaaaactgggaggcggaacgaggaggccgccggtcccaacccggcccaggagcatctttctccgcagaccgtttcctggcgagcttgagcaggaggtggagcggcggcagcggctggggcaggagtcagcagctaggaaagccctcatcgcgagttcctaccacccggcacggcctgaggtctacgactcactgcaggatgcagctctggcccccgagttcctggccgtgactgagtacagcgtgtccccagacgcagacctcaagggccttctccagcggctggagacagtatcggaggagaagcgcatctaccgggtgcctgttttcacagcgcccttctgccaggccctgctggaagagctggagcacttcgagcaatcggacatgcctaaggggaggcccaacaccatgaacaactacggggtgctgctgcacgagctcgggctggacgagccgctgatgacaccactgcgggagcgcttcctgcagccgctgatggccctgctgtaccctgactgtggcgggggccggctcgacagccaccgggcctttgtggtcaaatacgcaccgggccaggacctggagctgggctgccactatgataatgccgagctcaccctcaatgtggccttgggcaaggtcttcacagggggcgccctgtattttgggggcctcttccaggcacccacagccctgacggagcccctggaggtggagcacgtggtgggccagggtgtcctccaccgtggcggccagctgcatggagcccggcccttgggcactggtgagcgttggaaccttgtcgtctggctccgagcctctgctgtgcgcaacagcctctgtcccatgtgctgccgtgagcccgacctggtggacgatgagggcttcggtgatggcttcacccgagaggagcccgccacggtggatgtatgtgcgctcacctgagcttgcttgggcccagtgtgggggtggcaggcaggtgagggctccgttgccttggtctgggggcagaaataaaatccccgcagcctactgcacttcttggctcaacggtgtgccagcttctgggtcattctatgggcaaagatgctgccttagttcaggtttgtcagaagcagggtctggaatggggcttcagcgagggagtcagggaagcaggggaggggagggagcagctgggcaaggaagtggcttcagaggacgtccagcctcagctggccccacggagagctccaggcagagcccacagtaccacagtgtgcccacaccaccggttactggctcctggatgagggggccagagaggagtgaataacttcccagacacttatctccagggcagggtgccttccagtagccaagggaagcctccagagagcacagatgtgaaccctcagcagcaggcatcaccccccagtggactcgggtgggccaccagtagcatcttctagatggcagaggggtgaatggcagggccaggaaccaggctgcccgggttcccattctgcttctgccacttccagctgtgtggctttaggtgagccttcaccttttggtgccttcgtttcctcatttagcacctacctcctagagctgttttgggagtcaaatgcgctgacgtatataaagtgctttgcaagat

SEQ ID NO: 102626 - DNA, 1828 bp, Homo sapiens
  Payload ID: 22
  Gene Symbol: OGFOD2
  Gene Name: 2-oxoglutarate and iron-dependent oxygenase domain containing 2
  Uniprot ID: Q6N063
  ENST ID: ENST00000540324
  CDS Start-End: 1-390
atggcgacggtgggggctccgcggcacttctgccgctgcgcctgcttctgcaccgataacttgtacgtggcgcgctatgggctgcacgtgcgcttccgaggcgagcagcagctgcgccgggactacggcccgatcctgcgcagccgaggctgtgttagcgccaaggacttccagcagctgttagcagagtggcctcaggaggatgggaggccccacctggtaacaaccctgtgccaccccagcttgagcaggaggtggagcggcggcagcggctggggcaggagtcagcagctaggaaagccctcatcgcgagttcctaccacccggcacggcctgaggtctacgactcactgcaggatgcagctctggcccccgagttcctggccgtgactgagtacagcgtgtccccagacgcagacctcaagggccttctccagcggctggagacaccctgaaaagcaaaggcctcatctccatggcacagaggagaagcgcatctaccgggtgcctgttttcacagcgcccttctgccaggccctgctggaagagctggagcacttcgagcaatcggacatgcctaaggggaggcccaacaccatgaacaactacggggtgctgctgcacgagctcgggctggacgagccgctgatgacaccactgcgggagcgcttcctgcagccgctgatggccctgctgtaccctgactgtggcgggggccggctcgacagccaccgggcctttgtggtcaaatacgcaccgggccaggacctggagctgggctgccactatgataatgccgagctcaccctcaatgtggccttgggcaaggtcttcacagggggcgccctgtattttgggggcctcttccaggcacccacagccctgacggagcccctggaggtggagcacgtggtgggccagggtgtcctccaccgtggcggccagctgcatggagcccggcccttgggcactggtgagcgttggaaccttgtcgtctggctccgagcctctgctgtgcgcaacagcctctgtcccatgtgctgccgtgagcccgacctggtggacgatgagggcttcggtgatggcttcacccgagaggagcccgccacggtggatgtatgtgcgctcacctgagcttgcttgggcccagtgtgggggtggcaggcaggtgagggctccgttgccttggtctgggggcagaaataaaatccccgcagcctactgcacttcttggctcaacggtgtgccagcttctgggtcattctatgggcaaagatgctgccttagttcaggtttgtcagaagcagggtctggaatggggcttcagcgagggagtcagggaagcaggggaggggagggagcagctgggcaaggaagtggcttcagaggacgtccagcctcagctggccccacggagagctccaggcagagcccacagtaccacagtgtgcccacaccaccggttactggctcctggatgagggggccagagaggagtgaataacttcccagacacttatctccagggcagggtgccttccagtagccaagggaagcctccagagagcacagatgtgaaccctcagcagcaggcatcaccccccagtggactcgggtgggccaccagtagcatcttctagatggcagaggggtgaatggcagggccaggaaccaggctgcccgggttcccattctgcttctgccacttccagctgtgtggctttaggtgagccttcaccttttggtgccttcgtttcctcatttagcacctacctcctagagctgttttgggagtcaaatgcgctgacgtatataaagtgctttgcaa

SEQ ID NO: 102627 - DNA, 635 bp, Homo sapiens
  Payload ID: 22
  Gene Symbol: OGFOD2
  Gene Name: 2-oxoglutarate and iron-dependent oxygenase domain containing 2
  ENST ID: ENST00000537966
  CDS Start-End: 14-635
tgggtgcttcactatggcgacggtgggggctccgcggcacttctgccgctgcgcctgcttctgcaccgataacttgtacgtggcgcgctatgggctgcacgtgcgcttccgaggcgagcagcagctgcgccgggactacggcccgatcctgcgcagccgaggctgtgttagcgccaaggacttccagcagctgttagcagaggctgctgccagggctgctgccccactccctcctcctccttcccctggagtcagtggtgggaagcttcccaggagagtcctcagcaacctctggaacacaggacttggccatgactgtctcctgtccctgtgtgggcccagatggttgagtttcttcatctgtacagtggcctcaggaggatgggaggccccacctggtaacaaccctgtgccaccccagcttgagcaggaggtggagcggcggcagcggctggggcaggagtcagcagctaggaaagccctcatcgcgagttcctaccacccggcacggcctgaggtctacgactcactgcaggatgcagctctggcccccgagttcctggccgtgactgagtacagcgtgtccccagacgcagacctcaagggccttctccagcggctggagacagtatcgg

SEQ ID NO: 102628 - DNA, 1568 bp, Homo sapiens
  Payload ID: 22
  Gene Symbol: OGFOD2
  Gene Name: 2-oxoglutarate and iron-dependent oxygenase domain containing 2
  ENST ID: ENST00000545056
  CDS Start-End: 1089-1568
cggagggaccggaagcgccaggcagggacccggggtagatgctaaatccaaactgaaacgtacagggctggatgattgaagcaccagcgggaactagtcggacctccgagctctttaaactgtcctcagctcggctggttctccacgagctccgggcagacggcggggggtgggtcggcgtttaagtcaaaggccttggggctccgagtcccttcctctccccgtcctgtgaaggcacgacccagttcagctgtctgtaaagtggagccattagtccctgcctcgtagtgggaaaactgggaggcggaacgaggaggccgccggtcccaacccggcccaggagcatctttctccgcagaccgtttcctggcgagatcctgcgcagccgaggctgtgttagcgccaaggacttccagcagctgttagcagagtggcctcaggaggatgggaggccccacctggtaacaaccctgtgccaccccagcttgagcaggaggtggagcggcggcagcggctggggcaggagtcagcagctaggaaagccctcatcgcgagttcctaccacccggcacggcctgaggtctacgactcactgcaggatgcagctctggcccccgagttcctggccgtgactgagtacagcgtgtccccagacgcagacctcaagggccttctccagcggctggagacagtatcggggcccagcaagaaagaacagccccttctggccttcctgctgggggacagaggctcccagagccacttctgagttggggtacagacttcggtggctcatcagatgaaaggaggtgcagagagagcctgaagttggctctgtgatcccgacttggctgtcactggcctgctgggtgtccctgggctacttccttcccctctctgggcctcaggacccatatgtgatgaaacaggaagactgaagcccaggcctggccggcccacggccacattcaggccaacagaccatccctccttccacagaggagaagcgcatctaccgggtgcctgttttcacagcgcccttctgccaggccctgctggaagagctggagcacttcgagcaatcggacatgcctaaggggaggcccaacaccatgaacaactacggggtgctgctgcacgagctcgggctggacgagccgctgatgacaccactgcgggagcgcttcctgcagccgctgatggccctgctgtaccctgactgtggcgggggccggctcgacagccaccgggcctttgtggtcaaatacgcaccgggccaggacctggagctgggctgccactatgataatgccgagctcaccctcaatgtggccttgggcaaggtcttcacagggggcgccctgtattttgggggcctcttccaggcacccacagccctgacggagcccctggaggtggagcacgtggtgggccagggtgtcctccaccgtggcggccagctgcatggagcccggcccttgggcactggtgagcgttggaaccttgtcgtctggctccgagcctctgctgtgcgcaacagcctctgtcccatgtgctgccgtgagccc

SEQ ID NO: 102629 - DNA, 1949 bp, Homo sapiens
  Payload ID: 22
  Gene Symbol: OGFOD2
  Gene Name: 2-oxoglutarate and iron-dependent oxygenase domain containing 2
  Uniprot ID: Q6N063
  ENST ID: ENST00000538755
  CDS Start-End: 973-1533
ggagacactcactggggcaatctgaggtaatccaacagactgtggcggagggaccggaagcgccaggcagggacccggggtagatgctaaatccaaactgaaacgtacagggctggatgattgaagcaccagcgggaactagtcggacctccgagctctttaaactgtcctcagctcggctggttctccacgagctccgggcagacggcggggggtgggtcggcgtttaagtcaaaggccttggggctccgagtcccttcctctccccgtcctgtgaaggcacgacccagttcagctgtctgtaaagtggagccattagtccctgcctcgtagtgggaaaactgggaggcggaacgaggaggccgccggtcccaacccggcccaggagcatctttctccgcagaccgtttcctggcgagatcctgcgcagccgaggctgtgttagcgccaaggacttccagcagctgttagcagagcttgagcaggaggtggagcggcggcagcggctggggcaggagtcagcagctaggaaagccctcatcgcgagttcctaccacccggcacggcctgaggtctacgactcactgcaggatgcagctctggcccccgagttcctggccgtgactgagtacagcgtgtccccagacgcagacctcaagggccttctccagcggctggagacagtatcggggcccagcaagaaagaacagccccttctggccttcctgctgggggacagaggctcccagagccacttctgagttggggtacagacttcggtggctcatcagatgaaaggaggtgatgaaacaggaagactgaagcccaggcctggccggcccacggccacattcaggccaacagaccatccctccttccacagaggagaagcgcatctaccgggtgcctgttttcacagcgcccttctgccaggccctgctggaagagctggagcacttcgagcaatcggacatgcctaaggggaggcccaacaccatgaacaactacggggtgctgctgcacgagctcgggctggacgagccgctgatgacaccactgcgggagcgcttcctgcagccgctgatggccctgctgtaccctgactgtggcgggggccggctcgacagccaccgggcctttgtggtcaaatacgcaccgggccaggacctggagctgggctgccactatgataatgccgagctcaccctcaatgtggccttgggcaaggtcttcacagggggcgccctgtattttgggggcctcttccaggcacccacagccctgacggagcccctggaggtggagcacgtggtgggccagggtgtcctccaccgtggcggccagctgcatggagcccggcccttgggcactggtgagcgttggaaccttgtcgtctggctccgagcctctgctgtgcgcaacagcctctgtcccatgtgctgccgtgagcccgacctggtggacgatgagggcttcggtgatggcttcacccgagaggagcccgccacggtggatgtatgtgcgctcacctgagcttgcttgggcccagtgtgggggtggcaggcaggtgagggctccgttgccttggtctgggggcagaaataaaatccccgcagcctactgcacttcttggctcaacggtgtgccagcttctgggtcattctatgggcaaagatgctgccttagttcaggtttgtcagaagcagggtctggaatggggcttcagcgagggagtcagggaagcaggggaggggagggagcagctgggcaaggaagtggcttcagaggacgtccagcctcagctggccccacggagagctccaggcagagcccacagtaccacagtgtgcccacaccaccggttactggctcctggatgagggggccagagaggagtgaataacttcccagacacttatctccagggcagggtgccttccagtagccaa

SEQ ID NO: 102630 - DNA, 1465 bp, Homo sapiens
  Payload ID: 22
  Gene Symbol: OGFOD2
  Gene Name: 2-oxoglutarate and iron-dependent oxygenase domain containing 2
  Uniprot ID: Q6N063
  ENST ID: ENST00000545612
  CDS Start-End: 813-1373
gggaccggaagcgccaggcagggacccggggtagatgctaaatccaaactgaaacgtacagggctggatgattgaagcaccagcgggaactagtcggacctccgagctctttaaactgtcctcagctcggctggttctccacgagctccgggcagacggcggggggtgggtcggcgtttaagtcaaaggccttggggctccgagtcccttcctctccccgtcctgtgaaggcacgacccagttcagctgtctgtaaagtggagccattagtccctgcctcgtagtgggaaaactgggaggcggaacgaggaggccgccggtcccaacccggcccaggagcatctttctccgcagaccgtttcctggcgagatcctgcgcagccgaggctgtgttagcgccaaggacttccagcagctgttagcagagcttgagcaggaggtggagcggcggcagcggctggggcaggagtcagcagctaggaaagccctcatcgcgagttcctaccacccggcacggcctgaggtctacgactcactgcaggatgcagctctggcccccgagttcctggccgtgactgagtacagcgtgtccccagacgcagacctcaagggccttctccagcggctggagacagtatcgggtgatgaaacaggaagactgaagcccaggcctggccggcccacggccacattcaggccaacagaccatccctccttccacagaggagaagcgcatctaccgggtgcctgttttcacagcgcccttctgccaggccctgctggaagagctggagcacttcgagcaatcggacatgcctaaggggaggcccaacaccatgaacaactacggggtgctgctgcacgagctcgggctggacgagccgctgatgacaccactgcgggagcgcttcctgcagccgctgatggccctgctgtaccctgactgtggcgggggccggctcgacagccaccgggcctttgtggtcaaatacgcaccgggccaggacctggagctgggctgccactatgataatgccgagctcaccctcaatgtggccttgggcaaggtcttcacagggggcgccctgtattttgggggcctcttccaggcacccacagccctgacggagcccctggaggtggagcacgtggtgggccagggtgtcctccaccgtggcggccagctgcatggagcccggcccttgggcactggtgagcgttggaaccttgtcgtctggctccgagcctctgctgtgcgcaacagcctctgtcccatgtgctgccgtgagcccgacctggtggacgatgagggcttcggtgatggcttcacccgagaggagcccgccacggtggatgtatgtgcgctcacctgagcttgcttgggcccagtgtgggggtggcaggcaggtgagggctccgttgccttggtctgggggcagaaataaaatccccgcagcctactgca

SEQ ID NO: 102631 - DNA, 1696 bp, Homo sapiens
  Payload ID: 22
  Gene Symbol: OGFOD2
  Gene Name: 2-oxoglutarate and iron-dependent oxygenase domain containing 2
  Uniprot ID: Q6N063
  ENST ID: ENST00000538628
  CDS Start-End: 1044-1604
gggaccggaagcgccaggcagggacccggggtagatgctaaatccaaactgaaacgtacagggctggatgattgaagcaccagcgggaactagtcggacctccgagctctttaaactgtcctcagctcggctggttctccacgagctccgggcagacggcggggggtgggtcggcgtttaagtcaaaggccttggggctccgagtcccttcctctccccgtcctgtgaaggcacgacccagttcagctgtctgtaaagtggagccattagtccctgcctcgtagtgggaaaactgggaggcggaacgaggaggccgccggtcccaacccggcccaggagcatctttctccgcagaccgtttcctggcgagatcctgcgcagccgaggctgtgttagcgccaaggacttccagcagctgttagcagagcttgagcaggaggtggagcggcggcagcggctggggcaggagtcagcagctaggaaagccctcatcgcgagttcctaccacccggcacggcctgaggtctacgactcactgcaggatgcagctctggcccccgagttcctggccgtgactgagtacagcgtgtccccagacgcagacctcaagggccttctccagcggctggagacagtatcgggtgaggtcctggccctgagacctggcaggaccagggaatggcagcctgggaaacctgggtgtgggatgctggggtccctccagccaccatctctgcctccaaaaaccaaaccagcaggagctggaagggtcagtgggaccaacctgccaggagcaggacatccgcattcattcattcaatacctgccatgagcctgccctgaaaagcaaaggcctcatctccatggcacaggtgatgaaacaggaagactgaagcccaggcctggccggcccacggccacattcaggccaacagaccatccctccttccacagaggagaagcgcatctaccgggtgcctgttttcacagcgcccttctgccaggccctgctggaagagctggagcacttcgagcaatcggacatgcctaaggggaggcccaacaccatgaacaactacggggtgctgctgcacgagctcgggctggacgagccgctgatgacaccactgcgggagcgcttcctgcagccgctgatggccctgctgtaccctgactgtggcgggggccggctcgacagccaccgggcctttgtggtcaaatacgcaccgggccaggacctggagctgggctgccactatgataatgccgagctcaccctcaatgtggccttgggcaaggtcttcacagggggcgccctgtattttgggggcctcttccaggcacccacagccctgacggagcccctggaggtggagcacgtggtgggccagggtgtcctccaccgtggcggccagctgcatggagcccggcccttgggcactggtgagcgttggaaccttgtcgtctggctccgagcctctgctgtgcgcaacagcctctgtcccatgtgctgccgtgagcccgacctggtggacgatgagggcttcggtgatggcttcacccgagaggagcccgccacggtggatgtatgtgcgctcacctgagcttgcttgggcccagtgtgggggtggcaggcaggtgagggctccgttgccttggtctgggggcagaaataaaatccccgcagcctactgca

SEQ ID NO: 102632 - DNA, 4287 bp, Homo sapiens
  Payload ID: 23
  Gene Symbol: OGFOD3
  Gene Name: 2-oxoglutarate and iron-dependent oxygenase domain containing 3
  Uniprot ID: Q6PK18
  ENST ID: ENST00000313056
  CDS Start-End: 153-1112
gattgctcgggcctggccgccagcccaggggccgatggccgagcgcgtcgcactcgcgtccctgcgccgtgcctgcctcgcgctccctgttacggcgttcgtccccgggcctggcgcccgcgtccggcccggctccgcggcggcctggtccgatggctcctcagcggagggccgcaaccaaggcgcccgagggcaacggagcggccgagcgccggaaccggagcagcaccaagaaggaccgagccccgcgggaggtgcagaggctgtggcagaggccgtggctaaggaccgcgggcctgggggctggctttgtgctcaccgcactcctgctctggagcagcttgggggccgacgacggggtcgcagaggtcctggcccgccgtggcgaggtcgtggcagggagattcatcgaggtgccctgctctgaggactacgacagtcaccgcaggttcgaaggctgcactccccgaaagtgcggcagaggtgtcaccgatgtcgtcatcaccagggaggaagcggagcggattcgcagcgtagctgaaaaggggctctccctgggaggatctgacggaggggcatccattctggacttgcactcaggggccctgtctgtcgggaagcactttgtgaacctgtacagatacttcggggataaaatacagaacatcttctcagaggaggacttccggttataccgggaggtgcggcagaaggtccagctcaccattgctgaggcttttggcatcagcgcatcctcgctgcatctgaccaagcccaccttcttctcccgcataaacagcacggaagcgcggacggcgcacgacgagtactggcatgcgcacgtggacaaggtgacctacggctccttcgactacacctcgctgctgtacctctccaactacctggaggacttcggcggagggcggttcatgttcatggaggagggtgccaacaagacggtggagccgagagctggtcgcgtctccttcttcacctcggggtccgagaacctacaccgcgtggagaaggtccactggggcacccgttacgccatcaccatcgccttcagctgcaaccccgaccatggcatcgaggacccagcgttcccgtagccagcagccgggccaaggtaacttcaggagggcccgtgtggaggcagccgcgccagtcgtgcacccacccccacgtccacccgctcctgttgcacagagtgccttaggaattctctgattttgatttgctgacgtgttaatcttttcatctgtgagtaaatgaagggaaccagcttttcacttctccagcatcatgtgtgcttgggctgtaggcctgggagcctgaggtggaggccaggaaagggacccagcaggacggggcacaagtccccatctgtgaatggacgggactcatccacccaggttcagcaaccccccgggactcgtccaggttcagcaaccccccggcccatcaaagactggctaaagcatcagccataaatggggacaaacgtggggccagcagcttctgttcggggtctcggcatcagcaaaccgcagcagctttggagaagggtccgtgagtggcggctctggaggcagcaacggggtcctttggggtgggtgggagttctgctggattcaggtggaggtgaacatctgccgttcccacagccctgcgtgcacccccaatgctgctggcccacaaatcaccgtgggccacggccccaccacaccaggcttggccctgtcagcggccagcatcccaagggccagggtccgagtgtcctcaccaaggaggctcttggcgtcgctgtgccggctcccatgggccttctgctgggtcgagggtaggtctcctcctccccctttgccctggcattaaactgatggtcaggctgggcgcggtggctcacacctgtaatctcagcactgcgggaggccgaggcaggaggatcacttgaggtcaggagttcaagaccagcctggccaacatggcgaaaccctgtctctactaaaaacacaaaaacaaattaatcccagctactggggaggctgaggcaggagaatcgcttgaacccagggggcagaagttgcagtgagccgagatcgtgccactacactccagcctgggtgacagagtgagactccatcttaaaaatataaaaataaagtggtggtcagaggagccccgaatagaccagttgtggagaggcctgggtggggtggctggcagggagggcaggccaagcccagtttctgcccacagtcacctcgaggtgactgtccagggctttgggcaccttcccgggagggggacggccgcccaccctgagtggtgttggaagctgggctctcctggatgccctgacccagctgcctggggagagccctgggcccctcctccctcagcacctcctccctcagcccctcctgcctcggtccctcctcccttagcctgtctggcatagatccatgttccctagcccctggcacaggtgcctctgactggaggaggccccacctgtggcccgggagctgctctgggggttgataaagggcagcattattgggtcctgggaaggagcgggcgtgaggccagctgaggcatggtgacccctgggaaggagcgggcgtgaggccagctgaggcatggtgacccctgggaaggagcgggcgtgaggccagctgaggcatggtgacccctgggaaggagcgggcgtgaggccagctgaggcatggtgacccctgggaaggagcgggcgtgaggccagctgaggcatggtgacccctgggtacgggggacttgggggccgcaccttggtttgcccagggcccctcctgcaccacgggccacatgcggaggacggcgtgggataggctccctgggtccacagcttctgcccgtgtatggggaaccctccttggtcagggctgcaggctctgggcagatggggcaggaaccctgaggctcccgcgccctcccatggcctctgatgtgggacactggagcgaggcacgattctgaaggactccatggatctgggaggatgaggcccacctccggttggtggccaaagccgtccttgcggggccggctgcttcacggacactctccgggtcgggctggtgggccccatcgtgggtgggaagtcgcctgagcctgggccgcccttgagcttctcccagtcttgactttccagagggtccgtggctgtggtcatggtcggggcaggtggaaaatgctgcatggaaacctgatcctgtcaccttggagtaaatgatgatgtcgccggcttctcgccacgtctaaaggataaatgcatttgaagaaagtgggtgttgggtttgttatgggttaaagtgcttttgaaataagtaaattattagtttgattttcattcttggctacttacactattcatgataatcacagagatacttggacaaagaaatatatttgggcaaaagcaagaatttccttctttttttttttgagacggagtctaactctgtcgcccaggctggagtgcagtggcgcaatctcggctcactgcaaggtccacctcctgggttcccaccattctcctgcctcaacctcccgagtagctgggactacaggcgcccgccaccatgcccggctaattttttttgtatttttagtagagatgggatttcaccgtgttagccagaatgaagaatttccttctgaagtgggaacatatggctcatgctggtaatcccagcactttgggaggccaaggtaggaagatcacttgagcccaggagttggagacccatctgtgcaacatagtgagacgctgtctgtacaagaaacttttaaaaaatgtagctgggcgtggcagtgtgctcctgtggtcccagctactcggagctgaggcaggacgactgcttgagcccaggaggtcgaggctacagtgagctgtgacggctccactgcattccagcctgggagacagcaagatactgtctcaaaaaaaaatttatcattgaagcctgggcattttaaaaaaataaaaaggtgggaaaatacgtgggcacagcagtgaatcctcacaccctgggctttgcccaagaagtgctcgtgaacctgatgaaagtgtcgggtgtggccgacgtgaggctgttccaggagccacgaggggtgattggttccgctagaaggttccagggaggaactggagtctcaggtgtgtcctctgatgagtgatctatttttaagtaaaagtgtttcattaaagtcaaagatgattattcctttcaaaataaagaa

SEQ ID NO: 102633 - DNA, 1652 bp, Homo sapiens
  Payload ID: 23
  Gene Symbol: OGFOD3
  Gene Name: 2-oxoglutarate and iron-dependent oxygenase domain containing 3
  Uniprot ID: Q6PK18
  ENST ID: ENST00000329197
  CDS Start-End: 92-1087
ctgcgccgtgcctgcctcgcgctccctgttacggcgttcgtccccgggcctggcgcccgcgtccggcccggctccgcggcggcctggtccgatggctcctcagcggagggccgcaaccaaggcgcccgagggcaacggagcggccgagcgccggaaccggagcagcaccaagaaggaccgagccccgcgggaggtgcagaggctgtggcagaggccgtggctaaggaccgcgggcctgggggctggctttgtgctcaccgcactcctgctctggagcagcttgggggccgacgacggggtcgcagaggtcctggcccgccgtggcgaggtcgtggcagggagattcatcgaggtgccctgctctgaggactacgacagtcaccgcaggttcgaaggctgcactccccgaaagtgcggcagaggtgtcaccgatgtcgtcatcaccagggaggaagcggagcggattcgcagcgtagctgaaaaggggctctccctgggaggatctgacggaggggcatccattctggacttgcactcaggggccctgtctgtcgggaagcactttgtgaacctgtacagatacttcggggataaaatacagaacatcttctcagaggaggacttccggttataccgggaggtgcggcagaaggtccagctcaccattgctgaggcttttggcatcagcgcatcctcgctgcatctgaccaagcccaccttcttctcccgcataaacagcacggaagcgcggacggcgcacgacgagtactggcatgcgcacgtggacaaggtgacctacggctccttcgactacacctcgctgctgtacctctccaactacctggaggacttcggcggagggcggttcatgttcatggaggagggtgccaacaagacggtggagccgagagctggatgtttttgtttccggatgatgtcttgtgggttccaagaagttaatggaccgagagccagtgaagctgctggtgcgaaggctggagtcaggtgtcctccggggactcaccacccgcccgagaggggagagacacatgcgattctggaagctgagagcattgcttattgttgattccttggttgccgtgctgagtcctgctttaaggaagcaggtcgcgtctccttcttcacctcggggtccgagaacctacaccgcgtggagaaggtccactggggcacccgttacgccatcaccatcgccttcagctgcaaccccgaccatggcatcgaggacccagcgttcccgtagccagcagccgggccaaggtaacttcaggagggcccgtgtggaggcagccgcgccagtcgtgcacccacccccacgtccacccgctcctgttgcacagagtgccttaggaattctctgattttgatttgctgacgtgttaatcttttcatctgtgagtaaatgaagggaaccagcttttcacttctccagcatcatgtgtgcttgggctgtaggcctgggagcctgaggtggaggccaggaaagggacccagcaggacggggcacaagtccccatctgtgaatggacgggactcatccacccaggttcagcaaccccccgggactcgtccaggttcagcaaccccccggcccatcaaagactggctaaagcatcagccataaatgggga

SEQ ID NO: 102634 - DNA, 1274 bp, Homo sapiens
  Payload ID: 23
  Gene Symbol: OGFOD3
  Gene Name: 2-oxoglutarate and iron-dependent oxygenase domain containing 3
  ENST ID: ENST00000580445
  CDS Start-End: 153-533
gattgctcgggcctggccgccagcccaggggccgatggccgagcgcgtcgcactcgcgtccctgcgccgtgcctgcctcgcgctccctgttacggcgttcgtccccgggcctggcgcccgcgtccggcccggctccgcggcggcctggtccgatggctcctcagcggagggccgcaaccaaggcgcccgagggcaacggagcggccgagcgccggaaccggagcagcaccaagaaggaccgagccccgcgggaggtgcagaggctgtggcagaggccgtggctaaggaccgcgggcctgggggctggctttgtgctcaccgcactcctgctctggagcagcttgggggccgacgacggggtcgcagaggtcctggcccgccgtggcgaggtcgtggcagggagattcatcgaggtgccctgctctgaggactacgacagtcaccgcaggctgcactccccgaaagtgcggcagaggtgtcaccgatgtcgtcatcaccagggaggaagcggagcggattcgcagcgtagctgaaaaggggctctccctgggaggatctgacggaggggcatccattctggacttgcactcaggggccctgtctgtcgggaagcactttgtgaacctgtacagatacttcggggataaaatacagaacatcttctcagaggaggacttccggttataccgggaggtgcggcagaaggtccagctcaccattgctgaggcttttggcatcagcgcatcctcgctgcatctgaccaagcccaccttcttctcccgcataaacagcacggaagcgcggacggcgcacgacgagtactggcatgcgcacgtggacaaggtgacctacggctccttcgactacacctcgctgctgtacctctccaactacctggaggacttcggcggagggcggttcatgttcatggaggagggtgccaacaagacggtggagccgagagctggatgtttttgtttccggatgatgtcttgtgggttccaagaagttaatggaccgagagccagtgaagctgctggtgcgaaggctggagtcaggtgtcctccggggactcaccacccgcccgagaggggagagacacatgcgattctggaagctgagagcattgcttattgttgattccttggttgccgtgctgagtcctgctttaaggaagcaggtcgcgtctccttcttcacctcggggtccgagaacctacaccgcgtggagaaggtccactggggcacccgttacgccatcaccatcgccttcag

SEQ ID NO: 102635 - DNA, 896 bp, Homo sapiens
  Payload ID: 23
  Gene Symbol: OGFOD3
  Gene Name: 2-oxoglutarate and iron-dependent oxygenase domain containing 3
  ENST ID: ENST00000583897
  CDS Start-End: 1-724
cagcttgggggccgacgacggggtcgcagaggtcctggcccgccgtggcgaggtcgtggcagggagattcatcgaggtgccctgctctgaggactacgacagtcaccgcaggctgcactccccgaaagtgcggcagaggtgtcaccgatgtcgtcatcaccagggaggaagcggagcggattcgcaggcatccattctggacttgcactcaggggccctgtctgtcgggaagcactttgtgaacctgtacagatacttcggggataaaatacagaacatcttctcagaggaggacttccggttataccgggaggtgcggcagaaggtccagctcaccattgctgaggcttttggcatcagcgcatcctcgctgcatctgaccaagcccaccttcttctcccgcataaacagcacggaagcgcggacggcgcacgacgagtactggcatgcgcacgtggacaaggtgacctacggctccttcgactacacctcgctgctgtacctctccaactacctggaggacttcggcggagggcggttcatgttcatggaggagggtgccaacaagacggtggagccgagagctggtcgcgtctccttcttcacctcggggtccgagaacctacaccgcgtggagaaggtccactggggcacccgttacgccatcaccatcgccttcagctgcaaccccgaccatggcatcgaggacccagcgttcccgtagccagcagccgggccaaggtaacttcaggagggcccgtgtggaggcagccgcgccagtcgtgcacccacccccacgtccacccgctcctgttgcacagagtgccttaggaattctctgattttgatttgctgacgtgttaatcttttcatctgtgagtaaatgaagggaacca

SEQ ID NO: 102636 - DNA, 385 bp, Homo sapiens
  Payload ID: 23
  Gene Symbol: OGFOD3
  Gene Name: 2-oxoglutarate and iron-dependent oxygenase domain containing 3
  ENST ID: ENST00000582593
  CDS Start-End: 1-286
cgacgagtactggcatgcgcacgtggacaaggtgacctacggctccttcgactacacctcgctgctgtacctctccaactacctggaggacttcggcggagggcggttcatgttcatggaggagggtgccaacaagacggtggagccgagagctggggaagggtttggacgtccagcctctgcaagcaggagcccagcctgtctgccctcaccccagaagtcccagtcacagcagttttgtgggaaaatgaaaaactcacagagcacaagacaggcgttttcttgagaagtcaagcagctgaagcctcctgggactcgaaattacacaactttttagcatattttgatcttagtcattttaagcatgataaatacttgagtcaaa

SEQ ID NO: 102637 - DNA, 872 bp, Homo sapiens
  Payload ID: 23
  Gene Symbol: OGFOD3
  Gene Name: 2-oxoglutarate and iron-dependent oxygenase domain containing 3
  ENST ID: ENST00000577495
  CDS Start-End: 827-872
gcactcgcgtccctgcgccgtgcctgcctcgcgctccctgttacggcgttcgtccccgggcctggcgcccgcgtccggcccggctccgcggcggcctggtccgatggctcctcagcggagggccgcaaccaaggcgcccgagggcaacggagcggccgagcgccggaaccggagcaggtagcgcaccaagaaggaccgagccccgcgggaggtgcagaggctgtggcagaggccgtggctaaggaccgcgggcctgggggctggctttgtgctcaccgcactcctgctctggagcagcttgggggccgacgacggggtcgcagaggtcctggcccgccgtggcgaggtcgtggcagggagattcatcgaggtgccctgctctgaggactacgacagtcaccgcaggttcgaaggctgcactccccgaaagtgcggcagaggtgtcaccgatgtcgtcatcaccagggaggaagcggagcggattcgcagcgtagctgaaaaggggctctccctgggaggatctgacggaggggcatccattctggacttgcactcaggggccctgtctgtcgggaagcactttgtgaacctgtacagatacttcggggataaaatacagaacatcttctcagaggaggacttccggttataccgcacggaagcgcggacggcgcacgacgagtactggcatgcgcacgtggacaaggtgagcgcgcccgtgggcagggtgagcgtgcccgtggacaaggtgacctacggctccttcgactacacctcgctgctgtacctctccaactacctggaggacttcggcggagggcggttcatgttcatggaggagggtgccaacaagacggtggagccgagagctg

SEQ ID NO: 102638 - DNA, 657 bp, Homo sapiens
  Payload ID: 23
  Gene Symbol: OGFOD3
  Gene Name: 2-oxoglutarate and iron-dependent oxygenase domain containing 3
  ENST ID: ENST00000583445
  CDS Start-End: 1-657
tgtgaacctgtacagatacttcggggataaaatacagaacatcttctcagaggaggacttccggttataccgggaggtgcggcagaaggtccagctcaccattgctgaggcttttggcatcagcgcatcctcgctgcatctgaccaagcccaccttcttctcccgcataaacagcacggaagcgcggacggcgcacgacgagtactggcatgcgcacgtggacaaggtgacctacggctccttcgactacacctcgctgctgtacctctccaactacctggaggacttcggcggagggcggttcatgttcatggaggagggtgccaacaagacggtggagccgagagctgttgttctgagtcatctctgcattaggggaagggtttggacgtccagcctctgcaagcaggagcccagcctgtctgccctcaccccagaagtcccagtcacagcagttttgtgggaaaatgaaaaactcacagagcacaagacaggcgttttcttgagaagtcaagcagctgaagcctcctgggactcgaaattacacaactttttagcatattttgatcttagtcattttaagcatgataaatacttgagtcaaacattttgtattacgatcttctttcagataattaaaacaacctgtctcctgca

SEQ ID NO: 102639 - DNA, 3281 bp, Homo sapiens
  Payload ID: 24
  Gene Symbol: PXYLP1
  Gene Name: 2-phosphoxylose phosphatase 1
  Uniprot ID: Q8TE99
  ENST ID: ENST00000286353
  CDS Start-End: 138-1580
tcccctcgcgccgggaggagctggcggcgagcgccgagccgggcgcgcagcgacggagctggggccggcctgggaccatgggcggacatgttcccgatttgaggtgaaaccatgaagagaaaatagaatacttaataatgcttttccgcaaccgcttcttgctgctgctggccctggctgcgctgctggcctttgtgagcctcagcctgcagttcttccacctgatcccggtgtcgactcctaagaatggaatgagtagcaagagtcgaaagagaatcatgcccgaccctgtgacggagccccctgtgacagaccccgtttatgaagctcttttgtactgcaacatccccagcgtggccgagcgcagcatggaaggtcatgccccgcatcattttaagctggtctcagtgcatgtgttcattcgccacggagacaggtacccactgtatgtcattcccaaaacaaagcgaccagaaattgactgcactctggtggctaacaggaaaccgtatcacccaaaactggaagctttcattagtcacatgtcaaaaggatccggagcctctttcgaaagccccttgaactccttgcctctttacccaaatcacccattgtgtgagatgggagagctcacacagacaggagttgtgcagcatttgcagaacggtcagctgctgagggatatctatctaaagaaacacaaactcctgcccaatgattggtctgcagaccagctctatttagagaccactgggaaaagccggaccctacaaagtgggctggccttgctttatggctttctcccagattttgactggaagaagatttatttcaggcaccagccaagtgcgctgttctgctctggaagctgctattgcccggtaagaaaccagtatctggaaaaggagcagcgtcgtcagtacctcctacgtttgaaaaacagccagctggagaagacctacggggagatggccaagatcgtggatgtccccaccaagcagcttagagctgccaaccccatagactccatgctctgccacttctgccacaatgtcagctttccctgtaccagaaatggctgtgttgacatggagcacttcaaggtaattaagacccatcagatcgaggatgaaagggaaagacgggagaagaaattgtacttcgggtattctctcctgggtgcccaccccatcctgaaccaaaccatcggccggatgcagcgtgccaccgagggcaggaaagaagagctctttgccctctactctgctcatgatgtcactctgtcaccagttctcagtgccttgggcctttcagaagccaggttcccaaggtttgcagccaggttgatctttgagctttggcaagacagagaaaagcccagtgaacattccgtccggattctttacaatggcgtcgatgtcacattccacacctctttctgccaagaccaccacaagcgttctcccaagcccatgtgcccgcttgaaaacttggtccgctttgtgaaaagggacatgtttgtagccctgggtggcagtggtacaaattattatgatgcatgtcacagggaaggattctaaaaggtatgcagtacagcagtatagaatccatgccaatacagagcatagggaaaggtccacttctagttttgtctgttactaagggtagaagattattgctttttaaaggctaaatattgtttgtgggaaccacagatggttggggttgaacagtaagcacattgctgcaatgtggtacgtgaattgcttggtacaaaatggccagttcacagaggaatagaaggtactttatcatagccagacttcgcttagaatgccagaataatatagttcaagacctgaagttgccaatccaagtttgcactcttctggcctgccccatgttactatgtgatggaaccagcacacctcaaccaaaatttttttaatcttagacatttttaccttgtccttgttaagaatttcttgaagtgatttatctaaaataaaggttggcaaactttttctgtaaagggccagattgtaaatatttcagactgtgtggaccaaaaggccacatacagtctctgtcataactactcaactctgtttctgaagcaggaaagccaccacagacagtacataaaggaatatgtgtagctgggttcccaggccggacaaaacagatggtgaccagatttggcccctgggctgtagtttgctgacccctcatctaaaaaataggctatactacaattgcacttccagcactttgagaacgagttgaataccaagaattattcaatggttcctccagtaacttctgctagaaacacagaatttggtctgtatctgacactagaacaaaacttgagggtaaataaacattgaattagaatgaatcatagaaaactgattagaagaatacttgatgtttatgatgattgtggtacaagatagttttaagtatgttctaaatatttgtctgctgtagtctatttgctgtatatgctgaaatttttgtatgccatttagtatttttatagtttaggaaaatattttctaagaccagttttagatgactcttattcctgtagtaatattcaatttgctgtacctgcttggtggttagaaggaggctagaagatgaattcaggcactttcttccaataaaactaattatggctcattccctttgacaagctgtagaactggattcatttttaaaccattttcatcagtttcaaatggtaaattctgattgatttttaaatgcgtttttggaagaactttgctattagatagtttacagatctttataaggtgttttatatattagaagcaattataattacatctgtgatttctgaactaatggtgctaattcagagaaatggaaagtgaaagtgagattctctgttgtcatcggcattccaactttttctctttgtttttgtccagtgttgcatttgaatatgtctgtttctataaataaattttttaagaatacctatactatacaactaatggtttgtacctataagtcactcgagttattttcaagtgagagccagtattttatttttcccccttcattcaaatgtcatgcagagaaccagtattttaaaattttattttaactgctttactaactgctgaaagttgtgttatctctcaagtattcaaagactaaatgtgttttctttccttcccactcacaatatatctgaattagaactgctaaacacagcttgaagacttaaaaataaaagtgactcggaa

SEQ ID NO: 102640 - DNA, 3160 bp, Homo sapiens
  Payload ID: 24
  Gene Symbol: PXYLP1
  Gene Name: 2-phosphoxylose phosphatase 1
  Uniprot ID: Q8TE99
  ENST ID: ENST00000393010
  CDS Start-End: 279-1721
ccgagccgggcgcgcagcgacggagctggggccggcctgggaccatgggcgtgagtgcaatctacggatcagtctctgatggtgggtcgttaacctcagtggggactccaagatttccatgaagaaaatcagttgtcttcattcaagaattggggtctggctcagaattcctgcagctggtgaaaatctgttttctagaagaggtttaattaatgcctgcagtctgacatgttcccgatttgaggtgaaaccatgaagagaaaatagaatacttaataatgcttttccgcaaccgcttcttgctgctgctggccctggctgcgctgctggcctttgtgagcctcagcctgcagttcttccacctgatcccggtgtcgactcctaagaatggaatgagtagcaagagtcgaaagagaatcatgcccgaccctgtgacggagccccctgtgacagaccccgtttatgaagctcttttgtactgcaacatccccagcgtggccgagcgcagcatggaaggtcatgccccgcatcattttaagctggtctcagtgcatgtgttcattcgccacggagacaggtacccactgtatgtcattcccaaaacaaagcgaccagaaattgactgcactctggtggctaacaggaaaccgtatcacccaaaactggaagctttcattagtcacatgtcaaaaggatccggagcctctttcgaaagccccttgaactccttgcctctttacccaaatcacccattgtgtgagatgggagagctcacacagacaggagttgtgcagcatttgcagaacggtcagctgctgagggatatctatctaaagaaacacaaactcctgcccaatgattggtctgcagaccagctctatttagagaccactgggaaaagccggaccctacaaagtgggctggccttgctttatggctttctcccagattttgactggaagaagatttatttcaggcaccagccaagtgcgctgttctgctctggaagctgctattgcccggtaagaaaccagtatctggaaaaggagcagcgtcgtcagtacctcctacgtttgaaaaacagccagctggagaagacctacggggagatggccaagatcgtggatgtccccaccaagcagcttagagctgccaaccccatagactccatgctctgccacttctgccacaatgtcagctttccctgtaccagaaatggctgtgttgacatggagcacttcaaggtaattaagacccatcagatcgaggatgaaagggaaagacgggagaagaaattgtacttcgggtattctctcctgggtgcccaccccatcctgaaccaaaccatcggccggatgcagcgtgccaccgagggcaggaaagaagagctctttgccctctactctgctcatgatgtcactctgtcaccagttctcagtgccttgggcctttcagaagccaggttcccaaggtttgcagccaggttgatctttgagctttggcaagacagagaaaagcccagtgaacattccgtccggattctttacaatggcgtcgatgtcacattccacacctctttctgccaagaccaccacaagcgttctcccaagcccatgtgcccgcttgaaaacttggtccgctttgtgaaaagggacatgtttgtagccctgggtggcagtggtacaaattattatgatgcatgtcacagggaaggattctaaaaggtatgcagtacagcagtatagaatccatgccaatacagagcatagggaaaggtccacttctagttttgtctgttactaagggtagaagattattgctttttaaaggctaaatattgtttgtgggaaccacagatggttggggttgaacagtaagcacattgctgcaatgtggtacgtgaattgcttggtacaaaatggccagttcacagaggaatagaaggtactttatcatagccagacttcgcttagaatgccagaataatatagttcaagacctgaagttgccaatccaagtttgcactcttctggcctgccccatgttactatgtgatggaaccagcacacctcaaccaaaatttttttaatcttagacatttttaccttgtccttgttaagaatttcttgaagtgatttatctaaaataaaggttggcaaactttttctgtaaagggccagattgtaaatatttcagactgtgtggaccaaaaggccacatacagtctctgtcataactactcaactctgtttctgaagcaggaaagccaccacagacagtacataaaggaatatgtgtagctgggttcccaggccggacaaaacagatggtgaccagatttggcccctgggctgtagtttgctgacccctcatctaaaaaataggctatactacaattgcacttccagcactttgagaacgagttgaataccaagaattattcaatggttcctccagtaacttctgctagaaacacagaatttggtctgtatctgacactagaacaaaacttgagggtaaataaacattgaattagaatgaatcatagaaaactgattagaagaatacttgatgtttatgatgattgtggtacaagatagttttaagtatgttctaaatatttgtctgctgtagtctatttgctgtatatgctgaaatttttgtatgccatttagtatttttatagtttaggaaaatattttctaagaccagttttagatgactcttattcctgtagtaatattcaatttgctgtacctgcttggtggttagaaggaggctagaagatgaattcaggcactttcttccaataaaactaattatggctcattccctttgacaagctgtagaactggattcatttttaaaccattttcatcagtttcaaatggtaaattctgattgatttttaaatgcgtttttggaagaactttgctattagatagtttacagatctttataaggtgttttatatattagaagcaattataattacatctgtgatttctgaactaatggtgctaattcagagaaatggaaagtgaaagtgagattctctgttgtcatcggcattccaactttttctctttgtttttgtccagtgttgcatttgaatatgtctgtttctataaataaattttttaagaatacctatactata

SEQ ID NO: 102641 - DNA, 568 bp, Homo sapiens
  Payload ID: 24
  Gene Symbol: PXYLP1
  Gene Name: 2-phosphoxylose phosphatase 1
  ENST ID: ENST00000505013
  CDS Start-End: 132-568
cagttgcttatagtctaggaagggatcacttgtgtaacatgggagcaaatgctgcctagcggaatattcgtgacttgggacatgttcccgatttgaggtgaaaccatgaagagaaaatagaatacttaataatgcttttccgcaaccgcttcttgctgctgctggccctggctgcgctgctggcctttgtgagcctcagcctgcagttcttccacctgatcccggtgtcgactcctaagaatggaatgagtagcaagagtcgaaagagaatcatgcccgaccctgtgacggagccccctgtgacagaccccgtttatgaagctcttttgtactgcaacatccccagcgtggccgagcgcagcatggaaggtcatgccccgcatcattttaagctggtctcagtgcatgtgttcattcgccacggagacaggtacccactgtatgtcattcccaaaacaaagcgaccagaaattgactgcactctggtggctaacaggaaaccgtatcacccaaaactggaagctttcattagtcacatgtcaaaaggatccggagcctctttcgaaag

SEQ ID NO: 102642 - DNA, 2066 bp, Homo sapiens
  Payload ID: 24
  Gene Symbol: PXYLP1
  Gene Name: 2-phosphoxylose phosphatase 1
  ENST ID: ENST00000502783
  CDS Start-End: 338-1666
gggaggagctggcggcgagcgccgagccgggcgcgcagcgacggagctggggccggcctgggaccatgggcggacatgttcccgatttgaggtgaaaccatgaagagaaaatagaatacttaataatgcttttccgcaaccgcttcttgctgctgctggccctggctgcgctgctggcctttgtgagcctcagcctgcagttctaattggaaaagaggtcaaaagaaggtgggcatcagaagtttaaaaatattccagatggcaaatgaattgtaaaatctgaatcctttccaaaaagtgtgtccacctgatcccggtgtcgactcctaagaatggaatgagtagcaagagtcgaaagagaatcatgcccgaccctgtgacggagccccctgtgacagaccccgtttatgaagctcttttgtactgcaacatccccagcgtggccgagcgcagcatggaaggtcatgccccgcatcattttaagctggtctcagtgcatgtgttcattcgccacggagacaggtacccactgtatgtcattcccaaaacaaagcgaccagaaattgactgcactctggtggctaacaggaaaccgtatcacccaaaactggaagctttcattagtcacatgtcaaaaggatccggagcctctttcgaaagccccttgaactccttgcctctttacccaaatcacccattgtgtgagatgggagagctcacacagacaggagttgtgcagcatttgcagaacggtcagctgctgagggatatctatctaaagaaacacaaactcctgcccaatgattggtctgcagaccagctctatttagagaccactgggaaaagccggaccctacaaagtgggctggccttgctttatggctttctcccagattttgactggaagaagatttatttcaggcaccagccaagtgcgctgttctgctctggaagctgctattgcccggtaagaaaccagtatctggaaaaggagcagcgtcgtcagtacctcctacgtttgaaaaacagccagctggagaagacctacggggagatggccaagatcgtggatgtccccaccaagcagcttagagctgccaaccccatagactccatgctctgccacttctgccacaatgtcagctttccctgtaccagaaatggctgtgttgacatggagcacttcaaggtaattaagacccatcagatcgaggatgaaagggaaagacgggagaagaaattgtacttcgggtattctctcctgggtgcccaccccatcctgaaccaaaccatcggccggatgcagcgtgccaccgagggcaggaaagaagagctctttgccctctactctgctcatgatgtcactctgtcaccagttctcagtgccttgggcctttcagaagccaggttcccaaggtttgcagccaggttgatctttgagctttggcaagacagagaaaagcccagtgaacattccgtccggattctttacaatggcgtcgatgtcacattccacacctctttctgccaagaccaccacaagcgttctcccaagcccatgtgcccgcttgaaaacttggtccgctttgtgaaaagggacatgtttgtagccctgggtggcagtggtacaaattattatgatgcatgtcacagggaaggattctaaaaggtatgcagtacagcagtatagaatccatgccaatacagagcatagggaaaggtccacttctagttttgtctgttactaagggtagaagattattgctttttaaaggctaaatattgtttgtgggaaccacagatggttggggttgaacagtaagcacattgctgcaatgtggtacgtgaattgcttggtacaaaatggccagttcacagaggaatagaaggtactttatcatagccagacttcgcttagaatgccagaataatatagttcaagacctgaagttgccaatccaagtttgcactcttctggcctgccccatgttactatgtgatggaaccagcacacctcaaccaaaatttttttaatcttagacatttttaccttgtccttgttaaga

SEQ ID NO: 102643 - DNA, 4158 bp, Homo sapiens
  Payload ID: 24
  Gene Symbol: PXYLP1
  Gene Name: 2-phosphoxylose phosphatase 1
  ENST ID: ENST00000508812
  CDS Start-End: 1908-3323
ggaaagccagtccaagttccaaaactgaggaacttggatccgatgttcaagggcagggcgcatccagcatgggagaaagatgtaggttgggaggctaggccagcctgtctattcatattttttctgcctgcttatattccagctgcattggcagcttattagattgtgcccacccagattgagggtgggtctgcctttcccagcccactgactcaaatgtaaatctcctttggcagcacactcatagacacaccaaggagcaatactttgtgttcttcaacccaatcaagtggacacccagtattaaccatcacatctggtaacttcccaatatttcctttatatccatgtcttcactgcatcgtttccatacctgcaccccccaaccagcaaccagtgagtgcagggggccccgtgcctgagaaggctattttctccttatggtccatgtgctttctccccaccttttcttatttaatgtctgactgtcccccgcaactggattgtaaaccccgtgagggcagagaccttgtccattttattctctgaagaatccccagcatgtgctccatacatgttggatggccagatggacaaatgcataaataccgagcttagtgggtgagcaggtccgggcttacaggcttcaggaccttaggtaactcccttgacctgcctctgcctaaggtctactgtctggctgatggttactcttcctaggttgagatccaaagctgggaaaagcagagagaggatcagtttggcttgcatcctagctatagctatgggaatgtttactagtaatacatacagagtcatccactgtgcattcgggagatggggtggggaagggtggtggggagggagcctgcgtgggatagcatctggttgttttactcatgattctaagaaatttgttggttgcttttgagagggagggtcccaaggagatgctttagaggtcatgttctctgccatttctttgaaattgagaccttgtcggcatctttacacatgagggttatagatgtgtggacaggatgaaagtgatcgtagatgagatgagcagagaacaccgccataaaagagaggcttatttccaaaggtagcttacggaaatttgccctcctacttggtaatcacaccacagagaaattgcatgcccgttggtacagagttaatcatcagtaaaagatatctcgtatcctgttattcgtgttggtcctggtggcacagtggccccaggacactcatttagattcatgggttttcccacctacataatgaaactcgttatccttccatctatttatctgcccactattctttctgatgcccccacagcctctttctcttgccctgtgacatctgagctgctgtcatctgcctgaggtcagcagagtttctaattgttccacaggacagctagaggcacggggggcctgggcaaagcctgctgggaggagcagtgtcctggagcagtgtctgcccccagcccctgggtctgtccctcagctccctttatctaggtgatcggggcaagcctcaagagctgatgtggtgagtagcacagcaccagggcagaggcggcctgcagcccggggtctgctcctccaggccccttcccagccttcctcctggagcccggcctgcacatcgaccctggtgaggccaacctgaccaggccttacgggacccaaggcgtatcctgagccagcttgctgacccccatctgccatgtttggctgtgtttcacggcctcccctctgctcctctcctcttcccctccacacagccagcttcatcagtttttcaggcccagctaggtgtctcctctgggaagcctgtttggatgcccctcaccccagactggttcggcaaccctcagtgctccacatgaggagtcaatgagatatttcatcaaaagcatggagcacagcgtctgccccagttcagcagtccacctgatcccggtgtcgactcctaagaatggaatgagtagcaagagtcgaaagagaatcatgcccgaccctgtgacggagccccctgtgacagaccccgtttatgaagctcttttgtactgcaacatccccagcgtggccgagcgcagcatggaaggtcatgccccgcatcattttaagctggtctcagtgcatgtgttcattcgccacggagacaggtacccactgtatgtcattcccaaaacaaagcgaccagaaattgactgcactctggtggctaacaggaaaccgtatcacccaaaactggaagctttcattagtcacatgtcaaaaggatccggagcctctttcgaaagccccttgaactccttgcctctttacccaaatcacccattgtgtgagatgggagagctcacacagacaggagttgtgcagcatttgcagaacggtcagctgctgagggatatctatctaaagaaacacaaactcctgcccaatgattggtctgcagaccagctctatttagagaccactgggaaaagccggaccctacaaagtgggctggccttgctttatggctttctcccagattttgactggaagaagatttatttcaggcaccagccaagtgcgctgttctgctctggaagctgctattgcccggtaagaaaccagtatctggaaaaggagcagcgtcgtcagtacctcctacgtttgaaaaacagccagctggagaagacctacggggagatggccaagatcgtggatgtccccaccaagcagcttagagctgccaaccccatagactccatgctctgccacttctgccacaatgtcagctttccctgtaccagaaatggctgtgttgacatggagcacttcaaggtaattaagacccatcagatcgaggatgaaagggaaagacgggagaagaaattgtacttcgggtattctctcctgggtgcccaccccatcctgaaccaaaccatcggccggatgcagcgtgccaccgagggcaggaaagaagagctctttgccctctactctgctcatgatgtcactctgtcaccagttctcagtgccttgggcctttcagaagccaggttcccaaggtttgcagccaggttgatctttgagctttggcaagacagagaaaagcccagtgaacattccgtccggattctttacaatggcgtcgatgtcacattccacacctctttctgccaagaccaccacaagcgttctcccaagcccatgtgcccgcttgaaaacttggtccgctttgtgaaaagggacatgtttgtagccctgggtggcagtggtacaaattattatgatgcatgtcacagggaaggattctaaaaggtatgcagtacagcagtatagaatccatgccaatacagagcatagggaaaggtccacttctagttttgtctgttactaagggtagaagattattgctttttaaaggctaaatattgtttgtgggaaccacagatggttggggttgaacagtaagcacattgctgcaatgtggtacgtgaattgcttggtacaaaatggccagttcacagaggaatagaaggtactttatcatagccagacttcgcttagaatgccagaataatatagttcaagacctgaagttgccaatccaagtttgcactcttctggcctgccccatgttactatgtgatggaaccagcacacctcaaccaaaatttttttaatcttagacatttttaccttgtccttgttaagaatttcttgaagtgatttatctaaaataaaggttggcaaactttttctgtaaagggccagattgtaaatatttcagactgtgtggaccaaaaggccacatacagtctctgtcataactactcaactctgtttctgaagcaggaaagccaccacagacagtacataaaggaatatgtgtagctgggttcccaggccggacaaaacagatggtgaccagatttggcccctgggctgtagtttgctgacccctcatctaaaaaataggctatactacaattgcacttccagcactttgagaacgagttgaataccaagaattattcaatggttcctccagtaacttctgctagaaacacagaatttggtctgtatctgacactagaacaaaacttgagggtaaataaacattgaattagaatgaatcatagaaaactga

SEQ ID NO: 102644 - DNA, 569 bp, Homo sapiens
  Payload ID: 24
  Gene Symbol: PXYLP1
  Gene Name: 2-phosphoxylose phosphatase 1
  ENST ID: ENST00000512457
  CDS Start-End: 178-569
tttctgttgcagtttgaatgatggaaagaagggcaggtggctcgaattggaaaagaggtcaaaagaaggtgggcatcagaagtttaaaaatattccagatggcaaatgaattgtaaaatctgaatcctttccaaaaagtgtgtccacctgatcccggtgtcgactcctaagaatggaatgagtagcaagagtcgaaagagaatcatgcccgaccctgtgacggagccccctgtgacagaccccgtttatgaagctcttttgtactgcaacatccccagcgtggccgagcgcagcatggaaggtcatgccccgcatcattttaagctggtctcagtgcatgtgttcattcgccacggagacaggtacccactgtatgtcattcccaaaacaaagcgaccagaaattgactgcactctggtggctaacaggaaaccgtatcacccaaaactggaagctttcattagtcacatgtcaaaaggatccggagcctctttcgaaagccccttgaactccttgcctctttacccaaatcacccattgtgtgagatgggagagctcacacagacagg

SEQ ID NO: 102645 - DNA, 629 bp, Homo sapiens
  Payload ID: 24
  Gene Symbol: PXYLP1
  Gene Name: 2-phosphoxylose phosphatase 1
  ENST ID: ENST00000514880
  CDS Start-End: 141-221
gcctcccctcgcgccgggaggagctggcggcgagcgccgagccgggcgcgcagcgacggagctggggccggcctgggaccatgggcggacatgttcccgatttgaggtgaaaccatgaagagaaaatagaatacttaataatgcttttccgcaaccgcttcttgctgctgctggccctggctgcgctgctggcctttgtgagcctcagcctgcagttctgaaaccgtatcacccaaaactggaagctttcattagtcacatgtcaaaaggatccggagcctctttcgaaagccccttgaactccttgcctctttacccaaatcacccattgtgtgagatgggagagctcacacagacaggagttgtgcagcatttgcagaacggtcagctgctgagggatatctatctaaagaaacacaaactcctgcccaatgattggtctgcagaccagctctatttagagaccactgggaaaagccggaccctacaaagtgggctggccttgctttatggctttctcccagattttgactggaagaagatttatttcaggcaccagccaagtgcgctgttctgctctggaagctgctattgcccggtaagaaaccagtatctggaaaaggagcagc

SEQ ID NO: 102646 - DNA, 797 bp, Homo sapiens
  Payload ID: 24
  Gene Symbol: PXYLP1
  Gene Name: 2-phosphoxylose phosphatase 1
  ENST ID: ENST00000513528
  CDS Start-End: 364-444
gacggagctggggccggcctgggaccatgggcgccctctcccgcacggcccccgcactcccgccgctggattccagccgagattcaagctcccgggatcccccttcccgggcggtcctgagccggctagtctccagtgagtgcaatctacggatcagtctctgatggtgggtcgttaacctcagtggggactccaagatttccatgaagaaaatcagttgtcttcattcaagaattggggtctggctcagaattcctgcagctggtgaaaatctgttttctagaagaggtttaattaatgcctgcagtctgacatgttcccgatttgaggtgaaaccatgaagagaaaatagaatacttaataatgcttttccgcaaccgcttcttgctgctgctggccctggctgcgctgctggcctttgtgagcctcagcctgcagttctaattggaaaagaggtcaaaagaaggtgggcatcagaagtttaaaaatattccagatggcaaatgaattgtaaaatctgaatcctttccaaaaagtgtgtccacctgatcccggtgtcgactcctaagaatggaatgagtagcaagagtcgaaagagaatcatgcccgaccctgtgacggagccccctgtgacagaccccgtttatgaagctcttttgtactgcaacatccccagcgtggccgagcgcagcatggaaggtcatgccccgcatcattttaagctggtctcagtgcatgtgttcattcgccacggagacaggtacccactgtatgtcattcccaaaacaaagcgacca

SEQ ID NO: 102647 - DNA, 1773 bp, Homo sapiens
  Payload ID: 24
  Gene Symbol: PXYLP1
  Gene Name: 2-phosphoxylose phosphatase 1
  ENST ID: ENST00000504264
  CDS Start-End: 83-1474
aaaattttgcagggtaaattagcctgtctgggtctgagctctttattcttggatacgttggagatcggaaagatattaagatatggacgttcttactgctcttcttttagtccacctgatcccggtgtcgactcctaagaatggaatgagtagcaagagtcgaaagagaatcatgcccgaccctgtgacggagccccctgtgacagaccccgtttatgaagctcttttgtactgcaacatccccagcgtggccgagcgcagcatggaaggtcatgccccgcatcattttaagctggtctcagtgcatgtgttcattcgccacggagacaggtacccactgtatgtcattcccaaaacaaagcgaccagaaattgactgcactctggtggctaacaggaaaccgtatcacccaaaactggaagctttcattagtcacatgtcaaaaggatccggagcctctttcgaaagccccttgaactccttgcctctttacccaaatcacccattgtgtgagatgggagagctcacacagacaggagttgtgcagcatttgcagaacggtcagctgctgagggatatctatctaaagaaacacaaactcctgcccaatgattggtctgcagaccagctctatttagagaccactgggaaaagccggaccctacaaagtgggctggccttgctttatggctttctcccagattttgactggaagaagatttatttcaggcaccagccaagtgcgctgttctgctctggaagctgctattgcccggtaagaaaccagtatctggaaaaggagcagcgtcgtcagtacctcctacgtttgaaaaacagccagctggagaagacctacggggagatggccaagatcgtggatgtccccaccaagcagcttagagctgccaaccccatagactccatgctctgccacttctgccacaatgtcagctttccctgtaccagaaatggctgtgttgacatggagcacttcaaggtaattaagacccatcagatcgaggatgaaagggaaagacgggagaagaaattgtacttcgggtattctctcctgggtgcccaccccatcctgaaccaaaccatcggccggatgcagcgtgccaccgagggcaggaaagaagagctctttgccctctactctgctcatgatgtcactctgtcaccagttctcagtgccttgggcctttcagaagccaggttcccaaggtttgcagccaggttgatctttgagctttggcaagacagagaaaagcccagtgaacattccgtccggattctttacaatggcgtcgatgtcacattccacacctctttctgccaagaccaccacaagcgttctcccaagcccatgtgcccgcttgaaaacttggtccgctttgtgaaaagggacatgtttgtagccctgggtggcagtggtacaaattattatgatgcatgtcacagggaaggattctaaaaggtatgcagtacagcagtatagaatccatgccaatacagagcatagggaaaggtccacttctagttttgtctgttactaagggtagaagattattgctttttaaaggctaaatattgtttgtgggaaccacagatggttggggttgaacagtaagcacattgctgcaatgtggtacgtgaattgcttggtacaaaatggccagttcacagaggaatagaaggtactttatcatagccagacttcgcttagaatgccagaataatatagttcaagacctgaagttgccaatccaagtt

SEQ ID NO: 102648 - DNA, 478 bp, Homo sapiens
  Payload ID: 24
  Gene Symbol: PXYLP1
  Gene Name: 2-phosphoxylose phosphatase 1
  ENST ID: ENST00000514680
  CDS Start-End: 193-478
agcgacggagctggggccggcctgggaccatgggcgtgagtgcaatctacggatcagtctctgatggtgggtcgttaacctcagtggggactccaagatttccatgaagaaaatcagttgtcttcattcaagaattggggacatgttcccgatttgaggtgaaaccatgaagagaaaatagaatacttaataatgcttttccgcaaccgcttcttgctgctgctggccctggctgcgctgctggcctttgtgagcctcagcctgcagttcttccacctgatcccggtgtcgactcctaagaatggaatgagtagcaagagtcgaaagagaatcatgcccgaccctgtgacggagccccctgtgacagaccccgtttatgaagctcttttgtactgcaacatccccagcgtggccgagcgcagcatggaaggtcatgccccgcatcattttaagctggtctcagtgcatgtgttcattc

SEQ ID NO: 102649 - DNA, 2465 bp, Homo sapiens
  Payload ID: 25
  Gene Symbol: BPNT1
  Gene Name: 3'(2'), 5'-bisphosphate nucleotidase 1
  Uniprot ID: O95861
  ENST ID: ENST00000322067
  CDS Start-End: 177-1103
gcttgcgcgcagtttcccgcatgctcagtagctgaggtagggatgccatccttctcaaaagacttattgacagtgccaaagctcggtactggacacaacgagggacctgggtctacgataacgcgcttttgctcctcctgaagtgtctttggtccaacgttgttccagagtgtaccatggcttccagtaacactgtgttgatgcggttggtagcctccgcatattctattgctcaaaaggcaggaatgatagtcagacgtgttattgctgaaggagacctgggtattgtggagaagacctgtgcaacagacctgcagaccaaagctgaccgattggcacagatgagcatatgttcttcattggcccggaaattccccaaactcacaattataggggaagaggatctgccttctgaggaagtggatcaagagctgattgaagacagtcagtgggaagaaatactgaagcaaccatgcccatcgcagtacagtgctattaaagaagaagatctcgtggtctgggttgatcctctggatggaaccaaggaatataccgaaggtcttcttgacaatgtaacagttcttattggaattgcttatgaaggaaaagccatagcaggagttattaaccagccatattacaactatgaggcaggaccagatgctgtgttggggaggacaatctggggagttttaggtttaggcgcctttgggtttcagctgaaagaagtccctgctgggaaacacattatcacaactactcgatcccatagcaacaagttggttactgactgtgttgctgctatgaaccccgatgctgtgctgcgagtaggaggagcaggaaataagattattcagctgattgaaggcaaagcctctgcttatgtatttgcaagtcctggttgtaagaagtgggatacttgtgctccagaagttattttacatgctgtgggaggcaagttaaccgatatccatgggaatgttcttcagtaccacaaggatgtgaagcatatgaactctgcaggagtcctggccacactgaggaattatgactactatgcaagccgagttccagaatctattaaaaatgcacttgttccttaaaggaaagtttcatttggccgggcgcggtggctcatgcctgtaatcccagcactttgggaggccgaggcaggtggatcacttgagctcaggagtttgagaccagcctgggcaatatcgtgagaccccatctctacaaaaatacaaattaactgggcatcctgtcatgcgcctgtcatcccagctacttgagaggctgaagcagaagaatctcttgagcccggaaggcagaggttgcagtgagctgagatcgtgccactgcactccagcctgagtgacaggagttaagccctgtctcagaaaaaaaaaaaacaaaaacccaaaaagtacttaaagtttcatttacttagctaggagaaagacttggttctcaaaataatacattttaagattaattgggtagaattagagttccacctttattcattgttgagcagtgatttatatttagttattatatttaggaatagaaaatagaattaaataatttaacttgattaatcaaccagaccaattttgacgtctggagaacttataaactcaatatgttatatttgttttcctgtatttaggtggagaaatgagaaaaagctttagttccaattgacagttcaggtcaatgttcaatgaacattcctatcttctaaaccagatttctctttttttttcctgagacggagtctcgctctgtagcctaggctagaatgtagtggcgtgatctcggctcactgcaagctccgcctcccgggttcatgccattctcctgcctcagcctcccgagtagctgggactgcaggcaccgccaccacgcctggctaattttttgtatttttagtagagaaggtgtttcaccgtgttagccaggatggtcttgatctcctgacatcgtgatctgtctgcctcggactcccaaagtgctgggattacaggtgtgagccaccgcacctggcctaaaccagatttctttagggcacaattttttctggaatctcactcttgtttttcacagtaattttaaaaacgtttctactccaattaagaatatatatgatgttattatatatgcttatgaaacagatttatgagaaaagttttttttaaataaattatttaatcctagctctttgttattcaccagctttttaaaaaagtgtttgaaaattatacattctcgactttggggattagtttattcttgtggcatcattataaggcttaattgtggaaagctaagtacttgcttctattccttccaatgagagattataacataaactattaaaattattctgctaatatacctagatttttatttttaggtctctgtccattgcttttaattaaaattatctgttttcaaatcaa

SEQ ID NO: 102650 - DNA, 1152 bp, Homo sapiens
  Payload ID: 25
  Gene Symbol: BPNT1
  Gene Name: 3'(2'), 5'-bisphosphate nucleotidase 1
  ENST ID: ENST00000354807
  CDS Start-End: 96-971
ctcggtactggacacaacgagggacctgggtctacgataacgcgcttttgctcctcctgaagtgtctttggtccaacgttgttccagagtgtaccatggcttccagtaacactgtgttgatgcggttggtagcctccgcatattctattgctcaaaaggcaggaatgatagtcagacgtgttattgctgaaggagacctgggtattgtggagaagacctgtgcaacagacctgcagaccaaagctgaccgattggcacagatgagcatatgttcttcattggcccggaaattccccaaactcacaattataggggaagaggatctgccttctgaggaagtggatcaagagctgattgaagacagtcagtgggaagaaatactgaagcaaccatgcccatcgcagtacagtgctattaaagaagaagatctcgtggtctgggttgatcctctggatggaaccaaggaatataccgaaggtcttcttgacaatgtaacagttcttattggaattgcttatgaaggaaaagccatagcaggagttattaaccagccatattacaactatgagaacaatgaaaaacagcagttaagggaacacaggaatgaagcaaaggcaggaccagatgctgtgttggggaggacaatctggggagttttaggtttaggcgcctttgggtttcagctgaaagaagtccctgctgggaaacacattatcacaactactcgatcccatagcaacaagttggttactgactgtgttgctgctatgaaccccgatgctgtgctgcgagtaggaggagcaggaaataagattattcagctgattgaaggcaaagcctctgcttatgtatttgcaagtcctggttgtaagaagtgggatacttgtgctccagaagttattttacatgctgtgggaggcaagttaaccgatatccatgggaatgttcttcagtaccacaaggatgtgtgagccaccgcacctggcctaaaccagatttctttagggcacaattttttctggaatctcactcttgtttttcacagtaattttaaaaacgtttctactccaattaagaatatatatgatgttattatatatgcttatgaaacagatttatgagaaaagttttttttaaataaattatttaatc

SEQ ID NO: 102651 - DNA, 2357 bp, Homo sapiens
  Payload ID: 25
  Gene Symbol: BPNT1
  Gene Name: 3'(2'), 5'-bisphosphate nucleotidase 1
  Uniprot ID: O95861
  ENST ID: ENST00000414869
  CDS Start-End: 177-995
gcttgcgcgcagtttcccgcatgctcagtagctgaggtagggatgccatccttctcaaaagacttattgacagtgccaaagctcggtactggacacaacgagggacctgggtctacgataacgcgcttttgctcctcctgaagtgtctttggtccaacgttgttccagagtgtaccatggcttccagtaacactgtgttgatgcggttggtagcctccgcatattctattgctcaaaaggcaggaatgatagtcagacgtgttattgctgaaggagacctgggtattgtggagaagacctgtgcaacagacctgcagaccaaagctgaccgattggcacagatgagcatatgttcttcattggcccggaaattccccaaactcacaattataggggaagagctcgtggtctgggttgatcctctggatggaaccaaggaatataccgaaggtcttcttgacaatgtaacagttcttattggaattgcttatgaaggaaaagccatagcaggagttattaaccagccatattacaactatgaggcaggaccagatgctgtgttggggaggacaatctggggagttttaggtttaggcgcctttgggtttcagctgaaagaagtccctgctgggaaacacattatcacaactactcgatcccatagcaacaagttggttactgactgtgttgctgctatgaaccccgatgctgtgctgcgagtaggaggagcaggaaataagattattcagctgattgaaggcaaagcctctgcttatgtatttgcaagtcctggttgtaagaagtgggatacttgtgctccagaagttattttacatgctgtgggaggcaagttaaccgatatccatgggaatgttcttcagtaccacaaggatgtgaagcatatgaactctgcaggagtcctggccacactgaggaattatgactactatgcaagccgagttccagaatctattaaaaatgcacttgttccttaaaggaaagtttcatttggccgggcgcggtggctcatgcctgtaatcccagcactttgggaggccgaggcaggtggatcacttgagctcaggagtttgagaccagcctgggcaatatcgtgagaccccatctctacaaaaatacaaattaactgggcatcctgtcatgcgcctgtcatcccagctacttgagaggctgaagcagaagaatctcttgagcccggaaggcagaggttgcagtgagctgagatcgtgccactgcactccagcctgagtgacaggagttaagccctgtctcagaaaaaaaaaaaacaaaaacccaaaaagtacttaaagtttcatttacttagctaggagaaagacttggttctcaaaataatacattttaagattaattgggtagaattagagttccacctttattcattgttgagcagtgatttatatttagttattatatttaggaatagaaaatagaattaaataatttaacttgattaatcaaccagaccaattttgacgtctggagaacttataaactcaatatgttatatttgttttcctgtatttaggtggagaaatgagaaaaagctttagttccaattgacagttcaggtcaatgttcaatgaacattcctatcttctaaaccagatttctctttttttttcctgagacggagtctcgctctgtagcctaggctagaatgtagtggcgtgatctcggctcactgcaagctccgcctcccgggttcatgccattctcctgcctcagcctcccgagtagctgggactgcaggcaccgccaccacgcctggctaattttttgtatttttagtagagaaggtgtttcaccgtgttagccaggatggtcttgatctcctgacatcgtgatctgtctgcctcggactcccaaagtgctgggattacaggtgtgagccaccgcacctggcctaaaccagatttctttagggcacaattttttctggaatctcactcttgtttttcacagtaattttaaaaacgtttctactccaattaagaatatatatgatgttattatatatgcttatgaaacagatttatgagaaaagttttttttaaataaattatttaatcctagctctttgttattcaccagctttttaaaaaagtgtttgaaaattatacattctcgactttggggattagtttattcttgtggcatcattataaggcttaattgtggaaagctaagtacttgcttctattccttccaatgagagattataacataaactattaaaattattctgctaatatacctagatttttatttttaggtctctgtccattgcttttaattaaaattatctgttttcaaatcaa

SEQ ID NO: 102652 - DNA, 2379 bp, Homo sapiens
  Payload ID: 25
  Gene Symbol: BPNT1
  Gene Name: 3'(2'), 5'-bisphosphate nucleotidase 1
  Uniprot ID: O95861
  ENST ID: ENST00000544404
  CDS Start-End: 256-1017
gcttgcgcgcagtttcccgcatgctcagtagctgaggtagggatgccatccttctcaaaagacttattgacagtgccaaagctcggtactggacacaacgagggacctgggtctacgataacgcgcttttgctcctcctgaagtgtctttggtccaacgttgttccaggtttgtcaccgtttctctccggccggtcagggcaagagccagacctgtgcaacagacctgcagaccaaagctgaccgattggcacagatgagcatatgttcttcattggcccggaaattccccaaactcacaattataggggaagaggatctgccttctgaggaagtggatcaagagctgattgaagacagtcagtgggaagaaatactgaagcaaccatgcccatcgcagtacagtgctattaaagaagaagatctcgtggtctgggttgatcctctggatggaaccaaggaatataccgaaggtcttcttgacaatgtaacagttcttattggaattgcttatgaaggaaaagccatagcaggagttattaaccagccatattacaactatgaggcaggaccagatgctgtgttggggaggacaatctggggagttttaggtttaggcgcctttgggtttcagctgaaagaagtccctgctgggaaacacattatcacaactactcgatcccatagcaacaagttggttactgactgtgttgctgctatgaaccccgatgctgtgctgcgagtaggaggagcaggaaataagattattcagctgattgaaggcaaagcctctgcttatgtatttgcaagtcctggttgtaagaagtgggatacttgtgctccagaagttattttacatgctgtgggaggcaagttaaccgatatccatgggaatgttcttcagtaccacaaggatgtgaagcatatgaactctgcaggagtcctggccacactgaggaattatgactactatgcaagccgagttccagaatctattaaaaatgcacttgttccttaaaggaaagtttcatttggccgggcgcggtggctcatgcctgtaatcccagcactttgggaggccgaggcaggtggatcacttgagctcaggagtttgagaccagcctgggcaatatcgtgagaccccatctctacaaaaatacaaattaactgggcatcctgtcatgcgcctgtcatcccagctacttgagaggctgaagcagaagaatctcttgagcccggaaggcagaggttgcagtgagctgagatcgtgccactgcactccagcctgagtgacaggagttaagccctgtctcagaaaaaaaaaaaacaaaaacccaaaaagtacttaaagtttcatttacttagctaggagaaagacttggttctcaaaataatacattttaagattaattgggtagaattagagttccacctttattcattgttgagcagtgatttatatttagttattatatttaggaatagaaaatagaattaaataatttaacttgattaatcaaccagaccaattttgacgtctggagaacttataaactcaatatgttatatttgttttcctgtatttaggtggagaaatgagaaaaagctttagttccaattgacagttcaggtcaatgttcaatgaacattcctatcttctaaaccagatttctctttttttttcctgagacggagtctcgctctgtagcctaggctagaatgtagtggcgtgatctcggctcactgcaagctccgcctcccgggttcatgccattctcctgcctcagcctcccgagtagctgggactgcaggcaccgccaccacgcctggctaattttttgtatttttagtagagaaggtgtttcaccgtgttagccaggatggtcttgatctcctgacatcgtgatctgtctgcctcggactcccaaagtgctgggattacaggtgtgagccaccgcacctggcctaaaccagatttctttagggcacaattttttctggaatctcactcttgtttttcacagtaattttaaaaacgtttctactccaattaagaatatatatgatgttattatatatgcttatgaaacagatttatgagaaaagttttttttaaataaattatttaatcctagctctttgttattcaccagctttttaaaaaagtgtttgaaaattatacattctcgactttggggattagtttattcttgtggcatcattataaggcttaattgtggaaagctaagtacttgcttctattccttccaatgagagattataacataaactattaaaattattctgctaatatacctagatttttatttttaggtctctgtccattgcttttaattaaaattatctgttttcaaatcaa

SEQ ID NO: 102653 - DNA, 2737 bp, Homo sapiens
  Payload ID: 25
  Gene Symbol: BPNT1
  Gene Name: 3'(2'), 5'-bisphosphate nucleotidase 1
  Uniprot ID: O95861
  ENST ID: ENST00000469520
  CDS Start-End: 451-1377
attagctgggtgtggtggcgcgcacctccaccagtagtcccagctacacggaaggctgaggcgggaggatggcttgagcctagaagtgggaaggcagcagtgagccgtaatcgactctgggcgacagagcaagctatctatcgcttaaaaaaaaaaaaaaaaaaaaaaaaaaaaaggtgacttgcacctacggagagcttggagaaaacacggacaagtggaattttcccgcggatcaggagtctaaagaggcagtgtgaaatcgctgttgtgcgcttgcgcgcagtttcccgcatgctcagtagctgaggtagggatgccatccttctcaaaagacttattgacagtgccaaagctcggtactggacacaacgagggacctgggtctacgataacgcgcttttgctcctcctgaagtgtctttggtccaacgttgttccagagtgtaccatggcttccagtaacactgtgttgatgcggttggtagcctccgcatattctattgctcaaaaggcaggaatgatagtcagacgtgttattgctgaaggagacctgggtattgtggagaagacctgtgcaacagacctgcagaccaaagctgaccgattggcacagatgagcatatgttcttcattggcccggaaattccccaaactcacaattataggggaagaggatctgccttctgaggaagtggatcaagagctgattgaagacagtcagtgggaagaaatactgaagcaaccatgcccatcgcagtacagtgctattaaagaagaagatctcgtggtctgggttgatcctctggatggaaccaaggaatataccgaaggtcttcttgacaatgtaacagttcttattggaattgcttatgaaggaaaagccatagcaggagttattaaccagccatattacaactatgaggcaggaccagatgctgtgttggggaggacaatctggggagttttaggtttaggcgcctttgggtttcagctgaaagaagtccctgctgggaaacacattatcacaactactcgatcccatagcaacaagttggttactgactgtgttgctgctatgaaccccgatgctgtgctgcgagtaggaggagcaggaaataagattattcagctgattgaaggcaaagcctctgcttatgtatttgcaagtcctggttgtaagaagtgggatacttgtgctccagaagttattttacatgctgtgggaggcaagttaaccgatatccatgggaatgttcttcagtaccacaaggatgtgaagcatatgaactctgcaggagtcctggccacactgaggaattatgactactatgcaagccgagttccagaatctattaaaaatgcacttgttccttaaaggaaagtttcatttggccgggcgcggtggctcatgcctgtaatcccagcactttgggaggccgaggcaggtggatcacttgagctcaggagtttgagaccagcctgggcaatatcgtgagaccccatctctacaaaaatacaaattaactgggcatcctgtcatgcgcctgtcatcccagctacttgagaggctgaagcagaagaatctcttgagcccggaaggcagaggttgcagtgagctgagatcgtgccactgcactccagcctgagtgacaggagttaagccctgtctcagaaaaaaaaaaaacaaaaacccaaaaagtacttaaagtttcatttacttagctaggagaaagacttggttctcaaaataatacattttaagattaattgggtagaattagagttccacctttattcattgttgagcagtgatttatatttagttattatatttaggaatagaaaatagaattaaataatttaacttgattaatcaaccagaccaattttgacgtctggagaacttataaactcaatatgttatatttgttttcctgtatttaggtggagaaatgagaaaaagctttagttccaattgacagttcaggtcaatgttcaatgaacattcctatcttctaaaccagatttctctttttttttcctgagacggagtctcgctctgtagcctaggctagaatgtagtggcgtgatctcggctcactgcaagctccgcctcccgggttcatgccattctcctgcctcagcctcccgagtagctgggactgcaggcaccgccaccacgcctggctaattttttgtatttttagtagagaaggtgtttcaccgtgttagccaggatggtcttgatctcctgacatcgtgatctgtctgcctcggactcccaaagtgctgggattacaggtgtgagccaccgcacctggcctaaaccagatttctttagggcacaattttttctggaatctcactcttgtttttcacagtaattttaaaaacgtttctactccaattaagaatatatatgatgttattatatatgcttatgaaacagatttatgagaaaagttttttttaaataaattatttaatcctagctctttgttattcaccagctttttaaaaaagtgtttgaaaattatacattctcgactttggggattagtttattcttgtggcatcattataaggcttaattgtggaaagctaagtacttgcttctattccttccaatgagagattataacataaactattaaaattattctgctaatatacctagatttttatttttaggtctctgtccattgcttttaattaaaattatctgttttcaaatc

SEQ ID NO: 102654 - DNA, 559 bp, Homo sapiens
  Payload ID: 25
  Gene Symbol: BPNT1
  Gene Name: 3'(2'), 5'-bisphosphate nucleotidase 1
  ENST ID: ENST00000498791
  CDS Start-End: 151-559
agtagctgaggtagggatgccatccttctcaaaagacttattgacagtgccaaagctcggtactggacacaacgagggacctgggtctacgataacgcgcttttgctcctcctgaagtgtctttggtccaacgttgttccagagtgtaccatggcttccagtaacactgtgttgatgcggttggtagcctccgcatattctattgctcaaaaggcaggaatgatagtcagacgtgttattgctgaaggagacctgggtattgtggagaagacctgtgcaacagacctgcagaccaaagctgaccgattggcacagatgagcatatgttcttcattggcccggaaattccccaaactcacaattataggggaagagctcgtggtctgggttgatcctctggatggaaccaaggaatataccgaaggtcttcttgacaatgtaacagttcttattggaattgcttatgaaggaaaagccatagcaggagttattaaccagccatattacaactatgaggcaggaccagatgctgtgttggggaggacaatctggggagttt

SEQ ID NO: 102655 - DNA, 644 bp, Homo sapiens
  Payload ID: 25
  Gene Symbol: BPNT1
  Gene Name: 3'(2'), 5'-bisphosphate nucleotidase 1
  ENST ID: ENST00000463953
  CDS Start-End: 135-644
ggtactggacacaacgagggacctgggtctacgataacgcgcttttgctcctcctgaagtgtctttggtccaacgttgttccaggtttgtcaccgtttctctccggccggtcagggcaagagccagagtgtaccatggcttccagtaacactgtgttgatgcggttggtagcctccgcatattctattgctcaaaaggcaggaatgatagtcagacgtgttattgctgaaggagacctgggtattgtggagaagacctgtgcaacagacctgcagaccaaagctgaccgattggcacagatgagcatatgttcttcattggcccggaaattccccaaactcacaattataggggaagagctcgtggtctgggttgatcctctggatggaaccaaggaatataccgaaggtcttcttgacaatgtaacagttcttattggaattgcttatgaaggaaaagccatagcaggagttattaaccagccatattacaactatgaggcaggaccagatgctgtgttggggaggacaatctggggagttttaggtttaggcgcctttgggtttcagctgaaagaagtccctgctgggaaacacattatcacaactactcgatcccatagcaacaagttggttactgactgt

SEQ ID NO: 102656 - DNA, 583 bp, Homo sapiens
  Payload ID: 25
  Gene Symbol: BPNT1
  Gene Name: 3'(2'), 5'-bisphosphate nucleotidase 1
  ENST ID: ENST00000480959
  CDS Start-End: 236-583
atgctcagtagctgaggtagggatgccatccttctcaaaagacttattgacagtgccaaagctcggtactggacacaacgagggacctgggtctacgataacgcgcttttgctcctcctgaagtgtctttggtccaacgttgttccaggtttgtcaccgtttctctccggccggtcagggcaagagccagacctgtgcaacagacctgcagaccaaagctgaccgattggcacagatgagcatatgttcttcattggcccggaaattccccaaactcacaattataggggaagaggatctgccttctgaggaagtggatcaagagctgattgaagacagtcagtgggaagaaatactgaagcaaccatgcccatcgcagtacagtgctattaaagaagaagatctcgtggtctgggttgatcctctggatggaaccaaggaatataccgaaggtcttcttgacaatgtaacagttcttattggaattgcttatgaaggaaaagccatagcaggagttattaaccagccatattacaactatgaggcaggaccagatgctgtgttggggaggacaatctgggga

SEQ ID NO: 102657 - DNA, 569 bp, Homo sapiens
  Payload ID: 25
  Gene Symbol: BPNT1
  Gene Name: 3'(2'), 5'-bisphosphate nucleotidase 1
  ENST ID: ENST00000498237
  CDS Start-End: 178-569
gatgccatccttctcaaaagacttattgacagtgccaaagctcggtactggacacaacgagggacctgggtctacgataacgcgcttttgctcctcctgaagtgtctttggtccaacgttgttccaggtttgtcaccgtttctctccggccggtcagggcaagagccagagtgtaccatggcttccagtaacactgtgttgatgcggttggtagcctccgcatattctattgctcaaaaggcaggaatgatagtcagacgtgttattgctgaaggagacctgggtattgtggagaagacctgtgcaacagacctgcagaccaaagctgaccgattggcacagatgagcatatgttcttcattggcccggaaattccccaaactcacaattataggggaagaggatctgccttctgaggaagtggatcaagagctgattgaagacagtcagtgggaagaaatactgaagcaaccatgcccatcgcagtacagtgctattaaagaagaagatctcgtggtctgggttgatcctctggatggaaccaaggaatataccgaaggtcttcttga

SEQ ID NO: 102658 - DNA, 4585 bp, Homo sapiens
  Payload ID: 26
  Gene Symbol: HMGCR
  Gene Name: 3-hydroxy-3-methylglutaryl-CoA reductase
  Uniprot ID: P04035
  ENST ID: ENST00000287936
  CDS Start-End: 157-2823
ctcttattggtcgaaggctcgtccagctccgagcgtgcgtaaggtgagggctccttccgctccgcgactgcgttaactggagccaggctgagcgtcggcgccggggttcggtggcctctagtgagatctggaggatccaaggattctgtagctacaatgttgtcaagactttttcgaatgcatggcctctttgtggcctcccatccctgggaagtcatagtggggacagtgacactgaccatctgcatgatgtccatgaacatgtttactggtaacaataagatctgtggttggaattatgaatgtccaaagtttgaagaggatgttttgagcagtgacattataattctgacaataacacgatgcatagccatcctgtatatttacttccagttccagaatttacgtcaacttggatcaaaatatattttgggtattgctggccttttcacaattttctcaagttttgtattcagtacagttgtcattcacttcttagacaaagaattgacaggcttgaatgaagctttgccctttttcctacttttgattgacctttccagagcaagcacattagcaaagtttgccctcagttccaactcacaggatgaagtaagggaaaatattgctcgtggaatggcaattttaggtcctacgtttaccctcgatgctcttgttgaatgtcttgtgattggagttggtaccatgtcaggggtacgtcagcttgaaattatgtgctgctttggctgcatgtcagttcttgccaactacttcgtgttcatgactttcttcccagcttgtgtgtccttggtattagagctttctcgggaaagccgcgagggtcgtccaatttggcagctcagccattttgcccgagttttagaagaagaagaaaataagccgaatcctgtaactcagagggtcaagatgattatgtctctaggcttggttcttgttcatgctcacagtcgctggatagctgatccttctcctcaaaacagtacagcagatacttctaaggtttcattaggactggatgaaaatgtgtccaagagaattgaaccaagtgtttccctctggcagttttatctctctaaaatgatcagcatggatattgaacaagttattaccctaagtttagctctccttctggctgtcaagtacatcttctttgaacaaacagagacagaatctacactctcattaaaaaaccctatcacatctcctgtagtgacacaaaagaaagtcccagacaattgttgtagacgtgaacctatgctggtcagaaataaccagaaatgtgattcagtagaggaagagacagggataaaccgagaaagaaaagttgaggttataaaacccttagtggctgaaacagataccccaaacagagctacatttgtggttggtaactcctccttactcgatacttcatcagtactggtgacacaggaacctgaaattgaacttcccagggaacctcggcctaatgaagaatgtctacagatacttgggaatgcagagaaaggtgcaaaattccttagtgatgctgagatcatccagttagtcaatgctaagcatatcccagcctacaagttggaaactctgatggaaactcatgagcgtggtgtatctattcgccgacagttactttccaagaagctttcagaaccttcttctctccagtacctaccttacagggattataattactccttggtgatgggagcttgttgtgagaatgttattggatatatgcccatccctgttggagtggcaggacccctttgcttagatgaaaaagaatttcaggttccaatggcaacaacagaaggttgtcttgtggccagcaccaatagaggctgcagagcaataggtcttggtggaggtgccagcagccgagtccttgcagatgggatgactcgtggcccagttgtgcgtcttccacgtgcttgtgactctgcagaagtgaaagcctggctcgaaacatctgaagggttcgcagtgataaaggaggcatttgacagcactagcagatttgcacgtctacagaaacttcatacaagtatagctggacgcaacctttatatccgtttccagtccaggtcaggggatgccatggggatgaacatgatttcaaagggtacagagaaagcactttcaaaacttcacgagtatttccctgaaatgcagattctagccgttagtggtaactattgtactgacaagaaacctgctgctataaattggatagagggaagaggaaaatctgttgtttgtgaagctgtcattccagccaaggttgtcagagaagtattaaagactaccacagaggctatgattgaggtcaacattaacaagaatttagtgggctctgccatggctgggagcataggaggctacaacgcccatgcagcaaacattgtcaccgccatctacattgcctgtggacaggatgcagcacagaatgttggtagttcaaactgtattactttaatggaagcaagtggtcccacaaatgaagatttatatatcagctgcaccatgccatctatagagataggaacggtgggtggtgggaccaacctactacctcagcaagcctgtttgcagatgctaggtgttcaaggagcatgcaaagataatcctggggaaaatgcccggcagcttgcccgaattgtgtgtgggaccgtaatggctggggaattgtcacttatggcagcattggcagcaggacatcttgtcaaaagtcacatgattcacaacaggtcgaagatcaatttacaagacctccaaggagcttgcaccaagaagacagcctgaatagcccgacagttctgaactggaacatgggcattgggttctaaaggactaacataaaatctgtgaattaaaaaagctcaatgcattgtcttgtggaggatgaatagatgtgatcactgagacagccacttggtttttggctctttcagagaggtctcaggttctttccatgcagactcctcagatctgaacacagtttagtgctttacatgctgtgctctttgaagagatttcaacaagaatattgtatgttaaagcatcagagatggtaatctacagctcacctctgaaggcaaatataagctgggaaaaaagttttgatgaaattcttgaagttcatggtgatcagtgcaattgaccttctccctcactcctgccagttgaaaatggatttttaaattatactgtagctgatgaaactcctgattttgtagttaatttattaagtctgggatgtagaacttcaagaagtaagagctaagttctaagttcatgtttgtaaattaatacttcatttggtgctggtctattttgattttggggggtaatcagcattattcttcagaaggggacctgttttcttcaagggaagaaacactcttattcccaaactacagaataatgtgttaaacatgctaaatagttctatcaggaaaacaaatcactgtatttatctccgcaggctatttgttcagagaggccttttgtttaaatataaatgtttaaatataaatgtttgtctggattggctataacatgtctttcagcattaggcttttaagaaacacagggttttgtattctttactaaagatatcagagctcttaatgttgcttagatgagggtgactgtcaagtacaagcaagactgggaccttagaaatcattgtagaaacacagttttgaaagaaaaataccatgtctctaagccaactttaattgcttaaaagacatttttatttagttgaaaaatctagttttttttgtaaactgtatcaaatctgtatatgttgtaataaaacttatgctagtttattggaagtgttcaagaaataaaaatcaacttgtgtactgataaaatactctagcctgggccagagaagataatgttctttaatgttgtccaggaaaccctggcttgcttgccgagcctaatgaaagggaaagtcagctttcagagccagtgaaggagccacgtgaatggccctagaactgtgcctagttcctgtggccaggaggttggtgactgaaacattcacacagggctctttgatggacccacgaacgctcttagctttctcagggggtcagcagagttattgaatcttaattttttttaatgtacaagttttgtataaataataaagaactccttattttgtattacatctaatgcttcaagtgttgctcttggaaagctgatgatgtctcttgtagaagatggactctgaaaaacattccaggaaaccatggcagcatggagagcctcttagtgattgtgtctgcattgttattgtggaagatttaccttttctgttgtacgtaaagcttaaattgcttttgttgtgactttttagccagtgactttttctgagcttttcatggaagtggcagtgaaaaatatgttgagtgttcattttagtgactgtaattaatatcttgctggattaatgttttgtacaattactaaattgtatacattttgttatagaatacttttttctagtttcagtaaataatgaaaaggaagttaataccaataa

SEQ ID NO: 102659 - DNA, 3681 bp, Homo sapiens
  Payload ID: 26
  Gene Symbol: HMGCR
  Gene Name: 3-hydroxy-3-methylglutaryl-CoA reductase
  Uniprot ID: P04035
  ENST ID: ENST00000343975
  CDS Start-End: 93-2600
cgactgcgttaactggagccaggctgagcgtcggcgccggggttcggtggcctctagtgagatctggaggatccaaggattctgtagctacaatgttgtcaagactttttcgaatgcatggcctctttgtggcctcccatccctgggaagtcatagtggggacagtgacactgaccatctgcatgatgtccatgaacatgtttactggtaacaataagatctgtggttggaattatgaatgtccaaagtttgaagaggatgttttgagcagtgacattataattctgacaataacacgatgcatagccatcctgtatatttacttccagttccagaatttacgtcaacttggatcaaaatatattttgggtattgctggccttttcacaattttctcaagttttgtattcagtacagttgtcattcacttcttagacaaagaattgacaggcttgaatgaagctttgccctttttcctacttttgattgacctttccagagcaagcacattagcaaagtttgccctcagttccaactcacaggatgaagtaagggaaaatattgctcgtggaatggcaattttaggtcctacgtttaccctcgatgctcttgttgaatgtcttgtgattggagttggtaccatgtcaggggtacgtcagcttgaaattatgtgctgctttggctgcatgtcagttcttgccaactacttcgtgttcatgactttcttcccagcttgtgtgtccttggtattagagctttctcgggaaagccgcgagggtcgtccaatttggcagctcagccattttgcccgagttttagaagaagaagaaaataagccgaatcctgtaactcagagggtcaagatgattatgtctctaggcttggttcttgttcatgctcacagtcgctggatagctgatccttctcctcaaaacagtacagcagatacttctaaggtttcattaggactggatgaaaatgtgtccaagagaattgaaccaagtgtttccctctggcagttttatctctctaaaatgatcagcatggatattgaacaagttattaccctaagtttagctctccttctggctgtcaagtacatcttctttgaacaaacagagacagaatctacactctcattaaaaaaccctatcacatctcctgtagtgacacaaaagaaagtcccagacaattgttgtagacgtgaacctatgctggtcagaaataaccagaaatgtgattcagtagaggaagagacagggataaaccgagaaagaaaagttgaggttataaaacccttagtggctgaaacagataccccaaacagagctacatttgtggttggtaactcctccttactcgatacttcatcagtactggtgacacaggaacctgaaattgaacttcccagggaacctcggcctaatgaagaatgtctacagatacttgggaatgcagagaaaggtgcaaaattccttagtgatgctgagatcatccagttagtcaatgctaagcatatcccagcctacaagttggaaactctgatggaaactcatgagcgtggtgtatctattcgccgacagttactttccaagaagctttcagaaccttcttctctccagtacctaccttacagggattataattactccttgcttggtggaggtgccagcagccgagtccttgcagatgggatgactcgtggcccagttgtgcgtcttccacgtgcttgtgactctgcagaagtgaaagcctggctcgaaacatctgaagggttcgcagtgataaaggaggcatttgacagcactagcagatttgcacgtctacagaaacttcatacaagtatagctggacgcaacctttatatccgtttccagtccaggtcaggggatgccatggggatgaacatgatttcaaagggtacagagaaagcactttcaaaacttcacgagtatttccctgaaatgcagattctagccgttagtggtaactattgtactgacaagaaacctgctgctataaattggatagagggaagaggaaaatctgttgtttgtgaagctgtcattccagccaaggttgtcagagaagtattaaagactaccacagaggctatgattgaggtcaacattaacaagaatttagtgggctctgccatggctgggagcataggaggctacaacgcccatgcagcaaacattgtcaccgccatctacattgcctgtggacaggatgcagcacagaatgttggtagttcaaactgtattactttaatggaagcaagtggtcccacaaatgaagatttatatatcagctgcaccatgccatctatagagataggaacggtgggtggtgggaccaacctactacctcagcaagcctgtttgcagatgctaggtgttcaaggagcatgcaaagataatcctggggaaaatgcccggcagcttgcccgaattgtgtgtgggaccgtaatggctggggaattgtcacttatggcagcattggcagcaggacatcttgtcaaaagtcacatgattcacaacaggtcgaagatcaatttacaagacctccaaggagcttgcaccaagaagacagcctgaatagcccgacagttctgaactggaacatgggcattgggttctaaaggactaacataaaatctgtgaattaaaaaagctcaatgcattgtcttgtggaggatgaatagatgtgatcactgagacagccacttggtttttggctctttcagagaggtctcaggttctttccatgcagactcctcagatctgaacacagtttagtgctttacatgctgtgctctttgaagagatttcaacaagaatattgtatgttaaagcatcagagatggtaatctacagctcacctctgaaggcaaatataagctgggaaaaaagttttgatgaaattcttgaagttcatggtgatcagtgcaattgaccttctccctcactcctgccagttgaaaatggatttttaaattatactgtagctgatgaaactcctgattttgtagttaatttattaagtctgggatgtagaacttcaagaagtaagagctaagttctaagttcatgtttgtaaattaatacttcatttggtgctggtctattttgattttggggggtaatcagcattattcttcagaaggggacctgttttcttcaagggaagaaacactcttattcccaaactacagaataatgtgttaaacatgctaaatagttctatcaggaaaacaaatcactgtatttatctccgcaggctatttgttcagagaggccttttgtttaaatataaatgtttaaatataaatgtttgtctggattggctataacatgtctttcagcattaggcttttaagaaacacagggttttgtattctttactaaagatatcagagctcttaatgttgcttagatgagggtgactgtcaagtacaagcaagactgggaccttagaaatcattgtagaaacacagttttgaaagaaaaataccatgtctctaagccaactttaattgcttaaaagacatttttatttagttgaaaaatctagttttttttgtaaactgtatcaaatctgtatatgttgtaataaaacttatgctagtttattggaagtgttcaagaaataaaaatcaacttgtgtactgataaaata

SEQ ID NO: 102660 - DNA, 268 bp, Homo sapiens
  Payload ID: 26
  Gene Symbol: HMGCR
  Gene Name: 3-hydroxy-3-methylglutaryl-CoA reductase
  ENST ID: ENST00000442032
  CDS Start-End: 214-268
gagatcccgccactgcactccagcctgggcgacagagcgagactccgtctcaaaaaaaaaaaaaaaaaaaaattaatttttattgcagcattgcataaatactgtcaacttaatttgcaggagctatcctgtagcctgcttgtgacatttgcaactgctgatgaaggtggacgattgaattctatggcatgatccaaggattctgtagctacaatgttgtcaagactttttcgaatgcatggcctctttgtggcctcccatccctggg

SEQ ID NO: 102661 - DNA, 487 bp, Homo sapiens
  Payload ID: 26
  Gene Symbol: HMGCR
  Gene Name: 3-hydroxy-3-methylglutaryl-CoA reductase
  ENST ID: ENST00000511986
  CDS Start-End: 1-348
tatttccctgaaatgcagattctagccgttagtggtaactattgtactgacaagaaacctgctgctataaattggatagagggaagaggaaaatctgttgtttgtgaagctgtcattccagccaaggttgtcagagaaatgctaggtgttcaaggagcatgcaaagataatcctggggaaaatgcccggcagcttgcccgaattgtgtgtgggaccgtaatggctggggaattgtcacttatggcagcattggcagcaggacatcttgtcaaaagtcacatgattcacaacaggtcgaagatcaatttacaagacctccaaggagcttgcaccaagaagacagcctgaatagcccgacagttctgaactggaacatgggcattgggttctaaaggactaacataaaatctgtgaattaaaaaagctcaatgcattgtcttgtggaggatgaatagatgtgatcactgagacagccacttggtttttg

SEQ ID NO: 102662 - DNA, 637 bp, Homo sapiens
  Payload ID: 26
  Gene Symbol: HMGCR
  Gene Name: 3-hydroxy-3-methylglutaryl-CoA reductase
  ENST ID: ENST00000509085
  CDS Start-End: 1-497
ttcacgagtatttccctgaaatgcagattctagccgttagtggtaactattgtactgacaagaaacctgctgctataaattggatagagggaagaggaaaatctgttgtttgtgaagctgtcattccagccaaggttgtcagagaagtattaaagactaccacagaggctatgattgaggtcaacattaacaagaatttagtgggctctgccatggctgggagcataggaggctacaacgcccatgcagcaaacattgtcaccgccatctacattgcctgtggacagatgctaggtgttcaaggagcatgcaaagataatcctggggaaaatgcccggcagcttgcccgaattgtgtgtgggaccgtaatggctggggaattgtcacttatggcagcattggcagcaggacatcttgtcaaaagtcacatgattcacaacaggtcgaagatcaatttacaagacctccaaggagcttgcaccaagaagacagcctgaatagcccgacagttctgaactggaacatgggcattgggttctaaaggactaacataaaatctgtgaattaaaaaagctcaatgcattgtcttgtggaggatgaatagatgtgatcactgagacagccacttggtttttgg

SEQ ID NO: 102663 - DNA, 3395 bp, Homo sapiens
  Payload ID: 26
  Gene Symbol: HMGCR
  Gene Name: 3-hydroxy-3-methylglutaryl-CoA reductase
  Uniprot ID: P04035
  ENST ID: ENST00000511206
  CDS Start-End: 313-2979
ctttctttaatccagtagacaatgagaaacgctgatttgggtctatggcataataggaagtagtatgccacatactgcatgtgggagttctgcaggacagattgggaagtgcatgcgtgtaagactgggaagaccagttaggagaggctattgcactgttttaagtaagacataataaagccctgcaccaggcggagagcagaaggaacgcacagaagacgcaggagaggcacatttcagagagaatccagtatgcaatggatgtcgcacacaagagagagagacgcaggatccaaggattctgtagctacaatgttgtcaagactttttcgaatgcatggcctctttgtggcctcccatccctgggaagtcatagtggggacagtgacactgaccatctgcatgatgtccatgaacatgtttactggtaacaataagatctgtggttggaattatgaatgtccaaagtttgaagaggatgttttgagcagtgacattataattctgacaataacacgatgcatagccatcctgtatatttacttccagttccagaatttacgtcaacttggatcaaaatatattttgggtattgctggccttttcacaattttctcaagttttgtattcagtacagttgtcattcacttcttagacaaagaattgacaggcttgaatgaagctttgccctttttcctacttttgattgacctttccagagcaagcacattagcaaagtttgccctcagttccaactcacaggatgaagtaagggaaaatattgctcgtggaatggcaattttaggtcctacgtttaccctcgatgctcttgttgaatgtcttgtgattggagttggtaccatgtcaggggtacgtcagcttgaaattatgtgctgctttggctgcatgtcagttcttgccaactacttcgtgttcatgactttcttcccagcttgtgtgtccttggtattagagctttctcgggaaagccgcgagggtcgtccaatttggcagctcagccattttgcccgagttttagaagaagaagaaaataagccgaatcctgtaactcagagggtcaagatgattatgtctctaggcttggttcttgttcatgctcacagtcgctggatagctgatccttctcctcaaaacagtacagcagatacttctaaggtttcattaggactggatgaaaatgtgtccaagagaattgaaccaagtgtttccctctggcagttttatctctctaaaatgatcagcatggatattgaacaagttattaccctaagtttagctctccttctggctgtcaagtacatcttctttgaacaaacagagacagaatctacactctcattaaaaaaccctatcacatctcctgtagtgacacaaaagaaagtcccagacaattgttgtagacgtgaacctatgctggtcagaaataaccagaaatgtgattcagtagaggaagagacagggataaaccgagaaagaaaagttgaggttataaaacccttagtggctgaaacagataccccaaacagagctacatttgtggttggtaactcctccttactcgatacttcatcagtactggtgacacaggaacctgaaattgaacttcccagggaacctcggcctaatgaagaatgtctacagatacttgggaatgcagagaaaggtgcaaaattccttagtgatgctgagatcatccagttagtcaatgctaagcatatcccagcctacaagttggaaactctgatggaaactcatgagcgtggtgtatctattcgccgacagttactttccaagaagctttcagaaccttcttctctccagtacctaccttacagggattataattactccttggtgatgggagcttgttgtgagaatgttattggatatatgcccatccctgttggagtggcaggacccctttgcttagatgaaaaagaatttcaggttccaatggcaacaacagaaggttgtcttgtggccagcaccaatagaggctgcagagcaataggtcttggtggaggtgccagcagccgagtccttgcagatgggatgactcgtggcccagttgtgcgtcttccacgtgcttgtgactctgcagaagtgaaagcctggctcgaaacatctgaagggttcgcagtgataaaggaggcatttgacagcactagcagatttgcacgtctacagaaacttcatacaagtatagctggacgcaacctttatatccgtttccagtccaggtcaggggatgccatggggatgaacatgatttcaaagggtacagagaaagcactttcaaaacttcacgagtatttccctgaaatgcagattctagccgttagtggtaactattgtactgacaagaaacctgctgctataaattggatagagggaagaggaaaatctgttgtttgtgaagctgtcattccagccaaggttgtcagagaagtattaaagactaccacagaggctatgattgaggtcaacattaacaagaatttagtgggctctgccatggctgggagcataggaggctacaacgcccatgcagcaaacattgtcaccgccatctacattgcctgtggacaggatgcagcacagaatgttggtagttcaaactgtattactttaatggaagcaagtggtcccacaaatgaagatttatatatcagctgcaccatgccatctatagagataggaacggtgggtggtgggaccaacctactacctcagcaagcctgtttgcagatgctaggtgttcaaggagcatgcaaagataatcctggggaaaatgcccggcagcttgcccgaattgtgtgtgggaccgtaatggctggggaattgtcacttatggcagcattggcagcaggacatcttgtcaaaagtcacatgattcacaacaggtcgaagatcaatttacaagacctccaaggagcttgcaccaagaagacagcctgaatagcccgacagttctgaactggaacatgggcattgggttctaaaggactaacataaaatctgtgaattaaaaaagctcaatgcattgtcttgtggaggatgaatagatgtgatcactgagacagccacttggtttttggctctttcagagaggtctcaggttctttccatgcagactcctcagatctgaacacagtttagtgctttacatgctgtgctctttgaagagatttcaacaagaatattgtatgttaaagcatcagagatggtaatctacagctcacctctgaaggcaaatataagctgggaaaaaagttttgatgaaattcttgaagttcatggtgatcagtgcaattgaccttctccctcactcctgccagttgaaaatggatttttaaattatactgtagctgatg

SEQ ID NO: 102664 - DNA, 527 bp, Homo sapiens
  Payload ID: 26
  Gene Symbol: HMGCR
  Gene Name: 3-hydroxy-3-methylglutaryl-CoA reductase
  ENST ID: ENST00000507942
  CDS Start-End: 195-527
agaacagttaatttctgcagtaggaggaggtcgatgtactccattcttaagtagtcgtttgaaatatttcaggatttgaggatattccttcttagacatggtcctgcagagtcgtaggaagcatttgtttctgggctatactaaatgtgcatgatttcggcgtcccacaaggatccaaggattctgtagctacaatgttgtcaagactttttcgaatgcatggcctctttgtggcctcccatccctgggaagtcatagtggggacagtgacactgaccatctgcatgatgtccatgaacatgtttactggtaacaataagatctgtggttggaattatgaatgtccaaagtttgaagaggatgttttgagcagtgacattataattctgacaataacacgatgcatagccatcctgtatatttacttccagttccagaatttacgtcaacttggatcaaaatatattttgggtattgctggccttttcacaattttctcaagttttgtattcagtacagttgtcatt

SEQ ID NO: 102665 - DNA, 3506 bp, Homo sapiens
  Payload ID: 27
  Gene Symbol: HMGCS1
  Gene Name: 3-hydroxy-3-methylglutaryl-CoA synthase 1 (soluble)
  Uniprot ID: Q01581
  ENST ID: ENST00000325110
  CDS Start-End: 208-1770
gtcccgcctcccagcgactctcggcggtgccggagtcgggtgggttggcggctataaagctggtggcgaaggggaggcgccgcggactgtcctttcgtggctcactccctttcctctgctgccgctcggtcacgcttgtgcccgaaggaggaaacagtgacagacctggagactgcagttctctatccttcacacagctctttcaccatgcctggatcacttcctttgaatgcagaagcttgctggccaaaagatgtgggaattgttgcccttgagatctattttccttctcaatatgttgatcaagcagagttggaaaaatatgatggtgtagatgctggaaagtataccattggcttgggccaggccaagatgggcttctgcacagatagagaagatattaactctctttgcatgactgtggttcagaatcttatggagagaaataacctttcctatgattgcattgggcggctggaagttggaacagagacaatcatcgacaaatcaaagtctgtgaagactaatttgatgcagctgtttgaagagtctgggaatacagatatagaaggaatcgacacaactaatgcatgctatggaggcacagctgctgtcttcaatgctgttaactggattgagtccagctcttgggatggacggtatgccctggtagttgcaggagatattgctgtatatgccacaggaaatgctagacctacaggtggagttggagcagtagctctgctaattgggccaaatgctcctttaatttttgaacgagggcttcgtgggacacatatgcaacatgcctatgatttttacaagcctgatatgctatctgaatatcctatagtagatggaaaactctccatacagtgctacctcagtgcattagaccgctgctattctgtctactgcaaaaagatccatgcccagtggcagaaagagggaaatgataaagattttaccttgaatgattttggcttcatgatctttcactcaccatattgtaaactggttcagaaatctctagctcggatgttgctgaatgacttccttaatgaccagaatagagataaaaatagtatctatagtggcctggaagcctttggggatgttaaattagaagacacctactttgatagagatgtggagaaggcatttatgaaggctagctctgaactcttcagtcagaaaacaaaggcatctttacttgtatcaaatcaaaatggaaatatgtacacatcttcagtatatggttcccttgcatctgttctagcacagtactcacctcagcaattagcagggaagagaattggagtgttttcttatggttctggtttggctgccactctgtactctcttaaagtcacacaagatgctacaccggggtctgctcttgataaaataacagcaagtttatgtgatcttaaatcaaggcttgattcaagaactggtgtggcaccagatgtcttcgctgaaaacatgaagctcagagaggacacccatcatttggtcaactatattccccagggttcaatagattcactctttgaaggaacgtggtacttagttagggtggatgaaaagcacagaagaacttacgctcggcgtcccactccaaatgatgacactttggatgaaggagtaggacttgtgcattcaaacatagcaactgagcatattccaagccctgccaagaaagtaccaagactccctgccacagcagcagaacctgaagcagctgtcattagtaatggggaacattaagatactctgtgaggtgcaagacttcagggtggggtgggcatggggtgggggtatgggaacagttggaggaatgggatatctggggataattttaaaggattacatgttatgtaaatttttatgtgactgacatggagcctggatgactatcgtgtacttgggaaagtctctttgctctatttgctgacatgcttcctgttgtggtctggccaatgccaaatgtactcgaatgatgttaagggctctgtaaaacttcatacctctttggccatttgtatgcatgatgtttggtttttaaacatggtataatgaattgtgtacttctgtcagaagaaagcagaggtactaatctccaattaaaaaattttttaacatgtaagaattttgtactttgaacaacaagattacagaaagtacctgtggtttttggaaaacatttctagcttggggaatgtgacaacattccccagtgtggtaaaattggggtaaaatgtggtaaaatgtgatacgcacaaaccctttgaaaatagcaaaacaaacatgccctttttctaaaattgataaatcctaaagaggaagaaaagagctgggacaataaaacactggctctggaatctggaatgttaagtccaggccagcagtgacaaaagttattgtaatgacctctgaacagagaaacactgccattgaagaggcttctggtatagaaaacatggtacattcaggagctgtgaatatagctctaggtgtgctcctgaatcagttcatggtagattatgctgaacaacagtgagatgttattggaggtgtggatgagggagtttgttgttgcagtccttctttgcaccttattttaaagaataaatgaaacatttttctggttacttttttaaaaatttaaaatggaagggaagaataggggcagggcattattaggctatttctgatgcttcagtgttataaattcaacatagaggctgacaacctaaattcatggtgtaacacagctcttttccttttccttttttttttttttttggtatctgttcaatgaaaataaggtatgacccaagtttttacctagtctgactagaagtattccacttcaaggtctgaagtaggacttttaccttaaaaaacaacaacaaacaaaactatcacacaggatagataagaagattggttaaacagttttgtgtagatctttttggtgctgaactatgacatgagccttatagattgtaaaatagggatagttggaactaatgtacagaactaaattttttaaactttatttgctgttaaattctgtgaagtttcagttatctaaaataaatatacacaaatatgaaatataatgtttcagattgcaaggtaatatgtaatagtagtgtttgtaagatactcttgtctaatattaactagtagtattttgatttgtacagtcataatttgttaaaatgacttcatttaacattcactgatgtagattaataatgtaagttctgatttaaagaatggtggcaaaatggtgcatgtaatacttttgcaagtgttggggagatcggtatgttttgaaaagagtaatttaacttttgggtgccaggaaatgggttttctcaaagtccattgccggcaatgggcaggcctgcaaatactggcacagagcattaatcatacaccttattaacggtgaggtgaataactttgaaataaagttttagagaaatgtttca

SEQ ID NO: 102666 - DNA, 3466 bp, Homo sapiens
  Payload ID: 27
  Gene Symbol: HMGCS1
  Gene Name: 3-hydroxy-3-methylglutaryl-CoA synthase 1 (soluble)
  Uniprot ID: Q01581
  ENST ID: ENST00000433297
  CDS Start-End: 168-1730
attggctgtgggagccaccgtcccgcctcccagcgactctcggcggtgccggagtcgggtgggttggcggctataaagctggtggcgaaggggaggcgccgcggactgtcctttcgtggctcactccctttcctctgctgccgctcggtcacgcttgctctttcaccatgcctggatcacttcctttgaatgcagaagcttgctggccaaaagatgtgggaattgttgcccttgagatctattttccttctcaatatgttgatcaagcagagttggaaaaatatgatggtgtagatgctggaaagtataccattggcttgggccaggccaagatgggcttctgcacagatagagaagatattaactctctttgcatgactgtggttcagaatcttatggagagaaataacctttcctatgattgcattgggcggctggaagttggaacagagacaatcatcgacaaatcaaagtctgtgaagactaatttgatgcagctgtttgaagagtctgggaatacagatatagaaggaatcgacacaactaatgcatgctatggaggcacagctgctgtcttcaatgctgttaactggattgagtccagctcttgggatggacggtatgccctggtagttgcaggagatattgctgtatatgccacaggaaatgctagacctacaggtggagttggagcagtagctctgctaattgggccaaatgctcctttaatttttgaacgagggcttcgtgggacacatatgcaacatgcctatgatttttacaagcctgatatgctatctgaatatcctatagtagatggaaaactctccatacagtgctacctcagtgcattagaccgctgctattctgtctactgcaaaaagatccatgcccagtggcagaaagagggaaatgataaagattttaccttgaatgattttggcttcatgatctttcactcaccatattgtaaactggttcagaaatctctagctcggatgttgctgaatgacttccttaatgaccagaatagagataaaaatagtatctatagtggcctggaagcctttggggatgttaaattagaagacacctactttgatagagatgtggagaaggcatttatgaaggctagctctgaactcttcagtcagaaaacaaaggcatctttacttgtatcaaatcaaaatggaaatatgtacacatcttcagtatatggttcccttgcatctgttctagcacagtactcacctcagcaattagcagggaagagaattggagtgttttcttatggttctggtttggctgccactctgtactctcttaaagtcacacaagatgctacaccggggtctgctcttgataaaataacagcaagtttatgtgatcttaaatcaaggcttgattcaagaactggtgtggcaccagatgtcttcgctgaaaacatgaagctcagagaggacacccatcatttggtcaactatattccccagggttcaatagattcactctttgaaggaacgtggtacttagttagggtggatgaaaagcacagaagaacttacgctcggcgtcccactccaaatgatgacactttggatgaaggagtaggacttgtgcattcaaacatagcaactgagcatattccaagccctgccaagaaagtaccaagactccctgccacagcagcagaacctgaagcagctgtcattagtaatggggaacattaagatactctgtgaggtgcaagacttcagggtggggtgggcatggggtgggggtatgggaacagttggaggaatgggatatctggggataattttaaaggattacatgttatgtaaatttttatgtgactgacatggagcctggatgactatcgtgtacttgggaaagtctctttgctctatttgctgacatgcttcctgttgtggtctggccaatgccaaatgtactcgaatgatgttaagggctctgtaaaacttcatacctctttggccatttgtatgcatgatgtttggtttttaaacatggtataatgaattgtgtacttctgtcagaagaaagcagaggtactaatctccaattaaaaaattttttaacatgtaagaattttgtactttgaacaacaagattacagaaagtacctgtggtttttggaaaacatttctagcttggggaatgtgacaacattccccagtgtggtaaaattggggtaaaatgtggtaaaatgtgatacgcacaaaccctttgaaaatagcaaaacaaacatgccctttttctaaaattgataaatcctaaagaggaagaaaagagctgggacaataaaacactggctctggaatctggaatgttaagtccaggccagcagtgacaaaagttattgtaatgacctctgaacagagaaacactgccattgaagaggcttctggtatagaaaacatggtacattcaggagctgtgaatatagctctaggtgtgctcctgaatcagttcatggtagattatgctgaacaacagtgagatgttattggaggtgtggatgagggagtttgttgttgcagtccttctttgcaccttattttaaagaataaatgaaacatttttctggttacttttttaaaaatttaaaatggaagggaagaataggggcagggcattattaggctatttctgatgcttcagtgttataaattcaacatagaggctgacaacctaaattcatggtgtaacacagctcttttccttttccttttttttttttttttggtatctgttcaatgaaaataaggtatgacccaagtttttacctagtctgactagaagtattccacttcaaggtctgaagtaggacttttaccttaaaaaacaacaacaaacaaaactatcacacaggatagataagaagattggttaaacagttttgtgtagatctttttggtgctgaactatgacatgagccttatagattgtaaaatagggatagttggaactaatgtacagaactaaattttttaaactttatttgctgttaaattctgtgaagtttcagttatctaaaataaatatacacaaatatgaaatataatgtttcagattgcaaggtaatatgtaatagtagtgtttgtaagatactcttgtctaatattaactagtagtattttgatttgtacagtcataatttgttaaaatgacttcatttaacattcactgatgtagattaataatgtaagttctgatttaaagaatggtggcaaaatggtgcatgtaatacttttgcaagtgttggggagatcggtatgttttgaaaagagtaatttaacttttgggtgccaggaaatgggttttctcaaagtccattgccggcaatgggcaggcctgcaaatactggcacagagcattaatcatacaccttattaacggtgaggtgaataactttgaaataaagttttagagaaatgtttca

SEQ ID NO: 102667 - DNA, 500 bp, Homo sapiens
  Payload ID: 27
  Gene Symbol: HMGCS1
  Gene Name: 3-hydroxy-3-methylglutaryl-CoA synthase 1 (soluble)
  ENST ID: ENST00000511774
  CDS Start-End: 214-500
tttgcccgggaggatggggcaccgtgagcggggccgggcgggggttccctcgtgagggacctgaggccgaccgtagcggatctgagaagatccgagaacacaggcgagtcgcggaggggagaacgcgagagggcgttgaggtctaggtattctaacgacagaggagttggaggtgccagagaggcagctgtgaccgcctagagctctttcaccatgcctggatcacttcctttgaatgcagaagcttgctggccaaaagatgtgggaattgttgcccttgagatctattttccttctcaatatgttgatcaagcagagttggaaaaatatgatggtgtagatgctggaaagtataccattggcttgggccaggccaagatgggcttctgcacagatagagaagatattaactctctttgcatgactgtggttcagaatcttatggagagaaataacctttcctatgattgcattgggcggctggaagttggaacagagac

SEQ ID NO: 102668 - DNA, 2428 bp, Homo sapiens
  Payload ID: 28
  Gene Symbol: HMGCS2
  Gene Name: 3-hydroxy-3-methylglutaryl-CoA synthase 2 (mitochondrial)
  Uniprot ID: P54868
  ENST ID: ENST00000369406
  CDS Start-End: 51-1577
ggtttctgctgggtttctgaactgctgggtttctgcttgctcctctggagatgcagcgtctgttgactccagtgaagcgcattctgcaactgacaagagcggtgcaggaaacctccctcacacctgctcgcctgctcccagtagcccaccaaaggttttctacagcctctgctgtccccctggccaaaacagatacttggccaaaggacgtgggcatcctggccctggaggtctacttcccagcccaatatgtggaccaaactgacctggagaagtataacaatgtggaagcaggaaagtatacagtgggcttgggccagacccgtatgggcttctgctcagtccaagaggacatcaactccctgtgcctgacggtggtgcaacggctgatggagcgcatacagctcccatgggactctgtgggcaggctggaagtaggcactgagaccatcattgacaagtccaaagctgtcaaaacagtgctcatggaactcttccaggattcaggcaatactgatattgagggcatagataccaccaatgcctgctacggtggtactgcctccctcttcaatgctgccaactggatggagtccagttcctgggatggtcgttatgccatggtggtctgtggagacattgccgtctatcccagtggtaatgctcgtcccacaggtggggccggagctgtggctatgctgattgggcccaaggcccctctggccctggagcgagggctgaggggaacccatatggagaatgtgtatgacttctacaaaccaaatttggcctcggagtacccaatagtggatgggaagctttccatccagtgctacttgcgggccttggatcgatgttacacatcataccgtaaaaaaatccagaatcagtggaagcaagctggcagcgatcgacccttcacccttgacgatttacagtacatgatctttcatacacccttttgcaagatggtccagaagtctctggctcgcctgatgttcaatgacttcctgtcagccagcagtgacacacaaaccagcttatataaggggctggaggctttcggggggctaaagctggaagacacctacaccaacaaggacctggataaagcacttctaaaggcctctcaggacatgttcgacaagaaaaccaaggcttccctttacctctccactcacaatgggaacatgtacacctcatccctgtacgggtgcctggcctcgcttctgtcccaccactctgcccaagaactggctggctccaggattggtgccttctcttatggctctggtttagcagcaagtttcttttcatttcgagtatcccaggatgctgctccaggctctcccctggacaagttggtgtccagcacatcagacctgccaaaacgcctagcctcccgaaagtgtgtgtctcctgaggagttcacagaaataatgaaccaaagagagcaattctaccataaggtgaatttctccccacctggtgacacaaacagccttttcccaggtacttggtacctggagcgagtggacgagcagcatcgccgaaagtatgcccggcgtcccgtctaaaggtgttctgcagatccatggaaagcttcctgggaaacgtatgctagcagagcttctccccgtgaatcatatttttaagatcccactcttagctggtaaatgaatttgaatcgacatagtagccccataagcatcagccctgtagagtgaggagccatctctagcgggcccttcattcctctccatgctgcaatcactgtcctgggcttatggtgctatggactaggggtcctttgtgaaagagcaagatggagcaatggagagaagacctcttcctgaatcactggactccagaaatgtgcatgcagatcagctgttgccttcaagatccagataaactttcctgtcatgtgttagaactttattattattaatattgttaaacttctgtgctgttcctgtgaatctccaaattttgtaccttgttctaagctaatatatagcaattaaaaagagagaaagaggaaatgattcctgcgtttcttggaacccagaatacaaacccagcctaacatgcagcaagcctgctagaccttgtgggtcagagggctgggtccttgcctcacaggctgcctctgtccccttgcaattccattctatttctgccacatgccaagtgctatgacaggtacaaggcaaataagaacggtagaacacagcttcccccagcccacttccctgttctaaagacaccacatagacagagagcagcagacaggggccagcaggagctgtagttcagatcttcttggtcattccttgccgctgttatttgaacaaataaacacagcgcaaaggttaacaagtttttgccttctatagccaaaaataaaaaaataaataaattttga

SEQ ID NO: 102669 - DNA, 1925 bp, Homo sapiens
  Payload ID: 28
  Gene Symbol: HMGCS2
  Gene Name: 3-hydroxy-3-methylglutaryl-CoA synthase 2 (mitochondrial)
  Uniprot ID: P54868
  ENST ID: ENST00000544913
  CDS Start-End: 62-1462
atctctttcaaggtttctgctgggtttctgaactgctgggtttctgcttgctcctctggagatgcagcgtctgttgactccagtgaagcgcattctgcaactgacaagagcggtgcaggaaacctccctcacacctgctcgcctgctcccagtagcccaccaaaggttttctacagcctctgctgtccccctggccaaaacagatacttggccaaaggacgtgggcatcctggccctggaggtctacttcccagcccaatatgtggaccaaactgacctggagaagtataacaatgtggaagcaggaaagtatacagtgggcttgggccagacccgtatgggcttctgctcagtccaagaggacatcaactccctgtgcctgacggtggtgcaacggctgatggagcgcatacagctcccatgggactctgtgggcaggctggaagtaggcactgagaccatcattgacaagtccaaagctgtcaaaacagtgctcatggaactcttccaggattcaggcaatactgatattgagggcatagataccaccaatgcctgctacggtggtactgcctccctcttcaatgctgccaactggatggagtccagttcctgggatgggctgaggggaacccatatggagaatgtgtatgacttctacaaaccaaatttggcctcggagtacccaatagtggatgggaagctttccatccagtgctacttgcgggccttggatcgatgttacacatcataccgtaaaaaaatccagaatcagtggaagcaagctggcagcgatcgacccttcacccttgacgatttacagtacatgatctttcatacacccttttgcaagatggtccagaagtctctggctcgcctgatgttcaatgacttcctgtcagccagcagtgacacacaaaccagcttatataaggggctggaggctttcggggggctaaagctggaagacacctacaccaacaaggacctggataaagcacttctaaaggcctctcaggacatgttcgacaagaaaaccaaggcttccctttacctctccactcacaatgggaacatgtacacctcatccctgtacgggtgcctggcctcgcttctgtcccaccactctgcccaagaactggctggctccaggattggtgccttctcttatggctctggtttagcagcaagtttcttttcatttcgagtatcccaggatgctgctccaggctctcccctggacaagttggtgtccagcacatcagacctgccaaaacgcctagcctcccgaaagtgtgtgtctcctgaggagttcacagaaataatgaaccaaagagagcaattctaccataaggtgaatttctccccacctggtgacacaaacagccttttcccaggtacttggtacctggagcgagtggacgagcagcatcgccgaaagtatgcccggcgtcccgtctaaaggtgttctgcagatccatggaaagcttcctgggaaacgtatgctagcagagcttctccccgtgaatcatatttttaagatcccactcttagctggtaaatgaatttgaatcgacatagtagccccataagcatcagccctgtagagtgaggagccatctctagcgggcccttcattcctctccatgctgcaatcactgtcctgggcttatggtgctatggactaggggtcctttgtgaaagagcaagatggagcaatggagagaagacctcttcctgaatcactggactccagaaatgtgcatgcagatcagctgttgccttcaagatccagataaactttcctgtcatgtgttagaactttattattattaatattgttaaacttctgtgctgttcctgtgaatctccaaattttgtaccttgttctaagctaatatatagcaattaaaaagagagaaaga

SEQ ID NO: 102670 - DNA, 773 bp, Homo sapiens
  Payload ID: 29
  Gene Symbol: HACD1
  Gene Name: 3-hydroxyacyl-CoA dehydratase 1
  ENST ID: ENST00000326961
  CDS Start-End: 29-505
gctgcgccgagccccctgcgcgctgcacatggggcgcctgacggaagcggcggcagcgggcagcggctctcgggctgcaggctgggcagggtcccctcccacgctcctgccgctgtctcccacgtcccccaggtgcgcggccaccatggcgtccagcgacgaggacggcaccaacggcggcgcctcggaggccggcgaggaccgggaggctcccggcgagcggaggcgcctgggggtcttggccaccgcctggctcaccttctacgacatcgccatgaccgcgggacggagactcattctgtcgcccaggctggagtgcattggcgcgatctccgctcactgccaacctcagcctccggagttcaagcgattctcctgcctcggcctccggagtagctgggactacaagcgtgggccaccacgccccattaatttttgtatttttggtagagacagggtatcaccatgttggccagggtggtctcgaactcctgacctcaaatgattcccccacttcggcctcccaatgtgctgggattacaggtgtgagccatcgcaccgggcctaatattttattttaattttttaaaaatagagatggcctctcactgtgttggctaggctggtctcaaactcccggcctcaagcaatcctcccacctcaacctccaaaagtgctgggattaccacttccggcttaatattttaaactttctccagggtttatagaaaaatgtgattgacaaaaatttaataaatctttacctatggtga

SEQ ID NO: 102671 - DNA, 2237 bp, Homo sapiens
  Payload ID: 29
  Gene Symbol: HACD1
  Gene Name: 3-hydroxyacyl-CoA dehydratase 1
  Uniprot ID: B0YJ81
  ENST ID: ENST00000361271
  CDS Start-End: 39-905
ggtagagctggctgcgccgagccccctgcgcgctgcacatggggcgcctgacggaagcggcggcagcgggcagcggctctcgggctgcaggctgggcagggtcccctcccacgctcctgccgctgtctcccacgtcccccaggtgcgcggccaccatggcgtccagcgacgaggacggcaccaacggcggcgcctcggaggccggcgaggaccgggaggctcccggcgagcggaggcgcctgggggtcttggccaccgcctggctcaccttctacgacatcgccatgaccgcggggtggttggttctagctattgccatggtacgtttttatatggaaaaaggaacacacagaggtttatataaaagtattcagaagacacttaaatttttccagacatttgccttgcttgagatagttcactgtttaattggaattgtacctacttctgtgattgtgactggggtccaagtgagttcaagaatctttatggtgtggctcattactcacagtataaaaccaatccagaatgaagagagtgtggtgctttttctggtcgcgtggactgtgacagagatcactcgctattccttctacacattcagccttcttgaccacttgccatacttcattaaatgggccagatataatttttttatcatcttatatcctgttggagttgctggtgaacttcttacaatatacgctgccttgccgcatgtgaagaaaacaggaatgttttcaataagacttcctaacaaatacaatgtctcttttgactactattattttcttcttataaccatggcatcatatatacctttgtttccacaactctattttcatatgttacgtcaaagaagaaaggtgcttcatggagaggtgattgtagaaaaggatgattaaatgatctctgcaaacaaggtgctttttccagaataaccaagattacctgagtccaagttttaataacaagaataaacaactttgtgaaatatcatggattgtatggtttcttaaaatataacttgagacacgtggtatttgccagtatttgtgttcctcttgtgccagatctattttttacaagaactgtgcaaatatcagtaacttttgggtaggtattgattattaggaaaataattaggtgtattatctgggggaaaaaaaaacttttgctaagttttttttgaaacatgctcaaagctttttaaatcaatatttagaaattagtttaacgatttactattatacctgctagtgatatttatgtgatatttataaatgaaaataaatgcaaaattataacaacttgttaataatgtattggtatttttgaacccacaatctattttttcaggaataaggcagcattatgactaataacagtgtttggaagcgtggatataatttgctaaagtaagacttttgatgtagataaagtagcagcataaaaacacacaaatattcaagtagatgtcacagttggaaaatattctttggaaatatttctaggcagctgaaattacttatactgctaaggaaatctgctttttatttaaattagccacttaaggacaaggttttcaactgtgaaggttttaaggggttaggaagagcataagtatttgccccactattaaaaaaaaaacatgacatctgactataatgttgtattcaggctgggagtggtagctcatgcctgtaatcccagcactttggaagactgaggcaggaggatcgtttgagcccagaagttcaaggccagtctgggcaacatagcaagaccccatccctaaaaaaattacaaacaaaaaaaattaaccaggcatggtgacacatgcctgtagttccagctgcttgggaggctgaggtgggaggatcacttgagcccaggaattcaaggttacaatgagctatgatggtaccactgtacttaagcctgggtgacagagcaagaccctgtctctgaaaaatagtgatgatgatgatgatgatgataacgatgatgaggaagatgatcatgctgtactcagaactttggttgagaaagtcttctctatactgtagaattatcttgtaacaattgttatgataatccctttgtggtacttaggtaactaaacattttggggtatgatctttggacagactcctttcattctgaattccattgaatagcaaaaggtcttgtaataaagttcctgtccttgtgtttaataaaaaaaatacaccaga

SEQ ID NO: 102672 - DNA, 717 bp, Homo sapiens
  Payload ID: 29
  Gene Symbol: HACD1
  Gene Name: 3-hydroxyacyl-CoA dehydratase 1
  ENST ID: ENST00000466335
  CDS Start-End: 1-523
gtgcgcggccaccatggcgtccagcgacgaggacggcaccaacggcggcgcctcggaggccggcgaggaccgggaggctcccggcgagcggaggcgcctgggggtcttggccaccgcctggctcaccttctacgacatcgccatgaccgcggggtggttggttctagctattgccatggtacgtttttatatggaaaaaggaacacacagaggtttatataaaagtattcagaagacacttaaatttttccagacatttgccttgcttgagatagttcactgtttaattggaattgtacctacttctgtgattgtgactggggtccaagtgagttcaagaatctttatggtgtggctcattactcacagtataaaaccaatccagaatgaagagagtgtggtgctttttctggtcgcgtggactgtgacagagatcactcgctattccttctacacattcagccttcttgaccacttgccatacttcattaaatgggccaggtggcgatatcttgcagtttagtttctccttgtcctgtgcatgcttattttgtgtgctaacgccagagaattaaaattcgtgtttcagccccacgatgccagaatgctgttataggaggtataactggtataactaataattatacaagttatgatttgtattctaaaagcttaatgatgagagaggaatcgtattaataaatattttgagtgaaa

SEQ ID NO: 102673 - DNA, 459 bp, Homo sapiens
  Payload ID: 29
  Gene Symbol: HACD1
  Gene Name: 3-hydroxyacyl-CoA dehydratase 1
  ENST ID: ENST00000498812
  CDS Start-End: 1-114
atagttcactgtttaattggaattgtacctacttctgtgattgtgactggggtccaagtgagttcaagaatctttatggtgtggctcattactcacagtataaaaccaatataatttttttatcatcttatatcctgttggagttgctggtgaacttcttacaatatacgctgccttgccgcatgtgaagaaaacaggaatgttttcaataagacttcctaacaaatacaatgtctcttttgactactattattttcttcttataaccatggcatcatatatacctttgtttccacaactctattttcatatgttacgtcaaagaagaaaggtgcttcatggagaggtgattgtagaaaaggatgattaaatgatctctgcaaacaaggtgctttttccagaataaccaagattacctgagtccaagttttaataacaagaataaacaactttgtgaaa

SEQ ID NO: 102674 - DNA, 4257 bp, Homo sapiens
  Payload ID: 30
  Gene Symbol: HACD2
  Gene Name: 3-hydroxyacyl-CoA dehydratase 2
  Uniprot ID: Q6Y1H2
  ENST ID: ENST00000383657
  CDS Start-End: 159-923
ctttgccctcagccaagatggcggctgccgtggaccctgtcccggctccgccccgcggccctggccccgcctgcccctcgtcccttcctccgccccctctcctcgcgtagtccggcccgagccgctcgcgctaggagagcgggcttcgggcacttgacatggcggcagtggcggcgactgcagcagcgaaggggaatgggggcggcggtggcagggccggggccggggacgccagcggcacgcggaagaagaagggcccggggcccctggccacggcgtacctggtcatctacaatgtggtgatgacagccgggtggctggttatagcggttggtctggtccgagcatacctggctaagggtagctaccatagcctttattattcaattgaaaagcctttgaaattctttcaaactggagccttattggagattttacattgtgctataggaattgttccatcttctgttgtcctgacttctttccaggtgatgtcaagagtttttctaatatgggcagtaacacatagcgtcaaagaggtacagagtgaagacagtgtcctcctgtttgttattgcatggacgatcacggaaatcatccgttactccttttatacattcagtctattaaaccatctgccttacctcatcaaatgggccaggtacacacttttcattgtgctgtacccaatgggagtgtcaggagaactgctcacaatatatgcagctctgccctttgtcagacaagctggcctatattccatcagtttacccaacaaatacaatttctcttttgactactatgcattcctgattctaataatgatctcctacattccaatttttccccagttatacttccacatgatacaccagagaagaaagatcctttctcatactgaagaacacaagaaatttgaatagttcctgctttctgcacctcccaccaaaacaaacttttcaatgatcaaaaaatgctgcagattttttgagttcccaatacgtttcatagaaaataagtaagaactatttttaaaatattcaaacaaaactaaaacaaaaatccagtgtcacatgggcctgagattttattttagaaaaaggttgttacataaaacaccctggccagttcatttcagcatgctctttcaaccagaagttcttaatatttatgatggcactagaaagggatttggcattttatgtccttctgtgtccttcatgtatctgatcaatgaagacctgtaacactaagtacttgagagttacagtctgaataatgaagtcgtaccagctgaatagcccagcttgcagtatagttatgtttcagtctgcagtgtgtttagcattcccttgtcaaagtgcttgactgcatgctggaaactttgtatttttgaagcggcaaactctgttctctggaatgctctgaagttatggctgggacctatcccctcacatctaatgaatgaattataaaatgtatatgtctatgaagcttcggggtagtgcctgtaatcagaaaacaacttagaacccttttgtttgtttccaattgagtcattactgcctgccactaagaaacgtgcttgaatctaataagtatgtgtgtaccgtaaagaatatatcttatctggagctcagcctcaatcatgtcttaacaaaatgacaggtctcagaaagggggagctcaatagctcaaaagtgacaagtccttttcacagcaccattctcagaacacctctgagtaacgtgtttgccagtagctattctcactgatgcactgatggccctgaagaagcggatccagtcacataggaaaggaggctgtgttagtgaaagcacatggaaggtgttgctttagaaaggtagtcaggaaaaacattcaggaatagatttatacaccattattgttttatttttaaattttcattcactcttctgtttggatacttttgctaattaacttcctatgttaatttccaccaagctataagtccatagtcagtaaaacattccccttgggctgtcatgagctaaaagcagtgtcatctccgcatgttggagcagccaagaaatagtttggtactaccgacattgtctaatccatgtcacatcctcatacaatttaattgctcaaccatgcatttaaaactcctcaagaaaggattggtactgcaactgtaggtaaactgaaaaaaaataagaaagaaagagttggatgaaaatgtgaaagcccaagtttagatgtgcattaagtattaaatagcacagtatcttcttcatggagccttttttcctcccccatcccctgcagctgcctttttttgggggcagggtgggggttgatgttgaactttaagagtttaaaagtttagcttattgagtagttgtcatttaaaatataattgcgaatatcagaaaactcatactggaaaactaaattttttttttctcttgagacggagtctcgctctgttgcccaggctggagtgcagtggcgcgatctcagctcactgcaagctccacctcccgggttcacgccatcctcctgcctcagcctcctgagtagctgggactacaggtgcctgccaccacacccagctaattttttttgtatttttagtagagacggggtttcaccgtgttagccaggatggtcttgatctcctgacctcgtgatccacccgcctcagcctcccaaagtgctgggattgcaggcatgagccactgcacccaacccctggaaaactaaatttttaagtgcttatttttatagaagtttgaaaatttaatgcaggcaggtgtgtaataaattatttttgaattgaacattaaaattctgcttcttaaagtcagcactcaacttggacatgttgaaattagaatctattcttgtatttgatagacaaaatatgtgggaaagattttttgcatgacttttctctcattttattcttccataatgtatttctactataaaatagaatcaacttgggttatatttgtcatttactttgttctgttagattttttcagttgtttttggaaaaattctagaaatcaggatgaaaaatgcagcttttccagggttgctggactgggggttttatttgggcctccttattataatttgtcactacttataaaaaacattctgttgcaaacagtggtgttgcattgaattgaactttggcaatgagaacacagcacacagctcccttttcaaaaagggtctcaaccccagtgtgtatttttgtacatcaacatttagaatacttatggcagataagtaaggcatgtcactgtgtccttcagtaacctctctcagtaactggtttctttatccctaacatgaattcatttctcctttgaagtcatttattattttataaattgagaacaaccacaccaccaaatgtcacaccttcttataaagtgtgaacaaggaaggtcatgtttttgtgggtattttgtcagacttagaggtttcatttcagggcatagtcaaaggcatcatcctcccaactacccacttgattatgtatttcagatccctccgtgggggccttcttctgacagagaattctttgaggtccgcagtagtgcttttgtcagcacagactgctaatctacatcttgctgcgttctgtttgctgaggttgggcttattcatttaacacataccaaccattatccagaggcaccatggagagttagtcatggaataaagcactgtccttgcagatgaaaaaagtctccagagcagacttctgacaggaaaggtttagatgctggagagttgaagaggtgtaagaagagatcgtgccctcatttttcacttatttttttggttattcatttataataaaaggttggcattgatatggtacaacctgcaaattacttgcagttctgagtttcagataaaacattataaaacattaaattcaatacatactgctcctttgaaatttgggtaaaaaattgtacaaccgtatatatagtcatttttgtattttttctatgttgtgaaaaccaaaattgtaattttataagtctttgattcactaaaattatataatttaaatgtattttttgtatatttagaaataaggagtccagagactacgcttaactttctatgcatgcatttgaaagctgtttttacctgataatgtagtaataagttgtattcataaaatactgatctgtgttgcatttcaaaataaactggtgtgtgctctgcctggatttgaaa

SEQ ID NO: 102675 - DNA, 529 bp, Homo sapiens
  Payload ID: 30
  Gene Symbol: HACD2
  Gene Name: 3-hydroxyacyl-CoA dehydratase 2
  ENST ID: ENST00000493515
  CDS Start-End: 1-184
gtacacacttttcattgtgctgtacccaatgggagtgtcaggagaactgctcacaatatatgcagctctgccctttgtcagacaagctggcctatattccatcagtttacccaacaaatacaatttctcttttgactactatgcattcctgattctaataatgatctcctacattccaagttaaatcagacagggttggacttctcctcattgcatggcatcatcggaatgaatcaccctaacaaagcgacatgcttgtgtccctctgtggaaaattgcatttcatgcattgtgagaaaaaaactacatccagatttcatgtgagtgtttatcttgcagaaattcttggatacagttctgcttcatgattcattttccactctttattcatgttgagtcctctctagtgctggaatcatagcgaccagaggccatctctcttcaaatgtaaaaagtggttgattttcaaacagatgataaatgtgaaatcatctaaactactaagtaataaaaattaactggtagttta

SEQ ID NO: 102676 - DNA, 590 bp, Homo sapiens
  Payload ID: 30
  Gene Symbol: HACD2
  Gene Name: 3-hydroxyacyl-CoA dehydratase 2
  ENST ID: ENST00000469317
  CDS Start-End: 295-590
gcggccggactacctgcggcgcggagcccgtcctgggcggccagattcggatgttgaacggcgccagcatggggagtggaggagctgtggctgcagagtgaccattcatttgggcggctgttttcaaaatctgggctgcgctttaatctgaaaggtggctggttatagcggttggtctggtccgagcatacctggctaagggtagctaccatagcctttattattcaattgaaaagcctttgaaattctttcaaactggagccttattggagattttacattgtgctataggtgatgtcaagagtttttctaatatgggcagtaacacatagcgtcaaagaggtacagagtgaagacagtgtcctcctgtttgttattgcatggacgatcacggaaatcatccgttactccttttatacattcagtctattaaaccatctgccttacctcatcaaatgggccaggtacacacttttcattgtgctgtacccaatgggagtgtcaggagaactgctcacaatatatgcagctctgccctttgtcagacaagctggcctatattccatcagtttacccaacaaatacaattt

SEQ ID NO: 102677 - DNA, 3228 bp, Homo sapiens
  Payload ID: 31
  Gene Symbol: HACD3
  Gene Name: 3-hydroxyacyl-CoA dehydratase 3
  Uniprot ID: Q9P035
  ENST ID: ENST00000261875
  CDS Start-End: 167-1255
actgcgcaggcgcggcccgcgagcgtggggtatctcgaggtgccgggttgcaggcgctcaggagcgctagggtttgaggcctgctttctgctcgcgccagcagagcactacctgaggcagcgaggcgcagcgagcctagcctccccgcgccctgggcagtgtggccatggagaatcaggtgttgacgccgcatgtctactgggctcagcgacaccgcgagctatatctgcgcgtggagctgagtgacgtacagaaccctgccatcagcatcactgaaaacgtgctgcatttcaaagctcaaggacatggtgccaaaggagacaatgtctatgaatttcacctggagttcttagaccttgtgaaaccagagcctgtttacaaactgacccagaggcaggtaaacattacagtacagaagaaagtgagtcagtggtgggagagactcacaaagcaggaaaagcgaccactgtttttggctcctgactttgatcgttggctggatgaatctgatgcggaaatggagctcagagctaaggaagaagagcgcctaaataaactccgactggaaagcgaaggctctcctgaaactcttacaaacttaaggaaaggatacctgtttatgtataatcttgtgcaattcttgggattctcctggatctttgtcaacctgactgtgcgattctgtatcttgggaaaagagtccttttatgacacattccatactgtggctgacatgatgtatttctgccagatgctggcagttgtggaaactatcaatgcagcaattggagtcactacgtcaccggtgctgccttctctgatccagcttcttggaagaaattttattttgtttatcatctttggcaccatggaagaaatgcagaacaaagctgtggttttctttgtgttttatttgtggagtgcaattgaaattttcaggtactctttctacatgctgacgtgcattgacatggattggaaggtgctcacatggcttcgttacactctgtggattcccttatatccactgggatgtttggcggaagctgtctcagtgattcagtccattccaatattcaatgagaccggacgattcagtttcacattgccatatccagtgaaaatcaaagttagattttccttttttcttcagatttatcttataatgatatttttaggtttatacataaattttcgtcacctttataaacagcgcagacggcgctatggacaaaaaaagaaaaagatccactaaaaagaaagatttagatggcttcttgccagtttgagcctaatctgattcttacagttttaccttcttgaaccaatgtaaaagtttttttaatgttaaatgattaaattctcagtgaggctatcttccttttccccagtaacattcctgaatttactgttatcttattgtagtacttgcatgacatggattcctgatatctgatgagaggttcattcttgtgtattcagttaatgacaccaaaaggctcagcccaccccaaccctatctcatgttcagtctgtctaatacatgccagagatttttttttcaaaaagtgctttatccctacaatgtactgacagttcttacagttgagatttgttcttttcagctattgcttgtgaaaaaaagcaagactatgtcactctatagaaggctgttaaagtgactcaggcaggaattaattattctgtacctaaggggttacttgtttaatgggatggcattgactttttgaaaatcaagtggactgagtcattgataaaacatttctaagagtggggctagagaacatactttacatctgacatcctttggcctaacaacatctattattatagtgctcagcagtgtgggcattgaagaggcgcagaatgctttgaaagaaactaatcagaatcttggaacatcatgatcatgccattcttaagtaaatcaactattttcaacactgaagaaaaatgaaacattatttagaaaacaatgagattacaagttccaaactcagccaggaatgtggctcacacctgtaatcccagcactttgggacacctaggtgggagcatcgcttgaagccaggagttcaagaccagcttgggcaacgtagtgagacccctatctctacaaaaaataaaaaaattagctgggtgtgatggcacacacctgttgtcccagctactcaagaagctgagatgggaggatcctgagctcaggaggtcaaggctgcagtgagccgagattgtgccactgcactgcagctggggtgacagtgcaagaccctgtctcaaaccaaaccaaaccacacacacacaaacacacatacacacacacacacacgaggtccaaatggtagcagggatccaaagggaacacagtatgtaggtcaaactggcagtaacagtgtacagcctttgacaaactagaaatattagagtaggccaaacacacctccaaactgtaaggctgtgcacaaacataaaaaatggcagccttccatctcctgcactggctgagtccatttacttgtgtacttgttctagtgagtggtgggactgtacatttttgaatagacctcaaaaatacttcattctgctgctgttcagttggctttttaaacctgtctgcagtaggacactgaaaacagcaagaacttcggggtgaacacccgctgatcctttaacaaggatttctggcaggaaactcacaaaaaggagaactgaaaatttagacatacagttggccattgtaaaaaacatcagtttcctctcatacattccaagtaaaccaagtaaaataagtgttggagtaacacttgcataaaagaatttaaggagtgatagctctttctgttctgccattcccaacattcctgggggaaaggagactcaatgagttaatactatttcactgagcccaagatggaaacttggtttgacctaaaacatctgattaatataggctagctgatttcttaaaaattcgttgcattgaaggatattttgcatgtctgtaacacctgtcaatacttgtttgtattgatttctgatattcttgcagctgactacgtgtaattgggcagatcagctttgcagtagattatgctgcatcctcgtggcaaaattctgtattcttagtgattgttacaaacccctttattgctgtctgagaaagtgaaagattgtgtatttctattaaaacatttacaatcaaaattc

SEQ ID NO: 102678 - DNA, 1332 bp, Homo sapiens
  Payload ID: 31
  Gene Symbol: HACD3
  Gene Name: 3-hydroxyacyl-CoA dehydratase 3
  Uniprot ID: Q9P035
  ENST ID: ENST00000442729
  CDS Start-End: 151-1074
ccgcgagcgtggggtatctcgaggtgccgggttgcaggcgctcaggagcgctagggtttgaggcctgctttctgctcgcgccagcagagcactacctgaggcagcgaggcgcagcgagcctagcctccccgcgccctgggcagtgtggccatggagaatcaggtgttgacgccgcatgtctactgggctcagcgacaccgcgagctatatctgcgcgtggagctgagtgacgtacagaaccctgccatcagcatcactgaaaacgtgctgcatttcaaagctcaaggacatggtgccaaaggagacaatgtctatgaatttcacctggagttcttagaccttgtgaaaccagaggaagaagagcgcctaaataaactccgactggaaagcgaaggctctcctgaaactcttacaaacttaaggaaaggatacctgtttatgtataatcttgtgcaattcttgggattctcctggatctttgtcaacctgactgtgcgattctgtatcttgggaaaagagtccttttatgacacattccatactgtggctgacatgatgtatttctgccagatgctggcagttgtggaaactatcaatgcagcaattggagtcactacgtcaccggtgctgccttctctgatccagcttcttggaagaaattttattttgtttatcatctttggcaccatggaagaaatgcagaacaaagctgtggttttctttgtgttttatttgtggagtgcaattgaaattttcaggtactctttctacatgctgacgtgcattgacatggattggaaggtgctcacatggcttcgttacactctgtggattcccttatatccactgggatgtttggcggaagctgtctcagtgattcagtccattccaatattcaatgagaccggacgattcagtttcacattgccatatccagtgaaaatcaaagttagattttccttttttcttcagatttatcttataatgatatttttaggtttatacataaattttcgtcacctttataaacagcgcagacggcgctatggacaaaaaaagaaaaagatccactaaaaagaaagatttagatggcttcttgccagtttgagcctaatctgattcttacagttttaccttcttgaaccaatgtaaaagtttttttaatgttaaatgattaaattctcagtgaggctatcttccttttccccagtaacattcctgaatttactgttatcttattgtagtacttgcatgacatggattcctgatatctgatgagaggttcattcttgtgtattcagttaatgacaccaaaaggctcagcccacccca

SEQ ID NO: 102679 - DNA, 789 bp, Homo sapiens
  Payload ID: 31
  Gene Symbol: HACD3
  Gene Name: 3-hydroxyacyl-CoA dehydratase 3
  ENST ID: ENST00000562832
  CDS Start-End: 372-789
tctggagcctctaagttagagacacaggcacagcgtgtttcattttcattcaccacctgcaatcctctgcccttccctctacctgttggaattaatttatcattcagaaccctgccatcagcatcactgaaaacgtgctgcatttcaaagctcaaggacatggtgccaaaggagacaatgtctatgaatttcacctggagttcttagaccttgtgaaaccagagcctgtttacaaactgacccagaggcaggtaaacattacagtacagaagaaagtgagtcagtggtgggagagactcacaaagcaggaaaagcgaccactgtttttggctcctgactttgatcgttggctggatgaatctgatgcggaaatggagctcagagctaaggaagaagagcgcctaaataaactccgactggaaagcgaaggctctcctgaaactcttacaaacttaaggaaaggatacctgtttatgtataatcttgtgcaattcttgggattctcctggatctttgtcaacctgactgtgcgattctgtatcttgggaaaagagtccttttatgacacattccatactgtggctgacatgatgtatttctgccagatgctggcagttgtggaaactatcaatgcagcaattggagtcactacgtcaccggtgctgccttctctgatccagcttcttggaagaaattttattttgtttatcatctttggcaccatggaagaaatgcagaacaaagctgtggttttctttgtgttttatttgtggagtgcaattgaaattt

SEQ ID NO: 102680 - DNA, 1471 bp, Homo sapiens
  Payload ID: 31
  Gene Symbol: HACD3
  Gene Name: 3-hydroxyacyl-CoA dehydratase 3
  ENST ID: ENST00000569894
  CDS Start-End: 387-1124
acactgggaaggagctgcctcttgcttgttaaccttgagctggaagtaggagttgggttgtttctcatccactggaaaaagtgttaagtagtttcactttacattatgatgctaaattgaagaaccctgccatcagcatcactgaaaacgtgctgcatttcaaagctcaaggacatggtgccaaaggagacaatgtctatgaatttcacctggagttcttagaccttgtgaaaccagagcctgtttacaaactgacccagaggcaggtaaacattacagtacagaagaaagtgagtcagtggtgggagagactcacaaagcaggaaaagcgaccactgtttttggctcctgactttgatcgttggctggatgaatctgatgcggaaatggagctcagagctaaggaagaagagcgcctaaataaactccgactggaaagcgaaggctctcctgaaactcttacaaacttaaggaaaggatacctgtttatgtataatcttgtgcaattcttgggattctcctggatctttgtcaacctgactgtgcgattctgtatcttgggaaaagagtccttttatgacacattccatactgtggctgacatgatgtatttctgccagatgctggcagttgtggaaactatcaatgcagcaattggagtcactacgtcaccggtgctgccttctctgatccagcttcttggaagaaattttattttgtttatcatctttggcaccatggaagaaatgcagaacaaagctgtggttttctttgtgttttatttgtggagtgcaattgaaattttcaggtactctttctacatgctgacgtgcattgacatggattggaaggtgctcacatggcttcgttacactctgtggattcccttatatccactgggatgtttggcggaagctgtctcagtgattcagtccattccaatattcaatgagaccggacgattcagtttcacattgccatatccagtgaaaatcaaagttagattttccttttttcttcagatttatcttataatgatatttttaggtttatacataaattttcgtcacctttataaacagcgcagacggcgctatggacaaaaaaagaaaaagatccactaaaaagaaagatttagatggcttcttgccagtttgagcctaatctgattcttacagttttaccttcttgaaccaatgtaaaagtttttttaatgttaaatgattaaattctcagtgaggctatcttccttttccccagtaacattcctgaatttactgttatcttattgtagtacttgcatgacatggattcctgatatctgatgagaggttcattcttgtgtattcagttaatgacaccaaaaggctcagcccaccccaaccctatctcatgttcagtctgtctaatacatgccagagatttttttttcaaaaagtgctttatccctacaatgtactgacagttctta

SEQ ID NO: 102681 - DNA, 1824 bp, Homo sapiens
  Payload ID: 31
  Gene Symbol: HACD3
  Gene Name: 3-hydroxyacyl-CoA dehydratase 3
  ENST ID: ENST00000568793
  CDS Start-End: 128-1141
gtgccgggttgcaggcgctcaggagcgctagggtttgaggcctgctttctgctcgcgccagcagagcactacctgaggcagcgaggcgcagcgagcctagcctccccgcgccctgggcagtgtggccatggagaatcagaaccctgccatcagcatcactgaaaacgtgctgcatttcaaagctcaaggacatggtgccaaaggagacaatgtctatgaatttcacctggagttcttagaccttgtgaaaccagagcctgtttacaaactgacccagaggcaggtaaacattacagtacagaagaaagtgagtcagtggtgggagagactcacaaagcaggaaaagcgaccactgtttttggctcctgactttgatcgttggctggatgaatctgatgcggaaatggagctcagagctaaggaagaagagcgcctaaataaactccgactggaaagcgaaggctctcctgaaactcttacaaacttaaggaaaggatacctgtttatgtataatcttgtgcaattcttgggattctcctggatctttgtcaacctgactgtgcgattctgtatcttgggaaaagagtccttttatgacacattccatactgtggctgacatgatgtatttctgccagatgctggcagttgtggaaactatcaatgcagcaattggagtcactacgtcaccggtgctgccttctctgatccagcttcttggaagaaattttattttgtttatcatctttggcaccatggaagaaatgcagaacaaagctgtggttttctttgtgttttatttgtggagtgcaattgaaattttcaggtactctttctacatgctgacgtgcattgacatggattggaaggtgctcacatggcttcgttacactctgtggattcccttatatccactgggatgtttggcggaagctgtctcagtgattcagtccattccaatattcaatgagaccggacgattcagtttcacattgccatatccagtgaaaatcaaagttagattttccttttttcttcagatttatcttataatgatatttttaggtttatacataaattttcgtcacctttataaacagcgcagacggcgctatggacaaaaaaagaaaaagatccactaaaaagaaagatttagatggcttcttgccagtttgagcctaatctgattcttacagttttaccttcttgaaccaatgtaaaagtttttttaatgttaaatgattaaattctcagtgaggctatcttccttttccccagtaacattcctgaatttactgttatcttattgtagtacttgcatgacatggattcctgatatctgatgagaggttcattcttgtgtattcagttaatgacaccaaaaggctcagcccaccccaaccctatctcatgttcagtctgtctaatacatgccagagatttttttttcaaaaagtgctttatccctacaatgtactgacagttcttacagttgagatttgttcttttcagctattgcttgtgaaaaaaagcaagactatgtcactctatagaaggctgttaaagtgactcaggcaggaattaattattctgtacctaaggggttacttgtttaatgggatggcattgactttttgaaaatcaagtggactgagtcattgataaaacatttctaagagtggggctagagaacatactttacatctgacatcctttggcctaacaacatctattattatagtgctcagcagtgtgggcattgaagaggcgcagaatgctttgaaagaaactaatcagaatcttggaacatcatgatcatgccatt

SEQ ID NO: 102682 - DNA, 1782 bp, Homo sapiens
  Payload ID: 31
  Gene Symbol: HACD3
  Gene Name: 3-hydroxyacyl-CoA dehydratase 3
  ENST ID: ENST00000566511
  CDS Start-End: 447-1184
ggaaatcattctcattacttttaattttaaaattcacaagagctggaggaagtgatttccccctctgttctgaaggttgtgagctcaggtttgctgagttgcacagagaacttaaaaagttcttaagttacattaagcatttctgtttgagctccttggcccttaatgtaagcaagctgaagaaccctgccatcagcatcactgaaaacgtgctgcatttcaaagctcaaggacatggtgccaaaggagacaatgtctatgaatttcacctggagttcttagaccttgtgaaaccagagcctgtttacaaactgacccagaggcaggtaaacattacagtacagaagaaagtgagtcagtggtgggagagactcacaaagcaggaaaagcgaccactgtttttggctcctgactttgatcgttggctggatgaatctgatgcggaaatggagctcagagctaaggaagaagagcgcctaaataaactccgactggaaagcgaaggctctcctgaaactcttacaaacttaaggaaaggatacctgtttatgtataatcttgtgcaattcttgggattctcctggatctttgtcaacctgactgtgcgattctgtatcttgggaaaagagtccttttatgacacattccatactgtggctgacatgatgtatttctgccagatgctggcagttgtggaaactatcaatgcagcaattggagtcactacgtcaccggtgctgccttctctgatccagcttcttggaagaaattttattttgtttatcatctttggcaccatggaagaaatgcagaacaaagctgtggttttctttgtgttttatttgtggagtgcaattgaaattttcaggtactctttctacatgctgacgtgcattgacatggattggaaggtgctcacatggcttcgttacactctgtggattcccttatatccactgggatgtttggcggaagctgtctcagtgattcagtccattccaatattcaatgagaccggacgattcagtttcacattgccatatccagtgaaaatcaaagttagattttccttttttcttcagatttatcttataatgatatttttaggtttatacataaattttcgtcacctttataaacagcgcagacggcgctatggacaaaaaaagaaaaagatccactaaaaagaaagatttagatggcttcttgccagtttgagcctaatctgattcttacagttttaccttcttgaaccaatgtaaaagtttttttaatgttaaatgattaaattctcagtgaggctatcttccttttccccagtaacattcctgaatttactgttatcttattgtagtacttgcatgacatggattcctgatatctgatgagaggttcattcttgtgtattcagttaatgacaccaaaaggctcagcccaccccaaccctatctcatgttcagtctgtctaatacatgccagagatttttttttcaaaaagtgctttatccctacaatgtactgacagttcttacagttgagatttgttcttttcagctattgcttgtgaaaaaaagcaagactatgtcactctatagaaggctgttaaagtgactcaggcaggaattaattattctgtacctaaggggttacttgtttaatgggatggcattgactttttgaaaatcaagtggactgagtcattgataaaacatttctaagagtggggctagagaacatactttacatctgacatcctttggcctaacaacatctattattata

SEQ ID NO: 102683 - DNA, 1797 bp, Homo sapiens
  Payload ID: 31
  Gene Symbol: HACD3
  Gene Name: 3-hydroxyacyl-CoA dehydratase 3
  ENST ID: ENST00000562901
  CDS Start-End: 766-1503
ggctcgcgccaaggcccgctgctggcgccgccgccatcccggcgcgtcactgcgcaggcgcggcccgcgagcgtggggtatctcgaggtgccgggttgcaggcgctcaggagcgctagggtttgaggcctgctttctgctcgcgccagcagagcactacctgaggcagcgaggcgcagcgagcctagcctccccgcgccctgggcagtgtggccatggagaatcaggtgttgacgccgcatgtctactgggctcagcgacaccgcgagctatatctgcgcgtggagctgagtgacgtacagggctagtgactatgagagaacacggctgatgtgaggagaaatggtggacaataaagacttcagcagtggcatcgtctgtgcttgagggtctcactctgttgcccaggttggagtgcagcagtgtgatcatagctcaccgtagccttgaactcctgggtttgagcagtcctcctggctcagcctaccaagtaggactacagaaccctgccatcagcatcactgaaaacgtgctgcatttcaaagctcaaggacatggtgccaaaggagacaatgtctatgaatttcacctggagttcttagaccttgtgaaaccagagcctgtttacaaactgacccagaggcaggtaaacattacagtacagaagaaagtgagtcagtggtgggagagactcacaaagcaggaaaagcgaccactgtttttggctcctgactttgatcgttggctggatgaatctgatgcggaaatggagctcagagctaaggaagaagagcgcctaaataaactccgactggaaagcgaaggctctcctgaaactcttacaaacttaaggaaaggatacctgtttatgtataatcttgtgcaattcttgggattctcctggatctttgtcaacctgactgtgcgattctgtatcttgggaaaagagtccttttatgacacattccatactgtggctgacatgatgtatttctgccagatgctggcagttgtggaaactatcaatgcagcaattggagtcactacgtcaccggtgctgccttctctgatccagcttcttggaagaaattttattttgtttatcatctttggcaccatggaagaaatgcagaacaaagctgtggttttctttgtgttttatttgtggagtgcaattgaaattttcaggtactctttctacatgctgacgtgcattgacatggattggaaggtgctcacatggcttcgttacactctgtggattcccttatatccactgggatgtttggcggaagctgtctcagtgattcagtccattccaatattcaatgagaccggacgattcagtttcacattgccatatccagtgaaaatcaaagttagattttccttttttcttcagatttatcttataatgatatttttaggtttatacataaattttcgtcacctttataaacagcgcagacggcgctatggacaaaaaaagaaaaagatccactaaaaagaaagatttagatggcttcttgccagtttgagcctaatctgattcttacagttttaccttcttgaaccaatgtaaaagtttttttaatgttaaatgattaaattctcagtgaggctatcttccttttccccagtaacattcctgaatttactgttatcttattgtagtacttgcatgacatggattcctgatatctgatgagaggttcattcttgtgtattcagttaatgacaccaaaaggctcagcccaccccaaccctatctcatgttcagtctgtctaatacatgcca

SEQ ID NO: 102684 - DNA, 1658 bp, Homo sapiens
  Payload ID: 31
  Gene Symbol: HACD3
  Gene Name: 3-hydroxyacyl-CoA dehydratase 3
  ENST ID: ENST00000566074
  CDS Start-End: 345-1082
atcgcggctccgggtacccgccaggacccctgccccctttgtccgcgtgcgcgccggagagcctgcagtgcgccaacaagaaccctgccatcagcatcactgaaaacgtgctgcatttcaaagctcaaggacatggtgccaaaggagacaatgtctatgaatttcacctggagttcttagaccttgtgaaaccagagcctgtttacaaactgacccagaggcaggtaaacattacagtacagaagaaagtgagtcagtggtgggagagactcacaaagcaggaaaagcgaccactgtttttggctcctgactttgatcgttggctggatgaatctgatgcggaaatggagctcagagctaaggaagaagagcgcctaaataaactccgactggaaagcgaaggctctcctgaaactcttacaaacttaaggaaaggatacctgtttatgtataatcttgtgcaattcttgggattctcctggatctttgtcaacctgactgtgcgattctgtatcttgggaaaagagtccttttatgacacattccatactgtggctgacatgatgtatttctgccagatgctggcagttgtggaaactatcaatgcagcaattggagtcactacgtcaccggtgctgccttctctgatccagcttcttggaagaaattttattttgtttatcatctttggcaccatggaagaaatgcagaacaaagctgtggttttctttgtgttttatttgtggagtgcaattgaaattttcaggtactctttctacatgctgacgtgcattgacatggattggaaggtgctcacatggcttcgttacactctgtggattcccttatatccactgggatgtttggcggaagctgtctcagtgattcagtccattccaatattcaatgagaccggacgattcagtttcacattgccatatccagtgaaaatcaaagttagattttccttttttcttcagatttatcttataatgatatttttaggtttatacataaattttcgtcacctttataaacagcgcagacggcgctatggacaaaaaaagaaaaagatccactaaaaagaaagatttagatggcttcttgccagtttgagcctaatctgattcttacagttttaccttcttgaaccaatgtaaaagtttttttaatgttaaatgattaaattctcagtgaggctatcttccttttccccagtaacattcctgaatttactgttatcttattgtagtacttgcatgacatggattcctgatatctgatgagaggttcattcttgtgtattcagttaatgacaccaaaaggctcagcccaccccaaccctatctcatgttcagtctgtctaatacatgccagagatttttttttcaaaaagtgctttatccctacaatgtactgacagttcttacagttgagatttgttcttttcagctattgcttgtgaaaaaaagcaagactatgtcactctatagaaggctgttaaagtgactcaggcaggaattaattattctgtacctaaggggttacttgtttaatgggatggcattgactttttgaaaatcaagtggactgagtcattgataaaacatttctaagagtggggctagagaacatactttacatctgacatcctttgg

SEQ ID NO: 102685 - DNA, 1465 bp, Homo sapiens
  Payload ID: 31
  Gene Symbol: HACD3
  Gene Name: 3-hydroxyacyl-CoA dehydratase 3
  ENST ID: ENST00000565299
  CDS Start-End: 143-1345
gtggggtatctcgaggtgccgggttgcaggcgctcaggagcgctagggtttgaggcctgctttctgctcgcgccagcagagcactacctgaggcagcgaggcgcagcgagcctagcctccccgcgccctgggcagtgtggccatggagaatcaggtgttgacgccgcatgtctactgggctcagcgacaccgcgagctatatctgcgcgtggagctgagtgacgtacagggtctcactctgttgcccaggttggagtgcagcagtgtgatcatagctcaccgtagccttgaactcctgggtttgagcagtcctcctggctcagcctaccaagtaggactacagaaccctgccatcagcatcactgaaaacgtgctgcatttcaaagctcaaggacatggtgccaaaggagacaatgtctatgaatttcacctggagttcttagaccttgtgaaaccagagcctgtttacaaactgacccagaggcaggtaaacattacagtacagaagaaagtgagtcagtggtgggagagactcacaaagcaggaaaagcgaccactgtttttggctcctgactttgatcgttggctggatgaatctgatgcggaaatggagctcagagctaaggaagaagagcgcctaaataaactccgactggaaagcgaaggctctcctgaaactcttacaaacttaaggaaaggatacctgtttatgtataatcttgtgcaattcttgggattctcctggatctttgtcaacctgactgtgcgattctgtatcttgggaaaagagtccttttatgacacattccatactgtggctgacatgatgtatttctgccagatgctggcagttgtggaaactatcaatgcagcaattggagtcactacgtcaccggtgctgccttctctgatccagcttcttggaagaaattttattttgtttatcatctttggcaccatggaagaaatgcagaacaaagctgtggttttctttgtgttttatttgtggagtgcaattgaaattttcaggtactctttctacatgctgacgtgcattgacatggattggaaggtgctcacatggcttcgttacactctgtggattcccttatatccactgggatgtttggcggaagctgtctcagtgattcagtccattccaatattcaatgagaccggacgattcagtttcacattgccatatccagtgaaaatcaaagttagattttccttttttcttcagatttatcttataatgatatttttaggtttatacataaattttcgtcacctttataaacagcgcagacggcgctatggacaaaaaaagaaaaagatccactaaaaagaaagatttagatggcttcttgccagtttgagcctaatctgattcttacagttttaccttcttgaaccaatgtaaaagtttttttaatgttaaatgattaaattctcagtgaggcta

SEQ ID NO: 102686 - DNA, 8267 bp, Homo sapiens
  Payload ID: 32
  Gene Symbol: HACD4
  Gene Name: 3-hydroxyacyl-CoA dehydratase 4
  Uniprot ID: Q5VWC8
  ENST ID: ENST00000495827
  CDS Start-End: 47-745
ggtactccttcctggaccgcgctggaagccctggcggcggcggcccatggggcccttggcgctgcccgcctggctgcagcccaggtataggaagaatgcgtatcttttcatctattacttaatccagttctgtggccactcttggatatttacaaatatgacagtcagattcttttcatttggaaaagattcaatggttgacactttttatgctattggacttgtgatgcgactttgccaatccgtatctctcctggaactgctgcacatatatgttggcattgagtcaaaccatcttctcccaaggtttttgcagctcacagaaagaataatcatcctttttgtggtgatcaccagtcaagaggaagtccaagagaaatatgtggtgtgtgttttattcgtcttttggaatctattggatatggttaggtacacttatagcatgttatcagtcataggaatatcctatgctgtcttgacatggctcagtcaaacactatggatgccaatttatcctttgtgtgttcttgctgaagcatttgccatctatcaatcgctgccttattttgaatcatttggcacttattccaccaagctgccctttgacttatccatctatttcccatatgtgctgaaaatatatctcatgatgctctttataggtatgtattttacctacagtcatctatactcagaaagaagagacatcctcggaatctttcccattaaaaaaaagaagatgtgaagtacagcattccagtgtgacacgagaaaagacaggctgtggattcagtgcagtaaataaaacacaggaagtattctggtggaaaaataccttgtatttgataaaaatccattacatgaaataactgcacatacccccaaaactctagacataacaggctatgtttttcacacattgtatttttaagacatatatattctccataccctgcttcaccaaaattcctgcttcatttggattttatacaagttatacttacattgtatgaagtctgattattttcctgtaagtttaatgagaaataggagattagctgcaatagattcaattaaattaagaaaccaaacttgataacctaaattacatgtattctttttcacttccaagttcccaaatagatctgtaggagaagagggatggaaaatatattccacagttgcctagaataacatatttcatagacagatgtctgtcttcagatctaataatactcaccctaaacattagatatgtttagaaaattaaatatctttccaagccctatgtcttagctcaggttgctataatagaacaccataaaccgaatggcttaaacaacagcaaacgcttctcacagttctggaggctgggaattccgctcaggatcaaggcatcagctaatgcagtttctggtgagggccctcttcccagtttgcagatagatgtccttctttgtcctcacatgagagagagatcaactctcttatgtctcttataatggcactaaccccattcatgagggctctaccctcatgatctaattacctcccaatggccccacctccaaataccatcatattggaggttagggcttaacacatgaattttgggggaacacaaagattcactccatagcattctgtacctggtcctacaaaattcatgtcctcctcacatgcaaaatacatacattccatctcgacagcctcaaaagtcttaactcattcctgcatcaactctaaagtccaaagtctcgtctaaatcagatgtgggtgagattcaaggtagaattcatcctgaggtaaaattcctttccagctttgaacttgtgaaatgaaacaagttatgtgcttccacagtacaatggtgggacacacaaagggtggacattcctattcccaaagcaagaaacaggaaaaaaggaaggtgtaatgggtccccagcaagtccaaaacctagcaaggcaaacaccatgagatcttcagtcttagtaataatcctctttggcctgatactctggcttcaggacccagtgaggcagaggtattgcccccaggactatgttggaggaggatgacccccatatcaccaggcggaagctgtcaggcctgttgaaaccaaggcaatgactgccccttttgaaactgagaaggtaccactgatgttctctgaatcattgttccgggtcagtttctccttttcttgaagaatagtgtacattcacagctgaatagctctatggtcccaaattcaagaagtccaacagtcttccctcattctgtcccatctccattcctttcaatacaaactagcagtgttcctgctggggtggctgattaggtctgtggttcacacccacataaatctaattggatgacttgtctgctacactcttagtgttctctaccaaacgtgttttcttatctttttgtaatgcagacagactgataatttcccacatcttttaagttctggttccgtttttgttaagaattctgtcttcattttttgtcacattttactttaagcagtcaagataaaccgaggcactccttcaacactggttggagatctcttcagttcaatatctaatttcatggctcacaattttactttccacaaaacactagaacatgaacacaatcatccaagttctttggcatattataacaaagatcacctttcttccagtttcccataacaggttcctcattttcatttgagacttcatcagaatggcctttattgtccatgtctaccaacattatcttcatggtgatttacgtgttctctatgaagatggaggctttctctcccaccctcttctctttgagccctcaccaaaatcacctctatcaatcccttcatggcaatactggctttttctagcaaaaaaactagtacctcaaaactcttccagtactcttccaggtactctagtacctcaaaactcttccagcttctatctgttacctaacgtcaaagctgcttccacatctttatatattggttatagcatcaccacacttcttggtactaattgctgtcttagcttggctgctataacaaaataccataaactgggtggcttagacaacaaatatatttctcacagttctggaggcagggaagtccaagataaaggtgctagacaattaagttcctgatgaggttccaaggtgctagctgattcttcttcatggtttgcagatgaatgccttcttgctatatgttcacatggtggagggagaaaccatctctcccttatttcttattgtaaaggtactaatcccatttatgaaggttccagcttcaaatgccatcacactggagattagattttcaacatgtgaatttaatgggggacaccagcattcagtccctagtgctctgatagagtattcattaatgtcatgtatttgttaacatcttgtaagttatttgggctttgatgccttaaaagaagaccctggccaggcatgctggctcatacctgtaatcctagcactatgagaggctgaggtgggcagatcagttgaggtcaggagttcaagaccagcctggccaacatggtgaaaccccatttctactaaaaatacaaaaattagccaggcatggtggcgcatgcctgtaatcccagctacacgggaggctgggggcatgagaatcgcttgagcccaggagatggaggttgcagtgagcagagattgagccactgcactccagcctgggtgacagagtgagactctatctcaaaagagaagaccctaatgaaaatagtaaacctttagcaaatacacaaatgatgccccattctgtattctttttaattttaaaaataatgacacacacatacaggaagataaaaggtataaaaatatactaagtactttttaaaaaggaaaattcatgttttggattattactgaattgttgctaattactgtaatgtaagtcatatgtccttacatagttttgaaaaatgctttctttgaaaatctaaaaaaagtgtgaataactgatagtcattgctgtatcattgatgtatcactcaatttttggtaaagaattataaagatcttacctagaaactatgtaaaaaggtattaaatatattgtgatgtaagaataggataataaaaatgtaattttaaaaatgggtaacttatttccactaaagaaaacatttggaaagaaacaattgagtattaggctacttgaaatctttataaatatatttggattttaaaaaattatccttttaaaaagctacattttttctgcttttatagttatcttctaaatttcagaaaaattatgaaaagctttagtgtgcaaggagaacataaaccctttgcaaattttaggtgagttaatcttaatcactccaaataaagatggctccttacactgccgaagtacatgtacaatcaatcactaaaacaaagagaaaattagagaaactacactttactgggtcattataataaattaaaatttcattattaaataatgctttaattttttaaaaccagattaacttaaaaacttcttaaaattgaaaaccaaaagaaacacaagtgaatttataattattttaaaacagaaatgaggattgacagtaatttgagatatctgcaacaattgtaacataaaaagatcttacatttcctttggtgacagacacaattgttaatactactgtggttggttgcctgtattcacaatggaaaggaatactaaatttcattatcaattagtgaaaataaaggtgtaatttctttttctacttaagtacatgttccccaggttaagaaacccagacatagtgaagtcaagacagtaactatctggttaatcggatgttaccaaaatcgcaaagttgatgtctttgactatctgtcttaactgtatgttcaccaaatccctatttcattttgtacagtgtagacaaaggcttactttctcaaatctaagtaacatagatgaaataggaaccattagatattttgaaaacatatctaagacaacttttttcagtaatttttttattgtggtaaaatgtaaaatatactatcttattcctttttaagtgtgcagttcagtagtagtaagtaatttatattgtgcaaccatcaccactgtccatctccagaactttttttaccttgcaaaacttataccctatactcattaagcaatggttccctattctcccatctgccctgtccctggcaaccaccagtctactttttgtctctatgattttgattgctctaagtacctcatataaatgtaatcatacagtatctgtctttcgtaattggcttatttcacttagcataatgtctgcaagtttcctccattttgtatatgtcagaattttcttcctttttgaggatgactgataaggagggacttactcctgtcattttgctatttgttttctacatagcttagcttttttgtccctcatttcctgcattacgtcttttgtgtgtagtttacttttttatagtgaagcatttaagtatctttctcagttcttttgtgtatattctgtagctgttttctttgtggttaccatagggtgacatttaatatccggaaggtaatttggacttatgccagctgaacttcaaaaatatacaaaaattctgctctttatatctctgtctatcactcctttaagtttcacaaaattatatacactgtgtgtccaaaatcaatttttaaaaatgcagtagtctctatgtagaaaacaaaaagtggagttacaaaccattgttacaaaagtactagattttataattgcccatgtatttttctttactgagatccttatttcttcatgtggctttgagttgctgtttagtgtctttccatttcaacttgcaggacccctattagcatttctggcaggggcaggtctagtggtaacatactttctcagcttttgtttatctggggatgtcttaatttctctctcacgtttgaagaacagttttgtcaaatacaggaaatgtggttgatgatatatttttttcctaacactttgaatatgtgagctcactgcattctggcctccaaagtttctgatgagaaatctgataatcttattaaggatcacttatatgtgatgaattgattttttcatgctactttcaagattctctttctgtctttggcttttgatagttgtgtggatctcttggaattcattctacttggagtttgttggtcattatctggctgttcttcaaatattctctctgctcctttctttctctcttttccttctgggatcctcacaatgtgtatgttggtctgcttgatgggtcccacagatccttataccctgttcacttttttccaatttttttctattgctcagactaataatttccattgtcctattttcatgtatactgattcttctgctgcccaaatctgcctttgaatacctctagtgagtttttcatttcaattatcgtactttccagctcttgaatttcttttttgtatcgtcttagattttctctatattgatattaccattttgttcatccattggttttttgactttttccgcatgctctttggttctttaaaaaacatccttaaggcagtcgttgtagagcctttagtggatccaccatcaagtctttttcagagatagtttttgtttttgttttcatttgaaagggacatactttcctgtttctttgtatgccttgttatttttttgctgaaaactgaacgtttcaatctaataatatggtaactacatctcactaaggtccctaagttaatgtttttttttaaactattccttactttgcctgccttgagcaagttgtcaaatgtgagaaactgtatttatttcagaagtacaaatagatacaatctcaatgtccaaaatatttccccaaagaaagaatcttacaattatttaagtttacttatggagaaaacattttatggtactaaagtgttaaagtgatttaaaattaaggttaaaatatgctaaaaattatcttcctttacccagtatctatcttccacttgtttattactgctttttaataattataatgtttcccgttggttcggataattttaatattcttctcggtctgagttatatgctaatgttgatatgacatggttctccagggtagtgttcagattgtatgttcagggagcaacagccacaattaacaagttcacctgtttagaatgcagattccagggctccactaaagatagttgaatcagaagctctgggaataagctcaggatcctaccttttgatagactcctcaaatgagcctcatgcacagaaaagtttgagaaccactgcttttgagtctaaattatttcagctttggacagaaagaaaactgctaaaaagaactacttatataaaagccaccaatgttttcagaacagggatgattttttatggctttaaaaatccttaaatagtagttctgaacatgtttttaacatgccaagtaagaattactaactagtttatttttgctaagggtagctggagttttaaatctcatctaaaataaggttagttaattccatatgaaagtcaattagtaaaagtatgccttaattcatcacatacatgtaggtgtctattgttacttcatggtattcagctgaatgatggggttcttgtgaaagataatgtggtctggaattaagagcactaggtttgatttgagatcaagctccattatttactaactgaatgactctttgagttccagtttccttaaccacttaaagttattatgaagactaaatgacatatggtaaattaaacttttgcaaattataaagggctttgcagaagtaggacatttataacatgttctgttcttacttcatgatggtttagtgatttatattctctgactgtaagttccatgagagcagggatgacacgttttgttcagattgtaccccagaaacttgtatagtggcacataatagacacccataattgtgtgtgcaactctatctttaaagaacgccactactacatctagaaatatatttcaagaaatctatcggcttaattaggtaatgaatttcaattgtatctcaaagcgttccttatatttagaagacacataagttttgtttttttctttcaacttatataagtatcttaacatgctacttctagaatattttaattgttaagaacaatttcttaataaacttccactgtcttcctgag

SEQ ID NO: 102687 - DNA, 1265 bp, Homo sapiens
  Payload ID: 33
  Gene Symbol: HAAO
  Gene Name: 3-hydroxyanthranilate 3,4-dioxygenase
  Uniprot ID: P46952
  ENST ID: ENST00000294973
  CDS Start-End: 57-917
gctgcgggcctccgacggcgggaggacagcgctgcgaggaggcgcccgggacagtcatggagcgccgcctgggagtgagggcctgggtgaaggagaaccggggctccttccagcccccggtctgcaacaagctcatgcaccaggagcagctcaaagtcatgttcatcggaggccccaacaccaggaaggactatcacatcgaagagggtgaagaggtattttaccagctggagggagacatggttctccgagtcctggagcaagggaaacaccgggatgtggtcattcggcagggagagatattcctcctgcctgccagggtgccccactcaccacagaggtttgccaacaccgtggggctggtggttgagcgaaggcggctggagaccgagctagatgggctcaggtactatgtgggcgacaccatggacgttctgtttgagaagtggttctactgcaaggacctcggcacgcagttggcccccatcatccaggagttcttcagctctgagcagtacagaacaggaaagcccatccctgaccagctgctcaaggagccaccattccctctgagcacacgatccatcatggagcccatgtccctggatgcctggctggacagccaccacagggagctgcaggcaggcacaccactcagcctgtttggggacacctatgagacccaggtgatcgcctatgggcaaggcagcagcgaaggcctgagacagaatgtggacgtgtggctgtggcagctggagggctcctcggtggtgacaatggggggacggcgcctgagcctggcccctgatgacagcctcctggtgctagctgggacctcgtatgcctgggagcgaacacaaggctctgtggccctgtctgtgacccaggaccctgcctgcaagaagcccctggggtgaccctcttgccatggcctgaagcagccacaggtgtgccaagcaccctcgagtgccatccctgccaaacaactctcccagcccccactacctctctgtgtactgccgctgtgtcccccacagacctgcacattgttgtcacccaccctcctgcccttctcagcccagatgccatgcccctgggcgggcagcagctccccatcttctctggcagactcagcccactgccttgccagtcttgccaggtggtctacccccggccccgctcctgcccattcctctgtccctgcagactcagtgcagcacttccacaccaagaaggccctcaataaaggcttcctgaggaacgca

SEQ ID NO: 102688 - DNA, 827 bp, Homo sapiens
  Payload ID: 33
  Gene Symbol: HAAO
  Gene Name: 3-hydroxyanthranilate 3,4-dioxygenase
  ENST ID: ENST00000431905
  CDS Start-End: 298-827
ggaggacagcgctgcgaggaggcgcccgggacagtcatggagcgccgcctgggagtgagggcctgggtgaaggagaaccggggctccttccagcccccggtctgcaacaagctcatataaggttagtaacatgccccagggcctgtgcttataaacacatgccacactgacttgacaccgcctgaggcccctgctagatgtcacggtctcctgcatccactgagccatgcctccagccaggggagagtgcagggtcctatagtcagacagcatgggcaccaggagcagctcaaagtcatgttcatcggaggccccaacaccaggaaggactatcacatcgaagagggtgaagaggtattttaccagctggagggagacatggttctccgagtcctggagcaagggaaacaccgggatgtggtcattcggcagggagagatattcctcctgcctgccagggtgccccactcaccacagaggtttgccaacaccgtggggctggtggttgagcgaaggcggctggagaccgagctagatgggctcaggtactatgtgggcgacaccatggacgttctgtttgagaagtggttctactgcaaggacctcggcacgcagttggcccccatcatccaggagttcttcagctctgagcagtacagaacaggaaagcccatccctgaccagctgctcaaggagccaccattccctctgagcacacgatccatcatggagcccatgtccctggatgcctggctggacagccaccacagggagctgcaggcaggcacaccactcagcctgtttggggacacctatgagacccaggt

SEQ ID NO: 102689 - DNA, 3330 bp, Homo sapiens
  Payload ID: 34
  Gene Symbol: BDH1
  Gene Name: 3-hydroxybutyrate dehydrogenase, type 1
  Uniprot ID: Q02338
  ENST ID: ENST00000358186
  CDS Start-End: 187-1218
attgaaagaatacacagaaagcctggaaaaggtttccaggggtgtcaatacgccctgtcaactgagaattaagaggatccggctggtcacttgcctggagaggatcctgcatgctgatagtgctgaggcacctgccagctaagaaccaccgggaggaactgggccattctaacacccgttgctaccatgctggccacccgcctctccagacccctgtcacggctcccaggaaaaaccctaagtgcctgtgatagagaaaatggagcaagacgcccactattgcttggttctacttcctttatcccgattggccgtcggacttatgccagtgcggcggagccggttggcagcaaagctgtcctggtcacaggctgtgactctggatttgggttctcattggccaagcatctgcattcaaaaggcttccttgtgtttgctggctgcttgatgaaggacaaaggccatgatggggtcaaggagctggacagcctaaacagtgaccgattgagaaccgtccagctcaatgtctgcagcagcgaagaggtggagaaagtggtggagattgtccgctcgagcctgaaggaccctgagaaaggcatgtggggcctcgttaacaatgccggcatctcaacgttcggggaggtggagttcaccagcctggagacctacaagcaggtggcagaagtgaacctttggggcacagtgcggatgacgaaatcctttctccccctcatccgaagggccaaaggccgcgtcgtcaatatcagcagcatgctgggccgcatggccaacccggcccgctccccgtactgcatcaccaagttcggggtagaggctttctcggactgcctgcgctatgagatgtaccccctgggcgtgaaggtcagcgtggtggagcccggcaacttcatcgctgccaccagcctttacagccctgagagcattcaggccatcgccaagaagatgtgggaggagctgcctgaggtcgtgcgcaaggactacggcaagaagtactttgatgaaaagatcgccaagatggagacctactgcagcagtggctccacagacacgtcccctgtcatcgatgctgtcacacacgccctgaccgccaccaccccctacacccgctaccaccccatggactactactggtggctgcgaatgcagatcatgacccacttgcctggagccatctccgacatgatctacatccgctgaagagtctcgctgtggcctctgtcagggatccctggtggaaggggaggggagggaggaacccatatagtcaactcttgattatccacgtgtggattatccaccatgccaggaagacccataactggttttaacactaactagagggaatgacttctttgcatagtgagtgacttgggccttcacaaacagggtgtggagtggcaggcagaggcctctaaatctcagggcaaacatggtgaatctatctctccggagataatttcatacagagattttaagaaaacatctttatattaaaaacagatctcatttgatccttaagccagtctcatgaatgaaaaggacaggtttttttcttttgtaaatgaagcatttgcagcttaaagaggatgcatgaaataacccttttatcgcttataaatagtgccagttatgtgttcctgccacggctgtggaaatacttcacatttgcattccaggactgttttggatccatttgcccgagaatcttctgactaactctgtgtcctcatctgggcagcacacaccaagtgcccactggtacctctgcatgtccatggtgctgtgtgactggccagccagcagccagtgactcagagctggctgtatggagggggtgggaatgtttctggagatttttgtttttccagacacagtcttgctcagtcccctaggctggagtgcaatggcaccatctccgctcactgcaacctccgcctccctggttcaagcggttctcctgcctcagccttccaagtagctggggttataggcacccaccaccatgccgggctaatttttgtatttttagtagagatggggtttcaccatgttggctaggctggtcccgaactcccgacttcaagtgatccgcctgccttggcctcccaaagtgctgggattacaggcatgagatttttacttgagatttttccatcctcttttaggactcaggatagacttgtgtggaggtgctctctggctaaggggataagttgttactggtttgggtctgcttggttttgccttgggtggggccggtgtcgatggggcaggcttggcacgagcagtggtgccatggcagggcactgtggcatctcccctagcagtggatttggggtccctgcttgcctcacgtggtgcttacacacatgtacacacacacacacacacacacacacacacacaccttacacacatgtacacacacacacacacacacacacacacacacacacacacacacacacacacacacacacacacacacacacccctgttctgcagggcttcagcgtggccttcattcccgcctcgcctcggcctcttttcaattaagaagtgatgccacttgaggcagggtctgcatgatcacttcttgggtttcagtttgaaagctgccatccctgcgactgcccagggcctgtatgttgggaccgaagccaaacaccactgtcctccagggggctttcggcccggggcagggtccccagtgcccgccttcgaatcagactccgcgtttccgcctctccctgggcggacctgccgctagagggcgctcctcctccgcagccggcgccggcctccagcgccccagactcccgcgctgccgcccgagcctgaggtttctcacggcgttcgggattcgcgcttcggaaaccgggaacaaagaagcaagcagcacccttcagaaacagtgttctcgctctcctagcagctggcccgggcccggaggctggtgccaggagaaggcagaagagcccgggcagccggagtgggctacggggttcaggcagtgccaaggaagaagggcctcacaatgggcaattcagctgcctcccgggccgttgtccccgctgtcttcaaacaggggtcccctgtcccagctgccccaggaggagggggggaggcaggcagggccgaaaccctccagagcccagagggggacgcttggtggccgctgcagttacataaccataggatgcttttgtaccgtggaccttgttctagcaggatcctttcggaattgcacttttacatgttgggcgaatttgtgtccgtgctgaagtttattaaaggaaaatagatgga

SEQ ID NO: 102690 - DNA, 3455 bp, Homo sapiens
  Payload ID: 34
  Gene Symbol: BDH1
  Gene Name: 3-hydroxybutyrate dehydrogenase, type 1
  Uniprot ID: Q02338
  ENST ID: ENST00000392378
  CDS Start-End: 312-1343
ggaggaggcggctcggcggccccccgacagccacgccgccgtgagccccgcccagcgtagccccagcgcgcgcttcgcgtgtagaagcgtccgggtggcggaggccgcaggccgcaggagtgctggtggaggggcttccagaaagaccctgcggcagcgccccccctcggctctccccgcaggagagcgggcacctgcgcggcgccgggtgaaggcgagagcctcggcgagccctctgcagcggagccccctgcccatttggttttggaaccaccgggaggaactgggccattctaacacccgttgctaccatgctggccacccgcctctccagacccctgtcacggctcccaggaaaaaccctaagtgcctgtgatagagaaaatggagcaagacgcccactattgcttggttctacttcctttatcccgattggccgtcggacttatgccagtgcggcggagccggttggcagcaaagctgtcctggtcacaggctgtgactctggatttgggttctcattggccaagcatctgcattcaaaaggcttccttgtgtttgctggctgcttgatgaaggacaaaggccatgatggggtcaaggagctggacagcctaaacagtgaccgattgagaaccgtccagctcaatgtctgcagcagcgaagaggtggagaaagtggtggagattgtccgctcgagcctgaaggaccctgagaaaggcatgtggggcctcgttaacaatgccggcatctcaacgttcggggaggtggagttcaccagcctggagacctacaagcaggtggcagaagtgaacctttggggcacagtgcggatgacgaaatcctttctccccctcatccgaagggccaaaggccgcgtcgtcaatatcagcagcatgctgggccgcatggccaacccggcccgctccccgtactgcatcaccaagttcggggtagaggctttctcggactgcctgcgctatgagatgtaccccctgggcgtgaaggtcagcgtggtggagcccggcaacttcatcgctgccaccagcctttacagccctgagagcattcaggccatcgccaagaagatgtgggaggagctgcctgaggtcgtgcgcaaggactacggcaagaagtactttgatgaaaagatcgccaagatggagacctactgcagcagtggctccacagacacgtcccctgtcatcgatgctgtcacacacgccctgaccgccaccaccccctacacccgctaccaccccatggactactactggtggctgcgaatgcagatcatgacccacttgcctggagccatctccgacatgatctacatccgctgaagagtctcgctgtggcctctgtcagggatccctggtggaaggggaggggagggaggaacccatatagtcaactcttgattatccacgtgtggattatccaccatgccaggaagacccataactggttttaacactaactagagggaatgacttctttgcatagtgagtgacttgggccttcacaaacagggtgtggagtggcaggcagaggcctctaaatctcagggcaaacatggtgaatctatctctccggagataatttcatacagagattttaagaaaacatctttatattaaaaacagatctcatttgatccttaagccagtctcatgaatgaaaaggacaggtttttttcttttgtaaatgaagcatttgcagcttaaagaggatgcatgaaataacccttttatcgcttataaatagtgccagttatgtgttcctgccacggctgtggaaatacttcacatttgcattccaggactgttttggatccatttgcccgagaatcttctgactaactctgtgtcctcatctgggcagcacacaccaagtgcccactggtacctctgcatgtccatggtgctgtgtgactggccagccagcagccagtgactcagagctggctgtatggagggggtgggaatgtttctggagatttttgtttttccagacacagtcttgctcagtcccctaggctggagtgcaatggcaccatctccgctcactgcaacctccgcctccctggttcaagcggttctcctgcctcagccttccaagtagctggggttataggcacccaccaccatgccgggctaatttttgtatttttagtagagatggggtttcaccatgttggctaggctggtcccgaactcccgacttcaagtgatccgcctgccttggcctcccaaagtgctgggattacaggcatgagatttttacttgagatttttccatcctcttttaggactcaggatagacttgtgtggaggtgctctctggctaaggggataagttgttactggtttgggtctgcttggttttgccttgggtggggccggtgtcgatggggcaggcttggcacgagcagtggtgccatggcagggcactgtggcatctcccctagcagtggatttggggtccctgcttgcctcacgtggtgcttacacacatgtacacacacacacacacacacacacacacacacaccttacacacatgtacacacacacacacacacacacacacacacacacacacacacacacacacacacacacacacacacacacacccctgttctgcagggcttcagcgtggccttcattcccgcctcgcctcggcctcttttcaattaagaagtgatgccacttgaggcagggtctgcatgatcacttcttgggtttcagtttgaaagctgccatccctgcgactgcccagggcctgtatgttgggaccgaagccaaacaccactgtcctccagggggctttcggcccggggcagggtccccagtgcccgccttcgaatcagactccgcgtttccgcctctccctgggcggacctgccgctagagggcgctcctcctccgcagccggcgccggcctccagcgccccagactcccgcgctgccgcccgagcctgaggtttctcacggcgttcgggattcgcgcttcggaaaccgggaacaaagaagcaagcagcacccttcagaaacagtgttctcgctctcctagcagctggcccgggcccggaggctggtgccaggagaaggcagaagagcccgggcagccggagtgggctacggggttcaggcagtgccaaggaagaagggcctcacaatgggcaattcagctgcctcccgggccgttgtccccgctgtcttcaaacaggggtcccctgtcccagctgccccaggaggagggggggaggcaggcagggccgaaaccctccagagcccagagggggacgcttggtggccgctgcagttacataaccataggatgcttttgtaccgtggaccttgttctagcaggatcctttcggaattgcacttttacatgttgggcgaatttgtgtccgtgctgaagtttattaaaggaaaatagatgga

SEQ ID NO: 102691 - DNA, 3546 bp, Homo sapiens
  Payload ID: 34
  Gene Symbol: BDH1
  Gene Name: 3-hydroxybutyrate dehydrogenase, type 1
  Uniprot ID: Q02338
  ENST ID: ENST00000392379
  CDS Start-End: 403-1434
cccagcgcgcgcttcgcgtgtagaagcgtccgggtggcggaggccgcaggccgcaggagtgctggtggaggggcttccagaaagaccctgcggcagcgccccccctcggctctccccgcaggagagcgggcacctgcgcggcgccgggtgaaggcgagagcctcggcgagccctctgcagcggagccccctgcccatttggttttggccagtcagcctggaaatctgcctgtagtcagctgatgcagagtcaccctgcagttcctactttgaggggttgcagaagcacatatttcactatggagggccgcctgcaggcctcgcgctgacaggatcttttgtgacgctgcaaatgtcctgaaccaccgggaggaactgggccattctaacacccgttgctaccatgctggccacccgcctctccagacccctgtcacggctcccaggaaaaaccctaagtgcctgtgatagagaaaatggagcaagacgcccactattgcttggttctacttcctttatcccgattggccgtcggacttatgccagtgcggcggagccggttggcagcaaagctgtcctggtcacaggctgtgactctggatttgggttctcattggccaagcatctgcattcaaaaggcttccttgtgtttgctggctgcttgatgaaggacaaaggccatgatggggtcaaggagctggacagcctaaacagtgaccgattgagaaccgtccagctcaatgtctgcagcagcgaagaggtggagaaagtggtggagattgtccgctcgagcctgaaggaccctgagaaaggcatgtggggcctcgttaacaatgccggcatctcaacgttcggggaggtggagttcaccagcctggagacctacaagcaggtggcagaagtgaacctttggggcacagtgcggatgacgaaatcctttctccccctcatccgaagggccaaaggccgcgtcgtcaatatcagcagcatgctgggccgcatggccaacccggcccgctccccgtactgcatcaccaagttcggggtagaggctttctcggactgcctgcgctatgagatgtaccccctgggcgtgaaggtcagcgtggtggagcccggcaacttcatcgctgccaccagcctttacagccctgagagcattcaggccatcgccaagaagatgtgggaggagctgcctgaggtcgtgcgcaaggactacggcaagaagtactttgatgaaaagatcgccaagatggagacctactgcagcagtggctccacagacacgtcccctgtcatcgatgctgtcacacacgccctgaccgccaccaccccctacacccgctaccaccccatggactactactggtggctgcgaatgcagatcatgacccacttgcctggagccatctccgacatgatctacatccgctgaagagtctcgctgtggcctctgtcagggatccctggtggaaggggaggggagggaggaacccatatagtcaactcttgattatccacgtgtggattatccaccatgccaggaagacccataactggttttaacactaactagagggaatgacttctttgcatagtgagtgacttgggccttcacaaacagggtgtggagtggcaggcagaggcctctaaatctcagggcaaacatggtgaatctatctctccggagataatttcatacagagattttaagaaaacatctttatattaaaaacagatctcatttgatccttaagccagtctcatgaatgaaaaggacaggtttttttcttttgtaaatgaagcatttgcagcttaaagaggatgcatgaaataacccttttatcgcttataaatagtgccagttatgtgttcctgccacggctgtggaaatacttcacatttgcattccaggactgttttggatccatttgcccgagaatcttctgactaactctgtgtcctcatctgggcagcacacaccaagtgcccactggtacctctgcatgtccatggtgctgtgtgactggccagccagcagccagtgactcagagctggctgtatggagggggtgggaatgtttctggagatttttgtttttccagacacagtcttgctcagtcccctaggctggagtgcaatggcaccatctccgctcactgcaacctccgcctccctggttcaagcggttctcctgcctcagccttccaagtagctggggttataggcacccaccaccatgccgggctaatttttgtatttttagtagagatggggtttcaccatgttggctaggctggtcccgaactcccgacttcaagtgatccgcctgccttggcctcccaaagtgctgggattacaggcatgagatttttacttgagatttttccatcctcttttaggactcaggatagacttgtgtggaggtgctctctggctaaggggataagttgttactggtttgggtctgcttggttttgccttgggtggggccggtgtcgatggggcaggcttggcacgagcagtggtgccatggcagggcactgtggcatctcccctagcagtggatttggggtccctgcttgcctcacgtggtgcttacacacatgtacacacacacacacacacacacacacacacacaccttacacacatgtacacacacacacacacacacacacacacacacacacacacacacacacacacacacacacacacacacacacccctgttctgcagggcttcagcgtggccttcattcccgcctcgcctcggcctcttttcaattaagaagtgatgccacttgaggcagggtctgcatgatcacttcttgggtttcagtttgaaagctgccatccctgcgactgcccagggcctgtatgttgggaccgaagccaaacaccactgtcctccagggggctttcggcccggggcagggtccccagtgcccgccttcgaatcagactccgcgtttccgcctctccctgggcggacctgccgctagagggcgctcctcctccgcagccggcgccggcctccagcgccccagactcccgcgctgccgcccgagcctgaggtttctcacggcgttcgggattcgcgcttcggaaaccgggaacaaagaagcaagcagcacccttcagaaacagtgttctcgctctcctagcagctggcccgggcccggaggctggtgccaggagaaggcagaagagcccgggcagccggagtgggctacggggttcaggcagtgccaaggaagaagggcctcacaatgggcaattcagctgcctcccgggccgttgtccccgctgtcttcaaacaggggtcccctgtcccagctgccccaggaggagggggggaggcaggcagggccgaaaccctccagagcccagagggggacgcttggtggccgctgcagttacataaccataggatgcttttgtaccgtggaccttgttctagcaggatcctttcggaattgcacttttacatgttgggcgaatttgtgtccgtgctgaagtttattaaaggaaaatagatgga

SEQ ID NO: 102692 - DNA, 868 bp, Homo sapiens
  Payload ID: 34
  Gene Symbol: BDH1
  Gene Name: 3-hydroxybutyrate dehydrogenase, type 1
  ENST ID: ENST00000446746
  CDS Start-End: 371-868
gcgtgtagaagcgtccgggtggcggaggccgcaggccgcaggagtgctggtggaggggcttccagaaagaccctgcggcagcgccccccctcggctctccccgcaggagagcgggcacctgcgcggcgccgggtgaaggcgagagcctcggcgagccctctgcagcggagccccctgcccatttggttttggacgcccactattgcttggttctacttcctttatcccgattggccgtcggacttatgccagtgcggcggagccggttggcagcaaagctgtcctggtcacaggctgtgactctggatttgggttctcattggccaagcatctgcattcaaaaggcttccttgtgtttgctggctgcttgatgaaggacaaaggccatgatggggtcaaggagctggacagcctaaacagtgaccgattgagaaccgtccagctcaatgtctgcagcagcgaagaggtggagaaagtggtggagattgtccgctcgagcctgaaggaccctgagaaaggcatgtggggcctcgttaacaatgccggcatctcaacgttcggggaggtggagttcaccagcctggagacctacaagcaggtggcagaagtgaacctttggggcacagtgcggatgacgaaatcctttctccccctcatccgaagggccaaaggccgcgtcgtcaatatcagcagcatgctgggccgcatggccaacccggcccgctccccgtactgcatcaccaagttcggggtagaggctttctcggactgcctgcgctatgagatgtaccccctgggcgtgaaggtcagcgtggtggagcccggcaacttcatcgctgccaccagcctttacagccctgagagcatt

SEQ ID NO: 102693 - DNA, 453 bp, Homo sapiens
  Payload ID: 34
  Gene Symbol: BDH1
  Gene Name: 3-hydroxybutyrate dehydrogenase, type 1
  ENST ID: ENST00000431056
  CDS Start-End: 187-453
attgaaagaatacacagaaagcctggaaaaggtttccaggggtgtcaatacgccctgtcaactgagaattaagaggatccggctggtcacttgcctggagaggatcctgcatgctgatagtgctgaggcacctgccagctaagaaccaccgggaggaactgggccattctaacacccgttgctaccatgctggccacccgcctctccagacccctgtcacggctcccaggaaaaaccctaagtgcctgtgatagagaaaatggagcaagacgcccactattgcttggttctacttcctttatcccgattggccgtcggacttatgccagtgcggcggagccggttggcagcaaagctgtcctggtcacaggctgtgactctggatttgggttctcattggccaagcatctgcattcaaaaggcttccttgtgtttgctggctgcttgatgaag

SEQ ID NO: 102694 - DNA, 539 bp, Homo sapiens
  Payload ID: 34
  Gene Symbol: BDH1
  Gene Name: 3-hydroxybutyrate dehydrogenase, type 1
  ENST ID: ENST00000445160
  CDS Start-End: 388-539
ccgggtggcggaggccgcaggccgcaggagtgctggtggaggggcttccagaaagaccctgcggcagcgccccccctcggctctccccgcaggagagcgggcacctgcgcggcgccgggtgaaggcgagagcctcggcgagccctctgcagcggagccccctgcccatttggttttgggcaggaggaggccctgggttaaacacgcggccctgcagctcccaggtgaaacgactcatcgtttcctgccggcgcatcttactgaaggggacccaggccccacgaagggaaggaaccgtcctcaaggtcacgtcgtagtcaaaggccgagcccagaccgaagccagaaccaccgggaggaactgggccattctaacacccgttgctaccatgctggccacccgcctctccagacccctgtcacggctcccaggaaaaaccctaagtgcctgtgatagagaaaatggagcaagacgcccactattgcttggttctacttcctttatcccgattggccgtcggacttatgccagtgcggcgga

SEQ ID NO: 102695 - DNA, 386 bp, Homo sapiens
  Payload ID: 34
  Gene Symbol: BDH1
  Gene Name: 3-hydroxybutyrate dehydrogenase, type 1
  ENST ID: ENST00000455876
  CDS Start-End: 1-386
atgccggcatctcaacgttcggggaggtggagttcaccagcctggagacctacaagcaggtggcagaagtgaacctttggggcacagtgcggatgacgaaatcctttctccccctcatccgaagggccaaaggtgagtgggaaagggagctccctcctgcccctgaacctgccccacgtgttcatctttgctcagaatggaaatacctgtcccagcagctccaatgtccacaactcagcagaggccgcgtcgtcaatatcagcagcatgctgggccgcatggccaacccggcccgctccccgtactgcatcaccaagttcggggtagaggctttctcggactgcctgcgctatgagatgtaccccctgggcgtgaaggtcagcgtg

SEQ ID NO: 102696 - DNA, 659 bp, Homo sapiens
  Payload ID: 34
  Gene Symbol: BDH1
  Gene Name: 3-hydroxybutyrate dehydrogenase, type 1
  ENST ID: ENST00000434143
  CDS Start-End: 154-659
ggctactcaggaggctgaggcaggagaatcgcttgaacccaggaggcggaggttgcagtgagctgagatcgtgtcactgcactccagcctgggcaacaagagtgaaactctgtctcaaaaacaaaacaaaacaaaacaaaaaacaaaatttgaatggcgtcaaatggtatacagaaaagacgcccactattgcttggttctacttcctttatcccgattggccgtcggacttatgccagtgcggcggagccggttggcagcaaagctgtcctggtcacaggctgtgactctggatttgggttctcattggccaagcatctgcattcaaaaggcttccttgtgtttgctggctgcttgatgaaggacaaaggccatgatggggtcaaggagctggacagcctaaacagtgaccgattgagaaccgtccagctcaatgtctgcagcagcgaagaggtggagaaagtggtggagattgtccgctcgagcctgaaggaccctgagaaaggcatgtggggcctcgttaacaatgccggcatctcaacgttcggggaggtggagttcaccagcctggagacctacaagcaggtggcagaagtgaacctttggggcacagtgcggatgacgaaatcctttctccccctcatccgaagggccaaagg

SEQ ID NO: 102697 - DNA, 955 bp, Homo sapiens
  Payload ID: 34
  Gene Symbol: BDH1
  Gene Name: 3-hydroxybutyrate dehydrogenase, type 1
  ENST ID: ENST00000432819
  CDS Start-End: 396-955
cgcgcttcgcgtgtagaagcgtccgggtggcggaggccgcaggccgcaggagtgctggtggaggggcttccagaaagaccctgcggcagcgccccccctcggctctccccgcaggagagcgggcacctgcgcggcgccgggtgaaggcgagagcctcggcgagccctctgcagcggagccccctgcccatttggttttggccagtcagcctggaaatctgcctgtagtcagctgatgcagagtcaccctgcagttcctactttgaggggttgcagaagcacatatttcactatggagggccgcctgcaggcctcgcgctgacaggatcttttgtgacgctgcaaatgtcctgaaccaccgggaggaactgggccattctaacacccgttgctaccatgctggccacccgcctctccagacccctgtcacggctcccaggaaaaaccctaagtgcctgtgatagagaaaatggagcaagacgcccactattgcttggttctacttcctttatcccgattggccgtcggacttatgccagtgcggcggagccggttggcagcaaagctgtcctggtcacaggctgtgactctggatttgggttctcattggccaagcatctgcattcaaaaggcttccttgtgtttgctggctgcttgatgaaggacaaaggccatgatggggtcaaggagctggacagcctaaacagtgaccgattgagaaccgtccagctcaatgtctgcagcagcgaagaggtggagaaagtggtggagattgtccgctcgagcctgaaggaccctgagaaaggcatgtggggcctcgttaacaatgccggcatctcaacgttcggggaggtggagttcaccagcctggagacctacaagcaggtggcagaagtgaacctttggggcacagtgcggatgacgaaatcctttctccccctcatccgaagggccaa

SEQ ID NO: 102698 - DNA, 1605 bp, Homo sapiens
  Payload ID: 34
  Gene Symbol: BDH1
  Gene Name: 3-hydroxybutyrate dehydrogenase, type 1
  ENST ID: ENST00000441275
  CDS Start-End: 534-1304
cccagcgcgcgcttcgcgtgtagaagcgtccgggtggcggaggccgcaggccgcaggagtgctggtggaggggcttccagaaagaccctgcggcagcgccccccctcggctctccccgcaggagagcgggcacctgcgcggcgccgggtgaaggcgagagcctcggcgagccctctgcagcggagccccctgcccatttggttttggccagtcagcctggaaatctgcctgtagtcagctgatgcagagtcaccctgcagttcctactttgaggggttgcagaagcacatatttcactatggagggccgcctgcaggcctcgcgctgacaggatcttttgtgacgctgcaaatgtcctgacgcccactattgcttggttctacttcctttatcccgattggccgtcggacttatgccagtgcggcggagccggtgacaaagctgtcctggtcacaggctgtgactctggatttgggttctcattggccaagcatctgcattcaaaaggcttccttgtgtttgctggctgcttgatgaaggacaaaggccatgatggggtcaaggagctggacagcctaaacagtgaccgattgagaaccgtccagctcaatgtctgcagcagcgaagaggtggagaaagtggtggagattgtccgctcgagcctgaaggaccctgagaaaggcatgtggggcctcgttaacaatgccggcatctcaacgttcggggaggtggagttcaccagcctggagacctacaagcaggtggcagaagtgaacctttggggcacagtgcggatgacgaaatcctttctccccctcatccgaagggccaaaggccgcgtcgtcaatatcagcagcatgctgggccgcatggccaacccggcccgctccccgtactgcatcaccaagttcggggtagaggctttctcggactgcctgcgctatgagatgtaccccctgggcgtgaaggtcagcgtggtggagcccggcaacttcatcgctgccaccagcctttacagccctgagagcattcaggccatcgccaagaagatgtgggaggagctgcctgaggtcgtgcgcaaggactacggcaagaagtactttgatgaaaagatcgccaagatggagacctactgcagcagtggctccacagacacgtcccctgtcatcgatgctgtcacacacgccctgaccgccaccaccccctacacccgctaccaccccatggactactactggtggctgcgaatgcagatcatgacccacttgcctggagccatctccgacatgatctacatccgctgaagagtctcgctgtggcctctgtcagggatccctggtggaaggggaggggagggaggaacccatatagtcaactcttgattatccacgtgtggattatccaccatgccaggaagacccataactggttttaacactaactagagggaatgacttctttgcatagtgagtgacttgggccttcacaaacagggtgtggagtggcaggcagaggcctctaaatctcagggcaaacatggtgaatctatctctccggagataatttcatacagagattttaagaaaacatctttatattaaaaac

SEQ ID NO: 102699 - DNA, 3546 bp, Homo sapiens; identical to SEQ ID NO: 102691
  Payload ID: 34
  Gene Symbol: BDH1
  Gene Name: 3-hydroxybutyrate dehydrogenase, type 1
  Uniprot ID: Q02338
  ENST ID: ENST00000617317
  CDS Start-End: 403-1434

SEQ ID NO: 102700 - DNA, 7976 bp, Homo sapiens
  Payload ID: 34
  Gene Symbol: BDH1
  Gene Name: 3-hydroxybutyrate dehydrogenase, type 1
  Uniprot ID: Q02338
  ENST ID: ENST00000612690
  CDS Start-End: 312-1343
ggaggaggcggctcggcggccccccgacagccacgccgccgtgagccccgcccagcgtagccccagcgcgcgcttcgcgtgtagaagcgtccgggtggcggaggccgcaggccgcaggagtgctggtggaggggcttccagaaagaccctgcggcagcgccccccctcggctctccccgcaggagagcgggcacctgcgcggcgccgggtgaaggcgagagcctcggcgagccctctgcagcggagccccctgcccatttggttttggaaccaccgggaggaactgggccattctaacacccgttgctaccatgctggccacccgcctctccagacccctgtcacggctcccaggaaaaaccctaagtgcctgtgatagagaaaatggagcaagacgcccactattgcttggttctacttcctttatcccgattggccgtcggacttatgccagtgcggcggagccggttggcagcaaagctgtcctggtcacaggctgtgactctggatttgggttctcattggccaagcatctgcattcaaaaggcttccttgtgtttgctggctgcttgatgaaggacaaaggccatgatggggtcaaggagctggacagcctaaacagtgaccgattgagaaccgtccagctcaatgtctgcagcagcgaagaggtggagaaagtggtggagattgtccgctcgagcctgaaggaccctgagaaaggcatgtggggcctcgttaacaatgccggcatctcaacgttcggggaggtggagttcaccagcctggagacctacaagcaggtggcagaagtgaacctttggggcacagtgcggatgacgaaatcctttctccccctcatccgaagggccaaaggccgcgtcgtcaatatcagcagcatgctgggccgcatggccaacccggcccgctccccgtactgcatcaccaagttcggggtagaggctttctcggactgcctgcgctatgagatgtaccccctgggcgtgaaggtcagcgtggtggagcccggcaacttcatcgctgccaccagcctttacagccctgagagcattcaggccatcgccaagaagatgtgggaggagctgcctgaggtcgtgcgcaaggactacggcaagaagtactttgatgaaaagatcgccaagatggagacctactgcagcagtggctccacagacacgtcccctgtcatcgatgctgtcacacacgccctgaccgccaccaccccctacacccgctaccaccccatggactactactggtggctgcgaatgcagatcatgacccacttgcctggagccatctccgacatgatctacatccgctgaagagtctcgctgtggcctctgtcagggatccctggtggaaggggaggggagggaggaacccatatagtcaactcttgattatccacgtgtggattatccaccatgccaggaagacccataactggttttaacactaactagagggaatgacttctttgcatagtgagtgacttgggccttcacaaacagggtgtggagtggcaggcagaggcctctaaatctcagggcaaacatggtgaatctatctctccggagataatttcatacagagattttaagaaaacatctttatattaaaaacagatctcatttgatccttaagccagtctcatgaatgaaaaggacaggtttttttcttttgtaaatgaagcatttgcagcttaaagaggatgcatgaaataacccttttatcgcttataaatagtgccagttatgtgttcctgccacggctgtggaaatacttcacatttgcattccaggactgttttggatccatttgcccgagaatcttctgactaactctgtgtcctcatctgggcagcacacaccaagtgcccactggtacctctgcatgtccatggtgctgtgtgactggccagccagcagccagtgactcagagctggctgtatggagggggtgggaatgtttctggagatttttgtttttccagacacagtcttgctcagtcccctaggctggagtgcaatggcaccatctccgctcactgcaacctccgcctccctggttcaagcggttctcctgcctcagccttccaagtagctggggttataggcacccaccaccatgccgggctaatttttgtatttttagtagagatggggtttcaccatgttggctaggctggtcccgaactcccgacttcaagtgatccgcctgccttggcctcccaaagtgctgggattacaggcatgagatttttacttgagatttttccatcctcttttaggactcaggatagacttgtgtggaggtgctctctggctaaggggataagttgttactggtttgggtctgcttggttttgccttgggtggggccggtgtcgatggggcaggcttggcacgagcagtggtgccatggcagggcactgtggcatctcccctagcagtggatttggggtccctgcttgcctcacgtggtgcttacacacatgtacacacacacacacacacacacacacacacacaccttacacacatgtacacacacacacacacacacacacacacacacacacacacacacacacacacacacacacacacacacacacccctgttctgcagggcttcagcgtggccttcattcccgcctcgcctcggcctcttttcaattaagaagtgatgccacttgaggcagggtctgcatgatcacttcttgggtttcagtttgaaagctgccatccctgcgactgcccagggcctgtatgttgggaccgaagccaaacaccactgtcctccagggggctttcggcccggggcagggtccccagtgcccgccttcgaatcagactccgcgtttccgcctctccctgggcggacctgccgctagagggcgctcctcctccgcagccggcgccggcctccagcgccccagactcccgcgctgccgcccgagcctgaggtttctcacggcgttcgggattcgcgcttcggaaaccgggaacaaagaagcaagcagcacccttcagaaacagtgttctcgctctcctagcagctggcccgggcccggaggctggtgccaggagaaggcagaagagcccgggcagccggagtgggctacggggttcaggcagtgccaaggaagaagggcctcacaatgggcaattcagctgcctcccgggccgttgtccccgctgtcttcaaacaggggtcccctgtcccagctgccccaggaggagggggggaggcaggcagggccgaaaccctccagagcccagagggggacgcttggtggccgctgcagttacataaccataggatgcttttgtaccgtggaccttgttctagcaggatcctttcggaattgcacttttacatgttgggcgaatttgtgtccgtgctgaagtttattaaaggaaaatagatggagccttggagttgcacgtgtgcgtccctgcctgggaactagaggaaggagggccacatactctgggtccccatcagcagacccgaacgtcagagaagctgcatgtgcgtctactgggatcttctgagtaagctagaactgctgggccggcctgtgcaggttgttctggcttttaatcgtttccagtgattgaaaagcccaggctaccatccctccaaataactccagtgctaactcaaacctcatattcaccattcactttccggcagcttagaacctaccggggcgcaggacgtagttttcgtctttaccagagtgcgtggccgggcgcggtggctcacacctgtcatcccagcattttgggaggcccaggcggtcggatcgcctgaggtcaggagttcaagaccagcctggccaacgtggtgaaaccctgtctctactaaaagcacaaaaattagccaggcgtggtggtgggcgcctgtaaccccagctactcgggagggtgaggcagggagaatcgactgaacccagaggcagaggttgtagtgagccgagatcatgccactgcactccagcctgggcaacagagtgaggctctgtctcaaaaaacaaaacaacaacaacaaaacaaaaaaagagtgagaggacaaaacaggtgtatattcccattttatagatgacataactgaggcccaaagaaggaaagtgactcactcagtgtcacagtaaatccacggcaggaccagggccagaacaaaagtctcctgagtggcactcttcactatcacataacactgtggctcgcaacagccctggaagcaaagccagttggggtcaccaggcacctagaccctcactgcttgtctgctggcagagagccgctccttcttgtcagagtaagtaggaaggaggcctttgcctgtgcggacctatggtctggtgactccagccagcacaaacccatcccctgatggttggaggctgggcaagggcttcttgcaagatgcgcctgacagtgccttgttacagagcacctgctgtgcttagcattccacccggggccaagaggctgtgtgagcaggtgacagccagcctggccccgcctgtcacaagctgctaggtctgcacccttgccacccatggcagggggtctgacaaagactccccatttgtgaggtctgttcactgcctgtatttcgaacagggcctggctctgcaaacctgtgcaaactgtgttgatataggagccgacatgagcaagcagaggctcccctggctcaggcagccccaggttgggttggccagacagcaaccaggcacaggggccaagtgcaggtcctgctacccagccaccacagcttcctctcacctgattctcacagcaacccaggcaggataggcagggtggggttatcttattttgcagaaacaggctttcccaagtctgtcaccaagtgaggggtagagctgggtgtccagccagatctaacctccagcccagagctggtgatgcggaaaatcagggcagatggcagcaggatctaaaatagggagggaagaagtcctcagttacgtaacagcgaggagactctcagcctacgcacagtagcaaccatggggtcctgccactcgagccagaccctccttcccttcccgttttgggctctaagtgctgccccctgtgagagaatgtgctggaggagcccccagtatccttccagcgggaagtcggctctgtcaaggccattcccgagagcaggctctaggaattcaaagaccaagcaggcagagctggattctggagctgccctcaaagggcttgagggttatatgagcgccgtgcttgagaagttagtgatgatttctgctcaaagagacagagcaagagggctgaggggctctggtgctctgggggagatgaaacaaccccacagtatatgaggcctctctggtgtgtgcgggcactaaggaagggtgacttgcgagtggcgcattcggaggcacggggtgggcagctgttgagcaagggaccagggctgggacaggctgccaggacccccacaaccccaggggaggaaaggggactcagccatcatcatgcctgactcccaggctcccggatgaggagcctgctagccagggcttgaagccctccagtgacagggggtgcattacttcctaagaagccatttccttggttcagaaacgtttatccaaagactgagccgaaatctaccacctcacttaatgtttttggcacctggttatgacccagacctgcacagaataatttaactcttctgaaatagacttccagatatttggaagtggccaagtcaggtttaagagctcaggtctcccatttgacaagatttccatctcctcgctgtctgaacaggtttcagctgtggttatccaatccctcattcttgatgacacacaccaggctgaatggtctttagagttcccctcaagccgccaagcgctctgagacaggtttactagctttggtgagatgctgacactcctcacatgcacgtgcccctcccaactactcaagtgagttcgtggcaaatctctcatctgatctgcataaacggattatatcttaggcggtgccattgtctgcattttacaaataaggaaactgagcctcagggaggtgaagtcatttgcccaaaatcacagagccaggaaacgagagagccaagatccagaccccgcaagatccagaccccacaagatccagaccccgcaagatccagacccctcaagatatagaccctgcaagatccagacctcacaagatccagaccccacaagatccagacctcggctatctggcttctcttttttttgcgacagagtctcaatctgtcacccaggctggagcgcagtggtgtgatctcagctcactgcaacctctgcctcccaggttcaagcaattctcctgcctcagcctcccgagtagctgggatcacaggtgtgcgccatgcctggctaaatttttttttttttttttgtatttttagtagagatggggtttcgctatgttggccaagctggtctcgaacccctgacctcaggtgatccacctgcctcgacctctcagagtgctgggattacaggcgtgagccactgcacccagccccatctgacttctatacccgcagccccttcctttaccctcaggctgcctcagtctccacactggggcccagagctgggctggactcagcgcagtcagaacctcgccttgcacgtggcgaaggagcggcaggcaggcaggcaggcaggcaggcaagcaggacagccagcttcctcctagtccgcagtttcgcggagcagcctggaaagggaggcccaggcttccctgtctcgtcgcacgtgtgtctgcagtgtctgtgctatctcccaggggcctggatgtcgatggaatgcctgagggtggagagagctgtggctgaggcctaccctggcggcctcagcatctgtggagatgtgtagagacagggagagtgaatggggaccaacctcaggagatgctgggtcccagaagcaccatgtgcttctcctttggtgagacttaattactctctaaaatgtaaggctactcccacttatcaaattatagatgagtttaattacagcacactgagtaaccacactgggctccttcagaaatagcagcaggctggttgctcttctcagcttcagctgtagccaccccagtttcaggaggaagtgcccgtggttcctggggcctggaagtgccgctcaactctgctgccagacaagtgcgggcgtggtggactgcactgggtacactgctgtaccggccaccaccctccggccactctcagccggtgagtgctctgcggggccatctggccacgtgttctgtgactgggtcatttactctgctgcaacctctctttctcctacctacatcgtgttctggataaaggttttggctcataatgtccgaccagaggtggacaaagtggtgtgggacctgccgtaagaaacagggagcatggtgcggggagagaagcctgtgccttatggagactcggggcaccttcaggaagcagggtcaacagcagcaggccgctagggagtcgggagagctcggtgatgtcacgaggggcatcagactcttccctgcaggctggcgggactgatgggctctcgttccaatggaggtacaatgggacttccggggctgtgatgggaagggcggaggagctgccgatggtcccagtgccatattagtgtcacattctgaggggcagccctgtgccggacggcagctgctacctctccctctgcccctttattacttgaatctcttcgttgtgccctgtctaggcacggtcgtccgacagcaggcagcccactgccctcccagagctcactgtctagcccagggtgacacagggtaaccgtgggcatgacttgggccgggaagtgagaggctcgattccatcacatgtaaataaaaatactcattttcaatctaa

SEQ ID NO: 102701 - DNA, 868 bp, Homo sapiens; identical to SEQ ID NO: 102692
  Payload ID: 34
  Gene Symbol: BDH1
  Gene Name: 3-hydroxybutyrate dehydrogenase, type 1
  ENST ID: ENST00000625957
  CDS Start-End: 371-868

SEQ ID NO: 102702 - DNA, 1605 bp, Homo sapiens; identical to SEQ ID NO: 102698
  Payload ID: 34
  Gene Symbol: BDH1
  Gene Name: 3-hydroxybutyrate dehydrogenase, type 1
  ENST ID: ENST00000631323
  CDS Start-End: 534-1304

SEQ ID NO: 102703 - DNA, 845 bp, Homo sapiens
  Payload ID: 34
  Gene Symbol: BDH1
  Gene Name: 3-hydroxybutyrate dehydrogenase, type 1
  ENST ID: ENST00000630698
  CDS Start-End: 286-845
gcaggagagcgggcacctgcgcggcgccgggtgaaggcgagagcctcggcgagccctctgcagcggagccccctgcccatttggttttggccagtcagcctggaaatctgcctgtagtcagctgatgcagagtcaccctgcagttcctactttgaggggttgcagaagcacatatttcactatggagggccgcctgcaggcctcgcgctgacaggatcttttgtgacgctgcaaatgtcctgaaccaccgggaggaactgggccattctaacacccgttgctaccatgctggccacccgcctctccagacccctgtcacggctcccaggaaaaaccctaagtgcctgtgatagagaaaatggagcaagacgcccactattgcttggttctacttcctttatcccgattggccgtcggacttatgccagtgcggcggagccggttggcagcaaagctgtcctggtcacaggctgtgactctggatttgggttctcattggccaagcatctgcattcaaaaggcttccttgtgtttgctggctgcttgatgaaggacaaaggccatgatggggtcaaggagctggacagcctaaacagtgaccgattgagaaccgtccagctcaatgtctgcagcagcgaagaggtggagaaagtggtggagattgtccgctcgagcctgaaggaccctgagaaaggcatgtggggcctcgttaacaatgccggcatctcaacgttcggggaggtggagttcaccagcctggagacctacaagcaggtggcagaagtgaacctttggggcacagtgcggatgacgaaatcctttctccccctcatccgaagggccaa

SEQ ID NO: 102704 - DNA, 658 bp, Homo sapiens
  Payload ID: 34
  Gene Symbol: BDH1
  Gene Name: 3-hydroxybutyrate dehydrogenase, type 1
  ENST ID: ENST00000629309
  CDS Start-End: 154-658
ggctactcaggaggctgaggcaggagaatcgcttgaacccaggaggcggaggttgcagtgagctgagatcgtgtcactgcactccagcctgggcaacaagagtgaaactctgtctcaaaaacaaaacaaaacaaaacaaaaaacaaaatttgaatggcgtcaaatggtatacagaaaagacgcccactattgcttggttctacttcctttatcccgattggccgtcggacttatgccagtgcggcggagccggttggcagcaaagctgtcctggtcacaggctgtgactctggatttgggttctcattggccaagcatctgcattcaaaaggcttccttgtgtttgctggctgcttgatgaaggacaaaggccatgatggggtcaaggagctggacagcctaaacagtgaccgattgagaaccgtccagctcaatgtctgcagcagcgaagaggtggagaaagtggtggagattgtccgctcgagcctgaaggaccctgagaaaggcatgtggggcctcgttaacaatgccggcatctcaacgttcggggaggtggagttcaccagcctggagacctacaagcaggtggcagaagtgaacctttggggcacagtgcggatgacgaaatcctttctccccctcatccgaagggccaaag

SEQ ID NO: 102705 - DNA, 949 bp, Homo sapiens
  Payload ID: 34
  Gene Symbol: BDH1
  Gene Name: 3-hydroxybutyrate dehydrogenase, type 1
  ENST ID: ENST00000626799
  CDS Start-End: 388-949
ccgggtggcggaggccgcaggccgcaggagtgctggtggaggggcttccagaaagaccctgcggcagcgccccccctcggctctccccgcaggagagcgggcacctgcgcggcgccgggtgaaggcgagagcctcggcgagccctctgcagcggagccccctgcccatttggttttgggcaggaggaggccctgggttaaacacgcggccctgcagctcccaggtgaaacgactcatcgtttcctgccggcgcatcttactgaaggggacccaggccccacgaagggaaggaaccgtcctcaaggtcacgtcgtagtcaaaggccgagcccagaccgaagccagaaccaccgggaggaactgggccattctaacacccgttgctaccatgctggccacccgcctctccagacccctgtcacggctcccaggaaaaaccctaagtgcctgtgatagagaaaatggagcaagacgcccactattgcttggttctacttcctttatcccgattggccgtcggacttatgccagtgcggcggagccggttggcagcaaagctgtcctggtcacaggctgtgactctggatttgggttctcattggccaagcatctgcattcaaaaggcttccttgtgtttgctggctgcttgatgaaggacaaaggccatgatggggtcaaggagctggacagcctaaacagtgaccgattgagaaccgtccagctcaatgtctgcagcagcgaagaggtggagaaagtggtggagattgtccgctcgagcctgaaggaccctgagaaaggcatgtggggcctcgttaacaatgccggcatctcaacgttcggggaggtggagttcaccagcctggagacctacaagcaggtggcagaagtgaacctttggggcacagtgcggatgacgaaatcctttctccccctcatccgaagggccaaag

SEQ ID NO: 102706 - DNA, 310 bp, Homo sapiens
  Payload ID: 34
  Gene Symbol: BDH1
  Gene Name: 3-hydroxybutyrate dehydrogenase, type 1
  ENST ID: ENST00000627658
  CDS Start-End: 44-310
aaccaccgggaggaactgggccattctaacacccgttgctaccatgctggccacccgcctctccagacccctgtcacggctcccaggaaaaaccctaagtgcctgtgatagagaaaatggagcaagacgcccactattgcttggttctacttcctttatcccgattggccgtcggacttatgccagtgcggcggagccggttggcagcaaagctgtcctggtcacaggctgtgactctggatttgggttctcattggccaagcatctgcattcaaaaggcttccttgtgtttgctggctgcttgatgaag

SEQ ID NO: 102707 - DNA, 1126 bp, Homo sapiens
  Payload ID: 35
  Gene Symbol: BDH2
  Gene Name: 3-hydroxybutyrate dehydrogenase, type 2
  Uniprot ID: Q9BUT1
  ENST ID: ENST00000296424
  CDS Start-End: 122-859
agcatgcattattaagcgcttgacttgcttccagacaaaggttgtctcaagtttgttgctcaaaccgagttctggagaacgccatcagctcgctgcttaaaattaaaccacaggttccattatgggtcgacttgatgggaaagtcatcatcctgacggccgctgctcaggggattggccaagcagctgccttagcttttgcaagagaaggtgccaaagtcatagccacagacattaatgagtccaaacttcaggaactggaaaagtacccgggtattcaaactcgtgtccttgatgtcacaaagaagaaacaaattgatcagtttgccaatgaagttgagagacttgatgttctctttaatgttgctggttttgtccatcatggaactgtcctggattgtgaggagaaagactgggacttctcgatgaatctcaatgtgcgcagcatgtacctgatgatcaaggcattccttcctaaaatgcttgctcagaaatctggcaatattatcaacatgtcttctgtggcttccagcgtcaaaggagttgtgaacagatgtgtgtacagcacaaccaaggcagccgtgattggcctcacaaaatctgtggctgcagatttcatccagcagggcatcaggtgcaactgtgtgtgcccaggaacagttgatacgccatctctacaagaaagaatacaagccagaggaaatcctgaagaggcacggaatgatttcctgaagagacaaaagacgggaagattcgcaactgcagaagaaatagccatgctctgcgtgtatttggcttctgatgaatctgcttatgtaactggtaaccctgtcatcattgatggaggctggagcttgtgattttaggatctccatggtgggaaggaaggcaggcccttcctatccacagtgaacctggttacgaagaaaactcaccaatcatctccttcctgttaatcacatgttaatgaaaataagctctttttaatgatgtcactgtttgcaagagtctgattctttaagtatattaatctctttgtaatctcttctgaaatcattgtaaagaaataaaaatattgaactcatagcaggagaatagtttttaaaataaatctcgatttgttagca

SEQ ID NO: 102708 - DNA, 582 bp, Homo sapiens
  Payload ID: 35
  Gene Symbol: BDH2
  Gene Name: 3-hydroxybutyrate dehydrogenase, type 2
  ENST ID: ENST00000511354
  CDS Start-End: 68-340
gttgctcaaaccgagttctggagaacgccatcagctcgctgcttaaaattaaaccacaggttccattatgggtcgacttgatgggaaagtcatcatcctgacggccgctgctcaggggattggccaagcagctgccttagcttttgcaagagaaggtgccaaagtcatagccacagacattaatgagtccaaacttcaggaactggaaaagtacccgggtattcaaactcgtgtccttgatgtcacaaagaagaaacaaattgatcagtttgccaatgaagttgagagacttgatgttctctttaatgttgctggggtttgtcttggttccccaggctagagggcagtggaatgatcatagctcactgcatcctaaaactcctgggctcaagtggtcctcttgcctcagccttcaaagtagctgaggctgcagttttgtccatcatggaactgtcctggattgtgaggagaaagactgggacttctcgatgaatctcaatgtgcgcagcatgtacctgatgatcaaggcattccttcctaaaatgcttgctcagaaatctggcaatattatcaacatgtctt

SEQ ID NO: 102709 - DNA, 616 bp, Homo sapiens
  Payload ID: 35
  Gene Symbol: BDH2
  Gene Name: 3-hydroxybutyrate dehydrogenase, type 2
  ENST ID: ENST00000509245
  CDS Start-End: 268-616
aagcgcttgacttgcttccagacaaaggttgtctcaagtttgttgctcaaaccgagttctggagaacgccatcagctcgctgcttaaagggaaatgctgttgtgagagagaatgaggagagaactaggtaaggctgtgagagccatcagacctcgatgcaagtccacccgcgagggaggaaaagaaggaaaccaggttgagtggaagcatcccagacagctgtgcagtctaagagaacttcagcaagattaaaccacaggttccattatgggtcgacttgatgggaaagtcatcatcctgacggccgctgctcaggggattggccaagcagctgccttagcttttgcaagagaaggtgccaaagtcatagccacagacattaatgagtccaaacttcaggaactggaaaagtacccgggtattcaaactcgtgtccttgatgtcacaaagaagaaacaaattgatcagtttgccaatgaagttgagagacttgatgttctctttaatgttgctggttttgtccatcatggaactgtcctggattgtgaggagaaagactgggacttctcgatgaatctcaatgtgcgcagcatgtacctgatgatcaaggcattcc

SEQ ID NO: 102710 - DNA, 550 bp, Homo sapiens
  Payload ID: 35
  Gene Symbol: BDH2
  Gene Name: 3-hydroxybutyrate dehydrogenase, type 2
  ENST ID: ENST00000506521
  CDS Start-End: 109-303
aagcgcttgacttgcttccagacaaaggttgtctcaagtttgttgctcaaaccgagttctggagaacgccatcagctcgctgcttaaaattaaaccacaggttccattatgggtcgacttgatgggaaagtcatcatcctgacggccgctgctcaggggattggccaagcagctgccttagcttttgcaagagaaggtgccaaagtcatagccacagacattaatgagtccaaacttcaggaactggaaaagtacccggtgcctcttgttttatttttcaggtattcaaactcgtgtccttgatgtcacaaagaagaaacaaattgatcagtttgccaatgaagttgagagacttgatgttctctttaatgttgctggttttgtccatcatggaactgtcctggattgtgaggagaaagactgggacttctcgatgaatctcaatgtgcgcagcatgtacctgatgatcaaggcattccttcctaaaatgcttgctcagaaatctggcaatattatcaacatgtcttctgtggcttccagcgtcaaaggt

SEQ ID NO: 102711 - DNA, 578 bp, Homo sapiens
  Payload ID: 35
  Gene Symbol: BDH2
  Gene Name: 3-hydroxybutyrate dehydrogenase, type 2
  ENST ID: ENST00000504285
  CDS Start-End: 187-578
gttgctcaaaccgagttctggagaacgccatcagctcgctgcttaaactggaaacaaaagtctcaacttccaacctctttgcagctaggagtggccaagtagcatagatctggtgaatgaactgcaggtgggaatttctgagaaggtttccttcttaaatagaaagattaaaccacaggttccattatgggtcgacttgatgggaaagtcatcatcctgacggccgctgctcaggggattggccaagcagctgccttagcttttgcaagagaaggtgccaaagtcatagccacagacattaatgagtccaaacttcaggaactggaaaagtacccgggtattcaaactcgtgtccttgatgtcacaaagaagaaacaaattgatcagtttgccaatgaagttgagagacttgatgttctctttaatgttgctggttttgtccatcatggaactgtcctggattgtgaggagaaagactgggacttctcgatgaatctcaatgtgcgcagcatgtacctgatgatcaaggcattccttcctaaaatgcttgctcagaaatctggcaatattatcaacat

SEQ ID NO: 102712 - DNA, 1990 bp, Homo sapiens
  Payload ID: 36
  Gene Symbol: HIBADH
  Gene Name: 3-hydroxyisobutyrate dehydrogenase
  Uniprot ID: P31937
  ENST ID: ENST00000265395
  CDS Start-End: 208-1218
ggattgacaggccctgccgcgtcaggccgctcctctcggctccgcgctccttccctcgcgcgtgggcacccgcccccgagcggtgagagcgcgtgcgcgcgcgcccttctccgtgggcgagccagccagtcccgctgcacacgctcgcagtctgtgggccctccgggaggcggcggaggtcaccgcggggagaggggcgggcgcagcatggcagcctccttacggctcctcggagctgcctccggtctccggtactggagccggcggctgcggccggcagccggcagctttgcagcggtgtgttctaggtcagtggcttcaaagactccagttggattcattggactgggcaacatggggaatccaatggcaaaaaatctcatgaaacatggctatccacttattatttatgatgtgttccctgatgcctgcaaagagtttcaagatgcaggtgaacaggtagtatcttccccagcagatgttgctgaaaaagctgacagaattattacaatgctgcccaccagtatcaatgcaatagaagcttattccggagcaaatgggattctaaaaaaagtgaagaagggctcattattaatagattccagcactattgatcctgcagtttcaaaagaattggccaaagaagttgagaaaatgggagcagttttcatggatgcccctgtttctggtggtgtaggagctgcacgatctgggaacctcacgtttatggtgggaggagttgaagatgaatttgctgctgcccaagagttgctggggtgcatgggctccaacgtggtgtactgtggagctgttgggactgggcaggcggcaaagatctgcaacaacatgctgttagctattagtatgattggaactgctgaagctatgaatcttggaatcaggttagggcttgacccaaaactactggctaaaatcctaaatatgagctcaggacggtgttggtcaagtgacacttataatcctgtacctggagtgatggatggcgttccctcggctaataactatcagggtggatttggaacaacactcatggctaaggatctgggattggcacaagactctgctaccagcacaaagagcccaatccttcttggcagtctggcccatcagatctacaggatgatgtgtgcaaagggctactcaaagaaagacttctcatccgtgttccagttcctacgagaggaggagaccttctgagtgtgccctttggccacggacactgttgggaaccaaactctgtcttggagcctccttttagctcactccacaagtaaatggatttaatcaaaggtcacctatctgcttttgattgtctaggtcacagtaatccctaggatttttcaccgcttattctttttgtctttttaacaaacatattatccgaattttttttctgcaagccactgatagtctctgctaactagcttaattgacctttttacaaagtttgatccccaagcatcctcaactaaatcattgaatacttcaatcaggatattatctgctttactttacaaataaaaccaaatcttttgtcaacaggatgaaacccatcttaaaggaaagaaaaggaattggtgtgaagagagaagttagagaagggaaatgcagtgaattactatctgtgtccatcaggaagtttgtcctgttaaccaaatggttactgcactaccagggttactggtttattttccagggagctgataaagcaggagaactgttgctgcatgttttctatttggactccgtcacaatatggtaggatatccctcaccaactcccgacactcagcagacttgtttttatatttttttctttcttgttcattcttactacgtattttttgacttaagaatgacatctttagatgcatttcagagccaatgatgatatttgctttagataattattatattattataaatatagccatattattttgaattcaaataaatttctatactggtaa

SEQ ID NO: 102713 - DNA, 618 bp, Homo sapiens
  Payload ID: 36
  Gene Symbol: HIBADH
  Gene Name: 3-hydroxyisobutyrate dehydrogenase
  ENST ID: ENST00000425715
  CDS Start-End: 1-618
ctgaattacctcatactctgaagttaccaggcttacctctgtttcccaacaagtttcttatttctttagtgttgctaattttagtatcttccccagcagatgttgctgaaaaagctgacagaattattacaatgctgcccaccagtatcaatgcaatagaagcttattccggagcaaatgggattctaaaaaaagtgaagaagggctcattattaatagattccagcactattgatcctgcagtttcaaaagaattggccaaagaagttgagaaaatgggagcagttttcatggatgcccctgtttctggtggtgtaggagctgcacgatctgggaacctcacgtttatggtgggaggagttgaagatgaatttgctgctgcccaagagttgctggggtgcatgggctccaacgtggtgtactgtggagctgttgggactgggcaggcggcaaagatctgcaacaacatgctgttagctattagtatgattggaactgctgaagctatgaatcttggaatcaggttagggcttgacccaaaactactggctaaaatcctaaatatgagctcaggacggtgttggtcaagtgacacttataatcctgtacctggagtga

SEQ ID NO: 102714 - DNA, 1669 bp, Homo sapiens
  Payload ID: 36
  Gene Symbol: HIBADH
  Gene Name: 3-hydroxyisobutyrate dehydrogenase
  ENST ID: ENST00000428288
  CDS Start-End: 81-200
agtcccgctgcacacgctcgcagtctgtgggccctccgggaggcggcggaggtcaccgcggggagaggggcgggcgcagcatggcagcctccttacggctcctcggagctgcctccggtctccggtactggagccggcggctgcggccggcagccggcagctttgcagcgggtagtatcttccccagcagatgttgctgaaaaagctgacagaattattacaatgctgcccaccagtatcaatgcaatagaagcttattccggagcaaatgggattctaaaaaaagtgaagaagggctcattattaatagattccagcactattgatcctgcagtttcaaaagaattggccaaagaagttgagaaaatgggagcagttttcatggatgcccctgtttctggtggtgtaggagctgcacgatctgggaacctcacgtttatggtgggaggagttgaagatgaatttgctgctgcccaagagttgctggggtgcatgggctccaacgtggtgtactgtggagctgttgggactgggcaggcggcaaagatctgcaacaacatgctgttagctattagtatgattggaactgctgaagctatgaatcttggaatcaggttagggcttgacccaaaactactggctaaaatcctaaatatgagctcaggacggtgttggtcaagtgacacttataatcctgtacctggagtgatggatggcgttccctcggctaataactatcagggtggatttggaacaacactcatggctaaggatctgggattggcacaagactctgctaccagcacaaagagcccaatccttcttggcagtctggcccatcagatctacaggatgatgtgtgcaaagggctactcaaagaaagacttctcatccgtgttccagttcctacgagaggaggagaccttctgagtgtgccctttggccacggacactgttgggaaccaaactctgtcttggagcctccttttagctcactccacaagtaaatggatttaatcaaaggtcacctatctgcttttgattgtctaggtcacagtaatccctaggatttttcaccgcttattctttttgtctttttaacaaacatattatccgaattttttttctgcaagccactgatagtctctgctaactagcttaattgacctttttacaaagtttgatccccaagcatcctcaactaaatcattgaatacttcaatcaggatattatctgctttactttacaaataaaaccaaatcttttgtcaacaggatgaaacccatcttaaaggaaagaaaaggaattggtgtgaagagagaagttagagaagggaaatgcagtgaattactatctgtgtccatcaggaagtttgtcctgttaaccaaatggttactgcactaccagggttactggtttattttccagggagctgataaagcaggagaactgttgctgcatgttttctatttggactccgtcacaatatggtaggatatccctcaccaactcccgacactcagcagacttgtttttatatttttttctttcttgttcattcttactacgtattttttgacttaagaatgacatctttagatgcatttcagagccaatgatgatatttgctttagataattattatattattataaatatagccatatt

SEQ ID NO: 102715 - DNA, 1939 bp, Homo sapiens
  Payload ID: 37
  Gene Symbol: HIBCH
  Gene Name: 3-hydroxyisobutyryl-CoA hydrolase
  Uniprot ID: Q6NVY1
  ENST ID: ENST00000359678
  CDS Start-End: 296-1456
cctgcgaatccgccctagtccgttctatcctccctcttcccgctccgcctcagctcgctctccgccttctccctggcccggtccccgatcccttcctctccctcaactatttcctccaggcgtcgttcttgccccgcccttccccgtcgcgtagcggaaacggtcgctctggcttcctggaggacttgtcatctgtgcccggcggcgcaggacggcggtgggcggggctcacgcgaggcgctggaacggtccgggagattctcgctctgctgctttagcttcggagtgtttggcgatggggcagcgcgagatgtggaggctcatgtcgaggtttaatgcattcaaaaggactaataccatactgcaccatttgagaatgtccaagcacacagatgcagcagaagaggtgctattggaaaaaaaaggttgcacgggagtcataacactaaacagaccaaagttcctcaatgcactgactcttaatatgattcggcagatttatccacagctaaagaagtgggaacaagatcctgaaactttcctgatcattataaagggagcaggaggaaaggctttctgtgccgggggtgatatcagagtgatctcggaagctgaaaaggcaaaacagaagatagctccagttttcttcagagaagaatatatgctgaataatgctgttggttcttgccagaaaccttatgttgcacttattcatggaattacaatgggtgggggagttggtctctcagtccatgggcaatttcgagtggctacagaaaagtgtctttttgctatgccagaaactgcaataggactgttccctgatgtgggtggaggttatttcttgccacgactccaaggaaaacttggttacttccttgcattaacaggattcagactaaaaggaagagatgtgtacagagcaggaattgctacacactttgtagattctgaaaagttggccatgttagaggaagatttgttagccttgaaatctccttcaaaagaaaatattgcatctgtcttagaaaattaccatacagagtctaagattgatcgagacaagtcttttatacttgaggaacacatggacaaaataaacagttgtttttcagccaatactgtggaagaaattattgaaaacttacagcaagatggttcatcttttgccctagagcaattgaaggtaattaataaaatgtctccaacatctctaaagatcacactaaggcaactcatggaggggtcttcaaagaccttgcaagaagtactaactatggagtatcggctaagtcaagcttgtatgagaggtcatgactttcatgaaggcgttagagctgttttaattgataaagaccagagtccaaaatggaaaccagctgatctaaaagaagttactgaggaagatttgaataatcactttaagtctttgggaagcagtgatttgaaattttgaggtgacaggcttttaaggtatattttgtagcatgggttggcaatctacagcatgtgggccaaatccagcctgctgcctgtttttatataccctgtaagctaagaatggtttccgcatttttaaatggttgggaaaagaaatcaaagactaataattcatgacgtgaaaattatcagaattcacaaataaagctttattggaactagctatactcatctgtttatatattatctgtggctgctttgaaatgagtagttgcaatagagatggtaaagcctacaaagcctaattatttactgtctggtttttgtcagaaaaaagtttgtcaatccttgttttagaagatggaaaaatgtgaagatctttggagattctcttgagtggtatatctaattgaaatgggatcttcgtttggcttgtatgttgatgaaatcaacttaggtatacaatataaaaaataaagaccctgaaaattgttttgga

SEQ ID NO: 102716 - DNA, 2463 bp, Homo sapiens
  Payload ID: 37
  Gene Symbol: HIBCH
  Gene Name: 3-hydroxyisobutyryl-CoA hydrolase
  Uniprot ID: Q6NVY1
  ENST ID: ENST00000392332
  CDS Start-End: 141-1157
ggaaacggtcgctctggcttcctggaggacttgtcatctgtgcccggcggcgcaggacggcggtgggcggggctcacgcgaggcgctggaacggtccgggagattctcgctctgctgctttagcttcggagtgtttggcgatggggcagcgcgagatgtggaggctcatgtcgaggtttaatgcattcaaaaggactaataccatactgcaccatttgagaatgtccaagcacacagatgcagcagaagaggtgctattggaaaaaaaaggttgcacgggagtcataacactaaacagaccaaagttcctcaatgcactgactcttaatatgattcggcagatttatccacagctaaagaagtgggaacaagatcctgaaactttcctgatcattataaagggagcaggaggaaaggctttctgtgccgggggtgatatcagagtgatctcggaagctgaaaaggcaaaacagaagatagctccagttttcttcagagaagaatatatgctgaataatgctgttggttcttgccagaaaccttatgttgcacttattcatggaattacaatgggtgggggagttggtctctcagtccatgggcaatttcgagtggctacagaaaagtgtctttttgctatgccagaaactgcaataggactgttccctgatgtgggtggaggttatttcttgccacgactccaaggaaaacttggttacttccttgcattaacaggattcagactaaaaggaagagatgtgtacagagcaggaattgctacacactttgtagattctgaaaagttggccatgttagaggaagatttgttagccttgaaatctccttcaaaagaaaatattgcatctgtcttagaaaattaccatacagagtctaagattgatcgagacaagtcttttatacttgaggaacacatggacaaaataaacagttgtttttcagccaatactgtggaagaaattattgaaaacttacagcaagatggttcatcttttgccctagagcaattgaaggtaattaataaaatgtctccaacatctctaaagatcacactaaggcaactcatggaggggtcttcaaagaccttgcaagaagtactaactatggagtatcggctaagtcaagcttgtatgttttaattgataaagaccagagtccaaaatggaaaccagctgatctaaaagaagttactgaggaagatttgaataatcactttaagtctttgggaagcagtgatttgaaattttgaggtgacaggcttttaaggtatattttgtagcatgggttggcaatctacagcatgtgggccaaatccagcctgctgcctgtttttatataccctgtaagctaagaatggtttccgcatttttaaatggttgggaaaagaaatcaaagactaataattcatgacgtgaaaattatcagaattcacaaataaagctttattggaactagctatactcatctgtttatatattatctgtggctgctttgaaatgagtagttgcaatagagatggtaaagcctacaaagcctaattatttactgtctggtttttgtcagaaaaaagtttgtcaatccttgttttagaagatggaaaaatgtgaagatctttggagattctcttgagtggtatatctaattgaaatgggatcttcgtttggcttgtatgttgatgaaatcaacttaggtatacaatataaaaaataaagaccctgaaaattgttttggatactgtgttaatgcctcatagaatttttgttttggatactgtgttaatgcctcatagaattttctccatatatgagtgtgttttaaagtaactgagttactgtagcagaagagctccttttataaacattagaaaccttgggcagagagaaaagatttttattaacgtccctcttcagtattaactcagacttggtcttccctaaaataatcagaataccatcccatggtgaaactgaaaggattattttcttgttatttgtgatatttgttaatctggtagaatgagaaattaggaaactccaatctcttagatagagacactctgtttttttataatttacgtaagacttttgtgtgataattatccttacaaacaaggttcaagtcaggagaaaaaaattaattgaaagcaagaagacttttgttcaaaagatatattcaataattgatattgttaatgaagtaagtactttttaaggtatgaaagaactaaaaggtattccagactcagaaccttaaagttctaggcaagaataatttttaaactaaaggtaagtttataaattaacaaagtaaacaaaatttatgattttgttttttgtttgtaatttttgtttaattttaaaggtaagtttataaattaacaaacaaaatttataattttttgtttgtaatttttgtttataaacaaaataaattttttgtaacttg

SEQ ID NO: 102717 - DNA, 493 bp, Homo sapiens
  Payload ID: 37
  Gene Symbol: HIBCH
  Gene Name: 3-hydroxyisobutyryl-CoA hydrolase
  ENST ID: ENST00000392333
  CDS Start-End: 1-209
tgatctcggaagctgaaaaggcaaaacagaagatagctccagttttcttcagagaagaatatatgctgaataatgctgttggttcttgccagaaaccttatgttgcacttattcatggaattacaatgggtggggactgttccctgatgtgggtggaggttatttcttgccacgactccaaggaaaacttggttacttccttgcattaacaggattcagactaaaaggaagagatgtgtacagagcaggaattgctacacactttgtagattctgaaaagttggccatgttagaggaagatttgttagccttgaaatctccttcaaaagaaaatattgcatctgtcttagaaaattaccatacagagtctaagattgatcgagacaagtcttttatacttgaggaacacatggacaaaataaacagttgtttttcagccaatactgtggaagaaattattgaaaacttacagcaagatggttcatcttttgcc

SEQ ID NO: 102718 - DNA, 854 bp, Homo sapiens
  Payload ID: 37
  Gene Symbol: HIBCH
  Gene Name: 3-hydroxyisobutyryl-CoA hydrolase
  ENST ID: ENST00000410045
  CDS Start-End: 261-752
gctagtatctgcaatgagtagacagacattctcagggctgtagaggatatgaaaaagaggaatatactttggggatgcgattagaagtgggtacaaaagataaataaccatctctctcatctggcagaggtaaagtatggtaagtgtaaaaacaatacaaagaaaatactcaaagaattgaaaggaggaagagcttacctgtaagaaaggactagaagcttttttatgaaggttgcagtacagccggccttaagttggccatgttagaggaagatttgttagccttgaaatctccttcaaaagaaaatattgcatctgtcttagaaaattaccatacagagtctaagattgatcgagacaagtcttttatacttgaggaacacatggacaaaataaacagttgtttttcagccaatactgtggaagaaattattgaaaacttacagcaagatggttcatcttttgccctagagcaattgaaggtaattaataaaatgtctccaacatctctaaagatcacactaaggcaactcatggaggggtcttcaaagaccttgcaagaagtactaactatggagtatcggctaagtcaagcttgtatgagaggtcatgactttcatgaaggcgttagagctgttttaattgataaagaccagagtccaaaatggaaaccagctgatctaaaagaagttactgaggaagatttgaataatcactttaagtctttgggaagcagtgatttgaaattttgaggtgacaggcttttaaggtatattttgtagcatgggttggcaatctacagcatgtgggccaaatccagcctgctgcctgtttttatataccctgtaagctaa

SEQ ID NO: 102719 - DNA, 511 bp, Homo sapiens
  Payload ID: 37
  Gene Symbol: HIBCH
  Gene Name: 3-hydroxyisobutyryl-CoA hydrolase
  ENST ID: ENST00000409820
  CDS Start-End: 127-511
gcaatgagtagacagacattctcagggctgtagaggatatgaaaaagaggaatatactttggggatgcgattagaagtgggtacaaaagataaataaccatctctctcatctggcagaggtaaagtatgttggccatgttagaggaagatttgttagccttgaaatctccttcaaaagaaaatattgcatctgtcttagaaaattaccatacagagtctaagattgatcgagacaagtcttttatacttgaggaacacatggacaaaataaacagttgtttttcagccaatactgtggaagaaattattgaaaacttacagcaagatggttcatcttttgccctagagcaattgaaggtaattaataaaatgtctccaacatctctaaagatcacactaaggcaactcatggaggggtcttcaaagaccttgcaagaagtactaactatggagtatcggctaagtcaagcttgtatgagaggtcatgactttcatgaaggcgttagagctg

SEQ ID NO: 102720 - DNA, 826 bp, Homo sapiens
  Payload ID: 37
  Gene Symbol: HIBCH
  Gene Name: 3-hydroxyisobutyryl-CoA hydrolase
  ENST ID: ENST00000409934
  CDS Start-End: 6-826
cggcgatgccgggcatgcctggccgggcccggccgggggcggcctcgctgccggggcagggacctcgcaggccggcgcgcagaggcgaggaaccctcccggcgccatcgactcacctacccgcggagaggcgacggcgcgcgccgctcaccagcccgggccccagatccaaggaggaggggcagcggcgcggggaccctgtggtttaatgcattcaaaaggactaataccatactgcaccatttgagaatgtccaagcacacagatgcagcagaagaggtgctattggaaaaaaaaggttgcacgggagtcataacactaaacagaccaaagttcctcaatgcactgactcttaatatgattcggcagatttatccacagctaaagaagtgggaacaagatcctgaaactttcctgatcattataaagggagcaggaggaaaggctttctgtgccgggggtgatatcagagtgatctcggaagctgaaaaggcaaaacagaagatagctccagttttcttcagagaagaatatatgctgaataatgctgttggttcttgccagaaaccttatgttgcacttattcatggaattacaatgggtgggggagttggtctctcagtccatgggcaatttcgagtggctacagaaaagtgtctttttgctatgccagaaactgcaataggactgttccctgatgtgggtggaggttatttcttgccacgactccaaggaaaacttggttacttccttgcattaacaggattcagactaaaaggaagagatgtgtacagagcaggaattgctacacactttgtagattctga

SEQ ID NO: 102721 - DNA, 396 bp, Homo sapiens
  Payload ID: 37
  Gene Symbol: HIBCH
  Gene Name: 3-hydroxyisobutyryl-CoA hydrolase
  ENST ID: ENST00000399855
  CDS Start-End: 1-116
ttttaattgataaagaccagagtccaaaatggaaaccagctgatctaaaagaagttactgaggaagatttgaataatcactttaagtctttgggaagcagtgatttgaaattttgaggtgacaggcttttaagaccgcctatgggcagcatccagagcggaccagctccctgtgctggaggactccagtgtgaggcctgctgcttcctttctacattggcctgaaaccagcccaactcagtggtcataatcttctgggcctaccgaagagcaaaagcctacttctagttcttccagttgccagttcaagggctttatctgtcacttcctttgggaacaggtagagtgctttgatttagaatgatggcaataaatgagaaaccaatttgaaattgga

SEQ ID NO: 102722 - DNA, 502 bp, Homo sapiens
  Payload ID: 37
  Gene Symbol: HIBCH
  Gene Name: 3-hydroxyisobutyryl-CoA hydrolase
  ENST ID: ENST00000416732
  CDS Start-End: 1-360
cagtctaagattgatcgagacaagtcttttatacttgaggaacacatggacaaaataaacagttgtttttcagccaatactgtggaagaaattattgaaaacttacagcaagatggttcatcttttgccctagagcaattgaaggtaattaataaaatgtctccaacatctctaaagatcacactaaggcaactcatggaggggtcttcaaagaccttgcaagaagtactaactatggagtatcggctaagtcaagcttgtatgagaggtcatgactttcatgaaggcgttagagctggtaagtggcaaatgggaacttaccattttggggaaatgggatttgtgagcatatgctgttaattaaagaagatacagattatgcatcccaaatcctaaaatccaaaatgtaccaaaatctgaaactatttgagcaccaacatgacactcaaatgttcattggaccataagtataatgcaaatattccaaaatctgaaaaaaaaa

SEQ ID NO: 102723 - DNA, 202 bp, Homo sapiens
  Payload ID: 37
  Gene Symbol: HIBCH
  Gene Name: 3-hydroxyisobutyryl-CoA hydrolase
  ENST ID: ENST00000414928
  CDS Start-End: 1-159
gatgtgggtggaggttatttcttgccacgactccaaggaaaacttggttacttccttgcattaacaggattcagactaaaaggaagagatgtgtacagagcaggaattgctacacactttgtagattctgaaaagaatggagatgacactattacatagtagttgaaactccttgtgttacatgtggcagaagacccaattc

SEQ ID NO: 102724 - DNA, 1308 bp, Homo sapiens
  Payload ID: 37
  Gene Symbol: HIBCH
  Gene Name: 3-hydroxyisobutyryl-CoA hydrolase
  ENST ID: ENST00000622246
  CDS Start-End: 63-1205
gtccgggagattctcgctctgctgctttagcttcggagtgtttggcgatggggcagcgcgagatgtggaggctcatgtcgaggtttaatgcattcaaaaggactaataccatactgcaccatttgagaatgtccaagcacacagatgcagcagaagaggtgctattggaaaaaaaaggttgcacgggagtcataacactaaacagaccaaagttcctcaatgcactgactcttaatatgattcggcagatttatccacagctaaagaagtgggaacaagatcctgaaactttcctgatcattataaagggagcaggaggaaaggctttctgtgccgggggtgatatcagagtgatctcggaagctgaaaaggcaaaacagaagatagctccagttttcttcagagaagaatatatgctgaataatgctgttggttcttgccagaaaccttatgttgcacttattcatggaattacaatgggtgggggagttggtctctcagtccatgggcaatttcgagtggctacagaaaagtgtctttttgctatgccagaaactgcaataggactgttccctgatgtgggtggaggttatttcttgacgactccaaggaaaacttggttacttccttgcattaacggattcagactaaaaggaagagatgtgtacagagcaggaattgctacacactttgtagattctgaaaagttggccatgttagaggaagatttgttagccttgaaatctccttcaaaagaaaatattgcatctgtcttagaaaattaccatacagagtctaagattgatcgagacaagtcttttatacttgaggaacacatggacaaaataaacagttgtttttcagccaatactgtggaagaaattattgaaaacttacagcaagatggttcatcttttgccctagagcaattgaaggtaattaataaaatgtctccaacatctctaaagatcacactaaggcaactcatggaggggtcttcaaagaccttgcaagaagtactaactatggagtatcggctaagtcaagcttgtatgagaggtcatgactttcatgaaggcgttagagctgttttaattgataaagaccagagtccaaaatggaaaccagctgatctaaaagaagttactgaggaagatttgaataatcactttaagtctttgggaagcagtgatttgaaattttgaggtgacaggcttttaaggtatattttgtagcatgggttggcaatctacagcatgtgggccaaatccagcctgctgcctgtttttatataccctgtaagctaag

SEQ ID NO: 102725 - DNA, 1101 bp, Homo sapiens
  Payload ID: 38
  Gene Symbol: HMGCL
  Gene Name: 3-hydroxymethyl-3-methylglutaryl-CoA lyase
  ENST ID: ENST00000235958
  CDS Start-End: 1-548
ggaaggcgcttccgcggcgactggtgggcttggcgtccctccgggctgtcagcacctcatctatgggcactttaccaaagcgggtgaaaattgtggaagttggtccccgagatggactacaaaatgaaaaggtcaccaagaagttctactcaatgggctgctacgagatctccctgggggacaccattggtgtgggcaccccagggatcatgaaagacatgctatctgctgtcatgcaggaagtgcctctggctgccctggctgtccactgccatgacacctatggtcaagccctggccaacaccttgatggccctgcagatgggagtgagtgtcgtggactcttctgtggcaggacttggaggctgtccctacgcacagggggcatcaggaaacttggccacagaagacctggtctacatgctagagggcttgggcattcacacgggtgtgaatctccagaagcttctggaagctggaaactttatctgtcaagccctgaacagaaaaactagctccaaagtggctcaggctacctgtaaactctgagccccttgcccacctgaagccctggggatgatgtggaaataggggcacacacagatgattcatggatggggacatggaaatgagaataggttaaatggtgcaggtacctcatagccagctctacacagaggtctctcctggcagaaagcaggcgaagggcaggaggagctgcttggcagaaggacctcctgcccagacctgaggagtgagaggctttgagggctgaagtctccctttgttacggaccctggcccaggagttgaatgcctgaggacgtgtgggaaccccgttccctacttagcatgatccttgagtctcctctctggatggaatccgcgagctggccacctggccaccctctacacggctccaccctgccatggccgtggggcccttgctctctgacttctcaggacacaggtcatggaggttcttcccaagctggcagaggccatttgtggaaagtggagagctacgtggtggccgtctgccaactccagcatctctggaaaatctccacgctgaatgtgatttttgaaaacagcttatgtaa

SEQ ID NO: 102726 - DNA, 2151 bp, Homo sapiens
  Payload ID: 38
  Gene Symbol: HMGCL
  Gene Name: 3-hydroxymethyl-3-methylglutaryl-CoA lyase
  ENST ID: ENST00000374487
  CDS Start-End: 323-556
agtgccaggctgctcaaacctctaggggggcatacagacaggcagaggctgtgggcctccaaccccacggcagcatgtaggggtggatgcttacagctcctggagccccagtgggcgtgtgttacagggtgctcttttagttttgctgtctataggcgacttgtgttagttaaccagctcgagtgggctctcaaccttgtcataggacagagagggctttctatatgccgggttcttgccttggtgtaccagaagaattggatcacacctgggcttagagaatgggtgcaaggttttattgagtagaggtagctcttagcagatgttggaagccagaagagaatggagtaggaaggttttcccctggagtggggccactcagcagcccgggacccccttccacagtcccagccaaactctgcgtcgttctgctggtcagcggcctgctggcgtgccagtgcctgctgatgtgctcctctggacgtccagccgcctgtgtgttcctccactgatgtgctcctctccatgtccggctacctgtgtgtctgcctgctaaggtatgaaatctaaggatgccccctctctggagctgcctgcctgtgtttgaatcctgaagatcgtgatgcgtgagttaatccgtgctaagaactcggaacagtcagcacctcatctatgggcactttaccaaagcgggtgaaaattgtggaagttggtccccgagatggactacaaaatgaaaagaatatcgtatctactccagtgaaaatcaagctgatagacatgctttctgaagcaggactctctgttatagaaaccaccagctttgtgtctcctaagtgggttccccagatgggtgaccacactgaagtcttgaagggcattcagaagtttcctggcatcaactacccagtcctgaccccaaatttgaaaggcttcgaggcagcggttgctgctggagccaaggaagtagtcatctttggagctgcctcagagctcttcaccaagaagaacatcaattgttccatagaggagagttttcagaggtttgacgcaatcctgaaggcagcgcagtcagccaatatttctgtgcgggggtacgtctcctgtgctcttggctgcccttatgaagggaagatctccccagctaaagtagctgaggtcaccaagaagttctactcaatgggctgctacgagatctccctgggggacaccattggtgtgggcaccccagggatcatgaaagacatgctatctgctgtcatgcaggaagtgcctctggctgccctggctgtccactgccatgacacctatggtcaagccctggccaacaccttgatggccctgcagatgggagtgagtgtcgtggactcttctgtggcaggacttggaggctgtccctacgcacagggggcatcaggaaacttggccacagaagacctggtctacatgctagagggcttgggcattcacacgggtgtgaatctccagaagcttctggaagctggaaactttatctgtcaagccctgaacagaaaaactagctccaaagtggctcaggctacctgtaaactctgagccccttgcccacctgaagccctggggatgatgtggaaataggggcacacacagatgattcatggatggggacatggaaatgagaataggttaaatggtgcaggtacctcatagccagctctacacagaggtctctcctggcagaaagcaggcgaagggcaggaggagctgcttggcagaaggacctcctgcccagacctgaggagtgagaggctttgagggctgaagtctccctttgttacggaccctggcccaggagttgaatgcctgaggacgtgtgggaaccccgttccctacttagcatgatccttgagtctcctctctggatggaatccgcgagctggccacctggccaccctctacacggctccaccctgccatggccgtggggcccttgctctctgacttctcaggacacaggtcatggaggttcttcccaagctggcagaggccatttgtggaaagtggagagctacgtggtggccgtctgccaactccagcatctctggaaaatctccacgctgaatgtgatttttgaaaacagcttatgtaattaaaggttgaatggcacatcat

SEQ ID NO: 102727 - DNA, 1600 bp, Homo sapiens
  Payload ID: 38
  Gene Symbol: HMGCL
  Gene Name: 3-hydroxymethyl-3-methylglutaryl-CoA lyase
  Uniprot ID: P35914
  ENST ID: ENST00000374490
  CDS Start-End: 45-1022
cacgcggggcccagctggactgccgcgggggattctgggccaagatggcagcaatgaggaaggcgcttccgcggcgactggtgggcttggcgtccctccgggctgtcagcacctcatctatgggcactttaccaaagcgggtgaaaattgtggaagttggtccccgagatggactacaaaatgaaaagaatatcgtatctactccagtgaaaatcaagctgatagacatgctttctgaagcaggactctctgttatagaaaccaccagctttgtgtctcctaagtgggttccccagatgggtgaccacactgaagtcttgaagggcattcagaagtttcctggcatcaactacccagtcctgaccccaaatttgaaaggcttcgaggcagcggttgctgctggagccaaggaagtagtcatctttggagctgcctcagagctcttcaccaagaagaacatcaattgttccatagaggagagttttcagaggtttgacgcaatcctgaaggcagcgcagtcagccaatatttctgtgcgggggtacgtctcctgtgctcttggctgcccttatgaagggaagatctccccagctaaagtagctgaggtcaccaagaagttctactcaatgggctgctacgagatctccctgggggacaccattggtgtgggcaccccagggatcatgaaagacatgctatctgctgtcatgcaggaagtgcctctggctgccctggctgtccactgccatgacacctatggtcaagccctggccaacaccttgatggccctgcagatgggagtgagtgtcgtggactcttctgtggcaggacttggaggctgtccctacgcacagggggcatcaggaaacttggccacagaagacctggtctacatgctagagggcttgggcattcacacgggtgtgaatctccagaagcttctggaagctggaaactttatctgtcaagccctgaacagaaaaactagctccaaagtggctcaggctacctgtaaactctgagccccttgcccacctgaagccctggggatgatgtggaaataggggcacacacagatgattcatggatggggacatggaaatgagaataggttaaatggtgcaggtacctcatagccagctctacacagaggtctctcctggcagaaagcaggcgaagggcaggaggagctgcttggcagaaggacctcctgcccagacctgaggagtgagaggctttgagggctgaagtctccctttgttacggaccctggcccaggagttgaatgcctgaggacgtgtgggaaccccgttccctacttagcatgatccttgagtctcctctctggatggaatccgcgagctggccacctggccaccctctacacggctccaccctgccatggccgtggggcccttgctctctgacttctcaggacacaggtcatggaggttcttcccaagctggcagaggccatttgtggaaagtggagagctacgtggtggccgtctgccaactccagcatctctggaaaatctccacgctgaatgtgatttttgaaaacagcttatgtaattaaaggttgaatggcacatcataa

SEQ ID NO: 102728 - DNA, 1354 bp, Homo sapiens
  Payload ID: 38
  Gene Symbol: HMGCL
  Gene Name: 3-hydroxymethyl-3-methylglutaryl-CoA lyase
  Uniprot ID: P35914
  ENST ID: ENST00000436439
  CDS Start-End: 14-778
attctgggccaagatggcagcaatgaggaaggcgcttccgcggcgactggtgggcttggcgtccctccgggctgtcagcacctcatctatgggcactttaccaaagcgggtgaaaattgtggaagttggtccccgagatggactacaaaatgaaaagaatatcgtatctactccagtgaaaatcaagctgatagacatgctttctgaagcaggactctctgttatagaaaccaccagctttgtgtctcctaagtgggttccccagatgggtgaccacactgaagtcttgaagggcattcagaagtttcctggcatcaactacccagtcctgaccccaaatttgaaaggcttcgaggcagcggtcaccaagaagttctactcaatgggctgctacgagatctccctgggggacaccattggtgtgggcaccccagggatcatgaaagacatgctatctgctgtcatgcaggaagtgcctctggctgccctggctgtccactgccatgacacctatggtcaagccctggccaacaccttgatggccctgcagatgggagtgagtgtcgtggactcttctgtggcaggacttggaggctgtccctacgcacagggggcatcaggaaacttggccacagaagacctggtctacatgctagagggcttgggcattcacacgggtgtgaatctccagaagcttctggaagctggaaactttatctgtcaagccctgaacagaaaaactagctccaaagtggctcaggctacctgtaaactctgagccccttgcccacctgaagccctggggatgatgtggaaataggggcacacacagatgattcatggatggggacatggaaatgagaataggttaaatggtgcaggtacctcatagccagctctacacagaggtctctcctggcagaaagcaggcgaagggcaggaggagctgcttggcagaaggacctcctgcccagacctgaggagtgagaggctttgagggctgaagtctccctttgttacggaccctggcccaggagttgaatgcctgaggacgtgtgggaaccccgttccctacttagcatgatccttgagtctcctctctggatggaatccgcgagctggccacctggccaccctctacacggctccaccctgccatggccgtggggcccttgctctctgacttctcaggacacaggtcatggaggttcttcccaagctggcagaggccatttgtggaaagtggagagctacgtggtggccgtctgccaactccagcatctctggaaaatctccacgctgaatgtgatttttgaaaacagcttatgtaattaaaggttgaatggcacatcat

SEQ ID NO: 102729 - DNA, 2475 bp, Homo sapiens
  Payload ID: 39
  Gene Symbol: HMGCLL1
  Gene Name: 3-hydroxymethyl-3-methylglutaryl-CoA lyase-like 1
  Uniprot ID: Q8TB92
  ENST ID: ENST00000274901
  CDS Start-End: 160-1182
cctctcggcgccgccgcagtgcgcagaacagctctggtcctcacagccagtgcaccggaggggcgcgctcccgagctggcgcagtttcccagcgcggtgcccgcccctcatcctcctccagtctccctcccctcgccgactgccgccccaggctccgccatggggaatgtgccatccgcggtgaagcactgcctcagctaccagcagcttctccgggagcatctctggatcggggattcagtggcaggggcgctcgaccccgcgcaggaaacatcccagttatctggactccctgagtttgttaaaatagtagaagttgggcctagggatggattgcagaatgaaaaggttatagttcctacagatataaaaattgaatttatcaatcgactttcccaaactggcttgtctgtaatagaagtgactagctttgtgtcttccagatgggtaccacagatggctgatcacactgaagtaatgaaaggcattcatcaatatccaggagttcgctatcctgtccttactcctaatcttcagggttttcaccatgctgttgctgctggagctactgagatatcagtttttggagctgcatctgaatcctttagcaagaagaatattaactgttccattgaagaaagtatgggaaaatttgaggaggttgttaagtctgcaagacacatgaatattccagcacgagggtatgtgtcttgtgctctgggctgtccatatgaaggaagtattacaccgcaaaaagtgacagaagtgtctaagagattgtacggcatgggttgttatgagatctctctaggagacacaattggagtgggaactccaggaagtatgaaaagaatgttggaaagtgtgatgaaagaaatcccaccaggtgctcttgctgttcactgtcatgacacatacggacaagccttagcaaatatccttacggcccttcagatgggaattaatgtggtggactccgcagtatccggattaggtggctgcccttatgcaaaaggtgcttctgggaatgtagccactgaggatttgatatatatgcttaatggcctggggctcaatacaggtgtgaatctatacaaagtgatggaagctggtgactttatttgcaaagctgtgaataaaaccacaaactctaaagtagcacaagcctccttcaatgcttgacttgaatggatttatgacgtaccgttgagaagatcaatttcagctacaatactcatctgaaaatcattaatgccaacttgctctgatatgtgaagtaatggacaagagtgggaaaaaagagatccttttcaaaaagattataactggatagattaagtcaacaaaatgcaatatcagtcatcaggtaaattgcaagctgaggataaataataaaacttgtcataattttgaacttggaaaaaagtttcttttgctctcatagaaataactttttaatttagtagatgggaaaattgacttcgtatttccccaagtatcaaatactgtgttaatacttaatcaagcaggcttaacactgtgtacatattgtcagtagtttatgagctcctgcatagtatgcagagtgtgtggcctcaatattatacattatgcctctggatctcaactactcatttgccaagtcagttatgttatggaccaaaagccaaatctccatctgaccctacataattttagcaatagaacttttatatttcaagtatggctaacatctgttaactatttcagtgactttatctggttccaagaggctgtggccaatggcaagatgccatatcctggaaacatattacgacctcccatgtttgttacatgcatccagtttaccacactttacctgtcatcagttatagtaaaaaccagcatggtgttactcaactattgagaaattgtaagctatttttttttgtcctgatgtctaaattgcagtgataagaataggttgatacatgtatcataatctacctttataattttcagatcactttcaaattgcccaaggaaatattgtgatcctaagaatattaagataattttaggttaatgaaatacccattttccttttattcatggtgctttgcttacccacattattttttggtgtattttttagtggttattttagaagttgaagtggctgaaattttgtctattgtcttagaattgattgccagaaattgcaagatgtaatatatcaaagtcagggatgaggagcaggaggactattcaagataaacttctgtaacctatgcatattttatgggggcagtattattacaaatggatctgaaatgtcagttctagtatttagagagacttctctaataataccgggtgatattatctttgagtaaatttgaatataaattgaaacataaaaatgagtattgtgaactttctaggaaatattcattaaaaccattgaaataaaaataaattcaagaaagtaagaag

SEQ ID NO: 102730 - DNA, 1314 bp, Homo sapiens
  Payload ID: 39
  Gene Symbol: HMGCLL1
  Gene Name: 3-hydroxymethyl-3-methylglutaryl-CoA lyase-like 1
  Uniprot ID: Q8TB92
  ENST ID: ENST00000308161
  CDS Start-End: 126-1052
tggtcctcacagccagtgcaccggaggggcgcgctcccgagctggcgcagtttcccagcgcggtgcccgcccctcatcctcctccagtctccctcccctcgccgactgccgccccaggctccgccatggggaatgtgccatccgcggtgaagcactgcctcagctaccagcagcttctccgggagcatctctggatcggggattcagtggcaggggcgctcgaccccgcgcaggaaacatcccagttatctggactccctgagtttgttaaaatagtagaagttgggcctagggatggattgcagaatgaaaaggttatagttcctacagatataaaaattgaatttatcaatcgactttcccaaactggcttgtctgtaatagaagtgactagctttgtgtcttccagatgggtaccacaggttgctgctggagctactgagatatcagtttttggagctgcatctgaatcctttagcaagaagaatattaactgttccattgaagaaagtatgggaaaatttgaggaggttgttaagtctgcaagacacatgaatattccagcacgagggtatgtgtcttgtgctctgggctgtccatatgaaggaagtattacaccgcaaaaagtgacagaagtgtctaagagattgtacggcatgggttgttatgagatctctctaggagacacaattggagtgggaactccaggaagtatgaaaagaatgttggaaagtgtgatgaaagaaatcccaccaggtgctcttgctgttcactgtcatgacacatacggacaagccttagcaaatatccttacggcccttcagatgggaattaatgtggtggactccgcagtatccggattaggtggctgcccttatgcaaaaggtgcttctgggaatgtagccactgaggatttgatatatatgcttaatggcctggggctcaatacaggtgtgaatctatacaaagtgatggaagctggtgactttatttgcaaagctgtgaataaaaccacaaactctaaagtagcacaagcctccttcaatgcttgacttgaatggatttatgacgtaccgttgagaagatcaatttcagctacaatactcatctgaaaatcattaatgccaacttgctctgatatgtgaagtaatggacaagagtgggaaaaaagagatccttttcaaaaagattataactggatagattaagtcaacaaaatgcaatatcagtcatcaggtaaattgcaagctgaggataaataataaaacttgtcataattttgaacttggaaaaaagtttcttttgctctcatag

SEQ ID NO: 102731 - DNA, 1171 bp, Homo sapiens
  Payload ID: 39
  Gene Symbol: HMGCLL1
  Gene Name: 3-hydroxymethyl-3-methylglutaryl-CoA lyase-like 1
  ENST ID: ENST00000370850
  CDS Start-End: 112-825
agtgcaccggaggggcgcgctcccgagctggcgcagtttcccagcgcggtgcccgcccctcatcctcctccagtctccctcccctcgccgactgccgccccaggctccgccatggggaatgtgccatccgcggtgaagcactgcctcagctaccagcagcttctccgggagcatctctggatcggggattcagtggcaggggcgctcgaccccgcgcaggaaacatcccagttatctggactccctgagtttgttaaaatagtagaagttgggcctagggatggattgcagaatgaaaaggttatagttcctacagatataaaaattgaatttatcaatcgactttcccaaactggcttgtctgtaatagaagtgactagctttgtgtcttccagatgggtaccacaggtgtctaagagattgtacggcatgggttgttatgagatctctctaggagacacaattggagtgggaactccaggaagtatgaaaagaatgttggaaagtgtgatgaaagaaatcccaccaggtgctcttgctgttcactgtcatgacacatacggacaagccttagcaaatatccttacggcccttcagatgggaattaatgtggtggactccgcagtatccggattaggtggctgcccttatgcaaaaggtgcttctgggaatgtagccactgaggatttgatatatatgcttaatggcctggggctcaatacaggtgtgaatctatacaaagtgatggaagctggtgactttatttgcaaagctgtgaataaaaccacaaactctaaagtagcacaagcctccttcaatgcttgacttgaatggatttatgacgtaccgttgagaagatcaatttcagctacaatactcatctgaaaatcattaatgccaacttgctctgatatgtgaagtaatggacaagagtgggaaaaaagagatccttttcaaaaagattataactggatagattaagtcaacaaaatgcaatatcagtcatcaggtaaattgcaagctgaggataaataataaaacttgtcataattttgaacttggaaaaaagtttcttttgctctcatagaaataactttttaatttagtagatgggaaaattgacttcgtatttccccaagtatcaaatactgtgttaatacttaatcaagca

SEQ ID NO: 102732 - DNA, 2445 bp, Homo sapiens
  Payload ID: 39
  Gene Symbol: HMGCLL1
  Gene Name: 3-hydroxymethyl-3-methylglutaryl-CoA lyase-like 1
  Uniprot ID: Q8TB92
  ENST ID: ENST00000370852
  CDS Start-End: 45-206
ctccagtctccctcccctcgccgactgccgccccaggctccgccatggggaatgtgccatccgcggtgaagcactgcctcagctaccagcagcttctccgggagcatctctggatcggggattcagtggcaggggcgctcgaccccgcgcaggagcttcagtctgtgatgctgatgctgcaccatggacctctcaggaagccctgatccccatcatatttgagggcacctctccctcttttactaaaggaaacatcccagttatctggactccctgagtttgttaaaatagtagaagttgggcctagggatggattgcagaatgaaaaggttatagttcctacagatataaaaattgaatttatcaatcgactttcccaaactggcttgtctgtaatagaagtgactagctttgtgtcttccagatgggtaccacagatggctgatcacactgaagtaatgaaaggcattcatcaatatccaggagttcgctatcctgtccttactcctaatcttcagggttttcaccatgctgttgctgctggagctactgagatatcagtttttggagctgcatctgaatcctttagcaagaagaatattaactgttccattgaagaaagtatgggaaaatttgaggaggttgttaagtctgcaagacacatgaatattccagcacgagggtatgtgtcttgtgctctgggctgtccatatgaaggaagtattacaccgcaaaaagtgacagaagtgtctaagagattgtacggcatgggttgttatgagatctctctaggagacacaattggagtgggaactccaggaagtatgaaaagaatgttggaaagtgtgatgaaagaaatcccaccaggtgctcttgctgttcactgtcatgacacatacggacaagccttagcaaatatccttacggcccttcagatgggaattaatgtggtggactccgcagtatccggattaggtggctgcccttatgcaaaaggtgcttctgggaatgtagccactgaggatttgatatatatgcttaatggcctggggctcaatacaggtgtgaatctatacaaagtgatggaagctggtgactttatttgcaaagctgtgaataaaaccacaaactctaaagtagcacaagcctccttcaatgcttgacttgaatggatttatgacgtaccgttgagaagatcaatttcagctacaatactcatctgaaaatcattaatgccaacttgctctgatatgtgaagtaatggacaagagtgggaaaaaagagatccttttcaaaaagattataactggatagattaagtcaacaaaatgcaatatcagtcatcaggtaaattgcaagctgaggataaataataaaacttgtcataattttgaacttggaaaaaagtttcttttgctctcatagaaataactttttaatttagtagatgggaaaattgacttcgtatttccccaagtatcaaatactgtgttaatacttaatcaagcaggcttaacactgtgtacatattgtcagtagtttatgagctcctgcatagtatgcagagtgtgtggcctcaatattatacattatgcctctggatctcaactactcatttgccaagtcagttatgttatggaccaaaagccaaatctccatctgaccctacataattttagcaatagaacttttatatttcaagtatggctaacatctgttaactatttcagtgactttatctggttccaagaggctgtggccaatggcaagatgccatatcctggaaacatattacgacctcccatgtttgttacatgcatccagtttaccacactttacctgtcatcagttatagtaaaaaccagcatggtgttactcaactattgagaaattgtaagctatttttttttgtcctgatgtctaaattgcagtgataagaataggttgatacatgtatcataatctacctttataattttcagatcactttcaaattgcccaaggaaatattgtgatcctaagaatattaagataattttaggttaatgaaatacccattttccttttattcatggtgctttgcttacccacattattttttggtgtattttttagtggttattttagaagttgaagtggctgaaattttgtctattgtcttagaattgattgccagaaattgcaagatgtaatatatcaaagtcagggatgaggagcaggaggactattcaagataaacttctgtaacctatgcatattttatgggggcagtattattacaaatggatctgaaatgtcagttctagtatttagagagacttctctaataataccgggtgatattatctttgagtaaatttgaatataaattgaaacataaaaatgagtattgtgaactttctaggaaatattcattaaaaccattgaaataaaaataaattcaag

SEQ ID NO: 102733 - DNA, 2532 bp, Homo sapiens
  Payload ID: 39
  Gene Symbol: HMGCLL1
  Gene Name: 3-hydroxymethyl-3-methylglutaryl-CoA lyase-like 1
  Uniprot ID: Q8TB92
  ENST ID: ENST00000398661
  CDS Start-End: 133-1245
acagctctggtcctcacagccagtgcaccggaggggcgcgctcccgagctggcgcagtttcccagcgcggtgcccgcccctcatcctcctccagtctccctcccctcgccgactgccgccccaggctccgccatggggaatgtgccatccgcggtgaagcactgcctcagctaccagcagcttctccgggagcatctctggatcggggattcagtggcaggggcgctcgaccccgcgcagacttctcttctaacaaaccttcactgctttcagcccgatgtctctggcttctcagtctccttggcaggcacggtggcttgtatccactgggaaacatcccagttatctggactccctgagtttgttaaaatagtagaagttgggcctagggatggattgcagaatgaaaaggttatagttcctacagatataaaaattgaatttatcaatcgactttcccaaactggcttgtctgtaatagaagtgactagctttgtgtcttccagatgggtaccacagatggctgatcacactgaagtaatgaaaggcattcatcaatatccaggagttcgctatcctgtccttactcctaatcttcagggttttcaccatgctgttgctgctggagctactgagatatcagtttttggagctgcatctgaatcctttagcaagaagaatattaactgttccattgaagaaagtatgggaaaatttgaggaggttgttaagtctgcaagacacatgaatattccagcacgagggtatgtgtcttgtgctctgggctgtccatatgaaggaagtattacaccgcaaaaagtgacagaagtgtctaagagattgtacggcatgggttgttatgagatctctctaggagacacaattggagtgggaactccaggaagtatgaaaagaatgttggaaagtgtgatgaaagaaatcccaccaggtgctcttgctgttcactgtcatgacacatacggacaagccttagcaaatatccttacggcccttcagatgggaattaatgtggtggactccgcagtatccggattaggtggctgcccttatgcaaaaggtgcttctgggaatgtagccactgaggatttgatatatatgcttaatggcctggggctcaatacaggtgtgaatctatacaaagtgatggaagctggtgactttatttgcaaagctgtgaataaaaccacaaactctaaagtagcacaagcctccttcaatgcttgacttgaatggatttatgacgtaccgttgagaagatcaatttcagctacaatactcatctgaaaatcattaatgccaacttgctctgatatgtgaagtaatggacaagagtgggaaaaaagagatccttttcaaaaagattataactggatagattaagtcaacaaaatgcaatatcagtcatcaggtaaattgcaagctgaggataaataataaaacttgtcataattttgaacttggaaaaaagtttcttttgctctcatagaaataactttttaatttagtagatgggaaaattgacttcgtatttccccaagtatcaaatactgtgttaatacttaatcaagcaggcttaacactgtgtacatattgtcagtagtttatgagctcctgcatagtatgcagagtgtgtggcctcaatattatacattatgcctctggatctcaactactcatttgccaagtcagttatgttatggaccaaaagccaaatctccatctgaccctacataattttagcaatagaacttttatatttcaagtatggctaacatctgttaactatttcagtgactttatctggttccaagaggctgtggccaatggcaagatgccatatcctggaaacatattacgacctcccatgtttgttacatgcatccagtttaccacactttacctgtcatcagttatagtaaaaaccagcatggtgttactcaactattgagaaattgtaagctatttttttttgtcctgatgtctaaattgcagtgataagaataggttgatacatgtatcataatctacctttataattttcagatcactttcaaattgcccaaggaaatattgtgatcctaagaatattaagataattttaggttaatgaaatacccattttccttttattcatggtgctttgcttacccacattattttttggtgtattttttagtggttattttagaagttgaagtggctgaaattttgtctattgtcttagaattgattgccagaaattgcaagatgtaatatatcaaagtcagggatgaggagcaggaggactattcaagataaacttctgtaacctatgcatattttatgggggcagtattattacaaatggatctgaaatgtcagttctagtatttagagagacttctctaataataccgggtgatattatctttgagtaaatttgaatataaattgaaacataaaaatgagtattgtgaactttctaggaaatattcattaaaaccattgaaataaaaataaattcaagaaagt

SEQ ID NO: 102734 - DNA, 2437 bp, Homo sapiens
  Payload ID: 39
  Gene Symbol: HMGCLL1
  Gene Name: 3-hydroxymethyl-3-methylglutaryl-CoA lyase-like 1
  ENST ID: ENST00000428842
  CDS Start-End: 19-474
gccgccccaggctccgccatggggaatgtgccatccgcggtgaagcactgcctcagctaccagcagcttctccgggagcatctctggatcggggattcagtggcaggggcgctcgaccccgcgcaggaaacatcccagttatctggactccctgagtttgttaaaatagtagaagttgggcctagggatggattgcagaatgaaaaggttatagttcctacagatataaaaattgaatttatcaatcgactttcccaaactggcttgtctgtaatagaagtgactagctttgtgtcttccagatgggtaccacaggttgctgctggagctactgagatatcagtttttggagctgcatctgaatcctttagcaagaagaatattaactgttccattgaagaaagtatgggaaaatttgaggaggttgttaagtctgcaagacacatgaatattccagcacgagggtacttatgaaatcccacaaattctgttttgttaatgtttattgttaaagcttactcaaaaattatctagagattcttatatcatttataaaaatatacatagaatatcatatttctattttgtttaatcagggtaatcactatatagttacatctcattaacatcactgctgattattagtgagtatctagcttgtggaatgtgtcatgcagttgaaatcagaggaactagcatgcaaatctggcattattaactattttattaacactctagcacccaaatgcagccctcttatctcagcctacatgtgctgataagttggtataaactcacaacagcttttggaaaagaatcacctaatgtggttttcaaattttttttaaaacatgactttttcttcaaagagtattttatgtagaacttcaatagaatacagcagatataaaattgagctgctctgggaaatcattttatccattctttctccccctcaatggctgacttttctacttcctctgggtgatcccaaatcacctccatagtatcttgcagaacactgtttaaaaatacttgataaattgcttatagaagataaatataaactttcagttctctactattttctattatatgtgatttctataaatttaggagtatcagagatatcaatccctttctcctcgccttgcctttttcttgtggaaacttatcagctgttcattctaagagatgttgattacaggacatggaaaataaaaactgacccaagatccacaaacctaattttctctctcaggagtttagaaatggtataccaaacatggttacttgtattgaaagattatgtgattttgtcactgagttcactattttggggttcctaggatggagccacatgcaaaccagtgacaggacagagtagtagaaagcagaaatggaaaaaggaggctcctagcggtgatgagaggtatgggggagggaggagagggaaaaatctgccttggtgcttgtctgcttccaggaccaatagttgcctcaagtattataaccaggcctatgggttgtgaaacctataatgcatttttgtgtgtgtttgtttcttaaggaagaatttgtttctaagacattagctactttttctattaattttataaatatggagatatgatgaacacacatcgtaacaagttaaagtgcatagcgattggtaatagaaggttgaaagctggggatggatttgggtgcaggctgtacttcccttagttgaggtgagcaaagttcatggtagcgggaaagattcaacagttaatgagaaagataagtgagtcaattgtgactgaaaatattagtgaaatgattggaatttcaatcaaggtgttttgggggaacaattagagttagactatacctagtaaaatattttgttagtttgttttctatttatatttttcctgtcctccatagtaagtctacatgagtttctaaaatttgaaattacttttgtaattaagatagatgcatatcatgtaaggactatatgagaaaaatttaaaatccaaggcaatgtacttccaaagacataaaataaaggatatttatttttcaggcaaaagttacaaaaccacaatcaaaaaggagagatatactattggtttctcaattcgaatataaataagttgtctcaattttctttaaaataaagagaaagatgaagaccctattctacttcaatatgtgtttaaagtgtggagtataagctttaaagtaattctcattggaaagttaaaaagtatgtgactataagaagtaaattgcttatgtagcttgctcttcaaataggaagggtttttttagtgttgaaagatggatgcaaatataagttgtaggaagtaaccttttattatcttagctttctgttgtaaaatggaatagttaatgtaactgggctaataaaaatcttaaaccctcttaa

SEQ ID NO: 102735 - DNA, 884 bp, Homo sapiens
  Payload ID: 39
  Gene Symbol: HMGCLL1
  Gene Name: 3-hydroxymethyl-3-methylglutaryl-CoA lyase-like 1
  ENST ID: ENST00000508459
  CDS Start-End: 51-575
atcctcctccagtctccctcccctcgccgactgccgccccaggctccgccatggggaatgtgccatccgcggtgaagcactgcctcagctaccagcagcttctccgggagcatctctggatcggggattcagtggcaggggcgctcgaccccgcgcaggaaacatcccagttatctggactccctgagtttgttaaaatagtagaagttgggcctagggatggattgcagaatgaaaaggttatagttcctacagatataaaaattgaatttatcaatcgactttcccaaactggcttgtctgtaatagaagtgactagctttgtgtcttccagatgggtaccacagatgggaattaatgtggtggactccgcagtatccggattaggtggctgcccttatgcaaaaggtgcttctgggaatgtagccactgaggatttgatatatatgcttaatggcctggggctcaatacaggtgtgaatctatacaaagtgatggaagctggtgactttatttgcaaagctgtgaataaaaccacaaactctaaagtagcacaagcctccttcaatgcttgacttgaatggatttatgacgtaccgttgagaagatcaatttcagctacaatactcatctgaaaatcattaatgccaacttgctctgatatgtgaagtaatggacaagagtgggaaaaaagagatccttttcaaaaagattataactggatagattaagtcaacaaaatgcaatatcagtcatcaggtaaattgcaagctgaggataaataataaaacttgtcataattttgaacttggaaaaaagtttcttttgctctcatagaaataactttttaatttagtagatgggaaaattgacttcgtatttcc

SEQ ID NO: 102736 - DNA, 569 bp, Homo sapiens
  Payload ID: 39
  Gene Symbol: HMGCLL1
  Gene Name: 3-hydroxymethyl-3-methylglutaryl-CoA lyase-like 1
  ENST ID: ENST00000515546
  CDS Start-End: 112-231
agtgcaccggaggggcgcgctcccgagctggcgcagtttcccagcgcggtgcccgcccctcatcctcctccagtctccctcccctcgccgactgccgccccaggctccgccatggggaatgtgccatccgcggtgaagcactgcctcagctaccagcagcttctccgggagcatctctggatcggggattcagtggcaggggcgctcgaccccgcgcaggagaaggagtagaaacattgaaggatgtaatgatcccctcagggttaagcagcttctctgttgcaatgtctaagctatggtctccggtttaggattcagtgttcgggctcttttttccaccaatagaaacatcccagttatctggactccctgagtttgttaaaatagtagaagttgggcctagggatggattgcagaatgaaaaggttatagttcctacagatataaaaattgaatttatcaatcgactttcccaaactggcttgtctgtaatagaagtgactagctttgtgtcttccagatgggtaccacagatggctgatcacactgaagtaatgaaaggcattcat

SEQ ID NO: 102737 - DNA, 1024 bp, Homo sapiens
  Payload ID: 40
  Gene Symbol: KDSR
  Gene Name: 3-ketodihydrosphingosine reductase
  Uniprot ID: Q06136
  ENST ID: ENST00000326575
  CDS Start-End: 87-893
gattctcgcctcgccgcagcccagccctgcgcgccttgcccggcggcccccgcccggccgctccgggcccctggccccgcggagcgatgctgctgctggctgccgccttcctcgtggccttcgtgctgctgctgtacatggtgtctccgctcatcagccccaagcccctcgccctgcccggggcgcatgtggtggttacaggaggttccagtggcatcgggaagtgcattgctatcgagtgctataaacaaggagcttttataactctggttgcacgaaatgaggataagctgctgcaggcaaagaaagaaattgaaatgcactctattaatgacaaacaggtggtgctttgcatatcagttgatgtatctcaagactataaccaagtagagaatgtcataaaacaagcacaggagaaactgggtccagtggacatgctggtaaattgtgcaggaatggcagtgtcaggaaaatttgaagatcttgaagttagtacctttgaagtgaagccatataatgtctacatcacagttgcttacccaccagacacagacacacctggctttgccgaagaaaacagaacaaagcctttggagactcgacttatttcagagaccacatctgtgtgcaaaccagaacaggtggccaaacaaattgttaaagatgccatacaaggaaatttcaacagttcccttggctcagatgggtacatgctctcggccctgacctgtgggatggctccagtaacttctattactgaggggctccagcaggtggtcaccatgggccttttccgcactattgctttgttttaccttggaagttttgacagcatagttcgtcgctgcatgatgcagagagaaaaatctgaaaatgcagacaaaactgcctaatcttcttaccccttggaagaagactgtttccaaataatttgaacagcttgctgctaaatgggacccaatttttggcctatagacacttatgtattgttttcgaatacgtcagattggaccagtgctcttca

SEQ ID NO: 102738 - DNA, 5447 bp, Homo sapiens
  Payload ID: 40
  Gene Symbol: KDSR
  Gene Name: 3-ketodihydrosphingosine reductase
  Uniprot ID: Q06136
  ENST ID: ENST00000406396
  CDS Start-End: 393-1391
ggcgcgctcgcatctggcgctgtccggagcccgctcgcgacgcacagggacgggaggcccggtttccacgggagaggctgcggactgcgggccccgtcccgaggccgggggagtgggagacacccggcgacccccgagaggcgattctggcagtggtggcggtggcggtggcggtggcggcctactcgccccctggaagcaccgccccgcctgggtggcgcgcgcgccggctcctcctcttcccctccgccgcggcccgccccggcccgcaaacccaaacactccaggcgcccgcccgccgcgcgtgattctcgcctcgccgcagcccagccctgcgcgccttgcccggcggcccccgcccggccgctccgggcccctggccccgcggagcgatgctgctgctggctgccgccttcctcgtggccttcgtgctgctgctgtacatggtgtctccgctcatcagccccaagcccctcgccctgcccggggcgcatgtggtggttacaggaggttccagtggcatcgggaagtgcattgctatcgagtgctataaacaaggagcttttataactctggttgcacgaaatgaggataagctgctgcaggcaaagaaagaaattgaaatgcactctattaatgacaaacaggtggtgctttgcatatcagttgatgtatctcaagactataaccaagtagagaatgtcataaaacaagcacaggagaaactgggtccagtggacatgctggtaaattgtgcaggaatggcagtgtcaggaaaatttgaagatcttgaagttagtacctttgaaaggttaatgagcatcaattacctgggcagcgtgtaccccagccgggccgtgatcaccaccatgaaggagcgccgggtgggcaggatcgtgtttgtgtcctcccaggcaggacagttgggattattcggtttcacagcctactctgcatccaagtttgccataaggggattggcagaagctttgcagatggaggtgaagccatataatgtctacatcacagttgcttacccaccagacacagacacacctggctttgccgaagaaaacagaacaaagcctttggagactcgacttatttcagagaccacatctgtgtgcaaaccagaacaggtggccaaacaaattgttaaagatgccatacaaggaaatttcaacagttcccttggctcagatgggtacatgctctcggccctgacctgtgggatggctccagtaacttctattactgaggggctccagcaggtggtcaccatgggccttttccgcactattgctttgttttaccttggaagttttgacagcatagttcgtcgctgcatgatgcagagagaaaaatctgaaaatgcagacaaaactgcctaatcttcttaccccttggaagaagactgtttccaaataatttgaacagcttgctgctaaatgggacccaatttttggcctatagacacttatgtattgttttcgaatacgtcagattggaccagtgctcttcaggaatgtggctgcaagcaaggggctagaagttcacctcctgacagtattattaatactatgcaaatatggaataggagaccatttgattttctaggctttgtggtagagaggtgaaggtatgagaattaatagcgtgtgaacaaagtaaagaacaggattccagaatgatcattaaatttgtttctatttattcttttttgcccccctagagattaagtccagaaatgtactttctggcacataaagaaatcttgaggactttgtttaaaccttccataaaaaaacaattttcggtttctcgggttctctctctctctctctctgtctctctgtctctctgtctctctgtctctctgtctctctgtctctctctctctctctctttctttctttgtgtattttattcaagatgagttggacccattgccagtgagtctgaatgtcactgacagccctgtgttgtgctcaggactcactctgctgctggtggaaactcatggcttctctctctctttgatcccataaagctacgagggggacgggagagggcagtgcaatgggaagtaaagagatattttccagtaggaaaagcaatgctttcttgtctttagactcaaatgcttagggaacgtttcatttctcattcatggggaaaggcagcctccttaaatgttttctgaagagcggtaaaatctagaagcttaagaatttacagttccttcaataaccatgatgacctgaagttcacctatcccattttagcatctacttgtttttcccatctcttcctttccaattttgcttatactgctgtaatatttttgtaaaaaaaaaaaaaaaggaaaaaaaagaccagctaaaattttcgacttgactttttaacttaactcatgaattaattaaagcaaatgaaaaaattaaaaagtgtgactttttctcggagcatatatgtagcttttaggaaaggctgatgatggtataaagtttgctcattaagaaaaaaagacaaggctgattttgaagagagttgcttttgaaataaaatgatcacctgttctttatgtgactctcccactgaacctgcagacattatttttataccacatgctaaggaagcccactcatctaactctgtagccctggaaaccctcttggcccctgaatgttgtttccaggttataggatctgtgttcattagtggattttgacagcaagtgcctctgatgagttttagccaacattccccgttgcatcctgctcattgttcacactcctctgacttgaggagagctgccttcaccttgatcttgtaacctgtcttccttgcatatacggtagcacattccagatcacttcggtgagaaaagacctctgtttttgaagaggaaactttcttaaattgtaaaataaaacttaaaaaacataaaaactctatacaaaaattgaagacctaaaaattatagcataccttttttttgctcttgagtttttgaagctcttgactttaaatgacttaactttttaaaaaataagatgttttatggctttaacccatgtttttattaagatctgagaatagcatattttaaacactgatagatacagaagaaattattatttaatatataaattgcttggaatgatttcattgcagcttgtaaggatgggttgatgccagaatggtttcataaatctttcagtcttacagagccaaagtttgcagattatatcgagttgcgttgtgcagctgctaaaatggaatcatagctttttataatttgcagaaaacaattgcattaatgtctggatgtttctcagttttattcttttctcataaatgttcctcgaatgttggcaccttctactgctgatctatattagaatctagtccaagaaagtgtctgatttaataacattaaatagttatttcaatatattttttcaaattatcctcatagaacctgttgcctccagtgagatggtaatctactacccgaataaatttaagagcacctgttgagagcccctgttttgcggtagaagacaattgtccctatcccaatttccactgaaatatgagagcagatttgcagagaccatcatgtcagagaagaaatttccttgtcagagatgttaaagggctacagtcccttagcaaagaaacttcgaaatctaagttggtttgtgtttttctaaatttgataccgtaattcatttggcagcaaaatctgacttgaactgatgtgagagtattgtactttatatttatgctacttcattgtgacttaattttccctgaagaaatatccatggatttgattataggttttcccttagatgctgtggaggtgttttgtaatattcaaaatatgcccatattgcctttttaaaaccccaaagattatgaattctgaaacacatccagcccagcgggttttggataaggggttgtaggcatttaagcagcctcacataatgggctgacttcatccaaaacatgaaaatattacaaggcaaattctattttttatattttttggttcaatgcttgaacaacttgtttttctgctgggggaagaaaaaaagaaccaaccctgagtgtgattgttacggaaactaatgactttgtttttaaaggatcacattgattcaacaccttctattggacccagaagtgcgtaaatattacctatggtagtaaacgtttaattatcattcagtttaaatgttggccttctgtatgtagccaagaacagctcattttgtgaatttcagtttttaagtggctgctttttgatttggttgtattattttattataatgtatttgcaagtatattaaaaaattaacattgagccataaaaatccccaaatatgttcaaggacttcataattgaaaaatatatagaaaacaatccttacttctttttacaaaaacaaaatcatgggaattattcttttctatatatttagttataaatctttctctgggccgggcgtggtggctcacgccagtaatcccagcactttgggaggctgagacaggcgaatcacgaggtcaggagttcgagaccagcctggccaacatggtgaaaccccgtctctactgaaaatacaaaaaattagctggacacggtggcaggcgcctgtgtgtggcgggcgccagctactcaggaggctgaggcaggagaatcgcttgaacccaggaggcagaggttgcagtgagccaagattgcgccactgcactccagcctaggtgacagtgcgagactctgtctcaaaaaaaaaaaaaaagaaaaaaaatctttatctggatctgttaaaccatatattattgatcattgcaagtgaaattttgagagattgtttctagtatttaggtgatgaaaacatttggtaatattgctttggttcaaagaattttatgtctttatctttctagaagaaagcaattatatatatatttttgctaaattacataaacatttaattacatcaggttctaatttaaacatgtattactcacttgaggccacttttaaatattcatactctttgacataagatgctttgtatatttctcatttcttttagttcttagtaagtcagctttaaaaagtacctgccaaccagaaccttccatattctggactaaatcttgctcttcggattatacttcagtgcagtaactgtggatttgcaattttgaaggggagatagtagctattatattttacacttgcttgatgtgataactctaaagactttttaactgataaaagcgcacatggctattttgatacacaaagttgtgtttgctactttagaagcttttgtggcagaattgtaatctaattttcataccttgtatttctgaatcacaacaaaaaaataaatggggaacaagacttacagatttgcaaa

SEQ ID NO: 102739 - DNA, 553 bp, Homo sapiens
  Payload ID: 40
  Gene Symbol: KDSR
  Gene Name: 3-ketodihydrosphingosine reductase
  ENST ID: ENST00000592327
  CDS Start-End: 87-553
gattctcgcctcgccgcagcccagccctgcgcgccttgcccggcggcccccgcccggccgctccgggcccctggccccgcggagcgatgctgctgctggctgccgccttcctcgtggccttcgtgctgctgctgtacatggtgtctccgctcatcagccccaagcccctcgccctgcccggggcgcatgtggtggttacaggaggttccagtggcatcgggaagtgcattgctatcgagtgctataaacaaggagcttttataactctggttgcacgaaatgaggataagctgctgcaggcaaagaaagaaattgaaatgcactctattaatgacaaacaggtggtgctttgcatatcagttgatgtatctcaagactataaccaagtagagaatgtcataaaacaagcacaggagaaactgggtccagtggacatgctggtaaattgtgcaggaatggcagtgtcaggaaaatttgaagatcttgaaaggttaatgagcatcaattacctgggcagcgtgtaccccagccgggccgtgatcaccaccatgaa

SEQ ID NO: 102740 - DNA, 1011 bp, Homo sapiens
  Payload ID: 40
  Gene Symbol: KDSR
  Gene Name: 3-ketodihydrosphingosine reductase
  ENST ID: ENST00000591902
  CDS Start-End: 1-612
caagactataaccaagtagagaatgtcataaaacaagcacaggagaaactgggtccagtggacatgctggtaaattgtgcaggaatggcagtgtcaggaaaatttgaagatcttgaagttagtacctttgaaaggttaatgagcatcaattacctgggcagcgtgtaccccagccgggccgtgatcaccaccatgaaggagcgccgggtgggcaggatcgtgtttgtgtcctcccaggcaggacagttgggattattcggtttcacagcctactctgcatccaagtttgccataaggggattggcagaagctttgcagatggaggtgaagccatataatgtctacatcacagttgcttacccaccagacacagacacacctggctttgccgaagaaaacagaacaaagcctttggagactcgacttatttcagagaccacatctgtgtgcaaaccagaacaggtggccaaacaaattgttaaagatgccatagtggtcaccatgggccttttccgcactattgctttgttttaccttggaagttttgacagcatagttcgtcgctgcatgatgcagagagaaaaatctgaaaatgcagacaaaactgcctaatcttcttaccccttggaagaagactgtttccaaataatttgaacagcttgctgctaaatgggacccaatttttggcctatagacacttatgtattgttttcgaatacgtcagattggaccagtgctcttcaggaatgtggctgcaagcaaggggctagaagttcacctcctgacagtattattaatactatgcaaatatggaataggagaccatttgattttctaggctttgtggtagagaggtgaaggtatgagaattaatagcgtgtgaacaaagtaaagaacaggattccagaatgatcattaaatttgtttctatttattcttttttgcccccctagagattaagtccagaaatgtactttctggcacataaagaaatcttgaggactttgttta

SEQ ID NO: 102741 - DNA, 3388 bp, Homo sapiens
  Payload ID: 41
  Gene Symbol: OXCT1
  Gene Name: 3-oxoacid CoA transferase 1
  Uniprot ID: P55809
  ENST ID: ENST00000196371
  CDS Start-End: 162-1724
agcagccagcagcgcgccggtggcgtgcggctcgaaaggccgggaggacgtcatcgacgcgctgtcgagcctccagcccgcccgggtttccttcgcagtcgcgcaccgacgctcaaacgcgcgctccaacccgcagcctcctcctgcctcaccgcccgaagatggcggctctcaaactcctctcctccgggcttcggctctgcgcctctgcccgcggatctggggcaacctggtacaagggatgtgtttgttccttttccaccagtgctcatcgccataccaagttttatacagatccagtagaagctgtaaaagacatccctgatggtgccacggttttggttggtggttttgggctatgtggaattccagagaatcttatagatgctttactgaaaactggagtaaaaggactaactgcagtcagcaacaatgcaggggttgacaattttggtttggggcttttgcttcggtccaagcagataaaacgcatggtctcttcatatgtgggagaaaatgcagaatttgaacgacagtacttatctggtgaattagaagtggagctgacaccacagggcacacttgcagagaggatccgtgcaggcggggctggagttcctgcattttacaccccaacagggtatgggaccctggtacaagaaggaggatcgcccatcaaatacaacaaagatggcagtgttgccattgccagtaagccaagagaggtgagggagttcaatggtcagcactttattttggaggaagcaattacaggggattttgctttggtgaaagcctggaaggcggaccgagcaggaaacgtgattttcaggaaaagtgcaaggaatttcaacttgccaatgtgcaaagctgcagaaaccacagtggtagaggttgaagaaattgtggatattggagcatttgctccagaagacatccatattcctcagatttatgtacatcgccttataaagggagaaaaatatgagaaaagaattgagcgtttatcaatccggaaagagggagatggggaagccaaatctgctaaacctggagatgacgtaagggaacgaatcatcaagagggccgctcttgagtttgaggatggcatgtatgctaatttgggcataggaatccctctcctggccagcaattttatcagcccaaatataactgttcatcttcaaagtgaaaatggagttctgggtttgggtccatatccacgacaacatgaagctgatgcagatctcatcaatgcaggcaaggaaacagttactattcttccaggagcctcttttttctccagcgatgaatcatttgcaatgattagaggtggacacgtcgatctgacaatgctaggagcgatgcaggtttccaaatatggtgacctggctaactggatgatacctgggaagatggtgaaaggaatgggaggtgctatggatttagtgtccagtgcgaaaaccaaagtggtggtcaccatggagcattctgcaaagggaaatgcacataaaatcatggagaaatgtacattaccattgactggaaagcaatgtgtcaaccgcattattactgaaaaggctgtgtttgatgtggacaagaagaaagggttgactctgattgagctctgggaaggcctgacagtggatgacgtacagaagagtactgggtgtgattttgcagtttcaccaaaactcatgccaatgcagcagatcgcaaattgaaatatggatatttgtaccaggctgcgtgtttttcattttaaacacacaagatttaattgaaaggacatcaataatcataattgtgtatttaacaggtggttttttattagttttcttgtgtttcagactttatgcagccatataaactgttctctaggcatgctgtgacattttaataaaaagcaaaaggagcatttataattatctcatttgttaaggctgagaaggttgtttttataataggtaattatattgaatgcattttcactgaatatggtatgtatgctaaattatatgaacctttccccaagaagggccctagaaattgatgtggctttcctcttaaatattaattattagtcctgaaagaaagataacatatgtgatttttgtggttaggagagttgctgtcatgattgttttttcttcagcctcctctgacttttcttttggggcttcagattttatgattacatcttgtccccctagaacatcccccttcctcccatactgcttttaaacagatgcccaagaaggcaagcaggaatgcctcttgtgggggagggcagggagaaataactagttcaaaccaactatctatctatgctttgcaaagactaaggcgtattataggaagagggctagaaacctaactgattcttctcagttttctcattttaaaacagcccagtattcctttgtatcctcaagggtccttgagaatacttctgttattgagaccctgtgggctacttgtactgtacctcctctcaagccaagaagggctgtgggataatttaccatgaatccttagtagcaatgacagcagagttaaaaaataaaaggtgttttactttcaggctcttgttttggttcagaggagattttaaatattgaatgacacttctacagaacaacggtttttcttctgccaaggctacttcctttaacgaagtgcctttaattcagccttatccaactagggaaaataatgttggacaagtctaggatttgaagagtcagtgaacttttagtgtcagggaataaacatggtgggtagattaggtttgaaaaaaacttccttagaggtatttattctcaatacctgacaggggcccatgggaatgacttcagaagcatcccggataatagatgggtaaaaagtctaggcaccctgaagaacaggtgagacagctggcctctggacagaggtaggcatagtacagtacgatatatcattcctctggtcctaaatatacaaacttattcatgtttttaggtgatgatggtcattgaaactcacttcttttcaggtgtagctacaattgtgtaatgtacaatattagagaaaggacaggctttttatgagtaacacacaccatatataaaacagcctttctggctgaccacatggttaaatgcataccttcccagtactggggggaaaaaatgacccttcttagaatgtgcaagttccatgagagtaatatattgatatgattttgaaaagaattgttgatagttacatcttcaaacttatcattccagtatgcatctttaagataatgtgattctaagtagatgactttatattcttgattgaagagtgctatacatgttaagaaatgcattaaggaatacaataaatattctaaagtgatgta

SEQ ID NO: 102742 - DNA, 1593 bp, Homo sapiens
  Payload ID: 41
  Gene Symbol: OXCT1
  Gene Name: 3-oxoacid CoA transferase 1
  Uniprot ID: P55809
  ENST ID: ENST00000512084
  CDS Start-End: 234-605
actttctagctagtgtttgtgttcaagtagtcacattctgcctcactgaaggaaacagtcttcctgtgtacacctgttcatagtttgttattgaaacaatgtatactgtaacttttttttcaaaaagaatttttagtgattatttctctgtcagcatggagctgatctattaggaaatcagttgtgtggtgggggaagcaagtatattttggtgtggacacgtcgatctgacaatgctaggagcgatgcaggtttccaaatatggtgacctggctaactggatgatacctgggaagatggtgaaaggaatgggaggtgctatggatttagtgtccagtgcgaaaaccaaagtggtggtcaccatggagcattctgcaaagggaaatgcacataaaatcatggagaaatgtacattaccattgactggaaagcaatgtgtcaaccgcattattactgaaaaggctgtgtttgatgtggacaagaagaaagggttgactctgattgagctctgggaaggcctgacagtggatgacgtacagaagagtactgggtgtgattttgcagtttcaccaaaactcatgccaatgcagcagatcgcaaattgaaatatggatatttgtaccaggctgcgtgtttttcattttaaacacacaagatttaattgaaaggacatcaataatcataattgtgtatttaacaggtggttttttattagttttcttgtgtttcagactttatgcagccatataaactgttctctaggcatgctgtgacattttaataaaaagcaaaaggagcatttataattatctcatttgttaaggctgagaaggttgtttttataataggtaattatattgaatgcattttcactgaatatggtatgtatgctaaattatatgaacctttccccaagaagggccctagaaattgatgtggctttcctcttaaatattaattattagtcctgaaagaaagataacatatgtgatttttgtggttaggagagttgctgtcatgattgttttttcttcagcctcctctgacttttcttttggggcttcagattttatgattacatcttgtccccctagaacatcccccttcctcccatactgcttttaaacagatgcccaagaaggcaagcaggaatgcctcttgtgggggagggcagggagaaataactagttcaaaccaactatctatctatgctttgcaaagactaaggcgtattataggaagagggctagaaacctaactgattcttctcagttttctcattttaaaacagcccagtattcctttgtatcctcaagggtccttgagaatacttctgttattgagaccctgtgggctacttgtactgtacctcctctcaagccaagaagggctgtgggataatttaccatgaatccttagtagcaatgacagcagagttaaaaaataaaaggtgttttactttcaggctcttgttttggttcagaggagattttaaatattgaatgacacttctacagaacaacggtttttcttctgccaaggctacttcctttaacgaagtgcctttaattcagccttatccaactagggaaa

SEQ ID NO: 102743 - DNA, 1441 bp, Homo sapiens
  Payload ID: 41
  Gene Symbol: OXCT1
  Gene Name: 3-oxoacid CoA transferase 1
  Uniprot ID: P55809
  ENST ID: ENST00000510634
  CDS Start-End: 182-553
atttcccagccagaaaactatcaggagtttgttcggctgcagggtgtgaaattattcacatcgaatgttgggcattgaatatccagcccactgttaggaaaagaacccccaaaatggaatccatgcctttgtgccaaccatactgaaataaacatttctaagtggacacgtcgatctgacaatgctaggagcgatgcaggtttccaaatatggtgacctggctaactggatgatacctgggaagatggtgaaaggaatgggaggtgctatggatttagtgtccagtgcgaaaaccaaagtggtggtcaccatggagcattctgcaaagggaaatgcacataaaatcatggagaaatgtacattaccattgactggaaagcaatgtgtcaaccgcattattactgaaaaggctgtgtttgatgtggacaagaagaaagggttgactctgattgagctctgggaaggcctgacagtggatgacgtacagaagagtactgggtgtgattttgcagtttcaccaaaactcatgccaatgcagcagatcgcaaattgaaatatggatatttgtaccaggctgcgtgtttttcattttaaacacacaagatttaattgaaaggacatcaataatcataattgtgtatttaacaggtggttttttattagttttcttgtgtttcagactttatgcagccatataaactgttctctaggcatgctgtgacattttaataaaaagcaaaaggagcatttataattatctcatttgttaaggctgagaaggttgtttttataataggtaattatattgaatgcattttcactgaatatggtatgtatgctaaattatatgaacctttccccaagaagggccctagaaattgatgtggctttcctcttaaatattaattattagtcctgaaagaaagataacatatgtgatttttgtggttaggagagttgctgtcatgattgttttttcttcagcctcctctgacttttcttttggggcttcagattttatgattacatcttgtccccctagaacatcccccttcctcccatactgcttttaaacagatgcccaagaaggcaagcaggaatgcctcttgtgggggagggcagggagaaataactagttcaaaccaactatctatctatgctttgcaaagactaaggcgtattataggaagagggctagaaacctaactgattcttctcagttttctcattttaaaacagcccagtattcctttgtatcctcaagggtccttgagaatacttctgttattgagaccctgtgggctacttgtactgtacctcctctcaagccaagaagggctgtgggataatttaccatgaatccttagtagcaatgacagcagagttaaaaaataaaaggtgttttactttcaggctcttgttttggttcagaggagatttt

SEQ ID NO: 102744 - DNA, 1441 bp, Homo sapiens
  Payload ID: 41
  Gene Symbol: OXCT1
  Gene Name: 3-oxoacid CoA transferase 1
  ENST ID: ENST00000509987
  CDS Start-End: 78-1082
cattttgtgcagtgatggagtgtggcaatggatgcttgttttaattcccggaaataaaccgtcaagaataaaagaacatgatggtgagggagttcaatggtcagcactttattttggaggaagcaattacaggggattttgctttggtgaaagcctggaaggcggaccgagcaggaaacgtgattttcaggaaaagtgcaaggaatttcaacttgccaatgtgcaaagctgcagaaaccacagtggtagaggttgaagaaattgtggatattggagcatttgctccagaagacatccatattcctcagatttatgtacatcgccttataaagggagaaaaatatgagaaaagaattgagcgtttatcaatccggaaagagggagatggggaagccaaatctgctaaacctggagatgacgtaagggaacgaatcatcaagagggccgctcttgagtttgaggatggcatgtatgctaatttgggcataggaatccctctcctggccagcaattttatcagcccaaatataactgttcatcttcaaagtgaaaatggagttctgggtttgggtccatatccacgacaacatgaagctgatgcagatctcatcaatgcaggcaaggaaacagttactattcttccaggagcctcttttttctccagcgatgaatcatttgcaatgattagaggtggacacgtcgatctgacaatgctaggagcgatgcaggtttccaaatatggtgacctggctaactggatgatacctgggaagatggtgaaaggaatgggaggtgctatggatttagtgtccagtgcgaaaaccaaagtggtggtcaccatggagcattctgcaaagggaaatgcacataaaatcatggagaaatgtacattaccattgactggaaagcaatgtgtcaaccgcattattactgaaaaggctgtgtttgatgtggacaagaagaaagggttgactctgattgagctctgggaaggcctgacagtggatgacgtacagaagagtactgggtgtgattttgcagtttcaccaaaactcatgccaatgcagcagatcgcaaattgaaatatggatatttgtaccaggctgcgtgtttttcattttaaacacacaagatttaattgaaaggacatcaataatcataattgtgtatttaacaggtggttttttattagttttcttgtgtttcagactttatgcagccatataaactgttctctaggcatgctgtgacattttaataaaaagcaaaaggagcatttataattatctcatttgttaaggctgagaaggttgtttttataataggtaattatattgaatgcattttcactgaatatggtatgtatgctaaattatatgaacctttccccaagaagggccctagaaattgatgtggctttcctcttaaatattaattatta

SEQ ID NO: 102745 - DNA, 1826 bp, Homo sapiens
  Payload ID: 42
  Gene Symbol: OXCT2
  Gene Name: 3-oxoacid CoA transferase 2
  Uniprot ID: Q9BYC2
  ENST ID: ENST00000327582
  CDS Start-End: 94-1647
cagggcgcgggcgcccgccctgctctgtgacgcgcggcccgaggcgcacgcagggctcacaccacctgtcctggcctccgacccgggccgactatggcggcgctgcggctcctggcgtcagtgctcgggcgcggggtccccgccggcggctcagggctcgcgctgtcccagggctgcgcccgctgctttgccaccagtccccggctccgtgccaagttctacgcggacccggtggagatggtgaaggacatctctgacggggcgaccgtcatgatcgggggcttcgggctctgcgggatccccgagaacctgatcgccgcgctgctcaggacccgcgtgaaagacctgcaggtggtcagcagcaacgtgggcgtggaggacttcggcctgggcctcctgctggccgccaggcaggtccgtcgcatcgtctgttcctacgtgggcgagaacaccctgtgcgagagccagtacctggcaggagagctggagctggagctcacgccccagggcaccctggccgagcgcatccgcgcggggggcgccggggtgcccgccttctacacccccacgggctacgggaccctggtccaggaagggggcgcccccatccgctacaccccggacggccacctggcgctcatgagccagccccgagaggtgagggagttcaacggcgaccacttccttttggagcgcgccatccgggcagacttcgccctggtgaaagggtggaaggccgaccgggcaggaaacgtggtcttcaggagaagcgcccgcaatttcaacgtgcccatgtgcaaagctgcagacgtcacggcggtggaggtggaagagatcgtggaggtgggggctttccccccagaagacatccacgttcctaacatttatgtagatcgcgtgataaaggggcagaaatacgagaaacgaattgagcgcttaacgatcctgaaagaggaagatggagacgctggaaaggaagaggacgccaggacgcgcatcatcagacgcgcagctctggaatttgaggacggcatgtacgccaatctgggcataggcatccccctgctggccagcaacttcatcagtcccagcatgactgtccatcttcacagtgagaacgggatcctgggcctgggcccgtttcccacggaagatgaggtggatgccgacctcatcaatgcaggcaagcagacggtcacggtgcttcccgggggctgcttcttcgccagcgacgactccttcgccatgatccgagggggacacatccaactaaccatgcttggagccatgcaggtttccaaatacggcgacctggcgaactggatgatccctggcaagaaggtgaaaggcatgggcggtgccatggacttggtgtccagtcagaagaccagagtggtggtcaccatgcagcactgcacaaaggacaacacccccaagatcatggagaaatgcaccatgccgctgaccgggaagcggtgcgtggaccgcatcatcaccgagaaggccgtgtttgacgtgcacaggaagaaagagctgacgctgagggagctctgggagggcctgacggtggacgacatcaaaaagagcacggggtgtgcctttgctgtgtccccgaacctcaggcccatgcagcaggtggcaccctgacgggacctggatctgggcggggtggtgcgctcctcagggcgggtgccaccgggttccccaggggaatacatgtccccagctctgggaggggtttgctactggcctcctactttcctccctaggtggacagtgctcctctagagagctgcgactttaattaaaaacaacaggaaaacaga

SEQ ID NO: 102746 - DNA, 1519 bp, Homo sapiens
  Payload ID: 43
  Gene Symbol: OXSM
  Gene Name: 3-oxoacyl-ACP synthase, mitochondrial
  Uniprot ID: Q9NWU1
  ENST ID: ENST00000280701
  CDS Start-End: 100-1479
gtgcgcgtgcgctcgagagcgtcatcgcccccgactgtggagaagtgtccggggtagccccgttacaggaatgtgtttctgatcatctgaatcttaatcatgtccaactgcctgcaaaatttcctgaaaattacaagcactcgtcttctatgttcaagattatgccaacagttaagaagtaaaaggaagtttttcggaactgtgccaatatccagattgcataggcgagttgtcattacaggcattggcttagtgactcctcttggtgttggaactcacctggtttgggatcgtcttatcggaggagagagtggaattgtttcactggttggtgaagagtataagagtatcccttgcagtgttgctgcttatgtgccaagaggtagtgatgaaggtcagttcaatgaacaaaactttgtgtccaaatcagatatcaagtccatgtcttctcccaccatcatggccattggggctgcagaattagccatgaaggattctggctggcatcctcagtcagaagctgatcaagtggctactggtgttgcaattggcatgggaatgattcctcttgaagttgtttctgaaactgctttgaattttcagacaaaaggttacaataaagttagcccattttttgtccctaagattctggtcaatatggcagcaggccaggtcagcattcgatataaactcaagggcccaaatcatgcagtatccacagcctgtaccacaggagctcatgctgtgggagactcatttagatttatagcccatggtgatgctgatgtgatggtggctggaggtacagattcttgtattagccctttatctcttgctgggttttccagagcccgggctctgagcacaaactcagatcccaagttggcatgtcgaccatttcatccaaagagagatggttttgtaatgggagaaggtgcagctgtgctggtgctggaagaatatgaacatgctgttcaaagaagagcccggatctatgcagaagttttgggctatggactctcaggtgatgctggtcacataactgcccctgatcctgaaggagaaggtgccttaaggtgtatggctgctgctttaaaagatgcaggtgtgcagcctgaggagatatcctatatcaatgcacatgctacttccacaccattgggagatgctgctgaaaacaaagctatcaaacatctcttcaaagaccatgcatatgcccttgcagtttcctcaactaagggagcaacaggacatctgctgggagctgcaggggcagtcgaggcagcttttaccacattagcttgttattatcaaaaactaccacctactttaaacctggattgttcggaaccagaatttgatctcaactatgttccactaaaggcacaggaatggaaaactgagaaaagatttattggcctcaccaattcctttggttttggtggtactaatgcaacactttgtattgctggactgtagaacatataatttgtaattaaatactgatttttaaatgcta

SEQ ID NO: 102747 - DNA, 899 bp, Homo sapiens
  Payload ID: 43
  Gene Symbol: OXSM
  Gene Name: 3-oxoacyl-ACP synthase, mitochondrial
  ENST ID: ENST00000452098
  CDS Start-End: 240-899
acttggccgggtcccgaggcccctggccggcgggctcggacgttaggagcagaaccagctccaggtcccggtctgtccgggcgtcgctgccctctgaagctcaggccggacgccccagtccctggccgaacaaggtgccgcggcccacccaccccggtacccgccgtccgaccccgttgccctgcacctgaggatgttgtcagcataggaatgtgtttctgatcatctgaatcttaatcatgtccaactgcctgcaaaatttcctgaaaattacaagcactcgtcttctatgttcaagattatgccaacagttaagaagtaaaaggaagtttttcggaactgtgccaatatccagattgcataggcgagttgtcattacaggcattggcttagtgactcctcttggtgttggaactcacctggtttgggatcgtcttatcggaggagagagtggaattgtttcactggttggtgaagagtataagagtatcccttgcagtgttgctgcttatgtgccaagaggtagtgatgaaggtcagttcaatgaacaaaactttgtgtccaaatcagatatcaagtccatgtcttctcccaccatcatggccattggggctgcagaattagccatgaaggattctggctggcatcctcagtcagaagctgatcaagtggctactggtgttgcaattggcatgggaatgattcctcttgaagttgtttctgaaactgctttgaattttcagacaaaaggttacaataaagttagcccattttttgtccctaagattctggtcaatatggcagcaggccaggtcagcattcgatataaactcaagggcccaaatcatgcagtatccacagcctgtaccacaggagctcatgctgtgggagactcattt

SEQ ID NO: 102748 - DNA, 1044 bp, Homo sapiens
  Payload ID: 43
  Gene Symbol: OXSM
  Gene Name: 3-oxoacyl-ACP synthase, mitochondrial
  ENST ID: ENST00000448177
  CDS Start-End: 90-398
gctcgagagcgtcatcgcccccgactgtggagaagtgtccggggtagccccgttacaggaatgtgtttctgatcatctgaatcttaatcatgtccaactgcctgcaaaatttcctgaaaattacaagcactcgtcttctatgttcaagattatgccaacagttaagaagtaaaaggaagtttttcggaactgtgccaatatccagattgcataggcgagttgtcattacaggcattggcttagtgactcctcttggtgttggaactcacctggtttgggatcgtcttatcggaggagagagtggaattgtttcactggttggtgaagagtataagagtatcccttgcagtgttgctgcttatgtgccaagaggtagtgatgaagagcccgggctctgagcacaaactcagatcccaagttggcatgtcgaccatttcatccaaagagagatggttttgtaatgggagaaggtgcagctgtgctggtgctggaagaatatgaacatgctgttcaaagaagagcccggatctatgcagaagttttgggctatggactctcaggtgatgctggtcacataactgcccctgatcctgaaggagaaggtgccttaaggtgtatggctgctgctttaaaagatgcaggtgtgcagcctgaggagatatcctatatcaatgcacatgctacttccacaccattgggagatgctgctgaaaacaaagctatcaaacatctcttcaaagaccatgcatatgcccttgcagtttcctcaactaagggagcaacaggacatctgctgggagctgcaggggcagtcgaggcagcttttaccacattagcttgttattatcaaaaactaccacctactttaaacctggattgttcggaaccagaatttgatctcaactatgttccactaaaggcacaggaatggaaaactgagaaaagatttattggcctcaccaattcctttggttttggtggtactaatgcaacactttgtattgctggactgtagaacatataatttgtaattaaatactgatt

SEQ ID NO: 102749 - DNA, 756 bp, Homo sapiens
  Payload ID: 43
  Gene Symbol: OXSM
  Gene Name: 3-oxoacyl-ACP synthase, mitochondrial
  ENST ID: ENST00000428266
  CDS Start-End: 63-756
gtctgacggcacttaaggtctaaaaaagaaggaatgtgtttctgatcatctgaatcttaatcatgtccaactgcctgcaaaatttcctgaaaattacaagcactcgtcttctatgttcaagattatgccaacagttaagaagtaaaaggaagtttttcggaactgtgccaatatccagattgcataggcgagttgtcattacaggcattggcttagtgactcctcttggtgttggaactcacctggtttgggatcgtcttatcggaggagagagtggaattgtttcactggttggtgaagagtataagagtatcccttgcagtgttgctgcttatgtgccaagaggtagtgatgaaggtcagttcaatgaacaaaactttgtgtccaaatcagatatcaagtccatgtcttctcccaccatcatggccattggggctgcagaattagccatgaaggattctggctggcatcctcagtcagaagctgatcaagtggctactggtgttgcaattggcatgggaatgattcctcttgaagttgtttctgaaactgctttgaattttcagacaaaaggttacaataaagttagcccattttttgtccctaagattctggtcaatatggcagcaggccaggtcagcattcgatataaactcaagggcccaaatcatgcagtatccacagcctgtaccacaggagctcatgctgtgggagactcatttagatttatagcccatggtgatgctgatgtgatgg

SEQ ID NO: 102750 - DNA, 1256 bp, Homo sapiens
  Payload ID: 43
  Gene Symbol: OXSM
  Gene Name: 3-oxoacyl-ACP synthase, mitochondrial
  Uniprot ID: Q9NWU1
  ENST ID: ENST00000420173
  CDS Start-End: 86-1216
gagagcgtcatcgcccccgactgtggagaagtgtccggggtagccccgttacaggaatgtgtttctgatcatctgaatcttaatcatgtccaactgcctgcaaaatttcctgaaaattacaagcactcgtcttctatgttcaagattatgccaacagttaagaagtaaaaggaagtttttcggaactgtgccaatatccagattgcataggcgagttgtcattacaggcattggcttagtgactcctcttggtgttggaactcacctggtttgggatcgtcttatcggaggagagagtggaattgtttcactggttggtgaagagtataagagtatcccttgcagtgttgctgcttatgtgccaagaggtagtgatgaaggtcagttcaatgaacaaaactttgtgtccaaatcagatatcaagtccatgtcttctcccaccatcatggccattggggctgcagaattagccatgaaggattctggctggcatcctcagtcagaagctgatcaagtggctactggtgttgcaattggcatgggaatgattcctcttgaagttgtttctgaaactgctttgaattttcagacaaaaggttacaataaagttagcccattttttgtccctaagattctggtcaatatggcagcaggccaggtcagcattcgatataaactcaagggcccaaatcatgcagtatccacagcctgtaccacaggagctcatgctgtgggagactcatttagatttatagcccatggtgatgctggtcacataactgcccctgatcctgaaggagaaggtgccttaaggtgtatggctgctgctttaaaagatgcaggtgtgcagcctgaggagatatcctatatcaatgcacatgctacttccacaccattgggagatgctgctgaaaacaaagctatcaaacatctcttcaaagaccatgcatatgcccttgcagtttcctcaactaagggagcaacaggacatctgctgggagctgcaggggcagtcgaggcagcttttaccacattagcttgttattatcaaaaactaccacctactttaaacctggattgttcggaaccagaatttgatctcaactatgttccactaaaggcacaggaatggaaaactgagaaaagatttattggcctcaccaattcctttggttttggtggtactaatgcaacactttgtattgctggactgtagaacatataatttgtaattaaatactgatttttaaatgcta

SEQ ID NO: 102751 - DNA, 309 bp, Homo sapiens
  Payload ID: 43
  Gene Symbol: OXSM
  Gene Name: 3-oxoacyl-ACP synthase, mitochondrial
  ENST ID: ENST00000626005
  CDS Start-End: 1-309
atgtccaactgcctgcaaaatttcctgaaaattacaagcactcgtcttctatgttcaagattatgccaacagttaagaagtaaaaggaagtttttcggaactgtgccaatatccagattgcataggcgagttgtcattacaggcattggcttagtgactcctcttggtgttggaactcacctggtttgggatcgtcttatcggaggagagagtggaattgtttcactggttggtgaagagtataagagtatcccttgcagtgttgctgcttatgtgccaagaggtagtgatgaagagcccgggctctga

SEQ ID NO: 102752 - DNA, 2731 bp, Homo sapiens
  Payload ID: 44
  Gene Symbol: PAPSS1
  Gene Name: 3'-phosphoadenosine 5'-phosphosulfate synthase 1
  Uniprot ID: O43252
  ENST ID: ENST00000265174
  CDS Start-End: 274-2148
gcgagcgctgaagctccgcccccagcttctacctccggttctatcccggcgtttcgcccttccccacagacctctgccccggacccatttccgaggcgcgccgcatgcgccgcgcaacccaggccacgagcacgggcgcgtgcttaagtcagcgcgcgcccgctccgacgcgaggaggccccgccctccagccccgccccgctcgctggcctgccctcctcttgctaccctcccggcgcagagaaccccggctgctcagcgcgctccgcggtcatggagatccccgggagcctgtgcaagaaagtcaaactgagcaataacgcgcagaactggggaatgcagagagcaaccaatgtcacctaccaagcccatcatgtcagcaggaacaagagaggtcaggtggtggggaccagaggtggctttcgtggttgcacagtttggctaacaggcttgtctggagcgggaaagactactgtgagcatggccttggaggagtacctggtttgtcatggtattccatgctacactctggatggtgacaatattcgtcaaggtctcaataaaaatcttggctttagtcctgaagacagagaagagaatgttcgacgcatcgcagaagttgctaaactgtttgcagatgctggcttagtgtgcatcacaagtttcatatcaccttacactcaggatcgcaacaatgcaaggcaaattcatgaaggtgcaagtttaccgttttttgaagtatttgttgatgctcctctgcatgtttgtgaacagagggatgtcaaaggactctacaaaaaagcccgggcaggagaaattaaaggtttcactgggatcgattctgaatatgaaaagccagaggcccctgagttggtgctgaaaacagactcctgtgatgtaaatgactgtgtccagcaagttgtggaacttctacaggaacgggatattgtacctgtggatgcatcttatgaagtaaaagaactatatgtgccagaaaataaacttcatttggcaaaaacagatgcggaaacattaccagcactgaaaattaataaagtggatatgcagtgggtgcaggttttggcagaaggttgggcaaccccattgaatggctttatgagagagagggagtacttgcagtgccttcattttgattgtcttctggatggaggtgtcattaacttgtcagtacctatagttctgactgcgactcatgaagataaagagaggctggacggctgtacagcatttgctctgatgtatgagggccgccgtgtggccattcttcgcaatccagagttttttgagcacaggaaagaggagcgctgtgccagacagtggggaacgacatgcaagaaccacccctatattaagatggtgatggaacaaggagattggctgattggaggagatcttcaagtcttggatcgagtttattggaatgatggtcttgatcagtatcgtcttactcctactgagctaaagcagaaatttaaagatatgaatgctgatgctgtctttgcatttcaactacgcaacccagtgcacaatggacatgccctgttaatgcaggatacccataagcaacttctagagaggggctaccggcgccctgtcctcctcctccaccctctgggtggctggacaaaggatgacgatgttcctttgatgtggcgtatgaagcagcatgctgcagtgttggaggaaggagttctgaatcctgagacgacagtggtggccatcttcccatctcccatgatgtatgctggaccaactgaggtccagtggcattgcagagcacggatggttgcaggagccaacttttacattgttggacgagaccctgctggcatgcctcatccagaaacagggaaggatctttatgagccaagtcatggtgccaaagtgctgacgatggcccctggtttaatcactttggaaatagttccctttcgagttgcagcttacaacaagaaaaagaagcgtatggactactatgactctgaacaccatgaagactttgaatttatttcaggaacacgaatgcgcaaacttgctcgagaaggccagaaaccacctgaaggtttcatggctcccaaggcttggaccgtgctgacagaatactacaaatccttggagaaagcttaggctgttaacccagtcactccacctttgacacattactagtaacaagaggggaccacatagtctctgttggcatttctttgtggtgtctgtctggacatgcttcctaaaaacagaccattttccttaacttgcatcagttttggtctgccttatgagttctgttttgaacaagtgtaacacactgatggttttaatgtatcttttccacttattatagttatattcctacaatacaattttaaaattgtctttttatattatatttatgcttctgtgtcatgattttttcaagctgttatattagttgtaaccagtagtattcacattaaatcttgctttttttccccttaaaaaaagaaaaaaattaccaaacaataaacttggctagaccttgttttgaggattttacaagacctttgtagcgattagattttttttctacattgaaaatagaaactgcttcctttcttctttccagtcagctattggtctttccagctgttataatctaaagtattcttatgatctgtgtaagctctgaatgaacttctttactcaataaaattaattttttggcttctta

SEQ ID NO: 102753 - DNA, 3949 bp, Homo sapiens
  Payload ID: 45
  Gene Symbol: PAPSS2
  Gene Name: 3'-phosphoadenosine 5'-phosphosulfate synthase 2
  Uniprot ID: O95340
  ENST ID: ENST00000361175
  CDS Start-End: 370-2214
ggccgcgtgccgggcgtgccatctgccgctccgctgcaaggtctcgcccgggaccggggctggcggagcgcgcgcccgcgagtaggggccgggccggggaccccgcctaggcggcggcggccgggtccccaaggctgggcgctgcttgcggaaccgacggggcggagaggagcgtggcgggaggaggagtaggagaagggggctggtcaagggaagtgcgacgtgtctgcggagcctttttatacctccttcccgggagtccggcagccgctgctgctgctgctgctgctgctgccgccgccgccgccgccgtccctgcgtccttcggtctctgctcccgggacccgggctccgccgcagccagccagcatgtcggggatcaagaagcaaaagacggagaaccagcagaaatccaccaatgtagtctatcaggcccaccatgtgagcaggaataagagagggcaagtggttggaacaaggggtgggttccgaggatgtaccgtgtggctaacaggtctctctggtgctggaaaaacaacgataagttttgccctggaggagtaccttgtctcccatgccatcccttgttactccctggatggggacaatgtccgtcatggccttaacagaaatctcggattctctcctggggacagagaggaaaatatccgccggattgctgaggtggctaagctgtttgctgatgctggtctggtctgcattaccagctttatttctccattcgcaaaggatcgtgagaatgcccgcaaaatacatgaatcagcagggctgccattctttgaaatatttgtagatgcacctctaaatatttgtgaaagcagagacgtaaaaggcctctataaaagggccagagctggggagattaaaggatttacaggtattgattctgattatgagaaacctgaaactcctgagcgtgtgcttaaaaccaatttgtccacagtgagtgactgtgtccaccaggtagtggaacttctgcaagagcagaacattgtaccctatactataatcaaagatatccacgaactctttgtgccggaaaacaaacttgaccacgtccgagctgaggctgaaactctcccttcattatcaattactaagctggatctccagtgggtccaggttttgagcgaaggctgggccactcccctcaaaggtttcatgcgggagaaggagtacttacaggttatgcactttgacaccctgctagatgatggcgtgatcaacatgagcatccccattgtactgcccgtctctgcagaggataagacacggctggaagggtgcagcaagtttgtcctggcacatggtggacggagggtagctatcttacgagacgctgaattctatgaacacagaaaagaggaacgctgttcccgtgtttgggggacaacatgtacaaaacacccccatatcaaaatggtgatggaaagtggggactggctggttggtggagaccttcaggtgctggagaaaataagatggaatgatgggctggaccaataccgtctgacacctctggagctcaaacagaaatgtaaagaaatgaatgctgatgcggtgtttgcattccagttgcgcaatcctgtccacaatggccatgccctgttgatgcaggacactcgccgcaggctcctagagaggggctacaagcacccggtcctcctactacaccctctgggcggctggaccaaggatgacgatgtgcctctagactggcggatgaagcagcacgcggctgtgctcgaggaaggggtcctggatcccaagtcaaccattgttgccatctttccgtctcccatgttatatgctggccccacagaggtccagtggcactgcaggtcccggatgattgcgggtgccaatttctacattgtggggagggaccctgcaggaatgccccatcctgaaaccaagaaggatctgtatgaacccactcatgggggcaaggtcttgagcatggcccctggcctcacctctgtggaaatcattccattccgagtggctgcctacaacaaagccaaaaaagccatggacttctatgatccagcaaggcacaatgagtttgacttcatctcaggaactcgaatgaggaagctcgcccgggaaggagagaatcccccagatggcttcatggcccccaaagcatggaaggtcctgacagattattacaggtccctggagaagaactaagcctttggctccagagtttctttctgaagtgctctttgattaccttttctatttttatgattagatgctttgtattaaattgcttctcaatgatgcattttaatcttttataatgaagtaaaagttgtgtctataattaaaaaaaaatatatatatatacacacacacatatacatacaaagtcaaactgaagaccaaatcttagcaggtaaaagcaatattcttatacatttcataataaaattagctctatgtattttctactgcacctgagcaggcaggtcccagatttcttaaggctttgtttgaccatgtgtctagttacttgctgaaaagtgaatatattttccagcatgtcttgacaacctgtactcttccaatgtcatttatcagttgtaaaatatatcagattgtgtcctcttctgtacaattgacaaaaaaaaaaatttttttttctcactctaaaagaggtgtggctcacatcaagattcttcctgatattttacctcatgctgtacaaagccttaatgttgtaatcatatcttacgtgttgaagacctgactggagaaacaaaatgtgcaataacgtgaattttatcttagagatctgtgcagcctatttctgtcacaaaagttatattgtctaataagagaagtcttaatggcctctgtgaataatgtaactccagttacacggtgacttttaatagcatacagtgatttgatgaaaggacgtcaaacaatgtggcgatgtcgtggaaagttatctttcccgctctttgctgtggtcattgtgtcttgcagaaaggatggccctgatgcagcagcagcgccagctgtaataaaaaataattcacactatcagactagcaaggcactagaactggaaaagaccacagaaaacaaagaatccaaccctttcatcttacaggtgaacaaactgtgatgatgcacatgtatgtgttttgtaagctgtgagcaccgtaacaaaatgtaaatttgccattattaggaagtgctggtggcagtgaagaagcacccaggccacttgactcccagtctggtgccctgtctacaccagacaacacaggagctgggtcagattcccctcagctgcttaacaaagttcctcgaacagaaagtgcttacaaagctgccttctcggatactgaaaggtcgagttttctgaactgcactgattttattgcagttgaaaaaaaaaaaaagctattccaaagatttcaagctgttctgagacatcttctgatggctttacttcctgagaggcaatgtttttactttatgcataattcattgttgccaaggaataaagtgaagaaacagcaccttttaatatataggtctctctggaagagacctaaattagaaagagaaaactgtgacaattttcatattctcattcttaaaaaacactaatcttaactaacaaaagttcttttgagaataagttacacacaatggccacagcagtttgtctttaatagtatagtgcctatactcatgtaatcggttactcactactgcctttaaaaaaaaaaaccagcatatttattgaaaacatgagacaggattatagtgccttaaccgatatattttgtgacttaaaaaatacatttaaaactgctcttctgctctagtaccatgcttagtgcaaatgattatttctatgtacaactgatgcttgttcttattttaataaatttatcagagtgaa

SEQ ID NO: 102754 - DNA, 3856 bp, Homo sapiens
  Payload ID: 45
  Gene Symbol: PAPSS2
  Gene Name: 3'-phosphoadenosine 5'-phosphosulfate synthase 2
  Uniprot ID: O95340
  ENST ID: ENST00000456849
  CDS Start-End: 264-2123
ctaggcggcggcggccgggtccccaaggctgggcgctgcttgcggaaccgacggggcggagaggagcgtggcgggaggaggagtaggagaagggggctggtcaagggaagtgcgacgtgtctgcggagcctttttatacctccttcccgggagtccggcagccgctgctgctgctgctgctgctgctgccgccgccgccgccgccgtccctgcgtccttcggtctctgctcccgggacccgggctccgccgcagccagccagcatgtcggggatcaagaagcaaaagacggagaaccagcagaaatccaccaatgtagtctatcaggcccaccatgtgagcaggaataagagagggcaagtggttggaacaaggggtgggttccgaggatgtaccgtgtggctaacaggtctctctggtgctggaaaaacaacgataagttttgccctggaggagtaccttgtctcccatgccatcccttgttactccctggatggggacaatgtccgtcatggccttaacagaaatctcggattctctcctggggacagagaggaaaatatccgccggattgctgaggtggctaagctgtttgctgatgctggtctggtctgcattaccagctttatttctccattcgcaaaggatcgtgagaatgcccgcaaaatacatgaatcagcagggctgccattctttgaaatatttgtagatgcacctctaaatatttgtgaaagcagagacgtaaaaggcctctataaaagggccagagctggggagattaaaggatttacaggtattgattctgattatgagaaacctgaaactcctgagcgtgtgcttaaaaccaatttgtccacagtgagtgactgtgtccaccaggtagtggaacttctgcaagagcagaacattgtaccctatactataatcaaagatatccacgaactctttgtgccggaaaacaaacttgaccacgtccgagctgaggctgaaactctcccttcattatcaattactaagctggatctccagtgggtccaggttttgagcgaaggctgggccactcccctcaaaggtttcatgcgggagaaggagtacttacaggttatgcactttgacaccctgctagatggcatggcccttcctgatggcgtgatcaacatgagcatccccattgtactgcccgtctctgcagaggataagacacggctggaagggtgcagcaagtttgtcctggcacatggtggacggagggtagctatcttacgagacgctgaattctatgaacacagaaaagaggaacgctgttcccgtgtttgggggacaacatgtacaaaacacccccatatcaaaatggtgatggaaagtggggactggctggttggtggagaccttcaggtgctggagaaaataagatggaatgatgggctggaccaataccgtctgacacctctggagctcaaacagaaatgtaaagaaatgaatgctgatgcggtgtttgcattccagttgcgcaatcctgtccacaatggccatgccctgttgatgcaggacactcgccgcaggctcctagagaggggctacaagcacccggtcctcctactacaccctctgggcggctggaccaaggatgacgatgtgcctctagactggcggatgaagcagcacgcggctgtgctcgaggaaggggtcctggatcccaagtcaaccattgttgccatctttccgtctcccatgttatatgctggccccacagaggtccagtggcactgcaggtcccggatgattgcgggtgccaatttctacattgtggggagggaccctgcaggaatgccccatcctgaaaccaagaaggatctgtatgaacccactcatgggggcaaggtcttgagcatggcccctggcctcacctctgtggaaatcattccattccgagtggctgcctacaacaaagccaaaaaagccatggacttctatgatccagcaaggcacaatgagtttgacttcatctcaggaactcgaatgaggaagctcgcccgggaaggagagaatcccccagatggcttcatggcccccaaagcatggaaggtcctgacagattattacaggtccctggagaagaactaagcctttggctccagagtttctttctgaagtgctctttgattaccttttctatttttatgattagatgctttgtattaaattgcttctcaatgatgcattttaatcttttataatgaagtaaaagttgtgtctataattaaaaaaaaatatatatatatacacacacacatatacatacaaagtcaaactgaagaccaaatcttagcaggtaaaagcaatattcttatacatttcataataaaattagctctatgtattttctactgcacctgagcaggcaggtcccagatttcttaaggctttgtttgaccatgtgtctagttacttgctgaaaagtgaatatattttccagcatgtcttgacaacctgtactcttccaatgtcatttatcagttgtaaaatatatcagattgtgtcctcttctgtacaattgacaaaaaaaaaaatttttttttctcactctaaaagaggtgtggctcacatcaagattcttcctgatattttacctcatgctgtacaaagccttaatgttgtaatcatatcttacgtgttgaagacctgactggagaaacaaaatgtgcaataacgtgaattttatcttagagatctgtgcagcctatttctgtcacaaaagttatattgtctaataagagaagtcttaatggcctctgtgaataatgtaactccagttacacggtgacttttaatagcatacagtgatttgatgaaaggacgtcaaacaatgtggcgatgtcgtggaaagttatctttcccgctctttgctgtggtcattgtgtcttgcagaaaggatggccctgatgcagcagcagcgccagctgtaataaaaaataattcacactatcagactagcaaggcactagaactggaaaagaccacagaaaacaaagaatccaaccctttcatcttacaggtgaacaaactgtgatgatgcacatgtatgtgttttgtaagctgtgagcaccgtaacaaaatgtaaatttgccattattaggaagtgctggtggcagtgaagaagcacccaggccacttgactcccagtctggtgccctgtctacaccagacaacacaggagctgggtcagattcccctcagctgcttaacaaagttcctcgaacagaaagtgcttacaaagctgccttctcggatactgaaaggtcgagttttctgaactgcactgattttattgcagttgaaaaaaaaaaaaagctattccaaagatttcaagctgttctgagacatcttctgatggctttacttcctgagaggcaatgtttttactttatgcataattcattgttgccaaggaataaagtgaagaaacagcaccttttaatatataggtctctctggaagagacctaaattagaaagagaaaactgtgacaattttcatattctcattcttaaaaaacactaatcttaactaacaaaagttcttttgagaataagttacacacaatggccacagcagtttgtctttaatagtatagtgcctatactcatgtaatcggttactcactactgcctttaaaaaaaaaaaccagcatatttattgaaaacatgagacaggattatagtgccttaaccgatatattttgtgacttaaaaaatacatttaaaactgctcttctgctctagtaccatgcttagtgcaaatgattatttctatgtacaactgatgcttgttcttattttaataaatttatcagagtg

SEQ ID NO: 102755 - DNA, 4728 bp, Homo sapiens
  Payload ID: 46
  Gene Symbol: PDPK1
  Gene Name: 3-phosphoinositide dependent protein kinase 1
  Uniprot ID: O15530
  ENST ID: ENST00000268673
  CDS Start-End: 111-1400
cgcaggatgagggcggccattgctggggctccgcttcggggaggaggacgctgaggaggcgccgagccgcgcagcgctgcgggggaggcgcccgcgccgacgcggggcccatggccaggaccaccagccagctgtatgacgccgtgcccatccagtccagcgtggtgttatgttcctgcccatccccatcaatggtgaggacccagactgagtccagcacgccccctggcattcctggtggcagcaggcagggccccgccatggacggcactgcagccgagcctcggcccggcgccggctccctgcagcatgcccagcctccgccgcagcctcggaagaagcggcctgaggacttcaagtttgggaaaatccttggggaaggctctttttccacggttgtcctggctcgagaactggcaacctccagagaatatgcgaccagggccaactcattcgtgggaacagcgcagtacgtttctccagagctgctcacggagaagtccgcctgtaagagttcagacctttgggctcttggatgcataatataccagcttgtggcaggactcccaccattccgagctggaaacgagtatcttatatttcagaagatcattaagttggaatatgactttccagaaaaattcttccctaaggcaagagacctcgtggagaaacttttggttttagatgccacaaagcggttaggctgtgaggaaatggaaggatacggacctcttaaagcacacccgttcttcgagtccgtcacgtgggagaacctgcaccagcagacgcctccgaagctcaccgcttacctgccggctatgtcggaagacgacgaggactgctatggcaattatgacaatctcctgagccagtttggctgcatgcaggtgtcttcgtcctcctcctcacactccctgtcagcctccgacacgggcctgccccagaggtcaggcagcaacatagagcagtacattcacgatctggactcgaactcctttgaactggacttacagttttccgaagatgagaagaggttgttgttggagaagcaggctggcggaaacccttggcaccagtttgtagaaaataatttaatactaaagatgggcccagtggataagcggaagggtttatttgcaagacgacgacagctgttgctcacagaaggaccacatttatattatgtggatcctgtcaacaaagttctgaaaggtgaaattccttggtcacaagaacttcgaccagaggccaagaattttaaaactttctttgtccacacgcctaacaggacgtattatctgatggaccccagcgggaacgcacacaagtggtgcaggaagatccaggaggtttggaggcagcgataccagagccacccggacgccgctgtgcagtgacgtggcctgcggccgggctgcccttcgctgccaggacacctgccccagcgcggcttggccgccatccgggacgcttccagaccacctgccagccatcacaaggggaacgcagaggcggaaaccttgcagcatttttatttaaaagaaaagaagaaaaaaaacacccaaccacacaaagaacaaaaccagtaacaaacacaaaggaattcagggtcgctttgcttgctctctgtgctccgtggaggcctccgtgtgccctcgttgccgtggggacccagctccatgcacgtcaacccagtcccgcccagactagtggacagacctggtgtcaccagtttttcctagcatcagtccgaaccatgcgcccgccctgccccaactgtgtgctggtcctgctgtggccgaggggaccgggtgtgtttggctctttatgcccctcccgctgtggtcctggaactcttcaccagggagggagccctgcgggggccgcagctttgtggagggagccgccgtgcttctgtcacctgctccctttcttgcgtctccctgtgatgggcccttaggcctggctgggcccattacatatccctgtggtggctctggtggcagctttctgtggcccctgctgtgttggcaggcaggtttgcgtggtgaggagcgggaggggttggagtggtgcgggagcaggctgccgagtggagggtgccatcgagggctccggatcccttatcctacttagcagtgttggtctctggggctggaagccgagcgcatgctgggagcggtactgtcagaagtgagcccagttagtaccccgctggctcactgcacgagagagtcctgccccgagccctaggtggggccaggaggtgccttggagaagccagccagagcagagagggctgctgacttccgtgtggagcagagaggcctgagggcctcctaaaaggtttaaatgtccacgcctctccagttgctgaagtagggtctgagagaaccctggcatcagcagacccagggtgcttctgtctcctgcagaccacgccagggagtgcagacaccaccgtcacacacgccccttttgtgttttggttcaagtttctcagagcccctcagagcttctacatctgtgcatcagaaatctcacagccttctcatgctgccggctcatctgggcccatagagtgggctttgccagttgctgttgcacaggaggcgagaacagcacacttcaaccccagcttgctggtcggctttcctctagagagagccggttttggggccatttccctttgatgctttggtggccttgccccgctctgcagcacagacaggccagatgcatttgtcctttgcctagctactccccaggtagagagtgctcctggtggcctggcaggtctgggcccttctctccctgcccaggttgtccctggagggcagccctcactccctttgggggagaggcagacattgctgcccacagacctgcctctgactcaactgtgtccaccctccctggtccctacccccaagtcacaggtgactcagcagtgaccctgtgtgccaggccagatccaaactgagagggaaggtgtcgtttttacactgctaatgacgagagtggctctttttagctaggcgagtacagacggggcctgggagggggcagagatgttccccaggccctgcctgtggttcctgcctgggccttggctgctgctgtgtgagagctgcatgtgagcctgtgaccgtgagctggggtgagctgggccgcacctaccctggggccccagggagcaggacgctccggggcccagcacgttgccctgggcctgtggccggagtcggagtcctctctcctcctcctggcttttggaaaggcttggctgtgttggggagtctctcttagccctttcaggaatttctgttcaggcttcctcctcctcatcagctattttacccatctcagaacgtcctgtgtctccatgtaggagagtggctctctcagatctctcagggcgtctggttatagggaaacaagtggagcagggacgtggctttaattggagcactcggctgggctgcttggggagactcttccgtgcgttcttcctctggatagaaccaccacctcctgggcgtcactgacaagctccatcttaacctccaaagccacagaactaggggctcagagccagagctggcagccgccagccaaaatgatgccattgcctgagctgacagccaagcccttctgtgggtcacctttctcctcacccagccccttgctcttcccttttgaaaggcccgtgtgttttctttccttaccctgtgcttgctcatgtctactccggttttctctaccacatccttagagccatcacctggcacgcaggcgccttacattctacggtagaacgtggggtactgtgtgtgcacatagacacacttacgtggaattacagttgtgggtttatccaagatgaggaagatttcacctgctgtttaatagacttggggccatgtgcctccccacacatgggcaaggacaggtggaatgtcgggaccacactgtgcggcttctcggcacaaagcggagggaggctgtggtcgctgccggcctaggtgtcccaggtgccccgcctttctctgggacacagttgggggctggcttctgagggattcctttctcccctctttgtgtggccccagccagggcggtgggcagtcctggtgtagagcacaagcctctccaccctagagaaatgcctctgtaccacggctaccatgtggaaccttaacttgcagaaggcttgttaacaattgttttgagagagatggctggtcatgccacagctgctggggactccgcctactccagccctcttgggacacactgtgggatttgtggcccttccccagaggaattgtggagactgtcccatggaacaaaccctcaggcaccagcacagggctctgggtgactcagtaaaactaacgtttgtctctgacaagatcagctgtaggctcaccggccagagaagaccactgtgagcattttgccgtatatcctgccctgccatttgttcactttttaaactaaaataggaacatccgacacacaccgtttgcatcgtcttctcccttgatattttaagcattttcccatgtcatgagtttctcagaaacatgtttttaacaattgtactatttagtcattgtccatttactataatttatctgaccatttccctactgtaaaatacttaagacggtttctgatttttccactatttaaataatgctgtgatgaatatctttaaaa

SEQ ID NO: 102756 - DNA, 7241 bp, Homo sapiens
  Payload ID: 46
  Gene Symbol: PDPK1
  Gene Name: 3-phosphoinositide dependent protein kinase 1
  Uniprot ID: O15530
  ENST ID: ENST00000342085
  CDS Start-End: 150-1820
gcggcgccgggggcggggggcggcgggcgacggggcgggcgcaggatgagggcggccattgctggggctccgcttcggggaggaggacgctgaggaggcgccgagccgcgcagcgctgcgggggaggcgcccgcgccgacgcggggcccatggccaggaccaccagccagctgtatgacgccgtgcccatccagtccagcgtggtgttatgttcctgcccatccccatcaatggtgaggacccagactgagtccagcacgccccctggcattcctggtggcagcaggcagggccccgccatggacggcactgcagccgagcctcggcccggcgccggctccctgcagcatgcccagcctccgccgcagcctcggaagaagcggcctgaggacttcaagtttgggaaaatccttggggaaggctctttttccacggttgtcctggctcgagaactggcaacctccagagaatatgcgattaaaattctggagaagcgacatatcataaaagagaacaaggtcccctatgtaaccagagagcgggatgtcatgtcgcgcctggatcaccccttctttgttaagctttacttcacatttcaggacgacgagaagctgtatttcggccttagttatgccaaaaatggagaactacttaaatatattcgcaaaatcggttcattcgatgagacctgtacccgattttacacggctgagattgtgtctgctttagagtacttgcacggcaagggcatcattcacagggaccttaaaccggaaaacattttgttaaatgaagatatgcacatccagatcacagattttggaacagcaaaagtcttatccccagagagcaaacaagccagggccaactcattcgtgggaacagcgcagtacgtttctccagagctgctcacggagaagtccgcctgtaagagttcagacctttgggctcttggatgcataatataccagcttgtggcaggactcccaccattccgagctggaaacgagtatcttatatttcagaagatcattaagttggaatatgactttccagaaaaattcttccctaaggcaagagacctcgtggagaaacttttggttttagatgccacaaagcggttaggctgtgaggaaatggaaggatacggacctcttaaagcacacccgttcttcgagtccgtcacgtgggagaacctgcaccagcagacgcctccgaagctcaccgcttacctgccggctatgtcggaagacgacgaggactgctatggcaattatgacaatctcctgagccagtttggctgcatgcaggtgtcttcgtcctcctcctcacactccctgtcagcctccgacacgggcctgccccagaggtcaggcagcaacatagagcagtacattcacgatctggactcgaactcctttgaactggacttacagttttccgaagatgagaagaggttgttgttggagaagcaggctggcggaaacccttggcaccagtttgtagaaaataatttaatactaaagatgggcccagtggataagcggaagggtttatttgcaagacgacgacagctgttgctcacagaaggaccacatttatattatgtggatcctgtcaacaaagttctgaaaggtgaaattccttggtcacaagaacttcgaccagaggccaagaattttaaaactttctttgtccacacgcctaacaggacgtattatctgatggaccccagcgggaacgcacacaagtggtgcaggaagatccaggaggtttggaggcagcgataccagagccacccggacgccgctgtgcagtgacgtggcctgcggccgggctgcccttcgctgccaggacacctgccccagcgcggcttggccgccatccgggacgcttccagaccacctgccagccatcacaaggggaacgcagaggcggaaaccttgcagcatttttatttaaaagaaaagaagaaaaaaaacacccaaccacacaaagaacaaaaccagtaacaaacacaaaggaattcagggtcgctttgcttgctctctgtgctccgtggaggcctccgtgtgccctcgttgccgtggggacccagctccatgcacgtcaacccagtcccgcccagactagtggacagacctggtgtcaccagtttttcctagcatcagtccgaaccatgcgcccgccctgccccaactgtgtgctggtcctgctgtggccgaggggaccgggtgtgtttggctctttatgcccctcccgctgtggtcctggaactcttcaccagggagggagccctgcgggggccgcagctttgtggagggagccgccgtgcttctgtcacctgctccctttcttgcgtctccctgtgatgggcccttaggcctggctgggcccattacatatccctgtggtggctctggtggcagctttctgtggcccctgctgtgttggcaggcaggtttgcgtggtgaggagcgggaggggttggagtggtgcgggagcaggctgccgagtggagggtgccatcgagggctccggatcccttatcctacttagcagtgttggtctctggggctggaagccgagcgcatgctgggagcggtactgtcagaagtgagcccagttagtaccccgctggctcactgcacgagagagtcctgccccgagccctaggtggggccaggaggtgccttggagaagccagccagagcagagagggctgctgacttccgtgtggagcagagaggcctgagggcctcctaaaaggtttaaatgtccacgcctctccagttgctgaagtagggtctgagagaaccctggcatcagcagacccagggtgcttctgtctcctgcagaccacgccagggagtgcagacaccaccgtcacacacgccccttttgtgttttggttcaagtttctcagagcccctcagagcttctacatctgtgcatcagaaatctcacagccttctcatgctgccggctcatctgggcccatagagtgggctttgccagttgctgttgcacaggaggcgagaacagcacacttcaaccccagcttgctggtcggctttcctctagagagagccggttttggggccatttccctttgatgctttggtggccttgccccgctctgcagcacagacaggccagatgcatttgtcctttgcctagctactccccaggtagagagtgctcctggtggcctggcaggtctgggcccttctctccctgcccaggttgtccctggagggcagccctcactccctttgggggagaggcagacattgctgcccacagacctgcctctgactcaactgtgtccaccctccctggtccctacccccaagtcacaggtgactcagcagtgaccctgtgtgccaggccagatccaaactgagagggaaggtgtcgtttttacactgctaatgacgagagtggctctttttagctaggcgagtacagacggggcctgggagggggcagagatgttccccaggccctgcctgtggttcctgcctgggccttggctgctgctgtgtgagagctgcatgtgagcctgtgaccgtgagctggggtgagctgggccgcacctaccctggggccccagggagcaggacgctccggggcccagcacgttgccctgggcctgtggccggagtcggagtcctctctcctcctcctggcttttggaaaggcttggctgtgttggggagtctctcttagccctttcaggaatttctgttcaggcttcctcctcctcatcagctattttacccatctcagaacgtcctgtgtctccatgtaggagagtggctctctcagatctctcagggcgtctggttatagggaaacaagtggagcagggacgtggctttaattggagcactcggctgggctgcttggggagactcttccgtgcgttcttcctctggatagaaccaccacctcctgggcgtcactgacaagctccatcttaacctccaaagccacagaactaggggctcagagccagagctggcagccgccagccaaaatgatgccattgcctgagctgacagccaagcccttctgtgggtcacctttctcctcacccagccccttgctcttcccttttgaaaggcccgtgtgttttctttccttaccctgtgcttgctcatgtctactccggttttctctaccacatccttagagccatcacctggcacgcaggcgccttacattctacggtagaacgtggggtactgtgtgtgcacatagacacacttacgtggaattacagttgtgggtttatccaagatgaggaagatttcacctgctgtttaatagacttggggccatgtgcctccccacacatgggcaaggacaggtggaatgtcgggaccacactgtgcggcttctcggcacaaagcggagggaggctgtggtcgctgccggcctaggtgtcccaggtgccccgcctttctctgggacacagttgggggctggcttctgagggattcctttctcccctctttgtgtggccccagccagggcggtgggcagtcctggtgtagagcacaagcctctccaccctagagaaatgcctctgtaccacggctaccatgtggaaccttaacttgcagaaggcttgttaacaattgttttgagagagatggctggtcatgccacagctgctggggactccgcctactccagccctcttgggacacactgtgggatttgtggcccttccccagaggaattgtggagactgtcccatggaacaaaccctcaggcaccagcacagggctctgggtgactcagtaaaactaacgtttgtctctgacaagatcagctgtaggctcaccggccagagaagaccactgtgagcattttgccgtatatcctgccctgccatttgttcactttttaaactaaaataggaacatccgacacacaccgtttgcatcgtcttctcccttgatattttaagcattttcccatgtcatgagtttctcagaaacatgtttttaacaattgtactatttagtcattgtccatttactataatttatctgaccatttccctactgtaaaatacttaagacggtttctgatttttccactatttaaataatgctgtgatgaatatctttaaaatcttctgatttcttacttttttcccccttagatgcctggaagtggtattttgaggtgaaagagtttgttcattttgaagatatttctgtctctctctcgacctgatgtgtagacgctcacttccagtagcagaaccaccttagttgtgtcttacagattctgaacaaatcggtttctgataagccatgtgttccaaagaatgtctgaataagaccgctctttatttaaatgctaagaggatgtcactactgcaatccatctgtggccgattttttccaagagccaatttccttgttttggttgcaagaacctggctctgcctgcatgtcagctctctgccctccctgctgccgtggctttcaagcgcttggcagaatcttgtacttcgtgtccacaatggtactgaatttgcatctgcacagtcagcagagataacaagtgttgaactgaccttgccacatgcttagtgagtgatttgtaattaagtttatagactcagaaggtatattaggacatttggaatcagtagcagagcaaagcctctttgaaaaaaaccacgtagctgattgggttttacaagagtgcatttgtctcccccttccacccgtggggccccaccttcaggtcttagtggttcacaagagcccagcagccaggctggctttttcattgtagggcgtggttgtcccagctggtgtagatttcaggccgccccccccaactccctgcccacagtgttgcagattgcctggctggcagcaagtccagaccacccaaatttggttggattcttcatttctccactgtagttggggtccattgattgtgcaggggaacgtgcaggaggtttttctaggcaccgtgttcagtgctgcttcactctaccagagattatggccaaattgcacggaatttggtttcttgccctctgaagcctgagggcccccccttgcctggctggttgacagacccggggtggtcactgctgagacttcagagatcgcagctgctgtgagaatacggtgaaggtactttgttctggaagatgttgtcatacacttttccccagttattttcaaacttgacatgagcctatgttgactcactgggtgggggtcccttcttacgcagcacacgtggcaagtgcctgaatcggggctggaggcacttcagagcctctgaggggccaccacttctggcccaaaattgcagggttgtagatgaggctgcctgtggagaactggtgtgaggaggaagctgtttccaacaaagagcactttcatctgttgagatggctgtggtgagcaactgaacgagcctacgtgtgtacctgaattttccccgtaactcatttcttccatatgaagaaacaccaaactatgtacagagaactttttacaaaaggcagaccttttttaagctgtgtaacccacatagcctaaccacctggcagaatgactacgaataggggtcattgtgctggtaaaagcctctattacgactgtaagtaagttggatgttggcaaaattaaattgttacagtatttagagctgctgtagctgttccttcacaacataaaataggataaatgactagtacgtctttcaggtgggtggcaagcagaacatgcgtaatattctctacctggtctgtagctgtaactgtgatgtacagacaaagcaaaaattaaaagaacttatgaaaacaaatgcaatgatactaggatatacacttttgtatttttattcttatataaggttatttgctggctattgttggcctctagttcagtctgtgttatttaaattctaatatatgaattatttgaattgaattcatgttcggggccacgttgttgtatgtattgatgtacagccttgaatgtgaataattattgtaaactatattttacaactttttttctggctttattatataaattttctattgggtcagtgatttaatcatataatttaatgaatctgtttatcctttttttttttccaaatacttgtgctttaggtgtagttaccagatgatgaattttcctcgtatggtcagtagtcttgtaataaaaagcatgtagagtgta

SEQ ID NO: 102757 - DNA, 2416 bp, Homo sapiens
  Payload ID: 46
  Gene Symbol: PDPK1
  Gene Name: 3-phosphoinositide dependent protein kinase 1
  ENST ID: ENST00000389224
  CDS Start-End: 666-2255
gccggtttgttaccctgccgggtccggcggccgcccgggtccggcgaggcggggcggcccggggtcccgagggccgggtgcctccttacctgcagccgggcggccgggccggggatggcgggcgccggccgagggcgctgcttggctgcggcggggagaccgggcctgggttgcggcgggcggcggcctggccgggggcgctgacagacgcgcggagggcgggggaggccgggaggtgtcacccggcccagcggggtggaagtgcctggaaagtttgttttcggcttggcgcagcctggagccgagcctccagggttacctttcggttctgtctgtagaggaaccgccctgggcttccacctggaacggggtccttggcgcctccgcctgcgagagaagcagaaggtgcaagttcttgctgaaagcacctgatgctcctgggcccccttttccagattcttgatgacagtggtcgggaaaactcgcctttcacggcccggccaaggggcatttgggtgcttttgctgcccgtggctgtgctcagcgttgtgggaagcccctgggaggccgaatgtgcaggatcaccgaggggaaagtgagcttgacagtatgacgccgtgcccatccagtccagcgtggtgttatgttcctgcccatccccatcaatggtgaggacccagactgagtccagcacgccccctggcattcctggtggcagcaggcagggccccgccatggacggcactgcagccgagcctcggcccggcgccggctccctgcagcatgcccagcctccgccgcagcctcggaagaagcggcctgaggacttcaagtttgggaaaatccttggggaaggctctttttccacggttgtcctggctcgagaactggcaacctccagagaatatgcgattaaaattctggagaagcgacatatcataaaagagaacaaggtcccctatgtaaccagagagcgggatgtcatgtcgcgcctggatcaccccttctttgttaagctttacttcacatttcaggacgacgagaagctgtatttcggccttagttatgccaaaaatggagaactacttaaatatattcgcaaaatcggttcattcgatgagacctgtacccgattttacacggctgagattgtgtctgctttagagtacttgcacggcaagggcatcattcacagggaccttaaaccggaaaacattttgttaaatgaagatatgcacatccagatcacagattttggaacagcaaaagtcttatccccagagagcaaacaagccagggccaactcattcgtgggaacagcgcagtacgtttctccagagctgctcacggagaagtccgcctgtaagagttcagacctttgggctcttggatgcataatataccagcttgtggcaggactcccaccattccgagctggaaacgagtatcttatatttcagaagatcattaagttggaatatgactttccagaaaaattcttccctaaggcaagagacctcgtggagaaacttttggttttagatgccacaaagcggttaggctgtgaggaaatggaaggatacggacctcttaaagcacacccgttcttcgagtccgtcacgtgggagaacctgcaccagcagacgcctccgaagctcaccgcttacctgccggctatgtcggaagacgacgaggactgctatggcaattatgacaatctcctgagccagtttggctgcatgcaggtgtcttcgtcctcctcctcacactccctgtcagcctccgacacgggcctgccccagaggtcaggcagcaacatagagcagtacattcacgatctggactcgaactcctttgaactggacttacagttttccgaagatgagaagaggttgttgttggagaagcaggctggcggaaacccttggcaccagtttgtagaaaataatttaatactaaagatgggcccagtggataagcggaagggtttatttgcaagacgacgacagctgttgctcacagaaggaccacatttatattatgtggatcctgtcaacaaagttctgaaaggtgaaattccttggtcacaagaacttcgaccagaggccaagaattttaaaactttctttgtccacacgcctaacaggacgtattatctgatggaccccagcgggaacgcacacaagtggtgcaggaagatccaggaggtttggaggcagcgataccagagccacccggacgccgctgtgcagtgacgtggcctgcggccgggctgcccttcgctgccaggacacctgccccagcgcggcttggccgccatccgggacgcttccagaccacctgccagccatcacaaggggaacgcagaggcggaaaccttgcagcatttttatttaaaagaaaagaagaaaaaaaa

SEQ ID NO: 102758 - DNA, 1729 bp, Homo sapiens
  Payload ID: 46
  Gene Symbol: PDPK1
  Gene Name: 3-phosphoinositide dependent protein kinase 1
  Uniprot ID: O15530
  ENST ID: ENST00000441549
  CDS Start-End: 117-1481
ggcgggcgcaggatgagggcggccattgctggggctccgcttcggggaggaggacgctgaggaggcgccgagccgcgcagcgctgcgggggaggcgcccgcgccgacgcggggcccatggccaggaccaccagccagctgtatgacgccgtgcccatccagtccagcgtggtgttatgttcctgcccatccccatcaatggtgaggacccagactgagtccagcacgccccctggcattcctggtggcagcaggcagggccccgccatggacggcactgcagccgagcctcggcccggcgccggctccctgcagcatgcccagcctccgccgcagcctcggaagaagcggcctgaggacttcaagtttgggaaaatccttggggaaggctctttttccacggttgtcctggctcgagaactggcaacctccagagaatatgcgattaaaattctggagaagcgacatatcataaaagagaacaaggtcccctatgtaaccagagagcgggatgtcatgtcgcgcctggatcaccccttctttgttaagctttacttcacatttcaggacgacgagaagctgtatttcggccttagttatgccaaaaatggagaactacttaaatatattcgcaaaatcggttcattcgatgagacctgtacccgattttacacggctgagattgtgtctgctttagagtacttgcacggcaagggcatcattcacagggaccttaaaccggaaaacattttgttaaatgaagatatgcacatccagatcacagattttggaacagcaaaagtcttatccccagagagcaaacaagccagggccaactcattcgtgggaacagcgcagtacgtttctccagagctgctcacggagaagtccgcctgtaagagttcagacctttgggctcttggatgcataatataccagcttgtggcaggactcccaccattccgagctggaaacgagtatcttatatttcagaagatcattaagttggaatatgactttccagaaaaattcttccctaaggcaagagacctcgtggagaaacttttggttttagatgccacaaagcggttaggctgtgaggaaatggaaggatacggacctcttaaagcacacccgttcttcgagtccgtcacgtgggagaacctgcaccagcagacgcctccgaagctcaccgcttacctgccggctatgtcggaagacgacgaggactgctatggcaattatgacaatctcctgagccagtttggctgcatgcaggtgtcttcgtcctcctcctcacactccctgtcagcctccgacacgggcctgccccagaggtcaggcagcaacatagagcagtacattcacgatctggactcgaactcctttgaactggacttacagttttccgaagatgagaagaggttgttgttggagaagcaggctggcggaaacccttgcctaacaggacgtattatctgatggaccccagcgggaacgcacacaagtggtgcaggaagatccaggaggtttggaggcagcgataccagagccacccggacgccgctgtgcagtgacgtggcctgcggccgggctgcccttcgctgccaggacacctgccccagcgcggcttggccgccatccgggacgcttccagaccacctgccagccatcacaaggggaacgcagaggcggaaaccttgcagcatttttatttaaaagaaaagaag

SEQ ID NO: 102759 - DNA, 699 bp, Homo sapiens
  Payload ID: 46
  Gene Symbol: PDPK1
  Gene Name: 3-phosphoinositide dependent protein kinase 1
  ENST ID: ENST00000474706
  CDS Start-End: 94-201
cattgctggggctccgcttcggggaggaggacgctgaggaggcgccgagccgcgcagcgctgcgggggaggcgcccgcgccgacgcggggcccatggccaggaccaccagccagctgaggaaccgccctgggcttccacctggaacggggtccttggcgcctccgcctgcgagagaagcagaaggtgcaagttcttgctgaaagcacctgatgctcctgggcccccttttccagattcttgatgacagtggtcgggaaaactcgcctttcacggcccggccaaggggcatttgggtgcttttgctgcccgtggctgtgctcagcgttgtgggaagcccctgggaggccgaatgtgcaggatcaccgaggggaaagtgagcttgacagtatgacgccgtgcccatccagtccagcgtggtgttatgttcctgcccatccccatcaatggtgaggacccagactgagtccagcacgccccctggcattcctggtggcagcaggcagggccccgccatggacggcactgcagccgagcctcggcccggcgccggctccctgcagcatgcccagcctccgccgcagcctcggaagaagcggcctgaggacttcaagtttgggaaaatccttggggaaggctctttttccacggttgtcctggctcgagaactggcaacctccagagaatatgcgagtgagtat

SEQ ID NO: 102760 - DNA, 445 bp, Homo sapiens
  Payload ID: 46
  Gene Symbol: PDPK1
  Gene Name: 3-phosphoinositide dependent protein kinase 1
  ENST ID: ENST00000478708
  CDS Start-End: 1-121
ccaccattccgagctggaaacgagtatcttatatttcagaagatcattaagttggaatatgactttccagaaaaattcttccctaaggcaagagacctcgtggagaaacttttggttttagatgccacaaagcggttaggctgtgaggaaatggaaggatacggacctcttaaagcacacccgttcttcgagtccgtcacgtgggagaacctgcaccagcagacgcctccgaagctcaccgcttacctgccggctatgtcggaagacgacgaggactgctatggcaatggtgccgctagaaccggacgccgagcacccccggcactggccccggggtcccacgtacggggcctcctgcccggcctgtcgcatctgcgcttggcttggtgcttgtacaactgtgcggccaagatgctccagaacactgcctgtctttccacagaaa

SEQ ID NO: 102761 - DNA, 451 bp, Homo sapiens
  Payload ID: 46
  Gene Symbol: PDPK1
  Gene Name: 3-phosphoinositide dependent protein kinase 1
  ENST ID: ENST00000566659
  CDS Start-End: 188-451
gggggcggcgggcgacggggcgggcgcaggatgagggcggccattgctggggctccgcttcggggaggaggacgctgaggaggcgccgagccgcgcagcgctgcgggggaggcgcccgcgccgacgcggggcccatggccaggaccaccagccagctgggaccttaaaccggaaaacattttgttaaatgaagatatgcacatccagatcacagattttggaacagcaaaagtcttatccccagagagcaaacaagccagggccaactcattcgtgggaacagcgcagtacgtttctccagagctgctcacggagaagtccgcctgtaagagacctttgggctcttggatgcataatataccagcttgtggcaggactcccaccattccgagctggaaacgagtatcttatatttcagaagatcattaagttggaatatgactttccagaa

SEQ ID NO: 102762 - DNA, 611 bp, Homo sapiens
  Payload ID: 46
  Gene Symbol: PDPK1
  Gene Name: 3-phosphoinositide dependent protein kinase 1
  ENST ID: ENST00000461815
  CDS Start-End: 165-611
gtgaaattgagacctggcgcttcctgaggctggcagcccggttgagcctgaggaccagacttgaggcagttggcagtccgcgcctcgttgccctctgtctgccctggtatgacgccgtgcccatccagtccagcgtggtgttatgttcctgcccatccccatcaatggtgaggacccagactgagtccagcacgccccctggcattcctggtggcagcaggcagggccccgccatggacggcactgcagccgagcctcggcccggcgccggctccctgcagcatgcccagcctccgccgcagcctcggaagaagcggcctgaggacttcaagtttgggaaaatccttggggaaggctctttttccacggttgtcctggctcgagaactggcaacctccagagaatatgcgattaaaattctggagaagcgacatatcataaaagagaacaaggtcccctatgtaaccagagagcgggatgtcatgtcgcgcctggatcaccccttctttgttaagctttacttcacatttcaggacgacgagaagctgtatttcggccttagttatgccaaaaatggagaactacttaaatatattcgcaaaatcggttca

SEQ ID NO: 102763 - DNA, 552 bp, Homo sapiens
  Payload ID: 46
  Gene Symbol: PDPK1
  Gene Name: 3-phosphoinositide dependent protein kinase 1
  ENST ID: ENST00000492021
  CDS Start-End: 93-260
attgctggggctccgcttcggggaggaggacgctgaggaggcgccgagccgcgcagcgctgcgggggaggcgcccgcgccgacgcggggcccatggccaggaccaccagccagctgattcttgatgacagtggtcgggaaaactcgcctttcacggcccggccaaggggcatttgggtgcttttgctgcccgtggctgtgctcagcgttgtgggaagcccctgggaggccgaatgtgcaggatcaccgaggggaaagtgagcttgacagtatgacgccgtgcccatccagtccagcgtggtgttatgttcctgcccatccccatcaatggtgaggacccagactgagtccagcacgccccctggcattcctggtggcagcaggcagggccccgccatggacggcactgcagccgagcctcggcccggcgccggctccctgcagcatgcccagcctccgccgcagcctcggaagaagcggcctgaggacttcaagtttgggaaaatccttggggaaggctctttttccacggttgtcctggctcgagaactgg

SEQ ID NO: 102764 - DNA, 4836 bp, Homo sapiens
  Payload ID: 47
  Gene Symbol: ABAT
  Gene Name: 4-aminobutyrate aminotransferase
  Uniprot ID: P80404
  ENST ID: ENST00000268251
  CDS Start-End: 189-1691
ggccgggacgctcggcggagccagggagtccggcgagtcgctgggggaagtcgagcagacacccagcgctgccggaactcggggcgcgcatcccgcaagtcggaacccggcggatcggatcccgcagatcggagacggggcctggagggtggcagcacgcaaagggtgtccctgtccctcaaggggtcatggcctccatgttgctcgcccagcgcctggcctgcagcttccagcacagctaccgcctgctggtgcctggatccagacacattagtcaagctgcagccaaagtcgacgttgaatttgattatgatgggcctctgatgaagacggaagtcccagggcctagatctcaggagttaatgaaacagctgaatataattcagaatgcagaggctgtgcattttttctgcaattacgaagagagccgaggcaattacctggttgatgtggacggcaaccgaatgctggatctttattcccagatctcctctgtccccataggttacagccaccccgccctgctgaaactcatccaacagcctcaaaatgcgagcatgtttgtcaacagacccgccctcggaatcctgcctccggagaactttgtggagaagctccggcagtccttgctctcggtggctcccaaagggatgtcccagctcatcaccatggcctgcggctcctgctccaatgaaaacgccttaaagaccatcttcatgtggtaccggagcaaggaaagagggcagaggggcttctcccaggaggagctggagacgtgcatgattaaccaggcccctggctgccccgactacagcatcctctccttcatgggcgcgttccatgggaggaccatgggttgcttagcgaccacgcactctaaagccattcacaagatcgacatcccttcctttgactggcccatcgcaccgttcccacggctgaaataccctctggaagagtttgtgaaagagaaccaacaggaggaggcccgctgtctggaagaggtggaggatctgattgtgaaatatcggaaaaagaagaagacggtggccgggatcatcgtggagcccatccagtccgagggtggagacaaccacgcatccgatgacttctttcggaagctgagagacatcgccaggaagcatggctgcgccttcttggtggacgaggtccagaccggaggaggctgcacgggcaagttctgggcccatgagcactggggcctggatgacccagcagacgtgatgaccttcagcaagaagatgatgactgggggcttcttccacaaggaggagttcaggcctaatgctccctaccggatcttcaacacctggctgggggacccgtccaagaacctgttgctggctgaggtcatcaacatcatcaagcgggaggacctgctaaataatgcagcccatgccgggaaggccctgctcacaggactgctggacctccaggcccggtacccccagttcatcagcagggtgagaggacgaggcaccttttgctccttcgatactcccgatgattccatacggaataagctcattttaattgccagaaacaaaggtgtggtgttgggtggctgtggtgacaaatccattcgtttccgtcccacgctggtcttcagggatcaccacgctcacctgttcctcaatattttcagtgacatcttagcagacttcaagtaaagaagccatttccactacagtgagaaagcccggatcccaacagttgtcaaattgattagtttgcctaattcatgttttcacttaaaagtatcagaggtgaatgcacagtgaagggtgatttgtggggagggagcatttttggtggtcttgggggaggggaggggagggaagggctggtgttgattttcctccctgcagagccaatggtgcacattggtttaagcccagagatcctgcttgagccctggactcatcttgggaagggccatgggaggtcctggctagagttctgcccaaccttgaccaaccccagcaatttttccaaaagccagtcaagggcattacatttgttcctgggactggcagctgggcctcctgggtgccagtccatctcaagtgccatattctgtgatcacggatgttggctccccctcgccctatgcaagcaaacacactctcacctcctctcccagcctcccggagctctgagcacgccccacgcatggtgcaggagggactggacagatctgaggaaggccgtaaaatggggacaggaggattcagctcaggagtaagggaagaggtcctctggccccctgaagatgagaatcacccctctcagtgcacctggggatccccctaaactgtgaattctgccctggacagggctttgcccttggaggatccccaggtggccttacccgtgattcttactcggcatcctccattccccaaactccctcctccctgttaaatgtcaacctagacctggacctgggtgggaggaaactgtagcctgagtgtccacagggacacacgtgagccacagggctagaagcacaggcccgtcaccccaggaggaaaagcccagggtctggggcagcagagccatcgcatcatgtttcccagggcaacttgaggtctgacttttggctccctcgccctaagaggctcttcctctcttttgctcatccaccttcacaccacttgtgagctgacccccaggaacagcttggctgttccaccagagcagagggaatcattgctggactggatttcttctggagggaagcaccatgaattaaaggtgccagagctccatgcatggaaaagtggcctgttggttcaacgtggtttccttgtacttgatcctcctgaaatgagagattttcctgagatgactgagtatggagattaccaggcagatgataccgaaatgcttaaaggggctgtggctgaggctgtagcatctctgctggaggtgagacactctgggaactgatttgacctcgaatgctcctaaaagagaacttgatagcctgacagcagagaagtattatttggtggggagtctgagaaagcctggcttgtattatctgtccaaaaggaagcctcttcatctcccggtgccttggttgactattttggaaataggcatatcaaggttcctgattcagcactttgctcttttaataacaaatcgtccaaagatctcaaagtaagggtttttttttttagcttccactcttccgcagacttggtcatcgacctatttttgttgaagaatgaaaggcaatgacaagtttaacatatacaaattcgtgaattcttgttcattttgcattcctgcagtcagtgctaatccgtcgttcttaatcaggagttctgccaggtttaaggtcacctgcactcccagccaagtggtgatgtatgcctcccactctctgcaaggttttcctcatttttatattcatttattcatcattcattcattcacctaactttcattaaatagctgcaccatcccaggccctgtgcggagcatcgggaatacaaagatgagataaaacattgtccctgcccccgggggctcacatgccactggaaacaacagactcttaaactaacaattcaagcaggcgccaagtgctatgacagaggtgtgaataaaagcatcaggaaatcggatggagaaccaccattcacccaagggtcagaggaggtttcaaagaaaaggtgtcattggagcagtgttttgcagaatgagccagagttcaccaagcaggcaaggcaaggaagggtgttgcagagagggaacagcatatgcaaaggcgtatcagttcatggcatcacatctttcactggggaagccagtttccacaggcagcatcccaaggttcaataaggccttatttaacaagcaagcaaaatgcaaaccaaaccattattcatttattggcttaagtatgctttctcctgaaaactttagcattgggtgcaaatattcagtatggttctcggagtccaaagggttttaagccagggcacaaccagaaaagtggctctctttggtagggagaggggctccaatatttcgttctctccccatggggcactgacagagaaatgaaatagttttatctggaaaattccagagctattatttactccttaccaagggaagttacttcttgtaaaaacttttaagccatttatcaacaagttcttgttgactcagggcataatgagttcctgagacatgctcttttgggggctggggctttagctagaagaatttcaaggaaaagaattctcagcagagctcaagattgtagaaactcagcagaagctggtaaaaacatggggagcccggaggacaggctgctgtccagggcagaggccatgaagaagtgcttccgtggccgacagtctggaaatgaatccatcatacattagtgccatagagtttagtaaccgtccagcaagtgtcatcacttttacagaaaacaaggtccagtaatagcaagtcttagtacatcctcacttttattataaatgggtgttttttcataatttttactgacgctcagtaaccatgcaaaattgtgtatagcattaatgtatctacatacctacacctatctatatataagctcatggtagaaaaccatagctaagtagcatcgcagacttaagcgtacaaagtgatcttgttcacaagtaatctgttgacagtgccaataaatgataaaaaaaaaattaacatgtcacaatgtaacggatgaccatatgcacaattccatgaattaaatctgtttcctgtgttagtcagtattcttaaataaaatttataattgaaacatga

SEQ ID NO: 102765 - DNA, 5586 bp, Homo sapiens
  Payload ID: 47
  Gene Symbol: ABAT
  Gene Name: 4-aminobutyrate aminotransferase
  Uniprot ID: P80404
  ENST ID: ENST00000396600
  CDS Start-End: 939-2441
tcttgtgatcaccctcattacctcttctgggccccctgtggacctgcgttgacccagcatgggctacaatgggggagttgggtaatcgctcccggtaggttcctccccaacccccgaggcggggtcaggtggagcgtgggcgccagagcagcccctctgccttgggtgtcttggagatgacttggcgccccccggagccccgtcatggctgtggctgcgtccacaacactgcatcagcagagtcctggggaagccatttaggaatctgaagcccgggatttctgctttgtcccttcaggggttcctgagcctgttaaaaaaaaaaaaaaatctaggaagaggccctggaaggaaaaaggggagggagatagcctattttacaaggtctgaaatgatgtgtcttatccttctggcttaaaccaagctgggcttaaaacatcttttaaaaaaaatctgtattctatttttttctctctgtttatcgctctccttctgcctctgttaatctttgtttctgtgtagttgcatcctgtttctgtctgaaaacccttgtctttctgaatccatctttcagtctctcacattctgtctttcccctcctccttcaccttccctccgtccctctcccttgcgcacttgccgggtaccagctgagtgcatccttttcccaaacctgctctgcttccaaggggcccttttctgtctcctccacctgtccccatgttttggggactgcctggaaatccgggacaccctcctgaggagggagctggtgcccaacggcacctcttaggatgaacccagccagctgcgttcctggcctctgcagaatggcatacagaaggcattttaagcaagcgagctgagctcgccgcaggactccgactaccaggcaccggtggcagcacgcaaagggtgtccctgtccctcaaggggtcatggcctccatgttgctcgcccagcgcctggcctgcagcttccagcacagctaccgcctgctggtgcctggatccagacacattagtcaagctgcagccaaagtcgacgttgaatttgattatgatgggcctctgatgaagacggaagtcccagggcctagatctcaggagttaatgaaacagctgaatataattcagaatgcagaggctgtgcattttttctgcaattacgaagagagccgaggcaattacctggttgatgtggacggcaaccgaatgctggatctttattcccagatctcctctgtccccataggttacagccaccccgccctgctgaaactcatccaacagcctcaaaatgcgagcatgtttgtcaacagacccgccctcggaatcctgcctccggagaactttgtggagaagctccggcagtccttgctctcggtggctcccaaagggatgtcccagctcatcaccatggcctgcggctcctgctccaatgaaaacgccttaaagaccatcttcatgtggtaccggagcaaggaaagagggcagaggggcttctcccaggaggagctggagacgtgcatgattaaccaggcccctggctgccccgactacagcatcctctccttcatgggcgcgttccatgggaggaccatgggttgcttagcgaccacgcactctaaagccattcacaagatcgacatcccttcctttgactggcccatcgcaccgttcccacggctgaaataccctctggaagagtttgtgaaagagaaccaacaggaggaggcccgctgtctggaagaggtggaggatctgattgtgaaatatcggaaaaagaagaagacggtggccgggatcatcgtggagcccatccagtccgagggtggagacaaccacgcatccgatgacttctttcggaagctgagagacatcgccaggaagcatggctgcgccttcttggtggacgaggtccagaccggaggaggctgcacgggcaagttctgggcccatgagcactggggcctggatgacccagcagacgtgatgaccttcagcaagaagatgatgactgggggcttcttccacaaggaggagttcaggcctaatgctccctaccggatcttcaacacctggctgggggacccgtccaagaacctgttgctggctgaggtcatcaacatcatcaagcgggaggacctgctaaataatgcagcccatgccgggaaggccctgctcacaggactgctggacctccaggcccggtacccccagttcatcagcagggtgagaggacgaggcaccttttgctccttcgatactcccgatgattccatacggaataagctcattttaattgccagaaacaaaggtgtggtgttgggtggctgtggtgacaaatccattcgtttccgtcccacgctggtcttcagggatcaccacgctcacctgttcctcaatattttcagtgacatcttagcagacttcaagtaaagaagccatttccactacagtgagaaagcccggatcccaacagttgtcaaattgattagtttgcctaattcatgttttcacttaaaagtatcagaggtgaatgcacagtgaagggtgatttgtggggagggagcatttttggtggtcttgggggaggggaggggagggaagggctggtgttgattttcctccctgcagagccaatggtgcacattggtttaagcccagagatcctgcttgagccctggactcatcttgggaagggccatgggaggtcctggctagagttctgcccaaccttgaccaaccccagcaatttttccaaaagccagtcaagggcattacatttgttcctgggactggcagctgggcctcctgggtgccagtccatctcaagtgccatattctgtgatcacggatgttggctccccctcgccctatgcaagcaaacacactctcacctcctctcccagcctcccggagctctgagcacgccccacgcatggtgcaggagggactggacagatctgaggaaggccgtaaaatggggacaggaggattcagctcaggagtaagggaagaggtcctctggccccctgaagatgagaatcacccctctcagtgcacctggggatccccctaaactgtgaattctgccctggacagggctttgcccttggaggatccccaggtggccttacccgtgattcttactcggcatcctccattccccaaactccctcctccctgttaaatgtcaacctagacctggacctgggtgggaggaaactgtagcctgagtgtccacagggacacacgtgagccacagggctagaagcacaggcccgtcaccccaggaggaaaagcccagggtctggggcagcagagccatcgcatcatgtttcccagggcaacttgaggtctgacttttggctccctcgccctaagaggctcttcctctcttttgctcatccaccttcacaccacttgtgagctgacccccaggaacagcttggctgttccaccagagcagagggaatcattgctggactggatttcttctggagggaagcaccatgaattaaaggtgccagagctccatgcatggaaaagtggcctgttggttcaacgtggtttccttgtacttgatcctcctgaaatgagagattttcctgagatgactgagtatggagattaccaggcagatgataccgaaatgcttaaaggggctgtggctgaggctgtagcatctctgctggaggtgagacactctgggaactgatttgacctcgaatgctcctaaaagagaacttgatagcctgacagcagagaagtattatttggtggggagtctgagaaagcctggcttgtattatctgtccaaaaggaagcctcttcatctcccggtgccttggttgactattttggaaataggcatatcaaggttcctgattcagcactttgctcttttaataacaaatcgtccaaagatctcaaagtaagggtttttttttttagcttccactcttccgcagacttggtcatcgacctatttttgttgaagaatgaaaggcaatgacaagtttaacatatacaaattcgtgaattcttgttcattttgcattcctgcagtcagtgctaatccgtcgttcttaatcaggagttctgccaggtttaaggtcacctgcactcccagccaagtggtgatgtatgcctcccactctctgcaaggttttcctcatttttatattcatttattcatcattcattcattcacctaactttcattaaatagctgcaccatcccaggccctgtgcggagcatcgggaatacaaagatgagataaaacattgtccctgcccccgggggctcacatgccactggaaacaacagactcttaaactaacaattcaagcaggcgccaagtgctatgacagaggtgtgaataaaagcatcaggaaatcggatggagaaccaccattcacccaagggtcagaggaggtttcaaagaaaaggtgtcattggagcagtgttttgcagaatgagccagagttcaccaagcaggcaaggcaaggaagggtgttgcagagagggaacagcatatgcaaaggcgtatcagttcatggcatcacatctttcactggggaagccagtttccacaggcagcatcccaaggttcaataaggccttatttaacaagcaagcaaaatgcaaaccaaaccattattcatttattggcttaagtatgctttctcctgaaaactttagcattgggtgcaaatattcagtatggttctcggagtccaaagggttttaagccagggcacaaccagaaaagtggctctctttggtagggagaggggctccaatatttcgttctctccccatggggcactgacagagaaatgaaatagttttatctggaaaattccagagctattatttactccttaccaagggaagttacttcttgtaaaaacttttaagccatttatcaacaagttcttgttgactcagggcataatgagttcctgagacatgctcttttgggggctggggctttagctagaagaatttcaaggaaaagaattctcagcagagctcaagattgtagaaactcagcagaagctggtaaaaacatggggagcccggaggacaggctgctgtccagggcagaggccatgaagaagtgcttccgtggccgacagtctggaaatgaatccatcatacattagtgccatagagtttagtaaccgtccagcaagtgtcatcacttttacagaaaacaaggtccagtaatagcaagtcttagtacatcctcacttttattataaatgggtgttttttcataatttttactgacgctcagtaaccatgcaaaattgtgtatagcattaatgtatctacatacctacacctatctatatataagctcatggtagaaaaccatagctaagtagcatcgcagacttaagcgtacaaagtgatcttgttcacaagtaatctgttgacagtgccaataaatgataaaaaaaaaattaacatgtcacaatgtaacggatgaccatatgcacaattccatgaattaaatctgtttcctgtgttagtcagtattcttaaataaaatttataattgaaacatga

SEQ ID NO: 102766 - DNA, 1923 bp, Homo sapiens
  Payload ID: 47
  Gene Symbol: ABAT
  Gene Name: 4-aminobutyrate aminotransferase
  Uniprot ID: P80404
  ENST ID: ENST00000425191
  CDS Start-End: 261-1763
tttgtgtccctttgagtctgcagagaagccagcagctggggctgcagacgggaaaggaatgtcctcagcgtctgccagcacttttgtcttggtcccaacggctgataggaaaatgagaggcagggtcttttctagagagatctggggggtccatttctagccgatgatgcatgcaaagagttcgtgttcacaggacctgggaagcagcggagtagaaagggtggcagcacgcaaagggtgtccctgtccctcaaggggtcatggcctccatgttgctcgcccagcgcctggcctgcagcttccagcacagctaccgcctgctggtgcctggatccagacacattagtcaagctgcagccaaagtcgacgttgaatttgattatgatgggcctctgatgaagacggaagtcccagggcctagatctcaggagttaatgaaacagctgaatataattcagaatgcagaggctgtgcattttttctgcaattacgaagagagccgaggcaattacctggttgatgtggacggcaaccgaatgctggatctttattcccagatctcctctgtccccataggttacagccaccccgccctgctgaaactcatccaacagcctcaaaatgcgagcatgtttgtcaacagacccgccctcggaatcctgcctccggagaactttgtggagaagctccggcagtccttgctctcggtggctcccaaagggatgtcccagctcatcaccatggcctgcggctcctgctccaatgaaaacgccttaaagaccatcttcatgtggtaccggagcaaggaaagagggcagaggggcttctcccaggaggagctggagacgtgcatgattaaccaggcccctggctgccccgactacagcatcctctccttcatgggcgcgttccatgggaggaccatgggttgcttagcgaccacgcactctaaagccattcacaagatcgacatcccttcctttgactggcccatcgcaccgttcccacggctgaaataccctctggaagagtttgtgaaagagaaccaacaggaggaggcccgctgtctggaagaggtggaggatctgattgtgaaatatcggaaaaagaagaagacggtggccgggatcatcgtggagcccatccagtccgagggtggagacaaccacgcatccgatgacttctttcggaagctgagagacatcgccaggaagcatggctgcgccttcttggtggacgaggtccagaccggaggaggctgcacgggcaagttctgggcccatgagcactggggcctggatgacccagcagacgtgatgaccttcagcaagaagatgatgactgggggcttcttccacaaggaggagttcaggcctaatgctccctaccggatcttcaacacctggctgggggacccgtccaagaacctgttgctggctgaggtcatcaacatcatcaagcgggaggacctgctaaataatgcagcccatgccgggaaggccctgctcacaggactgctggacctccaggcccggtacccccagttcatcagcagggtgagaggacgaggcaccttttgctccttcgatactcccgatgattccatacggaataagctcattttaattgccagaaacaaaggtgtggtgttgggtggctgtggtgacaaatccattcgtttccgtcccacgctggtcttcagggatcaccacgctcacctgttcctcaatattttcagtgacatcttagcagacttcaagtaaagaagccatttccactacagtgagaaagcccggatcccaacagttgtcaaattgattagtttgcctaattcatgttttcacttaaaagtatcagaggtgaatgcacagtgaagggtgatttgtggggagggagcatttttggtggtcttgggggagggga

SEQ ID NO: 102767 - DNA, 580 bp, Homo sapiens
  Payload ID: 47
  Gene Symbol: ABAT
  Gene Name: 4-aminobutyrate aminotransferase
  ENST ID: ENST00000565016
  CDS Start-End: 307-580
gcacttgccgggtaccagctgagtgcatccttttcccaaacctgctctgcttccaaggggcccttttctgtctcctccacctgtccccatgttttggggactgcctggaaatccgggacaccctcctgaggagggagctggtgcccaacggcacctcttaggatgaacccagccagctgcgttcctggcctctgcagaatggcatacagaaggcattttaagcaagcgagctgagctcgccgcaggactccgactaccaggcaccggtggcagcacgcaaagggtgtccctgtccctcaaggggtcatggcctccatgttgctcgcccagcgcctggcctgcagcttccagcacagctaccgcctgctggtgcctggatccaatccaggatccagacacattagtcaagctgcagccaaagtcgacgttgaatttgattatgatgggcctctgatgaagacggaagtcccagggcctagatctcaggagttaatgaaacagctgaatataattcagaatgcagaggctgtgcattttttctgcaattacgaagagagccgaggcaattacctggttgatg

SEQ ID NO: 102768 - DNA, 1911 bp, Homo sapiens
  Payload ID: 47
  Gene Symbol: ABAT
  Gene Name: 4-aminobutyrate aminotransferase
  ENST ID: ENST00000569156
  CDS Start-End: 258-1805
gtgtccctttgagtctgcagagaagccagcagctggggctgcagacgggaaaggaatgtcctcagcgtctgccagcacttttgtcttggtcccaacggctgataggaaaatgagaggcagggtcttttctagagagatctggggggtccatttctagccgatgatgcatgcaaagagttcgtgttcacaggacctgggaagcagcggagtagaaagggtggcagcacgcaaagggtgtccctgtccctcaaggggtcatggcctccatgttgctcgcccagcgcctggcctgcagcttccagcacagctaccgcctgctggtgcctggatccagacacattagtcaagctgcagccaaagtcgacgttgaatttgattatgatgggcctctgatgaagacggaagtcccagggcctagatctcaggagttaatgaaacagctgaatataattcagaatgcagaggctgtgcattttttctgcaattacgaagagagccgaggcaattacctggttgatgtggacggcaaccgaatgctggatctttattcccagatctcctctgtccccataggttacagccaccccgccctgctgaaactcatccaacagcctcaaaatgcgagcatgtttgtcaacagacccgccctcggaatcctgcctccggagaactttgtggagaagctccggcagtccttgctctcggtggctcccaaagggatgtcccagctcatcaccatggcctgcggctcctgctccaatgaaaacgccttaaagaccatcttcatgtggtaccggagcaaggaaagagggcagaggggcttctcccaggaggagctggagacgtgcatgattaaccaggcccctggctgccccgactacagcatcctctccttcatgggcgcgttccatgggaggaccatgggttgcttagcgaccacgcactctaaagccattcacaagatcgacatcccttcctttgactggcccatcgcaccgttcccacggctgaaataccctctggaagagtttgtgaaagagaaccaacaggaggaggcccgctgtctggaagaggtggaggatctgattgtgaaatatcggaaaaagaagaagacggtggccgggatcatcgtggagcccatccagtccgagggtggagacaaccacgcatccgatgacttctttcggaagctgagagacatcgccaggaagcatggctgcgccttcttggtggacgaggtccagaccggaggaggctgcacgggcaagttctgggcccatgagcactggggcctggatgacccagcagacgtgatgaccttcagcaagaagatgatgactgggggcttcttccacaaggaggagttcaggcctaatgctccctaccggatcttcaacacctggctgggggacccgtccaagaacctgttgctggctgaggtcatcaacatcatcaagcgggaggacctgctaaataatgcagcccatgccgggaaggccctgctcacaggactgctggacctccaggcccggtacccccagttcatcagcagggtgagaggacgaggcaccttttgctccttcgatactcccgatgattccatacggaataagctcattttaattgccagaaacaaagctctcccagcatgtgactttgagaaaccacgctcctcacctacctcctgcctctttcaggtgtggtgttgggtggctgtggtgacaaatccattcgtttccgtcccacgctggtcttcagggatcaccacgctcacctgttcctcaatattttcagtgacatcttagcagacttcaagtaaagaagccatttccactacagtgagaaagcccggatcccaacagttgtcaaattgattagtttgcctaattcatgttttcacttaaaagtatc

SEQ ID NO: 102769 - DNA, 580 bp, Homo sapiens
  Payload ID: 47
  Gene Symbol: ABAT
  Gene Name: 4-aminobutyrate aminotransferase
  ENST ID: ENST00000568847
  CDS Start-End: 486-580
gatttagaaccagtgtgtctctcctgcagcctccattctgggtgcctccacccccttgccgtcgtcatgttgcatcctgtttctgtctgaaaacccttgtctttctgaatccatctttcagtctctcacattctgtctttcccctcctccttcaccttccctccgtccctctcccttgcgcacttgccgggtaccagctgagtgcatccttttcccaaacctgctctgcttccaaggggcccttttctgtctcctccacctgtccccatgttttggggactgcctggaaatccgggacaccctcctgaggagggagctggtgcccaacggcacctcttaggatgaacccagccagctgcgttcctggcctctgcagaatggcatacagaaggcattttaagcaagcgagctgagctcgccgcaggactccgactaccaggcaccggtggcagcacgcaaagggtgtccctgtccctcaaggggtcatggcctccatgttgctcgcccagcgcctggcctgcagcttccagcacagctaccgcctgctggtgcctggatccagacacattagtcaagctgc

SEQ ID NO: 102770 - DNA, 2423 bp, Homo sapiens
  Payload ID: 47
  Gene Symbol: ABAT
  Gene Name: 4-aminobutyrate aminotransferase
  ENST ID: ENST00000566590
  CDS Start-End: 918-1079
ctcttctgggccccctgtggacctgcgttgacccagcatgggctacaatgggggagttgggtaatcgctcccggtaggttcctccccaacccccgaggcggggtcaggtggagcgtgggcgccagagcagcccctctgccttgggtgtcttggagatgacttggcgccccccggagccccgtcatggctgtggctgcgtccacaacactgcatcagcagagtcctggggaagccatttaggaatctgaagcccgggatttctgctttgtcccttcaggggttcctgagcctgttaaaaaaaaaaaaaaatctaggaagaggccctggaaggaaaaaggggagggagatagcctattttacaaggtctgaaatgatgtgtcttatccttctggcttaaaccaagctgggcttaaaacatcttttaaaaaaaatctgtattctatttttttctctctgtttatcgctctccttctgcctctgttaatctttgtttctgtgtagttgcatcctgtttctgtctgaaaacccttgtctttctgaatccatctttcagtctctcacattctgtctttcccctcctccttcaccttccctccgtccctctcccttgcgcacttgccgggtaccagctgagtgcatccttttcccaaacctgctctgcttccaaggggcccttttctgtctcctccacctgtccccatgttttggggactgcctggaaatccgggacaccctcctgaggagggagctggtgcccaacggcacctcttaggatgaacccagccagctgcgttcctggcctctgcagaatggcatacagaaggcattttaagcaagcgagctgagctcgccgcaggactccgactaccaggcaccggtggcagcacgcaaagggtgtccctgtccctcaaggggtcatggcctccatgttgctcgcccagcgcctggcctgcagcttccagcacagctaccgcctgctggtgcctggagttaatgaaacagctgaatataattcagaatgcagaggctgtgcattttttctgcaattacgaagagagccgaggcaattacctggttgatgtggacggcaaccgaatgctggatctttattcccagatctcctctgtccccataggttacagccaccccgccctgctgaaactcatccaacagcctcaaaatgcgagcatgtttgtcaacagacccgccctcggaatcctgcctccggagaactttgtggagaagctccggcagtccttgctctcggtggctcccaaagggatgtcccagctcatcaccatggcctgcggctcctgctccaatgaaaacgccttaaagaccatcttcatgtggtaccggagcaaggaaagagggcagaggggcttctcccaggaggagctggagacgtgcatgattaaccaggcccctggctgccccgactacagcatcctctccttcatgggcgcgttccatgggaggaccatgggttgcttagcgaccacgcactctaaagccattcacaagatcgacatcccttcctttgactggcccatcgcaccgttcccacggctgaaataccctctggaagagtttgtgaaagagaaccaacaggaggaggcccgctgtctggaagaggtggaggatctgattgtgaaatatcggaaaaagaagaagacggtggccgggatcatcgtggagcccatccagtccgagggtggagacaaccacgcatccgatgacttctttcggaagctgagagacatcgccaggaagcatggctgcgccttcttggtggacgaggtccagaccggaggaggctgcacgggcaagttctgggcccatgagcactggggcctggatgacccagcagacgtgatgaccttcagcaagaagatgatgactgggggcttcttccacaaggaggagttcaggcctaatgctccctaccggatcttcaacacctggctgggggacccgtccaagaacctgttgctggctgaggtcatcaacatcatcaagcgggaggacctgctaaataatgcagcccatgccgggaaggccctgctcacaggactgctggacctccaggcccggtacccccagttcatcagcagggtgagaggacgaggcaccttttgctccttcgatactcccgatgattccatacggaataagctcattttaattgccagaaacaaaggtgtggtgttgggtggctgtggtgacaaatccattcgtttccgtcccacgctggtcttcagggatcaccacgctcacctgttcctcaatattttcagtgacatcttagcagacttcaagtaaagaagccatttccactacagtgagaaagcccggatcccaacagttgtcaaattgattagtttgcctaattcatgttttcacttaaaagtatcagaggtgaa

SEQ ID NO: 102771 - DNA, 634 bp, Homo sapiens
  Payload ID: 47
  Gene Symbol: ABAT
  Gene Name: 4-aminobutyrate aminotransferase
  ENST ID: ENST00000562115
  CDS Start-End: 155-508
aggaaaatgagaggcagggtcttttctagagagatctggggggtccatttctagccgatgatgcatgcaaagagttcgtgttcacaggacctgggaagcagcggagtagaaagggtggcagcacgcaaagggtgtccctgtccctcaaggggtcatggcctccatgttgctcgcccagcgcctggcctgcagcttccagcacagctaccgcctgctggtgcctggatccagacacattagtcaagctgcagccaaagtcgacgttgaatttgattatgatgggcctctgatgaagacggaagtcccagggcctagatctcaggagttaatgaaacagctgaatataattcagaatgcagaggctgtgcattttttctgcaattacgaagagagccgaggcaattacctggttgatgtggacggcaaccgaatgctggatctttattcccagatctcctctgtccccatagagtctcactgtcacccaggctggagtgcagtggcgtgatctcaactcaatgcaacctccgcctcttgtgttcaagagattcttctgcctcagccccccgagtacctgggattacaggttacagccaccccgccctgctgaaactcatccaacagcctcaaaatg

SEQ ID NO: 102772 - DNA, 592 bp, Homo sapiens
  Payload ID: 47
  Gene Symbol: ABAT
  Gene Name: 4-aminobutyrate aminotransferase
  ENST ID: ENST00000561870
  CDS Start-End: 397-592
ataccccctccccatcttgtgatcaccctcattacctcttctgggccccctgtggacctgcgttgacccagcatgggctacaatgggggagttgggtaatcgctcccgctgagtgcatccttttcccaaacctgctctgcttccaaggggcccttttctgtctcctccacctgtccccatgttttggggactgcctggaaatccgggacaccctcctgaggagggagctggtgcccaacggcacctcttaggatgaacccagccagctgcgttcctggcctctgcagaatggcatacagaaggcattttaagcaagcgagctgagctcgccgcaggactccgactaccaggcaccggtggcagcacgcaaagggtgtccctgtccctcaaggggtcatggcctccatgttgctcgcccagcgcctggcctgcagcttccagcacagctaccgcctgctggtgcctggatccagacacattagtcaagctgcagccaaagtcgacgttgaatttgattatgatgggcctctgatgaagacggaagtcccagggcctagatctcaggagttaatgaaacagctgaatataattc

SEQ ID NO: 102773 - DNA, 1959 bp, Homo sapiens
  Payload ID: 47
  Gene Symbol: ABAT
  Gene Name: 4-aminobutyrate aminotransferase
  ENST ID: ENST00000567812
  CDS Start-End: 263-1810
accagctgagtgcatccttttcccaaacctgctctgcttccaaggggcccttttctgtctcctccacctgtccccatgttttggggactgcctggaaatccgggacaccctcctgaggagggagctggtgcccaacggcacctcttaggatgaacccagccagctgcgttcctggcctctgcagaatggcatacagaaggcattttaagcaagcgagctgagctcgccgcaggactccgactaccaggcaccgtgagtgcaaatgtggtggcagcacgcaaagggtgtccctgtccctcaaggggtcatggcctccatgttgctcgcccagcgcctggcctgcagcttccagcacagctaccgcctgctggtgcctggatccagacacattagtcaagctgcagccaaagtcgacgttgaatttgattatgatgggcctctgatgaagacggaagtcccagggcctagatctcaggagttaatgaaacagctgaatataattcagaatgcagaggctgtgcattttttctgcaattacgaagagagccgaggcaattacctggttgatgtggacggcaaccgaatgctggatctttattcccagatctcctctgtccccataggttacagccaccccgccctgctgaaactcatccaacagcctcaaaatgcgagcatgtttgtcaacagacccgccctcggaatcctgcctccggagaactttgtggagaagctccggcagtccttgctctcggtggctcccaaagggatgtcccagctcatcaccatggcctgcggctcctgctccaatgaaaacgccttaaagaccatcttcatgtggtaccggagcaaggaaagagggcagaggggcttctcccaggaggagctggagacgtgcatgattaaccaggcccctggctgccccgactacagcatcctctccttcatgggcgcgttccatgggaggaccatgggttgcttagcgaccacgcactctaaagccattcacaagatcgacatcccttcctttgactggcccatcgcaccgttcccacggctgaaataccctctggaagagtttgtgaaagagaaccaacaggaggaggcccgctgtctggaagaggtggaggatctgattgtgaaatatcggaaaaagaagaagacggtggccgggatcatcgtggagcccatccagtccgagggtggagacaaccacgcatccgatgacttctttcggaagctgagagacatcgccaggaagcatggctgcgccttcttggtggacgaggtccagaccggaggaggctgcacgggcaagttctgggcccatgagcactggggcctggatgacccagcagacgtgatgaccttcagcaagaagatgatgactgggggcttcttccacaaggaggagttcaggcctaatgctccctaccggatcttcaacacctggctgggggacccgtccaagaacctgttgctggctgaggtcatcaacatcatcaagcgggaggacctgctaaataatgcagcccatgccgggaaggccctgctcacaggactgctggacctccaggcccggtacccccagttcatcagcagggtgagaggacgaggcaccttttgctccttcgatactcccgatgattccatacggaataagctcattttaattgccagaaacaaaggtgtggtgttgggtggctgtggtgacaaatccattcgtttccgtcccacgctggtcttcagggatcaccacgctcacctgttcctcaatattttcagtgacatcttagcagacttcaagtaaagaagccatttccactacagtgagaaagcccggatcccaacagttgtcaaattgattagtttgcctaattcatgttttcacttaaaagtatcagaggtgaatgcacagtgaagggtgatttgtggggagggagcatttttggtggtctt

SEQ ID NO: 102774 - DNA, 466 bp, Homo sapiens
  Payload ID: 47
  Gene Symbol: ABAT
  Gene Name: 4-aminobutyrate aminotransferase
  ENST ID: ENST00000564714
  CDS Start-End: 180-466
ggcgagtcgctgggggaagtcgagcagacacccagcgctgccggaactcggggcgcgcatcccgcaagtcggaacccggcggatcggatcccgcagatcggagacggggcctggagatgcgcccatccagggtctagcggattgcaaagggcctggtagaatcaaagagggatatactaatgcaacttcgagggtggcagcacgcaaagggtgtccctgtccctcaaggggtcatggcctccatgttgctcgcccagcgcctggcctgcagcttccagcacagctaccgcctgctggtgcctggatccagacacattagtcaagctgcagccaaagtcgacgttgaatttgattatgatgggcctctgatgaagacggaagtcccagggcctagatctcaggagttaatgaaacagctgaatataattcagaatgcagaggctgtgcattttttctgcaattacga

SEQ ID NO: 102775 - DNA, 384 bp, Homo sapiens
  Payload ID: 48
  Gene Symbol: HOGA1
  Gene Name: 4-hydroxy-2-oxoglutarate aldolase 1
  ENST ID: ENST00000370642
  CDS Start-End: 1-256
cagcggtggtgatgtgaccaggattgggctgattgttcacaagaccaggaagcaggattttcaggtgttggctggatcggctggctttctgatggccagctatgccttgggagctgtggggggcgtctgcgccctggccaatgtcctgggggctcaggtgtgccagctggagcgactgtgctgcacggggcaatgggaagatgcccagaaactgcagcaccgcctcattgagccaaacgctgcgaaaatcctttgagagaacatcccagtgtgggaactccttgtgactcccagaaaatcctgacttcggacaaagtcgagcaccactgattgtcaaacttaagtgtgcattaaaatttccttgggggcgaattaaagttccaa

SEQ ID NO: 102776 - DNA, 2488 bp, Homo sapiens
  Payload ID: 48
  Gene Symbol: HOGA1
  Gene Name: 4-hydroxy-2-oxoglutarate aldolase 1
  Uniprot ID: Q86XE5
  ENST ID: ENST00000370646
  CDS Start-End: 362-1345
ggctgggcttctggcttcagagctgggaattgtgggaggagggcccagatcccactggagataccgaaggagatactctttagtattgggatcccagaaaccagtcctatatctggccagagggacactgggttgtggcatctctctagctgctacccagaaggaacagggccccctggggcctataggccttgcccctgaccctgggaacacccagctcaggcctgccccagtggccacaagtcagggaggccgcaaatttttaactagaaacattgatcattaatagggggttagaaagagttcaaactaagtctcactctgggacatagaccaattgtgcttcaggcctcctgcagagatgctgggtccccaagtctggtcttctgtgaggcaggggctaagcaggagcttgtccaggaatgtgggggtctgggcctcaggggaggggaagaaggtggacattgcgggtatctacccccctgtgaccacccccttcactgccactgcagaggtggactatgggaaactggaggagaatctgcacaaactgggcaccttccccttccgaggcttcgtggtccagggctccaatggcgagtttcctttcctgaccagcagtgagcgcctcgaggtggtgagccgtgtgcgccaggccatgcccaagaacaggctcctgctagctggctccggatgcgagtccactcaagccacagtggagatgaccgtcagcatggcccaggtcggggctgacgcggccatggtggtgaccccttgctactatcgtggccgcatgagcagtgcggccctcattcaccactacaccaaggttgctgatctctctccaatccctgtggtgctgtacagtgtcccagccaacacagggctggacctgcctgtggatgcagtggtcacgctttcccagcacccgaatattgtgggcatgaaggacagcggtggtgatgtgaccaggattgggctgattgttcacaagaccaggaagcaggattttcaggtgttggctggatcggctggctttctgatggccagctatgccttgggagctgtggggggcgtctgcgccctggccaatgtcctgggggctcaggtgtgccagctggagcgactgtgctgcacggggcaatgggaagatgcccagaaactgcagcaccgcctcattgagccaaacgctgcggtgacccggcgctttgggatcccagggctgaagaaaatcatggactggtttggctactatggaggcccctgccgcgcccccttgcaggagctgagccccgctgaggaggaggcactgcgcatggatttcaccagcaacggctggctctgagggcaggcagggtccatggctggcctgagcccatctcagcctcctgccttgcacttgcagcctgaagcggagagcacagggggatgagggtggcaggcagcggggagccgatagaggctcctttgcctgctgtggtcctccaggcagcctttcacaggcacgcccatgcatatctcctattctaacggcccctgacctctcccttttggatcctaaactgtgtctctggtctgaagactgggaaggagcaatttctcaatttatctttctactgtggatgctttcctacgccctgaggcacatgaagtcagaaaggaagggcagaggggcaagtaggcacagtaagggaattttcttttctttttttttttttttgagacagagtttcactctgtcacccaggctggagtgcaatggcatgatctcgcctcctgggttcaagcgattctcctgcctcagcctcccgagtagctgggattacaggcgcctgccaccacgcccagctaatttttgtatttttagcagagatggggtttcaccgtgttggccaggctggtcttgaactcctgacctcaggtgatccaactgcctcggcctcccaaagtgctgggattacagctgtgagccactgcacccggccgggaatttatcaaaggggggactacttagatttggggcttcaaacctgagtctagcacaatgcagctggaggccagggctactcctacaaacccaagttctgactccttccagggaagtatcagcttaagaaacttgatcaggaaagtgacactggtctttcaaagagccctctttaccctcccatccctgccctccacactgcaagctgcattccagccacaacgcccttttctaaatctattttcattcatctcctattctggtctgtagccttgattccaaccattgaatgcacggagacagcccagtggcttgtcagattggtaaataatgacacctggtggataaatgttacattctagaagactattctggtcagcctaggtctgaaacactaaggagacttggcctgagatagggccatccacttgcctacaggcactctgcttttattattaaaaatagtcactttgttactataataaaatttaacagaaaaaa

SEQ ID NO: 102777 - DNA, 1999 bp, Homo sapiens
  Payload ID: 48
  Gene Symbol: HOGA1
  Gene Name: 4-hydroxy-2-oxoglutarate aldolase 1
  Uniprot ID: Q86XE5
  ENST ID: ENST00000370647
  CDS Start-End: 362-856
ggctgggcttctggcttcagagctgggaattgtgggaggagggcccagatcccactggagataccgaaggagatactctttagtattgggatcccagaaaccagtcctatatctggccagagggacactgggttgtggcatctctctagctgctacccagaaggaacagggccccctggggcctataggccttgcccctgaccctgggaacacccagctcaggcctgccccagtggccacaagtcagggaggccgcaaatttttaactagaaacattgatcattaatagggggttagaaagagttcaaactaagtctcactctgggacatagaccaattgtgcttcaggcctcctgcagagatgctgggtccccaagtctggtcttctgtgaggcaggggctaagcaggagcttgtccaggaatgtgggggtctgggcctcaggggaggggaagaaggtggacattgcgggtatctacccccctgtgaccacccccttcactgccactgcagaggtggactatgggaaactggaggagaatctgcacaaactgggcaccttccccttccgaggagctgtggggggcgtctgcgccctggccaatgtcctgggggctcaggtgtgccagctggagcgactgtgctgcacggggcaatgggaagatgcccagaaactgcagcaccgcctcattgagccaaacgctgcggtgacccggcgctttgggatcccagggctgaagaaaatcatggactggtttggctactatggaggcccctgccgcgcccccttgcaggagctgagccccgctgaggaggaggcactgcgcatggatttcaccagcaacggctggctctgagggcaggcagggtccatggctggcctgagcccatctcagcctcctgccttgcacttgcagcctgaagcggagagcacagggggatgagggtggcaggcagcggggagccgatagaggctcctttgcctgctgtggtcctccaggcagcctttcacaggcacgcccatgcatatctcctattctaacggcccctgacctctcccttttggatcctaaactgtgtctctggtctgaagactgggaaggagcaatttctcaatttatctttctactgtggatgctttcctacgccctgaggcacatgaagtcagaaaggaagggcagaggggcaagtaggcacagtaagggaattttcttttctttttttttttttttgagacagagtttcactctgtcacccaggctggagtgcaatggcatgatctcgcctcctgggttcaagcgattctcctgcctcagcctcccgagtagctgggattacaggcgcctgccaccacgcccagctaatttttgtatttttagcagagatggggtttcaccgtgttggccaggctggtcttgaactcctgacctcaggtgatccaactgcctcggcctcccaaagtgctgggattacagctgtgagccactgcacccggccgggaatttatcaaaggggggactacttagatttggggcttcaaacctgagtctagcacaatgcagctggaggccagggctactcctacaaacccaagttctgactccttccagggaagtatcagcttaagaaacttgatcaggaaagtgacactggtctttcaaagagccctctttaccctcccatccctgccctccacactgcaagctgcattccagccacaacgcccttttctaaatctattttcattcatctcctattctggtctgtagccttgattccaaccattgaatgcacggagacagcccagtggcttgtcagattggtaaataatgacacctggtggataaatgttacattctagaagactattctggtcagcctaggtctgaaacactaaggagacttggcctgagatagggccatccacttgcctacaggcactctgcttttattattaaaaatagtcactttgttactataataaaatttaacagaaaaaa

SEQ ID NO: 102778 - DNA, 1419 bp, Homo sapiens
  Payload ID: 49
  Gene Symbol: HPD
  Gene Name: 4-hydroxyphenylpyruvate dioxygenase
  ENST ID: ENST00000289004
  CDS Start-End: 37-1218
ctctagtcccagtaggaggtttgactaagatcaatcatgacgacttacagtgacaaaggggcaaagcctgagagaggccgattcctccacttccactctgtgaccttctgggttggcaacgccaagcaggccacgtcattctactgcagcaagatgggctttgaacctctagcctacaggggcctggagaccggttcccgggaggtggtcagccatgtaatcaaacaagggaagattgtgtttgtcctctcctcagcgctcaacccctggaacaaagagatgggcgatcacctggtgaaacacggtgacggagtgaaggacattgcgttcgaggtggaagattgtgactacatcgtgcagaaagcacgggaacggggcgccaaaatcatgcgggagccctgggtagagcaagacaagtttgggaaggtgaagtttgctgtgctgcagacgtatggggacaccacacacaccctggtggagaagatgaactacatcggccaattcttgcctggatatgaggccccagcgttcatggaccccctacttcctaaactgcccaaatgcagtctggagatgatcgaccacattgtgggaaaccagcctgatcaggagatggtgtccgcctccgaatggtacctgaaaaacctgcagttccaccgcttctggtccgtggatgacacgcaggtgcacacggaatatagctctctgcgatccattgtggtggccaactatgaagagtccatcaagatgcccatcaatgagccagcgcctggcaagaagaagtcccagatccaggaatatgtggactataacgggggcgctggggtccagcacatcgctctcaagaccgaagacatcatcacagcgattcgccacttgagagagagaggcctggagttcttatctgttccctccacgtactacaaacaactgcgggagaagctgaagacggccaagatcaaggtgaaggagaacattgatgccctggaggagctgaaaatcctggtggactacgacgagaaaggctacctcctgcagatcttcaccaaaccggtgcaggaccggcccacgctcttcctggaagtcatccagcgccacaaccaccagggttttggagccggcaacttcaactcactgttcaaggctttcgaggaggagcagaacctgcggggtaacctcaccaacatggagaccaatggggtggtgcccggcatgtaagccccgcccaccccacggaggccacagccacacagccacgccccctgattctggaactcgcccaacttccctactggctgctccccttgggtcccgcccaccagcggactcggcccccaaggctccgcccacactgaccacgcccctcggcggggccgccctctgctccagccctcccgattaaagcgtgccccggtccaa

SEQ ID NO: 102779 - DNA, 1709 bp, Homo sapiens
  Payload ID: 49
  Gene Symbol: HPD
  Gene Name: 4-hydroxyphenylpyruvate dioxygenase
  Uniprot ID: P32754
  ENST ID: ENST00000543163
  CDS Start-End: 447-1511
tgagcagcatagaagaaataatgccttttgagggacagttgcatttaacagacagccttactaaggcaagagttctggagccgccactgcactccagccggccttggcttctgagctttggattctgggcagtaatggtcacattcccagcgtcctggaaaagcttgcccttggcttctggccctgactctgcctcccactgactagtggacgtcactgcccctctctgggcctggcaacaccatcctgttcaatgaggctgcggctggatcagaggtccccaggcctggaaccttccagggctgggctcagctccccaccccatcccccagacgacttacagtgacaaaggggcaaagcctgagagaggccgattcctccacttccactctgtgaccttctgggttggcaacgccaagcaggccacgtcattctactgcagcaagatgggctttgaacctctagcctacaggggcctggagaccggttcccgggaggtggtcagccatgtaatcaaacaagggaagattgtgtttgtcctctcctcagcgctcaacccctggaacaaagagatgggcgatcacctggtgaaacacggtgacggagtgaaggacattgcgttcgaggtggaagattgtgactacatcgtgcagaaagcacgggaacggggcgccaaaatcatgcgggagccctgggtagagcaagacaagtttgggaaggtgaagtttgctgtgctgcagacgtatggggacaccacacacaccctggtggagaagatgaactacatcggccaattcttgcctggatatgaggccccagcgttcatggaccccctacttcctaaactgcccaaatgcagtctggagatgatcgaccacattgtgggaaaccagcctgatcaggagatggtgtccgcctccgaatggtacctgaaaaacctgcagttccaccgcttctggtccgtggatgacacgcaggtgcacacggaatatagctctctgcgatccattgtggtggccaactatgaagagtccatcaagatgcccatcaatgagccagcgcctggcaagaagaagtcccagatccaggaatatgtggactataacgggggcgctggggtccagcacatcgctctcaagaccgaagacatcatcacagcgattcgccacttgagagagagaggcctggagttcttatctgttccctccacgtactacaaacaactgcgggagaagctgaagacggccaagatcaaggtgaaggagaacattgatgccctggaggagctgaaaatcctggtggactacgacgagaaaggctacctcctgcagatcttcaccaaaccggtgcaggaccggcccacgctcttcctggaagtcatccagcgccacaaccaccagggttttggagccggcaacttcaactcactgttcaaggctttcgaggaggagcagaacctgcggggtaacctcaccaacatggagaccaatggggtggtgcccggcatgtaagccccgcccaccccacggaggccacagccacacagccacgccccctgattctggaactcgcccaacttccctactggctgctccccttgggtcccgcccaccagcggactcggcccccaaggctccgcccacactgaccacgcccctcggcggggccgccctctgctccagccctcccgattaaagcgtgccccggtc

SEQ ID NO: 102780 - DNA, 1629 bp, Homo sapiens
  Payload ID: 50
  Gene Symbol: HPDL
  Gene Name: 4-hydroxyphenylpyruvate dioxygenase-like
  Uniprot ID: Q96IR7
  ENST ID: ENST00000334815
  CDS Start-End: 245-1360
gctcggctcactgagacccggtggtccagacgctgctcctggctggggtggcgctgcagggagaaccgcgagctctcaggggtcggcgggtgacttctttccggaagaaagcgaggaacgcgctctgcggggtgagccggactccccaactccggacgatcagcccaggactgagagccccgaagtccccaaccacaagtaagcggccccagaaggacaagtctaggtcgccgtccagagcgccatggccgcgcccgcccttcgtttgtgccacatcgccttccacgtgcccgccgggcagcccctagcccggaacctgcagcgcctcttcggcttccagcccctggcttcgcgggaggtggacggctggcggcagctagccctgcgcagcggcgacgcggtctttttggtgaacgagggcgcagggtctggagagccgctgtacggcctggatccgcgtcacgccgtgcccagcgccacaaacctgtgcttcgacgtggcggacgccggcgctgcaacccgggagctggcagcgctgggctgcagcgtgcctgtccctcccgttcgcgtgcgggacgcgcagggtgccgccacttacgccgtggtcagctcgcctgccggcatcctcagcctgaccttgctggagcgcgctggctaccgcggacccttcctacccggcttcaggcccgtgtcctctgcgcctggccccgggtgggtcagccgcgtggaccacctgaccttggcctgcacccccggcagctcccccacacttttgcgctggttccacgactgcctgggcttttgccacttgccgctgagcccaggtgaggatcccgagctgggcctcgaaatgacagcagggtttgggcttgggggactgaggcttacagccctgcaggcccagccgggcagcattgtccccactcttgttctggctgagtcccttccgggggcgacgacacgacaggaccaggtggagcagttcctggcccggcacaaggggccaggcctgcagcacgtggggctgtatacgcctaacattgtggaggccactgagggggtggcaactgctggaggccagttcctggctccccctggggcatactaccagcagccaggaaaggagaggcagatccgagctgcagggcacgagcctcatctgcttgctcgacaggggatcctgctagatggtgataaaggcaagtttctgcttcaggtcttcaccaagtccctttttactgaggacactttcttcctggagctgattcagaggcagggggccactggctttggtcagggcaacatcagagctctgtggcagtccgtacaggagcaatctgccaggagccaggaagcctaaggatgcccagggctgggtgcagccagctgtcctgcagctctggggagaccagcacagaactgaggaacatctgcaggaggcccaactagtgaaaggctttgcctccggggggcaggtgtgacttccatttcatcagtgcctgccagaagctgtgtctctcattgggctccaaagaggtgggattttttaaaactaaaacatttcttatatacagtctataataaatatgtaagatacaaagaacaataaaagaattacacactaggaaa

SEQ ID NO: 102781 - DNA, 954 bp, Homo sapiens
  Payload ID: 51
  Gene Symbol: NT5C
  Gene Name: 5', 3'-nucleotidase, cytosolic
  Uniprot ID: Q8TCD5
  ENST ID: ENST00000245552
  CDS Start-End: 89-694
ggcggactccggaagcagcgctccctccgcttccggccgagcccgcgccccccagaccccgagagctcgcagctccggcccggcggcgatggcgcggagcgtgcgcgtgctggtggacatggacggcgtcctggccgacttcgaggccggcctcctgcggggcttccgccgccgcttccctgaggagccgcacgtgccgctggagcaacgccgcggcttcctggcccgcgagcagtaccgcgccctgcggcccgacctggcggataaagtggccagtgtgtacgaagccccgggctttttcctggacctggagcccatcccgggagccttggacgctgtgcgggagatgaacgacctaccggacacgcaggtcttcatctgcaccagccccctgctgaagtaccaccactgtgtgggtgagaagtaccgctgggtggagcagcacctggggccccagttcgtagaacgaattatcctgacaagggacaagacggtggtcttgggggacctgctcattgatgacaaggacacagttcgaggccaggaggagaccccaagctgggagcacatcttgttcacctgctgccacaatcggcacctggtcctgcccccgacaaggagacggctgctctcctggagtgacaactggagggagatcttagatagcaagcgcggagctgcgcagcgggaatgagcggggatgccgcgggcagcagctggagctaaaggaagggcaggcccacaggggccaccgcagagccgagtcggggcggcatcgtgctggtgcctctggccccgtggagtggagcaggcagataccgttaagcgctgtgctaccgggccccaggcccagccacccggtacctcccgagaggctgtccctggaccctggctggcatggaaatacagtgggaaaaccagtcgggacctttaataaaagaccttggctttcta

SEQ ID NO: 102782 - DNA, 653 bp, Homo sapiens
  Payload ID: 51
  Gene Symbol: NT5C
  Gene Name: 5', 3'-nucleotidase, cytosolic
  ENST ID: ENST00000582170
  CDS Start-End: 38-586
ccagaccccgagagctcgcagctccggcccggcggcgatggcgcggagcgtgcgcgtgctggtggacatggacggcgtcctggccgacttcgaggccggcctcctgcggggcttccgccgccgcttccctgaggagccgcacgtgccgctggagcaacgccgcggcttcctggcccgcgagcagtaccgcgccctgcggcccgacctggcggataaagtggccagtgtgtacgaagccccgggctttttcctggacctggagcccatcccgggagccttggacgctgtgcgggagatgaacgacctaccggacacgcaggtcttcatctgcaccagccccctgctgaagtaccaccactgtgtgggtgagaagtaccgctgggtggagcagcacctggggccccagttcgtagaacgaattatcctgacaagggacaagacggtggtcttgggggacctgctcattgatgacaaggacacagttcgaggaggagaccccaagctgggagcacatcttgttcacctgctgccacaatcggcacctggtcctgcccccgacaaggagacggctgctctcctggagtgacaactggagggagatcttagatagcaagcgcggagctgcgcagcgggaatgagcggggatgccgcgg

SEQ ID NO: 102783 - DNA, 958 bp, Homo sapiens
  Payload ID: 51
  Gene Symbol: NT5C
  Gene Name: 5', 3'-nucleotidase, cytosolic
  Uniprot ID: Q8TCD5
  ENST ID: ENST00000580758
  CDS Start-End: 37-390
cagaccccgagagctcgcagctccggcccggcggcgatggcgcggagcgtgcgcgtgctggtggacatggacggcgtcctggccgacttcgaggccggcctcctgcggggcttccgccgccgcttccctgaggagccgcacgtgccgctggagcaacgccgcggcttcctggcccgcgagcagtaccgcgccctgcggcccgacctggcggataaagtggccagtgtgtacgaagccccgggctttttcctggacctggagcccatcccgggagccttggacgctgtgcgggagatgaacgacctaccggaccccctgctgaagtaccaccactgtgtgggtgagaaggtgtggctgccccgcccctactccgcacgtggagctgcctaaatcctgattttaaaaagaaaccaccagaaacccagaagtaccgctgggtggagcagcacctggggccccagttcgtagaacgaattatcctgacaagggacaagacggtggtcttgggggacctgctcattgatgacaaggacacagttcgaggccaggaggagaccccaagctgggagcacatcttgttcacctgctgccacaatcggcacctggtcctgcccccgacaaggagacggctgctctcctggagtgacaactggagggagatcttagatagcaagcgcggagctgcgcagcgggaatgagcggggatgccgcgggcagcagctggagctaaaggaagggcaggcccacaggggccaccgcagagccgagtcggggcggcatcgtgctggtgcctctggccccgtggagtggagcaggcagataccgttaagcgctgtgctaccgggccccaggcccagccacccggtacctcccgagaggctgtccctggaccctggctggcatggaaatacagtgggaaaaccagtcgggacctttaataaaagaccttggctttcta

SEQ ID NO: 102784 - DNA, 921 bp, Homo sapiens
  Payload ID: 51
  Gene Symbol: NT5C
  Gene Name: 5', 3'-nucleotidase, cytosolic
  ENST ID: ENST00000582744
  CDS Start-End: 277-396
ccttctctgtgaagggcgcagagctctcaccctggaacccgcgggcagcgcaccctggggaggagcctttgggcgcgtgcccctgaccgacgccccctccgcccctctgagctcgggcccggagcccccaggagcctccctgcgggtcctcgcgggaacgggaagccgggacccagaactcttgtctttcaggataaagtggccagtgtgtacgaagccccgggctttttcctggacctggagcccatcccgggagccttggacgctgtgcgggagatgaacgacctaccggacacgcaggtcttcatctgcaccagccccctgctgaagtaccaccactgtgtgggtgagaaggtgtggctgccccgcccctactccgcacgtggagctgcctaaatcctgattttaaaaagaaaccaccagaaacccagaagtaccgctgggtggagcagcacctggggccccagttcgtagaacgaattatcctgacaagggacaagacggtggtcttgggggacctgctcattgatgacaaggacacagttcgaggccaggaggagaccccaagctgggagcacatcttgttcacctgctgccacaatcggcacctggtcctgcccccgacaaggagacggctgctctcctggagtgacaactggagggagatcttagatagcaagcgcggagctgcgcagcgggaatgagcggggatgccgcgggcagcagctggagctaaaggaagggcaggcccacaggggccaccgcagagccgagtcggggcggcatcgtgctggtgcctctggccccgtggagtggagcaggcagataccgttaagcgctgtgctaccgggccccaggcccagccacccggtacctcccgagaggctgtccctggaccctggctggcatggaaatacagtg

SEQ ID NO: 102785 - DNA, 720 bp, Homo sapiens
  Payload ID: 51
  Gene Symbol: NT5C
  Gene Name: 5', 3'-nucleotidase, cytosolic
  ENST ID: ENST00000578407
  CDS Start-End: 1-462
gtggacatggacggcgtcctggccgacttcgaggccggcctcctgcggggcttccgccgccgcttccctgaggagccgcacgtgccgctggagcaacgccgcggcttcctggcccgcgagcagtaccgcgccctgcggcccgacctggcggataaagtggccagtgtgtacgaagccccgggctttttcctggacctggagcccatcccgggagccttggacgctgtgcgggagatgaacgacctaccggacacgcaggtcttcatctgcaccagccccctgctgaagtaccaccactgtgtgggtgagaaggaggagaccccaagctgggagcacatcttgttcacctgctgccacaatcggcacctggtcctgcccccgacaaggagacggctgctctcctggagtgacaactggagggagatcttagatagcaagcgcggagctgcgcagcgggaatgagcggggatgccgcgggcagcagctggagctaaaggaagggcaggcccacaggggccaccgcagagccgagtcggggcggcatcgtgctggtgcctctggccccgtggagtggagcaggcagataccgttaagcgctgtgctaccgggccccaggcccagccacccggtacctcccgagaggctgtccctggaccctggctggcatggaaatacagtgggaaaaccagtcgggacctttaataaaagaccttggctttc

SEQ ID NO: 102786 - DNA, 860 bp, Homo sapiens
  Payload ID: 51
  Gene Symbol: NT5C
  Gene Name: 5', 3'-nucleotidase, cytosolic
  ENST ID: ENST00000582160
  CDS Start-End: 250-597
caccctggaacccgcgggcagcgcaccctggggaggagcctttgggcgcgtgcccctgaccgacgccccctccgcccctctgagctcgggcccggagcccccaggagcctccctgcgggtcctcgcgggaacgggaagccgggacccagaactcttgtctttcaggataaagtggccagtgtgtacgaagccccgggctttttcctggacctggagcccatcccgggagccttggacgctgtgcgggagatgaacgacctaccggacacgcaggtcttcatctgcaccagccccctgctgaagtaccaccactgtgtgggtgagaagtaccgctgggtggagcagcacctggggccccagttcgtagaacgaattatcctgacaagggacaagacggtggtcttgggggacctgctcattgatgacaaggacacagttcgaggccaggaggagaccccaagctgggagcacatcttgttcacctgctgccacaatcggcacctggtcctgcccccgacaaggagacggctgctctcctggagtgacaactggagggagatcttagatagcaagcgcggagctgcgcagcgggaatgagcggggatgccgcgggcagcagctggagctaaaggaagggcaggcccacaggggccaccgcagagccgagtcggggcggcatcgtgctggtgcctctggccccgtggagtggagcaggcagataccgttaagcgctgtgctaccgggccccaggcccagccacccggtacctcccgagaggctgtccctggaccctggctggcatggaaatacagtgggaaaaccagtcgggacctttaataaaagaccttggctttctagtc

SEQ ID NO: 102787 - DNA, 582 bp, Homo sapiens
  Payload ID: 51
  Gene Symbol: NT5C
  Gene Name: 5', 3'-nucleotidase, cytosolic
  ENST ID: ENST00000578337
  CDS Start-End: 125-244
cgggaacgggaagccgggacccagaactcttgtctttcaggataaagtggccagtgtgtacgaagccccgggctttttcctggacctggagcccatcccgggagccttggacgctgtgcgggagatgaacgacctaccggacacgcaggtcttcatctgcaccagccccctgctgaagtaccaccactgtgtgggtgagaaggtgtggctgccccgcccctactccgcacgtggagctgcctaaatcctgattttaaaaagaaaccaccagaaacccagaagtaccgctgggtggagcagcacctggggccccagttcgtagaacgaattatcctgacaagggacaagacggtggtcttgggggacctgctcattgatgacaaggacacagttcgaggttggacccgttatccttggcagcctccaggcctctggcctgcccggattagggagagggagtaataatacccatgacagatggcagcgcgctgtctttcactgtcctaggccaggaggagaccccaagctgggagcacatcttgttcacctgctgccacaatcggcacctggtcctgcccccga

SEQ ID NO: 102788 - DNA, 450 bp, Homo sapiens
  Payload ID: 51
  Gene Symbol: NT5C
  Gene Name: 5', 3'-nucleotidase, cytosolic
  ENST ID: ENST00000580423
  CDS Start-End: 1-262
agccccgggctttttcctggacctggagcccatcccgggagccttggacgctgtgcgggagatgaacgacctaccggacacgcaggtcttcatctgcaccagccccctgctgaagtaccaccactgtgtgggtgagaaggccaggaggagaccccaagctgggagcacatcttgttcacctgctgccacaatcggcacctggtcctgcccccgacaaggagacggctgctctcctggagtgacaactggagggagatcttagatagcaagcgcggagctgcgcagcgggaatgagcggggatgccgcgggcagcagctggagctaaaggaagggcaggcccacaggggccaccgcagagccgagtcggggcggcatcgtgctggtgcctctggccccgtggagtggagcaggcagataccgttaagcgctgtgctaccgggccccaggcc

SEQ ID NO: 102789 - DNA, 907 bp, Homo sapiens
  Payload ID: 52
  Gene Symbol: MTHFS
  Gene Name: 5,10-methenyltetrahydrofolate synthetase (5-formyltetrahydrofolate cyclo-ligase)
  Uniprot ID: P49914
  ENST ID: ENST00000258874
  CDS Start-End: 62-673
agaccgaacccgagggcgcccagggcgccgagggcgggactggactcggcttgggcgtgagatggcggcggcagcggtgagcagcgccaagcggagcctgcggggagagctgaagcagcgtctgcgggcgatgagtgccgaggagcggctacgccagtcccgcgtactgagccagaaggtgattgcccacagtgagtatcaaaagtccaaaagaatttccatctttctgagcatgcaagatgaaattgagacagaagagatcatcaaggacattttccaacgaggcaaaatctgcttcatccctcggtaccggttccagagcaatcacatggatatggtgagaatagaatcaccagaggaaatttctttacttcccaaaacatcctggaatatccctcagcctggtgagggtgatgttcgggaggaggccttgtccacagggggacttgatctcatcttcatgccaggccttgggtttgacaaacatggcaaccgactggggaggggcaagggctactatgatgcctatctgaagcgctgtttgcagcatcaggaagtgaagccctacaccctggcgttggctttcaaagaacagatttgcctccaggtcccagtgaatgaaaacgacatgaaggtagatgaagtcctttacgaagactcgtcaacagcttaaatctggattactacagccaaataatcagtgttttatatgagagtaaagcaaagtatgtgtatttttcccttgtcaaaaattagttgaaattgttcattaatgtgaatacagactgcattttaaaattgtaattatgaaataccttatataaaaccatctttaaaaaccaatagaagtgtgaatagtagaatattaattaaaatggaggctatcagcctgtgattttcagcttaa

SEQ ID NO: 102790 - DNA, 595 bp, Homo sapiens
  Payload ID: 52
  Gene Symbol: MTHFS
  Gene Name: 5,10-methenyltetrahydrofolate synthetase (5-formyltetrahydrofolate cyclo-ligase)
  ENST ID: ENST00000560261
  CDS Start-End: 1-118
agtgaagccctacaccctggcgttggctttcaaagaacagatttgcctccaggtcccagtgaatgaaaacgacatgaaggtagatgaagtcctttacgaagactcgtcaacagcttaaatctggattactacagccaaataatcagtgttttatatgagagtaaagcaaataggggctggagttcgaggttacagtgagctatgattgcggcactgaagtccagcctgggtgacagagcaagaccccgtctctaacaacaacaacaacaacaacaacaacaaaaacataaaaaacaatggtaccgtaagaggagacatgttggaaacatctctccttctactcagcctcacgccctgaaaaatttcttcctgtacttatttcttcagattgtcagcagtgttttctacttgtcatccaatagtacttcctgacaaaaagatgcgtcagggtctttttccccctaaattgtttcaccagtatttcatccacatttccatggtatgaagaagaagtaatttttaaatgaccaaaggagaagtcccatctaacatccttctgtacatcattactggaaatgaagagctgacagtcata

SEQ ID NO: 102791 - DNA, 470 bp, Homo sapiens
  Payload ID: 52
  Gene Symbol: MTHFS
  Gene Name: 5,10-methenyltetrahydrofolate synthetase (5-formyltetrahydrofolate cyclo-ligase)
  ENST ID: ENST00000560919
  CDS Start-End: 10-144
gggcgtgagatggcggcggcagcggtgagcagcgccaagcggagcctgcggggagagctgaagcagcgtctgcgggcgatgagtgccgaggagcggctacgccagtcccgcgtactgagccagaaggtgcgaggccgcccgtagcggaagccgcggcggacagaccctccgaaggcctggcggccagcgattgctgatctgtgcatggtgattgcccacagtgagtatcaaaagtccaaaagaatttccatctttctgagcatgcaagatgaaattgagacagaagagatcatcaaggacattttccaacgaggcaaaatctgcttcatccctcggtaccggttccagagcaatcacatggatatggtgagaatagaatcaccagaggaaatttctttacttcccaaaacatcctggaatatccctcagcctggtgagggtgatgttcgggaggaggccttgtccacagg

SEQ ID NO: 102792 - DNA, 948 bp, Homo sapiens
  Payload ID: 52
  Gene Symbol: MTHFS
  Gene Name: 5,10-methenyltetrahydrofolate synthetase (5-formyltetrahydrofolate cyclo-ligase)
  ENST ID: ENST00000559722
  CDS Start-End: 16-714
tgaacagtacaagagatgccaggcaccgtgggtactgccggccatctttaccatccccgccagtggcgctgccgcctccgcggtcccggtgagggcccaggctcagggaggtcaggcggcagggcagcgacggcgcctcgccaccgctcccctaaccggggagggcgagccggaccacggggaccgcacgagggctgggtcccaagggccagaggcgaggtgattgcccacagtgagtatcaaaagtccaaaagaatttccatctttctgagcatgcaagatgaaattgagacagaagagatcatcaaggacattttccaacgaggcaaaatctgcttcatccctcggtaccggttccagagcaatcacatggatatggtgagaatagaatcaccagaggaaatttctttacttcccaaaacatcctggaatatccctcagcctggtgagggtgatgttcgggaggaggccttgtccacagggggacttgatctcatcttcatgccaggccttgggtttgacaaacatggcaaccgactggggaggggcaagggctactatgatgcctatctgaagcgctgtttgcagcatcaggaagtgaagccctacaccctggcgttggctttcaaagaacagatttgcctccaggtcccagtgaatgaaaacgacatgaaggtagatgaagtcctttacgaagactcgtcaacagcttaaatctggattactacagccaaataatcagtgttttatatgagagtaaagcaaagtatgtgtatttttcccttgtcaaaaattagttgaaattgttcattaatgtgaatacagactgcattttaaaattgtaattatgaaataccttatataaaaccatctttaaaaaccaatagaagtgtgaatagtagaatattaattaaaatggaggctatcagcctgtgattttcagcttaa

SEQ ID NO: 102793 - DNA, 1617 bp, Homo sapiens
  Payload ID: 53
  Gene Symbol: NT5M
  Gene Name: 5',3'-nucleotidase, mitochondrial
  Uniprot ID: Q9NPB1
  ENST ID: ENST00000389022
  CDS Start-End: 217-903
gcgcgtgttcctttagggaccgcgcgcgccgcggcctcgctctggggccggtacttgcgcgcccgcaccccgcgctccccgccccgctccccgtcccgcgctccacgcgcgccccagcgttgggggcttctcctccgcggcgggaatgtctggccggctccggcagcacggcgcggcccaggtccccgcgcccacgacgggccagcgcgctgggccatgatccggctgggcggctggtgtgcgcggcggctctgcagcgcggcggttcccgcggggcggcgcggggcggcgggcgggctgggcctggcgggaggccgcgccctacgggtgctggtggacatggacggcgtgctggctgacttcgagggcggattcctcaggaagttccgcgcgcgctttcccgaccagcccttcatcgcgctggaggaccggcgcggcttctgggtgtcggagcagtacggccgcctgcggccagggctgagcgagaaggccatcagcatttgggagtcaaagaatttcttttttgaacttgagcctctgccaggggccgtggaagctgtcaaggagatggccagcctacaaaacactgacgtcttcatctgcacaagccccatcaagatgttcaagtactgtccctatgagaagtatgcctgggtggagaagtactttggccctgactttctggagcagattgtgctgaccagagacaagaccgtggtctctgctgaccttctcatagacgaccggccggacatcacaggggccgagccaacccccagctgggagcatgtcctcttcaccgcctgccacaaccagcacctgcagctgcagcccccccgccgcaggctgcactcgtgggcggacgactggaaggccattctggacagcaagcggccctgctgagctggactgtgcttcgggctcctctgtggggctctgacctcagggctcccagctcggggcctgtggggccagtatgctggtctgggagtccctcctagactcctgggccccatgacctcctgctgcatgtcccttcccttccccagccctgccaggccttaacctgatcacggggcagggctgggccctctgggcgcttggacatagacacgtggtcccaggccgttcagcctgacctcaggcagcaggcaccaagctgccagaagcccaggggctcaggacagggaggagttgaggccactgttcagggggctggtggccgtctccactccctaggcaagttctctgaggcagaagggggttccctgttcccagagtctgcagccatcagcaaggaggaccaggaacccggcgactgaggtgcttccaggtggggacaagcccctcttggtctcagccacagcaccccttattccagctgccctgcccaacctgctcaccccacatgaccttctgtgtattcagcaaacactcactaggtgacagcggccaccaggctctgtgctgggggacgatactggccctggcctcgaccagcttagaggtttctcacacctctgttcccagggccccgctcagggcccagcagagagtccgtaggcttgaacatgtgttgagtgcatgaaaaataaatgctgttcatgtgtgtagctc

SEQ ID NO: 102794 - DNA, 895 bp, Homo sapiens
  Payload ID: 53
  Gene Symbol: NT5M
  Gene Name: 5',3'-nucleotidase, mitochondrial
  ENST ID: ENST00000470418
  CDS Start-End: 162-443
tgcgcgcccgcaccccgcgctccccgccccgctccccgtcccgcgctccacgcgcgccccagcgttgggggcttctcctccgcggcgggaatgtctggccggctccggcagcacggcgcggcccaggtccccgcgcccacgacgggccagcgcgctgggccatgatccggctgggcggctggtgtgcgcggcggctctgcagcgcggcggttcccgcggggcggcgcggggcggcgggcgggctgggcctggcgggaggccgcgccctacgggtgctggtggacatggacggcgtgctggctgacttcgagggcggattcctcaggaagttccgcgcgcgctttcccgaccagcccttcatcgcgctggaggaccggcgcggcttctgggtgtcggagcagtacggccgcctgcggccagggctgagcagctggccttgctgaacacctgagctcaacccctaccatccgactcccgaggtgttctgtccaggatggatagaggggaaagatccaaggagggacgtttacacacagatcttggttggagaaggccatcagcatttgggagtcaaagaatttcttttttgaacttgagcctctgccaggggccgtggaagctgtcaaggagatggccagcctacaaaacactgacgtcttcatctgcacaagccccatcaagatgttcaagtactgtccctatgagaagtatgcctgggtggagaagtactttggccctgactttctggagcagattgtgctgaccagagacaagaccgtggtctctgctgaccttctcatagacgaccggccggacatcacaggcaagtggcctgcgacaggggccgagccaacccccagctgggagcatgtcctcttcaccgcctgccacaacc

SEQ ID NO: 102795 - DNA, 771 bp, Homo sapiens
  Payload ID: 53
  Gene Symbol: NT5M
  Gene Name: 5',3'-nucleotidase, mitochondrial
  ENST ID: ENST00000478373
  CDS Start-End: 186-527
cggcctcgctctggggccggtacttgcgcgcccgcaccccgcgctccccgccccgctccccgtcccgcgctccacgcgcgccccagcgttgggggcttctcctccgcggcgggaatgtctggccggctccggcagcacggcgcggcccaggtccccgcgcccacgacgggccagcgcgctgggccatgatccggctgggcggctggtgtgcgcggcggctctgcagcgcggcggttcccgcggggcggcgcggggcggcgggcgggctgggcctggcgggaggccgcgccctacgggtgctggtggacatggacggcgtgctggctgacttcgagggcggattcctcaggaagttccgcgcgcgctttcccgaccagcccttcatcgcgctggaggaccggcgcggcttctgggtgtcggagcagtacggccgcctgcggccagggctgagcgtgagcgtccccgccccgccccgcgccgggcctccttctcgccccgagccccagacaccgcccctgcgccggtgaccttggacggagaaggccatcagcatttgggagtcaaagaatttcttttttgaacttgagcctctgccaggggccgtggaagctgtcaaggagatggccagcctacaaaacactgacgtcttcatctgcacaagccccatcaagatgttcaagtactgtccctatgagaagtatgcctgggtggagaagtactttggccctgactttctggagcagattgtgctgaccagagacaagaccgtgg

SEQ ID NO: 102796 - DNA, 1408 bp, Homo sapiens
  Payload ID: 53
  Gene Symbol: NT5M
  Gene Name: 5',3'-nucleotidase, mitochondrial
  ENST ID: ENST00000483704
  CDS Start-End: 1-155
acggcgtgctggctgacttcgagggcggattcctcaggaagttccgcgcgcgctttcccgaccagcccttcatcgcgctggaggaccggcgcggcttctgggtgtcggagcagtacggccgcctgcggccagggctgagcagctggccttgctgaacacctgagctcaacccctaccatccgactcccgaggtgttctgtccaggatggatagaggggaaagatccaaggagggacgtttacacacagatcttggagaaggccatcagcatttgggagtcaaagaatttcttttttgaacttgagcctctgccaggggccgtggaagctgtcaaggagatggccagcctacaaaacactgacgtcttcatctgcacaagccccatcaagatgttcaagtactgtccctatgagaagtatgcctgggtggagaagtactttggccctgactttctggagcagattgtgctgaccagagacaagaccgtggtctctgctgaccttctcatagacgaccggccggacatcacaggcaagtggcctgcgacaggggccgagccaacccccagctgggagcatgtcctcttcaccgcctgccacaaccagcacctgcagctgcagcccccccgccgcaggctgcactcgtgggcggacgactggaaggccattctggacagcaagcggccctgctgagctggactgtgcttcgggctcctctgtggggctctgacctcagggctcccagctcggggcctgtggggccagtatgctggtctgggagtccctcctagactcctgggccccatgacctcctgctgcatgtcccttcccttccccagccctgccaggccttaacctgatcacggggcagggctgggccctctgggcgcttggacatagacacgtggtcccaggccgttcagcctgacctcaggcagcaggcaccaagctgccagaagcccaggggctcaggacagggaggagttgaggccactgttcagggggctggtggccgtctccactccctaggcaagttctctgaggcagaagggggttccctgttcccagagtctgcagccatcagcaaggaggaccaggaacccggcgactgaggtgcttccaggtggggacaagcccctcttggtctcagccacagcaccccttattccagctgccctgcccaacctgctcaccccacatgaccttctgtgtattcagcaaacactcactaggtgacagcggccaccaggctctgtgctgggggacgatactggccctggcctcgaccagcttagaggtttctcacacctctgttcccagggccccgctcagggcccagcagagagtccgtaggcttgaacatgtgttgagtgcatgaaaaataaatgctgttcatgtgtgtagctcaa

SEQ ID NO: 102797 - DNA, 1635 bp, Homo sapiens
  Payload ID: 53
  Gene Symbol: NT5M
  Gene Name: 5',3'-nucleotidase, mitochondrial
  ENST ID: ENST00000616989
  CDS Start-End: 217-921
gcgcgtgttcctttagggaccgcgcgcgccgcggcctcgctctggggccggtacttgcgcgcccgcaccccgcgctccccgccccgctccccgtcccgcgctccacgcgcgccccagcgttgggggcttctcctccgcggcgggaatgtctggccggctccggcagcacggcgcggcccaggtccccgcgcccacgacgggccagcgcgctgggccatgatccggctgggcggctggtgtgcgcggcggctctgcagcgcggcggttcccgcggggcggcgcggggcggcgggcgggctgggcctggcgggaggccgcgccctacgggtgctggtggacatggacggcgtgctggctgacttcgagggcggattcctcaggaagttccgcgcgcgctttcccgaccagcccttcatcgcgctggaggaccggcgcggcttctgggtgtcggagcagtacggccgcctgcggccagggctgagcgagaaggccatcagcatttgggagtcaaagaatttcttttttgaacttgagcctctgccaggggccgtggaagctgtcaaggagatggccagcctacaaaacactgacgtcttcatctgcacaagccccatcaagatgttcaagtactgtccctatgagaagtatgcctgggtggagaagtactttggccctgactttctggagcagattgtgctgaccagagacaagaccgtggtctctgctgaccttctcatagacgaccggccggacatcacaggcaagtggcctgcgacaggggccgagccaacccccagctgggagcatgtcctcttcaccgcctgccacaaccagcacctgcagctgcagcccccccgccgcaggctgcactcgtgggcggacgactggaaggccattctggacagcaagcggccctgctgagctggactgtgcttcgggctcctctgtggggctctgacctcagggctcccagctcggggcctgtggggccagtatgctggtctgggagtccctcctagactcctgggccccatgacctcctgctgcatgtcccttcccttccccagccctgccaggccttaacctgatcacggggcagggctgggccctctgggcgcttggacatagacacgtggtcccaggccgttcagcctgacctcaggcagcaggcaccaagctgccagaagcccaggggctcaggacagggaggagttgaggccactgttcagggggctggtggccgtctccactccctaggcaagttctctgaggcagaagggggttccctgttcccagagtctgcagccatcagcaaggaggaccaggaacccggcgactgaggtgcttccaggtggggacaagcccctcttggtctcagccacagcaccccttattccagctgccctgcccaacctgctcaccccacatgaccttctgtgtattcagcaaacactcactaggtgacagcggccaccaggctctgtgctgggggacgatactggccctggcctcgaccagcttagaggtttctcacacctctgttcccagggccccgctcagggcccagcagagagtccgtaggcttgaacatgtgttgagtgcatgaaaaataaatgctgttcatgtgtgtagctc

SEQ ID NO: 102798 - DNA, 10143 bp, Homo sapiens
  Payload ID: 54
  Gene Symbol: XRN1
  Gene Name: 5'-3' exoribonuclease 1
  Uniprot ID: Q8IZH2
  ENST ID: ENST00000264951
  CDS Start-End: 119-5239
atggtcggccgggcggtgtgttgtcatccgcggagcgacgaccggaggctgcggcggagccccggcggggcgtttggtttcggtttggccctgactgggattagtgttgacgatcgaaatgggagtccccaagttttacagatggatctcagagcggtatccctgtctcagcgaagtggtgaaagagcatcagattcctgaatttgacaacttgtacctggatatgaatggaattatacatcagtgctcccatcctaatgatgatgatgttcactttagaatttcagatgataaaatctttactgatatttttcactacctggaggtgttgtttcgcattattaaacccaggaaagtgttctttatggctgtagatggtgtggctcctcgagcaaaaatgaaccagcagcgtgggaggcgttttaggtcagcaaaggaggcagaagacaaaattaaaaaggcaatagagaagggagaaactcttcctacagaggccagatttgattccaactgtatcacaccaggaactgaatttatggccaggttacatgaacatctgaagtattttgtaaatatgaaaatttccacagacaagtcatggcaaggagttaccatctacttctcaggccatgagactcctggagaaggagagcataaaatcatggaatttatcagatccgagaaagcaaagccagatcatgatccaaacaccagacactgtctttatggtttagatgctgacttgattatgcttggattaacaagtcatgaggcacatttttctctcttaagagaagaagttcgatttggtggcaaaaaaacacaacgggtatgtgctccagaagaaactacatttcaccttctacacttgtctttaatgagagagtatattgactatgagttttcagtattaaaagaaaagatcacatttaaatatgatattgaaaggataatagatgattggattttgatggggtttcttgttggtaatgattttatccctcatctacctcatttacatattaatcatgatgcactgcctcttctttatggaacatatgttaccatcctgccagaacttgggggttatattaatgaaagtgggcacctcaacttacctcgatttgagaaataccttgtgaaactatcagattttgatcgggagcacttcagtgaagtttttgtggacctaaaatggtttgaaagcaaagttggtaacaagtacctcaatgaagcagcaggtgtcgcagcagaagaagccaggaactacaaggaaaagaaaaagttaaagggccaggaaaattctctgtgttggactgctttagacaaaaatgaaggcgaaatgataacttctaaggataatttagaagatgagactgaagatgatgacctatttgaaactgagtttagacaatataaaagaacatattacatgacgaagatgggggttgacgtagtatctgatgactttctggctgatcaagctgcatgttatgttcaggcaatacagtggattttgcactattactatcatggagttcagtcctggagctggtattatccttatcattatgcacctttcctgtctgatatacacaacatcagtacactcaaaatccattttgaactaggaaaaccttttaagccatttgaacagcttcttgctgtacttccagcagccagcaaaaatttacttcctgcatgctaccagcatttgatgaccaatgaagactcaccaattatagaatattacccacctgattttaaaactgacctaaatgggaaacaacaggaatgggaagctgtggtgttaatcccttttattgatgagaagcgattattggaagccatggagacatgtaaccactccctcaaaaaggaagagaggaaaagaaaccaacatagtgagtgcctaatgtgctggtatgatagagacacagagtttatctatccttctccatggccagaaaagttccctgccatagaacgatgttgtacaaggtataaaataatatccttagatgcttggcgtgtagacataaacaaaaacaaaataaccagaattgaccagaaagcattatatttctgtggatttcctactctgaaacacatcagacacaaattttttttgaagaaaagtggtgttcaagtattccagcaaagcagtcgtggagaaaacatgatgttggaaatcttagtggatgcagaatcagatgaacttaccgtagaaaatgtagcttcatcagtgcttggaaaatctgtctttgttaattggcctcaccttgaggaagctagagtcgtggctgtatcagatggagaaactaagttttacttggaagaacctccaggaacacagaagctttattcaggaagaactgccccaccatctaaagtggttcatcttggagataaagaacaatctaactgggcaaaagaagtacaaggaatttcagaacactacctgagaagaaaaggaataataataaatgaaacatctgcagttgtgtatgctcagttactcacaggtcgtaaatatcaaataaatcaaaatggtgaagttcgtctagagaaacagtggtcaaaacaagttgttccttttgtttatcaaactattgtcaaggacatccgagctttcgactcccgtttctccaatatcaaaacattggatgatttgtttcctctgagaagtatggtctttatgctgggaactccctattatggctgcactggagaagttcaggattcaggtgatgtgattacagaaggtaggattcgtgtgattttcagcattccatgtgaacccaatcttgatgctttaatacagaaccagcataaatattctataaagtacaacccaggatatgtgttggccagtcgccttggagtgagtggataccttgtttcaaggtttacaggaagtatttttattggaagaggatctaggagaaaccctcatggagaccataaagcaaatgtgggtttaaatctcaaattcaacaagaaaaatgaggaggtacctggatatactaagaaagttggaagtgaatggatgtattcatctgcagcagaacaacttctggcagagtacttagagagagctccagaactatttagttatatagccaaaaatagccaagaggatgtgttctatgaagatgacatttggcctggagaaaatgagaatggtgctgaaaaagttcaagaaattattacttggctaaaaggacatcctgtcagtactttatctcgttcttcttgtgatttacaaattctggatgcagctattgttgagaaaattgaggaagaagtcgaaaagtgcaagcaaagaaagaataataagaaggtgcgagtaacagtgaaaccccatttgctatacagacctttagaacagcaacatggagtcattcctgatcgggatgcagaattttgtctttttgaccgtgttgtaaatgtgagagaaaacttctcagttccagttggccttcgaggcaccatcataggaataaaaggagctaatagagaagccgatgtactatttgaagtattatttgatgaagaatttcctggagggttaacaataagatgctcacctggtagaggttatcgactgccaacaagtgccttggtgaacctttctcatgggagtcgctctgaaactggaaatcagaagttgacagccatcgtaaaaccacaaccagctgtacatcaacatagctcaagttcatcagtttcctctgggcatttgggagccctcaaccattcccctcaatcactttttgttcctactcaagtacctactaaagatgatgatgaattctgcaacatttggcagtccttacagggatctggaaagatgcaatactttcagccaactatacaagagaagggtgcagttctacctcaagaaataagccaagtaaatcaacatcataaatctggctttaatgacaacagtgttaaatatcagcaaagaaaacatgaccctcacagaaaatttaaagaagagtgtaagagtcctaaagctgagtgttggtcccaaaaaatgtccaataagcagcctaactctggaattgagaactttttagcatctttgaatatctccaaagaaaatgaagtacagtcatctcatcatggggagcctccaagtgaagagcatttgtcaccacagtcatttgccatgggaacacggatgcttaaagaaattctaaaaattgatggctctaacactgtggaccataagaatgaaatcaaacagattgctaatgaaatccctgtttcctctaacagaagagatgaatatggattaccctctcagcctaaacaaaataagaaattagcatcttatatgaacaagcctcacagtgctaatgagtaccataatgttcagtctatggacaatatgtgttggcctgcccccagccagatccctcctgtatccacaccagtaactgaactttctcgaatttgttcccttgttggaatgccacaacctgatttctcctttcttaggatgccacagacaatgaccgtttgccaagtaaaattatctaatggcttactggtacatgggccacagtgccactctgaaaatgaagccaaagagaaagctgcactttttgctttacaacagttgggctccttaggcatgaatttccctttgccttcacaagtatttgcaaattatccttcagctgtaccacctggaaccattcctccagcctttcccccacctactggctgggatcactatggaagcaactatgcattgggggcagctaatataatgccttcgtcgtctcatctctttggctcaatgccatggggaccatcggtgccagttcctgggaagcccttccatcatactttatattctgggaccatgcccatggctgggggaataccagggggtgtgcacaatcagtttatacctctgcaggttactaaaaaaagggttgcaaacaaaaagaactttgagaataaggaagcccagagttctcaagccactccagttcagactagccagccagattcttccaacattgtcaaagtaagtccacgggagagctcatcagcttctttgaagtcctctccgattgctcaacctgcatcttcttttcaagttgaaactgcctctcaaggccatagtatatctcaccataagtcaacaccaatctcttcttcaagaagaaaatcaagaaaactggctgttaattttggtgtttctaaaccttctgagtaaatttggctcttagaattaagttaatttcttctctttccatctacctttttataaatacatatctatgtctcataaaaattagaatgtactattttaaaataatatgtgtaaattgaaatttttttcatttttaagttatcaggcacttttcatgctgtttaaaagactgtgtatcaaattgtgcactttaagtatgtgcagtttgttgtatgtcaattatacctcaataaatctgtaataaaaaactaaattaaaccttgcattaaaataatatcacagtatcagtggactaaacattaaaatgtaccactctaatcattggcctcatgattgaagcatcctgaactatgaattagacatcagttagcaataataagcattttttacactatcattgaggaataattacatggagcatgaaatttgggcctccagtataacttactgaatgtggattttatttctctttttaatgatgtaagaaaattgtcaggagaatggctcttatttatgtgtgttttaacttatgctttgttgcctctgagggtctttagacctgctgtgaaaggatcacatttgttgtggtgctgccagttttgctttattctaaattttgtaccaaagcaactttagaataatcagaatatttcatctaactgcttagaactataaatagcattctaaatttgagtaaatacaattttttaggttactcaagaaccagcattagtaatttctagtaaaattgtttcaaaatctacagggtacaatgattacaaattaatcttctaacaaaataaaatatgaaatattagtcatgttaattaataaactgtattattttgtatagctttttatttgcttacctgacattttatgagagcttcatagttggtcggtatgtagtgcttcttgggactgaagaaattctaattgttgtttaagttccaaggtgtgctacaatataggaggcacagtcatcagtttgtgacatacattatttactgcctatttcattctgattctatatttttagctttatgctgaactgttcaatgatgctgggattctctctttgcatgtcatatgtgaatgtgtggttcaagctgtaactgttgaaattattttagaatttatgacgatttctcagcagggcctatgtttatatatatatatatatttattctttagtttttgtgatatgcttatatttttaaggaagtaagttatagcatacttttttaaaagtaggaaccacaatctttatatggagcagcttgttatatctgattttcatgtaactcattggaaactctgccatgactcttaaagtagtcttacttgttttttaaaatgctggtattaaactaaatggactcctttcactaactgctgatttcagagtttaaatgttagcaggatatttgtgtattagcagtgccttcagtataagagagaaatattcattatctgtcatttatcatagtcgtataagtttccatgattttattttctgttattttcataagttcagatgtttatcagttcccaacattgtttctttatctgtagtgggatcttgagtaatgaggctcaagtaaatcctcaatgtgtataattattgcctcataaactctctctttgtttttaaaggaaacatctattatggtaatacaaagaaaagttaaattgtgacagtaatgttatattaacctcttcctactttaaagtgtgaaatgtttcacctcagctgtacaaactccagcattgagaatttgcctcactcattactcctgtgtgacagttatataaatagcatgcagctcacatctgttttagagcatagaagaagcggcacctgccatcttctgaaaactccaaagggaaatttcagtagacatagtgcactaaacccataaggatacttgaccaatatttgagcacagcaagctgacagttctatacagataggcagtgaaagagttttattttccagccaggcgcagtggctcaaatcccagcacttcgggaggctaaggcaggcggatcacttgaggtccggagttccagacaagcctggccaacatgatgaagccctgtctctactaaaaatacaaaaattagccgggcgtgatggcacatgcctttagtcccagctactcgggaggctgaggcatgagaatcatttgaacccgcgaggcagagtctgcagtgagccgagattgcaccactgcactccagcctggagagcagagcaagactctgtctcaaaaaaaagaaaaaagttttattatccttactttttttttaacattattattctaaaggtcaaaactgagaagagattaagataggagagagctccataatggctggatagtggtcaggcattctctattcttttccccctgtagacccattctaaatgtgggcctgaggtcaatgggagatgtgccctccctatggaggatgtaagaagcagaggccatttctgccccatgttgaggaaacaatctgttgatagacctggaatttagagtatatctgaaaagcagttggacttcaagaaatttaaaattctctctttgagatggggtggactaagaccacccccaaagtttaaaaatatgctcattcaacttgaatcttctgaggactttttgtgaaaatggtggactgtttagggcataggacagattccccaaattgctttatgcttccacataactagagcacttcaatctatttaagcctttgtctcctaactgaaacattatttctaaatatttctattcaataagttttttcttttttgagcaacttaagtgaattttgaagattgctccttccagtctcgttccttttcacattttcctgcattacctaataattacctcagcgttagaatttgaatgtattaattgatttaaacatcatgtagactaaagtcttaaacatctaagactcagttgtagttgcagaaaaaaattaaagtcacctctactgaaccttggtttcaatttaagatttttcttgcttttcaaaggggtaactaataaagattgaagggtttttttcccgattggtggaggaatgaagaactattgatgcaagtttttttattgtttctttctatgatcaggtacctgctttcattttagactgctacttccaaactaagctagattcttggttttaatgagaggaggcagagagagggaggcagatggaagaagaaaaacagttaaataagacatacccagtcactgcatttttggactataccgtatctttctagcacaaggaaatagataaactgtaaggtcttttttactcactttttatttatgtgttctatttgtgttagtcataactgtttatagtggttgtctaatttttacttttattatatgagatagagctgtgcagatcttcactcaagttagttctgtcacgcttcttcccattatttagagcacagttttttaaagcaactgtacaatttctcagccttatgagcttgctgtatttcttggtatcatgttgcttccaaattttgtttttactgtagaagacaattaatttattgtagagaagtggctgtgaaagtcgttctctgtctttaaaaatcaattgcagaagttcatttgtcatttttctagagataaattatagtactcaaactggcagtgctcagtatatacattttgtaagctttgtcagtgaaaccatcagttttgcaggagcttcctttcctagtcaagataaagcttaaaattccagaaattaatgtcgttcggactgactttattcatatttccatcaaacttctccaatacagtaagagatagtgttgaaccagcatcaagtctccagaaacatggcagagcagacaggccgttaagtttcacagacatcatagatccttttcttaaagaagaaaaacatgtataaaatagttttagtagtccaaaatgtcaactatctgtagctgcttttgtgtgtgtgtcagtgaacaaataataatgccttgctcaatcaatgcattcagccatctcaagtgcaatttgtgaaggagactatggtttccaaaagatacatttttttacaaagttaaacctgtaaaaagtctttttttttttccctccagccgtacaccaactgcacttggttgtttcagcagttggtatactattaaattgtccaggccaaataggtttctgtagctgttttagtaatttgaagccaaattctcatgctgtttctcattaaaaagaatgagaatttggtccatagttagctttaagttctctcttcctttctttcccttacagttaagggtttggtgggggatggggaggttgttttcgttttttggatttttttgtcttttggctttaagtatcatattttcttttgcctgtatccaactgcttctttgagtattttcatctagtttaatgtgagtaatagatgctgtgctgtcattgaagtgttcaacattttgttcatttaaacaaaagtgtaattcatacatatatagatacatatcttaattgatttctcaactattttataagtaactggaatttttcattagatcttatacagagaagtattttattaaaaattcaaaagggaagacttttatgtgctcattttgtaatttttgattttaaatatctttacattgtctgccaattaaagtgttttaaacttgcattggaatggactccgaatgtatttttgtggtgttacgttatccgtagatttctagcatgaagttagcctcacgatgctgtgcaaaggattttaaaatatgagagtcactgaaagagtttaaacatctgttcatgttaaatgctctatggattttaattaaagacttgagaatgattttataa

SEQ ID NO: 102799 - DNA, 5383 bp, Homo sapiens
  Payload ID: 54
  Gene Symbol: XRN1
  Gene Name: 5'-3' exoribonuclease 1
  Uniprot ID: Q8IZH2
  ENST ID: ENST00000392981
  CDS Start-End: 49-5133
cgtttggtttcggtttggccctgactgggattagtgttgacgatcgaaatgggagtccccaagttttacagatggatctcagagcggtatccctgtctcagcgaagtggtgaaagagcatcagattcctgaatttgacaacttgtacctggatatgaatggaattatacatcagtgctcccatcctaatgatgatgatgttcactttagaatttcagatgataaaatctttactgatatttttcactacctggaggtgttgtttcgcattattaaacccaggaaagtgttctttatggctgtagatggtgtggctcctcgagcaaaaatgaaccagcagcgtgggaggcgttttaggtcagcaaaggaggcagaagacaaaattaaaaaggcaatagagaagggagaaactcttcctacagaggccagatttgattccaactgtatcacaccaggaactgaatttatggccaggttacatgaacatctgaagtattttgtaaatatgaaaatttccacagacaagtcatggcaaggagttaccatctacttctcaggccatgagactcctggagaaggagagcataaaatcatggaatttatcagatccgagaaagcaaagccagatcatgatccaaacaccagacactgtctttatggtttagatgctgacttgattatgcttggattaacaagtcatgaggcacatttttctctcttaagagaagaagttcgatttggtggcaaaaaaacacaacgggtatgtgctccagaagaaactacatttcaccttctacacttgtctttaatgagagagtatattgactatgagttttcagtattaaaagaaaagatcacatttaaatatgatattgaaaggataatagatgattggattttgatggggtttcttgttggtaatgattttatccctcatctacctcatttacatattaatcatgatgcactgcctcttctttatggaacatatgttaccatcctgccagaacttgggggttatattaatgaaagtgggcacctcaacttacctcgatttgagaaataccttgtgaaactatcagattttgatcgggagcacttcagtgaagtttttgtggacctaaaatggtttgaaagcaaagttggtaacaagtacctcaatgaagcagcaggtgtcgcagcagaagaagccaggaactacaaggaaaagaaaaagttaaagggccaggaaaattctctgtgttggactgctttagacaaaaatgaaggcgaaatgataacttctaaggataatttagaagatgagactgaagatgatgacctatttgaaactgagtttagacaatataaaagaacatattacatgacgaagatgggggttgacgtagtatctgatgactttctggctgatcaagctgcatgttatgttcaggcaatacagtggattttgcactattactatcatggagttcagtcctggagctggtattatccttatcattatgcacctttcctgtctgatatacacaacatcagtacactcaaaatccattttgaactaggaaaaccttttaagccatttgaacagcttcttgctgtacttccagcagccagcaaaaatttacttcctgcatgctaccagcatttgatgaccaatgaagactcaccaattatagaatattacccacctgattttaaaactgacctaaatgggaaacaacaggaatgggaagctgtggtgttaatcccttttattgatgagaagcgattattggaagccatggagacatgtaaccactccctcaaaaaggaagagaggaaaagaaaccaacatagtgagtgcctaatgtgctggtatgatagagacacagagtttatctatccttctccatggccagaaaagttccctgccatagaacgatgttgtacaaggtataaaataatatccttagatgcttggcgtgtagacataaacaaaaacaaaataaccagaattgaccagaaagcattatatttctgtggatttcctactctgaaacacatcagacacaaattttttttgaagaaaagtggtgttcaagtattccagcaaagcagtcgtggagaaaacatgatgttggaaatcttagtggatgcagaatcagatgaacttaccgtagaaaatgtagcttcatcagtgcttggaaaatctgtctttgttaattggcctcaccttgaggaagctagagtcgtggctgtatcagatggagaaactaagttttacttggaagaacctccaggaacacagaagctttattcaggaagaactgccccaccatctaaagtggttcatcttggagataaagaacaatctaactgggcaaaagaagtacaaggaatttcagaacactacctgagaagaaaaggaataataataaatgaaacatctgcagttgtgtatgctcagttactcacaggtcgtaaatatcaaataaatcaaaatggtgaagttcgtctagagaaacagtggtcaaaacaagttgttccttttgtttatcaaactattgtcaaggacatccgagctttcgactcccgtttctccaatatcaaaacattggatgatttgtttcctctgagaagtatggtctttatgctgggaactccctattatggctgcactggagaagttcaggattcaggtgatgtgattacagaaggtaggattcgtgtgattttcagcattccatgtgaacccaatcttgatgctttaatacagaaccagcataaatattctataaagtacaacccaggatatgtgttggccagtcgccttggagtgagtggataccttgtttcaaggtttacaggaagtatttttattggaagaggatctaggagaaaccctcatggagaccataaagcaaatgtgggtttaaatctcaaattcaacaagaaaaatgaggaggtacctggatatactaagaaagttggaagtgaatggatgtattcatctgcagcagaacaacttctggcagagtacttagagagagctccagaactatttagttatatagccaaaaatagccaagaggatgtgttctatgaagatgacatttggcctggagaaaatgagaatggtgctgaaaaagttcaagaaattattacttggctaaaaggacatcctgtcagtactttatctcgttcttcttgtgatttacaaattctggatgcagctattgttgagaaaattgaggaagaagtcgaaaagtgcaagcaaagaaagaataataagaaggtgcgagtaacagtgaaaccccatttgctatacagacctttagaacagcaacatggagtcattcctgatcgggatgcagaattttgtctttttgaccgtgttgtaaatgtgagagaaaacttctcagttccagttggccttcgaggcaccatcataggaataaaaggagctaatagagaagccgatgtactatttgaagtattatttgatgaagaatttcctggagggttaacaataagatgctcacctggtagaggttatcgactgccaacaagtgccttggtgaacctttctcatgggagtcgctctgaaactggaaatcagaagttgacagccatcgtaaaaccacaaccagctgtacatcaacatagctcaagttcatcagtttcctctgggcatttgggagccctcaaccattcccctcaatcactttttgttcctactcaagtacctactaaagatgatgatgaattctgcaacatttggcagtccttacagggatctggaaagatgcaatactttcagccaactatacaagagaagggtgcagttctacctcaagaaataagccaagtaaatcaacatcataaatctggctttaatgacaacagtgttaaatatcagcaaagaaaacatgaccctcacagaaaatttaaagaagagtgtaagagtcctaaagctgagtgttggtcccaaaaaatgtccaataagcagcctaactctggaattgagaactttttagcatctttgaatatctccaaagaaaatgaagtacagtcatctcatcatggggagcctccaagtgaagagcatttgtcaccacagtcatttgccatgaagggaacacggatgcttaaagaaattctaaaaattgatggctctaacactgtggaccataagaatgaaatcaaacagattgctaatgaaatccctgtttcctctaacagaagagatgaatatggattaccctctcagcctaaacaaaataagaaattagcatcttatatgaacaagcctcacagtgctaatgagtaccataatgttcagtctatggacaatatgtgttggcctgcccccagccagatccctcctgtatccacaccagtaactgaactttctcgaatttgttcccttgttggaatgccacaacctgatttctcctttcttaggatgccacagacaatgaccgtttgccaagtaaaattatctaatggcttactggtacatgggccacagtgccactctgaaaatgaagccaaagagaaagctgcactttttgctttacaacagttgggctccttaggcatgaatttccctttgccttcacaagtatttgcaaattatccttcagctgtaccacctggaaccattcctccagcctttcccccacctactgctaatataatgccttcgtcgtctcatctctttggctcaatgccatggggaccatcggtgccagttcctgggaagcccttccatcatactttatattctgggaccatgcccatggctgggggaataccagggggtgtgcacaatcagtttatacctctgcaggttactaaaaaaagggttgcaaacaaaaagaactttgagaataaggaagcccagagttctcaagccactccagttcagactagccagccagattcttccaacattgtcaaagtaagtccacgggagagctcatcagcttctttgaagtcctctccgattgctcaacctgcatcttcttttcaagttgaaactgcctctcaaggccatagtatatctcaccataagtcaacaccaatctcttcttcaagaagaaaatcaagaaaactggctgttaattttggtgtttctaaaccttctgagtaaatttggctcttagaattaagttaatttcttctctttccatctacctttttataaatacatatctatgtctcataaaaattagaatgtactattttaaaataatatgtgtaaattgaaatttttttcatttttaagttatcaggcacttttcatgctgtttaaaagactgtgtatcaaattgtgcactttaagtatgtgcagtttgttgtatgtcaattatacctcaataaatctgtaataaaaaactaaa

SEQ ID NO: 102800 - DNA, 2075 bp, Homo sapiens
  Payload ID: 54
  Gene Symbol: XRN1
  Gene Name: 5'-3' exoribonuclease 1
  Uniprot ID: Q8IZH2
  ENST ID: ENST00000463916
  CDS Start-End: 67-1446
ggcggagccccggcggggcgtttggtttcggtttggccctgactgggattagtgttgacgatcgaaatgggagtccccaagttttacagatggatctcagagcggtatccctgtctcagcgaagtggtgaaagagcatcagattcctgaatttgacaacttgtacctggatatgaatggaattatacatcagtgctcccatcctaatgatgatgatgttcactttagaatttcagatgataaaatctttactgatatttttcactacctggaggtgttgtttcgcattattaaacccaggaaagtgttctttatggctgtagatggtgtggctcctcgagcaaaaatgaaccagcagcgtgggaggcgttttaggtcagcaaaggaggcagaagacaaaattaaaaaggcaatagagaagggagaaactcttcctacagaggccagatttgattccaactgtatcacaccaggaactgaatttatggccaggttacatgaacatctgaagtattttgtaaatatgaaaatttccacagacaagtcatggcaaggagttaccatctacttctcaggccatgagactcctggagaaggagagcataaaatcatggaatttatcagatccgagaaagcaaagccagatcatgatccaaacaccagacactgtctttatggtttagatgctgacttgattatgcttggattaacaagtcatgaggcacatttttctctcttaagagaagaagttcgatttggtggcaaaaaaacacaacgggtatgtgctccagaagaaactacatttcaccttctacacttgtctttaatgagagagtatattgactatgagttttcagtattaaaagaaaagatcacatttaaatatgatattgaaaggataatagatgattggattttgatggggtttcttgttggtaatgattttatccctcatctacctcatttacatattaatcatgatgcactgcctcttctttatggaacatatgttaccatcctgccagaacttgggggttatattaatgaaagtgggcacctcaacttacctcgatttgagaaataccttgtgaaactatcagattttgatcgggagcacttcagtgaagtttttgtggacctaaaatggtttgaaagcaaagttggtaacaagtacctcaatgaagcagcaggtgtcgcagcagaagaagccaggaactacaaggaaaagaaaaagttaaagggccaggaaaattctctgtgttggactgctttagacaaaaatgaaggcgaaatgataacttctaaggataatttagaagatgagactgaagatgatgacctatttgaaactgagtttagacaatataaaagaacatattacatgacgaagatgggggttgacgtagtatctgagtacgtttttgccaatgcttttattttaaaatagaaaaaattagattttgcagttattcagaaaatatgattttgatgaagtagtgggagaaaaaggattttttggtttcatgaattattgtgtatgtttcaactagtctggttttggagaagatggtattaattctgacttgtattatattcctgtgataaaaattgctgaagagaaaatgatccttatgtataaggatttttgttacaaagttgtttataatagtaaaaaaattagaaataatctaaatgtccaataagaaggttcatcataattggccactgcttcttcattacagtcaccatctctgtcacctcttccatctccggaatctgcagaactgctaaactggtacttgcagaaagttcataacaatttggaaggatgcttatagtacattattaagtacaaattgtaaaggcaagacatgaaatcatacatacagtatgctctcattaaccttaaaaaaacctagatatagataaaagactgaaacactaaaaatgtaaaagtgatggctataagatgataaaaatgctgttcttcattgtccagattttcactcctgaggaaatagttcttttataataaaaaagcaatatttttcatattaaaaaactacctcccagaaa

SEQ ID NO: 102801 - DNA, 393 bp, Homo sapiens
  Payload ID: 54
  Gene Symbol: XRN1
  Gene Name: 5'-3' exoribonuclease 1
  ENST ID: ENST00000489241
  CDS Start-End: 1-190
agaagagtgtaagagtcctaaagctgagtgttggtcccaaaaaatgtccaataagcagcctaactctggaattgagaactttttagcatctttgaatatctccaaagaaaatgaagtacagtcatctcatcatggggagcctccaagtgaagagcatttgtcaccacagtcatttgccatgaagagatgaatatggattaccctctcagcctaaacaaaataagaaattagacaatgaccgtttgccaagtaaaattatctaatggcttactggtacatgggccacagtgccactctgaaaatgaagccaaagagaaagctgcactttttgctttacaacagttgggctccttaggcatgaatttccctttgccttcacaagtatttgcaaat

SEQ ID NO: 102802 - DNA, 5600 bp, Homo sapiens
  Payload ID: 54
  Gene Symbol: XRN1
  Gene Name: 5'-3' exoribonuclease 1
  ENST ID: ENST00000498077
  CDS Start-End: 1-3481
gaccaatgaagactcaccaattatagaatattacccacctgattttaaaactgacctaaatgggaaacaacaggaatgggaagctgtggtgttaatcccttttattgatgagcgattattggaagccatggagacatgtaaccactccctcaaaaaggaagagaggaaaagaaaccaacatagtgagtgcctaatgtgctggtatgatagagacacagagtttatctatccttctccatggccagaaaagttccctgccatagaacgatgttgtacaaggtataaaataatatccttagatgcttggcgtgtagacataaacaaaaacaaaataaccagaattgaccagaaagcattatatttctgtggatttcctactctgaaacacatcagacacaaattttttttgaagaaaagtggtgttcaagtattccagcaaagcagtcgtggagaaaacatgatgttggaaatcttagtggatgcagaatcagatgaacttaccgtagaaaatgtagcttcatcagtgcttggaaaatctgtctttgttaattggcctcaccttgaggaagctagagtcgtggctgtatcagatggagaaactaagttttacttggaagaacctccaggaacacagaagctttattcaggaagaactgccccaccatctaaagtggttcatcttggagataaagaacaatctaactgggcaaaagaagtacaaggaatttcagaacactacctgagaagaaaaggaataataataaatgaaacatctgcagttgtgtatgctcagttactcacaggtcgtaaatatcaaataaatcaaaatggtgaagttcgtctagagaaacagtggtcaaaacaagttgttccttttgtttatcaaactattgtcaaggacatccgagctttcgactcccgtttctccaatatcaaaacattggatgatttgtttcctctgagaagtatggtctttatgctgggaactccctattatggctgcactggagaagttcaggattcaggtgatgtgattacagaaggtaggattcgtgtgattttcagcattccatgtgaacccaatcttgatgctttaatacagaaccagcataaatattctataaagtacaacccaggatatgtgttggccagtcgccttggagtgagtggataccttgtttcaaggtttacaggaagtatttttattggaagaggatctaggagaaaccctcatggagaccataaagcaaatgtgggtttaaatctcaaattcaacaagaaaaatgaggaggtacctggatatactaagaaagttggaagtgaatggatgtattcatctgcagcagaacaacttctggcagagtacttagagagagctccagaactatttagttatatagccaaaaatagccaagaggatgtgttctatgaagatgacatttggcctggagaaaatgagaatggtgctgaaaaagttcaagaaattattacttggctaaaaggacatcctgtcagtactttatctcgttcttcttgtgatttacaaattctggatgcagctattgttgagaaaattgaggaagaagtcgaaaagtgcaagcaaagaaagaataataagaaggtgcgagtaacagtgaaaccccatttgctatacagacctttagaacagcaacatggagtcattcctgatcgggatgcagaattttgtctttttgaccgtgttgtaaatgtgagagaaaacttctcagttccagttggccttcgaggcaccatcataggaataaaaggagctaatagagaagccgatgtactatttgaagtattatttgatgaagaatttcctggagggttaacaataagatgctcacctggtagaggttatcgactgccaacaagtgccttggtgaacctttctcatgggagtcgctctgaaactggaaatcagaagttgacagccatcgtaaaaccacaaccagctgtacatcaacatagctcaagttcatcagtttcctctgggcatttgggagccctcaaccattcccctcaatcactttttgttcctactcaagtacctactaaagatgatgatgaattctgcaacatttggcagtccttacagggatctggaaagatgcaatactttcagccaactatacaagagaagggtgcagttctacctcaagaaataagccaagtaaatcaacatcataaatctggctttaatgacaacagtgttaaatatcagcaaagaaaacatgaccctcacagaaaatttaaagaagagtgtaagagtcctaaagctgagtgttggtcccaaaaaatgtccaataagcagcctaactctggaattgagaactttttagcatctttgaatatctccaaagaaaatgaagtacagtcatctcatcatggggagcctccaagtgaagagcatttgtcaccacagtcatttgccatgaagggaacacggatgcttaaagaaattctaaaaattgatggctctaacactgtggaccataagaatgaaatcaaacagattgctaatgaaatccctgtttcctctaacagaagagatgaatatggattaccctctcagcctaaacaaaataagaaattagcatcttatatgaacaagcctcacagtgctaatgagtaccataatgttcagtctatggacaatatgtgttggcctgcccccagccagatccctcctgtatccacaccagtaactgaactttctcgaatttgttcccttgttggaatgccacaacctgatttctcctttcttaggatgccacagacaatgaccgtttgccaagtaaaattatctaatggcttactggtacatgggccacagtgccactctgaaaatgaagccaaagagaaagctgcactttttgctttacaacagttgggctccttaggcatgaatttccctttgccttcacaagtatttgcaaattatccttcagctgtaccacctggaaccattcctccagcctttcccccacctactgctaatataatgccttcgtcgtctcatctctttggctcaatgccatggggaccatcggtgccagttcctgggaagcccttccatcatactttatattctgggaccatgcccatggctgggggaataccagggggtgtgcacaatcagtttatacctctgcaggttactaaaaaaagggttgcaaacaaaaagaactttgagaataaggaagcccagagttctcaagccactccagttcagactagccagccagattcttccaacattgtcaaagtaagtccacgggagagctcatcagcttctttgaagtcctctccgattgctcaacctgcatcttcttttcaagttgaaactgcctctcaaggccatagtatatctcaccataagtcaacaccaatctcttcttcaagaagaaaatcaagaaaactggctgttaattttggtgtttctaaaccttctgagtaaatttggctcttagaattaagttaatttcttctctttccatctacctttttataaatacatatctatgtctcataaaaattagaatgtactattttaaaataatatgtgtaaattgaaatttttttcatttttaagttatcaggcacttttcatgctgtttaaaagactgtgtatcaaattgtgcactttaagtatgtgcagtttgttgtatgtcaattatacctcaataaatctgtaataaaaaactaaattaaaccttgcattaaaataatatcacagtatcagtggactaaacattaaaatgtaccactctaatcattggcctcatgattgaagcatcctgaactatgaattagacatcagttagcaataataagcattttttacactatcattgaggaataattacatggagcatgaaatttgggcctccagtataacttactgaatgtggattttatttctctttttaatgatgtaagaaaattgtcaggagaatggctcttatttatgtgtgttttaacttatgctttgttgcctctgagggtctttagacctgctgtgaaaggatcacatttgttgtggtgctgccagttttgctttattctaaattttgtaccaaagcaactttagaataatcagaatatttcatctaactgcttagaactataaatagcattctaaatttgagtaaatacaattttttaggttactcaagaaccagcattagtaatttctagtaaaattgtttcaaaatctacagggtacaatgattacaaattaatcttctaacaaaataaaatatgaaatattagtcatgttaattaataaactgtattattttgtatagctttttatttgcttacctgacattttatgagagcttcatagttggtcggtatgtagtgcttcttgggactgaagaaattctaattgttgtttaagttccaaggtgtgctacaatataggaggcacagtcatcagtttgtgacatacattatttactgcctatttcattctgattctatatttttagctttatgctgaactgttcaatgatgctgggattctctctttgcatgtcatatgtgaatgtgtggttcaagctgtaactgttgaaattattttagaatttatgacgatttctcagcagggcctatgtttatatatatatatatatttattctttagtttttgtgatatgcttatatttttaaggaagtaagttatagcatacttttttaaaagtaggaaccacaatctttatatggagcagcttgttatatctgattttcatgtaactcattggaaactctgccatgactcttaaagtagtcttacttgttttttaaaatgctggtattaaactaaatggactcctttcactaactgctgatttcagagtttaaatgttagcaggatatttgtgtattagcagtgccttcagtataagagagaaatattcattatctgtcatttatcatagtcgtataagtttccatgattttattttctgttattttcataagttcagatgtttatcagttcccaacattgtttctttatctgtagtgggatcttgagtaatgaggctcaagtaaatcctcaatgtgtataattattgcctcataaactctctctttgtttttaaaggaaacatctattatggtaatacaaagaaaagttaaattgtgacagtaatgttatattaacctcttcctactttaaagtgtgaaatgtttcacctcagctgtacaaactccagcattgagaatttgcctcactcattactcctgtgtgacagttatataaatagcatgcagctcacatctgttttagagcatagaagaagcggcacctgccatcttctgaaaactccaaagggaaatttcagtagacatagtgcactaaacccataaggatacttgaccaatatttgagcacagcaagctgacagttctatacagataggcagtgaaagagttttattttccagccaggcgcagtggctcaaatcccagcacttcgggaggctaaggcaggcggatcacttgaggtccggagttccagacaagcctggccaacatgatgaagccctgtctctactaaaaatacaaaa

SEQ ID NO: 102803 - DNA, 686 bp, Homo sapiens
  Payload ID: 54
  Gene Symbol: XRN1
  Gene Name: 5'-3' exoribonuclease 1
  ENST ID: ENST00000477237
  CDS Start-End: 190-686
aattggcaaaatctgagtcatatgaagacacttagcttcagggaagcctgagaactttctaacctacctggtgtcagaaggtcagcaaaggaggcagaagacaaaattaaaaaggcaatagagaagggagaaactcttcctacagaggccagatttgattccaactgtatcacaccaggaactgaatttatggccaggttacatgaacatctgaagtattttgtaaatatgaaaatttccacagacaagtcatggcaaggagttaccatctacttctcaggccatgagactcctggagaaggagagcataaaatcatggaatttatcagatccgagaaagcaaagccagatcatgatccaaacaccagacactgtctttatggtttagatgctgacttgattatgcttggattaacaagtcatgaggcacatttttctctcttaagagaagaagttcgatttggtggcaaaaaaacacaacgggtatgtgctccagaagaaactacatttcaccttctacacttgtctttaatgagagagtatattgactatgagttttcagtattaaaagaaaagatcacatttaaatatgatattgaaaggataatagatgattggattttgatggggtttcttgttggtaatgattttatccctcatctacctcatttacatattaatcatga

SEQ ID NO: 102804 - DNA, 1180 bp, Homo sapiens
  Payload ID: 54
  Gene Symbol: XRN1
  Gene Name: 5'-3' exoribonuclease 1
  ENST ID: ENST00000486211
  CDS Start-End: 69-392
gcggcggagccccggcggggcgtttggtttcggtttggccctgactgggattagtgttgacgatcgaaatgggagtccccaagttttacagatggatctcagagcggtatccctgtctcagcgaagtggtgaaagagcatcagattcctgaatttgacaacttgtacctggatatgaatggaattatacatcagtgctcccatcctaatgatgatgatgttcactttagaatttcagatgataaaatctttactgatatttttcactacctggaggtgttgtttcgcattattaaacccaggaaagtgttctttatggctgtagatggtgtggctcctcgagcaaaaatgaaccagcagcgtgggaggcgttttagattatgcttggattaacaagtcatgaggcacatttttctctcttaagagaagaagttcgatttggtggcaaaaaaacacaacgggtatgtgctccagaagaaactacatttcaccttctacacttgtctttaatgagagagtatattgactatgagttttcagtattaaaagaaaagatcacatttaaatatgatattgaaaggataatagatgattggattttgatggggtttcttgttggtaatgattttatccctcatctacctcatttacatattaatcatgatgcactgcctcttctttatggaacatatgttaccatcctgccagaacttgggggttatattaatgaaagtgggcacctcaacttacctcgatttgagaaataccttgtgaaactatcagattttgatcgggagcacttcagtgaagtttttgtggacctaaaatggtttgaaagcaaagttggtaacaagtacctcaatgaagcagcaggtgtcgcagcagaagaagccaggaactacaaggaaaagaaaaagttaaagggccaggaaaattctctgtgttggactgctttagacaaaaatgaaggcgaaatgataacttctaaggataatttagaagatgagactgaagatgatgacctatttgaaactgagtttagacaatataaaagaacatattacatgacgaagatgggggttgacgtagtatctgagtacgtttttgccaatgcttttattttaaaatagaaaaaattagattttgcagttattcagaaaatatgattttgatgaagtagt

SEQ ID NO: 102805 - DNA, 3437 bp, Homo sapiens
  Payload ID: 55
  Gene Symbol: XRN2
  Gene Name: 5'-3' exoribonuclease 2
  Uniprot ID: Q9H0D6
  ENST ID: ENST00000377191
  CDS Start-End: 96-2948
acgtgggaggaagtgctggtgccctctgccgctgctcccgtctctttggttacgctcgtcagccggtcggccgccgcctccagccgtgtgccgctatgggagtcccggcgttcttccgctggctcagccgcaagtacccgtccatcatagtcaactgcgtggaagagaagccaaaagaatgcaatggtgtaaagattccagttgatgccagtaaacctaatccaaatgatgtggagtttgataatctgtatttggatatgaatggaatcatccatccctgtactcatcctgaagacaaaccagcaccaaaaaatgaagatgaaatgatggttgcaatttttgagtacattgacagacttttcagtattgtaagaccaagaagacttctctacatggcaatagatggagtggcaccacgtgctaaaatgaaccagcagcgttcaaggaggttcagggcatcaaaagaaggaatggaagcagcagtcgagaagcagcgagtcagggaagaaatattggcaaaaggtggctttcttcctccagaagaaataaaagaaagatttgacagcaactgtattacaccaggaactgaattcatggacaatcttgctaaatgccttcgctattacatagctgatcgtttaaataatgaccctgggtggaaaaatttgacagttattttatctgatgctagtgctcctggtgaaggagaacataaaatcatggattacattagaaggcaaagagcccagcctaaccatgacccaaatactcatcattgtttatgtggagcagatgctgatctcattatgcttggccttgccacacatgaaccgaactttaccattattagagaagaattcaaaccaaacaagcccaaaccatgtggtctttgtaatcagtttggacatgaggtcaaagattgtgaaggtttgccaagagaaaagaagggaaagcatgatgaacttgccgatagtcttccttgtgcagaaggagagtttatcttccttcggcttaatgttcttcgtgagtatttggaaagagaactcacaatggccagcctaccattcacatttgatgttgagaggagcattgatgactgggttttcatgtgcttctttgtgggaaatgacttcctccctcatttgccatcgttagagattagggaaaatgcaattgaccgtttggttaacatatacaaaaatgtggtacacaaaactgggggttaccttacagaaagtggttatgtcaatctgcaaagagtacagatgatcatgttagcagttggtgaagttgaggatagcatttttaaaaagagaaaggatgatgaggacagttttagaagacgacagaaagaaaaaagaaagagaatgaagagagatcaaccagctttcactcctagtggaatattaactcctcatgccttgggttcaagaaattcaccaggttctcaagtagccagtaatccgagacaagcagcctatgaaatgaggatgcagaataactctagtccttcgatatctcctaatacgagtttcacatctgatggctccccgtctccattaggaggaattaagcgaaaagcagaagacagtgacagtgaacctgagccagaggataatgtcaggttatgggaagctggctggaagcagcggtactacaagaacaaatttgatgtggatgcagctgatgagaaattccgtcggaaagttgtgcagtcgtacgttgaaggactttgctgggttcttagatattattaccagggctgtgcttcctggaagtggtattatccatttcattatgcaccatttgcttcagactttgaaggcattgcagacatgccatctgattttgagaagggtacgaaaccgtttaaaccactagaacaacttatgggggtatttccagctgcaagtggtaattttctacctccatcatggcggaagctcatgagtgatcctgattctagtataattgacttctatcctgaagattttgctattgatttgaatgggaagaaatatgcatggcaaggtgttgctctcttgccattcgtggatgagcgaaggctacgagctgccctagaagaggtatacccagacctcactccagaagagaccagaagaaacagccttggaggtgatgtcttatttgtggggaaacatcacccactccatgacttcattttagagctgtaccagacaggttccacagagccagtggaggtaccccctgaactatgtcatgggattcaaggaaagttttctttggatgaagaagccattcttccagatcaaatagtatgttctcctgttcctatgttaagggatctgacacagaacactgtagtcagtattaattttaaagacccacagtttgctgaagattacatttttaaagctgtaatgcttccaggagcaagaaagccagcagcagtactgaaacctagtgactgggaaaaatccagcaatggacggcagtggaagcctcagcttggctttaaccgtgaccggaggcctgtgcacctggatcaggcagccttcaggactttgggccatgtgatgccaagaggctcaggaactggcatttacagcaatgctgcaccaccacctgtgacttaccagggaaacttatacaggccgcttttgagaggacaagcccagattccaaaacttatgtcaaatatgaggccccaggattcctggcgaggtcctcctccccttttccagcagcaaaggtttgacagaggcgttggggctgaacctctgctcccatggaaccggatgctgcaaacccagaatgcagccttccagccaaaccagtaccagatgctagctgggcctggtgggtatccacccagacgagatgatcgtggagggagacagggatatcccagagaaggaaggaaataccctttgccaccaccctcaggaagatacaattggaattaagcttttgtaaagctttcccaaatcctttcatcattctacagttttatgctatttgtggaaagatttctttctcaagtagtagtttttaataaaactacagtactttgtgtatttcttttaactgtgtatatttctactgatctgatctcactgtttatgttgctttccaaagatgtatgttgcataatacagtggatctgaatttattattgcttataaaacacatttgatggaataggagtactggtttttcataatggttaaaaatgaaaccagctgtggatttcaaaacacagtgtattctagatcatctaagatccatgctgatttttattgcacaagaattaggtttgaactcgagctggaacctcagcaaactagagtatatattgttcagtatttctttggaaacatttcattaatgtacttgtcttacagaaatttctgaactttagtaaaaaaaaataaagttaaacttttaaaactctg

SEQ ID NO: 102806 - DNA, 2213 bp, Homo sapiens
  Payload ID: 56
  Gene Symbol: ATIC
  Gene Name: 5-aminoimidazole-4-carboxamide ribonucleotide formyltransferase/IMP cyclohydrolase
  Uniprot ID: P31939
  ENST ID: ENST00000236959
  CDS Start-End: 327-2105
actttggggtcgtgggcagatcgctggctcccacgcctggacttcgggatcgcaggcaggatcccttccagcccaagcactccgcccaggcgcgccaggcagagccccaccccatcccgccgttcccttcagccccggggcgcggatcttgcatctgaaactgagcagagcagggcgccgggcagggccggcgggccacgtgataagcccggaaacagctccgccccctcgcttcctgagccgccacatcccggcagccctcctacctgcgcacgtggtgccgccgctgctgcctcccgctcgccctgaacccagtgcctgcagccatggctcccggccagctcgccttatttagtgtctctgacaaaaccggccttgtggaatttgcaagaaacctgaccgctcttggtttgaatctggtcgcttccggagggactgcaaaagctctcagggatgctggtctggcagtcagagatgtctctgagttgacgggatttcctgaaatgttggggggacgtgtgaaaactttgcatcctgcagtccatgctggaatcctagctcgtaatattccagaagataatgctgacatggccagacttgatttcaatcttataagagttgttgcctgcaatctctatccctttgtaaagacagtggcttctccaggtgtaactgttgaggaggctgtggagcaaattgacattggtggagtaaccttactgagagctgcagccaaaaaccacgctcgagtgacagtggtgtgtgaaccagaggactatgtggtggtgtccacggagatgcagagctccgagagtaaggacacctccttggagactagacgccagttagccttgaaggcattcactcatacggcacaatatgatgaagcaatttcagattatttcaggaaacagtacagcaaaggcgtatctcagatgcccttgagatatggaatgaacccacatcagacccctgcccagctgtacacactgcagcccaagcttcccatcacagttctaaatggagcccctggatttataaacttgtgcgatgctttgaacgcctggcagctggtgaaggaactcaaggaggctttaggtattccagccgctgcctctttcaaacatgtcagcccagcaggtgctgctgttggaattccactcagtgaagatgaggccaaagtctgcatggtttatgatctctataaaaccctcacacccatctcagcggcatatgcaagagcaagaggggctgataggatgtcttcatttggtgattttgttgcattgtccgatgtttgtgatgtaccaactgcaaaaattatttccagagaagtatctgatggtataattgccccaggatatgaagaagaagccttgacaatactttccaaaaagaaaaatggaaactattgtgtccttcagatggaccaatcttacaaaccagatgaaaatgaagttcgaactctctttggtcttcatttaagccagaagagaaataatggtgtcgtcgacaagtcattatttagcaatgttgttaccaaaaataaagatttgccagagtctgccctccgagacctcatcgtagccaccattgctgtcaagtacactcagtctaactctgtgtgctacgccaagaacgggcaggttatcggcattggagcaggacagcagtctcgtatacactgcactcgccttgcaggagataaggcaaactattggtggcttagacaccatccacaagtgctttcgatgaagtttaaaacaggagtgaagagagcagaaatctccaatgccatcgatcaatatgtgactggaaccattggcgaggatgaagatttgataaagtggaaggcactgtttgaggaagtccctgagttactcactgaggcagagaagaaggaatgggttgagaaactgactgaagtttctatcagctctgatgccttcttccctttccgagataacgtagacagagctaaaaggagtggtgtggcgtacattgcggctccctccggttctgctgctgacaaagttgtgattgaggcctgcgacgaactgggaatcatcctcgctcatacgaaccttcggctcttccaccactgattttaccacacactgttttttggcttgcttatgtgtaggtgaacagtcacgcctgaaactttgaggataactttttaaaaaaataaaacagtatctcttaatcactgg

SEQ ID NO: 102807 - DNA, 569 bp, Homo sapiens
  Payload ID: 56
  Gene Symbol: ATIC
  Gene Name: 5-aminoimidazole-4-carboxamide ribonucleotide formyltransferase/IMP cyclohydrolase
  ENST ID: ENST00000444305
  CDS Start-End: 188-442
gcgcggatcttgcatctgaaactgagcagagcagggcgccgggcagggccggcgggccacgtgataagcccggaaacagctccgccccctcgcttcctgagccgccacatcccggcagccctcctacctgcgcacgtggtgccgccgctgctgcctcccgctcgccctgaacccagtgcctgcagccatggctcccggccagctcgccttatttagtgtctctgacaaaaccggccttgtggaatttgcaagaaacctgaccgctcttggtttgaatctggtcgcttccggagggactgcaaaagctctcagggatgctggtctggcagtcagagatgtctctgagttgacgggatttcctgaaatgttggggggacgtgtgaaaactttgcatcctgcagtccatgctgagttgttgcctgcaatctctatccctttgtaaagacagtggcttctccaggtgtaactgttgaggaggctgtggagcaaattgacattggtggagtaaccttactgagagctgcagccaaaaaccacgctcgagtgacagtggtgtgtgaaccagagga

SEQ ID NO: 102808 - DNA, 1046 bp, Homo sapiens
  Payload ID: 56
  Gene Symbol: ATIC
  Gene Name: 5-aminoimidazole-4-carboxamide ribonucleotide formyltransferase/IMP cyclohydrolase
  ENST ID: ENST00000427397
  CDS Start-End: 14-145
agtgcctgcagccatggctcccggccagctcggtgaggccctagcggagcggcgcggtctgcgtcctcgcctgcggccccccacgctcccgccttggcggcggccggcgggacccggcactgcaggggcggcgctgcgggattgaaagccagcgtccccgctccccggccgggccgcagcctgcgtggggcccgccttagagcagctcgcgggtccttatttagtgtctctgacaaaaccggccttgtggaatttgcaagaaacctgaccgctcttggtttgaatctggtcgcttccggagggactgcaaaagctctcagggatgctggtctggcagtcagagatgtctctgagttgacgggatttcctgaaatgttggggggacgtgtgaaaactttgcatcctgcagtccatgctggaatcctagctcgtaatattccagaagataatgctgacatggccagacttgatttcaatcttataagagttgttgcctgcaatctctatccctttgtaaagacagtggcttctccaggtgtaactgttgaggaggctgtggagcaaattgacattggtggagtaaccttactgagagctgcagccaaaaaccacgctcgagtgacagtggtgtgtgaaccagaggactatgtggtggtgtccacggagatgcagagctccgagagtaaggacacctccttggagactagacgccagttagccttgaagttctaaatggagcccctggatttataaacttgtgcgatgctttgaacgcctggcagctggtgaaggaactcaaggaggctttaggtattccagccgctgcctctttcaaacatgtcagcccagcaggtgctgctgttggaattccactcagtgaagatgaggccaaagtctgcatggtttatgatctctataaaaccctcacacccatctcagcggcatatgcaagagcaagaggggctgataggatgtcttcatttggtgattttgttgcattgtccgatgtttgtgatgtaccaactgcaaaaattatttccagagaa

SEQ ID NO: 102809 - DNA, 713 bp, Homo sapiens
  Payload ID: 56
  Gene Symbol: ATIC
  Gene Name: 5-aminoimidazole-4-carboxamide ribonucleotide formyltransferase/IMP cyclohydrolase
  ENST ID: ENST00000426233
  CDS Start-End: 1-694
aatatttttgcaggtatctgatggtataattgccccaggatatgaagaagaagccttgacaatactttccaaaaagaaaaatggaaactattgtgtccttcagatggaccaatcttacaaaccagatgaaaatgaagttcgaactctctttggtcttcatttaagccagaagagaaataatggtgtcgtcgacaagtcattatttagcaatgttgttaccaaaaataaagatttgccagagtctgccctccgagacctcatcgtagccaccattgctgtcaagtacactcagtctaactctgtgtgctacgccaagaacgggcaggttatcggcattggagcaggacagcagtctcgtatacactgcactcgccttgcaggagataaggcaaactattggtggcttagacaccatccacaagtgctttcgatgaagtttaaaacaggagtgaagagagcagaaatctccaatgccatcgatcaatatgtgactggaaccattggcgaggatgaagatttgataaagtggaaggcactgtttgaggaagtccctgagttactcactgaggcagagaagaaggaatgggttgagaaactgactgaagtttctatcagctctgatgccttcttccctttccgagataacgtagacagagctaaaagggtaagtatggaattgggtgcatttgcttagagttgagcattatgtagaa

SEQ ID NO: 102810 - DNA, 695 bp, Homo sapiens
  Payload ID: 56
  Gene Symbol: ATIC
  Gene Name: 5-aminoimidazole-4-carboxamide ribonucleotide formyltransferase/IMP cyclohydrolase
  ENST ID: ENST00000413174
  CDS Start-End: 185-695
ccttatttagtgtctctgacaaaaccggccttgtggaatttgcaagaaacctgaccgctcttggtttgaatctggtcgcttccggagggactgcaaaagctctcagggatgctggtctggcagtcagtaccattctgtttatctgtttttcagagatgtctctgagttgacgggatttcctgaaatgttggggggacgtgtgaaaactttgcatcctgcagtccatgctggaatcctagctcgtaatattccagaagataatgctgacatggccagacttgatttcaatcttataagagttgttgcctgcaatctctatccctttgtaaagacagtggcttctccaggtgtaactgttgaggaggctgtggagcaaattgacattggtggagtaaccttactgagagctgcagccaaaaaccacgctcgagtgacagtggtgtgtgaaccagaggactatgtggtggtgtccacggagatgcagagctccgagagtaaggacacctccttggagactagacgccagttagccttgaaggcattcactcatacggcacaatatgatgaagcaatttcagattatttcaggaaacagtacagcaaaggcgtatctcagatgcccttgagatatggaatgaacccacatcagacccctgcccagctgtacacactgcagcccaagcttcccatcacag

SEQ ID NO: 102811 - DNA, 2187 bp, Homo sapiens
  Payload ID: 56
  Gene Symbol: ATIC
  Gene Name: 5-aminoimidazole-4-carboxamide ribonucleotide formyltransferase/IMP cyclohydrolase
  ENST ID: ENST00000443953
  CDS Start-End: 72-203
agccctcctacctgcgcacgtggtgccgccgctgctgcctcccgctcgccctgaacccagtgcctgcagccatggctcccggccagctcggtgaggccctagcggagcggcgcggtctgcgtcctcgcctgcggccccccacgctcccgccttggcggcggccggcgggacccggcactgcaggggcggcgctgcgggattgaaagccagcgtccccgctccccggccgggccgcagcctgcgtggggcccgccttagagcagctcgcgggtgtaagacctggggaggcccggaccaggcctgcgaacgcagggtccagccttatttagtgtctctgacaaaaccggccttgtggaatttgcaagaaacctgaccgctcttggtttgaatctggtcgcttccggagggactgcaaaagctctcagggatgctggtctggcagtcagagatgtctctgagttgacgggatttcctgaaatgttggggggacgtgtgaaaactttgcatcctgcagtccatgctggaatcctagctcgtaatattccagaagataatgctgacatggccagacttgatttcaatcttataagagttgttgcctgcaatctctatccctttgtaaagacagtggcttctccaggtgtaactgttgaggaggctgtggagcaaattgacattggtggagtaaccttactgagagctgcagccaaaaaccacgctcgagtgacagtggtgtgtgaaccagaggactatgtggtggtgtccacggagatgcagagctccgagagtaaggacacctccttggagactagacgccagttagccttgaaggcattcactcatacggcacaatatgatgaagcaatttcagattatttcaggaaacagtacagcaaaggcgtatctcagatgcccttgagatatggaatgaacccacatcagacccctgcccagctgtacacactgcagcccaagcttcccatcacagttctaaatggagcccctggatttataaacttgtgcgatgctttgaacgcctggcagctggtgaaggaactcaaggaggctttaggtattccagccgctgcctctttcaaacatgtcagcccagcaggtgctgctgttggaattccactcagtgaagatgaggccaaagtctgcatggtttatgatctctataaaaccctcacacccatctcagcggcatatgcaagagcaagaggggctgataggatgtcttcatttggtgattttgttgcattgtccgatgtttgtgatgtaccaactgcaaaaattatttccagagaagtatctgatggtataattgccccaggatatgaagaagaagccttgacaatactttccaaaaagaaaaatggaaactattgtgtccttcagatggaccaatcttacaaaccagatgaaaatgaagttcgaactctctttggtcttcatttaagccagaagagaaataatggtgtcgtcgacaagtcattatttagcaatgttgttaccaaaaataaagatttgccagagtctgccctccgagacctcatcgtagccaccattgctgtcaagtacactcagtctaactctgtgtgctacgccaagaacgggcaggttatcggcattggagcaggacagcagtctcgtatacactgcactcgccttgcaggagataaggcaaactattggtggcttagacaccatccacaagtgctttcgatgaagtttaaaacaggagtgaagagagcagaaatctccaatgccatcgatcaatatgtgactggaaccattggcgaggatgaagatttgataaagtggaaggcactgtttgaggaagtccctgagttactcactgaggcagagaagaaggaatgggttgagaaactgactgaagtttctatcagctctgatgccttcttccctttccgagataacgtagacagagctaaaaggagtggtgtggcgtacattgcggctccctccggttctgctgctgacaaagttgtgattgaggcctgcgacgaactgggaatcatcctcgctcatacgaaccttcggctcttccaccactgattttaccacacactgttttttggcttgcttatgtgtaggtgaacagtcacgcctgaaactttgaggataactttttaaaaaaataaaacagtatctcttaatcactgg

SEQ ID NO: 102812 - DNA, 2275 bp, Homo sapiens
  Payload ID: 56
  Gene Symbol: ATIC
  Gene Name: 5-aminoimidazole-4-carboxamide ribonucleotide formyltransferase/IMP cyclohydrolase
  Uniprot ID: P31939
  ENST ID: ENST00000435675
  CDS Start-End: 392-2167
gtggtgccgccgctgctgcctcccgctcgccctgaacccagtgcctgcagccatggctcccggccagctcggtgaggccctagcggagcggcgcggtctgcgtcctcgcctgcggccccccacgctcccgccttggcggcggccggcgggacccggcactgcaggggcggcgctgcgggattgaaagccagcgtccccgctccccggccgggccgcagcctgcgtggggcccgccttagagcagctcgcgggtgtaagacctggggaggcccggaccaggcctgcgaacgcagggtccaggtgctggccttgcgattcgagaatctcctcccccagaccctcccaaggccttgcagaacacagtgcaatgtgctgcgaatcatgagaaaaaatgtcttctctttcagccttatttagtgtctctgacaaaaccggccttgtggaatttgcaagaaacctgaccgctcttggtttgaatctggtcgcttccggagggactgcaaaagctctcagggatgctggtctggcagtcagagatgtctctgagttgacgggatttcctgaaatgttggggggacgtgtgaaaactttgcatcctgcagtccatgctggaatcctagctcgtaatattccagaagataatgctgacatggccagacttgatttcaatcttataagagttgttgcctgcaatctctatccctttgtaaagacagtggcttctccaggtgtaactgttgaggaggctgtggagcaaattgacattggtggagtaaccttactgagagctgcagccaaaaaccacgctcgagtgacagtggtgtgtgaaccagaggactatgtggtggtgtccacggagatgcagagctccgagagtaaggacacctccttggagactagacgccagttagccttgaaggcattcactcatacggcacaatatgatgaagcaatttcagattatttcaggaaacagtacagcaaaggcgtatctcagatgcccttgagatatggaatgaacccacatcagacccctgcccagctgtacacactgcagcccaagcttcccatcacagttctaaatggagcccctggatttataaacttgtgcgatgctttgaacgcctggcagctggtgaaggaactcaaggaggctttaggtattccagccgctgcctctttcaaacatgtcagcccagcaggtgctgctgttggaattccactcagtgaagatgaggccaaagtctgcatggtttatgatctctataaaaccctcacacccatctcagcggcatatgcaagagcaagaggggctgataggatgtcttcatttggtgattttgttgcattgtccgatgtttgtgatgtaccaactgcaaaaattatttccagagaagtatctgatggtataattgccccaggatatgaagaagaagccttgacaatactttccaaaaagaaaaatggaaactattgtgtccttcagatggaccaatcttacaaaccagatgaaaatgaagttcgaactctctttggtcttcatttaagccagaagagaaataatggtgtcgtcgacaagtcattatttagcaatgttgttaccaaaaataaagatttgccagagtctgccctccgagacctcatcgtagccaccattgctgtcaagtacactcagtctaactctgtgtgctacgccaagaacgggcaggttatcggcattggagcaggacagcagtctcgtatacactgcactcgccttgcaggagataaggcaaactattggtggcttagacaccatccacaagtgctttcgatgaagtttaaaacaggagtgaagagagcagaaatctccaatgccatcgatcaatatgtgactggaaccattggcgaggatgaagatttgataaagtggaaggcactgtttgaggaagtccctgagttactcactgaggcagagaagaaggaatgggttgagaaactgactgaagtttctatcagctctgatgccttcttccctttccgagataacgtagacagagctaaaaggagtggtgtggcgtacattgcggctccctccggttctgctgctgacaaagttgtgattgaggcctgcgacgaactgggaatcatcctcgctcatacgaaccttcggctcttccaccactgattttaccacacactgttttttggcttgcttatgtgtaggtgaacagtcacgcctgaaactttgaggataactttttaaaaaaataaaacagtatctcttaatcactgg

SEQ ID NO: 102813 - DNA, 2212 bp, Homo sapiens
  Payload ID: 57
  Gene Symbol: ALAS1
  Gene Name: 5'-aminolevulinate synthase 1
  Uniprot ID: P13196
  ENST ID: ENST00000310271
  CDS Start-End: 146-2068
atattaaggcgccggcgatcgcggcctgaggctgctcccggacaagggcaacgagcgtttcgtttggacttctcgacttgagtgcccgcctccttcgccgccgcctctgcagtcctcagcgcaggagccagcatacttcctgaacatggagagtgttgttcgccgctgcccattcttatcccgagtcccccaggcctttctgcagaaagcaggcaaatctctgttgttctatgcccaaaactgccccaagatgatggaagttggggccaagccagcccctcgggcattgtccactgcagcagtacactaccaacagatcaaagaaacccctccggccagtgagaaagacaaaactgctaaggccaaggtccaacagactcctgatggatcccagcagagtccagatggcacacagcttccgtctggacaccccttgcctgccacaagccagggcactgcaagcaaatgccctttcctggcagcacagatgaatcagagaggcagcagtgtcttctgcaaagccagtcttgagcttcaggaggatgtgcaggaaatgaatgccgtgaggaaagaggttgctgaaacctcagcaggccccagtgtggttagtgtgaaaaccgatggaggggatcccagtggactgctgaagaacttccaggacatcatgcaaaagcaaagaccagaaagagtgtctcatcttcttcaagataacttgccaaaatctgtttccacttttcagtatgatcgtttctttgagaaaaaaattgatgagaaaaagaatgaccacacctatcgagtttttaaaactgtgaaccggcgagcacacatcttccccatggcagatgactattcagactccctcatcaccaaaaagcaagtgtcagtctggtgcagtaatgactacctaggaatgagtcgccacccacgggtgtgtggggcagttatggacactttgaaacaacatggtgctggggcaggtggtactagaaatatttctggaactagtaaattccatgtggacttagagcgggagctggcagacctccatgggaaagatgccgcactcttgttttcctcgtgctttgtggccaatgactcaaccctcttcaccctggctaagatgatgccaggctgtgagatttactctgattctgggaaccatgcctccatgatccaagggattcgaaacagccgagtgccaaagtacatcttccgccacaatgatgtcagccacctcagagaactgctgcaaagatctgacccctcagtccccaagattgtggcatttgaaactgtccattcaatggatggggcggtgtgcccactggaagagctgtgtgatgtggcccatgagtttggagcaatcaccttcgtggatgaggtccacgcagtggggctttatggggctcgaggcggagggattggggatcgggatggagtcatgccaaaaatggacatcatttctggaacacttggcaaagcctttggttgtgttggagggtacatcgccagcacgagttctctgattgacaccgtacggtcctatgctgctggcttcatcttcaccacctctctgccacccatgctgctggctggagccctggagtctgtgcggatcctgaagagcgctgagggacgggtgcttcgccgccagcaccagcgcaacgtcaaactcatgagacagatgctaatggatgccggcctccctgttgtccactgccccagccacatcatccctgtgcgggttgcagatgctgctaaaaacacagaagtctgtgatgaactaatgagcagacataacatctacgtgcaagcaatcaattaccctacggtgccccggggagaagagctcctacggattgcccccacccctcaccacacaccccagatgatgaactacttccttgagaatctgctagtcacatggaagcaagtggggctggaactgaagcctcattcctcagctgagtgcaacttctgcaggaggccactgcattttgaagtgatgagtgaaagagagaagtcctatttctcaggcttgagcaagttggtatctgctcaggcctgagcatgacctcaattatttcacttaaccccaggccattatcatatccagatggtcttcagagttgtctttatatgtgaattaagttatattaaattttaatctatagtaaaaacatagtcctggaaataaattcttgcttaaatg

SEQ ID NO: 102814 - DNA, 2430 bp, Homo sapiens
  Payload ID: 57
  Gene Symbol: ALAS1
  Gene Name: 5'-aminolevulinate synthase 1
  Uniprot ID: P13196
  ENST ID: ENST00000394965
  CDS Start-End: 361-2283
agcgcccaaggcgcatgcgcagcggtcactcccgctgtatattaaggcgccggcgatcgcggcctgaggctgctcccggacaagggcaacgagcgtttcgtttggacttctcgacttgagtgcccgcctccttcgccgccgcctctgcagtcctcagcgcagttatgcccagttcttcccgctgtggggacacgaccacggaggaatccttgcttcagggactcgggaccctgctggaccccttcctcgggtttaggggatgtggggaccaggagaaagtcaggatccctaagagtcttccctgcctggatggatgagtggcttcttctccacctagatgagccagcatacttcctgaacatggagagtgttgttcgccgctgcccattcttatcccgagtcccccaggcctttctgcagaaagcaggcaaatctctgttgttctatgcccaaaactgccccaagatgatggaagttggggccaagccagcccctcgggcattgtccactgcagcagtacactaccaacagatcaaagaaacccctccggccagtgagaaagacaaaactgctaaggccaaggtccaacagactcctgatggatcccagcagagtccagatggcacacagcttccgtctggacaccccttgcctgccacaagccagggcactgcaagcaaatgccctttcctggcagcacagatgaatcagagaggcagcagtgtcttctgcaaagccagtcttgagcttcaggaggatgtgcaggaaatgaatgccgtgaggaaagaggttgctgaaacctcagcaggccccagtgtggttagtgtgaaaaccgatggaggggatcccagtggactgctgaagaacttccaggacatcatgcaaaagcaaagaccagaaagagtgtctcatcttcttcaagataacttgccaaaatctgtttccacttttcagtatgatcgtttctttgagaaaaaaattgatgagaaaaagaatgaccacacctatcgagtttttaaaactgtgaaccggcgagcacacatcttccccatggcagatgactattcagactccctcatcaccaaaaagcaagtgtcagtctggtgcagtaatgactacctaggaatgagtcgccacccacgggtgtgtggggcagttatggacactttgaaacaacatggtgctggggcaggtggtactagaaatatttctggaactagtaaattccatgtggacttagagcgggagctggcagacctccatgggaaagatgccgcactcttgttttcctcgtgctttgtggccaatgactcaaccctcttcaccctggctaagatgatgccaggctgtgagatttactctgattctgggaaccatgcctccatgatccaagggattcgaaacagccgagtgccaaagtacatcttccgccacaatgatgtcagccacctcagagaactgctgcaaagatctgacccctcagtccccaagattgtggcatttgaaactgtccattcaatggatggggcggtgtgcccactggaagagctgtgtgatgtggcccatgagtttggagcaatcaccttcgtggatgaggtccacgcagtggggctttatggggctcgaggcggagggattggggatcgggatggagtcatgccaaaaatggacatcatttctggaacacttggcaaagcctttggttgtgttggagggtacatcgccagcacgagttctctgattgacaccgtacggtcctatgctgctggcttcatcttcaccacctctctgccacccatgctgctggctggagccctggagtctgtgcggatcctgaagagcgctgagggacgggtgcttcgccgccagcaccagcgcaacgtcaaactcatgagacagatgctaatggatgccggcctccctgttgtccactgccccagccacatcatccctgtgcgggttgcagatgctgctaaaaacacagaagtctgtgatgaactaatgagcagacataacatctacgtgcaagcaatcaattaccctacggtgccccggggagaagagctcctacggattgcccccacccctcaccacacaccccagatgatgaactacttccttgagaatctgctagtcacatggaagcaagtggggctggaactgaagcctcattcctcagctgagtgcaacttctgcaggaggccactgcattttgaagtgatgagtgaaagagagaagtcctatttctcaggcttgagcaagttggtatctgctcaggcctgagcatgacctcaattatttcacttaaccccaggccattatcatatccagatggtcttcagagttgtctttatatgtgaattaagttatattaaattttaatctatagtaaaaacatagtcctggaaataaattcttgcttaaatggtg

SEQ ID NO: 102815 - DNA, 758 bp, Homo sapiens
  Payload ID: 57
  Gene Symbol: ALAS1
  Gene Name: 5'-aminolevulinate synthase 1
  ENST ID: ENST00000493402
  CDS Start-End: 1-713
gccgagtgccaaagtacatcttccgccacaatgatgtcagccacctcagagaactgctgcaaagatctgacccctcagtccccaagattgtggcatttgaaactgtccattcaatggatggcaaagcctttggttgtgttggagggtacatcgccagcacgagttctctgattgacaccgtacggtcctatgctgctggcttcatcttcaccacctctctgccacccatgctgctggctggagccctggagtctgtgcggatcctgaagagcgctgagggacgggtgcttcgccgccagcaccagcgcaacgtcaaactcatgagacagatgctaatggatgccggcctccctgttgtccactgccccagccacatcatccctgtgcgggttgcagatgctgctaaaaacacagaagtctgtgatgaactaatgagcagacataacatctacgtgcaagcaatcaattaccctacggtgccccggggagaagagctcctacggattgcccccacccctcaccacacaccccagatgatgaactacttccttgagaatctgctagtcacatggaagcaagtggggctggaactgaagcctcattcctcagctgagtgcaacttctgcaggaggccactgcattttgaagtgatgagtgaaagagagaagtcctatttctcaggcttgagcaagttggtatctgctcaggcctgagcatgacctcaattatttcacttaaccccaggccattatcatatc

SEQ ID NO: 102816 - DNA, 2125 bp, Homo sapiens
  Payload ID: 57
  Gene Symbol: ALAS1
  Gene Name: 5'-aminolevulinate synthase 1
  Uniprot ID: P13196
  ENST ID: ENST00000469224
  CDS Start-End: 203-2125
aagaaggcagcgcccaaggcgcatgcgcagcggtcactcccgctgtatattaaggcgccggcgatcgcggcctgaggctgctcccggacaagggcaacgagcgtttcgtttggacttctcgacttgagtgcccgcctccttcgccgccgcctctgcagtcctcagcgcagtctttccacaggagccagcatacttcctgaacatggagagtgttgttcgccgctgcccattcttatcccgagtcccccaggcctttctgcagaaagcaggcaaatctctgttgttctatgcccaaaactgccccaagatgatggaagttggggccaagccagcccctcgggcattgtccactgcagcagtacactaccaacagatcaaagaaacccctccggccagtgagaaagacaaaactgctaaggccaaggtccaacagactcctgatggatcccagcagagtccagatggcacacagcttccgtctggacaccccttgcctgccacaagccagggcactgcaagcaaatgccctttcctggcagcacagatgaatcagagaggcagcagtgtcttctgcaaagccagtcttgagcttcaggaggatgtgcaggaaatgaatgccgtgaggaaagaggttgctgaaacctcagcaggccccagtgtggttagtgtgaaaaccgatggaggggatcccagtggactgctgaagaacttccaggacatcatgcaaaagcaaagaccagaaagagtgtctcatcttcttcaagataacttgccaaaatctgtttccacttttcagtatgatcgtttctttgagaaaaaaattgatgagaaaaagaatgaccacacctatcgagtttttaaaactgtgaaccggcgagcacacatcttccccatggcagatgactattcagactccctcatcaccaaaaagcaagtgtcagtctggtgcagtaatgactacctaggaatgagtcgccacccacgggtgtgtggggcagttatggacactttgaaacaacatggtgctggggcaggtggtactagaaatatttctggaactagtaaattccatgtggacttagagcgggagctggcagacctccatgggaaagatgccgcactcttgttttcctcgtgctttgtggccaatgactcaaccctcttcaccctggctaagatgatgccaggctgtgagatttactctgattctgggaaccatgcctccatgatccaagggattcgaaacagccgagtgccaaagtacatcttccgccacaatgatgtcagccacctcagagaactgctgcaaagatctgacccctcagtccccaagattgtggcatttgaaactgtccattcaatggatggggcggtgtgcccactggaagagctgtgtgatgtggcccatgagtttggagcaatcaccttcgtggatgaggtccacgcagtggggctttatggggctcgaggcggagggattggggatcgggatggagtcatgccaaaaatggacatcatttctggaacacttggcaaagcctttggttgtgttggagggtacatcgccagcacgagttctctgattgacaccgtacggtcctatgctgctggcttcatcttcaccacctctctgccacccatgctgctggctggagccctggagtctgtgcggatcctgaagagcgctgagggacgggtgcttcgccgccagcaccagcgcaacgtcaaactcatgagacagatgctaatggatgccggcctccctgttgtccactgccccagccacatcatccctgtgcgggttgcagatgctgctaaaaacacagaagtctgtgatgaactaatgagcagacataacatctacgtgcaagcaatcaattaccctacggtgccccggggagaagagctcctacggattgcccccacccctcaccacacaccccagatgatgaactacttccttgagaatctgctagtcacatggaagcaagtggggctggaactgaagcctcattcctcagctgagtgcaacttctgcaggaggccactgcattttgaagtgatgagtgaaagagagaagtcctatttctcaggcttgagcaagttggtatctgctcaggcctga

SEQ ID NO: 102817 - DNA, 2356 bp, Homo sapiens
  Payload ID: 57
  Gene Symbol: ALAS1
  Gene Name: 5'-aminolevulinate synthase 1
  Uniprot ID: P13196
  ENST ID: ENST00000484952
  CDS Start-End: 322-2244
cggcgatcgcggcctgaggctgctcccggacaagggcaacgagcgtttcgtttggacttctcgacttgagtgcccgcctccttcgccgccgcctctgcagtcctcagcgcagttatgcccagttcttcccgctgtggggacacgaccacggaggaatccttgcttcagggactcgggaccctgctggaccccttcctcgggtttaggggatgtggggaccaggagaaagtcaggatccctaagagtcttccctgcctggatggatgagtggcttcttctccacctagattctttccacaggagccagcatacttcctgaacatggagagtgttgttcgccgctgcccattcttatcccgagtcccccaggcctttctgcagaaagcaggcaaatctctgttgttctatgcccaaaactgccccaagatgatggaagttggggccaagccagcccctcgggcattgtccactgcagcagtacactaccaacagatcaaagaaacccctccggccagtgagaaagacaaaactgctaaggccaaggtccaacagactcctgatggatcccagcagagtccagatggcacacagcttccgtctggacaccccttgcctgccacaagccagggcactgcaagcaaatgccctttcctggcagcacagatgaatcagagaggcagcagtgtcttctgcaaagccagtcttgagcttcaggaggatgtgcaggaaatgaatgccgtgaggaaagaggttgctgaaacctcagcaggccccagtgtggttagtgtgaaaaccgatggaggggatcccagtggactgctgaagaacttccaggacatcatgcaaaagcaaagaccagaaagagtgtctcatcttcttcaagataacttgccaaaatctgtttccacttttcagtatgatcgtttctttgagaaaaaaattgatgagaaaaagaatgaccacacctatcgagtttttaaaactgtgaaccggcgagcacacatcttccccatggcagatgactattcagactccctcatcaccaaaaagcaagtgtcagtctggtgcagtaatgactacctaggaatgagtcgccacccacgggtgtgtggggcagttatggacactttgaaacaacatggtgctggggcaggtggtactagaaatatttctggaactagtaaattccatgtggacttagagcgggagctggcagacctccatgggaaagatgccgcactcttgttttcctcgtgctttgtggccaatgactcaaccctcttcaccctggctaagatgatgccaggctgtgagatttactctgattctgggaaccatgcctccatgatccaagggattcgaaacagccgagtgccaaagtacatcttccgccacaatgatgtcagccacctcagagaactgctgcaaagatctgacccctcagtccccaagattgtggcatttgaaactgtccattcaatggatggggcggtgtgcccactggaagagctgtgtgatgtggcccatgagtttggagcaatcaccttcgtggatgaggtccacgcagtggggctttatggggctcgaggcggagggattggggatcgggatggagtcatgccaaaaatggacatcatttctggaacacttggcaaagcctttggttgtgttggagggtacatcgccagcacgagttctctgattgacaccgtacggtcctatgctgctggcttcatcttcaccacctctctgccacccatgctgctggctggagccctggagtctgtgcggatcctgaagagcgctgagggacgggtgcttcgccgccagcaccagcgcaacgtcaaactcatgagacagatgctaatggatgccggcctccctgttgtccactgccccagccacatcatccctgtgcgggttgcagatgctgctaaaaacacagaagtctgtgatgaactaatgagcagacataacatctacgtgcaagcaatcaattaccctacggtgccccggggagaagagctcctacggattgcccccacccctcaccacacaccccagatgatgaactacttccttgagaatctgctagtcacatggaagcaagtggggctggaactgaagcctcattcctcagctgagtgcaacttctgcaggaggccactgcattttgaagtgatgagtgaaagagagaagtcctatttctcaggcttgagcaagttggtatctgctcaggcctgagcatgacctcaattatttcacttaaccccaggccattatcatatccagatggtcttcagagttgtctttatatgtgaattaagttatattaaattttaatctatagtaaaaa

SEQ ID NO: 102818 - DNA, 350 bp, Homo sapiens
  Payload ID: 57
  Gene Symbol: ALAS1
  Gene Name: 5'-aminolevulinate synthase 1
  ENST ID: ENST00000459884
  CDS Start-End: 1-350
tcgccgccagcaccagcgcaacgtcaaactcatgagacagatgctaatggatgccggcctccctgttgtccactgccccagccacatcatccctgtgcgggttgcagatgctgctaaaaacacagaagtctgtgatgaactaatgagcagacataacatctacgtgcaagcaatcaattaccctacggtgccccggggagaagagctcctacggattgcccccacccctcaccacacaccccagatgatgaactacttccttggtgagtacctggggagctgctggtgcctcactgaggagttgcataaagctgtctttgcagtgtttataattgaagcccttcagaggc

SEQ ID NO: 102819 - DNA, 2027 bp, Homo sapiens
  Payload ID: 58
  Gene Symbol: ALAS2
  Gene Name: 5'-aminolevulinate synthase 2
  Uniprot ID: P22557
  ENST ID: ENST00000330807
  CDS Start-End: 139-1902
aatgcagggccaggccggcagaaggcagggtgggtggggctgagtcagaggagaagggataaatgccaggtcctaacccaagtacccacctgtcattcgttcgtcctcagtgcagggcaacaggactttaggttcaagatggtgactgcagccatgctgctacagtgctgcccagtgcttgcccggggccccacaagcctcctaggcaaggtggttaagactcaccagttcctgtttggtattggacgctgtcccatcctggctacccaaggaccaaactgttctcaaatccaccttaaggcaacaaaggctggaggagattctccatcttgggcgaagggccactgtcccttcatgctgtcggaactccaggatgggaagagcaagattgtgcagaaggcagccccagaagtccaggaagatgtgaaggctttcaagacagatctgcctagctccctggtctcagtcagcctaaggaagccattttccggtccccaggagcaggagcagatctctgggaaggtcacacacctgattcagaacaatatgcctggaaactatgtcttcagttatgaccagtttttcagggacaagatcatggagaagaaacaggatcacacctaccgtgtgttcaagactgtgaaccgctgggctgatgcatatccctttgcccaacatttctctgaggcatctgtggcctcaaaggatgtgtccgtctggtgtagtaatgattacctgggcatgagccgacaccctcaggtcttgcaagccacacaggagaccctgcagcgtcatggtgctggagctggtggcacccgcaacatctcaggcaccagtaagtttcatgtggagcttgagcaggagctggctgagctgcaccagaaggactcagccctgctcttctcctcctgctttgttgccaatgactctactctcttcaccttggccaagatcctgccagggtgcgagatttactcagacgcaggcaaccatgcttccatgatccaaggtatccgtaacagtggagcagccaagtttgtcttcaggcacaatgaccctgaccacctaaagaaacttctagagaagtctaaccctaagatacccaaaattgtggcctttgagactgtccactccatggatggtgccatctgtcccctcgaggagttgtgtgatgtgtcccaccagtatggggccctgaccttcgtggatgaggtccatgctgtaggactgtatgggtcccggggcgctgggattggggagcgtgatggaattatgcataagattgacatcatctctggaactcttggcaaggcctttggctgtgtgggcggctacattgccagcacccgtgacttggtggacatggtgcgctcctatgctgcaggcttcatctttaccacttctctgccccccatggtgctctctggagctctagaatctgtgcggctgctcaagggagaggagggccaagccctgaggcgagcccaccagcgcaatgtcaagcacatgcgccagctactcatggacaggggccttcctgtcatcccctgccccagccacatcatccccatccgggtgggcaatgcagcactcaacagcaagctctgtgatctcctgctctccaagcatggcatctatgtgcaggccatcaactacccaactgtcccccggggtgaagagctcctgcgcttggcaccctccccccaccacagccctcagatgatggaagattttgtggagaagctgctgctggcttggactgcggtggggctgcccctccaggatgtgtctgtggctgcctgcaatttctgtcgccgtcctgtacactttgagctcatgagtgagtgggaacgttcctacttcgggaacatggggccccagtatgtcaccacctatgcctgagaagccagctgcctaggattcacaccccacctgcgcttcacttgggtccaggcctactcctgtcttctgctttgttgtgtgcctctagctgaattgagcctaaaaataaagcacaaaccacagca

SEQ ID NO: 102820 - DNA, 1795 bp, Homo sapiens
  Payload ID: 58
  Gene Symbol: ALAS2
  Gene Name: 5'-aminolevulinate synthase 2
  Uniprot ID: P22557
  ENST ID: ENST00000335854
  CDS Start-End: 52-1704
acctgtcattcgttcgtcctcagtgcagggcaacaggactttaggttcaagatggtgactgcagccatgctgctacagtgctgcccagtgcttgcccggggccccacaagcctcctaggcaaggtggttaagactcaccagttcctgtttggtattggacgctgtcccatcctggctacccaaggaccaaactgttctcaaatccaccttaaggcaacaaaggctggaggagattctccatcttgggcgaagggccactgtcccttcatgctgtcggaactccaggatgggaagagcaagattgtgcagaaggcagccccagaagtccaggaagatgtgaaggctttcaagacaggaaactatgtcttcagttatgaccagtttttcagggacaagatcatggagaagaaacaggatcacacctaccgtgtgttcaagactgtgaaccgctgggctgatgcatatccctttgcccaacatttctctgaggcatctgtggcctcaaaggatgtgtccgtctggtgtagtaatgattacctgggcatgagccgacaccctcaggtcttgcaagccacacaggagaccctgcagcgtcatggtgctggagctggtggcacccgcaacatctcaggcaccagtaagtttcatgtggagcttgagcaggagctggctgagctgcaccagaaggactcagccctgctcttctcctcctgctttgttgccaatgactctactctcttcaccttggccaagatcctgccagggtgcgagatttactcagacgcaggcaaccatgcttccatgatccaaggtatccgtaacagtggagcagccaagtttgtcttcaggcacaatgaccctgaccacctaaagaaacttctagagaagtctaaccctaagatacccaaaattgtggcctttgagactgtccactccatggatggtgccatctgtcccctcgaggagttgtgtgatgtgtcccaccagtatggggccctgaccttcgtggatgaggtccatgctgtaggactgtatgggtcccggggcgctgggattggggagcgtgatggaattatgcataagattgacatcatctctggaactcttggcaaggcctttggctgtgtgggcggctacattgccagcacccgtgacttggtggacatggtgcgctcctatgctgcaggcttcatctttaccacttctctgccccccatggtgctctctggagctctagaatctgtgcggctgctcaagggagaggagggccaagccctgaggcgagcccaccagcgcaatgtcaagcacatgcgccagctactcatggacaggggccttcctgtcatcccctgccccagccacatcatccccatccgggtgggcaatgcagcactcaacagcaagctctgtgatctcctgctctccaagcatggcatctatgtgcaggccatcaactacccaactgtcccccggggtgaagagctcctgcgcttggcaccctccccccaccacagccctcagatgatggaagattttgtggagaagctgctgctggcttggactgcggtggggctgcccctccaggatgtgtctgtggctgcctgcaatttctgtcgccgtcctgtacactttgagctcatgagtgagtgggaacgttcctacttcgggaacatggggccccagtatgtcaccacctatgcctgagaagccagctgcctaggattcacaccccacctgcgcttcacttgggtccaggcctactcctgtcttctgctttgttgtgtgcctctagctg

SEQ ID NO: 102821 - DNA, 1936 bp, Homo sapiens
  Payload ID: 58
  Gene Symbol: ALAS2
  Gene Name: 5'-aminolevulinate synthase 2
  Uniprot ID: P22557
  ENST ID: ENST00000396198
  CDS Start-End: 87-1811
acctgtcattcgttcgtcctcagtgcagggcaacagggcccacatgccttggccccacataccaacccaggctgctgtgacagcccatgagagggggagaggttgctctgggatggaacaagaaaaagaggttgttttgtgaggactttaggttcaagatggtgactgcagccatgctgctacagtgctgcccagtgcttgcccggggccccacaagcctcctaggcaaggtggttaagactcaccagttcctgtttggtattggacgctgtcccatcctggctacccaaggaccaaactgttctcaaatccaccttaaggcaacaaaggctggaggagattctccatcttgggcgaagggccactgtcccttcatgctgtcggaactccaggatgggaagagcaagattgtgcagaaggcagccccagaagtccaggaagatgtgaaggctttcaagacaggaaactatgtcttcagttatgaccagtttttcagggacaagatcatggagaagaaacaggatcacacctaccgtgtgttcaagactgtgaaccgctgggctgatgcatatccctttgcccaacatttctctgaggcatctgtggcctcaaaggatgtgtccgtctggtgtagtaatgattacctgggcatgagccgacaccctcaggtcttgcaagccacacaggagaccctgcagcgtcatggtgctggagctggtggcacccgcaacatctcaggcaccagtaagtttcatgtggagcttgagcaggagctggctgagctgcaccagaaggactcagccctgctcttctcctcctgctttgttgccaatgactctactctcttcaccttggccaagatcctgccagggtgcgagatttactcagacgcaggcaaccatgcttccatgatccaaggtatccgtaacagtggagcagccaagtttgtcttcaggcacaatgaccctgaccacctaaagaaacttctagagaagtctaaccctaagatacccaaaattgtggcctttgagactgtccactccatggatggtgccatctgtcccctcgaggagttgtgtgatgtgtcccaccagtatggggccctgaccttcgtggatgaggtccatgctgtaggactgtatgggtcccggggcgctgggattggggagcgtgatggaattatgcataagattgacatcatctctggaactcttggcaaggcctttggctgtgtgggcggctacattgccagcacccgtgacttggtggacatggtgcgctcctatgctgcaggcttcatctttaccacttctctgccccccatggtgctctctggagctctagaatctgtgcggctgctcaagggagaggagggccaagccctgaggcgagcccaccagcgcaatgtcaagcacatgcgccagctactcatggacaggggccttcctgtcatcccctgccccagccacatcatccccatccgggtgggcaatgcagcactcaacagcaagctctgtgatctcctgctctccaagcatggcatctatgtgcaggccatcaactacccaactgtcccccggggtgaagagctcctgcgcttggcaccctccccccaccacagccctcagatgatggaagattttgtggagaagctgctgctggcttggactgcggtggggctgcccctccaggatgtgtctgtggctgcctgcaatttctgtcgccgtcctgtacactttgagctcatgagtgagtgggaacgttcctacttcgggaacatggggccccagtatgtcaccacctatgcctgagaagccagctgcctaggattcacaccccacctgcgcttcacttgggtccaggcctactcctgtcttctgctttgttgtgtgcctctagctgaattgagcctaaaaataaagcacaaaccacagca

SEQ ID NO: 102822 - DNA, 664 bp, Homo sapiens
  Payload ID: 58
  Gene Symbol: ALAS2
  Gene Name: 5'-aminolevulinate synthase 2
  ENST ID: ENST00000455688
  CDS Start-End: 1-664
acctgtcattcgttcgtcctcagtgcagggcaacagattctccatcttgggcgaagggccactgtcccttcatgctgtcggaactccaggatgggaagagcaagattgtgcagaaggcagccccagaagtccaggaagatgtgaaggctttcaagacagatctgcctagctccctggtctcagtcagcctaaggaagccattttccggtccccaggagcaggagcagatctctgggaaggtcacacacctgattcagaacaatatgcctggaaactatgtcttcagttatgaccagtttttcagggacaagatcatggagaagaaacaggatcacacctaccgtgtgttcaagactgtgaaccgctgggctgatgcatatccctttgcccaacatttctctgaggcatctgtggcctcaaaggatgtgtccgtctggtgtagtaatgattacctgggcatgagccgacaccctcaggtcttgcaagccacacaggagaccctgcagcgtcatggtgctggagctggtggcacccgcaacatctcaggcaccagtaagtttcatgtggagcttgagcaggagctggctgagctgcaccagaaggactcagccctgctcttctcctcctgctttgttgccaatgactctactctcttcaccttggc

SEQ ID NO: 102823 - DNA, 943 bp, Homo sapiens
  Payload ID: 59
  Gene Symbol: AZI2
  Gene Name: 5-azacytidine induced 2
  Uniprot ID: Q9H6S1
  ENST ID: ENST00000334100
  CDS Start-End: 35-733
ggggcggccctacgtagcctggcttctggttgtcatggatgcactggtagaagatgatatctgtattctgaatcatgaaaaagcccataagagagatacagtgactccagtttcaatatattcaggagatgaatctgttgcttcccattttgctcttgtcactgcatatgaagacatcaaaaaacgacttaaggattcagagaaagagaactctttgttaaagaagagaataagatttttggaagaaaagctaatagctcgatttgaagaagaaacaagttccgtgggacgagaacaagtaaataaggcctatcatgcatatcgagaggtttgcattgatagagataatttgaagagcaaactggacaaaatgaataaagacaactctgaatctttgaaagtattgaatgagcagctacaatctaaagaagtagaactcctccagctgaggacagaggtggaaactcagcaggtgatgaggaatttaaatccaccttcatcaaactgggaggtggaaaagttgagctgtgacctgaagatccatggtttggaacaagagctggaactgatgaggaaagaatgtagcgatctcaaaatagaactacagaaagccaaacaaacggatccatatcaggaagacaatctgaagagcagagatctccaaaaactaagcatttcaagagtatctgtagcacagcctggagtgcagtggcgcaatcatgggatagcatgaattttgaggactgttccctcttcgcataagaatagaagtagccatcagagttcatatactttttcaaccctttttcctcaaatacgtatcatttttacttaagtaacttcaattctgtgttttaagctatctaataattgttgtttctactatgttaagatagcctctctacattgttaccctccatccaataaaaaatactgatctgac

SEQ ID NO: 102824 - DNA, 1136 bp, Homo sapiens
  Payload ID: 59
  Gene Symbol: AZI2
  Gene Name: 5-azacytidine induced 2
  Uniprot ID: Q9H6S1
  ENST ID: ENST00000457172
  CDS Start-End: 361-1092
tccagaacgtcccgggctcctgccgagtcagaagaaatgggactccctccgcgacgtgcccggagcagctcccttcgctgtggaagcggcggtgtcttcgaagaaaccggaagcccgtggtgacccctggcgacccggtttgttttcggtccgtttccaaacactaaggaatcgaaactcggcggccttgggggcggccctacgtagcctggcttctgggaggtcttaaaaggttttagccacagtttctccttccatcatgtttttcaggaacctaactctcagagaagtaatgctgaacctaacagcaaaagtagatgttcagagcaagtcagtttttcgttaaacaatgaagttgtcatggatgcactggtagaagatgatatctgtattctgaatcatgaaaaagcccataagagagatacagtgactccagtttcaatatattcaggagatgaatctgttgcttcccattttgctcttgtcactgcatatgaagacatcaaaaaacgacttaaggattcagagaaagagaactctttgttaaagaagagaataagatttttggaagaaaagctaatagctcgatttgaagaagaaacaagttccgtgggacgagaacaagtaaataaggcctatcatgcatatcgagaggtttgcattgatagagataatttgaagagcaaactggacaaaatgaataaagacaactctgaatctttgaaagtattgaatgagcagctacaatctaaagaagtagaactcctccagctgaggacagaggtggaaactcagcaggtgatgaggaatttaaatccaccttcatcaaactgggaggtggaaaagttgagctgtgacctgaagatccatggtttggaacaagagctggaactgatgaggaaagaatgtagcgatctcaaaatagaactacagaaagccaaacaaacggatccatatcaggaagacaatctgaagagcagagatctccaaaaactaagcatttcaagacagagtatctgtagcacagcctggagtgcagtggcgcaatcatgggatagcatgaattttgaggactgttccctcttcgcataagaatagaagtagccatcagagttcatatactttttcaacccttt

SEQ ID NO: 102825 - DNA, 1366 bp, Homo sapiens
  Payload ID: 59
  Gene Symbol: AZI2
  Gene Name: 5-azacytidine induced 2
  Uniprot ID: Q9H6S1
  ENST ID: ENST00000420543
  CDS Start-End: 456-1187
cgggcctgacttccggtttcctcgcgcgtccctggcgccgagcccgcggacagcggcagccccttttccggctgagagctcatccacacttccaatcactttccggagtgcttcccctccctccggcccgtgctggtcccgacggcgggcctgggtctcgcgcgcgtattgctgggtaacgggccttctctcgcgtcggcccggcccctcctgcctcggctcgtccctccttccagaacgtcccgggctcctgccgagtcagaagaaatgggactccctccgcgacgtgcccggagcagctcccttcgctgtggaagcggcggtgtcttcgaagaaaccggaagcccgtggtgacccctggcgacccggtttgttttcggtccgtttccaaacactaaggaatcgaaactcggcggccttgggggcggccctacgtagcctggcttctggttgtcatggatgcactggtagaagatgatatctgtattctgaatcatgaaaaagcccataagagagatacagtgactccagtttcaatatattcaggagatgaatctgttgcttcccattttgctcttgtcactgcatatgaagacatcaaaaaacgacttaaggattcagagaaagagaactctttgttaaagaagagaataagatttttggaagaaaagctaatagctcgatttgaagaagaaacaagttccgtgggacgagaacaagtaaataaggcctatcatgcatatcgagaggtttgcattgatagagataatttgaagagcaaactggacaaaatgaataaagacaactctgaatctttgaaagtattgaatgagcagctacaatctaaagaagtagaactcctccagctgaggacagaggtggaaactcagcaggtgatgaggaatttaaatccaccttcatcaaactgggaggtggaaaagttgagctgtgacctgaagatccatggtttggaacaagagctggaactgatgaggaaagaatgtagcgatctcaaaatagaactacagaaagccaaacaaacggatccatatcaggaagacaatctgaagagcagagatctccaaaaactaagcatttcaagacagagtatctgtagcacagcctggagtgcagtggcgcaatcatgggatagcatgaattttgaggactgttccctcttcgcataagaatagaagtagccatcagagttcatatactttttcaaccctttttcctcaaatacgtatcatttttacttaagtaacttcaattctgtgttttaagctatctaataattgttgtttctactatgttaagatagcctctctacattgttaccctccatccaataaaaaatactgatctg

SEQ ID NO: 102826 - DNA, 439 bp, Homo sapiens
  Payload ID: 59
  Gene Symbol: AZI2
  Gene Name: 5-azacytidine induced 2
  ENST ID: ENST00000429369
  CDS Start-End: 1-229
tctgaagagcagagatctccaaaaactaagcatttcaagtgataatatgcagcatgcatactgggaactgaagagagaaatgtctaatttacatctggtgactcaagtacaagctgaactactaagaaaactgaaaacctcaactgcaatcaagaaagcactgtcacagaatagagcaatgagaagcacagctcctgtcctgggaacccacggtgtaaaggacaagtaaagactggattaaaattaaatctacaaaatactgtgacagagctactctcatgaactactctggtccctccttctgaccactggctgccctagttccagactctgccacccctcatctactgtaagtaagcaactatttccaagtgagatcttaaacatcgtccttacaaagaagctgtaggcaaaaaaatgaaaataaaaataaattgtg

SEQ ID NO: 102827 - DNA, 1061 bp, Homo sapiens
  Payload ID: 59
  Gene Symbol: AZI2
  Gene Name: 5-azacytidine induced 2
  ENST ID: ENST00000414162
  CDS Start-End: 415-1061
cccgtgctggtcccgacggcgggcctgggtctcgcgcgcgtattgctgggtaacgggccttctctcgcgtcggcccggcccctcctgcctcggctcgtccctccttccagaacgtcccgggctcctgccgagtcagaagaaatgggactccctccgcgacgtgcccggagcagctcccttcgctgtggaagcggcggtgtcttcgaagaaaccggaagcccgtggtgacccctggcgacccggtttgttttcggtccgtttccaaacactaaggaatcgaaactcggcggccttgggggcggccctacgtagcctggcttctgggaacctaactctcagagaagtaatgctgaacctaacagcaaaagtagatgttcagagcaagtcagtttttcgttaaacaatgaagttgtcatggatgcactggtagaagatgatatctgtattctgaatcatgaaaaagcccataagagagatacagtgactccagtttcaatatattcaggagatgaatctgttgcttcccattttgctcttgtcactgcatatgaagacatcaaaaaacgacttaaggattcagagaaagagaactctttgttaaagaagagaataagatttttggaagaaaagctaatagctcgatttgaagaagaaacaagttccgtgggacgagaacaagtaaataaggcctatcatgcatatcgagaggtttgcattgatagagataatttgaagagcaaactggacaaaatgaataaagacaactctgaatctttgaaagtattgaatgagcagctacaatctaaagaagtagaactcctccagctgaggacagaggtggaaactcagcaggtgatgaggaatttaaatccaccttcatcaaactgggaggtggaaaagttgagctgtgacctgaagatccatggtttggaacaagagctggaactgatgaggaaagaatgtagcgatctcaaaatagaactacagaaagccaaacaaacggatccatatcaggaagacaatctgaagagcagagatctccaaaaactaagcatttcaag

SEQ ID NO: 102828 - DNA, 608 bp, Homo sapiens
  Payload ID: 59
  Gene Symbol: AZI2
  Gene Name: 5-azacytidine induced 2
  ENST ID: ENST00000415852
  CDS Start-End: 323-608
ctttgactagggagcggcccactcctgggcatccctttccccagtcacccccacacccagctgtccacaccctttcccctgtcaccctcacccccagctgtccaggcccttcttggtcattcacttctctaattactccttttcttttcgtactcttactggggcgccttcagttttttttcattcattgagactgctaaatgcttctttccgatacaaattatcggaaagaaaagagggacattggctaggacggtactccctggggcatctgagtggtgaatatcgaccccctgcacttgatcgagggctaacagttgtcatggatgcactggtagaagatgatatctgtattctgaatcatgaaaaagcccataagagagatacagtgactccagtttcaatatattcaggagatgaatctgttgcttcccattttgctcttgtcactgcatatgaagacatcaaaaaacgacttaaggattcagagaaagagaactctttgttaaagaagagaataagatttttggaagaaaagctaatagctcgatttgaagaagaaacaagttccgtgggacgagaacaagtaaataaggcctatcatgcat

SEQ ID NO: 102829 - DNA, 4706 bp, Homo sapiens
  Payload ID: 59
  Gene Symbol: AZI2
  Gene Name: 5-azacytidine induced 2
  Uniprot ID: Q9H6S1
  ENST ID: ENST00000479665
  CDS Start-End: 533-1711
agtacgccgcgcgccactcctgcacttccccacccccacgaccgaacctggcttcgctaacgccctcccagctccctcgggcctgacttccggtttcctcgcgcgtccctggcgccgagcccgcggacagcggcagccccttttccggctgagagctcatccacacttccaatcactttccggagtgcttcccctccctccggcccgtgctggtcccgacggcgggcctgggtctcgcgcgcgtattgctgggtaacgggccttctctcgcgtcggcccggcccctcctgcctcggctcgtccctccttccagaacgtcccgggctcctgccgagtcagaagaaatgggactccctccgcgacgtgcccggagcagctcccttcgctgtggaagcggcggtgtcttcgaagaaaccggaagcccgtggtgacccctggcgacccggtttgttttcggtccgtttccaaacactaaggaatcgaaactcggcggccttgggggcggccctacgtagcctggcttctggttgtcatggatgcactggtagaagatgatatctgtattctgaatcatgaaaaagcccataagagagatacagtgactccagtttcaatatattcaggagatgaatctgttgcttcccattttgctcttgtcactgcatatgaagacatcaaaaaacgacttaaggattcagagaaagagaactctttgttaaagaagagaataagatttttggaagaaaagctaatagctcgatttgaagaagaaacaagttccgtgggacgagaacaagtaaataaggcctatcatgcatatcgagaggtttgcattgatagagataatttgaagagcaaactggacaaaatgaataaagacaactctgaatctttgaaagtattgaatgagcagctacaatctaaagaagtagaactcctccagctgaggacagaggtggaaactcagcaggtgatgaggaatttaaatccaccttcatcaaactgggaggtggaaaagttgagctgtgacctgaagatccatggtttggaacaagagctggaactgatgaggaaagaatgtagcgatctcaaaatagaactacagaaagccaaacaaacggatccatatcaggaagacaatctgaagagcagagatctccaaaaactaagcatttcaagtgataatatgcagcatgcatactgggaactgaagagagaaatgtctaatttacatctggtgactcaagtacaagctgaactactaagaaaactgaaaacctcaactgcaatcaagaaagcctgtgcccctgtaggatgcagtgaagaccttggaagagacagcacaaaactgcacttgatgaattttactgcaacatacacaagacatccccctctcttaccaaatggcaaagctctttgtcataccacatcttcccctttaccaggagatgtaaaggttttatcagagaaagcaatcctccaatcatggacagacaatgagagatccattcctaatgatggtacatgctttcaggaacacagttcttatggcagaaattctctggaagacaattcctgggtatttccaagtcctcctaaatcaagtgagacagcatttggggaaactaaaactaaaactttgcctttacccaaccttccaccactgcattacttggatcaacataatcagaactgcctttataagaattaatttggaagagattcacgatttcaccatgaggacacttatctctttcagtggtcctcccaagaaattatttaacaaactgaaaggagattttgattaaaattttgcagaggtcttcagtatctatatttgaacacactgtacaatagtacaaaaaccaacatagttggttttctagtatgaaagagcaccctctagctccatattctaagaatctgaaatatgctactatactaattaataagtaaacttaaggtgtttaaaaaactctgccttctatattaattgtaaaattttgcctctcagaagaatggaattggagattgtagacgtggttttacaaaatgtgaaatgtctaaatatctgttcataaaaataaaaggaaaacatgtttcttcaaattgcataatggaacaaatggcaatgtgagtaggttacatttctgttgttataatgcgtaaagatattgaaaatataatgaaataaaagcatcttaggttataccatctttatatgctattgcgtttcaatatttaagatttaaagtgattttttggtcacagtgttttgttgataaaatttttttagaattgaagtttgaattctaagacttgaaacaacctgatcactgaagccaactttgtcccagcacattccttaagtcctaattgggaaaaaaaaaaaaaaaaatgaaatagttgaaaaactctggggtgtaaacaaatgattgtaaccctacacactattcaataagtagtagaaggagcatcacacagatttcagtctaatctgcccttctgtgggccataatataaacataaatgtgtgtaatgataaaaagtcattttcttcaaagagactacagctagctgcacattgtgtagagcagcttctaaattgttagactttgtgttgaaatgtaatattctatttattgagaaagtgatttaaaattattatttttaatcatagaaatcagggtttgggctgtattgatattgtcgatcatgaaatgtccacacttattctaagtggccaattatttggaaataaagaaggaaataaagatggcttcacatggaaatttaagttctttcagggtggagatttacttggttcatacaccttttgcctgaattaaagtatttcatgtaggaggacttttatcctttttgatagacagtttcatatatcttgaactcaatatctcagatctcttctactgtattactgaatagcatacatacatagacaatgttcgccattcactagatatttttttctattatcttacacttattcaagcttgtctgtgattaatggaattggtgtcagatgctggaatttattctgaccaatgaacacagctgactcaggggagtacaatctcctgccaagtaatagaaccaaacccaatatgcataaaagaaatacaatactccaggctttagctgaaggaagcaactacctgtgtaataacaaagcagcaaaaactatttctcatgtggctgcataggctgtatattatatctgatctctaatgtagcttactggtttgccttttttaaaaccaaaattggaaattttcctttgtaaagaaaaaaagtcttatgagataattgcttgattaatgttttgaacaataccaagaaattgtttaattaaaataaatatttttgtttgaaattgaagtggatgtgaaatattgtccttgcctatagatctcaaaatctagtactaattgttggttgttaatatgattcatacaatagacatttgttaaaccagcttttgagtggagaaaattattttccatttaaacagtacagtgatgatagctatcaaacaggtatactaaaaagtcagtgactgtgacagtttaaagtgttagacaaatgatgtataaggttctttagtaaggaaagattagccaaaaattttttacccagctagaagcttttaaatctacacttgatatctctgttctaggtaaaattcaaacaaccaaaaaacagtggcccatctgtagcttatgaatctatttaaaattgaatattttatgttgacttctttcatactagctgaaacttgctctaaagagcttcctttggaatctttagatttctttttataaggttcaattcagtacatccataaatcgacagaatgaagaaaacataacaaaaagccacctattccttcctcttgctcccttattagctaaagtaaaatttacatctgtaagacttactgagttgctgccaaaatggaactgaattcttaaaagcaggaacatgcctatgtgaaacattagaaaaccaaaataaatgggaaaattcagacttgaagagctgaatcatgtgacaacaaagtactgatcttaattcagaaaggctacttggagaaggtgtatcttaaggggtaaaaaacctgtgggttaccacatattaacagggaataatatcaacagaggcacccataagcaagcaagacacaactgagacagatgtaccaggtgaaaaaaatcttcagtatggatacacatgggtattctgaaggctacaatgaatggtttagtctttgacataaggaggatgaacatattatttatactgtgtaatctaatctggcttctatggggaaagcaacatgtacataagtgaattttctacatgaagtgggctacttctgattttaatcaaagctataaaatagattgtatatttcactagcttcttaaagtaactcttccattttcatttatctctaaaaacagttaacttcctgtgctctaggaaatgcaccaataccaaaggtcaatgtggaaatatgggcatgtttgcccctatgctgtgtggtctctagatttctatatttgctttgcttttgtctgctctagtaatctccctccttttgatctgtggcctgggaaaatgtggtttctttgtatttcaaataaaagtaaaatagttttttgagtggttcactcaagagtaaa

SEQ ID NO: 102830 - DNA, 2515 bp, Homo sapiens
  Payload ID: 60
  Gene Symbol: HMCES
  Gene Name: 5-hydroxymethylcytosine (hmC) binding, ES cell-specific
  Uniprot ID: Q96FZ2
  ENST ID: ENST00000383463
  CDS Start-End: 90-1154
tggccaaagcggagcggagcgggggtgaggagagtcgagggaggtgacgcgcgctgccggggcgaggttgcgaggggcggtgttgaagaatgtgtgggcgaacatcctgtcacttacctagagatgttctcacgagagcttgcgcctaccaggatcggcggggccagcagcggctcccggagtggagggaccctgataagtactgcccctcttacaacaagagtcctcaatccaacagcccagtgcttctgtctcgactgcactttgagaaggatgcagactcatctgagcgtatcattgctcccatgcgctggggcttggtcccttcttggttcaaagaaagtgatccttccaagctgcagttcaatactaccaactgtcgtagtgataccgtaatggagaaacggtcatttaaggtgcctctgggaaagggaagacgctgtgtcgttttagcagatggattctatgagtggcagcgatgtcagggaacaaaccagaggcagccatacttcatctattttcctcaaatcaagacagagaagtcaggtagcattggtgctgcagatagtcctgagaactgggagaaagtctgggacaactggaggctgctgacaatggccgggatctttgactgctgggagcccccagagggaggagatgtcctgtattcctataccatcatcacagtggattcctgcaaaggcttgagtgacatccaccacaggatgcctgccatattagatggagaggaggcagtttctaaatggcttgactttggtgaagtctcaactcaggaagctctgaaattaatccacccaacagagaacatcaccttccatgcagtctcttctgtggtgaacaactcgcgaaacaacactcctgagtgtctggctcctgtcgacttggtggtcaaaaaggagctcagggcaagtggcagtagccagaggatgttgcagtggttggccacaaagtcacccaaaaaggaagactcaaaaacacctcaaaaggaagagtcagatgttccccagtggtccagtcagttcctgcagaagagtccactccccaccaagagaggcactgcaggactcctagagcaatggctgaagcgggagaaggaggaggaacctgtggccaagcgtccttacagccagtgacacaggactttcagagaccaaggccagggtctgctgcactgctgttctgataataggttcttaacattgtatgtatatgtgtttgctttgggaggaggtggcactgtgttagttgacagttgtgggctcatgtagtcttttttgccatgagtaggagcccctagtggggctggtggacagctttggaagaggtgtcctgctgctgttaccagccatgtgggccccataggggcactgcgcctgctgccctttcctggcagggctggtggagtcttccctcaaagcatgccttacccagctgggaagtctctgccctgatctggtactccttgtagtaagctgttttctgctcagccactgggctctttcacttttttagttcttaaaaatttatttttaagttctaaaataaaataaaaataagttcttaaaatttatttttttcctgaataaattgtatttggtaaacttctgcctacattttggaaagtgatgctggtggggaaagttctagatcttacttggtttcttctagaatcagtcttcaggaatggattttgtcacaaatggggcatgggggctttctgaggaaataactacaagtcttggtggtgggctccttattatgtttctttttctttcattcttgatacttggaagtcgtctgaatcctttagcttcaaaccagcctgagtttgagtgcttgccgtagcagaaactatccttaccacaggtgggaaggaaaggaccagtttctagcagtgtcgggccactcctctttcgaacatccctaagggaggcattcacaaaagctgtcccaagcagctggaagaaaacagcttccgagatgaccaggaggactgggcggcgccgagcccagaacgctcctggcgcagcaccgttggcgttggccgattgctgctggtggggggcgggggtgcaggccccagtctctatgcaaatcagggatcagaagatcggaatttccaccaatcagcgggaagcctcggccctgtaactgctaatgggagacagcagcgccacgccacaggcttttcccctggtttcgggaggggtggggagccaggtggggctcccgcccagaccctttcccgaggtccgccctctccgccttttctctaaattcctcttttgagtgccctcccttccggttgagaggcgggggttggcccgtagttgtacactcagtcaccctgcactgtggaggcgggggcctcccttgtggactgatttgcgtgggatttggttgttttattaagagatttaaaaaattcagatgacttactagtatgactgttttgtcatatttgcttccaggttaataaatgacaaaaatgaaa

SEQ ID NO: 102831 - DNA, 1763 bp, Homo sapiens
  Payload ID: 60
  Gene Symbol: HMCES
  Gene Name: 5-hydroxymethylcytosine (hmC) binding, ES cell-specific
  Uniprot ID: Q96FZ2
  ENST ID: ENST00000389735
  CDS Start-End: 262-1326
gcgagctgacagaggggagcagaggcccgagcggacgcgaggcgacgcggagagggcggcctgggccgaagtgaggcgacgcggggcggcggagtctgagggccggagcggagcggaggcgacgcggggaggggcgagggatcgcggccggtggctgggggccacctgctccccgagcaccggcccccgctccggggagcagagtccggagcgggatccgcggcccacaggttcgcaggttgcgaggggcggtgttgaagaatgtgtgggcgaacatcctgtcacttacctagagatgttctcacgagagcttgcgcctaccaggatcggcggggccagcagcggctcccggagtggagggaccctgataagtactgcccctcttacaacaagagtcctcaatccaacagcccagtgcttctgtctcgactgcactttgagaaggatgcagactcatctgagcgtatcattgctcccatgcgctggggcttggtcccttcttggttcaaagaaagtgatccttccaagctgcagttcaatactaccaactgtcgtagtgataccgtaatggagaaacggtcatttaaggtgcctctgggaaagggaagacgctgtgtcgttttagcagatggattctatgagtggcagcgatgtcagggaacaaaccagaggcagccatacttcatctattttcctcaaatcaagacagagaagtcaggtagcattggtgctgcagatagtcctgagaactgggagaaagtctgggacaactggaggctgctgacaatggccgggatctttgactgctgggagcccccagagggaggagatgtcctgtattcctataccatcatcacagtggattcctgcaaaggcttgagtgacatccaccacaggatgcctgccatattagatggagaggaggcagtttctaaatggcttgactttggtgaagtctcaactcaggaagctctgaaattaatccacccaacagagaacatcaccttccatgcagtctcttctgtggtgaacaactcgcgaaacaacactcctgagtgtctggctcctgtcgacttggtggtcaaaaaggagctcagggcaagtggcagtagccagaggatgttgcagtggttggccacaaagtcacccaaaaaggaagactcaaaaacacctcaaaaggaagagtcagatgttccccagtggtccagtcagttcctgcagaagagtccactccccaccaagagaggcactgcaggactcctagagcaatggctgaagcgggagaaggaggaggaacctgtggccaagcgtccttacagccagtgacacaggactttcagagaccaaggccagggtctgctgcactgctgttctgataataggttcttaacattgtatgtatatgtgtttgctttgggaggaggtggcactgtgttagttgacagttgtgggctcatgtagtcttttttgccatgagtaggagcccctagtggggctggtggacagctttggaagaggtgtcctgctgctgttaccagccatgtgggccccataggggcactgcgcctgctgccctttcctggcagggctggtggagtcttccctcaaagcatgccttacccagctgggaagtctctgccctgatctggtactccttgtagtaagctgttttctgctcagccactgggctctttcacttttttagttcttaaaaatttatttttaagttctaaaataaaataaaaataagttcttaaaattta

SEQ ID NO: 102832 - DNA, 1490 bp, Homo sapiens
  Payload ID: 60
  Gene Symbol: HMCES
  Gene Name: 5-hydroxymethylcytosine (hmC) binding, ES cell-specific
  ENST ID: ENST00000417226
  CDS Start-End: 84-1022
aagcggagcggagcgggggtgaggagagtcgagggaggtgacgcgcgctgccggggcgaggttgcgaggggcggtgttgaagaatgtgtgggcgaacatcctgtcacttacctagagatgttctcacgagagcttgcgcctaccaggatcggcggggccagcagcggctcccggagtggagggaccctgataagtactgcccctcttacaacaagagtcctcaatccaacagcccagtgcttctgtctcgactgcactttgagaaggatgcagactcatctgagcgtatcattgctcccatgcgctggggcttggtcccttcttggttcaaagaaagtgatccttccaagctgcagttcaatactaccaactgtcgtagtgataccgtaatggagaaacggtcatttaagtcaggtagcattggtgctgcagatagtcctgagaactgggagaaagtctgggacaactggaggctgctgacaatggccgggatctttgactgctgggagcccccagagggaggagatgtcctgtattcctataccatcatcacagtggattcctgcaaaggcttgagtgacatccaccacaggatgcctgccatattagatggagaggaggcagtttctaaatggcttgactttggtgaagtctcaactcaggaagctctgaaattaatccacccaacagagaacatcaccttccatgcagtctcttctgtggtgaacaactcgcgaaacaacactcctgagtgtctggctcctgtcgacttggtggtcaaaaaggagctcagggcaagtggcagtagccagaggatgttgcagtggttggccacaaagtcacccaaaaaggaagactcaaaaacacctcaaaaggaagagtcagatgttccccagtggtccagtcagttcctgcagaagagtccactccccaccaagagaggcactgcaggactcctagagcaatggctgaagcgggagaaggaggaggaacctgtggccaagcgtccttacagccagtgacacaggactttcagagaccaaggccagggtctgctgcactgctgttctgataataggttcttaacattgtatgtatatgtgtttgctttgggaggaggtggcactgtgttagttgacagttgtgggctcatgtagtcttttttgccatgagtaggagcccctagtggggctggtggacagctttggaagaggtgtcctgctgctgttaccagccatgtgggccccataggggcactgcgcctgctgccctttcctggcagggctggtggagtcttccctcaaagcatgccttacccagctgggaagtctctgccctgatctggtactccttgtagtaagctgttttctgctcagccactgggctctttcacttttttagttcttaaaaatttatttttaagttctaaaataaaataaaaataagttcttaaaatttatttttttcctgaataaattgtatttggtaaa

SEQ ID NO: 102833 - DNA, 643 bp, Homo sapiens
  Payload ID: 60
  Gene Symbol: HMCES
  Gene Name: 5-hydroxymethylcytosine (hmC) binding, ES cell-specific
  ENST ID: ENST00000511665
  CDS Start-End: 223-643
cggacgcgaggcgacgcggagagggcggcctgggccgaagtgaggcgacgcggggcggcggagtctgagggccggagcggagcggaggcgacgcggggaggggcgagggatcgcggccggtggctgggggccacctgctccccgagcaccggcccccgctccggggagcagagtccggagcgggatccgcggcccacaggttgcgaggggcggtgttgaagaatgtgtgggcgaacatcctgtcacttacctagagatgttctcacgagagcttgcgcctaccaggatcggcggggccagcagcggctcccggagtggagggaccctgataagtactgcccctcttacaacaagagtcctcaatccaacagcccagtgcttctgtctcgactgcactttgagaagtcaggtagcattggtgctgcagatagtcctgagaactgggagaaagtctgggacaactggaggctgctgacaatggccgggatctttgactgctgggagcccccagagggaggagatgtcctgtattcctataccatcatcacagtggattcctgcaaaggcttgagtgacatccaccacaggatgcctgccatattagatggagaggaggcagtttctaaatggcttgactttggtg

SEQ ID NO: 102834 - DNA, 948 bp, Homo sapiens
  Payload ID: 60
  Gene Symbol: HMCES
  Gene Name: 5-hydroxymethylcytosine (hmC) binding, ES cell-specific
  ENST ID: ENST00000509042
  CDS Start-End: 102-948
cggtgacgcgggtggccaaagcggagcggagcgggggtgaggagagtcgagggaggtgacgcgcgctgccggggcgaggttgcgaggggcggtgttgaagaatgtgtgggcgaacatcctgtcacttacctagagatgttctcacgagagcttgcgcctaccaggatcggcggggccagcagcggctcccggagtggagggaccctgataagtactgcccctcttacaacaagagtcctcaatccaacagcccagtgcttctgtctcgactgcactttgagaaggtgcctctgggaaagggaagacgctgtgtcgttttagcagatggattctatgagtggcagcgatgtcagggaacaaaccagaggcagccatacttcatctattttcctcaaatcaagacagagaagtcaggtagcattggtgctgcagatagtcctgagaactgggagaaagtctgggacaactggaggctgctgacaatggccgggatctttgactgctgggagcccccagagggaggagatgtcctgtattcctataccatcatcacagtggattcctgcaaaggcttgagtgacatccaccacaggatgcctgccatattagatggagaggaggcagtttctaaatggcttgactttggtgaagtctcaactcaggaagctctgaaattaatccacccaacagagaacatcaccttccatgcagtctcttctgtggtgaacaactcgcgaaacaacactcctgagtgtctggctcctgtcgacttggtggtcaaaaaggagctcagggcaagtggcagtagccagaggatgttgcagtggttggccacaaagtcacccaaaaaggaagactcaaaaacacctcaaaaggaagagtcagatgttccccagtggtccagtcagttcctgcagaagagtccactccccaccaagagaggcactg

SEQ ID NO: 102835 - DNA, 774 bp, Homo sapiens
  Payload ID: 60
  Gene Symbol: HMCES
  Gene Name: 5-hydroxymethylcytosine (hmC) binding, ES cell-specific
  ENST ID: ENST00000509551
  CDS Start-End: 75-774
cagaggcccgagcggacgcgaggcgacgcggagagggcggcctgggccgaagttgcgaggggcggtgttgaagaatgtgtgggcgaacatcctgtcacttacctagagatgttctcacgagagcttgcgcctaccaggatcggcggggccagcagcggctcccggagtggagggaccctgataagtactgcccctcttacaacaagagtcctcaatccaacagcccagtgcttctgtctcgactgcactttgagaaggatgcagactcatctgagcgtatcattgctcccatgcgctggggcttggtcccttcttggttcaaagaaagtgatccttccaagctgcagttcaatactaccaactgtcgtagtgataccgtaatggagaaacggtcatttaaggtgcctctgggaaagggaagacgctgtgtcgttttagcagatggattctatgagtggcagcgatgtcagggaacaaaccagaggcagccatacttcatctattttcctcaaatcaagacagagaagtcaggtagcattggtgctgcagatagtcctgagaactgggagaaagtctgggacaactggaggctgctgacaatggccgggatctttgactgctgggagcccccagagggaggagatgtcctgtattcctataccatcatcacagtggattcctgcaaaggcttgagtgacatccaccacaggatgcctgccatattagatggagaggaggcagtttctaaatggcttgactttggtgaagtctcaa

SEQ ID NO: 102836 - DNA, 1952 bp, Homo sapiens
  Payload ID: 60
  Gene Symbol: HMCES
  Gene Name: 5-hydroxymethylcytosine (hmC) binding, ES cell-specific
  Uniprot ID: Q96FZ2
  ENST ID: ENST00000502878
  CDS Start-End: 272-1336
gaggggaaaggaagcgacgcgagctgacagaggggagcagaggcccgagcggacgcgaggcgacgcggagagggcggcctgggccgaagtgaggcgacgcggggcggcggagtctgagggccggagcggagcggaggcgacgcggggaggggcgagggatcgcggccggtggctgggggccacctgctccccgagcaccggcccccgctccggggagcagagtccggagcgggatccgcggcccacaggttgcgaggggcggtgttgaagaatgtgtgggcgaacatcctgtcacttacctagagatgttctcacgagagcttgcgcctaccaggatcggcggggccagcagcggctcccggagtggagggaccctgataagtactgcccctcttacaacaagagtcctcaatccaacagcccagtgcttctgtctcgactgcactttgagaaggatgcagactcatctgagcgtatcattgctcccatgcgctggggcttggtcccttcttggttcaaagaaagtgatccttccaagctgcagttcaatactaccaactgtcgtagtgataccgtaatggagaaacggtcatttaaggtgcctctgggaaagggaagacgctgtgtcgttttagcagatggattctatgagtggcagcgatgtcagggaacaaaccagaggcagccatacttcatctattttcctcaaatcaagacagagaagtcaggtagcattggtgctgcagatagtcctgagaactgggagaaagtctgggacaactggaggctgctgacaatggccgggatctttgactgctgggagcccccagagggaggagatgtcctgtattcctataccatcatcacagtggattcctgcaaaggcttgagtgacatccaccacaggatgcctgccatattagatggagaggaggcagtttctaaatggcttgactttggtgaagtctcaactcaggaagctctgaaattaatccacccaacagagaacatcaccttccatgcagtctcttctgtggtgaacaactcgcgaaacaacactcctgagtgtctggctcctgtcgacttggtggtcaaaaaggagctcagggcaagtggcagtagccagaggatgttgcagtggttggccacaaagtcacccaaaaaggaagactcaaaaacacctcaaaaggaagagtcagatgttccccagtggtccagtcagttcctgcagaagagtccactccccaccaagagaggcactgcaggactcctagagcaatggctgaagcgggagaaggaggaggaacctgtggccaagcgtccttacagccagtgacacaggactttcagagaccaaggccagggtctgctgcactgctgttctgataataggttcttaacattgtatgtatatgtgtttgctttgggaggaggtggcactgtgttagttgacagttgtgggctcatgtagtcttttttgccatgagtaggagcccctagtggggctggtggacagctttggaagaggtgtcctgctgctgttaccagccatgtgggccccataggggcactgcgcctgctgccctttcctggcagggctggtggagtcttccctcaaagcatgccttacccagctgggaagtctctgccctgatctggtactccttgtagtaagctgttttctgctcagccactgggctctttcacttttttagttcttaaaaatttatttttaagttctaaaataaaataaaaataagttcttaaaatttatttttttcctgaataaattgtatttggtaaacttctgcctacattttggaaagtgatgctggtggggaaagttctagatcttacttggtttcttctagaatcagtcttcaggaatggattttgtcacaaatggggcatgggggctttctgaggaaataactacaagtcttggtggtggg

SEQ ID NO: 102837 - DNA, 599 bp, Homo sapiens
  Payload ID: 60
  Gene Symbol: HMCES
  Gene Name: 5-hydroxymethylcytosine (hmC) binding, ES cell-specific
  ENST ID: ENST00000510314
  CDS Start-End: 50-599
gaggtgacgcgcgctgccggggcgaggttgcgaggggcggtgttgaagaatgtgtgggcgaacatcctgtcacttacctagagatgttctcacgagagcttgcgcctaccaggatcggcggggccagcagcggctcccggagtggagggaccctgataagtactgcccctcttacaacaagagtcctcaatccaacagcccagtgcttctgtctcgactgcactttgagaagtcaggtagcattggtgctgcagatagtcctgagaactgggagaaagtctgggacaactggaggctgctgacaatggccgggatctttgactgctgggagcccccagagggaggagatgtcctgtattcctataccatcatcacagtggattcctgcaaaggcttgagtgacatccaccacaggatgcctgccatattagatggagaggaggcagtttctaaatggcttgactttggtgaagtctcaactcaggaagctctgaaattaatccacccaacagagaacatcaccttccatgcagtctcttctgtggtgaacaactcgcgaaacaacactcctgagtgtctggctcctgtcgacttggtgg

SEQ ID NO: 102838 - DNA, 1778 bp, Homo sapiens
  Payload ID: 61
  Gene Symbol: HTR1A
  Gene Name: 5-hydroxytryptamine (serotonin) receptor 1A, G protein-coupled
  Uniprot ID: P08908
  ENST ID: ENST00000323865
  CDS Start-End: 415-1683
gtggaggatggggcttctcggttctagatatttctgggattggagactgtttgctagtggggagactccagctccggcagccagttcgggagcggcaaagtaaaatggacagcgacagacagacgttccagccacctctccgccgccgggagatcctggagctgctttcaggccaactccagtttcccagctggagcttctgaacgcgctggactgcgagagcccagggagcgcctgaaagctgctcctcggagatacccttcgccgaagcagtaagaacttcctgcttgggtctctgcattcccttcctccgaaacttcccaggagaagggcggaagaccccaggggaaggggcgaggcgaatcttcgcgctgctttttcttccctcccccttcccgcgccgggcgcgcaggcatggatgtgctcagccctggtcagggcaacaacaccacatcaccaccggctccctttgagaccggcggcaacactactggtatctccgacgtgaccgtcagctaccaagtgatcacctctctgctgctgggcacgctcatcttctgcgcggtgctgggcaatgcgtgcgtggtggctgccatcgccttggagcgctccctgcagaacgtggccaattatcttattggctctttggcggtcaccgacctcatggtgtcggtgttggtgctgcccatggccgcgctgtatcaggtgctcaacaagtggacactgggccaggtaacctgcgacctgttcatcgccctcgacgtgctgtgctgcacctcatccatcttgcacctgtgcgccatcgcgctggacaggtactgggccatcacggaccccatcgactacgtgaacaagaggacgccccggcgcgccgctgcgctcatctcgctcacttggcttattggcttcctcatctctatcccgcccatgctgggctggcgcaccccggaagaccgctcggaccccgacgcatgcaccattagcaaggatcatggctacactatctattccacctttggagctttctacatcccgctgctgctcatgctggttctctatgggcgcatattccgagctgcgcgcttccgcatccgcaagacggtcaaaaaggtggagaagaccggagcggacacccgccatggagcatctcccgccccgcagcccaagaagagtgtgaatggagagtcggggagcaggaactggaggctgggcgtggagagcaaggctgggggtgctctgtgcgccaatggcgcggtgaggcaaggtgacgatggcgccgccctggaggtgatcgaggtgcaccgagtgggcaactccaaagagcacttgcctctgcccagcgaggctggtcctaccccttgtgcccccgcctctttcgagaggaaaaatgagcgcaacgccgaggcgaagcgcaagatggccctggcccgagagaggaagacagtgaagacgctgggcatcatcatgggcaccttcatcctctgctggctgcccttcttcatcgtggctcttgttctgcccttctgcgagagcagctgccacatgcccaccctgttgggcgccataatcaattggctgggctactccaactctctgcttaaccccgtcatttacgcatacttcaacaaggactttcaaaacgcgtttaagaagatcattaagtgtaagttctgccgccagtgatgacggaggagtagccggccagtcgaggctacaggatccgtcccattcactatgcttcccccaaccctagggaatcaacacttaagataattcgc

SEQ ID NO: 102839 - DNA, 553 bp, Homo sapiens
  Payload ID: 61
  Gene Symbol: HTR1A
  Gene Name: 5-hydroxytryptamine (serotonin) receptor 1A, G protein-coupled
  ENST ID: ENST00000506598
  CDS Start-End: 429-553
tttgttacaaccttggtctgaccggcagggatctggtgtgtatatttctgggattggagactgtttgctagtggggagactccagctccggcagccagttcgggagcggcaaagtaaaatggacagcgacagacagacgttccagccacctctccgccgccgggagatcctggagctgctttcaggccaactccagtttcccagctggagcttctgaacgcgctggactgcgagagcccagggagcgcctgaaagctgctcctcggagatacccttcgccgaagcagtaagaacttcctgcttgggtctctgcattcccttcctccgaaacttcccaggagaagggcggaagaccccaggggaaggggcgaggcgaatcttcgcgctgctttttcttccctcccccttcccgcgccgggcgcgcaggcatggatgtgctcagccctggtcagggcaacaacaccacatcaccaccggctccctttgagaccggcggcaacactactggtatctccgacgtgaccgtcagctaccaagtgatcacctctctgct

SEQ ID NO: 102840 - DNA, 1260 bp, Homo sapiens
  Payload ID: 62
  Gene Symbol: HTR1B
  Gene Name: 5-hydroxytryptamine (serotonin) receptor 1B, G protein-coupled
  Uniprot ID: P28222
  ENST ID: ENST00000369947
  CDS Start-End: 62-1234
ccctctccttcgtccgctccatgcccaagagctgcgctccggagctggggcgaggagagccatggaggaaccgggtgctcagtgcgctccaccgccgcccgcgggctccgagacctgggttcctcaagccaacttatcctctgctccctcccaaaactgcagcgccaaggactacatttaccaggactccatctccctaccctggaaagtactgctggttatgctattggcgctcatcaccttggccaccacgctctccaatgcctttgtgattgccacagtgtaccggacccggaaactgcacaccccggctaactacctgatcgcctctctggcggtcaccgacctgcttgtgtccatcctggtgatgcccatcagcaccatgtacactgtcaccggccgctggacactgggccaggtggtctgtgacttctggctgtcgtcggacatcacttgttgcactgcctccatcctgcacctctgtgtcatcgccctggaccgctactgggccatcacggacgccgtggagtactcagctaaaaggactcccaagagggcggcggtcatgatcgcgctggtgtgggtcttctccatctctatctcgctgccgcccttcttctggcgtcaggctaaggccgaagaggaggtgtcggaatgcgtggtgaacaccgaccacatcctctacacggtctactccacggtgggtgctttctacttccccaccctgctcctcatcgccctctatggccgcatctacgtagaagcccgctcccggattttgaaacagacgcccaacaggaccggcaagcgcttgacccgagcccagctgataaccgactcccccgggtccacgtcctcggtcacctctattaactcgcgggttcccgacgtgcccagcgaatccggatctcctgtgtatgtgaaccaagtcaaagtgcgagtctccgacgccctgctggaaaagaagaaactcatggccgctagggagcgcaaagccaccaagaccctagggatcattttgggagcctttattgtgtgttggctacccttcttcatcatctccctagtgatgcctatctgcaaagatgcctgctggttccacctagccatctttgacttcttcacatggctgggctatctcaactccctcatcaaccccataatctataccatgtccaatgaggactttaaacaagcattccataaactgatacgttttaagtgcacaagttgacttgccgtttgcagtggggtcgccta

SEQ ID NO: 102841 - DNA, 2835 bp, Homo sapiens
  Payload ID: 63
  Gene Symbol: HTR1D
  Gene Name: 5-hydroxytryptamine (serotonin) receptor 1D, G protein-coupled
  Uniprot ID: P28221
  ENST ID: ENST00000374619
  CDS Start-End: 511-1644
ctaaatccagaatcgtttcaattactgtgaggggaattctgaagttctcattaaacacacgaatgtctcaagctttgaaaagagccagatgccaaaggcaagaatcccagggcattgcccacctgggtgtgatcccctgataattgtctaacaaattcagcatgtgtcccctgggcatgaccatctgctgggaaaagttccaggaccctgagacatcttgggattcctgtggtttaggaaagacctttaactaccagctggtagttgtctcagcattcttcaaatagtccggtcttgtttaatattattattattattgttatttaattttattttattgcaactgtacttagagaatagtctggtcttgagaccttttcactgtggtctgttctggtgtacggctcccaccagtgtgaagcagaaggatgactttgctctgttgtcaggacaaccttgaaggaaggagccaaatgtgtggaggtctgtgggaagagagagccacctagcatgtccccactgaaccagtcagcagaaggccttccccaggaggcctccaacagatccctgaatgccacagaaacctcagaggcttgggatcccaggaccctccaggcgctcaagatctcccttgccgtggtcctttccgtcatcacactggccacagtcctctccaatgcctttgtactcaccaccatcttactcaccaggaagctccacacccctgccaactacctgattggctccctggccaccaccgacctcttggtttccatcttggtaatgcccatcagcatcgcctataccatcacccacacctggaactttggccaaatcttgtgtgacatctggctgtcctctgacatcacgtgctgcacagcctccatcctgcatctctgtgtcattgctctggacaggtactgggcaatcacagatgccctggaatacagtaaacgcaggacggctggccacgcggccaccatgatcgccattgtctgggccatctccatctgcatctccatccccccgctcttctggcggcaggccaaggcccaggaggagatgtcggactgtctggtgaacacctctcagatctcctacaccatctactccacctgtggggccttctacattccctcggtgttgctcatcatcctatatggccggatctaccgggctgcccggaaccgcatcctgaatccaccctcactctatgggaagcgcttcaccacggcccacctcatcacaggctctgccgggtcctcgctctgctcgctcaactccagcctccatgaggggcactcgcactcggctggctcccctctctttttcaaccacgtgaaaatcaagcttgctgacagtgccctggaacgcaagaggatttctgctgctcgagaaaggaaagccactaaaatcctgggcatcattctgggggcctttatcatctgctggctgcccttcttcgtggtgtctctggtcctccccatctgccgggactcctgctggatccacccggcgctctttgacttcttcacctggctaggctatttaaactccctcatcaatccaataatctacactgtgtttaatgaagagtttcggcaagcttttcagaaaattgtccctttccggaaggcctcctagtcttattcggtgatgactcttgttatcttttgtgtcctgtaacctcatcgggattgtcttttttttttttaattattttctgagacttggattaattcatggtatcttgagtcttggttcaatcaacagaattgttctttttcctgttgttttcttaacttctgaaagagctgtgggtggtggggggcggggggcaggactgaagatttcactacttagcataatattttctttctttttttttttttttgagacggagtcttgccctctcgccaggctggagtgtagtggcacaatctcagctcactgcaacctccgcatcccgggttcaagagattctgcctcagcctccagagtagctgggactacaaacgtgtgtcaccaggcccagctaatttttgtatttttaataaagacggggtttcatcatgttggccagggtggtctcgatctcttgacctcgtgatccgcccgcctcagcatcccaaagtgctgggattacaggcatgagccactgtgcctggccaacataatgttttcacagttcctctttgttggaagaagtgtgtgacctacaagattcctggttgatacagttcaggtgagaaactgtttgattatagaaaagaccccagactcagagggaaggctctctggtctacctgagatctatatggagcttaaaggagggtgaataagattaatgacctgaattgaaagagaatttggagccaggatgggtctccattctgtgtggcaccttgattggaaaataatatccatgcgtttcttccactgagtctttcttagattaaatctctcccagttgtccgtgaagagaaagacagtatttgcagtgccgatgatatagagtgacttggagagagattcagaagttaggggtagcgggggtaggatggttgggaccagattgactaccctgtacccttccttcttccccaatatgcctgcgccatcttcacattctgaagttgaaacccatgatcacccctttgaggtagattgaccggctttagacgcccaccccccacccaccgcaagctttgagtgggacaccattctgaattttttttctgaatttttttttaacatctctttctcattagagatctgaaaactcattagagatgttgagtcttatcaaataaaaagcatgagacatcatggcca

SEQ ID NO: 102842 - DNA, 2052 bp, Homo sapiens
  Payload ID: 64
  Gene Symbol: HTR1E
  Gene Name: 5-hydroxytryptamine (serotonin) receptor 1E, G protein-coupled
  Uniprot ID: P28566
  ENST ID: ENST00000305344
  CDS Start-End: 704-1801
aagacctggagtacctcggagctgcgacctccagttcacaataccacctgcctcacacccgggctcatcttttcatcccacacccaccacccccctctccgttcacggtgtcccgggaggctgcgacctgcgtagatgatttagcagactgcccctgcccatgctcctgctcctgctcctcctcctcctcttccccgctctctccctctcgcctcctcttccagtccaggcgcccagactcggcgaagcgcagcgcctgccaccagcggtgcctcgggctgcccggcgcgccgcgctcccaggttctgtctcgccgcaccccggcgggcactggcgcgggcaaggacgctggcggggagaacgccctgggctcaacgtactccagaatcgaatgttgagagaagcagtgctctgatccagctcaggagaaaaaggagcgggttccgagtgagacttctggagccagctggacgtgccggtttgcccagtgcggcgcggctgcacgcaccgtccacaaggaaccttcactcagaagaaatgctgtggcccttccctttaccaacagaaaatggaacacaagagaccacatagctgaacaaattatagcctccttacaagtgagaaaccttcgaggctacatagttttcagccaaaggaaaataaccaacagcttctccacagtgtagactgaaacaagggaaacatgaacatcacaaactgtaccacagaggccagcatggctataagacccaagaccatcactgagaagatgctcatttgcatgactctggtggtcatcaccaccctcaccacgttgctgaacttggctgtgatcatggctattggcaccaccaagaagctccaccagcctgccaactacctaatctgttctctggccgtgacggacctcctggtggcagtgctcgtcatgcccctgagcatcatctacattgtcatggatcgctggaagcttgggtacttcctctgtgaggtgtggctgagtgtggacatgacctgctgcacctgctccatcctccacctctgtgtcattgccctggacaggtactgggccatcaccaatgctattgaatacgccaggaagaggacggccaagagggccgcgctgatgatccttaccgtctggaccatctccattttcatctccatgccccctctgttctggagaagccaccgccgcctaagccctccccctagtcagtgcaccatccagcacgaccatgttatctacaccatttactccacgctgggtgcgttttatatccccttgactttgatactgattctctattaccggatttaccacgcggccaagagcctttaccagaaaaggggatcaagtcggcacttaagcaacagaagcacagatagccagaattcttttgcaagttgtaaacttacacagactttctgtgtgtctgacttctccacctcagaccctaccacagagtttgaaaagttccatgcctccatcaggatcccccccttcgacaatgatctagatcacccaggagaacgtcagcagatctctagcaccagggaacggaaggcagcacgcatcctggggctgattctgggtgcattcattttatcctggctgccatttttcatcaaagagttgattgtgggtctgagcatctacaccgtgtcctcggaagtggccgactttctgacgtggctcggttatgtgaattctctgatcaaccctctgctctatacgagttttaatgaagactttaagctggcttttaaaaagctcattagatgccgagagcatacttagactgtaaaaagctaaaaggcacgactttttccagagcctcatgagtggatgggggtaaggggtgcaacttattaattcttgaacatacttggttcaggagagtttgtaagtatgtgtggtcttgtttccttgtttgtttgtttgttttgttctgttttgtttgaggattgttatttggcgtgctgttttctacctctggtcttatctgtgatacataatttcaaataaacattatcatacaaaaacagaaa

SEQ ID NO: 102843 - DNA, 3140 bp, Homo sapiens
  Payload ID: 65
  Gene Symbol: HTR1F
  Gene Name: 5-hydroxytryptamine (serotonin) receptor 1F, G protein-coupled
  Uniprot ID: P30939
  ENST ID: ENST00000319595
  CDS Start-End: 55-1155
cccttgttacaggtatccatttttcagctatattaatcttttaaaacaaagaaaatggatttcttaaattcatctgatcaaaacttgacctcagaggaactgttaaacagaatgccatccaaaattctggtgtccctcactctgtctgggctggcactgatgacaacaactatcaactcccttgtgatcgctgcaattattgtgacccggaagctgcaccatccagccaattatttaatttgttcccttgcagtcacagattttcttgtggctgtcctggtgatgcccttcagcattgtgtatattgtgagagagagctggattatggggcaagtggtctgtgacatttggctgagtgttgacattacctgctgcacgtgctccatcttgcatctctcagctatagctttggatcggtatcgagcaatcacagatgctgttgagtatgccaggaaaaggactccaaagcatgctggcattatgattacaatagtttggattatatctgtttttatctctatgcctcctctattctggaggcaccaaggaactagcagagatgatgaatgcatcatcaagcacgaccacattgtttccaccatttactcaacatttggagctttctacatcccactggcattgattttgatcctttactacaaaatatatagagcagcaaagacattataccacaagagacaagcaagtaggattgcaaaggaggaggtgaatggccaagtccttttggagagtggtgagaaaagcactaaatcagtttccacatcctatgtactagaaaagtctttatctgacccatcaacagactttgataaaattcatagcacagtgagaagtctcaggtctgaattcaagcatgagaaatcttggagaaggcaaaagatctcaggtacaagagaacggaaagcagccactaccctgggattaatcttgggtgcatttgtaatatgttggcttcctttttttgtaaaagaattagttgttaatgtctgtgacaaatgtaaaatttctgaagaaatgtccaattttttggcatggcttgggtatctcaattcccttataaatccactgatttacacaatctttaatgaagacttcaagaaagcattccaaaagcttgtgcgatgtcgatgttagttttaaaaatgtttattattgaaggatgggggtttttgaggggaggaataactagatgaatgccaaataataaaacacttaagcttttagagggaaatacatgaaaactgctaaattgataaggctataatttatattttaatagcaatgtgaatataaaagttattgatcaccactattctagggtattcaaaattagaaaataatttatgtaggttataaacaatattttgcctatgcaatgttcctaaaaagctaactggaaaaaatatatatatatacaatagtaatgacagtgattttccatgtttacatcttacaataattatagaggagttttcaattaacaacatacctccctccataatttctatctagtcctactgttttataatataattctattattttgtataagaaaatataattcaccacaaagtacacatttctcctgtctccattcttgtcccttctccatcttaccctgagcaaaagggagggggaaggagcaactcttacttagtgtgactgcagaaaatgtaaaaaagtcagagcttgaaattgtccttgtgtttaggtagcaaagagtaatcataaagtgggttaggtacagcaaaataattcaatactgaacttgtgcatatttaatgtattatgtttgatataaacttctagaataatattatcttatccttatattatcagcatttgaaatcaaagccttaccttagtaacaataactcaacaaaggggcatgggtgacgttgttataattgctctctgtttacttaggaatcaaatttaaagcactaaatatcatagattactcaccacagttatactcttaacatctttttaaaagtataaaatgtatttcatttctgttaataagctcagttattaactaaattgtctgtggtattttgcacttcagtattttccatacctttgatttcaacattatttcccgtttactagacagaatataatggaaatttttagaactttccctttactttaaaatatttctacttttccaattggtagaaatgaacaggaaaaaagactcatattacactaattaataaatgtacacacatatatatttttgtaattagtcactctactagttcagtgagccaaagcaattccataagtttttcttccatatttataaaaggatttgaaaacaatagaaccatgagtttgagaggattttattttatttgaaccagcaaggtcatagactacctttgggaagacctatcatcaaccaagatcgtttgaaaaacaatatatacctttttttaagttgtacatttatgtgcattgtaaatattccttcctgatggtgtggttaagagtacattacatcaattttatgtatatatagatctgtgacaaattactctcaatctaacaaacatttacagagttcccattttatacaaggcattgagacatatactagatagaagatatacgaaataataaaatacagttttttttcctgaatatgtttacagtctaaaaggagaaacaagaaaaaataaaactataatagaaaagagcaaactaaaatctggcatggaagttgtttacacagttatgatggtgcagaggaaaaactgatcgcatcttgtttagaaaaatcagaaatatttcacaaagaatgtatctagaacacatgtcaaatacacagcactggggcaagaaaaatggaagagcacactccaggttgtgacaacatcaggatacaaactgcaccatgcaagtatttggtggggcatgttcataaatagcaatgagtttggcaactatttagagcaatagaggaaaaggatattaaaagaaaaattgggcatttttgtggctgactttgaacgtcagaaaaaagtctacagtcaattttattgctgacgatgggtaatcactgatacttttagcaaaaatattacaagtttagagcaaatctaaacaaaaaa

SEQ ID NO: 102844 - DNA, 4835 bp, Homo sapiens
  Payload ID: 66
  Gene Symbol: HTR2A
  Gene Name: 5-hydroxytryptamine (serotonin) receptor 2A, G protein-coupled
  Uniprot ID: P28223
  ENST ID: ENST00000378688
  CDS Start-End: 133-1548
ccagccccgggagaacagcatgtacaccagcctcagtgttacagagtgtgggtacatcaaggtgaatggtgagcagaaactataacctgttagtccttctacacctcatctgctacaagttctggcttagacatggatattctttgtgaagaaaatacttctttgagctcaactacgaactccctaatgcaattaaatgatgacaccaggctctacagtaatgactttaactccggagaagctaacacttctgatgcatttaactggacagtcgactctgaaaatcgaaccaacctttcctgtgaagggtgcctctcaccgtcgtgtctctccttacttcatctccaggaaaaaaactggtctgctttactgacagccgtagtgattattctaactattgctggaaacatactcgtcatcatggcagtgtccctagagaaaaagctgcagaatgccaccaactatttcctgatgtcacttgccatagctgatatgctgctgggtttccttgtcatgcccgtgtccatgttaaccatcctgtatgggtaccggtggcctctgccgagcaagctttgtgcagtctggatttacctggacgtgctcttctccacggcctccatcatgcacctctgcgccatctcgctggaccgctacgtcgccatccagaatcccatccaccacagccgcttcaactccagaactaaggcatttctgaaaatcattgctgtttggaccatatcagtaggtatatccatgccaataccagtctttgggctacaggacgattcgaaggtctttaaggaggggagttgcttactcgccgatgataactttgtcctgatcggctcttttgtgtcatttttcattcccttaaccatcatggtgatcacctactttctaactatcaagtcactccagaaagaagctactttgtgtgtaagtgatcttggcacacgggccaaattagcttctttcagcttcctccctcagagttctttgtcttcagaaaagctcttccagcggtcgatccatagggagccagggtcctacacaggcaggaggactatgcagtccatcagcaatgagcaaaaggcatgcaaggtgctgggcatcgtcttcttcctgtttgtggtgatgtggtgccctttcttcatcacaaacatcatggccgtcatctgcaaagagtcctgcaatgaggatgtcattggggccctgctcaatgtgtttgtttggatcggttatctctcttcagcagtcaacccactagtctacacactgttcaacaagacctataggtcagccttttcacggtatattcagtgtcagtacaaggaaaacaaaaaaccattgcagttaattttagtgaacacaataccggctttggcctacaagtctagccaacttcaaatgggacaaaaaaagaattcaaagcaagatgccaagacaacagataatgactgctcaatggttgctctaggaaagcagcattctgaagaggcttctaaagacaatagcgacggagtgaatgaaaaggtgagctgtgtgtgataggctagttgccgtggcaactgtggaaggcacactgagcaagttttcacctatctggaaaaaaaaaaatatgagattggaaaaaattagacaagtctagtggaaccaacgatcatatctgtatgcctcattttattctgtcaatgaaaagcggggttcaatgctacaaaatgtgtgcttggaaaatgttctgacagcatttcagctgtgagctttctgatacttatttataacattgtaaatgatatgtctttaaaatgattcacttttattgtataattatgaagccctaagtaaatctaaattaacttctattttcaagtggaaaccttgctgctatgctgttcattgatgacatgggattgagttggttacctattgctgtaaataaaaatagctataaatagtgaaaattttattgaatataatggcctcttaaaaattatctttaaaacttactatggtatatattttgaaaggagaaaaaaaaagccactaaggtcagtgttataaaatctgtattgctaagataattaaatgaaatacttgacaacatttttcattcctgctttttcatagataccattttgaaatattcacaaggttgctggcatttgctgcatttcaagttaattctcagaagtgaaaaagacttcaaatgttattcaataactattgctgctttctcttctacttcttgtgctttactctgaatttccagtgtggtcttgtttaatatttgttcctctaggtaaactagcaaaaggatgatttaacattaccaaatgcctttctagcaattgcttctctaaaacagcactatcgaggtatttggtaacttgctgtgaaatgactgcatcatgcatgcactcttttgagcagtaaatgtatattgatgtaactgtgtcaggattgaggatgaactcaggtttccggctactgacagtggtagagtcctaggacatctctgtaaaaagcaggtgactttcctatgacactcatcaggtaaactgatgctttcagatccatcggtttatactatttattaaaaccattctgcttggttccacaatcatctattgagtgtacatttatgtgtgaagcaaatttctagatatgagaaatataaaaataattaaaacaaaatccttgccttcaaacgaaatggctcggccaggcacggaggctcgtgcatgtaatcctagcactttgggaggctgagatgggaggatcacttgaggccaagagtttgagaccaacctgggtaacaaagtgagacctccctgtctctacaaaaaaaatcaaaaaattatctgatccttgtggcacacaactgtggtcccagctacaggggaggctgagacgcaaggatcacttgagcccagaagctcaaggctgcagtgagccaagttcacaccactgccatttcctcctgggcaacagagtgagaccctatcacaaaaaaaaagaaagaaaaaaagaaaatgactaaactgaaatggtcttagtcaaaaaatatatacagacttatttttagaatcatttcaacttatttccttcttacctggttcagaaacaagtttgtttcaactgtgagagtagttttaaaaataagttttcctgattggttaccaataaacaccaaacaaataaaggagggggaaaatatcacttgaggcttaacattgcaattaatttagaaatacgcacctcaatctcaagccagtttataactaccatagttttgagcaaaatttttcttctatttctccaaaaactcactcatttcagtattactcattgacactgggctccctaatagaaaagcagatattataatatttcattgaaatggttactaaagagaaaaagagattaacaacagttaatccaccttgatattataacactcaaggttaaattgcatgttgttattagaatcaatgttatatatatgattacaatgctgaagcatttctattgaatgagaaatagtgtttgccctaaacctttgggaaaaaaatacagatttgaaaactaaagaatgtgggaagtgtcattgtgtaatttggaaatgcataaaattctcattatgtcctcatagatatgttgaaagatggttcactgtttcaaagatagaatgtataatatgctgctagtaccaaggctgcatttgaactgaactactccttatgatataccatactaactgatgaaaatataaatgttaaaatgtctccactctaatgtattttgccttcacttgtaactctgcacatttcattatatattagggaaaagattacagattctacccccatatactcaatcttgatcagaatgtacattaatgttgcctgatagatgtcttttgactacctatatattacaaatgtgtatgtgtttttttcttccataagtatctattcaagtgtatactgtataggcaaatgtgtagctgtatatatgtacagacatgttctcatgcactttattcaatatttatatatttatatggacgaaaagcaagtcaatgaaaacactcagtatatacacatgtgtgcatgtttgtatcatgtttatttaaatgtgaattcatgttctaatatttctatgaccttccattgctgcaaagcagattaaagtgtaacaaaaatatcagctctttaaataaactggaaattaatctaattttgtggaagaactttaagacaagtctatgaggatggcgaaaacaatggtccacatatatagtttcttgatcctaaataaaatggtacctttgggccctttgtttagtctggcaattttctgactactatggctttttaaacagactcacacctaagtgaaacacagttgtcaaatgatttatggatctgtgattaaaggattcacttttaatgaatactattaaaacggagtaacaaaccttgctctactttaagttgaatgatagattcctctatattcaaaaaaaagcaattaactgccataattagggaaaactgtttaaagcatactgcatttacttggccacagcgccatctcatggtaattttttaaagtgctaccgtagccaaattgaactaagtcactgtactgctttcagcaaagggtgctcctcccatttgtgcatcaatgagacatatttataaagtgctaaattattctgtgccatatgtaacaaatacagtgaagattattttatgaacttattttaatcaaggcgatgctaaaagttttcaagaaaggataaataactgtaaataaagtagactcaaaaa

SEQ ID NO: 102845 - DNA, 5429 bp, Homo sapiens
  Payload ID: 66
  Gene Symbol: HTR2A
  Gene Name: 5-hydroxytryptamine (serotonin) receptor 2A, G protein-coupled
  Uniprot ID: P28223
  ENST ID: ENST00000542664
  CDS Start-End: 732-2147
ctgatgaaatgaacgagacagtcagagagctactccattcccgtggaaaccaggagtcccttggtgcagacagctcttcctactttcccatgcagttcttttgtgcgactttgaggggctcgtgaatgatttctaaatgtgtgcctgctgaggcgagccgcacagggagggaggaacccagccgagccgtgccagaggaagccaacaggatcctagcagtgcgggagctggctcagctcttgcatgcagtttttgaagtcagcaaaacagaaaccaaattactatcatattatgctggtggaagatcaagaagaggggactctacaccagtttaattactgtgagagatgcagcgagtcacagaataacaaatgtatctcatgtgtggaccctgaagacaaatgacatttatcttcccgagcgctcaaaaaaaaccctgcaacctctatgctaaaagttcattctgcttttttgtcctcggtttggtgagaaaataataaaaccaaacagtggactctcctaaaattgtgaatgaagaaaacttacagccaccacagttcagttctttaactatcattgtaataatggaagacaaaaatccagccccgggagaacagcatgtacaccagcctcagtgttacagagtgtgggtacatcaaggtgaatggtgagcagaaactataacctgttagtccttctacacctcatctgctacaagttctggcttagacatggatattctttgtgaagaaaatacttctttgagctcaactacgaactccctaatgcaattaaatgatgacaccaggctctacagtaatgactttaactccggagaagctaacacttctgatgcatttaactggacagtcgactctgaaaatcgaaccaacctttcctgtgaagggtgcctctcaccgtcgtgtctctccttacttcatctccaggaaaaaaactggtctgctttactgacagccgtagtgattattctaactattgctggaaacatactcgtcatcatggcagtgtccctagagaaaaagctgcagaatgccaccaactatttcctgatgtcacttgccatagctgatatgctgctgggtttccttgtcatgcccgtgtccatgttaaccatcctgtatgggtaccggtggcctctgccgagcaagctttgtgcagtctggatttacctggacgtgctcttctccacggcctccatcatgcacctctgcgccatctcgctggaccgctacgtcgccatccagaatcccatccaccacagccgcttcaactccagaactaaggcatttctgaaaatcattgctgtttggaccatatcagtaggtatatccatgccaataccagtctttgggctacaggacgattcgaaggtctttaaggaggggagttgcttactcgccgatgataactttgtcctgatcggctcttttgtgtcatttttcattcccttaaccatcatggtgatcacctactttctaactatcaagtcactccagaaagaagctactttgtgtgtaagtgatcttggcacacgggccaaattagcttctttcagcttcctccctcagagttctttgtcttcagaaaagctcttccagcggtcgatccatagggagccagggtcctacacaggcaggaggactatgcagtccatcagcaatgagcaaaaggcatgcaaggtgctgggcatcgtcttcttcctgtttgtggtgatgtggtgccctttcttcatcacaaacatcatggccgtcatctgcaaagagtcctgcaatgaggatgtcattggggccctgctcaatgtgtttgtttggatcggttatctctcttcagcagtcaacccactagtctacacactgttcaacaagacctataggtcagccttttcacggtatattcagtgtcagtacaaggaaaacaaaaaaccattgcagttaattttagtgaacacaataccggctttggcctacaagtctagccaacttcaaatgggacaaaaaaagaattcaaagcaagatgccaagacaacagataatgactgctcaatggttgctctaggaaagcagcattctgaagaggcttctaaagacaatagcgacggagtgaatgaaaaggtgagctgtgtgtgataggctagttgccgtggcaactgtggaaggcacactgagcaagttttcacctatctggaaaaaaaaaaatatgagattggaaaaaattagacaagtctagtggaaccaacgatcatatctgtatgcctcattttattctgtcaatgaaaagcggggttcaatgctacaaaatgtgtgcttggaaaatgttctgacagcatttcagctgtgagctttctgatacttatttataacattgtaaatgatatgtctttaaaatgattcacttttattgtataattatgaagccctaagtaaatctaaattaacttctattttcaagtggaaaccttgctgctatgctgttcattgatgacatgggattgagttggttacctattgctgtaaataaaaatagctataaatagtgaaaattttattgaatataatggcctcttaaaaattatctttaaaacttactatggtatatattttgaaaggagaaaaaaaaagccactaaggtcagtgttataaaatctgtattgctaagataattaaatgaaatacttgacaacatttttcattcctgctttttcatagataccattttgaaatattcacaaggttgctggcatttgctgcatttcaagttaattctcagaagtgaaaaagacttcaaatgttattcaataactattgctgctttctcttctacttcttgtgctttactctgaatttccagtgtggtcttgtttaatatttgttcctctaggtaaactagcaaaaggatgatttaacattaccaaatgcctttctagcaattgcttctctaaaacagcactatcgaggtatttggtaacttgctgtgaaatgactgcatcatgcatgcactcttttgagcagtaaatgtatattgatgtaactgtgtcaggattgaggatgaactcaggtttccggctactgacagtggtagagtcctaggacatctctgtaaaaagcaggtgactttcctatgacactcatcaggtaaactgatgctttcagatccatcggtttatactatttattaaaaccattctgcttggttccacaatcatctattgagtgtacatttatgtgtgaagcaaatttctagatatgagaaatataaaaataattaaaacaaaatccttgccttcaaacgaaatggctcggccaggcacggaggctcgtgcatgtaatcctagcactttgggaggctgagatgggaggatcacttgaggccaagagtttgagaccaacctgggtaacaaagtgagacctccctgtctctacaaaaaaaatcaaaaaattatctgatccttgtggcacacaactgtggtcccagctacaggggaggctgagacgcaaggatcacttgagcccagaagctcaaggctgcagtgagccaagttcacaccactgccatttcctcctgggcaacagagtgagaccctatcacaaaaaaaaagaaagaaaaaaagaaaatgactaaactgaaatggtcttagtcaaaaaatatatacagacttatttttagaatcatttcaacttatttccttcttacctggttcagaaacaagtttgtttcaactgtgagagtagttttaaaaataagttttcctgattggttaccaataaacaccaaacaaataaaggagggggaaaatatcacttgaggcttaacattgcaattaatttagaaatacgcacctcaatctcaagccagtttataactaccatagttttgagcaaaatttttcttctatttctccaaaaactcactcatttcagtattactcattgacactgggctccctaatagaaaagcagatattataatatttcattgaaatggttactaaagagaaaaagagattaacaacagttaatccaccttgatattataacactcaaggttaaattgcatgttgttattagaatcaatgttatatatatgattacaatgctgaagcatttctattgaatgagaaatagtgtttgccctaaacctttgggaaaaaaatacagatttgaaaactaaagaatgtgggaagtgtcattgtgtaatttggaaatgcataaaattctcattatgtcctcatagatatgttgaaagatggttcactgtttcaaagatagaatgtataatatgctgctagtaccaaggctgcatttgaactgaactactccttatgatataccatactaactgatgaaaatataaatgttaaaatgtctccactctaatgtattttgccttcacttgtaactctgcacatttcattatatattagggaaaagattacagattctacccccatatactcaatcttgatcagaatgtacattaatgttgcctgatagatgtcttttgactacctatatattacaaatgtgtatgtgtttttttcttccataagtatctattcaagtgtatactgtataggcaaatgtgtagctgtatatatgtacagacatgttctcatgcactttattcaatatttatatatttatatggacgaaaagcaagtcaatgaaaacactcagtatatacacatgtgtgcatgtttgtatcatgtttatttaaatgtgaattcatgttctaatatttctatgaccttccattgctgcaaagcagattaaagtgtaacaaaaatatcagctctttaaataaactggaaattaatctaattttgtggaagaactttaagacaagtctatgaggatggcgaaaacaatggtccacatatatagtttcttgatcctaaataaaatggtacctttgggccctttgtttagtctggcaattttctgactactatggctttttaaacagactcacacctaagtgaaacacagttgtcaaatgatttatggatctgtgattaaaggattcacttttaatgaatactattaaaacggagtaacaaaccttgctctactttaagttgaatgatagattcctctatattcaaaaaaaagcaattaactgccataattagggaaaactgtttaaagcatactgcatttacttggccacagcgccatctcatggtaattttttaaagtgctaccgtagccaaattgaactaagtcactgtactgctttcagcaaagggtgctcctcccatttgtgcatcaatgagacatatttataaagtgctaaattattctgtgccatatgtaacaaatacagtgaagattattttatgaacttattttaatcaaggcgatgctaaaagttttcaagaaaggataaataactgtaaataaagtagactc

SEQ ID NO: 102846 - DNA, 4689 bp, Homo sapiens
  Payload ID: 66
  Gene Symbol: HTR2A
  Gene Name: 5-hydroxytryptamine (serotonin) receptor 2A, G protein-coupled
  Uniprot ID: P28223
  ENST ID: ENST00000543956
  CDS Start-End: 244-1407
ctgatgaaatgaacgagacagtcagagagctactccattcccgtggaaaccaggagtcccttggtgcagacagctcttcctactttcccatgcagttcttttgtgcgactttgaggggctcgtgaatgatttctaaatgtgtgcctgctgaggcgagccgcacagggagggaggaacccagccgagccgtgccagaggaagccaacaggatcctagcagtgcgggagctggctcagctcttgcatgcagtttttgaagtcagcaaaacagaaaccaaattactatcatattatgctggtggaagatcaagaagaggggactctacaccagtttaattactgtgagagatgcagcgagtcacagaataacaaatgtatctcatgtgtggaccctgaagacaaatggtaccggtggcctctgccgagcaagctttgtgcagtctggatttacctggacgtgctcttctccacggcctccatcatgcacctctgcgccatctcgctggaccgctacgtcgccatccagaatcccatccaccacagccgcttcaactccagaactaaggcatttctgaaaatcattgctgtttggaccatatcagtaggtatatccatgccaataccagtctttgggctacaggacgattcgaaggtctttaaggaggggagttgcttactcgccgatgataactttgtcctgatcggctcttttgtgtcatttttcattcccttaaccatcatggtgatcacctactttctaactatcaagtcactccagaaagaagctactttgtgtgtaagtgatcttggcacacgggccaaattagcttctttcagcttcctccctcagagttctttgtcttcagaaaagctcttccagcggtcgatccatagggagccagggtcctacacaggcaggaggactatgcagtccatcagcaatgagcaaaaggcatgcaaggtgctgggcatcgtcttcttcctgtttgtggtgatgtggtgccctttcttcatcacaaacatcatggccgtcatctgcaaagagtcctgcaatgaggatgtcattggggccctgctcaatgtgtttgtttggatcggttatctctcttcagcagtcaacccactagtctacacactgttcaacaagacctataggtcagccttttcacggtatattcagtgtcagtacaaggaaaacaaaaaaccattgcagttaattttagtgaacacaataccggctttggcctacaagtctagccaacttcaaatgggacaaaaaaagaattcaaagcaagatgccaagacaacagataatgactgctcaatggttgctctaggaaagcagcattctgaagaggcttctaaagacaatagcgacggagtgaatgaaaaggtgagctgtgtgtgataggctagttgccgtggcaactgtggaaggcacactgagcaagttttcacctatctggaaaaaaaaaaatatgagattggaaaaaattagacaagtctagtggaaccaacgatcatatctgtatgcctcattttattctgtcaatgaaaagcggggttcaatgctacaaaatgtgtgcttggaaaatgttctgacagcatttcagctgtgagctttctgatacttatttataacattgtaaatgatatgtctttaaaatgattcacttttattgtataattatgaagccctaagtaaatctaaattaacttctattttcaagtggaaaccttgctgctatgctgttcattgatgacatgggattgagttggttacctattgctgtaaataaaaatagctataaatagtgaaaattttattgaatataatggcctcttaaaaattatctttaaaacttactatggtatatattttgaaaggagaaaaaaaaagccactaaggtcagtgttataaaatctgtattgctaagataattaaatgaaatacttgacaacatttttcattcctgctttttcatagataccattttgaaatattcacaaggttgctggcatttgctgcatttcaagttaattctcagaagtgaaaaagacttcaaatgttattcaataactattgctgctttctcttctacttcttgtgctttactctgaatttccagtgtggtcttgtttaatatttgttcctctaggtaaactagcaaaaggatgatttaacattaccaaatgcctttctagcaattgcttctctaaaacagcactatcgaggtatttggtaacttgctgtgaaatgactgcatcatgcatgcactcttttgagcagtaaatgtatattgatgtaactgtgtcaggattgaggatgaactcaggtttccggctactgacagtggtagagtcctaggacatctctgtaaaaagcaggtgactttcctatgacactcatcaggtaaactgatgctttcagatccatcggtttatactatttattaaaaccattctgcttggttccacaatcatctattgagtgtacatttatgtgtgaagcaaatttctagatatgagaaatataaaaataattaaaacaaaatccttgccttcaaacgaaatggctcggccaggcacggaggctcgtgcatgtaatcctagcactttgggaggctgagatgggaggatcacttgaggccaagagtttgagaccaacctgggtaacaaagtgagacctccctgtctctacaaaaaaaatcaaaaaattatctgatccttgtggcacacaactgtggtcccagctacaggggaggctgagacgcaaggatcacttgagcccagaagctcaaggctgcagtgagccaagttcacaccactgccatttcctcctgggcaacagagtgagaccctatcacaaaaaaaaagaaagaaaaaaagaaaatgactaaactgaaatggtcttagtcaaaaaatatatacagacttatttttagaatcatttcaacttatttccttcttacctggttcagaaacaagtttgtttcaactgtgagagtagttttaaaaataagttttcctgattggttaccaataaacaccaaacaaataaaggagggggaaaatatcacttgaggcttaacattgcaattaatttagaaatacgcacctcaatctcaagccagtttataactaccatagttttgagcaaaatttttcttctatttctccaaaaactcactcatttcagtattactcattgacactgggctccctaatagaaaagcagatattataatatttcattgaaatggttactaaagagaaaaagagattaacaacagttaatccaccttgatattataacactcaaggttaaattgcatgttgttattagaatcaatgttatatatatgattacaatgctgaagcatttctattgaatgagaaatagtgtttgccctaaacctttgggaaaaaaatacagatttgaaaactaaagaatgtgggaagtgtcattgtgtaatttggaaatgcataaaattctcattatgtcctcatagatatgttgaaagatggttcactgtttcaaagatagaatgtataatatgctgctagtaccaaggctgcatttgaactgaactactccttatgatataccatactaactgatgaaaatataaatgttaaaatgtctccactctaatgtattttgccttcacttgtaactctgcacatttcattatatattagggaaaagattacagattctacccccatatactcaatcttgatcagaatgtacattaatgttgcctgatagatgtcttttgactacctatatattacaaatgtgtatgtgtttttttcttccataagtatctattcaagtgtatactgtataggcaaatgtgtagctgtatatatgtacagacatgttctcatgcactttattcaatatttatatatttatatggacgaaaagcaagtcaatgaaaacactcagtatatacacatgtgtgcatgtttgtatcatgtttatttaaatgtgaattcatgttctaatatttctatgaccttccattgctgcaaagcagattaaagtgtaacaaaaatatcagctctttaaataaactggaaattaatctaattttgtggaagaactttaagacaagtctatgaggatggcgaaaacaatggtccacatatatagtttcttgatcctaaataaaatggtacctttgggccctttgtttagtctggcaattttctgactactatggctttttaaacagactcacacctaagtgaaacacagttgtcaaatgatttatggatctgtgattaaaggattcacttttaatgaatactattaaaacggagtaacaaaccttgctctactttaagttgaatgatagattcctctatattcaaaaaaaagcaattaactgccataattagggaaaactgtttaaagcatactgcatttacttggccacagcgccatctcatggtaattttttaaagtgctaccgtagccaaattgaactaagtcactgtactgctttcagcaaagggtgctcctcccatttgtgcatcaatgagacatatttataaagtgctaaattattctgtgccatatgtaacaaatacagtgaagattattttatgaacttattttaatcaaggcgatgctaaaagttttcaagaaaggataaataactgtaaataaagtagactc

SEQ ID NO: 102847 - DNA, 509 bp, Homo sapiens
  Payload ID: 66
  Gene Symbol: HTR2A
  Gene Name: 5-hydroxytryptamine (serotonin) receptor 2A, G protein-coupled
  ENST ID: ENST00000612998
  CDS Start-End: 1-333
tttaactccggagaagctaacacttctgatgcatttaactggacagtcgactctgaaaatcgaaccaacctttcctgtgaagggtgcctctcaccgtcgtgtctctccttacttcatctccaggaaaaaaactggtctgctttactgacagccgtagtgattattctaactattgctggaaacatactcgtcatcatggcagtgtccctagagaaaaagctgcagaatgccaccaactatttcctgatgtcacttgccatagctgatatgctgctgggtttccttgtcatgcccgtgtccatgttaaccatcctgtatggtgagtggcattagtttcccagctatattcgcactggtaataaagagcatgtgcatgccaccagcagatgagatggggctcagggggcaaacaaactataaatagaagtctttgtttatagactagagcctactatgttacttatattttactcttaaaatgggatttcacataaaaatcagacagtcta

SEQ ID NO: 102848 - DNA, 2246 bp, Homo sapiens
  Payload ID: 67
  Gene Symbol: HTR2B
  Gene Name: 5-hydroxytryptamine (serotonin) receptor 2B, G protein-coupled
  Uniprot ID: P41595
  ENST ID: ENST00000258400
  CDS Start-End: 514-1959
tatacaacgtatttgtttcactgctttcaaccgcctgtgctggaggctcagaataagtcaatgggaggaggatttcagtcacagcagcaagcaagtctagtgaacagataagatgacatgctcagcaaaataacaacgaaaccagagggggaactctctggcatgcaagttcaaacacgactctacaactacggcagaaaaagagagagagagaaactaaaaatatatatatatcctatttttttcacagctatcagtttctttcactgagctttcctaaatttaagcctctagaaaataataaatacttggatatcttacctacaaacatggacagatgtgtgtatgcgctcattttagagaacttgaatttttttttttaaaggaaggtgtcaactttggcttttgagtgtttggcatggttacaatgccttaaaaaaacagatgagcagcttagctactaaccatgctgaccactgttcggaacgggattgaatcacagaaaaacagcaaatggctctctcttacagagtgtctgaacttcaaagcacaattcctgagcacattttgcagagcacctttgttcacgttatctcttctaactggtctggattacagacagaatcaataccagaggaaatgaaacagattgttgaggaacagggaaataaactgcactgggcagctcttctgatactcatggtgataatacccacaattggtggaaatacccttgttattctggctgtttcactggagaagaagctgcagtatgctactaattactttctaatgtccttggcggtggctgatttgctggttggattgtttgtgatgccaattgccctcttgacaataatgtttgaggctatgtggcccctcccacttgttctatgtcctgcctggttatttcttgacgttctcttttcaaccgcatccatcatgcatctctgtgccatttcagtggatcgttacatagccatcaaaaagccaatccaggccaatcaatataactcacgggctacagcattcatcaagattacagtggtgtggttaatttcaataggcattgccattccagtccctattaaagggatagagactgatgtggacaacccaaacaatatcacttgtgtgctgacaaaggaacgttttggcgatttcatgctctttggctcactggctgccttcttcacacctcttgcaattatgattgtcacctactttctcactatccatgctttacagaagaaggcttacttagtcaaaaacaagccacctcaacgcctaacatggttgactgtgtctacagttttccaaagggatgaaacaccttgctcgtcaccggaaaaggtggcaatgctggatggttctcgaaaggacaaggctctgcccaactcaggtgatgaaacacttatgcgaagaacatccacaattgggaaaaagtcagtgcagaccatttccaacgaacagagagcctcaaaggtcctagggattgtgtttttcctctttttgcttatgtggtgtcccttctttattacaaatataactttagttttatgtgattcctgtaaccaaactactctccaaatgctcctggagatatttgtgtggataggctatgtttcctcaggagtgaatcctttggtctacaccctcttcaataagacatttcgggatgcatttggccgatatatcacctgcaattaccgggccacaaagtcagtaaaaactctcagaaaacgctccagtaagatctacttccggaatccaatggcagagaactctaagtttttcaagaaacatggaattcgaaatgggattaaccctgccatgtaccagagtccaatgaggctccgaagttcaaccattcagtcttcatcaatcattctactagatacgcttctcctcactgaaaatgaaggtgacaaaactgaagagcaagttagttatgtatagcagaactggcagttgtcatcaaacataatgatgagtaagatgatgaatgagatgtaaatgtgccaagaatatattatataaagaattttatgtcatatatcaaatcatctctttaacctaagatgtaagtattaagaatatctaattttcctaatttggacaagattattccatgaggaaaataattttatatagctacaaatgaaaacaatccagcactctggttaaattttaaggtattcgaatgaaataaagtcaaatcaataaatttcaggctttaaaaagaa

SEQ ID NO: 102849 - DNA, 4751 bp, Homo sapiens
  Payload ID: 68
  Gene Symbol: HTR2C
  Gene Name: 5-hydroxytryptamine (serotonin) receptor 2C, G protein-coupled
  Uniprot ID: P28335
  ENST ID: ENST00000276198
  CDS Start-End: 729-2105
acccgcgcgaggtaggcgctctggtgcttgccgaggacgcttccttcctcagatgcaccgatcttcccgatactgcctttggagcggctagattgctagccttggctgctccattggcctgccttgccccttacctgccgattgcatatgaactcttcttctgtctgtacatcgttgtcgtcggagtcgtcgcgatcgtcgtggcgctcgtgtgatggccttcgtccgtttagagtagtgtagttagttaggggccaacgaagaagaaagaagacgcgattagtgcagagatgctggaggtggtcagttactaagctagagtaagatagcggagcgaaaagagccaaacctagccggggggcgcacggtcacccaaaggaggtcgactcgccggcgcttcctatcgcgccgagctccctccattcctctccctccgccgaggcgcgaggttgcggcgcgcagcgcagcgcagctcagcgcaccgactgccgcgggctccgctgggcgattgcagccgagtccgtttctcgtctagctgccgccgcggcgaccgctgcctggtcttcctcccggacgctagtgggttatcagctaacacccgcgagcatctataacataggccaactgacgccatccttcaaaaacaactaaaggatgatatgatgaacctagcctgttaatttcgtcttctcaattttaaactttggttgcttaagactgaagcaatcatggtgaacctgaggaatgcggtgcattcattccttgtgcacctaattggcctattggtttggcaatctgatatttctgtgagcccagtagcagctatagtaactgacattttcaatacctccgatggtggacgcttcaaattcccagacggggtacaaaactggccagcactttcaatcgtcatcataataatcatgacaataggtggcaacatccttgtgatcatggcagtaagcatggaaaagaaactgcacaatgccaccaattacttcttaatgtccctagccattgctgatatgctagtgggactacttgtcatgcccctgtctctcctggcaatcctttatgattatgtctggccactacctagatatttgtgccccgtctggatttctttagatgttttattttcaacagcgtccatcatgcacctctgcgctatatcgctggatcggtatgtagcaatacgtaatcctattgagcatagccgtttcaattcgcggactaaggccatcatgaagattgctattgtttgggcaatttctataggtgtatcagttcctatccctgtgattggactgagggacgaagaaaaggtgttcgtgaacaacacgacgtgcgtgctcaacgacccaaatttcgttcttattgggtccttcgtagctttcttcataccgctgacgattatggtgattacgtattgcctgaccatctacgttctgcgccgacaagctttgatgttactgcacggccacaccgaggaaccgcctggactaagtctggatttcctgaagtgctgcaagaggaatacggccgaggaagagaactctgcaaaccctaaccaagaccagaacgcacgccgaagaaagaagaaggagagacgtcctaggggcaccatgcaggctatcaacaatgaaagaaaagcttcgaaagtccttgggattgttttctttgtgtttctgatcatgtggtgcccatttttcattaccaatattctgtctgttctttgtgagaagtcctgtaaccaaaagctcatggaaaagcttctgaatgtgtttgtttggattggctatgtttgttcaggaatcaatcctctggtgtatactctgttcaacaaaatttaccgaagggcattctccaactatttgcgttgcaattataaggtagagaaaaagcctcctgtcaggcagattccaagagttgccgccactgctttgtctgggagggagcttaatgttaacatttatcggcataccaatgaaccggtgatcgagaaagccagtgacaatgagcccggtatagagatgcaagttgagaatttagagttaccagtaaatccctccagtgtggttagcgaaaggattagcagtgtgtgagaaagaacagcacagtcttttcctacggtacaagctacatatgtaggaaaattttcttctttaatttttctgttggtcttaactaatgtaaatattgctgtctgaaaaagtgtttttacatatagctttgcaaccttgtactttacaatcatgcctacattagtgagatttagggttctatatttactgtttataataggtggagactaacttattttgattgtttgatgaataaaatgtttatttttgctctccctcccttctttccttccttttttcctttcttccttcctttctctctttcttttgtgcatatggcaacgttcatgttcatctcaggtggcatttgcaggtgaccagaatgaggcacatgacagtggttatatttcaaccacacctaaattaacaaattcagtggacatttgttctgggttaacagtaaatatacactttacattcttgctctgctcatctacacatataaacacagtaagataggttctgctttctgatacatctgtcagtgagtcagaggcagaacctagtcttgttgttcatataggggcaaaaatttgacattgtcagaatgttgtgttggtatttactgcaatgtctgtccctaaacatagtggtattttaacatagcagctggttaaccgggactacagaagtggaaggataatgagatgtaatacaccaaatagcttttcacttcttaaggacagtgttcaaattctgattattacaacaagcaaactgaaattagtgttttcattctggtccttagtaaattcctaattctatgattaaactgggaaatgagatcccagagttatttcccaacccaggattcaacatcaattgggttttgatctcagcatcctggaaatttgtgtgcttcacacaaagtgaaattagtattttgagccttattaaaatattttcttaattatggtacctctgtctataggacttaatttagcagtccatttttgagtaaaacttgtattggaagtatagatggtagaaactttggaagttttacttgattaaggactacagaattgggcccttagaatgtgaaaaaaaaaagtaattaaaaagacacttttaccgaactcgggattacagaaacacggagtttccatttggattttaaacaaaatttatgtcattttcagatccttccaaactctctagtgcaggaaaaggctgcagctaatttgtgaaagtggcaagctcttcattgcactgcagttatttaccagaagtttaaatctttgttaaaatatagtgttgtgttacaataagtgttggccatcatttcattcgtgggcctgctgctctctaagaattcagtagcattttaatagtttctaaaccatgaaaagttttcaagcattgctaaagtcaggccattcagtctatgctgtgtgcagagtatacaagtgtttctagtaacagtatttccatacgtgcccatttcacacaactgtggataaattttggaagaattcatgatgctagttcttacgcttgacagttacttacacacctgagaatgtgcctctcagtatcttaaaattggttaatgaaaaatctgaatttctaaaacccttggtctgtgttctcaacacacagtatagataaatccaatagtctgccacaagggcagtggaagagctgctgtatttgaggaaactcatacagtctctatttgatttgcaacactgccaaacatcagtcaattgcttgagcatgcccaaatataacatgaaagtcaagtctacctgccttgcctgttaggtctgttgaagtgcatgttaaaataattatatgaagcagaatgagatgatttaattcttaccgaaatgaaaatggctgaagaaacacagcatgcatttagcatgagttctgcacatacagatggtgtcctgcatgtatgccatgtatgttgcatgaatccatcgatttgtattaatgtagggcagaatagctgatagaagaaggactgaagaaaatccttcagcaatccttaaaaagaccatgcattcagatctgaagtagtgtgagtgttagaaaaaactggaaacatctgatttctgaactatcagggcaagctcatagcacatgttttacaaagaaacaaaatataaatcacagatttccaaaagtactagcaataagttgaatgataatagctcacagcacatttgttaatgattcttgtgtcatcaagtagtagtacttaatagtacccaacctggtaattatcctcaagttgtgtgctattcgtaagttctgtgcagtttggtatgaaacaaatatactcatttggatataaatcttacccttcaatgttaaatctacaaacttttataaatgttttaaagaagtccatgtgataattgtaaaggtgatgaatttaccatcaaacaaatcattttgatgtattattatatatgtatatctgtgtaagacacgtgcaacagactgccttatattattttctgtaattcttctcctttgtcaaatggtattttttgtgaatggttgcaaagtgttgtcttattcctaattcctgtatgttatccactacaggttttatgagacttcctattaatttattaaatttattaaatgttg

SEQ ID NO: 102850 - DNA, 4652 bp, Homo sapiens
  Payload ID: 68
  Gene Symbol: HTR2C
  Gene Name: 5-hydroxytryptamine (serotonin) receptor 2C, G protein-coupled
  Uniprot ID: P28335
  ENST ID: ENST00000371950
  CDS Start-End: 725-1471
gcgcgaggtaggcgctctggtgcttgccgaggacgcttccttcctcagatgcaccgatcttcccgatactgcctttggagcggctagattgctagccttggctgctccattggcctgccttgccccttacctgccgattgcatatgaactcttcttctgtctgtacatcgttgtcgtcggagtcgtcgcgatcgtcgtggcgctcgtgtgatggccttcgtccgtttagagtagtgtagttagttaggggccaacgaagaagaaagaagacgcgattagtgcagagatgctggaggtggtcagttactaagctagagtaagatagcggagcgaaaagagccaaacctagccggggggcgcacggtcacccaaaggaggtcgactcgccggcgcttcctatcgcgccgagctccctccattcctctccctccgccgaggcgcgaggttgcggcgcgcagcgcagcgcagctcagcgcaccgactgccgcgggctccgctgggcgattgcagccgagtccgtttctcgtctagctgccgccgcggcgaccgctgcctggtcttcctcccggacgctagtgggttatcagctaacacccgcgagcatctataacataggccaactgacgccatccttcaaaaacaactaaaggatgatatgatgaacctagcctgttaatttcgtcttctcaattttaaactttggttgcttaagactgaagcaatcatggtgaacctgaggaatgcggtgcattcattccttgtgcacctaattggcctattggtttggcaatctgatatttctgtgagcccagtagcagctatagtaactgacattttcaatacctccgatggtggacgcttcaaattcccagacggggtacaaaactggccagcactttcaatcgtcatcataataatcatgacaataggtggcaacatccttgtgatcatggcagtaagcatggaaaagaaactgcacaatgccaccaattacttcttaatgtccctagccattgctgatatgctagtgggactacttgtcatgcccctgtctctcctggcaatcctttatgattatgtctggccactacctagatatttgtgccccgtctggatttctttagatgttttattttcaacagcgtccatcatgcacctctgcgctatatcgctggatcggtgtatcagttcctatccctgtgattggactgagggacgaagaaaaggtgttcgtgaacaacacgacgtgcgtgctcaacgacccaaatttcgttcttattgggtccttcgtagctttcttcataccgctgacgattatggtgattacgtattgcctgaccatctacgttctgcgccgacaagctttgatgttactgcacggccacaccgaggaaccgcctggactaagtctggatttcctgaagtgctgcaagaggaatacggccgaggaagagaactctgcaaaccctaaccaagaccagaacgcacgccgaagaaagaagaaggagagacgtcctaggggcaccatgcaggctatcaacaatgaaagaaaagcttcgaaagtccttgggattgttttctttgtgtttctgatcatgtggtgcccatttttcattaccaatattctgtctgttctttgtgagaagtcctgtaaccaaaagctcatggaaaagcttctgaatgtgtttgtttggattggctatgtttgttcaggaatcaatcctctggtgtatactctgttcaacaaaatttaccgaagggcattctccaactatttgcgttgcaattataaggtagagaaaaagcctcctgtcaggcagattccaagagttgccgccactgctttgtctgggagggagcttaatgttaacatttatcggcataccaatgaaccggtgatcgagaaagccagtgacaatgagcccggtatagagatgcaagttgagaatttagagttaccagtaaatccctccagtgtggttagcgaaaggattagcagtgtgtgagaaagaacagcacagtcttttcctacggtacaagctacatatgtaggaaaattttcttctttaatttttctgttggtcttaactaatgtaaatattgctgtctgaaaaagtgtttttacatatagctttgcaaccttgtactttacaatcatgcctacattagtgagatttagggttctatatttactgtttataataggtggagactaacttattttgattgtttgatgaataaaatgtttatttttgctctccctcccttctttccttccttttttcctttcttccttcctttctctctttcttttgtgcatatggcaacgttcatgttcatctcaggtggcatttgcaggtgaccagaatgaggcacatgacagtggttatatttcaaccacacctaaattaacaaattcagtggacatttgttctgggttaacagtaaatatacactttacattcttgctctgctcatctacacatataaacacagtaagataggttctgctttctgatacatctgtcagtgagtcagaggcagaacctagtcttgttgttcatataggggcaaaaatttgacattgtcagaatgttgtgttggtatttactgcaatgtctgtccctaaacatagtggtattttaacatagcagctggttaaccgggactacagaagtggaaggataatgagatgtaatacaccaaatagcttttcacttcttaaggacagtgttcaaattctgattattacaacaagcaaactgaaattagtgttttcattctggtccttagtaaattcctaattctatgattaaactgggaaatgagatcccagagttatttcccaacccaggattcaacatcaattgggttttgatctcagcatcctggaaatttgtgtgcttcacacaaagtgaaattagtattttgagccttattaaaatattttcttaattatggtacctctgtctataggacttaatttagcagtccatttttgagtaaaacttgtattggaagtatagatggtagaaactttggaagttttacttgattaaggactacagaattgggcccttagaatgtgaaaaaaaaaagtaattaaaaagacacttttaccgaactcgggattacagaaacacggagtttccatttggattttaaacaaaatttatgtcattttcagatccttccaaactctctagtgcaggaaaaggctgcagctaatttgtgaaagtggcaagctcttcattgcactgcagttatttaccagaagtttaaatctttgttaaaatatagtgttgtgttacaataagtgttggccatcatttcattcgtgggcctgctgctctctaagaattcagtagcattttaatagtttctaaaccatgaaaagttttcaagcattgctaaagtcaggccattcagtctatgctgtgtgcagagtatacaagtgtttctagtaacagtatttccatacgtgcccatttcacacaactgtggataaattttggaagaattcatgatgctagttcttacgcttgacagttacttacacacctgagaatgtgcctctcagtatcttaaaattggttaatgaaaaatctgaatttctaaaacccttggtctgtgttctcaacacacagtatagataaatccaatagtctgccacaagggcagtggaagagctgctgtatttgaggaaactcatacagtctctatttgatttgcaacactgccaaacatcagtcaattgcttgagcatgcccaaatataacatgaaagtcaagtctacctgccttgcctgttaggtctgttgaagtgcatgttaaaataattatatgaagcagaatgagatgatttaattcttaccgaaatgaaaatggctgaagaaacacagcatgcatttagcatgagttctgcacatacagatggtgtcctgcatgtatgccatgtatgttgcatgaatccatcgatttgtattaatgtagggcagaatagctgatagaagaaggactgaagaaaatccttcagcaatccttaaaaagaccatgcattcagatctgaagtagtgtgagtgttagaaaaaactggaaacatctgatttctgaactatcagggcaagctcatagcacatgttttacaaagaaacaaaatataaatcacagatttccaaaagtactagcaataagttgaatgataatagctcacagcacatttgttaatgattcttgtgtcatcaagtagtagtacttaatagtacccaacctggtaattatcctcaagttgtgtgctattcgtaagttctgtgcagtttggtatgaaacaaatatactcatttggatataaatcttacccttcaatgttaaatctacaaacttttataaatgttttaaagaagtccatgtgataattgtaaaggtgatgaatttaccatcaaacaaatcattttgatgtattattatatatgtatatctgtgtaagacacgtgcaacagactgccttatattattttctgtaattcttctcctttgtcaaatggtattttttgtgaatggttgcaaagtgttgtcttattcctaattcctgtatgttatccactacaggttttatgagacttcctattaatttattaaatttattaaatgttg

SEQ ID NO: 102851 - DNA, 3288 bp, Homo sapiens
  Payload ID: 68
  Gene Symbol: HTR2C
  Gene Name: 5-hydroxytryptamine (serotonin) receptor 2C, G protein-coupled
  Uniprot ID: P28335
  ENST ID: ENST00000371951
  CDS Start-End: 820-2196
acccgcgcgaggtaggcgctctggtgcttgccgaggacgcttccttcctcagatgcaccgatcttcccgatactgcctttggagcggctagattgctagccttggctgctccattggcctgccttgccccttacctgccgattgcatatgaactcttcttctgtctgtacatcgttgtcgtcggagtcgtcgcgatcgtcgtggcgctcgtgtgatggccttcgtccgtttagagtagtgtagttagttaggggccaacgaagaagaaagaagacgcgattagtgcagagatgctggaggtggtcagttactaagctagagtaagatagcggagcgaaaagagccaaacctagccggggggcgcacggtcacccaaaggaggtcgactcgccggcgcttcctatcgcgccgagctccctccattcctctccctccgccgaggcgcgaggttgcggcgcgcagcgcagcgcagctcagcgcaccgactgccgcgggctccgctgggcgattgcagccgagtccgtttctcgtctagctgccgccgcggcgaccgctgcctggtcttcctcccggacgctagtgggttatcagctaacacccgcgagcatctataacataggccaactgacgccatccttcaaaaacaactgtctgggaaaaaaagaataaaaagtagtgtgagagcagaaaacgtgattgaaacacgaccaatctttcttcagtgccaaagggtggaaaagaaaggatgatatgatgaacctagcctgttaatttcgtcttctcaattttaaactttggttgcttaagactgaagcaatcatggtgaacctgaggaatgcggtgcattcattccttgtgcacctaattggcctattggtttggcaatctgatatttctgtgagcccagtagcagctatagtaactgacattttcaatacctccgatggtggacgcttcaaattcccagacggggtacaaaactggccagcactttcaatcgtcatcataataatcatgacaataggtggcaacatccttgtgatcatggcagtaagcatggaaaagaaactgcacaatgccaccaattacttcttaatgtccctagccattgctgatatgctagtgggactacttgtcatgcccctgtctctcctggcaatcctttatgattatgtctggccactacctagatatttgtgccccgtctggatttctttagatgttttattttcaacagcgtccatcatgcacctctgcgctatatcgctggatcggtatgtagcaatacgtaatcctattgagcatagccgtttcaattcgcggactaaggccatcatgaagattgctattgtttgggcaatttctataggtgtatcagttcctatccctgtgattggactgagggacgaagaaaaggtgttcgtgaacaacacgacgtgcgtgctcaacgacccaaatttcgttcttattgggtccttcgtagctttcttcataccgctgacgattatggtgattacgtattgcctgaccatctacgttctgcgccgacaagctttgatgttactgcacggccacaccgaggaaccgcctggactaagtctggatttcctgaagtgctgcaagaggaatacggccgaggaagagaactctgcaaaccctaaccaagaccagaacgcacgccgaagaaagaagaaggagagacgtcctaggggcaccatgcaggctatcaacaatgaaagaaaagcttcgaaagtccttgggattgttttctttgtgtttctgatcatgtggtgcccatttttcattaccaatattctgtctgttctttgtgagaagtcctgtaaccaaaagctcatggaaaagcttctgaatgtgtttgtttggattggctatgtttgttcaggaatcaatcctctggtgtatactctgttcaacaaaatttaccgaagggcattctccaactatttgcgttgcaattataaggtagagaaaaagcctcctgtcaggcagattccaagagttgccgccactgctttgtctgggagggagcttaatgttaacatttatcggcataccaatgaaccggtgatcgagaaagccagtgacaatgagcccggtatagagatgcaagttgagaatttagagttaccagtaaatccctccagtgtggttagcgaaaggattagcagtgtgtgagaaagaacagcacagtcttttcctacggtacaagctacatatgtaggaaaattttcttctttaatttttctgttggtcttaactaatgtaaatattgctgtctgaaaaagtgtttttacatatagctttgcaaccttgtactttacaatcatgcctacattagtgagatttagggttctatatttactgtttataataggtggagactaacttattttgattgtttgatgaataaaatgtttatttttgctctccctcccttctttccttccttttttcctttcttccttcctttctctctttcttttgtgcatatggcaacgttcatgttcatctcaggtggcatttgcaggtgaccagaatgaggcacatgacagtggttatatttcaaccacacctaaattaacaaattcagtggacatttgttctgggttaacagtaaatatacactttacattcttgctctgctcatctacacatataaacacagtaagataggttctgctttctgatacatctgtcagtgagtcagaggcagaacctagtcttgttgttcatataggggcaaaaatttgacattgtcagaatgttgtgttggtatttactgcaatgtctgtccctaaacatagtggtattttaacatagcagctggttaaccgggactacagaagtggaaggataatgagatgtaatacaccaaatagcttttcacttcttaaggacagtgttcaaattctgattattacaacaagcaaactgaaattagtgttttcattctggtccttagtaaattcctaattctatgattaaactgggaaatgagatcccagagttatttcccaacccaggattcaacatcaattgggttttgatctcagcatcctggaaatttgtgtgcttcacacaaagtgaaattagtattttgagccttattaaaatattttcttaattatggtacctctgtctataggacttaatttagcagtccatttttgagtaaaacttgtattggaagtatagatggtagaaactttggaagttttacttgattaaggactacagaattgggcccttagaatgtgaaaaaaaaaa

SEQ ID NO: 102852 - DNA, 1994 bp, Homo sapiens
  Payload ID: 69
  Gene Symbol: HTR3A
  Gene Name: 5-hydroxytryptamine (serotonin) receptor 3A, ionotropic
  Uniprot ID: P46098
  ENST ID: ENST00000299961
  CDS Start-End: 56-1447
agctgtcttgtgccacttgctcttccaagccagatctctgctttcctgtcaatgaatgcataggtcctttctacaagccaggaggagccgaaacaccaccaggcccgctctgctgaggctgtcggattaccttttgaccaactacaggaagggtgtgcgccccgtgagggactggaggaagccaaccaccgtatccattgacgtcattgtctatgccatcctcaacgtggatgagaagaatcaggtgctgaccacctacatctggtaccggcagtactggactgatgagtttctccagtggaaccctgaggactttgacaacatcaccaagttgtccatccccacggacagcatctgggtcccggacattctcatcaatgagttcgtggatgtggggaagtctccaaatatcccgtacgtgtatattcggcatcaaggcgaagttcagaactacaagccccttcaggtggtgactgcctgtagcctcgacatctacaacttccccttcgatgtccagaactgctcgctgaccttcaccagttggctgcacaccatccaggacatcaacatctctttgtggcgcttgccagaaaaggtgaaatccgacaggagtgtcttcatgaaccagggagagtgggagttgctgggggtgctgccctactttcgggagttcagcatggaaagcagtaactactatgcagaaatgaagttctatgtggtcatccgccggcggcccctcttctatgtggtcagcctgctactgcccagcatcttcctcatggtcatggacatcgtgggcttctacctgccccccaacagtggcgagagggtctctttcaagattacactcctcctgggctactcggtcttcctgatcatcgtttctgacacgctgccggccactgccatcggcactcctctcattggtgtctactttgtggtgtgcatggctctgctggtgataagtttggccgagaccatcttcattgtgcggctggtgcacaagcaagacctgcagcagcccgtgcctgcttggctgcgtcacctggttctggagagaatcgcctggctactttgcctgagggagcagtcaacttcccagaggcccccagccacctcccaagccaccaagactgatgactgctcagccatgggaaaccactgcagccacatgggaggaccccaggacttcgagaagagcccgagggacagatgtagccctcccccaccacctcgggaggcctcgctggcggtgtgtgggctgctgcaggagctgtcctccatccggcaattcctggaaaagcgggatgagatccgagaggtggcccgagactggctgcgcgtgggctccgtgctggacaagctgctattccacatttacctgctagcggtgctggcctacagcatcaccctggttatgctctggtccatctggcagtacgcttgagtgggtacagcccagtggaggagggggtacagtcctggttaggtggggacagaggatttctgcttaggcccctcaggacccagggaatgccagggacattttcaagacacagacaaagtcccgtgccctgtttccaatgccaattcatctcagcaatcacaagccaaggtctgaacccttccaccaaaaactgggtgttcaaggcccttacacccttgtcccacccccagcagctcaccatggctttaaaacatgctgtcttagatcaggagaaactcgggcactccctaagtccactctagttgtggacttttccccattgaccctcacctgaataagggactttggaattctgcttctctttcacaactttgcttttaggttgaaggcaaaaccaactctctactacacaggcctgataactctgtacgaggcttctctaacccctagtgtcttttttttcttcacctcacttgtggcagcttccctgaacactcatcccccatcagatgatgggagtgggaagaataaaatgcagtgaaaccct

SEQ ID NO: 102853 - DNA, 2331 bp, Homo sapiens
  Payload ID: 69
  Gene Symbol: HTR3A
  Gene Name: 5-hydroxytryptamine (serotonin) receptor 3A, ionotropic
  Uniprot ID: P46098
  ENST ID: ENST00000355556
  CDS Start-End: 234-1784
ctctcagctgtcccctcccctttcctcccgcctgaaacatgatccagctgaaggactgattgcaggaaaacttggcagctccccaaccttggtggcccagggagtgtgaggctgcagcctcagaaggtgtgagcagtggccacgagaggcaggctggctgggacatgaggttggcagagggcaggcaagctggcccttggtgggcctcgtcctgagcactcggaggcactcctatgcttggaaagctcgctatgctgctgtgggtccagcaggcgctgctcgccttgctcctccccacactcctggcacagggagaagccaggaggagccgaaacaccaccaggcccgctctgctgaggctgtcggattaccttttgaccaactacaggaagggtgtgcgccccgtgagggactggaggaagccaaccaccgtatccattgacgtcattgtctatgccatcctcaacgtggatgagaagaatcaggtgctgaccacctacatctggtaccggcagtactggactgatgagtttctccagtggaaccctgaggactttgacaacatcaccaagttgtccatccccacggacagcatctgggtcccggacattctcatcaatgagttcgtggatgtggggaagtctccaaatatcccgtacgtgtatattcggcatcaaggcgaagttcagaactacaagccccttcaggtggtgactgcctgtagcctcgacatctacaacttccccttcgatgtccagaactgctcgctgaccttcaccagttggctgcacaccatccaggacatcaacatctctttgtggcgcttgccagaaaaggtgaaatccgacaggagtgtcttcatgaaccagggagagtgggagttgctgggggtgctgccctactttcgggagttcagcatggaaagcagtaactactatgcagaaatgaagttctatgtggtcatccgccggcggcccctcttctatgtggtcagcctgctactgcccagcatcttcctcatggtcatggacatcgtgggcttctacctgccccccaacagtggcgagagggtctctttcaagattacactcctcctgggctactcggtcttcctgatcatcgtttctgacacgctgccggccactgccatcggcactcctctcattggtaaggcccctcctggcagcagagctcagtctggtgagaaacccgccccctcccacctcctgcatgtgtctcttgcctctgccctgggctgcacaggtgtctactttgtggtgtgcatggctctgctggtgataagtttggccgagaccatcttcattgtgcggctggtgcacaagcaagacctgcagcagcccgtgcctgcttggctgcgtcacctggttctggagagaatcgcctggctactttgcctgagggagcagtcaacttcccagaggcccccagccacctcccaagccaccaagactgatgactgctcagccatgggaaaccactgcagccacatgggaggaccccaggacttcgagaagagcccgagggacagatgtagccctcccccaccacctcgggaggcctcgctggcggtgtgtgggctgctgcaggagctgtcctccatccggcaattcctggaaaagcgggatgagatccgagaggtggcccgagactggctgcgcgtgggctccgtgctggacaagctgctattccacatttacctgctagcggtgctggcctacagcatcaccctggttatgctctggtccatctggcagtacgcttgagtgggtacagcccagtggaggagggggtacagtcctggttaggtggggacagaggatttctgcttaggcccctcaggacccagggaatgccagggacattttcaagacacagacaaagtcccgtgccctgtttccaatgccaattcatctcagcaatcacaagccaaggtctgaacccttccaccaaaaactgggtgttcaaggcccttacacccttgtcccacccccagcagctcaccatggctttaaaacatgctgtcttagatcaggagaaactcgggcactccctaagtccactctagttgtggacttttccccattgaccctcacctgaataagggactttggaattctgcttctctttcacaactttgcttttaggttgaaggcaaaaccaactctctactacacaggcctgataactctgtacgaggcttctctaacccctagtgtcttttttttcttcacctcacttgtggcagcttccctgaacactcatcccccatcagatgatgggagtgggaagaataaaatgcagtgaaaccct

SEQ ID NO: 102854 - DNA, 2235 bp, Homo sapiens
  Payload ID: 69
  Gene Symbol: HTR3A
  Gene Name: 5-hydroxytryptamine (serotonin) receptor 3A, ionotropic
  Uniprot ID: P46098
  ENST ID: ENST00000375498
  CDS Start-End: 234-1688
ctctcagctgtcccctcccctttcctcccgcctgaaacatgatccagctgaaggactgattgcaggaaaacttggcagctccccaaccttggtggcccagggagtgtgaggctgcagcctcagaaggtgtgagcagtggccacgagaggcaggctggctgggacatgaggttggcagagggcaggcaagctggcccttggtgggcctcgtcctgagcactcggaggcactcctatgcttggaaagctcgctatgctgctgtgggtccagcaggcgctgctcgccttgctcctccccacactcctggcacagggagaagccaggaggagccgaaacaccaccaggcccgctctgctgaggctgtcggattaccttttgaccaactacaggaagggtgtgcgccccgtgagggactggaggaagccaaccaccgtatccattgacgtcattgtctatgccatcctcaacgtggatgagaagaatcaggtgctgaccacctacatctggtaccggcagtactggactgatgagtttctccagtggaaccctgaggactttgacaacatcaccaagttgtccatccccacggacagcatctgggtcccggacattctcatcaatgagttcgtggatgtggggaagtctccaaatatcccgtacgtgtatattcggcatcaaggcgaagttcagaactacaagccccttcaggtggtgactgcctgtagcctcgacatctacaacttccccttcgatgtccagaactgctcgctgaccttcaccagttggctgcacaccatccaggacatcaacatctctttgtggcgcttgccagaaaaggtgaaatccgacaggagtgtcttcatgaaccagggagagtgggagttgctgggggtgctgccctactttcgggagttcagcatggaaagcagtaactactatgcagaaatgaagttctatgtggtcatccgccggcggcccctcttctatgtggtcagcctgctactgcccagcatcttcctcatggtcatggacatcgtgggcttctacctgccccccaacagtggcgagagggtctctttcaagattacactcctcctgggctactcggtcttcctgatcatcgtttctgacacgctgccggccactgccatcggcactcctctcattggtgtctactttgtggtgtgcatggctctgctggtgataagtttggccgagaccatcttcattgtgcggctggtgcacaagcaagacctgcagcagcccgtgcctgcttggctgcgtcacctggttctggagagaatcgcctggctactttgcctgagggagcagtcaacttcccagaggcccccagccacctcccaagccaccaagactgatgactgctcagccatgggaaaccactgcagccacatgggaggaccccaggacttcgagaagagcccgagggacagatgtagccctcccccaccacctcgggaggcctcgctggcggtgtgtgggctgctgcaggagctgtcctccatccggcaattcctggaaaagcgggatgagatccgagaggtggcccgagactggctgcgcgtgggctccgtgctggacaagctgctattccacatttacctgctagcggtgctggcctacagcatcaccctggttatgctctggtccatctggcagtacgcttgagtgggtacagcccagtggaggagggggtacagtcctggttaggtggggacagaggatttctgcttaggcccctcaggacccagggaatgccagggacattttcaagacacagacaaagtcccgtgccctgtttccaatgccaattcatctcagcaatcacaagccaaggtctgaacccttccaccaaaaactgggtgttcaaggcccttacacccttgtcccacccccagcagctcaccatggctttaaaacatgctgtcttagatcaggagaaactcgggcactccctaagtccactctagttgtggacttttccccattgaccctcacctgaataagggactttggaattctgcttctctttcacaactttgcttttaggttgaaggcaaaaccaactctctactacacaggcctgataactctgtacgaggcttctctaacccctagtgtcttttttttcttcacctcacttgtggcagcttccctgaacactcatcccccatcagatgatgggagtgggaagaataaaatgcagtgaaaccct

SEQ ID NO: 102855 - DNA, 1385 bp, Homo sapiens
  Payload ID: 69
  Gene Symbol: HTR3A
  Gene Name: 5-hydroxytryptamine (serotonin) receptor 3A, ionotropic
  ENST ID: ENST00000510849
  CDS Start-End: 41-757
ctgagcactcggaggcactcctatgcttggaaagctcgctatgctgctgtgggtccagcaggcgctgctcgccttgctcctccccacactcctggcacagggagaagccaggaggagccgaaacaccaccaggcccgctctgctgaggctgtcggattaccttttgaccaactacaggaagggtgtgcgccccgtgagggactggaggaagccaaccaccgtatccattgacgtcattgtctatgccatcctcaacgtggatgagaagaatcaggtgctgaccacctacatctggtaccggcagtactggactgatgagtttctccagtggaaccctgaggactttgacaacatcaccaagttgtccatccccacggacagcatctgggtcccggacattctcatcaatgagttcgtggatgtggggaagtctccaaatatcccgtacgtgtatattcggcatcaaggcgaagttcagaactacaagccccttcaggtggtgactgcctgtagcctcgacatctacaacttccccttcgatgtccagaactgctcgctgaccttcaccagttggctgcacaccagtggtcatccgccggcggcccctcttctatgtggtcagcctgctactgcccagcatcttcctcatggtcatggacatcgtgggcttctacctgccccccaacagtggcgagagggtctctttcaagattacactcctcctgggctactcggtcttcctgatcatcgtttctgacacgctgccggccactgccatcggcactcctctcattggtgtctactttgtggtgtgcatggctctgctggtgataagtttggccgagaccatcttcattgtgcggctggtgcacaagcaagacctgcagcagcccgtgcctgcttggctgcgtcacctggttctggagagaatcgcctggctactttgcctgagggagcagtcaacttcccagaggcccccagccacctcccaagccaccaagactgatgactgctcagccatgggaaaccactgcagccacatgggaggaccccaggacttcgagaagagcccgagggacagatgtagccctcccccaccacctcgggaggcctcgctggcggtgtgtgggctgctgcaggagctgtcctccatccggcaattcctggaaaagcgggatgagatccgagaggtggcccgagactggctgcgcgtgggctccgtgctggacaagctgctattccacatttacctgctagcggtgctggcctacagcatcaccctggttatgctctggtccatctggcagtacgcttgagtgggtacagcccagtggaggagggggtacagtcctggttaggtggggacagaggatttctgcttaggc

SEQ ID NO: 102856 - DNA, 2432 bp, Homo sapiens
  Payload ID: 69
  Gene Symbol: HTR3A
  Gene Name: 5-hydroxytryptamine (serotonin) receptor 3A, ionotropic
  Uniprot ID: P46098
  ENST ID: ENST00000504030
  CDS Start-End: 446-1882
acatacttgccaagggacatcaatgaaagcagcagcgtggtgcacctcccaggggtcaggctgcacccttgtctcatgggcttctgcagcccctgtccccacctaagttactccttggggaaacatggccaagccccctggctgaatgggtggactgagctcccacagcatgacatcagctagggcgggctcccctctcagctgtcccctcccctttcctcccgcctgaaacatgatccagctgaaggactgattgcaggaaaacttggcagctccccaaccttggtggcccagggagtgtgaggctgcagcctcagaaggtgtgagcagtggccacgagaggcaggctggctgggacatgaggttggcagagggcaggcaagctggcccttggtgggcctcgtcctgagcactcggaggcactcctatgcttggaaagctcgctatgctgctgtgggtccagcaggcgctgctcgccttgctcctccccacactcctggcacagggagaagccaggaggagccgaaacaccaccaggcccgctctgctgaggctgtcggattaccttttgaccaactacaggaagggtgtgcgccccgtgagggactggaggaagccaaccaccgtatccattgacgtcattgtctatgccatcctcaacgtggatgagaagaatcaggtgctgaccacctacatctggtaccggcagtactggactgatgagtttctccagtggaaccctgaggactttgacaacatcaccaagttgtccatccccacggacagcatctgggtcccggacattctcatcaatgagttcgtggatgtggggaagtctccaaatatcccgtacgtgtatattcggcatcaaggcgaagttcagaactacaagccccttcaggtggtgactgcctgtagcctcgacatctacaacttccccttcgatgtccagaactgctcgctgaccttcaccagttggctgcacaccatccaggacatcaacatctctttgtggcgcttgccagaaaaggtgaaatccgacaggagtgtcttcatgaaccagggagagtgggagttgctgggggtgctgccctactttcgggagttcagcatggaaagcagtaactactatgcagaaatgaagttctatgtggtcatccgccggcggcccctcttctatgtggtcagcctgctactgcccagcatcttcctcatggtcatggacatcgtgggcttctacctgccccccaacagtggcgagagggtctctttcaagattacactcctcctgggctactcggtcttcctgatcatcgtttctgacacgctgccggccactgccatcggcactcctctcattggtgtctactttgtggtgtgcatggctctgctggtgataagtttggccgagaccatcttcattgtgcggctggtgcacaagcaagacctgcagcagcccgtgcctgcttggctgcgtcacctggttctggagagaatcgcctggctactttgcctgagggagcagtcaacttcccagaggcccccagccacctcccaagccaccaagactgatgactgctcagccatgggaaaccactgcagccacatgggaggaccccaggacttcgagaagagcccgagggacagatgtagccctcccccaccacctcgggaggcctcgctggcggtgtgtgggctgctgcaggagctgtcctccatccggcaattcctggaaaagcgggatgagatccgagaggtggcccgagactggctgcgcgtgggctccgtgctggacaagctgctattccacatttacctgctagcggtgctggcctacagcatcaccctggttatgctctggtccatctggcagtacgcttgagtgggtacagcccagtggaggagggggtacagtcctggttaggtggggacagaggatttctgcttaggcccctcaggacccagggaatgccagggacattttcaagacacagacaaagtcccgtgccctgtttccaatgccaattcatctcagcaatcacaagccaaggtctgaacccttccaccaaaaactgggtgttcaaggcccttacacccttgtcccacccccagcagctcaccatggctttaaaacatgctgtcttagatcaggagaaactcgggcactccctaagtccactctagttgtggacttttccccattgaccctcacctgaataagggactttggaattctgcttctctttcacaactttgcttttaggttgaaggcaaaaccaactctctactacacaggcctgataactctgtacgaggcttctctaacccctagtgtcttttttttcttcacctcacttgtggcagcttccctgaacactcatcccccatcagatgatgggagtgggaagaataaaatgcagtgaaaccctaaa

SEQ ID NO: 102857 - DNA, 2221 bp, Homo sapiens
  Payload ID: 69
  Gene Symbol: HTR3A
  Gene Name: 5-hydroxytryptamine (serotonin) receptor 3A, ionotropic
  Uniprot ID: P46098
  ENST ID: ENST00000506841
  CDS Start-End: 139-1671
gcagcctcagaaggtgtgagcagtggccacgagaggcaggctggctgggacatgaggttggcagagggcaggcaagctggcccttggtgggcctcgtcctgagcactcggaggcactcctatgcttggaaagctcgctatgctgctgtgggtccagcaggcgctgctcgccttgctcctccccacactcctggcacagggagaagccaggaggagccgaaacaccaccaggcccgctctgctgaggctgtcggattaccttttgaccaactacaggaagggtgtgcgccccgtgagggactggaggaagccaaccaccgtatccattgacgtcattgtctatgccatcctcaacgtggatgagaagaatcaggtgctgaccacctacatctggtaccggcagtactggactgatgagtttctccagtggaaccctgaggactttgacaacatcaccaagttgtccatccccacggacagcatctgggtcccggacattctcatcaatgagttcgtggatgtggggaagtctccaaatatcccgtacgtgtatattcggcatcaaggcgaagttcagaactacaagccccttcaggtggtgactgcctgtagcctcgacatctacaacttccccttcgatgtccagaactgctcgctgaccttcaccagttggctgcacaccatccaggacatcaacatctctttgtggcgcttgccagaaaaggtgaaatccgacaggagtgtcttcatgaaccagggagagtgggagttgctgggggtgctgccctactttcgggagttcagcatggaaagcagtaactactatgcagaaatgaagttctatgtggtcatccgccggcggcccctcttctatgtggtcagcctgctactgcccagcatcttcctcatggtcatggacatcgtgggcttctacctgccccccaacagtggcgagagggtctctttcaagattacactcctcctgggctactcggtcttcctgatcatcgtttctgacacgctgccggccactgccatcggcactcctctcattggtaaggcccctcctggcagcagagctcagtctggtgagaaacccgccccctcccacctcctgcatgtgtctcttgcctctgccctgggctgcacaggtgtctactttgtggtgtgcatggctctgctggtgataagtttggccgagaccatcttcattgtgcggctggtgcacaagcaagacctgcagcagcccgtgcctgcttggctgcgtcacctggttctggagagaatcgcctggctactttgcctgagggagcagtcaacttcccagaggcccccagccacctcccaagccaccaagactgatgactgctcagccatgggaaaccactgcagccacatgggaggaccccaggacttcgagaagagcccgagggacagatgtagccctcccccaccacctcgggaggcctcgctggcggtgtgtgggctgctgcaggagctgtcctccatccggcaattcctggaaaagcgggatgagatccgagaggtggcccgagactggctgcgcgtgggctccgtgctggacaagctgctattccacatttacctgctagcggtgctggcctacagcatcaccctggttatgctctggtccatctggcagtacgcttgagtgggtacagcccagtggaggagggggtacagtcctggttaggtggggacagaggatttctgcttaggcccctcaggacccagggaatgccagggacattttcaagacacagacaaagtcccgtgccctgtttccaatgccaattcatctcagcaatcacaagccaaggtctgaacccttccaccaaaaactgggtgttcaaggcccttacacccttgtcccacccccagcagctcaccatggctttaaaacatgctgtcttagatcaggagaaactcgggcactccctaagtccactctagttgtggacttttccccattgaccctcacctgaataagggactttggaattctgcttctctttcacaactttgcttttaggttgaaggcaaaaccaactctctactacacaggcctgataactctgtacgaggcttctctaacccctagtgtcttttttttcttcacctcacttgtggcagcttccctgaacactcatcccccatcagatgatgggagtgggaagaataaaatgcagtgaaaccctaaa

SEQ ID NO: 102858 - DNA, 2011 bp, Homo sapiens
  Payload ID: 70
  Gene Symbol: HTR3B
  Gene Name: 5-hydroxytryptamine (serotonin) receptor 3B, ionotropic
  Uniprot ID: O95264
  ENST ID: ENST00000260191
  CDS Start-End: 258-1583
acggtctgatcttggggcagaaccaaagggagaagttaagggatttcatgacggcatcaattccaaaacatttgcatggtgctggtattgcctttggtcccactgagtgtttacaaaatagcaccagtaaggatagcatcaactggcaaacggagaaggaggagaacagagtggagaggaaccctgttaggagaaattgagcggcattccatctggtaggcaagtttgcatttctcctttttgggatctgcccaggaatgttgtcaagtgtaatggctcccctgtgggcctgcatcctggtggctgcaggaattctagccacagatacacatcatccccaggattctgctctgtatcatctcagcaagcagctattacagaaatatcataaagaagtgagacctgtttacaactggaccaaggccaccacagtctacctggacctgttcgtccatgctatattggatgtggatgcagagaatcaaatattaaagacaagtgtatggtaccaagaggtctggaatgatgaatttttatcctggaactccagcatgtttgatgagattagagagatctccctacctctaagtgccatctgggcccccgatatcatcatcaatgagtttgtggacattgaaagataccctgaccttccctatgtttatgtgaactcatctgggaccattgagaactataagcccatccaggtggtctctgcgtgcagtttagagacatatgcttttccatttgatgtccagaattgcagcctgaccttcaagagcattctgcatacagtggaagacgtagacctggcctttctgaggagcccagaagacattcagcatgacaaaaaggcgtttttgaatgacagtgagtgggaacttctatctgtgtcctccacatacagcatcctgcagagcagcgctggaggatttgcacagattcagtttaatgtggtgatgcgcaggcaccccctggtctatgtcgtgagtctgctgattcctagcatctttctcatgctggtggacctggggagcttctacctgccacccaactgccgagccaggattgtgttcaagaccagtgtgctggtgggctacaccgtcttcagggtcaacatgtccaaccaggtgccacggagtgtagggagcacccctctgattgggcacttcttcaccatctgcatggccttcttggttctcagcttagctaagtccatcgtgttggtcaaattcctccatgatgagcagcgtggtggacaggagcagcccttcttgtgccttcgaggggacaccgatgctgacaggcctagagtggaacccagggcccaacgtgctgtggtaacagagtcctcgctgtatggagagcacctggcccagccaggaaccctgaaggaagtctggtcgcagcttcaatctatcagcaactacctccaaactcaggaccagacagaccaacaggaggcagagtggctggtcctcctgtcccgctttgaccgactgctcttccaaagctaccttttcatgctggggatctacaccatcactctgtgctccctctgggcactgtggggcggcgtgtgaagactgaagtgttcttcagtaattgtgctggcacttaggagagagaggagggggaataatagtgggttaaaaagctttctgggtcgggtgtggtggttcttgcctatagtcccagtgctttgggaggccatagcaggaggattgcttgagcccaggagttcgagaccagccagagcaacatagtgagaccacatctctaccagtaaataaataaataaataaataaataaataaataaataaatagctgggcatagtggctcatgcctgtactctcagctacttgggaggttgaggtgggaggattgcttgagcccaggatttcaaggctgcagtgagccatgattgcaccactgcaccccagcctgggtgacagagcaagaccctgtctcaaaaaaaataaaataaaaggctttctgccttcattgc

SEQ ID NO: 102859 - DNA, 612 bp, Homo sapiens
  Payload ID: 70
  Gene Symbol: HTR3B
  Gene Name: 5-hydroxytryptamine (serotonin) receptor 3B, ionotropic
  ENST ID: ENST00000543092
  CDS Start-End: 1-527
atgcagagaatcaaatattaaagacaagtgtatggtaccaagaggtctggaatgatgaatttttatcctggaactccagcatgtttgatgagattagagagatctccctacctctaagtgccatctgggcccccgatatcatcatcaatgagtttgtggacattgaaagataccctgaccttccctatgtttatgtgaactcatctgggaccattgagaactataagcccatccaggtggtctctgcgtgcagtttagagacatatgcttttccatttgatgtccagaattgcagcctgaccttcaagagcattctgcatacagtggaagacgtagacctggcctttctgaggagcccagaagacattcagcatgacaaaaaggcgtttttgaatgacagtgagtgggaacttctatctgtgtcctccacatacagcatcctgcagagcagcgctggaggatttgcacagattcagtttaatggcacttcttcaccatctgcatggccttcttggttctcagcttagctaagtccatcgtgttggtcaaattcctccatgatgagcagcgtggtggacaggagcagcccttcttgtgccttcgaggggacac

SEQ ID NO: 102860 - DNA, 1692 bp, Homo sapiens
  Payload ID: 70
  Gene Symbol: HTR3B
  Gene Name: 5-hydroxytryptamine (serotonin) receptor 3B, ionotropic
  Uniprot ID: O95264
  ENST ID: ENST00000537778
  CDS Start-End: 285-1577
aattattctgtctccaaaatgcaagattgttgtaaaatggaattgtaggtacagttttccaaccttggagatggcgttgatttacttgtttttacaatgaggtttctccattgggcacttaggccatcagcttactttaagcatttgccaaaggccccaccagctggctgtgaattgatgcagattttggtgagctgaaagctatattctagtaaaagccaccgagtcctgaacagtctgaaacctcctaaagaaaccaagctcctcttacttttatcttcacaatgatagtttattttccaggaattctagccacagatacacatcatccccaggattctgctctgtatcatctcagcaagcagctattacagaaatatcataaagaagtgagacctgtttacaactggaccaaggccaccacagtctacctggacctgttcgtccatgctatattggatgtggatgcagagaatcaaatattaaagacaagtgtatggtaccaagaggtctggaatgatgaatttttatcctggaactccagcatgtttgatgagattagagagatctccctacctctaagtgccatctgggcccccgatatcatcatcaatgagtttgtggacattgaaagataccctgaccttccctatgtttatgtgaactcatctgggaccattgagaactataagcccatccaggtggtctctgcgtgcagtttagagacatatgcttttccatttgatgtccagaattgcagcctgaccttcaagagcattctgcatacagtggaagacgtagacctggcctttctgaggagcccagaagacattcagcatgacaaaaaggcgtttttgaatgacagtgagtgggaacttctatctgtgtcctccacatacagcatcctgcagagcagcgctggaggatttgcacagattcagtttaatgtggtgatgcgcaggcaccccctggtctatgtcgtgagtctgctgattcctagcatctttctcatgctggtggacctggggagcttctacctgccacccaactgccgagccaggattgtgttcaagaccagtgtgctggtgggctacaccgtcttcagggtcaacatgtccaaccaggtgccacggagtgtagggagcacccctctgattgggcacttcttcaccatctgcatggccttcttggttctcagcttagctaagtccatcgtgttggtcaaattcctccatgatgagcagcgtggtggacaggagcagcccttcttgtgccttcgaggggacaccgatgctgacaggcctagagtggaacccagggcccaacgtgctgtggtaacagagtcctcgctgtatggagagcacctggcccagccaggaaccctgaaggaagtctggtcgcagcttcaatctatcagcaactacctccaaactcaggaccagacagaccaacaggaggcagagtggctggtcctcctgtcccgctttgaccgactgctcttccaaagctaccttttcatgctggggatctacaccatcactctgtgctccctctgggcactgtggggcggcgtgtgaagactgaagtgttcttcagtaattgtgctggcacttaggagagagaggagggggaataatagtgggttaaaaagctttctgggtcgggtgtggtggttcttgcctatagtcccag

SEQ ID NO: 102861 - DNA, 1697 bp, Homo sapiens
  Payload ID: 71
  Gene Symbol: HTR3C
  Gene Name: 5-hydroxytryptamine (serotonin) receptor 3C, ionotropic
  Uniprot ID: Q8WXA8
  ENST ID: ENST00000318351
  CDS Start-End: 35-1378
tggtgaatccccagagaagagtccagaaagaagaatggaaggagggtggcctgcaaggcagagtgccctcctctgcctcactgtcagtcttctgcttcaaggaagaggcgacgcttttaccatcaattgctcaggctttgaccagcatggggttgaccctgctgtcttccaagcagtgtttgacagaaaggccttccgtccattcaccaactacagcatccctacccgtgtcaacatctccttcaccctgtctgccatcctgggagtggatgcacagctccagctgctgacatcattcctgtggatggatttggtatgggacaatcctttcattaattggaacccaaaagagtgtgttggcatcaataaactcacagtattagctgaaaacctgtggctcccagacatcttcatcgtggaatccatggatgtggatcagacgccttccggtctcactgcctatatcagcagtgaaggtcgaattaagtatgataagccaatgagggtgaccagcatctgtaacctggacatcttctacttcccttttgaccaacagaactgtaccttcaccttcagttctttcctctacacagtggacagcatgctgctgggcatggacaaggaggtgtgggagatcacagacacgtctcgcaaagtcatccaaacccagggggagtgggagctcttgggcatcaacaaggccaccccaaagatgtccatgggcaacaacctatatgaccagatcatgttttatgtggccatcaggcgcaggccaagcctctacatcataaacctgctggtgcccagtagctttctggttgccattgatgccctcagcttctacctgccagcagagagcgagaatcgtgccccattcaagataacacttctgctgggctacaacgtcttcctgctcatgatgaatgacttgctccctgccagtggcacccccctcatcagtgtctacttcgccctgtgcctgtccctgatggtggtcagcctgctggagaccgtcttcattacctacctgctgcacgtggccaccacccagcccccacccatgcctaggtggcttcactccctgctgctccactgcaccagcccagggagatgctgtcccactgcgccccagaagggaaataagggcctgggtctcaccctcacccacctgcctggcccaaaggagccgggggagttagcagggaagaagctgggacccagagagaccgagccagatgggggctcaggatggacaaagacccagctaatggagctgtgggtgcagttcagccacgcgatggacaccctgctcttccgcctctacctgctcttcatggcctcctccatccttactgtcattgtcctctggaacacctaggcagacatcccccctctctggcaaacaacagcttggagtttctgctggtcttgggccagccggactcattttcctaatcttagccacttatccccagtgactaccatgtccccttctaaattccaaagactccaacgcagcactagcaagcaggttcgggacagccctggacgatttcccgaccgctgctcaggctgctcattcctgctcaccctcagtctccctgagctaccacctaactcctcactccctgatcaatggaagtccaggtcagtggagtctctccttgattgatcaccccaataaacaactttccagg

SEQ ID NO: 102862 - DNA, 1459 bp, Homo sapiens
  Payload ID: 72
  Gene Symbol: HTR3D
  Gene Name: 5-hydroxytryptamine (serotonin) receptor 3D, ionotropic
  ENST ID: ENST00000334128
  CDS Start-End: 226-1065
ctagattcaggcccagttaaagcacaggtggcttagatcaaaaatcattattgccacatggaccagccttggaagtgaacaaggagagggtggtggcatgggacctgccttcctggagttaatcatctagatgaaagctgctattccaggattcacaccttcaactggtgacatcgttcctgtggctaaatatgcatcagtgtggatcagacacctgcaggtctcatggctagtatgtcaatagtgaaggccacatcaaacacaataagccaatgtgggtggtcagcatctgcaaactggacaccttctatttccccttccatggacagaggtgaacgctctccttcagccctttcacctacacaggtggccatcaggcgcaggtgcaggcccagcccctacgtggtaaactttctggtgcccagtggcattctgattgccatcgatgccctcagtttctacctgccactggaaagtgggaattgtgccccattcaagatgactgttctgctgggctacagcgtcttcctgctcatgatgaatgacttgctcccagccactagcacttcatcacatgcttcactagtacgtcctcatccatcaagagaccaaaagcgaggtgtctacttcgccctgtgcctgtccctgatggtgggcagcctgctggagaccatcttcatcacccacctgctgcacgtggccaccacccagcccctacctctgcctcggtggctccactccctgctgctgcactgcaccggccaagggagatgctgtcccactgcgccccagaagggaaataagggcccgggtctcacccccacccacctgcccggtgtgaaggagccagaggtatcagcagggcagatgccaggccctggggaggcagagctgacagggggctcagaatggacaagggcccagcgggaacacgaggcccagaagcagcactcggtggagctgtgggtgcagttcagccacgcgatggacgccctgctcttccgcctctacctgctcttcatggcctcctccatcatcaccgtcatatgcctctggaacacctaggcaggtgctcacctgcaaacttcagtctggacttctttttgccagagaactccagaaaccagtcaggctctcagtcagccttgtggccctgtcaaccgcctcatttttaacccagtcctctgtgtagtttcagaccagacctgaatagtctcctatgccctccaaaagtcgggtccttgctcctgcatgccatcagccccactcagccctcccatacctccctggctcctcaggattcaggttcctagggtacgtccttgattaaatcaccccaatatgcccctttgcagaaagtattggcttttccctgaattctgttatggtaaaaaaaatcttgggattgagagtcttcttgcagaaacttctcagccaaagtaaaaaggattttctctta

SEQ ID NO: 102863 - DNA, 1674 bp, Homo sapiens
  Payload ID: 72
  Gene Symbol: HTR3D
  Gene Name: 5-hydroxytryptamine (serotonin) receptor 3D, ionotropic
  Uniprot ID: Q70Z44
  ENST ID: ENST00000382489
  CDS Start-End: 1-1365
atgcagaaacactctccaggccccccagccctggccctcctctctcagtctctgctcactacaggaaatggcgacactttgattatcaattgcccaggctttggccagcacagggtggaccctgcagcctttcaagcagtgtttgacagaaaggctattggtccagtcaccaactacagtgtcgccactcatgtcaacatctccttcaccttgtctgccatctggaactgctattccaggattcacaccttcaactgccaccatgcccggccttggcacaatcaatttgtgcagtggaacccagatgaatgcggaggcatcaagaagtccggcatggcaactgagaacctatggctttcagatgtcttcatcgaggagtctgtggatcagacacctgcaggtctcatggctagtatgtcaatagtgaaggccacatcaaacacaataagccaatgtgggtggtcagcatctgcaaactggacaccttctatttccccttccatggacagagcccgggcatggagaaggatgtccaggagctttcaaatacatcacagaacctcattcagaacaaggagggagtgggtactgctgggtatccaaaaaagaacaataaaggtgaccgtggccactaaccagtatgaacaagccatcttccatgtggccatcaggcgcaggtgcaggcccagcccctacgtggtaaactttctggtgcccagtggcattctgattgccatcgatgccctcagtttctacctgccactggaaagtgggaattgtgccccattcaagatgactgttctgctgggctacagcgtcttcctgctcatgatgaatgacttgctcccagccactagcacttcatcacatgcttcactagtggcgcctctggccctcatgcagacccccttgcctgcaggtgtctacttcgccctgtgcctgtccctgatggtgggcagcctgctggagaccatcttcatcacccacctgctgcacgtggccaccacccagcccctacctctgcctcggtggctccactccctgctgctgcactgcaccggccaagggagatgctgtcccactgcgccccagaagggaaataagggcccgggtctcacccccacccacctgcccggtgtgaaggagccagaggtatcagcagggcagatgccaggccctggggaggcagagctgacagggggctcagaatggacaagggcccagcgggaacacgaggcccagaagcagcactcggtggagctgtgggtgcagttcagccacgcgatggacgccctgctcttccgcctctacctgctcttcatggcctcctccatcatcaccgtcatatgcctctggaacacctaggcaggtgctcacctgcaaacttcagtctggacttctttttgccagagaactccagaaaccagtcaggctctcagtcagccttgtggccctgtcaaccgcctcatttttaacccagtcctctgtgtagtttcagaccagacctgaatagtctcctatgccctccaaaagtcgggtccttgctcctgcatgccatcagccccactcagccctcccatacctccctggctcctcaggattcaggttcctagggtacgtccttgattaaatcaccccaatatgcccctttgcagaaagtattggcttttccct

SEQ ID NO: 102864 - DNA, 1043 bp, Homo sapiens
  Payload ID: 72
  Gene Symbol: HTR3D
  Gene Name: 5-hydroxytryptamine (serotonin) receptor 3D, ionotropic
  Uniprot ID: Q70Z44
  ENST ID: ENST00000453435
  CDS Start-End: 117-818
tgaacaaggagagggtggtggcatgggacctgccttcctggagttaatcatctagatgaaagctgctattccaggattcacaccttcaactggtgacatcgttcctgtggctaaatatggtggccatcaggcgcaggtgcaggcccagcccctacgtggtaaactttctggtgcccagtggcattctgattgccatcgatgccctcagtttctacctgccactggaaagtgggaattgtgccccattcaagatgactgttctgctgggctacagcgtcttcctgctcatgatgaatgacttgctcccagccactagcacttcatcacatgcttcactagtacgtcctcatccatcaagagaccaaaagcgaggtgtctacttcgccctgtgcctgtccctgatggtgggcagcctgctggagaccatcttcatcacccacctgctgcacgtggccaccacccagcccctacctctgcctcggtggctccactccctgctgctgcactgcaccggccaagggagatgctgtcccactgcgccccagaagggaaataagggcccgggtctcacccccacccacctgcccggtgtgaaggagccagaggtatcagcagggcagatgccaggccctggggaggcagagctgacagggggctcagaatggacaagggcccagcgggaacacgaggcccagaagcagcactcggtggagctgtgggtgcagttcagccacgcgatggacgccctgctcttccgcctctacctgctcttcatggcctcctccatcatcaccgtcatatgcctctggaacacctaggcaggtgctcacctgcaaacttcagtctggacttctttttgccagagaactccagaaaccagtcaggctctcagtcagccttgtggccctgtcaaccgcctcatttttaacccagtcctctgtgtagtttcagaccagacctgaatagtctcctatgccctccaaaagtcgggtccttgctcctgcatgccatcagccccactcagccctcccatacctccctgg

SEQ ID NO: 102865 - DNA, 1215 bp, Homo sapiens
  Payload ID: 72
  Gene Symbol: HTR3D
  Gene Name: 5-hydroxytryptamine (serotonin) receptor 3D, ionotropic
  Uniprot ID: Q70Z44
  ENST ID: ENST00000428798
  CDS Start-End: 1-1215
atggaaagaggctggttccatgggaaaggattcctccttggcttcatcctccacctgctgctgcaagattcacaccttcaactggtgacatcgttcctgtggctaaatatgtggaacccagatgaatgcggaggcatcaagaagtccggcatggcaactgagaacctatggctttcagatgtcttcatcgaggagtctgtggatcagacacctgcaggtctcatggctagtatgtcaatagtgaaggccacatcaaacacaataagccaatgtgggtggtcagcatctgcaaactggacaccttctatttccccttccatggacagaggtgaacgctctccttcagccctttcacctacacaggtaacccgggcatggagaaggatgtccaggagctttcaaatacatcacagaacctcattcagaacaaggagggagtgggtactgctgggtatccaaaaaagaacaataaaggtgaccgtggccactaaccagtatgaacaagccatcttccatgtggccatcaggcgcaggtgcaggcccagcccctacgtggtaaactttctggtgcccagtggcattctgattgccatcgatgccctcagtttctacctgccactggaaagtgggaattgtgccccattcaagatgactgttctgctgggctacagcgtcttcctgctcatgatgaatgacttgctcccagccactagcacttcatcacatgcttcactagtacgtcctcatccatcaagagaccaaaagcgaggtgtctacttcgccctgtgcctgtccctgatggtgggcagcctgctggagaccatcttcatcacccacctgctgcacgtggccaccacccagcccctacctctgcctcggtggctccactccctgctgctgcactgcaccggccaagggagatgctgtcccactgcgccccagaagggaaataagggcccgggtctcacccccacccacctgcccggtgtgaaggagccagaggtatcagcagggcagatgccaggccctggggaggcagagctgacagggggctcagaatggacaagggcccagcgggaacacgaggcccagaagcagcactcggtggagctgtgggtgcagttcagccacgcgatggacgccctgctcttccgcctctacctgctcttcatggcctcctccatcatcaccgtcatatgcctctggaacacctag

SEQ ID NO: 102866 - DNA, 1912 bp, Homo sapiens
  Payload ID: 73
  Gene Symbol: HTR3E
  Gene Name: 5-hydroxytryptamine (serotonin) receptor 3E, ionotropic
  Uniprot ID: A5X5Y0
  ENST ID: ENST00000335304
  CDS Start-End: 195-1610
gaacaagtccggcttctgccttttattggctgtctgactgtaggaagttacttcctcttattgcaccttagttagctcgtttattacatgagggtaaagcagtatctacctgataggggattgggaggattaaatgaggtaatccatttttaaagggcttagaatatacctgacacacagccagtgctcaacaaatgttagctttcattttatcacgggcgaccccacgccctgccttggggcccctctcatatagggagcacagggttgctctccttcatctcacacattcgatgtccactacaggaaggggcgttactttcaccatcaattgctcagggtttggccagcacggggcggatcccactgctctgaattcagtgtttaatagaaagcccttccgtccggtcaccaacatcagcgtccccacccaagtcaacatctccttcgcgatgtctgccatcctagatgtgaatgaacagctgcacctcttgtcatcattcctgtggctggaaatggtttgggataacccatttatcagctggaacccagaggaatgtgagggcatcacgaagatgagtatggcagccaagaacctgtggctcccagacattttcatcattgaactcatggatgtggataagaccccaaaaggcctcacagcatatgtaagtaatgaaggtcgcatcaggtataagaaacccatgaaggtggacagtatctgtaacctggacatcttctacttccccttcgaccagcagaactgcacactcaccttcagctcattcctctacacagtggacagcatgttgctggacatggagaaagaagtgtgggaaataacagacgcatcccggaacatccttcagacccatggagaatgggagctcctgggcctcagcaaggccaccgcaaagttgtccaggggaggcaacctgtatgatcagatcgtgttctatgtggccatcaggcgcaggcccagtctctatgtcataaaccttctcgtgcccagtggctttctggttgccatcgatgccctcagcttctacctgccagtgaaaagtgggaatcgtgtcccattcaagataacgctcctgctgggctacaacgtcttcctgctcatgatgagtgacttgctccccaccagtggcacccccctcatcggtgtctacttcgccctgtgcctgtccctgatggtgggcagcctgctggagaccatcttcatcacccacctgctgcacgtggccaccacccagcccccacccctgcctcggtggctccactccctgctgctccactgcaacagcccggggagatgctgtcccactgcgccccagaaggaaaataagggcccgggtctcacccccacccacctgcccggtgtgaaggagccagaggtatcagcagggcagatgccgggccctgcggaggcagagctgacagggggctcagaatggacaagggcccagcgggaacacgaggcccagaagcagcactcagtggagctgtggttgcagttcagccacgcgatggacgccatgctcttccgcctctacctgctcttcatggcctcctctatcatcaccgtcatatgcctctggaacacctaggcaggtgctcacctgccaacttcagtctggagcttctcttgcctccagggactggccaggtctcccccctttcctgagtaccaactatcatatccccaaagatgactgagtctctgctgtattccatgtatcccaatccggtcctgctgatcaattccaatcccagacatttctccctgttcctgcattttgttggcttccttcagtcctaccatatggttctaggtccctcttacgtcatctgcatagcagactatacctcttctgtccgctgacttgcccaataaataattctgcagaga

SEQ ID NO: 102867 - DNA, 705 bp, Homo sapiens
  Payload ID: 73
  Gene Symbol: HTR3E
  Gene Name: 5-hydroxytryptamine (serotonin) receptor 3E, ionotropic
  ENST ID: ENST00000431041
  CDS Start-End: 232-705
cctcttattgcaccttagttagctcgtttattacatgagggtaaagcagtatctacctgataggggattgggaggattaaatgaggaaggggcgttactttcaccatcaattgctcagggtttggccagcacggggcggatcccactgctctgaattcagtgtttaatagaaagcccttccgtccggtcaccaacatcagcgtccccacccaagtcaacatctccttcgcgatgtctgccatcctagatgtgaatgaacagctgcacctcttgtcatcattcctgtggctggaaatggtttgggataacccatttatcagctggaacccagaggaatgtgagggcatcacgaagatgagtatggcagccaagaacctgtggctcccagacattttcatcattgaactcatggatgtggataagaccccaaaaggcctcacagcatatgtaagtaatgaaggtcgcatcaggtataagaaacccatgaaggtggacagtatctgtaacctggacatcttctacttccccttcgaccagcagaactgcacactcaccttcagctcattcctctacacagtggacagcatgttgctggacatggagaaagaagtgtgggaaataacagacgcatcccggaacatccttcagacccatggagaatgggagctcctgggcctcagcaaggccaccgcaaagttgtccagg

SEQ ID NO: 102868 - DNA, 1371 bp, Homo sapiens
  Payload ID: 73
  Gene Symbol: HTR3E
  Gene Name: 5-hydroxytryptamine (serotonin) receptor 3E, ionotropic
  Uniprot ID: A5X5Y0
  ENST ID: ENST00000436361
  CDS Start-End: 1-1371
atgttagctttcattttatcacgggcgaccccacgccctgccttggggcccctctcatatagggagcacagggttgctctccttcatctcacacattcgatgtccactacaggaaggggcgttactttcaccatcaattgctcagggtttggccagcacggggcggatcccactgctctgaattcagtgtttaatagaaagcccttccgtccggtcaccaacatcagcgtccccacccaagtcaacatctccttcgcgatgtctgccatcctagatgtggtttgggataacccatttatcagctggaacccagaggaatgtgagggcatcacgaagatgagtatggcagccaagaacctgtggctcccagacattttcatcattgaactcatggatgtggataagaccccaaaaggcctcacagcatatgtaagtaatgaaggtcgcatcaggtataagaaacccatgaaggtggacagtatctgtaacctggacatcttctacttccccttcgaccagcagaactgcacactcaccttcagctcattcctctacacagtggacagcatgttgctggacatggagaaagaagtgtgggaaataacagacgcatcccggaacatccttcagacccatggagaatgggagctcctgggcctcagcaaggccaccgcaaagttgtccaggggaggcaacctgtatgatcagatcgtgttctatgtggccatcaggcgcaggcccagtctctatgtcataaaccttctcgtgcccagtggctttctggttgccatcgatgccctcagcttctacctgccagtgaaaagtgggaatcgtgtcccattcaagataacgctcctgctgggctacaacgtcttcctgctcatgatgagtgacttgctccccaccagtggcacccccctcatcggtgtctacttcgccctgtgcctgtccctgatggtgggcagcctgctggagaccatcttcatcacccacctgctgcacgtggccaccacccagcccccacccctgcctcggtggctccactccctgctgctccactgcaacagcccggggagatgctgtcccactgcgccccagaaggaaaataagggcccgggtctcacccccacccacctgcccggtgtgaaggagccagaggtatcagcagggcagatgccgggccctgcggaggcagagctgacagggggctcagaatggacaagggcccagcgggaacacgaggcccagaagcagcactcagtggagctgtggttgcagttcagccacgcgatggacgccatgctcttccgcctctacctgctcttcatggcctcctctatcatcaccgtcatatgcctctggaacacctag

SEQ ID NO: 102869 - DNA, 2139 bp, Homo sapiens
  Payload ID: 73
  Gene Symbol: HTR3E
  Gene Name: 5-hydroxytryptamine (serotonin) receptor 3E, ionotropic
  Uniprot ID: A5X5Y0
  ENST ID: ENST00000415389
  CDS Start-End: 467-1837
gtaaaataacaaattgtgtttatttaagccactgggtttgtgatttgttacaacagcaataaaaggcatgtaagatagaaggaaaccattcaacacatgtctaataagaaaaatagaggaagtgaaacatttataaatgtctgagaattttccaaaattgaagagatgagtcttcagaccaagggatctcaccaagatctgcaagttgatcacgtatgaactatctataaccatttacgttgcagtgaaatacctaagactaagataaagtcttaaaagcagactgaaccttaagcataggcaagaacaagacaaccagaacactctttgaaggaaggttacaaatgtcagtggtcaaccaatgctattagtattcaaagtcagactctaggtgtggcctgtgctgctttaatctgggcattcctgggtcccagtacatgttcagagaagaacttagacaaagaagatggaaggaagctggttccacaggaaaagattttccttctacctccttctcggttttctgcttcaaggaaggggcgttactttcaccatcaattgctcagggtttggccagcacggggcggatcccactgctctgaattcagtgtttaatagaaagcccttccgtccggtcaccaacatcagcgtccccacccaagtcaacatctccttcgcgatgtctgccatcctagatgtgaatgaacagctgcacctcttgtcatcattcctgtggctggaaatggtttgggataacccatttatcagctggaacccagaggaatgtgagggcatcacgaagatgagtatggcagccaagaacctgtggctcccagacattttcatcattgaactcatggatgtggataagaccccaaaaggcctcacagcatatgtaagtaatgaaggtcgcatcaggtataagaaacccatgaaggtggacagtatctgtaacctggacatcttctacttccccttcgaccagcagaactgcacactcaccttcagctcattcctctacacagtggacagcatgttgctggacatggagaaagaagtgtgggaaataacagacgcatcccggaacatccttcagacccatggagaatgggagctcctgggcctcagcaaggccaccgcaaagttgtccaggggaggcaacctgtatgatcagatcgtgttctatgtggccatcaggcgcaggcccagtctctatgtcataaaccttctcgtgcccagtggctttctggttgccatcgatgccctcagcttctacctgccagtgaaaagtgggaatcgtgtcccattcaagataacgctcctgctgggctacaacgtcttcctgctcatgatgagtgacttgctccccaccagtggcacccccctcatcggtgtctacttcgccctgtgcctgtccctgatggtgggcagcctgctggagaccatcttcatcacccacctgctgcacgtggccaccacccagcccccacccctgcctcggtggctccactccctgctgctccactgcaacagcccggggagatgctgtcccactgcgccccagaaggaaaataagggcccgggtctcacccccacccacctgcccggtgtgaaggagccagaggtatcagcagggcagatgccgggccctgcggaggcagagctgacagggggctcagaatggacaagggcccagcgggaacacgaggcccagaagcagcactcagtggagctgtggttgcagttcagccacgcgatggacgccatgctcttccgcctctacctgctcttcatggcctcctctatcatcaccgtcatatgcctctggaacacctaggcaggtgctcacctgccaacttcagtctggagcttctcttgcctccagggactggccaggtctcccccctttcctgagtaccaactatcatatccccaaagatgactgagtctctgctgtattccatgtatcccaatccggtcctgctgatcaattccaatcccagacatttctccctgttcctgcattttgttggcttccttcagtcctaccatatggttctaggtccctcttacgtcatctgcatagcagactatacctcttctgtccgctgacttgcccaataaataattctgcagaga

SEQ ID NO: 102870 - DNA, 1326 bp, Homo sapiens
  Payload ID: 73
  Gene Symbol: HTR3E
  Gene Name: 5-hydroxytryptamine (serotonin) receptor 3E, ionotropic
  Uniprot ID: A5X5Y0
  ENST ID: ENST00000425359
  CDS Start-End: 1-1326
atggaaggaagctggttccacaggaaaagattttccttctacctccttctcggttttctgcttcaaggaaggggcgttactttcaccatcaattgctcagggtttggccagcacggggcggatcccactgctctgaattcagtgtttaatagaaagcccttccgtccggtcaccaacatcagcgtccccacccaagtcaacatctccttcgcgatgtctgccatcctagatgtggtttgggataacccatttatcagctggaacccagaggaatgtgagggcatcacgaagatgagtatggcagccaagaacctgtggctcccagacattttcatcattgaactcatggatgtggataagaccccaaaaggcctcacagcatatgtaagtaatgaaggtcgcatcaggtataagaaacccatgaaggtggacagtatctgtaacctggacatcttctacttccccttcgaccagcagaactgcacactcaccttcagctcattcctctacacagtggacagcatgttgctggacatggagaaagaagtgtgggaaataacagacgcatcccggaacatccttcagacccatggagaatgggagctcctgggcctcagcaaggccaccgcaaagttgtccaggggaggcaacctgtatgatcagatcgtgttctatgtggccatcaggcgcaggcccagtctctatgtcataaaccttctcgtgcccagtggctttctggttgccatcgatgccctcagcttctacctgccagtgaaaagtgggaatcgtgtcccattcaagataacgctcctgctgggctacaacgtcttcctgctcatgatgagtgacttgctccccaccagtggcacccccctcatcggtgtctacttcgccctgtgcctgtccctgatggtgggcagcctgctggagaccatcttcatcacccacctgctgcacgtggccaccacccagcccccacccctgcctcggtggctccactccctgctgctccactgcaacagcccggggagatgctgtcccactgcgccccagaaggaaaataagggcccgggtctcacccccacccacctgcccggtgtgaaggagccagaggtatcagcagggcagatgccgggccctgcggaggcagagctgacagggggctcagaatggacaagggcccagcgggaacacgaggcccagaagcagcactcagtggagctgtggttgcagttcagccacgcgatggacgccatgctcttccgcctctacctgctcttcatggcctcctctatcatcaccgtcatatgcctctggaacacctag

SEQ ID NO: 102871 - DNA, 1449 bp, Homo sapiens
  Payload ID: 73
  Gene Symbol: HTR3E
  Gene Name: 5-hydroxytryptamine (serotonin) receptor 3E, ionotropic
  Uniprot ID: A5X5Y0
  ENST ID: ENST00000440596
  CDS Start-End: 1-1449
atgttagctttcattttatcacgggcgaccccacgccctgccttggggcccctctcatatagggagcacagggttgctctccttcatctcacacattcgatgtccactacaggaaggggcgttactttcaccatcaattgctcagggtttggccagcacggggcggatcccactgctctgaattcagtgtttaatagaaagcccttccgtccggtcaccaacatcagcgtccccacccaagtcaacatctccttcgcgatgtctgccatcctagatgtggtttgggataacccatttatcagctggaacccagaggaatgtgagggcatcacgaagatgagtatggcagccaagaacctgtggctcccagacattttcatcattgaactgtgcgtatcaagggctggtcagagggaagtcccatctcctggtagccacagagatcacagtttaccattggggccactcatggatgtggataagaccccaaaaggcctcacagcatatgtaagtaatgaaggtcgcatcaggtataagaaacccatgaaggtggacagtatctgtaacctggacatcttctacttccccttcgaccagcagaactgcacactcaccttcagctcattcctctacacagtggacagcatgttgctggacatggagaaagaagtgtgggaaataacagacgcatcccggaacatccttcagacccatggagaatgggagctcctgggcctcagcaaggccaccgcaaagttgtccaggggaggcaacctgtatgatcagatcgtgttctatgtggccatcaggcgcaggcccagtctctatgtcataaaccttctcgtgcccagtggctttctggttgccatcgatgccctcagcttctacctgccagtgaaaagtgggaatcgtgtcccattcaagataacgctcctgctgggctacaacgtcttcctgctcatgatgagtgacttgctccccaccagtggcacccccctcatcggtgtctacttcgccctgtgcctgtccctgatggtgggcagcctgctggagaccatcttcatcacccacctgctgcacgtggccaccacccagcccccacccctgcctcggtggctccactccctgctgctccactgcaacagcccggggagatgctgtcccactgcgccccagaaggaaaataagggcccgggtctcacccccacccacctgcccggtgtgaaggagccagaggtatcagcagggcagatgccgggccctgcggaggcagagctgacagggggctcagaatggacaagggcccagcgggaacacgaggcccagaagcagcactcagtggagctgtggttgcagttcagccacgcgatggacgccatgctcttccgcctctacctgctcttcatggcctcctctatcatcaccgtcatatgcctctggaacacctag

SEQ ID NO: 102872 - DNA, 3082 bp, Homo sapiens
  Payload ID: 74
  Gene Symbol: HTR4
  Gene Name: 5-hydroxytryptamine (serotonin) receptor 4, G protein-coupled
  Uniprot ID: Q13639
  ENST ID: ENST00000360693
  CDS Start-End: 140-1426
gcggcagcggcggcagcagaagctcggctcagcggctgggggtggccgctcgaatctgccagggcacctcgctccctcgcctctggcagcgggaccctgtgggcattgaaatccaactcactcatgcttatttcctgtaatggacaaacttgatgctaatgtgagttctgaggagggtttcgggtcagtggagaaggtggtgctgctcacgtttctctcgacggttatcctgatggccatcttggggaacctgctggtgatggtggctgtgtgctgggacaggcagctcaggaaaataaaaacaaattatttcattgtatctcttgcttttgcggatctgctggtttcggtgctggtgatgccctttggtgccattgagctggttcaagacatctggatttatggggaggtgttttgtcttgttcggacatctctggacgtcctgctcacaacggcatcgatttttcacctgtgctgcatttctctggataggtattacgccatctgctgccagcctttggtctataggaacaagatgacccctctgcgcatcgcattaatgctgggaggctgctgggtcatccccacgtttatttcttttctccctataatgcaaggctggaataacattggcataattgatttgatagaaaagaggaagttcaaccagaactctaactctacgtactgtgtcttcatggtcaacaagccctacgccatcacctgctctgtggtggccttctacatcccatttctcctcatggtgctggcctattaccgcatctatgtcacagctaaggagcatgcccatcagatccagatgttacaacgggcaggagcctcctccgagagcaggcctcagtcggcagaccagcatagcactcatcgcatgaggacagagaccaaagcagccaagaccctgtgcatcatcatgggttgcttctgcctctgctgggcaccattctttgtcaccaatattgtggatcctttcatagactacactgtccctgggcaggtgtggactgctttcctctggctcggctatatcaattccgggttgaacccttttctctacgccttcttgaataagtcttttagacgtgccttcctcatcatcctctgctgtgatgatgagcgctaccgaagaccttccattctgggccagactgtcccttgttcaaccacaaccattaatggatccacacatgtactaaggacagattttctgtttgacagagacattttagcaaggtattggacaaagcctgccagagcgggtccattctcaggcacattgagcattagatgtttgactgcaaggaagcctgtcttgggggatgcagtggagtgtggtggccagtgggagagtcagtgtcacccgccagcaacttctcctttggtggctgctcagcccagtgacacttaggcccctgggacaatgacccagaagacagccatgcctccgaaagagggccaggtcctaagctgctgcttgtgcgcgactgcacccggtattctcttcacctgaggctttccgtccgccagtgcaggaacccggtgctcgctgggcttttcctctgagattccagcaggtggcgctggagggagtcaggggacataatggcctccttgttcactttttatttcccaacactccctcttcccagattctctgcttttgccgcgtggtctctggtgtctctgacatgttcccgtcactcactgtgtctgatctgtctcactcacgttctaagcacgatagcttgctgcgtcctatctcggtcactgatgtctccaaatacgccttctttgctgtgtgggcttccagatatcaacaaaatactccctctctgttcctgtcttagccagaggcgtcgctcctgtcttgcttacttgcttggtcacgtccgtcacagccatgttcaagctatcccctgcctcttcttcgccctgttctgtgccagacgctaacacacttttctccctgtgtctgggtccaaacgtgcatcctcttggttggcccccttgtcagtcccagacgtccacttgctcttccttatgtccaatgtctgtcctcctcttcaggacatgctccatttattttccatggaagacacagggtcagagatctgtcagaggaaaatggtctccacagcaactctggagggaagctgaagacagatagcttcctcctggtgtcctggccgctggcgtgtctgccctgagatgctcgctctcctgctgggctagaacgggacgtcttctaaaaagccttgggcagggctagcaacatcgtaggtgtttattaggcttcaggatctttcccatgaacttgtgatatcattttgaaacccttcaatctggctttgttgctgccaaaggagataactgttggaagttcacactggggaaactcattttcccctgcagctcccccaaggtgcaggagggcaggatccagcagcactggggatgccgaggcaatgctgtacttgaagccagaggacccaaattgccgccctggctgtgctgcaaacaagctgtgagatcttgaatagtgttctttcatctctggaccccactttccacatctgtgcactcaagcttggactagaggacctttaagttttctttctgtttctaagacaacagtatgctgctatagccgtctgctacctcgagaagccatggcctgcctgccttttggctttgtttcaaaggaacgaccctcctcatttgggccttttagacccctgacctttccagctttgtccttcagattaatctggatgtcttttattcaaagctgagtcagtggctcttgcgaatgccccatagcagaagtcccgggaaggtaaatgccaaacccagagccatgtgagattctgactttgatcttggctgtggtttaatagcatctcaggattatttatcatattctctttttttcttattgcttataaggtgtcagttattgtttccattgttgtttactttagttctggaactgaaaccgacaggaagaaactttggaataaggaagagaagattgaccaaaccatccaaatgccaaaaagaaaaa

SEQ ID NO: 102873 - DNA, 2979 bp, Homo sapiens
  Payload ID: 74
  Gene Symbol: HTR4
  Gene Name: 5-hydroxytryptamine (serotonin) receptor 4, G protein-coupled
  Uniprot ID: Q13639
  ENST ID: ENST00000362016
  CDS Start-End: 48-1334
gaccctgtgggcattgaaatccaactcactcatgcttatttcctgtaatggacaaacttgatgctaatgtgagttctgaggagggtttcgggtcagtggagaaggtggtgctgctcacgtttctctcgacggttatcctgatggccatcttggggaacctgctggtgatggtggctgtgtgctgggacaggcagctcaggaaaataaaaacaaattatttcattgtatctcttgcttttgcggatctgctggtttcggtgctggtgatgccctttggtgccattgagctggttcaagacatctggatttatggggaggtgttttgtcttgttcggacatctctggacgtcctgctcacaacggcatcgatttttcacctgtgctgcatttctctggataggtattacgccatctgctgccagcctttggtctataggaacaagatgacccctctgcgcatcgcattaatgctgggaggctgctgggtcatccccacgtttatttcttttctccctataatgcaaggctggaataacattggcataattgatttgatagaaaagaggaagttcaaccagaactctaactctacgtactgtgtcttcatggtcaacaagccctacgccatcacctgctctgtggtggccttctacatcccatttctcctcatggtgctggcctattaccgcatctatgtcacagctaaggagcatgcccatcagatccagatgttacaacgggcaggagcctcctccgagagcaggcctcagtcggcagaccagcatagcactcatcgcatgaggacagagaccaaagcagccaagaccctgtgcatcatcatgggttgcttctgcctctgctgggcaccattctttgtcaccaatattgtggatcctttcatagactacactgtccctgggcaggtgtggactgctttcctctggctcggctatatcaattccgggttgaacccttttctctacgccttcttgaataagtcttttagacgtgccttcctcatcatcctctgctgtgatgatgagcgctaccgaagaccttccattctgggccagactgtcccttgttcaaccacaaccattaatggatccacacatgtactaaggacagattttctgtttgacagagacattttagcaaggtattggacaaagcctgccagagcgggtccattctcaggcacattgagcattagatgtttgactgcaaggaagcctgtcttgggggatgcagtggagtgtggtggccagtgggagagtcagtgtcacccgccagcaacttctcctttggtggctgctcagcccagtgacacttaggcccctgggacaatgacccagaagacagccatgcctccgaaagagggccaggtcctaagctgctgcttgtgcgcgactgcacccggtattctcttcacctgaggctttccgtccgccagtgcaggaacccggtgctcgctgggcttttcctctgagattccagcaggtggcgctggagggagtcaggggacataatggcctccttgttcactttttatttcccaacactccctcttcccagattctctgcttttgccgcgtggtctctggtgtctctgacatgttcccgtcactcactgtgtctgatctgtctcactcacgttctaagcacgatagcttgctgcgtcctatctcggtcactgatgtctccaaatacgccttctttgctgtgtgggcttccagatatcaacaaaatactccctctctgttcctgtcttagccagaggcgtcgctcctgtcttgcttacttgcttggtcacgtccgtcacagccatgttcaagctatcccctgcctcttcttcgccctgttctgtgccagacgctaacacacttttctccctgtgtctgggtccaaacgtgcatcctcttggttggcccccttgtcagtcccagacgtccacttgctcttccttatgtccaatgtctgtcctcctcttcaggacatgctccatttattttccatggaagacacagggtcagagatctgtcagaggaaaatggtctccacagcaactctggagggaagctgaagacagatagcttcctcctggtgtcctggccgctggcgtgtctgccctgagatgctcgctctcctgctgggctagaacgggacgtcttctaaaaagccttgggcagggctagcaacatcgtaggtgtttattaggcttcaggatctttcccatgaacttgtgatatcattttgaaacccttcaatctggctttgttgctgccaaaggagataactgttggaagttcacactggggaaactcattttcccctgcagctcccccaaggtgcaggagggcaggatccagcagcactggggatgccgaggcaatgctgtacttgaagccagaggacccaaattgccgccctggctgtgctgcaaacaagctgtgagatcttgaatagtgttctttcatctctggaccccactttccacatctgtgcactcaagcttggactagaggacctttaagttttctttctgtttctaagacaacagtatgctgctatagccgtctgctacctcgagaagccatggcctgcctgccttttggctttgtttcaaaggaacgaccctcctcatttgggccttttagacccctgacctttccagctttgtccttcagattaatctggatgtcttttattcaaagctgagtcagtggctcttgcgaatgccccatagcagaagtcccgggaaggtaaatgccaaacccagagccatgtgagattctgactttgatcttggctgtggtttaatagcatctcaggattatttatcatattctctttttttcttattgcttataaggtgtcagttattgtttccattgttgtttactttagttctggaactgaaaccgacaggaagaaactttggaataaggaagagaagattgaccaaaccatccaaatgcc

SEQ ID NO: 102874 - DNA, 2962 bp, Homo sapiens
  Payload ID: 74
  Gene Symbol: HTR4
  Gene Name: 5-hydroxytryptamine (serotonin) receptor 4, G protein-coupled
  Uniprot ID: Q13639
  ENST ID: ENST00000377888
  CDS Start-End: 140-1306
gcggcagcggcggcagcagaagctcggctcagcggctgggggtggccgctcgaatctgccagggcacctcgctccctcgcctctggcagcgggaccctgtgggcattgaaatccaactcactcatgcttatttcctgtaatggacaaacttgatgctaatgtgagttctgaggagggtttcgggtcagtggagaaggtggtgctgctcacgtttctctcgacggttatcctgatggccatcttggggaacctgctggtgatggtggctgtgtgctgggacaggcagctcaggaaaataaaaacaaattatttcattgtatctcttgcttttgcggatctgctggtttcggtgctggtgatgccctttggtgccattgagctggttcaagacatctggatttatggggaggtgttttgtcttgttcggacatctctggacgtcctgctcacaacggcatcgatttttcacctgtgctgcatttctctggataggtattacgccatctgctgccagcctttggtctataggaacaagatgacccctctgcgcatcgcattaatgctgggaggctgctgggtcatccccacgtttatttcttttctccctataatgcaaggctggaataacattggcataattgatttgatagaaaagaggaagttcaaccagaactctaactctacgtactgtgtcttcatggtcaacaagccctacgccatcacctgctctgtggtggccttctacatcccatttctcctcatggtgctggcctattaccgcatctatgtcacagctaaggagcatgcccatcagatccagatgttacaacgggcaggagcctcctccgagagcaggcctcagtcggcagaccagcatagcactcatcgcatgaggacagagaccaaagcagccaagaccctgtgcatcatcatgggttgcttctgcctctgctgggcaccattctttgtcaccaatattgtggatcctttcatagactacactgtccctgggcaggtgtggactgctttcctctggctcggctatatcaattccgggttgaacccttttctctacgccttcttgaataagtcttttagacgtgccttcctcatcatcctctgctgtgatgatgagcgctaccgaagaccttccattctgggccagactgtcccttgttcaaccacaaccattaatggatccacacatgtactaagggatgcagtggagtgtggtggccagtgggagagtcagtgtcacccgccagcaacttctcctttggtggctgctcagcccagtgacacttaggcccctgggacaatgacccagaagacagccatgcctccgaaagagggccaggtcctaagctgctgcttgtgcgcgactgcacccggtattctcttcacctgaggctttccgtccgccagtgcaggaacccggtgctcgctgggcttttcctctgagattccagcaggtggcgctggagggagtcaggggacataatggcctccttgttcactttttatttcccaacactccctcttcccagattctctgcttttgccgcgtggtctctggtgtctctgacatgttcccgtcactcactgtgtctgatctgtctcactcacgttctaagcacgatagcttgctgcgtcctatctcggtcactgatgtctccaaatacgccttctttgctgtgtgggcttccagatatcaacaaaatactccctctctgttcctgtcttagccagaggcgtcgctcctgtcttgcttacttgcttggtcacgtccgtcacagccatgttcaagctatcccctgcctcttcttcgccctgttctgtgccagacgctaacacacttttctccctgtgtctgggtccaaacgtgcatcctcttggttggcccccttgtcagtcccagacgtccacttgctcttccttatgtccaatgtctgtcctcctcttcaggacatgctccatttattttccatggaagacacagggtcagagatctgtcagaggaaaatggtctccacagcaactctggagggaagctgaagacagatagcttcctcctggtgtcctggccgctggcgtgtctgccctgagatgctcgctctcctgctgggctagaacgggacgtcttctaaaaagccttgggcagggctagcaacatcgtaggtgtttattaggcttcaggatctttcccatgaacttgtgatatcattttgaaacccttcaatctggctttgttgctgccaaaggagataactgttggaagttcacactggggaaactcattttcccctgcagctcccccaaggtgcaggagggcaggatccagcagcactggggatgccgaggcaatgctgtacttgaagccagaggacccaaattgccgccctggctgtgctgcaaacaagctgtgagatcttgaatagtgttctttcatctctggaccccactttccacatctgtgcactcaagcttggactagaggacctttaagttttctttctgtttctaagacaacagtatgctgctatagccgtctgctacctcgagaagccatggcctgcctgccttttggctttgtttcaaaggaacgaccctcctcatttgggccttttagacccctgacctttccagctttgtccttcagattaatctggatgtcttttattcaaagctgagtcagtggctcttgcgaatgccccatagcagaagtcccgggaaggtaaatgccaaacccagagccatgtgagattctgactttgatcttggctgtggtttaatagcatctcaggattatttatcatattctctttttttcttattgcttataaggtgtcagttattgtttccattgttgtttactttagttctggaactgaaaccgacaggaagaaactttggaataaggaagagaagattgaccaaaccatccaaatgccaaaaagaaaaa

SEQ ID NO: 102875 - DNA, 1236 bp, Homo sapiens
  Payload ID: 74
  Gene Symbol: HTR4
  Gene Name: 5-hydroxytryptamine (serotonin) receptor 4, G protein-coupled
  Uniprot ID: Q13639
  ENST ID: ENST00000520514
  CDS Start-End: 1-1236
atggacaaacttgatgctaatgtgagttctgaggagggtttcgggtcagtggagaaggtggtgctgctcacgtttctctcgacggttatcctgatggccatcttggggaacctgctggtgatggtggctgtgtgctgggacaggcagctcaggaaaataaaaacaaattatttcattgtatctcttgcttttgcggatctgctggtttcggtgctggtgatgccctttggtgccattgagctggttcaagacatctggatttatggggaggtgttttgtcttgttcggacatctctggacgtcctgctcacaacggcatcgatttttcacctgtgctgcatttctctggataggtattacgccatctgctgccagcctttggtctataggaacaagatgacccctctgcgcatcgcattaatgctgggaggctgctgggtcatccccacgtttatttcttttctccctataatgcaaggctggaataacattggcataattgatttgatagaaaagaggaagttcaaccagaactctaactctacgtactgtgtcttcatggtcaacaagccctacgccatcacctgctctgtggtggccttctacatcccatttctcctcatggtgctggcctattaccgcatctatgtcacagctaaggagcatgcccatcagatccagatgttacaacgggcaggagcctcctccgagagcaggcctcagtcggcagaccagcatagcactcatcgcatgaggacagagaccaaagcagccaagaccctgtgcatcatcatgggttgcttctgcctctgctgggcaccattctttgtcaccaatattgtggatcctttcatagactacactgtccctgggcaggtgtggactgctttcctctggctcggctatatcaattccgggttgaacccttttctctacgccttcttgaataagtcttttagacgtgccttcctcatcatcctctgctgtgatgatgagcgctaccgaagaccttccattctgggccagactgtcccttgttcaaccacaaccattaatggatccacacatgtactaagttctggaactgaaaccgacaggaagaaactttggaataaggaagagaagattgaccaaaccatccaaatgccaaaaagaaaaagaaaaaaaaaagcctctctgtcctatgaagacttaattctgttggggagaaagtcatgttttagggaaggaaaatag

SEQ ID NO: 102876 - DNA, 1323 bp, Homo sapiens
  Payload ID: 74
  Gene Symbol: HTR4
  Gene Name: 5-hydroxytryptamine (serotonin) receptor 4, G protein-coupled
  Uniprot ID: Q13639
  ENST ID: ENST00000521530
  CDS Start-End: 7-1170
cctgtaatggacaaacttgatgctaatgtgagttctgaggagggtttcgggtcagtggagaaggtggtgctgctcacgtttctctcgacggttatcctgatggccatcttggggaacctgctggtgatggtggctgtgtgctgggacaggcagctcaggaaaataaaaacaaattatttcattgtatctcttgcttttgcggatctgctggtttcggtgctggtgatgccctttggtgccattgagctggttcaagacatctggatttatggggaggtgttttgtcttgttcggacatctctggacgtcctgctcacaacggcatcgatttttcacctgtgctgcatttctctggataggtattacgccatctgctgccagcctttggtctataggaacaagatgacccctctgcgcatcgcattaatgctgggaggctgctgggtcatccccacgtttatttcttttctccctataatgcaaggctggaataacattggcataattgatttgatagaaaagaggaagttcaaccagaactctaactctacgtactgtgtcttcatggtcaacaagccctacgccatcacctgctctgtggtggccttctacatcccatttctcctcatggtgctggcctattaccgcatctatgtcacagctaaggagcatgcccatcagatccagatgttacaacgggcaggagcctcctccgagagcaggcctcagtcggcagaccagcatagcactcatcgcatgaggacagagaccaaagcagccaagaccctgtgcatcatcatgggttgcttctgcctctgctgggcaccattctttgtcaccaatattgtggatcctttcatagactacactgtccctgggcaggtgtggactgctttcctctggctcggctatatcaattccgggttgaacccttttctctacgccttcttgaataagtcttttagacgtgccttcctcatcatcctctgctgtgatgatgagcgctaccgaagaccttccattctgggccagactgtcccttgttcaaccacaaccattaatggatccacacatgtactaaggtacaccgttctgcacaggggacatcatcaggaactcgagaaactgcccatacacaatgacccagaatccctggaatcatgcttctgattgaggacatggctcacaacttagccattcattcgcattcatgtttgcatgaacaggtcaccctggcatcacttctgaacctcatcaccaccagtgaggcatcaggtagtaggggctgagagcccagaggaggtacatggaggacagtgttgg

SEQ ID NO: 102877 - DNA, 2272 bp, Homo sapiens
  Payload ID: 74
  Gene Symbol: HTR4
  Gene Name: 5-hydroxytryptamine (serotonin) receptor 4, G protein-coupled
  ENST ID: ENST00000520086
  CDS Start-End: 26-289
gtgcagaagggcactagccctgagtatgtgccacctcgtacgcctctcacatgcttctccgttttccctacttcactttcctgggttcattccaagacggagaatggaagaaaccagagctaaacttgtgtgcctgcagtccagctgtcgtgcctggagagacctctcttccatgatcatccagggtgaattagaccaggtcctcctgagaccagcagcgtggatgttgtatatccaaaaggaccctgtgggcattgaaatccaactcactcatgcttatttcctgtaatggacaaacttgatgctaatgtgagcttccatggacttggacacagttctgtttgggaattggagcatctgggttaagatcttgtgtctctttgactcctggtcttgtgctggattccatacagccagctctcctttatatgcaatcattcccttgattggtgacccctgtttacaagaaaatacccctgacttatttctttctgctattgtatttgtcagtgtccaggcaggaaaatggaaactgttgtatatattttaagcaaacggagatttagtgcaggtcacagagctccatggcagagcagggagaaggagatgttaaagaggtcaagaagcctcatgatcctccttgctgttatgggtctgctggaggcacaaccattgccacatttctggaaccatttgctgttgctcttactgcttaaagcacctccaaatagagaagaaatatactcctctttctcacctcatcgcccaaatttccatgttgaatctctcatttggaaaacataacctgaagccagtgggcaagaaagtctgaaaaatatagttttcaggcttctggctctcattgattgatataagtgcataaaaactgtggcaaataacagatacagcttccccactatataagcttggtttcttctggaacttactgctgtggaggctgcttcacccggcttcagaaacctgagggtgcagatgtgacggcattaatataagcatctgagtctcaatctgcttgactgcaggaagctcagtcttttgtgcagtttaccttgtccacctgttttagagaatttggttattactgaaaggggtgctcccaagtgtcctgactttgttttgcttgccaagctgaacctctgcagcctccagctctatcagttccactgaggcatactttgaattacagcctgctaaatgagcagtctgtaggcctcaaagcttccccctggactttagtaaagcagaagctccttgataatgaaaatccacatcatttcacctgtgaagtgagaagagtatgccttccatgtcatgcttgatcaaagtgggccccatactaaaattgcttgagatagaagtatttcagaagcaagcattgtagcatttcaaattctcagacctaatcttgttccctggaacacacagagggtagtgttatgatgaattttagtatcaacagttacatgttctcagaattattattgacctgcatcgttctgggtctgttgctcagtcaaccctggtgtatctggcttcttttcttatgacaccttgttattcctccctgcagtttgcttcttttattaccaatctttatttaaatgtcacattttaatgagattttttacatagtttattaggacttgtgcaaatcagcggatgcaaatagcttggcaagggtagagatattgcctaattaaaaaaaaaattgcaagatctttatgactctcagctcaagcccagtcagaattacctctgtacctaataggattacagcatggtctagatggaagggtcacttggattcctgtaagactgtgtctttttgtctcactttgcaagcacaggctgtgatgagattcaagaaacgtgattgaagctgtgaattatttacaatttcttagaagctcctttctataatttggagccttgcctatgacttgtagcttcttgcagtcctacaaagcacaatttttgtaaataaagaaataaatatctttatttacaaaagaaataaaaagagtttcagaggattaagtgatttttcctcagcctacacagctaataagtgattaacctgagactaaaatccaagtctttgcttccggaatcactgattttttcaaattatctcccaactctccaaagacaaactatctcctaaggtatatataatttagattaaaatgtcactcaaccatgacaatatctatgaaaatggatttcgacaataaaaggaaaatatcaaatc

SEQ ID NO: 102878 - DNA, 2274 bp, Homo sapiens
  Payload ID: 74
  Gene Symbol: HTR4
  Gene Name: 5-hydroxytryptamine (serotonin) receptor 4, G protein-coupled
  ENST ID: ENST00000524063
  CDS Start-End: 514-1629
agatgagcagcgctccggccagggagggcgcgtgctggccagcccggaacgggtgagatcgctccagcccgcctctgtgcccactcccctgtgcgccctgccggcagagcggcacccccgctgtccctggcgcccagtgggggcggcagcgggcagggcagcggggaccaccggggctgggggctgttgagcccgtggagtccggctcggttggggagaaggacgatgcgcggcgagcccaggtgatccggggctggggtcctgcgcccgcagcccctggcccgcgcctcacgctcgccggctccccagcgcgggggctggagcccgcacccgagggggcggcagggagggcgcaggcagcggctgggagcgcagcggcagcggcggcagcagaagctcggctcagcggctgggggtggccgctcgaatctgccagggcacctcgctccctcgcctctggcagcgggaccctgtgggcattgaaatccaactcactcatgcttatttcctgtaatggacaaacttgatgctaatgtgagttctgaggagggtttcgggtcagtggagaaggtggtgctgctcacgtttctctcgacggttatcctgatggccatcttggggaacctgctggtgatggtggctgtgtgctgggacaggcagctcaggaaaataaaaacaaattatttcattgtatctcttgcttttgcggatctgctggtttcggtgctggtgatgccctttggtgccattgagctggttcaagacatctggatttatggggaggtgttttgtcttgttcggacatctctggacgtcctgctcacaacggcatcgatttttcacctgtgctgcatttctctggataggtattacgccatctgctgccagcctttggtctataggaacaagatgacccctctgcgcatcgcattaatgctgggaggctgctgggtcatccccacgtttatttcttttctccctataatgcaaggctggaataacattggcataattgatttgatagaaaagaggaagttcaaccagaactctaactctacgtactgtgtcttcatggtcaacaagccctacgccatcacctgctctgtggtggccttctacatcccatttctcctcatggtgctggcctattaccgcatctatgtcacagctaaggagcatgcccatcagatccagatgttacaacgggcaggagcctcctccgagagcaggcctcagtcggcagaccagcatagcactcatcgcatgaggacagagaccaaagcagccaagaccctgtgcatcatcatgggttgcttctgcctctgctgggcaccattctttgtcaccaatattgtggatcctttcatagactacactgtccctgggcaggtgtggactgctttcctctggctcggctatatcaattccgggttgaacccttttctctacgccttcttgaataagtcttttagacgtgccttcctcatcatcctctgctgtgatgatgagcgctaccgaagaccttccattctgggccagactgtcccttgttcaaccacaaccattaatggatccacacatgtactaagggctgttagaggaaacaggaattcgacttcttctgcataatgtgagggagagaggtaagaaacaaaggattgaggttataagaacatgtatttcagcacaaaatggaatggattgccttactagggagttcctagtaaagttgaaggagacaattggatgaccatcagtcaattaaaagtgttgattgaccgaatatcagtaactggaagaactgaatgttcattagtcaacatttctggggaagagggatgcagtggagtgtggtggccagtgggagagtcagtgtcacccgccagcaacttctcctttggtggctgctcagcccagtgacacttaggcccctgggacaatgacccagaagacagccatgcctccgaaagagggccaggtcctaagctgctgcttgtgcgcgactgcacccggtattctcttcacctgaggctttccgtccgccagtgcaggaacccggtgctcgctgggcttttcctctgagattccagcaggtggcgctggagggagtcaggggacataatggcctccttgttcactttttatttcccaacactccctcttcccagattctctgcttttgccgcgtggtctctggtgtctctgacatgttcccgtcactcactgtgtctgatctgtctcactcacgttctaagcacgatagcttgctgcgtc

SEQ ID NO: 102879 - DNA, 1326 bp, Homo sapiens
  Payload ID: 74
  Gene Symbol: HTR4
  Gene Name: 5-hydroxytryptamine (serotonin) receptor 4, G protein-coupled
  Uniprot ID: Q13639
  ENST ID: ENST00000522588
  CDS Start-End: 1-1137
atggacaaacttgatgctaatgtgagttctgaggagggtttcgggtcagtggagaaggtggtgctgctcacgtttctctcgacggttatcctgatggccatcttggggaacctgctggtgatggtggctgtgtgctgggacaggcagctcaggaaaataaaaacaaattatttcattgtatctcttgcttttgcggatctgctggtttcggtgctggtgatgccctttggtgccattgagctggttcaagacatctggatttatggggaggtgttttgtcttgttcggacatctctggacgtcctgctcacaacggcatcgatttttcacctgtgctgcatttctctggataggtattacgccatctgctgccagcctttggtctataggaacaagatgacccctctgcgcatcgcattaatgctgggaggctgctgggtcatccccacgtttatttcttttctccctataatgcaaggctggaataacattggcataattgatttgatagaaaagaggaagttcaaccagaactctaactctacgtactgtgtcttcatggtcaacaagccctacgccatcacctgctctgtggtggccttctacatcccatttctcctcatggtgctggcctattaccgcatctatgtcacagctaaggagcatgcccatcagatccagatgttacaacgggcaggagcctcctccgagagcaggcctcagtcggcagaccagcatagcactcatcgcatgaggacagagaccaaagcagccaagaccctgtgcatcatcatgggttgcttctgcctctgctgggcaccattctttgtcaccaatattgtggatcctttcatagactacactgtccctgggcaggtgtggactgctttcctctggctcggctatatcaattccgggttgaacccttttctctacgccttcttgaataagtcttttagacgtgccttcctcatcatcctctgctgtgatgatgagcgctaccgaagaccttccattctgggccagactgtcccttgttcaaccacaaccattaatggatccacacatgtactaagtggctgttcccctgtctccagcttcctcctgctcttctgcaatagaccagttcctgtctaactctgaaagtgctctatttctactttaattccactgtggcctgagagcagacattgtgtaatttctattcttttacatttgttaaggtacaccgttctgcacaggggacatcatcaggaactcgagaaactgcccatacacaatgacccagaatccctggaatcatgcttctgattgaggacatggctc

SEQ ID NO: 102880 - DNA, 1242 bp, Homo sapiens
  Payload ID: 74
  Gene Symbol: HTR4
  Gene Name: 5-hydroxytryptamine (serotonin) receptor 4, G protein-coupled
  Uniprot ID: Q13639
  ENST ID: ENST00000521735
  CDS Start-End: 3-1139
taatggacaaacttgatgctaatgtgagttctgaggagggtttcgggtcagtggagaaggtggtgctgctcacgtttctctcgacggttatcctgatggccatcttggggaacctgctggtgatggtggctgtgtgctgggacaggcagctcaggaaaataaaaacaaattatttcattgtatctcttgcttttgcggatctgctggtttcggtgctggtgatgccctttggtgccattgagctggttcaagacatctggatttatggggaggtgttttgtcttgttcggacatctctggacgtcctgctcacaacggcatcgatttttcacctgtgctgcatttctctggataggtattacgccatctgctgccagcctttggtctataggaacaagatgacccctctgcgcatcgcattaatgctgggaggctgctgggtcatccccacgtttatttcttttctccctataatgcaaggctggaataacattggcataattgatttgatagaaaagaggaagttcaaccagaactctaactctacgtactgtgtcttcatggtcaacaagccctacgccatcacctgctctgtggtggccttctacatcccatttctcctcatggtgctggcctattaccgcatctatgtcacagctaaggagcatgcccatcagatccagatgttacaacgggcaggagcctcctccgagagcaggcctcagtcggcagaccagcatagcactcatcgcatgaggacagagaccaaagcagccaagaccctgtgcatcatcatgggttgcttctgcctctgctgggcaccattctttgtcaccaatattgtggatcctttcatagactacactgtccctgggcaggtgtggactgctttcctctggctcggctatatcaattccgggttgaacccttttctctacgccttcttgaataagtcttttagacgtgccttcctcatcatcctctgctgtgatgatgagcgctaccgaagaccttccattctgggccagactgtcccttgttcaaccacaaccattaatggatccacacatgtactaagtggctgttcccctgtctccagcttcctcctgctcttctgcaatagaccagttcctgtctaactctgaaagtgctctgtacaccgttctgcacaggggacatcatcaggaactcgagaaactgcccatacacaatgacccagaatccctggaatcatgcttctga

SEQ ID NO: 102881 - DNA, 1201 bp, Homo sapiens
  Payload ID: 74
  Gene Symbol: HTR4
  Gene Name: 5-hydroxytryptamine (serotonin) receptor 4, G protein-coupled
  Uniprot ID: Q13639
  ENST ID: ENST00000517929
  CDS Start-End: 16-1098
tgcttatttcctgtaatggacaaacttgatgctaatgtgagttctgaggagggtttcgggtcagtggagaaggtggtgctgctcacgtttctctcgacggttatcctgatggccatcttggggaacctgctggtgatggtggctgtgtgctgggacaggcagctcaggaaaataaaaacaaattatttcattgtatctcttgcttttgcggatctgctggtttcggtgctggtgatgccctttggtgccattgagctggttcaagacatctggatttatggggaggtgttttgtcttgttcggacatctctggacgtcctgctcacaacggcatcgatttttcacctgtgctgcatttctctggataggtattacgccatctgctgccagcctttggtctataggaacaagatgacccctctgcgcatcgcattaatgctgggaggctgctgggtcatccccacgtttatttcttttctccctataatgcaaggctggaataacattggcataattgatttgatagaaaagaggaagttcaaccagaactctaactctacgtactgtgtcttcatggtcaacaagccctacgccatcacctgctctgtggtggccttctacatcccatttctcctcatggtgctggcctattaccgcatctatgtcacagctaaggagcatgcccatcagatccagatgttacaacgggcaggagcctcctccgagagcaggcctcagtcggcagaccagcatagcactcatcgcatgaggacagagaccaaagcagccaagaccctgtgcatcatcatgggttgcttctgcctctgctgggcaccattctttgtcaccaatattgtggatcctttcatagactacactgtccctgggcaggtgtggactgctttcctctggctcggctatatcaattccgggttgaacccttttctctacgccttcttgaataagtcttttagacgtgccttcctcatcatcctctgctgtgatgatgagcgctaccgaagaccttccattctgggccagactgtcccttgttcaaccacaaccattaatggatccacacatgtactaagattttgagctccttgaggactgtggccaattcttattgctcatttttttttcttagtgcccaacacaggtttttgtacactgaagttatcaaataaattcattggatgta

SEQ ID NO: 102882 - DNA, 1224 bp, Homo sapiens
  Payload ID: 74
  Gene Symbol: HTR4
  Gene Name: 5-hydroxytryptamine (serotonin) receptor 4, G protein-coupled
  Uniprot ID: Q13639
  ENST ID: ENST00000631296
  CDS Start-End: 20-1186
ctcatgcttatttcctgtaatggacaaacttgatgctaatgtgagttctgaggagggtttcgggtcagtggagaaggtggtgctgctcacgtttctctcgacggttatcctgatggccatcttggggaacctgctggtgatggtggctgtgtgctgggacaggcagctcaggaaaataaaaacaaattatttcattgtatctcttgcttttgcggatctgctggtttcggtgctggtgatgccctttggtgccattgagctggttcaagacatctggatttatggggaggtgttttgtcttgttcggacatctctggacgtcctgctcacaacggcatcgatttttcacctgtgctgcatttctctggataggtattacgccatctgctgccagcctttggtctataggaacaagatgacccctctgcgcatcgcattaatgctgggaggctgctgggtcatccccacgtttatttcttttctccctataatgcaaggctggaataacattggcataattgatttgatagaaaagaggaagttcaaccagaactctaactctacgtactgtgtcttcatggtcaacaagccctacgccatcacctgctctgtggtggccttctacatcccatttctcctcatggtgctggcctattaccgcatctatgtcacagctaaggagcatgcccatcagatccagatgttacaacgggcaggagcctcctccgagagcaggcctcagtcggcagaccagcatagcactcatcgcatgaggacagagaccaaagcagccaagaccctgtgcatcatcatgggttgcttctgcctctgctgggcaccattctttgtcaccaatattgtggatcctttcatagactacactgtccctgggcaggtgtggactgctttcctctggctcggctatatcaattccgggttgaacccttttctctacgccttcttgaataagtcttttagacgtgccttcctcatcatcctctgctgtgatgatgagcgctaccgaagaccttccattctgggccagactgtcccttgttcaaccacaaccattaatggatccacacatgtactaagggatgcagtggagtgtggtggccagtgggagagtcagtgtcacccgccagcaacttctcctttggtggctgctcagcccagtgacacttaggcccctgggacaatgacccagaagacagccatgcctcc

SEQ ID NO: 102883 - DNA, 2912 bp, Homo sapiens
  Payload ID: 75
  Gene Symbol: HTR5A
  Gene Name: 5-hydroxytryptamine (serotonin) receptor 5A, G protein-coupled
  Uniprot ID: P47898
  ENST ID: ENST00000287907
  CDS Start-End: 577-1650
agcattcgctctccggagctgcagcctccgaaggggtggcgggggcaacagggacagaaggcaggtcccagaaagcaggttcccccaaaactggcttccctagcacggagttaaggctgcagccggctgcctagagagaagggtgggcagggagacaacgcggtgagagcgactgctctgacgcaccagcccctctcctgcacccacacgctgctggccgcccagcttctccccgatctgggagatgctcggctctgggcggccaaacagcctttccaccaaggcgaggagccctgggctcctgacagcttaggcgggccctggctgcgacacgcagcccctcgcctctgcttccttagcctctgagggcttcagacctgccgcgcttgcagccacaccatctccaacggatgctcactagcaggaaattggggccaaattcacaggcactttccagaaactcccccactggccagaggttgcaaacatccggattggctctgggcacagtggccgccttaagtcctcctgaacaccccttctgcaagtaccccagggcggtctcctgacccagagatggatttacctgtgaacctaacctccttttccctctccaccccctcccctttggagaccaaccacagcctcggcaaagacgacctgcgccccagctcgcccctgctctcggtcttcggagtgcttattctcaccttgctgggctttctggtggcggcgacgttcgcctggaacctgctggtgctggcgaccatcctccgtgtacgcaccttccaccgcgtgccccacaacctggtggcatccatggccgtctcggatgtcctggtggccgcgctggtcatgccgctgagcctggtgcacgagctgtccgggcgccgctggcagctaggtcggaggctgtgccagctttggatcgcgtgcgacgtgctttgctgcacggccagcatctggaacgtgacggccatagccctggaccgctactggtccatcacgcgccacatggaatacacgctccgcacccgcaagtgcgtctccaacgtcatgatcgcgctcacctgggcactctccgctgtcatctctctggccccgctgctttttggctggggagagacgtactctgagggcagcgaggagtgccaggtaagccgcgagccttcctacgccgtgttctccaccgtaggcgccttctacctgccgctctgtgtggtgctcttcgtgtactggaagatctacaaggctgccaagttccgcgtgggctccaggaagaccaatagcgtctcacccatatccgaagctgtggaggtgaaggactctgccaaacagccccagatggtgttcacggtccgccacgccaccgtcaccttccagccagaaggggacacgtggcgggagcagaaggagcagcgggccgccctcatggtgggcatcctcattggcgtgttcgtgctctgctggatccccttctttctcaccgagctcatcagtcccctctgctcctgtgacatccccgccatctggaaaagcatcttcctgtggcttggctactccaactccttctttaaccccctgatctatacggctttcaacaagaactacaacagcgccttcaagaacttcttttctaggcaacactgagggagaggaccaggattgaaaaaagtttcttcccataattcagtggaattcccagttcatccatttcccatccccacccaacagccatgtggacgggatgaatcctcaccattctccagggtcatcttcagaactgcactggcctcttttccacctcctcagtaggaatatgactcctcatagagttacggtgacatgatgtatctaacttatctactatccctttctctgtgctgacagtcatggtctttgcccgcaaagtgtcctttcctccccaaattcactctggcatggtgatcgacattgtcttaaagaagtcaaggcaaataagaaggaggaggtaaaacaatatgggcaggttgagattgaatagaaaagaatgaacaagtcatgatgtagacctctgagggtaggagaccatagttccaggctttctggcacagtccccatttcaaatattctctgtggtcctagtacatatatcctaatactgatggggtatgacccaagagttgaccacaaaacactgtctccaaatatattaaagtatatagtcctatccatgagagcagggaatcttagctttaaggttttgtttgtggcaaccacacacgaacatacacacacacacacacacaactatgaaagaggcaggtgttctagctagctagtttactccaaaatgcaatccgttgacatgaaacaggcactgagggtaactacttcctttcattttgaagcaacagtttataaacaggaaagtctactggtttcatagaatctgtcagatttgtttatttgctactggtttcacgcgcgtggactatattccagtgtttctagtcaaagacctttatcctcaaatcatgagattagagtaaaacaactgctgtaaggttgagcatttcatgaccaatgactatgaaggcacattcaccaaacacaggcactttaagggcatccttgattaatttgctaattgctattttttgttggtatgtgaattcctgctaggaggccgaggctagtaggcaatgaaaaagacagaacaatggtaaaatgcagccccagtcctctacaaattgacagtataatttatgaggtgaggcagttaagtgatgatgcagcatttggatgatcatgtaaaaccagtgtcattacacaaaacttaaaaaaaaatcctaggcaataaaactgcctgtggtctgctatgtctctgactcttcaaatgcatgaattaaagaatgatataataatctctg

SEQ ID NO: 102884 - DNA, 1984 bp, Homo sapiens
  Payload ID: 76
  Gene Symbol: HTR6
  Gene Name: 5-hydroxytryptamine (serotonin) receptor 6, G protein-coupled
  Uniprot ID: P50406
  ENST ID: ENST00000289753
  CDS Start-End: 468-1790
cccgagagcgcccattcacccccctcacccacctccccgcgttcccacttccccgcactctgacccggccggacgcccctcccctatcttgccgcccgccccctccagggggctctgctcccaccccagggagcccatccgacctctgcttgacttcccgccgcttccttcaggggcctcggctcatcgggtgcccctccccaaacttccaacccgtttgctccaggagttcctgccccatccccgagggcgcccaaatagccacactgtgtcctcctgtagtcgctgccccctgacctagcgcgacccagcgcccccgcccatgtccccccactcacctcccccggggggcgtggtgagtcgcggtctgttctcacggacggtccccgtccagcctgcgcttcgccggggccctcatctgctttcccgccaccctatcactcccttgccgtccaccctcggtcctcatggtcccagagccgggcccaaccgccaatagcaccccggcctggggggcagggccgccgtcggccccggggggcagcggctgggtggcggccgcgctgtgcgtggtcatcgcgctgacggcggcggccaactcgctgctgatcgcgctcatctgcactcagcccgcgctgcgcaacacgtccaacttcttcctggtgtcgctcttcacgtctgacctgatggtggggctggtggtgatgccgccggccatgctgaacgcgctgtacgggcgctgggtgctggcgcgcggcctctgcctgctctggaccgccttcgacgtgatgtgctgcagcgcctccatcctcaacctctgcctcatcagcctggaccgctacctgctcatcctctcgccgctgcgctacaagctgcgcatgacgcccctgcgtgccctggccctagtcctgggcgcctggagcctcgccgctctcgcctccttcctgcccctgctgctgggctggcacgagctgggccacgcacggccacccgtccctggccagtgccgcctgctggccagcctgccttttgtccttgtggcgtcgggcctcaccttcttcctgccctcgggtgccatatgcttcacctactgcaggatcctgctagctgcccgcaagcaggccgtgcaggtggcctccctcaccaccggcatggccagtcaggcctcggagacgctgcaggtgcccaggaccccacgcccaggggtggagtctgctgacagcaggcgtctagccacgaagcacagcaggaaggccctgaaggccagcctgacgctgggcatcctgctgggcatgttctttgtgacctggttgcccttctttgtggccaacatagtccaggccgtgtgcgactgcatctccccaggcctcttcgatgtcctcacatggctgggttactgtaacagcaccatgaaccccatcatctacccactcttcatgcgggacttcaagcgggcgctgggcaggttcctgccatgtccacgctgtccccgggagcgccaggccagcctggcctcgccatcactgcgcacctctcacagcggcccccggcccggccttagcctacagcaggtgctgccgctgcccctgccgccggactcagattcggactcagacgcaggctcaggcggctcctcgggcctgcggctcacggcccagctgctgcttcctggcgaggccacccaggaccccccgctgcccaccagggccgctgccgccgtcaatttcttcaacatcgaccccgcggagcccgagctgcggccgcatccacttggcatccccacgaactgacccgggcttggggctggccaatggggagctggattgagcagaacccagaccctgagtccttgggccagctcttggctaagaccaggaggctgcaagtctcctagaagccctctgagctccagaggggtgcgcagagctgaccccctgctgccatctccaggccccttacctgcagggatcatagctgactcaga

SEQ ID NO: 102885 - DNA, 3028 bp, Homo sapiens
  Payload ID: 77
  Gene Symbol: HTR7
  Gene Name: 5-hydroxytryptamine (serotonin) receptor 7, adenylate cyclase-coupled
  Uniprot ID: P34969
  ENST ID: ENST00000277874
  CDS Start-End: 28-1365
ccatgggcagcggcacacggcggcgcgatgatggacgttaacagcagcggccgcccggacctctacgggcacctccgctctttccttctgccagaagtggggcgcgggctgcccgacttgagccccgacggtggcgccgacccggtcgcgggctcctgggcgccgcacctgctgagcgaggtgacagccagcccggcgcccacctgggacgcgcccccggacaatgcctccggctgtggggaacagatcaactacggcagagtcgagaaagttgtgatcggctccatcctgacgctcatcacgctgctgacgatcgcgggcaactgcctggtggtgatctccgtgtgcttcgtcaagaagctccgccagccctccaactacctgatcgtgtccctggcgctggccgacctctcggtggctgtggcggtcatgcccttcgtcagcgtcaccgacctcatcgggggcaagtggatctttggacactttttctgtaatgtcttcatcgccatggacgtcatgtgctgcacggcctcgatcatgaccctgtgcgtgatcagcattgacaggtaccttgggatcacaaggcccctcacataccctgtgaggcagaatgggaaatgcatggcgaagatgattctctccgtctggcttctctccgcctccatcaccttacctccactctttggatgggctcagaatgtaaatgatgataaggtgtgcttgatcagccaggactttggctatacgatttactctaccgcagtggcattttatatccccatgtccgtcatgcttttcatgtactaccagatttacaaggctgccaggaagagtgctgccaaacacaagtttcctggcttccctcgagtggagccagacagcgtcatcgccctgaatggcatagtgaagctccagaaggaggtggaagagtgtgcaaacctttcgagactcctcaagcatgaaaggaaaaacatctccatctttaagcgagaacagaaagcagccaccaccctggggatcatcgtcggggcctttaccgtgtgctggctgccatttttcctcctctcgacagccagacccttcatctgtggcacttcctgcagctgcatcccactgtgggtggagaggacatttctgtggctaggctatgcaaactctctcattaacccttttatatatgccttcttcaaccgggacctgaggaccacctatcgcagcctgctccagtgccagtaccggaatatcaaccggaagctctcagctgcaggcatgcatgaagccctgaagcttgctgagaggccagagagacctgagtttgtgctacaaaatgctgactactgtagaaaaaaaggtcatgattcatgattgaaagcagaacaatggagatgaaataaacaaggcaaaatagaggtggaaacagaaggaagtcatttgctgagtctgcagaatggaatgcagcttctgtcctttcttgggatgtctaaaacatgacaaacagggtgatctgttgtacacactatcttatgagggagatggtgacttctccttttttctgtggatcagtgctattgtgtgttctcagtttaagatagcagatcatctcagcagtaagcacaccaacagaactgagttccagaaaggaagcagtttctggtgctttgcatatgtccaaatccatgcaagtgggagaaagttccagtgcacacttcccatgcttctgagtctaggcgttgtggtgaatatgcaggaatcattcatgagacagaatgtattttgttgtatgacagaaggcttttccaagcaaactgcggtgagcgtagtgttgaatatgttgcatgtccatgttagaaaacagaatccagtcatcagctaatacaaatgatttcccagagcagtgtttgtttcaagcttctgtcaaatagtttggcttttctgcagggtctctgtgatttccccacctatgtacttttctgtgttaactcacttattatggtataactcaggaacaggtctcaggatggagagaagcatacaacatgagcaaagctttttctcgtgctctgaagggtcttgagaggggagtgggatgccttctgtgaggatttttatcgcagtgaagctcaagtggtacccaactgcgttgtaattaacatgattattggcatgtttttgactctcattttctacaaggctgcagtgggcccacccatgggctggcccataactgtatgttatgtggaagaagtgtgggaatgatgggttttccatgaaatgtgatgcttctggagatggggcataaacatgttcattcttgttgagctgcattgtgttaaaccaaattgtgtgaagcgaggtcacctggaccactcttgggaaatgcttcagaacaccagtctgttccttctagagaatttgtttttgtgttctatgtatcttaaatcaaatgtgtgcctaagcaattctgtcctctgattcccacccctacccaccaaaaaatggtagacatgaaaggcaggtgaggaaacagaaaaggtctctttgcagatatatattttttaaatggcactatgtagtaattaagagctaaggagacagaaagacagtagatgagaatagaagagtacctgtacctacaaggggaaaaatgaatgcaattctttatttgataagagtgaactgaaagagaatattattttcctacaataaagcaagctgtcctctcacaggataaagtggaattctgacatggattatggacttcttctaactcccattgacattgcttcttaccagacatggggaaaagctacctttcctgaaaggggaggagggcactgtcctttcagacaaagcttgtacaaattcctgaaccgcaaatttgctgaagtgaccgtatatattatattcataatttaaatgattatttatggtcagatacatattgttaaacttgaaaatgttttattacattacatcaaataaagtttatttgtagctgaaataaagcaacgtaagtaacaatttttaa

SEQ ID NO: 102886 - DNA, 3126 bp, Homo sapiens
  Payload ID: 77
  Gene Symbol: HTR7
  Gene Name: 5-hydroxytryptamine (serotonin) receptor 7, adenylate cyclase-coupled
  Uniprot ID: P34969
  ENST ID: ENST00000336152
  CDS Start-End: 28-1467
ccatgggcagcggcacacggcggcgcgatgatggacgttaacagcagcggccgcccggacctctacgggcacctccgctctttccttctgccagaagtggggcgcgggctgcccgacttgagccccgacggtggcgccgacccggtcgcgggctcctgggcgccgcacctgctgagcgaggtgacagccagcccggcgcccacctgggacgcgcccccggacaatgcctccggctgtggggaacagatcaactacggcagagtcgagaaagttgtgatcggctccatcctgacgctcatcacgctgctgacgatcgcgggcaactgcctggtggtgatctccgtgtgcttcgtcaagaagctccgccagccctccaactacctgatcgtgtccctggcgctggccgacctctcggtggctgtggcggtcatgcccttcgtcagcgtcaccgacctcatcgggggcaagtggatctttggacactttttctgtaatgtcttcatcgccatggacgtcatgtgctgcacggcctcgatcatgaccctgtgcgtgatcagcattgacaggtaccttgggatcacaaggcccctcacataccctgtgaggcagaatgggaaatgcatggcgaagatgattctctccgtctggcttctctccgcctccatcaccttacctccactctttggatgggctcagaatgtaaatgatgataaggtgtgcttgatcagccaggactttggctatacgatttactctaccgcagtggcattttatatccccatgtccgtcatgcttttcatgtactaccagatttacaaggctgccaggaagagtgctgccaaacacaagtttcctggcttccctcgagtggagccagacagcgtcatcgccctgaatggcatagtgaagctccagaaggaggtggaagagtgtgcaaacctttcgagactcctcaagcatgaaaggaaaaacatctccatctttaagcgagaacagaaagcagccaccaccctggggatcatcgtcggggcctttaccgtgtgctggctgccatttttcctcctctcgacagccagacccttcatctgtggcacttcctgcagctgcatcccactgtgggtggagaggacatttctgtggctaggctatgcaaactctctcattaacccttttatatatgccttcttcaaccgggacctgaggaccacctatcgcagcctgctccagtgccagtaccggaatatcaaccggaagctctcagctgcaggcatgcatgaagccctgaagcttgctgagaggccagagagacctgagtttgtgctgagggcctgcacaaggagggtgctgttgagaccagaaaagaggccaccggtatctgtgtgggtgctacaatctccagaccatcacaattggttagcagacaaaatgctgactactgtagaaaaaaaggtcatgattcatgattgaaagcagaacaatggagatgaaataaacaaggcaaaatagaggtggaaacagaaggaagtcatttgctgagtctgcagaatggaatgcagcttctgtcctttcttgggatgtctaaaacatgacaaacagggtgatctgttgtacacactatcttatgagggagatggtgacttctccttttttctgtggatcagtgctattgtgtgttctcagtttaagatagcagatcatctcagcagtaagcacaccaacagaactgagttccagaaaggaagcagtttctggtgctttgcatatgtccaaatccatgcaagtgggagaaagttccagtgcacacttcccatgcttctgagtctaggcgttgtggtgaatatgcaggaatcattcatgagacagaatgtattttgttgtatgacagaaggcttttccaagcaaactgcggtgagcgtagtgttgaatatgttgcatgtccatgttagaaaacagaatccagtcatcagctaatacaaatgatttcccagagcagtgtttgtttcaagcttctgtcaaatagtttggcttttctgcagggtctctgtgatttccccacctatgtacttttctgtgttaactcacttattatggtataactcaggaacaggtctcaggatggagagaagcatacaacatgagcaaagctttttctcgtgctctgaagggtcttgagaggggagtgggatgccttctgtgaggatttttatcgcagtgaagctcaagtggtacccaactgcgttgtaattaacatgattattggcatgtttttgactctcattttctacaaggctgcagtgggcccacccatgggctggcccataactgtatgttatgtggaagaagtgtgggaatgatgggttttccatgaaatgtgatgcttctggagatggggcataaacatgttcattcttgttgagctgcattgtgttaaaccaaattgtgtgaagcgaggtcacctggaccactcttgggaaatgcttcagaacaccagtctgttccttctagagaatttgtttttgtgttctatgtatcttaaatcaaatgtgtgcctaagcaattctgtcctctgattcccacccctacccaccaaaaaatggtagacatgaaaggcaggtgaggaaacagaaaaggtctctttgcagatatatattttttaaatggcactatgtagtaattaagagctaaggagacagaaagacagtagatgagaatagaagagtacctgtacctacaaggggaaaaatgaatgcaattctttatttgataagagtgaactgaaagagaatattattttcctacaataaagcaagctgtcctctcacaggataaagtggaattctgacatggattatggacttcttctaactcccattgacattgcttcttaccagacatggggaaaagctacctttcctgaaaggggaggagggcactgtcctttcagacaaagcttgtacaaattcctgaaccgcaaatttgctgaagtgaccgtatatattatattcataatttaaatgattatttatggtcagatacatattgttaaacttgaaaatgttttattacattacatcaaataaagtttatttgtagctgaaataaagcaacgtaagtaacaatttttaa

SEQ ID NO: 102887 - DNA, 3033 bp, Homo sapiens
  Payload ID: 77
  Gene Symbol: HTR7
  Gene Name: 5-hydroxytryptamine (serotonin) receptor 7, adenylate cyclase-coupled
  Uniprot ID: P34969
  ENST ID: ENST00000371719
  CDS Start-End: 28-1326
ccatgggcagcggcacacggcggcgcgatgatggacgttaacagcagcggccgcccggacctctacgggcacctccgctctttccttctgccagaagtggggcgcgggctgcccgacttgagccccgacggtggcgccgacccggtcgcgggctcctgggcgccgcacctgctgagcgaggtgacagccagcccggcgcccacctgggacgcgcccccggacaatgcctccggctgtggggaacagatcaactacggcagagtcgagaaagttgtgatcggctccatcctgacgctcatcacgctgctgacgatcgcgggcaactgcctggtggtgatctccgtgtgcttcgtcaagaagctccgccagccctccaactacctgatcgtgtccctggcgctggccgacctctcggtggctgtggcggtcatgcccttcgtcagcgtcaccgacctcatcgggggcaagtggatctttggacactttttctgtaatgtcttcatcgccatggacgtcatgtgctgcacggcctcgatcatgaccctgtgcgtgatcagcattgacaggtaccttgggatcacaaggcccctcacataccctgtgaggcagaatgggaaatgcatggcgaagatgattctctccgtctggcttctctccgcctccatcaccttacctccactctttggatgggctcagaatgtaaatgatgataaggtgtgcttgatcagccaggactttggctatacgatttactctaccgcagtggcattttatatccccatgtccgtcatgcttttcatgtactaccagatttacaaggctgccaggaagagtgctgccaaacacaagtttcctggcttccctcgagtggagccagacagcgtcatcgccctgaatggcatagtgaagctccagaaggaggtggaagagtgtgcaaacctttcgagactcctcaagcatgaaaggaaaaacatctccatctttaagcgagaacagaaagcagccaccaccctggggatcatcgtcggggcctttaccgtgtgctggctgccatttttcctcctctcgacagccagacccttcatctgtggcacttcctgcagctgcatcccactgtgggtggagaggacatttctgtggctaggctatgcaaactctctcattaacccttttatatatgccttcttcaaccgggacctgaggaccacctatcgcagcctgctccagtgccagtaccggaatatcaaccggaagctctcagctgcaggcatgcatgaagccctgaagcttgctgagaggccagagagacctgagtttgtgctgtaagacaaaatgctgactactgtagaaaaaaaggtcatgattcatgattgaaagcagaacaatggagatgaaataaacaaggcaaaatagaggtggaaacagaaggaagtcatttgctgagtctgcagaatggaatgcagcttctgtcctttcttgggatgtctaaaacatgacaaacagggtgatctgttgtacacactatcttatgagggagatggtgacttctccttttttctgtggatcagtgctattgtgtgttctcagtttaagatagcagatcatctcagcagtaagcacaccaacagaactgagttccagaaaggaagcagtttctggtgctttgcatatgtccaaatccatgcaagtgggagaaagttccagtgcacacttcccatgcttctgagtctaggcgttgtggtgaatatgcaggaatcattcatgagacagaatgtattttgttgtatgacagaaggcttttccaagcaaactgcggtgagcgtagtgttgaatatgttgcatgtccatgttagaaaacagaatccagtcatcagctaatacaaatgatttcccagagcagtgtttgtttcaagcttctgtcaaatagtttggcttttctgcagggtctctgtgatttccccacctatgtacttttctgtgttaactcacttattatggtataactcaggaacaggtctcaggatggagagaagcatacaacatgagcaaagctttttctcgtgctctgaagggtcttgagaggggagtgggatgccttctgtgaggatttttatcgcagtgaagctcaagtggtacccaactgcgttgtaattaacatgattattggcatgtttttgactctcattttctacaaggctgcagtgggcccacccatgggctggcccataactgtatgttatgtggaagaagtgtgggaatgatgggttttccatgaaatgtgatgcttctggagatggggcataaacatgttcattcttgttgagctgcattgtgttaaaccaaattgtgtgaagcgaggtcacctggaccactcttgggaaatgcttcagaacaccagtctgttccttctagagaatttgtttttgtgttctatgtatcttaaatcaaatgtgtgcctaagcaattctgtcctctgattcccacccctacccaccaaaaaatggtagacatgaaaggcaggtgaggaaacagaaaaggtctctttgcagatatatattttttaaatggcactatgtagtaattaagagctaaggagacagaaagacagtagatgagaatagaagagtacctgtacctacaaggggaaaaatgaatgcaattctttatttgataagagtgaactgaaagagaatattattttcctacaataaagcaagctgtcctctcacaggataaagtggaattctgacatggattatggacttcttctaactcccattgacattgcttcttaccagacatggggaaaagctacctttcctgaaaggggaggagggcactgtcctttcagacaaagcttgtacaaattcctgaaccgcaaatttgctgaagtgaccgtatatattatattcataatttaaatgattatttatggtcagatacatattgttaaacttgaaaatgttttattacattacatcaaataaagtttatttgtagctgaaataaagcaacgtaagtaacaatttttaa

SEQ ID NO: 102888 - DNA, 5234 bp, Homo sapiens
  Payload ID: 78
  Gene Symbol: MTR
  Gene Name: 5-methyltetrahydrofolate-homocysteine methyltransferase
  ENST ID: ENST00000366576
  CDS Start-End: 1-2460
ggcatgctagatggtccaagtgcaatgaccagattttgcaacttaattgcttccgagccagacatcgcaaaggtacctttgtgcatcgactcctccaattttgctgtgattgaagctgggttaaagtgctgccaagggaagtgcattgtcaatagcattagtctgaaggaaggagaggcaacagaaacagacacaaaaatcagagtgtgcacccgggcctaccatctgcttgtgaaaaaactgggctttaatccaaatgacattatttttgaccctaatatcctaaccattgggactggaatggaggaacacaacttgtatgccattaattttatccatgcaacaaaagtcattaaagaaacattacctggagccagaataagtggaggtctttccaacttgtccttctccttccgaggaatggaagccattcgagaagcaatgcatggggttttcctttaccatgcaatcaagtctggcatggacatggggatagtgaatgctggaaacctccctgtgtatgatgatatccataaggaacttctgcagctctgtgaagatctcatctggaataaagaccctgaggccactgagaagctcttacgttatgcccagactcaaggcacaggagggaagaaagtcattcagactgatgagtggagaaatggccctgtcgaagaacgccttgagtatgcccttgtgaagggcattgaaaaacatattattgaggatactgaggaagccaggttaaaccaaaaaaaatatccccgacctctcaatataattgaaggacccctgatgaatggaatgaaaattgttggtgatctttttggagctggaaaaatgtttctacctcaggttataaagtcagcccgggttatgaagaaggctgttggccaccttatccctttcatggaaaaagaaagagaagaaaccagagtgcttaacggcacagtagaagaagaggacccttaccagggcaccatcgtgctggccactgttaaaggcgacgtgcacgacataggcaagaacatagttggagtagtccttggctgcaataatttccgagttattgatttaggagtcatgactccatgtgataagatactgaaagctgctcttgaccacaaagcagatataattggcctgtcaggactcatcactccttccctggatgaaatgatttttgttgccaaggaaatggagagattagctataaggattccattgttgattggaggagcaaccacttcaaaaacccacacagcagttaaaatagctccgagatacagtgcacctgtaatccatgtcctggacgcgtccaagagtgtggtggtgtgttcccagctgttagatgaaaatctaaaggatgaatactttgaggaaatcatggaagaatatgaagatattagacaggaccattatgagtctctcaaggagaggagatacttacccttaagtcaagccagaaaaagtggtttccaaatggattggctgtctgaacctcacccagtgaagcccacgtttattgggacccaggtctttgaagactatgacctgcagaagctggtggactacattgactggaagcctttctttgatgtctggcagctccggggcaagtacccgaatcgaggctttcccaagatatttaacgacaaaacagtaggtggagaggccaggaaggtctacgatgatgcccacaatatgctgaacacactgattagtcaaaagaaactccgggcccggggtgtggttgggttctggccagcacagagtatccaagacgacattcacctgtacgcagaggctgctgtgccccaggctgcagagcccatagccaccttctatgggttaaggcaacaggctgagaaggactctgccagcacggagccatactactgcctctcagacttcatcgctcccttgcattctggcatccgtgactacctgggcctgtttgccgttgcctgctttggggtagaagagctgagcaaggcctatgaggatgatggtgacgactacagcagcatcatggtcaaggcgctgggggaccggctggcagaggcctttgcagaagagctccatgaaagagttcgccgagaactgtgggcctactgtggcagtgagcagctggacgtcgcagacctgcgcaggctgcggtacaagggcatccgcccggctcctggctaccccagccagcccgaccacaccgagaagctcaccatgtggagactcgcagacatcgagcagtctacaggcattaggttaacagaatcattagcaatggcacctgcttcagcagtctcaggcctctacttctccaatttgaagtccaaatattttgctgtggggaagatttccaaggatcaggttgaggattatgcattgaggaagaacatatctgtggctgaggttgagaaatggcttggacccattttgggatatgatacagactaactttttttttttttttgccttttttattcttgatgatcctcaaggaaatacaacctagggtgccttaaaaataacaacaacaaaaaacctgtgtgcatctggctgacacttacctgcttctggttttcgaagactatttagtggaaccttgtagaggagcagggtcttcctgcagtgcctggaaaacaggcgctgtttttttgggaccttgcgtgaagagcagtgagcagggttcctgtggtttccctggtccctctgagatggggacagactgaagacagaggtcgtttgatttcaaagcaagtcaacctgcttttttctgtttttacagtggaatctaggaggccacttagtcgtctttttttcctcttagaagaaaagcctgaaactgagttgaatagagaagtgtgaccctgtgacaaaatgatactgtgagaaatggggcattttaatctaagtggttataacagtggattctgacggggaaggtgtagctctgttctcttcggaagacctcgttttctaaaggctggactaaatggctgcagaactccctttggcaaaaggcatgcgctcactgcttgcttgtcagaaacactgaagccatttgccccagtgtggtcaagcagccatgctttctgggcattttcgtcctcccataatttcatatttccgtacccctgaggaaacaaaaaggaaatgaggagagaaagttactgttaagggtggttaacattttttttgttttgttttgttttggtttttttttttttgagacagagtctggctctgtcgcccaggctggagtgcaggggcgcaatctcggctcatagcaagctccgcctcctgggttcatgccattctcctgcctcagcctccagagtagctgggactacaggtgcccgccaccacacccggctaattttttgtgtttttacaaaatacaaaaaagtagagacaggatttcactgtgttagccaggatggtcttgatctcccgacctcgtgatctgcccacctcagcctcccaaaatgctgggattacaggcgtgagccaccgagcctggccggttaacatcttttaattgtttccaggattgagcaggttctcagctgggctctgatatcccgtgcggagttggacaagtgggcagcataaagtcactcatttcttaccattttattcccctcaattctcaatatattcagtaatgaagaatggtgccaccactcaagcaacaagcctcaaactcaaccatgtcatctttttcttggatgattgcagttatttcaaaaatttgcatgcaaaatatacactcatcctacttcaagatggtggtggcaatagtcaggagaaggtaacattggagtcctggtttgattcgaaggatgaagacgaagaagcaagggaggaacaaatgaagaaccatctttgttcatgaataggaatattcaagattataaaggtatcaggtctcctaaaattgatctatggatttaataccattttcaatggaaattccaacagattttattgaatgaaacaagcaggtgtttatatggagtagcaaaggacttaaaattaccaaatgcttctaaatatgaaggagaggttggggacacgcaccctatgtgataccaagttttattgtcaagacagtgtcatggtgcagaggtaggcattctgagcaggggaacaaaataagggcctagaaactcacccgtgcatatgttgacctttgcaaaatgacctggtgacatggcaagtcagtggggacaggaaggaccactccctaagtaatcccagaacaatggctattcatgtgggaaaaaaagaaattttactttctctcaccttacctggtgataagttccaaatatgttaagggctttaatacaaaaagcaaaaattgtcagtgtttggatgaaaaaagccttagggcaggaaagaatctcttgagacataaagtagtaatcataaaggacaagatggttaagtcaattctgttaaaactcaaggcttatattaagcaaacacttgaagtgagaagatgatccacaacttgagaagacatttataatacaaataactgatgaaggattcataatcacaaatatagagaattcctatttaaaaaaatagaaaaatagtgaagactacacaagaggaaatagggcttttaaataaatagatgttctgtagcattggtcagggaaatatgaattaggaccacaatgagattccattttatatccataagatttgcaaaggttgggtctgacagtaccagttgttagatctgtagggacttgtacaacattgtggatgtgtaaacaggcaccactgctttaaaaaacaattatcccttacagacttgaacatttgcagacgttatgatcttgcttccaactcccacctgtatgtccagcaaactcttgcatgtggccactaggaggaatgtgtaagaatgttcatagttacatatttataatagttaataactggaaaaagtgaaatgtatgtctgtctacaggaaaataggtgaataattagatatatatattcattctacgggatattattcagtagtggaaatgagtgaactacagctatacctcacaataagaatgaatctcagaaaatattaaggaaaaaagcaagtttgaagagaccacatggggcgtactatttttattgagcccaaaaacaagcaaaaccaaagaatatgtagtctaagcatacgtatacaataaaactatgctattaaaaaaaaa

SEQ ID NO: 102889 - DNA, 10529 bp, Homo sapiens
  Payload ID: 78
  Gene Symbol: MTR
  Gene Name: 5-methyltetrahydrofolate-homocysteine methyltransferase
  Uniprot ID: Q99707
  ENST ID: ENST00000366577
  CDS Start-End: 395-4192
aaaggttctaaatgtctgcggggctcagagccggatgtcacgtcgtcctcctctgccggttttctcttgggtccttttccgtgccgtcccgcgactccgcctctggccgcgcgtgtctggctgctaggccgacaccaaggactggccgggtacccgggaagaaagcacgtgctccagcagttgccgcgcccagccccgagagaggccctagggcgctgcgggctttcggggtccgcagtccccccgcgacgcgagccaacgggaggcgtcaaaagacccgggccttgtgtggcaggctcgcctggcgctggctggcgtggcccttggccgtcgtcacctgtggagagcacgtcttctctgccgcgccctctgcgcaaggaggagactcgacaacatgtcacccgcgctccaagacctgtcgcaacccgaaggtctgaagaaaaccctgcgggatgagatcaatgccattctgcagaagaggattatggtgctggatggagggatggggaccatgatccagcgggagaagctaaacgaagaacacttccgaggtcaggaatttaaagatcatgccaggccgctgaaaggcaacaatgacattttaagtataactcagcctgatgtcatttaccaaatccataaggaatacttgctggctggggcagatatcattgaaacaaatacttttagcagcactagtattgcccaagctgactatggccttgaacacttggcctaccggatgaacatgtgctctgcaggagtggccagaaaagctgccgaggaggtaactctccagacaggaattaagaggtttgtggcaggggctctgggtccgactaataagacactctctgtgtccccatctgtggaaaggccggattataggaacatcacatttgatgagcttgttgaagcataccaagagcaggccaaaggacttctggatggcggggttgatatcttactcattgaaactatttttgatactgccaatgccaaggcagccttgtttgcactccaaaatctttttgaggagaaatatgctccccggcctatctttatttcagggacgatcgttgataaaagtgggcggactctttccggacagacaggagagggatttgtcatcagcgtgtctcatggagaaccactctgcattggattaaattgtgctttgggtgcagctgaaatgagaccttttattgaaataattggaaaatgtacaacagcctatgtcctctgttatcccaatgcaggtcttcccaacacctttggtgactatgatgaaacgccttctatgatggccaagcacctaaaggattttgctatggatggcttggtcaatatagttggaggatgctgtgggtcaacaccagatcatatcagggaaattgctgaagctgtgaaaaattgtaagcctagagttccacctgccactgcttttgaaggacatatgttactgtctggtctagagcccttcaggattggaccgtacaccaactttgttaacattggagagcgctgtaatgttgcaggatcaaggaagtttgctaaactcatcatggcaggaaactatgaagaagccttgtgtgttgccaaagtgcaggtggaaatgggagcccaggtgttggatgtcaacatggatgatggcatgctagatggtccaagtgcaatgaccagattttgcaacttaattgcttccgagccagacatcgcaaaggtacctttgtgcatcgactcctccaattttgctgtgattgaagctgggttaaagtgctgccaagggaagtgcattgtcaatagcattagtctgaaggaaggagaggacgacttcttggagaaggccaggaagattaaaaagtatggagctgctatggtggtcatggcttttgatgaagaaggacaggcaacagaaacagacacaaaaatcagagtgtgcacccgggcctaccatctgcttgtgaaaaaactgggctttaatccaaatgacattatttttgaccctaatatcctaaccattgggactggaatggaggaacacaacttgtatgccattaattttatccatgcaacaaaagtcattaaagaaacattacctggagccagaataagtggaggtctttccaacttgtccttctccttccgaggaatggaagccattcgagaagcaatgcatggggttttcctttaccatgcaatcaagtctggcatggacatggggatagtgaatgctggaaacctccctgtgtatgatgatatccataaggaacttctgcagctctgtgaagatctcatctggaataaagaccctgaggccactgagaagctcttacgttatgcccagactcaaggcacaggagggaagaaagtcattcagactgatgagtggagaaatggccctgtcgaagaacgccttgagtatgcccttgtgaagggcattgaaaaacatattattgaggatactgaggaagccaggttaaaccaaaaaaaatatccccgacctctcaatataattgaaggacccctgatgaatggaatgaaaattgttggtgatctttttggagctggaaaaatgtttctacctcaggttataaagtcagcccgggttatgaagaaggctgttggccaccttatccctttcatggaaaaagaaagagaagaaaccagagtgcttaacggcacagtagaagaagaggacccttaccagggcaccatcgtgctggccactgttaaaggcgacgtgcacgacataggcaagaacatagttggagtagtccttggctgcaataatttccgagttattgatttaggagtcatgactccatgtgataagatactgaaagctgctcttgaccacaaagcagatataattggcctgtcaggactcatcactccttccctggatgaaatgatttttgttgccaaggaaatggagagattagctataaggattccattgttgattggaggagcaaccacttcaaaaacccacacagcagttaaaatagctccgagatacagtgcacctgtaatccatgtcctggacgcgtccaagagtgtggtggtgtgttcccagctgttagatgaaaatctaaaggatgaatactttgaggaaatcatggaagaatatgaagatattagacaggaccattatgagtctctcaaggagaggagatacttacccttaagtcaagccagaaaaagtggtttccaaatggattggctgtctgaacctcacccagtgaagcccacgtttattgggacccaggtctttgaagactatgacctgcagaagctggtggactacattgactggaagcctttctttgatgtctggcagctccggggcaagtacccgaatcgaggctttcccaagatatttaacgacaaaacagtaggtggagaggccaggaaggtctacgatgatgcccacaatatgctgaacacactgattagtcaaaagaaactccgggcccggggtgtggttgggttctggccagcacagagtatccaagacgacattcacctgtacgcagaggctgctgtgccccaggctgcagagcccatagccaccttctatgggttaaggcaacaggctgagaaggactctgccagcacggagccatactactgcctctcagacttcatcgctcccttgcattctggcatccgtgactacctgggcctgtttgccgttgcctgctttggggtagaagagctgagcaaggcctatgaggatgatggtgacgactacagcagcatcatggtcaaggcgctgggggaccggctggcagaggcctttgcagaagagctccatgaaagagttcgccgagaactgtgggcctactgtggcagtgagcagctggacgtcgcagacctgcgcaggctgcggtacaagggcatccgcccggctcctggctaccccagccagcccgaccacaccgagaagctcaccatgtggagactcgcagacatcgagcagtctacaggcattaggttaacagaatcattagcaatggcacctgcttcagcagtctcaggcctctacttctccaatttgaagtccaaatattttgctgtggggaagatttccaaggatcaggttgaggattatgcattgaggaagaacatatctgtggctgaggttgagaaatggcttggacccattttgggatatgatacagactaactttttttttttttttgccttttttattcttgatgatcctcaaggaaatacaacctagggtgccttaaaaataacaacaacaaaaaacctgtgtgcatctggctgacacttacctgcttctggttttcgaagactatttagtggaaccttgtagaggagcagggtcttcctgcagtgcctggaaaacaggcgctgtttttttgggaccttgcgtgaagagcagtgagcagggttcctgtggtttccctggtccctctgagatggggacagactgaagacagaggtcgtttgatttcaaagcaagtcaacctgcttttttctgtttttacagtggaatctaggaggccacttagtcgtctttttttcctcttagaagaaaagcctgaaactgagttgaatagagaagtgtgaccctgtgacaaaatgatactgtgagaaatggggcattttaatctaagtggttataacagtggattctgacggggaaggtgtagctctgttctcttcggaagacctcgttttctaaaggctggactaaatggctgcagaactccctttggcaaaaggcatgcgctcactgcttgcttgtcagaaacactgaagccatttgccccagtgtggtcaagcagccatgctttctgggcattttcgtcctcccataatttcatatttccgtacccctgaggaaacaaaaaggaaatgaggagagaaagttactgttaagggtggttaacattttttttgttttgttttgttttggtttttttttttttgagacagagtctggctctgtcgcccaggctggagtgcaggggcgcaatctcggctcatagcaagctccgcctcctgggttcatgccattctcctgcctcagcctccagagtagctgggactacaggtgcccgccaccacacccggctaattttttgtgtttttacaaaatacaaaaaagtagagacaggatttcactgtgttagccaggatggtcttgatctcccgacctcgtgatctgcccacctcagcctcccaaaatgctgggattacaggcgtgagccaccgagcctggccggttaacatcttttaattgtttccaggattgagcaggttctcagctgggctctgatatcccgtgcggagttggacaagtgggcagcataaagtcactcatttcttaccattttattcccctcaattctcaatatattcagtaatgaagaatggtgccaccactcaagcaacaagcctcaaactcaaccatgtcatctttttcttggatgattgcagttatttcaaaaatttgcatgcaaaatatacactcatcctacttcaagatggtggtggcaatagtcaggagaaggtaacattggagtcctggtttgattcgaaggatgaagacgaagaagcaagggaggaacaaatgaagaaccatctttgttcatgaataggaatattcaagattataaaggtatcaggtctcctaaaattgatctatggatttaataccattttcaatggaaattccaacagattttattgaatgaaacaagcaggtgtttatatggagtagcaaaggacttaaaattaccaaatgcttctaaatatgaaggagaggttggggacacgcaccctatgtgataccaagttttattgtcaagacagtgtcatggtgcagaggtaggcattctgagcaggggaacaaaataagggcctagaaactcacccgtgcatatgttgacctttgcaaaatgacctggtgacatggcaagtcagtggggacaggaaggaccactccctaagtaatcccagaacaatggctattcatgtgggaaaaaaagaaattttactttctctcaccttacctggtgataagttccaaatatgttaagggctttaatacaaaaagcaaaaattgtcagtgtttggatgaaaaaagccttagggcaggaaagaatctcttgagacataaagtagtaatcataaaggacaagatggttaagtcaattctgttaaaactcaaggcttatattaagcaaacacttgaagtgagaagatgatccacaacttgagaagacatttataatacaaataactgatgaaggattcataatcacaaatatagagaattcctatttaaaaaaatagaaaaatagtgaagactacacaagaggaaatagggcttttaaataaatagatgttctgtagcattggtcagggaaatatgaattaggaccacaatgagattccattttatatccataagatttgcaaaggttgggtctgacagtaccagttgttagatctgtagggacttgtacaacattgtggatgtgtaaacaggcaccactgctttaaaaaacaattatcccttacagacttgaacatttgcagacgttatgatcttgcttccaactcccacctgtatgtccagcaaactcttgcatgtggccactaggaggaatgtgtaagaatgttcatagttacatatttataatagttaataactggaaaaagtgaaatgtatgtctgtctacaggaaaataggtgaataattagatatatatattcattctacgggatattattcagtagtggaaatgagtgaactacagctatacctcacaataagaatgaatctcagaaaatattaaggaaaaaagcaagtttgaagagaccacatggggcgtactatttttattgagcccaaaaacaagcaaaaccaaagaatatgtagtctaagcatacgtatacaataaaactatgctattaaaaaaaaagaaggtaactgataaaccaaaattgagcatagtaattacccacagaaggaggaagtggaagggacaggagcacataggtagatgccaagttatgcagctgttctggttcctcctggtaggcttacaagtgtttactatatgctattaatacattatactttataactaatagataacagttttttacatattaaatatgttctacttaaatatattataaaaaataaaggcaaagtggaatgataacctaaaatctggtatggtgattttgtaggtaatgtttgtatatgtcaaatacagtttttaaggaaaggaagaacatcttagggtaaacagcagctagaaaggtgaggggcaggagagtggtgcatccttgctgctgccagcagtgcccagataccaggctttggggaatgagtggatggctggaccatttgctaagacagaggccaggggatgggagaaatgatgagttttggaaagattcgatgtgactagactgaatataggcagttggatactagactttggaatttaaaaagaatgtctggagttagaattgagagacttgaacgtggagatggaggtcaggctgcagtgcgatgggatcatctatggagcatatgaggagaagagaatctggaggaggaggagggggagccagcaggggagcagctgtgggttggaggaagccaggagggagagtgcaatgccgagaaagcaatgaagagcgtttcgaagcatgccagcagaacccaatgctgcaaagaggcctgggaatgggattgctgagggcccttctcacagtgagcccctcaagagcagcgtcaggggattgtggggactgttggcacacagctggctttgctaggttgaagacaatgggaggtgtggaagacttgttgactcatttaaagaagattggagggaaaggtaggattgagagtgtttcagacagaaaaaggattatatgctgagggtaaagcacaagtacagagggttgcagatagtgcagaagtctttaaaaacaattattttaacccaacttccagggagactgaatttcttctgccagtcagtaacaccatcaacctgggagttgcccctgacccctccagtcttagctcctgctcctgtaacaaaataccacaaactggttagcttatagagaacagatgtttatttcttacagttcaggagtctggaagtccaagatcatggtgccatcatggccgagttctggtgagggccctcttctgggatgcagcggccagcttctcatgttctcacagtgggtggagggtaagcttgctctctggcctcctcttaaaaaggcactaatcccattcatgagggctccaccttcatgacctaattacctcccaaagatgccatctccaaacaccatcattctggggattccatttcaacatgatttgggggatacatcagaccataacacttttctttttctcaaccttcacatccagttggttctcaagccctggcgattttacgcgctagataggtcttaagttcatctctacgcctgccctggttaaggttctcatcatttctcctctggattcatctgcaacacaggctgccgggttggttcccacctcctagagctggaagagtgggctctctgattctttacacccccgcctcaatcctcctgctgcctgaataaccatctccccgtgacctaggatatatcccagccccttagaggcatgcaaagccttccatgtctgaccctgcctcatgtcttggaagccctagactgctgctgtaccctgaaggaggtacctgctcacattggcccctctgtctggaataaccccaccccggttccacccaagtcaggaaagcttcccaacccctccctcccaccaccccaaagctaagtgaagtgacccctcttcttgcctctgtaacaccgccatgcacatttcatacagcccttgctgaaacttcatctagttctctgttagacttaacattccctaagggcaggtttggaaccttactcatctttatatggcgtctaaaatagtgcttgctttatgataggtgctcagtaaaggttgtcttgaattgagcagatcctctagggacaggagttggatggagagcagactgtaaagcctcatgagggcaggggccctgcctcttcctgagctcaggatacccagagcctagctcagtgcctgccatgaaattgttcactccatcaagccttgttaaatgagttcggggcggggggagcatgatggttttctctctctcagaaagaaagcgctgtatcaaagccctagcaccctctctacacccaccttcagtatttcatattagatgcggcccaagtgatactttctttaccgtcccgtgaagacagcatattggcagccctgcaaaaacaaaacaaaacaaaaccctcagttcatggcatacttgctataaatcagctatgtgtattgtcaaattgtagaactgaaagtatattctgattcggtgtgtgtataaggaaatatacaccagtatatgcattaaaacgtcaagaagagctgggcacagtgtcacatgcctgtaaacccagctattcaggaggctgaggtgggaggatcggttgaggccaggagtttgaggctgcagtgagctatgattgcacagctgcactccagcctgtgctgagacctcatctcttaaaaaataaaaaataaaaagtctaagaggatacacagaaatttttaagtggttacctccacggaatgggattaggggatcagaggtgagggaactcatggtttggctatttctcgttctttctgcactgtttcaaatttttacaagtgtatgttattgtacttttaaaaagattagcttggcaacaagtctagcctgaaatgggtgctattttgactagtctgagtgaaaagtgaggatttaaatgaagtaacccctaaactcagccagtcccatgtttttttaacacttggaatatctaattccatttacactgcattcttcaaatgtaattttcaaagatgccttttgcctcatcccttgcttttaagtattattatagacttttggagactcacgaaacaagcaatccctaaattctcgcccaggaaagtatcttggattaaatggtttttgagaaccttgagagtgtatattctatgaaatggaagaaacaagaactagacagagtcacaaatgctgttgatcacagacaatctctgccatccataaggtaaatgtaatacatctggcgacctgctgagtgtgaacttgcagcaggtgaggaaggaactctgaactctcacaatcttgtttcttcatttcccagagagaaactcggcaaagagaaaaaggacatttccctccaggttatctgaaagaatttcaatgcttacctttaatcatgtgacattgtttatcttggattaaaagaaaagaaaatgtatttattttgtgcatattttcaataaaatatataaaatcgagttggtatatagtgccaaataccattaattaaaaatattttaacctga

SEQ ID NO: 102890 - DNA, 10405 bp, Homo sapiens
  Payload ID: 78
  Gene Symbol: MTR
  Gene Name: 5-methyltetrahydrofolate-homocysteine methyltransferase
  Uniprot ID: Q99707
  ENST ID: ENST00000535889
  CDS Start-End: 424-4068
agattgagcgcagaactaaccgcgctctgaaaggttctaaatgtctgcggggctcagagccggatgtcacgtcgtcctcctctgccggttttctcttgggtccttttccgtgccgtcccgcgactccgcctctggccgcgcgtgtctggctgctaggccgacaccaaggactggccgggtacccgggaagaaagcacgtgctccagcagttgccgcgcccagccccgagagaggccctagggcgctgcgggctttcggggtccgcagtccccccgcgacgcgagccaacgggaggcgtcaaaagacccgggccttgtgtggcaggctcgcctggcgctggctggcgtggcccttggccgtcgtcacctgtggagagcacgtcttctctgccgcgccctctgcgcaaggaggagactcgacaacatgtcacccgcgctccaagacctgtcgcaacccgaaggtctgaagaaaaccctgcgggatgagatcaatgccattctgcagaagaggattatggtgctggatggagggatggggaccatgatccagcgggagaagctaaacgaagaacacttccgaggtcaggaatttaaagatcatgccaggccgctgaaaggcaacaatgacattttaagtataactcagcctgatgtcatttaccaaatccataaggaatacttgctggctggggcagatatcattgaaacaaatacttttagcagcactagtattgcccaagctgactatggccttgaacacttggcctaccggatgaacatgtgctctgcaggagtggccagaaaagctgccgaggaggtaactctccagacaggaattaagaggtttgtggcaggggctctgggtccgactaataagacactctctgtgtccccatctgtggaaaggccggattataggaacatcacatttgatgagcttgttgaagcataccaagagcaggccaaaggacttctggatggcggggttgatatcttactcattgaaactatttttgatactgccaatgccaaggcagccttgtttgcactccaaaatctttttgaggagaaatatgctccccggcctatctttatttcagggacgatcgttgataaaagtgggcggactctttccggacagacaggagagggatttgtcatcagcgtgtctcatggagaaccactctgcattggattaaattgtgctttgggtgcagctgaaatgagaccttttattgaaataattggaaaatgtacaacagcctatgtcctctgttatcccaatgcaggtcttcccaacacctttggtgactatgatgaaacgccttctatgatggccaagcacctaaaggattttgctatggatggcttggtcaatatagttggaggatgctgtgggtcaacaccagatcatatcagggaaattgctgaagctgtgaaaaattgtaagcctagagttccacctgccactgcttttgaaggacatatgttactgtctggtctagagcccttcaggattggaccgtacaccaactttgttaacattggagagcgctgtaatgttgcaggatcaaggaagtttgctaaactcatcatggcaggaaactatgaagaagccttgtgtgttgccaaagtgcaggtggaaatgggagcccaggtgttggatgtcaacatggatgatggcatgctagatggtccaagtgcaatgaccagattttgcaacttaattgcttccgagccagacatcgcaaaggtacctttgtgcatcgactcctccaattttgctgtgattgaagctgggttaaagtgctgccaagggaagtgcattgtcaatagcattagtctgaaggaaggagaggacgacttcttggagaaggccaggaagattaaaaagtatggagctgctatggtggtcatggcttttgatgaagaaggacaggcaacagaaacagacacaaaaatcagagtgtgcacccgggcctaccatctgcttgtgaaaaaactgggctttaatccaaatgacattatttttgaccctaatatcctaaccattgggactggaatggaggaacacaacttgtatgccattaattttatccatgcaacaaaagtcattaaagaaacattacctggagccagaataagtggaggtctttccaacttgtccttctccttccgaggaatggaagccattcgagaagcaatgcatggggttttcctttaccatgcaatcaagtctggcatggacatggggatagtgaatgctggaaacctccctgtgtatgatgatatccataaggaacttctgcagctctgtgaagatctcatctggaataaagaccctgaggccactgagaagctcttacgttatgcccagactcaaggcacaggagggaagaaagtcattcagactgatgagtggagaaatggccctgtcgaagaacgccttgagtatgcccttgtgaaggttataaagtcagcccgggttatgaagaaggctgttggccaccttatccctttcatggaaaaagaaagagaagaaaccagagtgcttaacggcacagtagaagaagaggacccttaccagggcaccatcgtgctggccactgttaaaggcgacgtgcacgacataggcaagaacatagttggagtagtccttggctgcaataatttccgagttattgatttaggagtcatgactccatgtgataagatactgaaagctgctcttgaccacaaagcagatataattggcctgtcaggactcatcactccttccctggatgaaatgatttttgttgccaaggaaatggagagattagctataaggattccattgttgattggaggagcaaccacttcaaaaacccacacagcagttaaaatagctccgagatacagtgcacctgtaatccatgtcctggacgcgtccaagagtgtggtggtgtgttcccagctgttagatgaaaatctaaaggatgaatactttgaggaaatcatggaagaatatgaagatattagacaggaccattatgagtctctcaaggagaggagatacttacccttaagtcaagccagaaaaagtggtttccaaatggattggctgtctgaacctcacccagtgaagcccacgtttattgggacccaggtctttgaagactatgacctgcagaagctggtggactacattgactggaagcctttctttgatgtctggcagctccggggcaagtacccgaatcgaggctttcccaagatatttaacgacaaaacagtaggtggagaggccaggaaggtctacgatgatgcccacaatatgctgaacacactgattagtcaaaagaaactccgggcccggggtgtggttgggttctggccagcacagagtatccaagacgacattcacctgtacgcagaggctgctgtgccccaggctgcagagcccatagccaccttctatgggttaaggcaacaggctgagaaggactctgccagcacggagccatactactgcctctcagacttcatcgctcccttgcattctggcatccgtgactacctgggcctgtttgccgttgcctgctttggggtagaagagctgagcaaggcctatgaggatgatggtgacgactacagcagcatcatggtcaaggcgctgggggaccggctggcagaggcctttgcagaagagctccatgaaagagttcgccgagaactgtgggcctactgtggcagtgagcagctggacgtcgcagacctgcgcaggctgcggtacaagggcatccgcccggctcctggctaccccagccagcccgaccacaccgagaagctcaccatgtggagactcgcagacatcgagcagtctacaggcattaggttaacagaatcattagcaatggcacctgcttcagcagtctcaggcctctacttctccaatttgaagtccaaatattttgctgtggggaagatttccaaggatcaggttgaggattatgcattgaggaagaacatatctgtggctgaggttgagaaatggcttggacccattttgggatatgatacagactaactttttttttttttttgccttttttattcttgatgatcctcaaggaaatacaacctagggtgccttaaaaataacaacaacaaaaaacctgtgtgcatctggctgacacttacctgcttctggttttcgaagactatttagtggaaccttgtagaggagcagggtcttcctgcagtgcctggaaaacaggcgctgtttttttgggaccttgcgtgaagagcagtgagcagggttcctgtggtttccctggtccctctgagatggggacagactgaagacagaggtcgtttgatttcaaagcaagtcaacctgcttttttctgtttttacagtggaatctaggaggccacttagtcgtctttttttcctcttagaagaaaagcctgaaactgagttgaatagagaagtgtgaccctgtgacaaaatgatactgtgagaaatggggcattttaatctaagtggttataacagtggattctgacggggaaggtgtagctctgttctcttcggaagacctcgttttctaaaggctggactaaatggctgcagaactccctttggcaaaaggcatgcgctcactgcttgcttgtcagaaacactgaagccatttgccccagtgtggtcaagcagccatgctttctgggcattttcgtcctcccataatttcatatttccgtacccctgaggaaacaaaaaggaaatgaggagagaaagttactgttaagggtggttaacattttttttgttttgttttgttttggtttttttttttttgagacagagtctggctctgtcgcccaggctggagtgcaggggcgcaatctcggctcatagcaagctccgcctcctgggttcatgccattctcctgcctcagcctccagagtagctgggactacaggtgcccgccaccacacccggctaattttttgtgtttttacaaaatacaaaaaagtagagacaggatttcactgtgttagccaggatggtcttgatctcccgacctcgtgatctgcccacctcagcctcccaaaatgctgggattacaggcgtgagccaccgagcctggccggttaacatcttttaattgtttccaggattgagcaggttctcagctgggctctgatatcccgtgcggagttggacaagtgggcagcataaagtcactcatttcttaccattttattcccctcaattctcaatatattcagtaatgaagaatggtgccaccactcaagcaacaagcctcaaactcaaccatgtcatctttttcttggatgattgcagttatttcaaaaatttgcatgcaaaatatacactcatcctacttcaagatggtggtggcaatagtcaggagaaggtaacattggagtcctggtttgattcgaaggatgaagacgaagaagcaagggaggaacaaatgaagaaccatctttgttcatgaataggaatattcaagattataaaggtatcaggtctcctaaaattgatctatggatttaataccattttcaatggaaattccaacagattttattgaatgaaacaagcaggtgtttatatggagtagcaaaggacttaaaattaccaaatgcttctaaatatgaaggagaggttggggacacgcaccctatgtgataccaagttttattgtcaagacagtgtcatggtgcagaggtaggcattctgagcaggggaacaaaataagggcctagaaactcacccgtgcatatgttgacctttgcaaaatgacctggtgacatggcaagtcagtggggacaggaaggaccactccctaagtaatcccagaacaatggctattcatgtgggaaaaaaagaaattttactttctctcaccttacctggtgataagttccaaatatgttaagggctttaatacaaaaagcaaaaattgtcagtgtttggatgaaaaaagccttagggcaggaaagaatctcttgagacataaagtagtaatcataaaggacaagatggttaagtcaattctgttaaaactcaaggcttatattaagcaaacacttgaagtgagaagatgatccacaacttgagaagacatttataatacaaataactgatgaaggattcataatcacaaatatagagaattcctatttaaaaaaatagaaaaatagtgaagactacacaagaggaaatagggcttttaaataaatagatgttctgtagcattggtcagggaaatatgaattaggaccacaatgagattccattttatatccataagatttgcaaaggttgggtctgacagtaccagttgttagatctgtagggacttgtacaacattgtggatgtgtaaacaggcaccactgctttaaaaaacaattatcccttacagacttgaacatttgcagacgttatgatcttgcttccaactcccacctgtatgtccagcaaactcttgcatgtggccactaggaggaatgtgtaagaatgttcatagttacatatttataatagttaataactggaaaaagtgaaatgtatgtctgtctacaggaaaataggtgaataattagatatatatattcattctacgggatattattcagtagtggaaatgagtgaactacagctatacctcacaataagaatgaatctcagaaaatattaaggaaaaaagcaagtttgaagagaccacatggggcgtactatttttattgagcccaaaaacaagcaaaaccaaagaatatgtagtctaagcatacgtatacaataaaactatgctattaaaaaaaaagaaggtaactgataaaccaaaattgagcatagtaattacccacagaaggaggaagtggaagggacaggagcacataggtagatgccaagttatgcagctgttctggttcctcctggtaggcttacaagtgtttactatatgctattaatacattatactttataactaatagataacagttttttacatattaaatatgttctacttaaatatattataaaaaataaaggcaaagtggaatgataacctaaaatctggtatggtgattttgtaggtaatgtttgtatatgtcaaatacagtttttaaggaaaggaagaacatcttagggtaaacagcagctagaaaggtgaggggcaggagagtggtgcatccttgctgctgccagcagtgcccagataccaggctttggggaatgagtggatggctggaccatttgctaagacagaggccaggggatgggagaaatgatgagttttggaaagattcgatgtgactagactgaatataggcagttggatactagactttggaatttaaaaagaatgtctggagttagaattgagagacttgaacgtggagatggaggtcaggctgcagtgcgatgggatcatctatggagcatatgaggagaagagaatctggaggaggaggagggggagccagcaggggagcagctgtgggttggaggaagccaggagggagagtgcaatgccgagaaagcaatgaagagcgtttcgaagcatgccagcagaacccaatgctgcaaagaggcctgggaatgggattgctgagggcccttctcacagtgagcccctcaagagcagcgtcaggggattgtggggactgttggcacacagctggctttgctaggttgaagacaatgggaggtgtggaagacttgttgactcatttaaagaagattggagggaaaggtaggattgagagtgtttcagacagaaaaaggattatatgctgagggtaaagcacaagtacagagggttgcagatagtgcagaagtctttaaaaacaattattttaacccaacttccagggagactgaatttcttctgccagtcagtaacaccatcaacctgggagttgcccctgacccctccagtcttagctcctgctcctgtaacaaaataccacaaactggttagcttatagagaacagatgtttatttcttacagttcaggagtctggaagtccaagatcatggtgccatcatggccgagttctggtgagggccctcttctgggatgcagcggccagcttctcatgttctcacagtgggtggagggtaagcttgctctctggcctcctcttaaaaaggcactaatcccattcatgagggctccaccttcatgacctaattacctcccaaagatgccatctccaaacaccatcattctggggattccatttcaacatgatttgggggatacatcagaccataacacttttctttttctcaaccttcacatccagttggttctcaagccctggcgattttacgcgctagataggtcttaagttcatctctacgcctgccctggttaaggttctcatcatttctcctctggattcatctgcaacacaggctgccgggttggttcccacctcctagagctggaagagtgggctctctgattctttacacccccgcctcaatcctcctgctgcctgaataaccatctccccgtgacctaggatatatcccagccccttagaggcatgcaaagccttccatgtctgaccctgcctcatgtcttggaagccctagactgctgctgtaccctgaaggaggtacctgctcacattggcccctctgtctggaataaccccaccccggttccacccaagtcaggaaagcttcccaacccctccctcccaccaccccaaagctaagtgaagtgacccctcttcttgcctctgtaacaccgccatgcacatttcatacagcccttgctgaaacttcatctagttctctgttagacttaacattccctaagggcaggtttggaaccttactcatctttatatggcgtctaaaatagtgcttgctttatgataggtgctcagtaaaggttgtcttgaattgagcagatcctctagggacaggagttggatggagagcagactgtaaagcctcatgagggcaggggccctgcctcttcctgagctcaggatacccagagcctagctcagtgcctgccatgaaattgttcactccatcaagccttgttaaatgagttcggggcggggggagcatgatggttttctctctctcagaaagaaagcgctgtatcaaagccctagcaccctctctacacccaccttcagtatttcatattagatgcggcccaagtgatactttctttaccgtcccgtgaagacagcatattggcagccctgcaaaaacaaaacaaaacaaaaccctcagttcatggcatacttgctataaatcagctatgtgtattgtcaaattgtagaactgaaagtatattctgattcggtgtgtgtataaggaaatatacaccagtatatgcattaaaacgtcaagaagagctgggcacagtgtcacatgcctgtaaacccagctattcaggaggctgaggtgggaggatcggttgaggccaggagtttgaggctgcagtgagctatgattgcacagctgcactccagcctgtgctgagacctcatctcttaaaaaataaaaaataaaaagtctaagaggatacacagaaatttttaagtggttacctccacggaatgggattaggggatcagaggtgagggaactcatggtttggctatttctcgttctttctgcactgtttcaaatttttacaagtgtatgttattgtacttttaaaaagattagcttggcaacaagtctagcctgaaatgggtgctattttgactagtctgagtgaaaagtgaggatttaaatgaagtaacccctaaactcagccagtcccatgtttttttaacacttggaatatctaattccatttacactgcattcttcaaatgtaattttcaaagatgccttttgcctcatcccttgcttttaagtattattatagacttttggagactcacgaaacaagcaatccctaaattctcgcccaggaaagtatcttggattaaatggtttttgagaaccttgagagtgtatattctatgaaatggaagaaacaagaactagacagagtcacaaatgctgttgatcacagacaatctctgccatccataaggtaaatgtaatacatctggcgacctgctgagtgtgaacttgcagcaggtgaggaaggaactctgaactctcacaatcttgtttcttcatttcccagagagaaactcggcaaagagaaaaaggacatttccctccaggttatctgaaagaatttcaatgcttacctttaatcatgtgacattgtttatcttggattaaaagaaaagaaaatgtatttattttgtgcatattttcaataaaatatataaaatcgagttggtatatagtgccaaataccattaattaaaaatattttaacctga

SEQ ID NO: 102891 - DNA, 3274 bp, Homo sapiens
  Payload ID: 79
  Gene Symbol: MTRR
  Gene Name: 5-methyltetrahydrofolate-homocysteine methyltransferase reductase
  Uniprot ID: Q9UBK8
  ENST ID: ENST00000264668
  CDS Start-End: 31-2208
ggagctttctattggtcctgggtaccgagcatgggcgctgcgtcagtgcgcgctggcgcaaggttggtggaagtcgcgttgtgcagtttcactgttacatgccttgaagtgatgaggaggtttctgttactatatgctacacagcagggacaggcaaaggccatcgcagaagaaatatgtgagcaagctgtggtacatggattttctgcagatcttcactgtattagtgaatccgataagtatgacctaaaaaccgaaacagctcctcttgttgttgtggtttctaccacgggcaccggagacccacccgacacagcccgcaagtttgttaaggaaatacagaaccaaacactgccggttgatttctttgctcacctgcggtatgggttactgggtctcggtgattcagaatacacctacttttgcaatggggggaagataattgataaacgacttcaagagcttggagcccggcatttctatgacactggacatgcagatgactgtgtaggtttagaacttgtggttgagccgtggattgctggactctggccagccctcagaaagcattttaggtcaagcagaggacaagaggagataagtggcgcactcccggtggcatcacctgcatcctcgaggacagaccttgtgaagtcagagctgctacacattgaatctcaagtcgagcttctgagattcgatgattcaggaagaaaggattctgaggttttgaagcaaaatgcagtgaacagcaaccaatccaatgttgtaattgaagactttgagtcctcacttacccgttcggtacccccactctcacaagcctctctgaatattcctggtttacccccagaatatttacaggtacatctgcaggagtctcttggccaggaggaaagccaagtatctgtgacttcagcagatccagtttttcaagtgccaatttcaaaggcagttcaacttactacgaatgatgccataaaaaccactctgctggtagaattggacatttcaaatacagacttttcctatcagcctggagatgccttcagcgtgatctgccctaacagtgattctgaggtacaaagcctactccaaagactgcagcttgaagataaaagagagcactgcgtccttttgaaaataaaggcagacacaaagaagaaaggagctaccttaccccagcatatacctgcgggatgttctctccagttcatttttacctggtgtcttgaaatccgagcaattcctaaaaaggcatttttgcgagcccttgtggactataccagtgacagtgctgaaaagcgcaggctacaggagctgtgcagtaaacaaggggcagccgattatagccgctttgtacgagatgcctgtgcctgcttgttggatctcctcctcgctttcccttcttgccagccaccactcagtctcctgctcgaacatcttcctaaacttcaacccagaccatattcgtgtgcaagctcaagtttatttcacccaggaaagctccattttgtcttcaacattgtggaatttctgtctactgccacaacagaggttctgcggaagggagtatgtacaggctggctggccttgttggttgcttcagttcttcagccaaacatacatgcatcccatgaagacagcgggaaagccctggctcctaagatatccatctctcctcgaacaacaaattctttccacttaccagatgacccctcaatccccatcataatggtgggtccaggaaccggcatagccccgtttattgggttcctacaacatagagagaaactccaagaacaacacccagatggaaattttggagcaatgtggttgttttttggctgcaggcataaggatagggattatctattcagaaaagagctcagacatttccttaagcatgggatcttaactcatctaaaggtttccttctcaagagatgctcctgttggggaggaggaagccccagcaaagtatgtgcaagacaacatccagcttcatggccagcaggtggcgagaatcctcctccaggagaacggccatatttatgtgtgtggagatgcaaagaatatggccaaggatgtacatgatgcccttgtgcaaataataagcaaagaggttggagttgaaaaactagaagcaatgaaaaccctggccactttaaaagaagaaaaacgctaccttcaggatatttggtcataaaaccagaaattaaagaaagaggattaagcttttttgactgaaagtactaaaagtcagctttactagtgccaaacctttaaattttcaaaagaaaattttctttcaacatttcttgaaggacatggagtggagattggatcatttaacaatataacaaaacttcctgatttgattttacgtatcttctatctacgcccttcctgtgcctgtgactctccccaaattgccctgttgccttgagctcttctgagctaaggcagccttcagtccctatcagcgcctcctttacttcccagagaacttcacagagactctgtccttccatgcaaaggcttcctgaaatagggagactgactgagtagctcattcttgtgacttacagtgccaacatttaaaaaagtatgaaaatgatttatttttatatgatgtatacccataaagaatgctcatattaatgtacttaaattacacatgtagagcatatctgttatatgtttatgtaactatcaaatggttatttgttactaaagctatatttctgataaaaaatattttaggataattgcctacagagggatttatttttatgatgctggaaatatgaaatgtattttaaaatttcactctggcatatgatttatctatcaccattacttttttttaagtcacaatttcagaattttgggacatttgcattcaatttacaggtaccagtacgtacatattttaatagaaagatacaacctttttattttcactccttttatttctgctgcttggcacatttttgagttttcccacattatttgtctccatgataccactcaagcagtgtgctggacctaaaatactgactttagttagtatccttggatttttagattcccagtgtctaattccctgttataatttgcacaaacaaaacaaaatgttatgataatctttctccactgttctaatatatattgtatttttatttgatagcttgggatttaaaacatctctgttgaaggcttttgatccttttgagaaataaagatctgaaagaaatggcataatcttaaaa

SEQ ID NO: 102892 - DNA, 3215 bp, Homo sapiens
  Payload ID: 79
  Gene Symbol: MTRR
  Gene Name: 5-methyltetrahydrofolate-homocysteine methyltransferase reductase
  Uniprot ID: Q9UBK8
  ENST ID: ENST00000440940
  CDS Start-End: 53-2149
ggttcgtgcccggctggcgcggcgtggtttcactgttacatgccttgaagtgatgaggaggtttctgttactatatgctacacagcagggacaggcaaaggccatcgcagaagaaatatgtgagcaagctgtggtacatggattttctgcagatcttcactgtattagtgaatccgataagtatgacctaaaaaccgaaacagctcctcttgttgttgtggtttctaccacgggcaccggagacccacccgacacagcccgcaagtttgttaaggaaatacagaaccaaacactgccggttgatttctttgctcacctgcggtatgggttactgggtctcggtgattcagaatacacctacttttgcaatggggggaagataattgataaacgacttcaagagcttggagcccggcatttctatgacactggacatgcagatgactgtgtaggtttagaacttgtggttgagccgtggattgctggactctggccagccctcagaaagcattttaggtcaagcagaggacaagaggagataagtggcgcactcccggtggcatcacctgcatcctcgaggacagaccttgtgaagtcagagctgctacacattgaatctcaagtcgagcttctgagattcgatgattcaggaagaaaggattctgaggttttgaagcaaaatgcagtgaacagcaaccaatccaatgttgtaattgaagactttgagtcctcacttacccgttcggtacccccactctcacaagcctctctgaatattcctggtttacccccagaatatttacaggtacatctgcaggagtctcttggccaggaggaaagccaagtatctgtgacttcagcagatccagtttttcaagtgccaatttcaaaggcagttcaacttactacgaatgatgccataaaaaccactctgctggtagaattggacatttcaaatacagacttttcctatcagcctggagatgccttcagcgtgatctgccctaacagtgattctgaggtacaaagcctactccaaagactgcagcttgaagataaaagagagcactgcgtccttttgaaaataaaggcagacacaaagaagaaaggagctaccttaccccagcatatacctgcgggatgttctctccagttcatttttacctggtgtcttgaaatccgagcaattcctaaaaaggcatttttgcgagcccttgtggactataccagtgacagtgctgaaaagcgcaggctacaggagctgtgcagtaaacaaggggcagccgattatagccgctttgtacgagatgcctgtgcctgcttgttggatctcctcctcgctttcccttcttgccagccaccactcagtctcctgctcgaacatcttcctaaacttcaacccagaccatattcgtgtgcaagctcaagtttatttcacccaggaaagctccattttgtcttcaacattgtggaatttctgtctactgccacaacagaggttctgcggaagggagtatgtacaggctggctggccttgttggttgcttcagttcttcagccaaacatacatgcatcccatgaagacagcgggaaagccctggctcctaagatatccatctctcctcgaacaacaaattctttccacttaccagatgacccctcaatccccatcataatggtgggtccaggaaccggcatagccccgtttattgggttcctacaacatagagagaaactccaagaacaacacccagatggaaattttggagcaatgtggttgttttttggctgcaggcataaggatagggattatctattcagaaaagagctcagacatttccttaagcatgggatcttaactcatctaaaggtttccttctcaagagatgctcctgttggggaggaggaagccccagcaaagtatgtgcaagacaacatccagcttcatggccagcaggtggcgagaatcctcctccaggagaacggccatatttatgtgtgtggagatgcaaagaatatggccaaggatgtacatgatgcccttgtgcaaataataagcaaagaggttggagttgaaaaactagaagcaatgaaaaccctggccactttaaaagaagaaaaacgctaccttcaggatatttggtcataaaaccagaaattaaagaaagaggattaagcttttttgactgaaagtactaaaagtcagctttactagtgccaaacctttaaattttcaaaagaaaattttctttcaacatttcttgaaggacatggagtggagattggatcatttaacaatataacaaaacttcctgatttgattttacgtatcttctatctacgcccttcctgtgcctgtgactctccccaaattgccctgttgccttgagctcttctgagctaaggcagccttcagtccctatcagcgcctcctttacttcccagagaacttcacagagactctgtccttccatgcaaaggcttcctgaaatagggagactgactgagtagctcattcttgtgacttacagtgccaacatttaaaaaagtatgaaaatgatttatttttatatgatgtatacccataaagaatgctcatattaatgtacttaaattacacatgtagagcatatctgttatatgtttatgtaactatcaaatggttatttgttactaaagctatatttctgataaaaaatattttaggataattgcctacagagggatttatttttatgatgctggaaatatgaaatgtattttaaaatttcactctggcatatgatttatctatcaccattacttttttttaagtcacaatttcagaattttgggacatttgcattcaatttacaggtaccagtacgtacatattttaatagaaagatacaacctttttattttcactccttttatttctgctgcttggcacatttttgagttttcccacattatttgtctccatgataccactcaagcagtgtgctggacctaaaatactgactttagttagtatccttggatttttagattcccagtgtctaattccctgttataatttgcacaaacaaaacaaaatgttatgataatctttctccactgttctaatatatattgtatttttatttgatagcttgggatttaaaacatctctgttgaaggcttttgatccttttgagaaataaagatctgaaagaaatggcataatcttaaaa

SEQ ID NO: 102893 - DNA, 520 bp, Homo sapiens
  Payload ID: 79
  Gene Symbol: MTRR
  Gene Name: 5-methyltetrahydrofolate-homocysteine methyltransferase reductase
  ENST ID: ENST00000512217
  CDS Start-End: 185-520
taggatcaaataagaaccaagaatcctatcattttaatatagtttttacttttatctttttttaaaaagaggaaaccaaaagctatttaagactgttgtgaatgatactgtggctcaagttttgttcaggttcttggcttgtgccacatcgtttttcagtttcactgttacatgccttgaagtgatgaggaggtttctgttactatatgctacacagcagggacaggcaaaggccatcgcagaagaaatatgtgagcaagctgtggtacatggattttctgcagatcttcactgtattagtgaatccgataagtatgacctaaaaaccgaaacagctcctcttgttgttgtggtttctaccacgggcaccggagacccacccgacacagcccgcaagtttgttaaggaaatacagaaccaaacactgccggttgatttctttgctcacctgcggtatgggttactgggtctcggtgattcagaatacacctacttttgcaatggggggaagataattgat

SEQ ID NO: 102894 - DNA, 3091 bp, Homo sapiens
  Payload ID: 79
  Gene Symbol: MTRR
  Gene Name: 5-methyltetrahydrofolate-homocysteine methyltransferase reductase
  ENST ID: ENST00000510525
  CDS Start-End: 1-1117
tttcactgttacatgccttgaagtgatgaggaggtttctgttactatatgctacacagcagggacaggcaaaggccatcgcagaagaaatatgtgagcaagctgtggtacatggattttctgcagatcttcactgtattagtgaatccgataagtatgacctaaaaaccgaaacagctcctcttgttgttgtggtttctaccacgggcaccggagacccacccgacacagcccgcaagtttgttaaggaaatacagaaccaaacactgccggttgatttctttgctcacctgcggtatgggttactgggtctcggtgattcagaatacacctacttttgcaatggggggaagataattgataaacgacttcaagagcttggagcccggcatttctatgacactggacatgcagatgactgtgtaggtttagaacttgtggttgagccgtggattgctggactctggccagccctcagaaagcattttaggtcaagcagaggacaagaggagataagtggcgcactcccggtggcatcacctgcatcctcgaggacagaccttgtgaagtcagagctgctacacattgaatctcaagtcgagcttctgagattcgatgattcaggaagaaaggattctgaggttttgaagcaaaatgcagtgaacagcaaccaatccaatgttgtaattgaagactttgagtcctcacttacccgttcggtacccccactctcacaagcctctctgaatattcctggtttacccccagaatatttacaggtacatctgcaggagtctcttggccaggaggaaagccaagtatctgtgacttcagcagatccagtttttcaagtgccaatttcaaaggcagttcaacttactacgaatgatgccataaaaaccactctgctggtagaattggacatttcaaatacagacttttcctatcagcctggagatgccttcagcgtgatctgccctaacagtgattctgaggtacaaagcctactccaaagactgcagcttgaagataaaagagagcactgcgtccttttgaaaataaaggcagacacaaagaagaaaggcatttttgcgagcccttgtggactataccagtgacagtgctgaaaagcgcaggctacaggagctgtgcagtaaacaaggggcagccgattatagccgctttgtacgagatgcctgtgcctgcttgttggatctcctcctcgctttcccttcttgccagccaccactcagtctcctgctcgaacatcttcctaaacttcaacccagaccatattcgtgtgcaagctcaagtttatttcacccaggaaagctccattttgtcttcaacattgtggaatttctgtctactgccacaacagaggttctgcggaagggagtatgtacaggctggctggccttgttggttgcttcagttcttcagccaaacatacatgcatcccatgaagacagcgggaaagccctggctcctaagatatccatctctcctcgaacaacaaattctttccacttaccagatgacccctcaatccccatcataatggtgggtccaggaaccggcatagccccgtttattgggttcctacaacatagagagaaactccaagaacaacacccagatggaaattttggagcaatgtggttgttttttggctgcaggcataaggatagggattatctattcagaaaagagctcagacatttccttaagcatgggatcttaactcatctaaaggtttccttctcaagagatgctcctgttggggaggaggaagccccagcaaagtatgtgcaagacaacatccagcttcatggccagcaggtggcgagaatcctcctccaggagaacggccatatttatgtgtgtggagatgcaaagaatatggccaaggatgtacatgatgcccttgtgcaaataataagcaaagaggttggagttgaaaaactagaagcaatgaaaaccctggccactttaaaagaagaaaaacgctaccttcaggatatttggtcataaaaccagaaattaaagaaagaggattaagcttttttgactgaaagtactaaaagtcagctttactagtgccaaacctttaaattttcaaaagaaaattttctttcaacatttcttgaaggacatggagtggagattggatcatttaacaatataacaaaacttcctgatttgattttacgtatcttctatctacgcccttcctgtgcctgtgactctccccaaattgccctgttgccttgagctcttctgagctaaggcagccttcagtccctatcagcgcctcctttacttcccagagaacttcacagagactctgtccttccatgcaaaggcttcctgaaatagggagactgactgagtagctcattcttgtgacttacagtgccaacatttaaaaaagtatgaaaatgatttatttttatatgatgtatacccataaagaatgctcatattaatgtacttaaattacacatgtagagcatatctgttatatgtttatgtaactatcaaatggttatttgttactaaagctatatttctgataaaaaatattttaggataattgcctacagagggatttatttttatgatgctggaaatatgaaatgtattttaaaatttcactctggcatatgatttatctatcaccattacttttttttaagtcacaatttcagaattttgggacatttgcattcaatttacaggtaccagtacgtacatattttaatagaaagatacaacctttttattttcactccttttatttctgctgcttggcacatttttgagttttcccacattatttgtctccatgataccactcaagcagtgtgctggacctaaaatactgactttagttagtatccttggatttttagattcccagtgtctaattccctgttataatttgcacaaacaaaacaaaatgttatgataatctttctccactgttctaatatatattgtatttttatttgatagcttgggatttaaaacatctctgttgaaggcttttgatccttttgagaaataaagatctgaaagaaatggcataa

SEQ ID NO: 102895 - DNA, 535 bp, Homo sapiens
  Payload ID: 79
  Gene Symbol: MTRR
  Gene Name: 5-methyltetrahydrofolate-homocysteine methyltransferase reductase
  ENST ID: ENST00000508047
  CDS Start-End: 1-346
agtgcgcgctggcgcaaggttggtggaagtcgcgttgtgcagtttcactgttacatgccttgaagtgatgaggaggtttctgttactatatgctacacagcagggacaggcaaaggccatcgcagaagaaatatgtgagcaagctgtggtacatggattttctgcagatcttcactgtattagtgaatccgataagtatgacctaaaaaccgaaacagctcctcttgttgttgtggtttctaccacgggcaccggagacccacccgacacagcccgcaagtttgttaaggaaatacagaaccaaacactgccggttgatttctttgctcacctgcggtctcggtgattcagaatacacctacttttgcaatggggggaagataattgataaacgacttcaagagcttggagcccggcatttctatgacactggacatgcagatgactgtgtaggtttagaacttgtggttgagccgtggattgctggactctggccagccctcagaaagcattttaggtcaagcagaggacaaga

SEQ ID NO: 102896 - DNA, 478 bp, Homo sapiens
  Payload ID: 79
  Gene Symbol: MTRR
  Gene Name: 5-methyltetrahydrofolate-homocysteine methyltransferase reductase
  ENST ID: ENST00000514220
  CDS Start-End: 1-478
agtgcgcgctggcgcaaggttggtggaagtcgcgttgtgcaggttcgtgcccggctggcgcggcgtgggtctcggtgattcagaatacacctacttttgcaatggggggaagataattgataaacgacttcaagagcttggagcccggcatttctatgacactggacatgcagatgactgtgtaggtttagaacttgtggttgagccgtggattgctggactctggccagccctcagaaagcattttaggtcaagcagaggacaagaggagataagtggcgcactcccggtggcatcacctgcatcctcgaggacagaccttgtgaagtcagagctgctacacattgaatctcaagtcgagcttctgagattcgatgattcaggaagaaaggattctgaggttttgaagcaaaatgcagtgaacagcaaccaatccaatgttgtaattgaagactttgagtcctcacttacccgttcg

SEQ ID NO: 102897 - DNA, 567 bp, Homo sapiens
  Payload ID: 79
  Gene Symbol: MTRR
  Gene Name: 5-methyltetrahydrofolate-homocysteine methyltransferase reductase
  ENST ID: ENST00000502550
  CDS Start-End: 98-567
gtcggctacggttcccggattccggccgctcgccctgcactaatctcctgggagaggcggcccggggcggggtttcactgttacatgccttgaagtgatgaggaggtttctgttactatatgctacacagcagggacaggcaaaggccatcgcagaagaaatatgtgagcaagctgtggtacatggattttctgcagatcttcactgtattagtgaatccgataagtatgacctaaaaaccgaaacagctcctcttgttgttgtggtttctaccacgggcaccggagacccacccgacacagcccgcaagtttgttaaggaaatacagaaccaaacactgccggttgatttctttgctcacctgcggtatgggttactgggtctcggtgattcagaatacacctacttttgcaatggggggaagataattgataaacgacttcaagagcttggagcccggcatttctatgacactggacatgcagatgactgtgtaggtttagaacttgtggttgagccgtggattgctggactctggccagccctcagaaagcattttaggtcaag

SEQ ID NO: 102898 - DNA, 556 bp, Homo sapiens
  Payload ID: 79
  Gene Symbol: MTRR
  Gene Name: 5-methyltetrahydrofolate-homocysteine methyltransferase reductase
  ENST ID: ENST00000503550
  CDS Start-End: 58-198
gtgcaggttcgtgcccggctggcgcggcgtggtttcactgttacatgccttgaagtgatgaggaggtttctgttactatatgctacacagcagggacaggcaaaggccatcgcagaagaaatatgtgagcaagctgtggtacatggattttctgcagatcttcactgtattagtgaatccgataagtgtgaaaaataaggtgaattatttggagccaaattcgatggtgttcatgggcagtaaagcttgtggagtcttacaatatgacctaaaaaccgaaacagctcctcttgttgttgtggtttctaccacgggcaccggagacccacccgacacagcccgcaagtttgttaaggaaatacagaaccaaacactgccggttgatttctttgctcacctgcggtatgggttactgggtctcggtgattcagaatacacctacttttgcaatggggggaagataattgataaacgacttcaagagcttggagcccggcatttctatgacactggacatgcagatgactgtgtaggtttagaacttgtggttgagccg

SEQ ID NO: 102899 - DNA, 3076 bp, Homo sapiens
  Payload ID: 79
  Gene Symbol: MTRR
  Gene Name: 5-methyltetrahydrofolate-homocysteine methyltransferase reductase
  ENST ID: ENST00000511461
  CDS Start-End: 1-244
agtgcgcgctggcgcaaggttggtggaagtcgcgttgtgcagtttcactgttacatgccttgaagtgatgaggaggtttctgttactatatgctacacagcagggacaggcaaaggccatcgcagaagaaatatgtgagcaagctgtggtacatggattttctgcagatcttcactgtattagtgaatccgataaggtctcggtgattcagaatacacctacttttgcaatggggggaagataattgataaacgacttcaagagcttggagcccggcatttctatgacactggacatgcagatgactgtgtaggtttagaacttgtggttgagccgtggattgctggactctggccagccctcagaaagcattttaggtcaagcagaggacaagaggagataagtggcgcactcccggtggcatcacctgcatcctcgaggacagaccttgtgaagtcagagctgctacacattgaatctcaagtcgagcttctgagattcgatgattcaggaagaaaggattctgaggttttgaagcaaaatgcagtgaacagcaaccaatccaatgttgtaattgaagactttgagtcctcacttacccgttcggtacccccactctcacaagcctctctgaatattcctggtttacccccagaatatttacaggtacatctgcaggagtctcttggccaggaggaaagccaagtatctgtgacttcagcagatccagtttttcaagtgccaatttcaaaggcagttcaacttactacgaatgatgccataaaaaccactctgctggtagaattggacatttcaaatacagacttttcctatcagcctggagatgccttcagcgtgatctgccctaacagtgattctgaggtacaaagcctactccaaagactgcagcttgaagataaaagagagcactgcgtccttttgaaaataaaggcagacacaaagaagaaaggagctaccttaccccagcatatacctgcgggatgttctctccagttcatttttacctggtgtcttgaaatccgagcaattcctaaaaaggcatttttgcgagcccttgtggactataccagtgacagtgctgaaaagcgcaggctacaggagctgtgcagtaaacaaggggcagccgattatagccgctttgtacgagatgcctgtgcctgcttgttggatctcctcctcgctttcccttcttgccagccaccactcagtctcctgctcgaacatcttcctaaacttcaacccagaccatattcgtgtgcaagctcaagtttatttcacccaggaaagctccattttgtcttcaacattgtggaatttctgtctactgccacaacagaggttctgcggaagggagtatgtacaggctggctggccttgttggttgcttcagttcttcagccaaacatacatgcatcccatgaagacagcgggaaagccctggctcctaagatatccatctctcctcgaacaacaaattctttccacttaccagatgacccctcaatccccatcataatggtgggtccaggaaccggcatagccccgtttattgggttcctacaacatagagagaaactccaagaacaacacccagatggaaattttggagcaatgtggttgttttttggctgcaggcataaggatagggattatctattcagaaaagagctcagacatttccttaagcatgggatcttaactcatctaaaggtttccttctcaagagatgctcctgttggggaggaggaagccccagcaaagtatgtgcaagacaacatccagcttcatggccagcaggtggcgagaatcctcctccaggagaacggccatatttatgtgtgtggagatgcaaagaatatggccaaggatgtacatgatgcccttgtgcaaataataagcaaagaggttggagttgaaaaactagaagcaatgaaaaccctggccactttaaaagaagaaaaacgctaccttcaggatatttggtcataaaaccagaaattaaagaaagaggattaagcttttttgactgaaagtactaaaagtcagctttactagtgccaaacctttaaattttcaaaagaaaattttctttcaacatttcttgaaggacatggagtggagattggatcatttaacaatataacaaaacttcctgatttgattttacgtatcttctatctacgcccttcctgtgcctgtgactctccccaaattgccctgttgccttgagctcttctgagctaaggcagccttcagtccctatcagcgcctcctttacttcccagagaacttcacagagactctgtccttccatgcaaaggcttcctgaaatagggagactgactgagtagctcattcttgtgacttacagtgccaacatttaaaaaagtatgaaaatgatttatttttatatgatgtatacccataaagaatgctcatattaatgtacttaaattacacatgtagagcatatctgttatatgtttatgtaactatcaaatggttatttgttactaaagctatatttctgataaaaaatattttaggataattgcctacagagggatttatttttatgatgctggaaatatgaaatgtattttaaaatttcactctggcatatgatttatctatcaccattacttttttttaagtcacaatttcagaattttgggacatttgcattcaatttacaggtaccagtacgtacatattttaatagaaagatacaacctttttattttcactccttttatttctgctgcttggcacatttttgagttttcccacattatttgtctccatgataccactcaagcagtgtgctggacctaaaatactgactttagttagtatccttggatttttagattcccagtgtctaattccctgttataatttgcacaaacaaaacaaaatgttatgataatctttctccactgttctaatatatattgtatttttatttgatagcttgggatttaaaacatctctgttgaaggcttttgatccttttgagaaataaagatctgaaagaaatggcataatcttaaaa

SEQ ID NO: 102900 - DNA, 779 bp, Homo sapiens
  Payload ID: 79
  Gene Symbol: MTRR
  Gene Name: 5-methyltetrahydrofolate-homocysteine methyltransferase reductase
  Uniprot ID: Q9UBK8
  ENST ID: ENST00000514369
  CDS Start-End: 48-224
gtgcccggctggcgcggcgtggtttcactgttacatgccttgaagtgatgaggaggtttctgttactatatgctacacagcagggacaggcaaaggccatcgcagaagaaatatgtgagcaagctgtggtacatggattttctgcagatcttcactgtattagtgaatccgataaggtctcggtgattcagaatacacctacttttgcaatggggggaagataattgataaacgacttcaagagcttggagcccggcatttctatgacactggacatgcagatgactgtgtaggaacttgtggttgagccgtggattgctggactctggccagccctcagaaagcattttaggtcaagcagaggacaagaggagataagtggcgcactcccggtggcatcacctgcatcctcgaggacagaccttgtgaagtcagagctgctacacattgaatctcaagtcgagcttctgagattcgatgattcaggaagaaaggattctgaggttttgaagcaaaatgcagtgaacagcaaccaatccaatgttgtaattgaagactttgagtcctcacttacccgttcggtacccccactctcacaagcctctctgaatattcctggtttacccccagaatatttacaggtacatctgcaggagtctcttggccaggaggaaagccaagtatctgtgacttcagcagatccagtttttcaagtgccaatttcaaaggcagttcaacttactacgaatgatgccataaaaaccactctgctggtagaa

SEQ ID NO: 102901 - DNA, 2441 bp, Homo sapiens
  Payload ID: 79
  Gene Symbol: MTRR
  Gene Name: 5-methyltetrahydrofolate-homocysteine methyltransferase reductase
  ENST ID: ENST00000513439
  CDS Start-End: 138-416
ggagctttctattggtcctgggtaccgagcatgggcgctgcgtcagtgcgcgctggcgcaaggttggtggaagtcgcgttgtgcaggttcgtgcccggctggcgcggcgtggtttcactgttacatgccttgaagtgatgaggaggtttctgttactatatgctacacagcagggacaggcaaaggccatcgcagaagaaatatgtgagcaagctgtggtacatggattttctgcagatcttcactgtattagtgaatccgataagtatgacctaaaaaccgaaacagctcctcttgttgttgtggtttctaccacgggcaccggagacccacccgacacagcccgcaagtttgttaaggaaatacagaaccaaacactgccggttgatttctttgctcacctgcggtctcggtgattcagaatacacctacttttgcaatggggggaagataattgataaacgacttcaagagcttggagcccggcatttctatgacactggacatgcagatgactgtgtaggtttagaacttgtggttgagccgtggattgctggactctggccagccctcagaaagcattttaggtcaagcagaggacaagaggagataagtggcgcactcccggtggcatcacctgcatcctcgaggacagaccttgtgaagtcagagctgctacacattgaatctcaagtcgagcttctgagattcgatgattcaggaagaaaggattctgaggttttgaagcaaaatgcagtgaacagcaaccaatccaatgttgtaattgaagactttgagtcctcacttacccgttcggtacccccactctcacaagcctctctgaatattcctggtttacccccagaatatttacaggtacatctgcaggagtctcttggccaggaggaaagccaagtatctgtgacttcagcagatccagtttttcaagtgccaatttcaaaggcagttcaacttactacgaatgatgccataaaaaccactctgctggtagaattggacatttcaaatacagacttttcctatcagcctggagatgccttcagcgtgatctgccctaacagtgattctgaggtacaaagcctactccaaagactgcagcttgaagataaaagagagcactgcgtccttttgaaaataaaggcagacacaaagaagaaaggagctaccttaccccagcatatacctgcgggatgttctctccagttcatttttacctggtgtcttgaaatccgagcaattcctaaaaaggcatttttgcgagcccttgtggactataccagtgacagtgctgaaaagcgcaggctacaggagctgtgcagtaaacaaggggcagccgattatagccgctttgtacgagatgcctgtgcctgcttgttggatctcctcctcgctttcccttcttgccagccaccactcagtctcctgctcgaacatcttcctaaacttcaacccagaccatattcgtgtgcaagctcaagtttatttcacccaggaaagctccattttgtcttcaacattgtggaatttctgtctactgccacaacagaggttctgcggaagggagtatgtacaggctggctggccttgttggttgcttcagttcttcagccaaacatacatgcatcccatgaagacagcgggaaagccctggctcctaagatatccatctctcctcgaacaacaaattctttccacttaccagatgacccctcaatccccatcataatggtgggtccaggaaccggcatagccccgtttattgggttcctacaacatagagagaaactccaagaacaacacccagatggaaattttggagcaatgtggttgttttttggctgcaggcataaggatagggattatctattcagaaaagagctcagacatttccttaagcatgggatcttaactcatctaaaggtttccttctcaagagatgctcctgttggggaggaggaagccccagcaaagtatgtgcaagacaacatccagcttcatggccagcaggtggcgagaatcctcctccaggagaacggccatatttatgtgtgtggagatgcaaagaatatggccaaggatgtacatgatgcccttgtgcaaataataagcaaagaggttggagttgaaaaactagaagcaatgaaaaccctggccactttaaaagaagaaaaacgctaccttcaggatatttggtcataaaaccagaaattaaagaaagaggattaagcttttttgactgaaagtactaaaagtcagctttactagtgccaaacctttaaattttcaaaagaaaattttctttcaacatttcttgaaggacatggagtggagattggatcatttaacaatataacaaaacttcctgatttgattttacgtatcttctatctacgcccttcctgtgcctgtgactctcccca

SEQ ID NO: 102902 - DNA, 546 bp, Homo sapiens
  Payload ID: 79
  Gene Symbol: MTRR
  Gene Name: 5-methyltetrahydrofolate-homocysteine methyltransferase reductase
  Uniprot ID: Q9UBK8
  ENST ID: ENST00000510279
  CDS Start-End: 94-270
agtgcgcgctggcgcaaggttggtggaagtcgcgttgtgcaggttcgtgcccggctggcgcggcgtggtttcactgttacatgccttgaagtgatgaggaggtttctgttactatatgctacacagcagggacaggcaaaggccatcgcagaagaaatatgtgagcaagctgtggtacatggattttctgcagatcttcactgtattagtgaatccgataaggtctcggtgattcagaatacacctacttttgcaatggggggaagataattgataaacgacttcaagagcttggagcccggcatttctatgacactggacatgcagatgactgtgtaggtttagaacttgtggttgagccgtggattgctggactctggccagccctcagaaagcattttaggtcaagcagaggacaagaggagataagtggcgcactcccggtggcatcacctgcatcctcgaggacagaccttgtgaagtcagagctgctacacattgaatctcaagtcgagcttctgagattcgatgattcaggaagaaagg

SEQ ID NO: 102903 - DNA, 628 bp, Homo sapiens
  Payload ID: 79
  Gene Symbol: MTRR
  Gene Name: 5-methyltetrahydrofolate-homocysteine methyltransferase reductase
  ENST ID: ENST00000506877
  CDS Start-End: 506-628
tcccggattccggccgctcgccctgcactaatctcctgggagaggcggcccggggcgggggtgggcagccggcttgcgcccgtggttcccacgcccttcggcctccgggggtcgccgcgggcgcgggctggggctcggacttggcctttggcctttggctttggtgtccccgggagcgtgtccttgggctcggcgtcggcctctgccgcgggaggcccctgggcggcgtggggtctctcctcatgttctgcctttggttctaggcgctttccaggcctagggaaaccgcactcggggacgcggggaactggggaacatgccgggttggggcggcgcgctccggggaacccgggacgttccgagcgcccacccggcgggacgcggccgtgagttctgcccgcggccgtgagctctgcccaccgcctccgcgccgcttccggggctgctggggcccgggcctccgctgagagtcgtgggaagtttcactgttacatgccttgaagtgatgaggaggtttctgttactatatgctacacagcagggacaggcaaaggccatcgcagaagaaatatgtgagcaagctgtggtacatggattttctgcagatcttcactgtattagtgaatcc

SEQ ID NO: 102904 - DNA, 6923 bp, Homo sapiens
  Payload ID: 80
  Gene Symbol: NT5DC1
  Gene Name: 5'-nucleotidase domain containing 1
  Uniprot ID: Q5TFE4
  ENST ID: ENST00000319550
  CDS Start-End: 83-1450
cggtcctgtcccgcagcgtcccgccagccagctccttgcacccttcgcggccgaggcgctccctggtgctccccgcgcagccatggctcagcacttctccctggccgcctgcgacgtggtcggattcgacctggaccacactctgtgtcgctacaacctgcccgagagcgccccgctcatttataatagctttgcccagttcctagttaaggagaaagggtacgataaggaattgctcaatgtgaccccagaggattgggatttctgttgcaaaggtttggcattggatctagaagatgggaacttccttaaacttgcaaataatggcactgttctcagggcaagccatggcaccaagatgatgactccagaggtgctggcagaggcatatggcaagaaagagtggaagcacttcttgtcggacactggaatggcttgccgctcaggaaagtattacttttacgacaactactttgacctgccaggagctcttctgtgtgccagggtggtggactatttaacaaaactgaacaatggtcaaaaaacatttgatttttggaaggatatagttgctgctatacaacacaattataaaatgtcagcttttaaggaaaactgtggaatatattttccagaaataaaaagagatccaggcagatatttacatagttgtcctgaatctgtgaaaaaatggcttcgacagctaaagaatgctgggaaaattcttctgttaattaccagttctcacagtgattactgtagacttctctgcgaatatattcttgggaatgattttacagacctttttgacattgtgattacaaatgcattgaagcctggtttcttctcccacttaccaagtcagagacctttccggacactcgagaatgatgaggagcaggaggcactgccatctctggataaacctggctggtactcccaagggaacgctgtccacctctatgaacttctgaagaaaatgactggcaaacctgaacccaaggttgtttattttggtgacagcatgcattcagatattttcccagctcgtcactatagtaattgggagacagtcctcatcctggaagaactcagaggggatgaaggcacgaggagtcagaggcctgaggagtcagagcctctagagaagaaaggaaaatatgagggaccaaaagcaaaacctttaaatacttcatctaaaaaatggggctctttttttattgattcagttttgggactggaaaatacagaagactccttggtttatacatggtcttgtaagagaatcagtacttacagcactattgcaattccaagtattgaagcaatcgcagaattacctctggactacaaatttacaagattctcttcaagcaattcaaaaacagctggctactatccaaatcctccactggtcttatcaagtgatgagacactgatatccaaataagttgtctttactgaaaaatgaagtgaagacccatatatgcagttaaaaaaaagttaattttcaaaaaatactgtaaaagactttaaggaacaagttttattgaccaataagttgatatttgtccataggtctcctttctataaatcatcttgatgtttaacaactcttattatattaaaatctcagtatcctaaaacttagaaccttattgatattttctatacagtagttttgtgattagaattcacctggggacacacactcacacgcacagtcactcttacacatatgcctagtccagtggttctcaaagtgtgatccatagactaatagcatagcattacctgagaacttgataatgcatatttgcaggccccacgcaaaacctgctgaatcagaagctctgagagtaaggcctaccaatctggtttaacaagcccgtcaggtgattctgatttacagtacagtttgagacccactggctagaacatatcctccagagacttggcttaattggtctgggtaaatatggctgagcgttgttatcttttgttatcttttatatgccctaggaaagtacaaccagaattgaaaaccaactgatctataccagttctttcaattaatagtcaagaacattgagtccagtgagattaagtgatttttgcaggctatgaggttttatgctattcctgtgttctccaaaacaagaaaataaaaagacatgacttattctctgttcatacagcaagtatggaaaaaagatgatctagaagtcaactatctcaacctccattgttacccactaggtttttttctaataatgttaaaggctatttaatttatttaatcaactttaagcattacattctcaattggggacaaaaattggttcttggggtgaaaaaatattagatatggcttgtggacttccaatatcatcctatccaacaaaatcttattccttagtattaatttatctcattgggaagaaatttgtagttaaaactatttaatgtaatttgaatttaatttctgtaattgggaaggagggtaataatgaacaaaaagtttgagaaaaaaatgctttaatgggttttacaggcatgctacaatccaggactgtggtgttctatgtgccgtgtatggtcatattagtagctatttgttgcaagatacttgaagccaaatgtttgcagtataggttcctggctactgtttatgctgtgatttcactctgtctatcatgggcagtattagaaaacacactggttttcactatctggtttacaaacactatcattattttacctggattgaagtgcagaatttggcatatcgatgcatgcaatggaaagaaaaaaaatttgttaaaatttgtaaatgttcagctaaatctcagatatactgtgggatgagtatctcagggtaagtaacaaaaaaacaaacaaaaaaaatcactgaaatttttccctcacagtcagtagctttgtttgatatttaacaataagtatatggtgatatacttgaaatttatgtccagaatgtcactggaatattacaatgagcataaataatcaagcttaggactaaatgaaagatactatctcatgtatgctttaaatagagaatttatttcttttaaaaataaagctatctttccttatccatgtttactctgtaaatggcaaataatacatctttaaatgcttatgaactactgttaatatgaaaaatgagaagtccaaaataagaaataactgcactttttgggccacttgagtagtggcgggggttcaggaggcagaattcagttgtcagaagttctagtattccctttatcattccacctaaagaccctgaacaagttaccaccaaatttggcttcagttttttccatcttatgaaaggaaaagtttagtttatttctaaatttccttcctttctagcagtcagtatttcttctaatgaatgttttttttctgtaattagaaagactataattaggctttttaaatttgtattttcattctttgtaaagagtgccaatggatatgaagattaaaaataatccaaatccataaaaattaaaaagaaaatattaaagaagttatatgaagcaaaaaaattgtataaatggacagaagacatgtaatattcgcatacaggcaaacattcataatctaaaggacacctaaaaatagatgtaagcgagcggaggttttctttgctggccactgtttatcgcatcagcagaggaaagatctgaatgactcagtgaccaaatgttttgtcagaatctggtatttggaatactgaggtagtaaaaactttatctgaaccatgaattacaatctaaaatcaacttctgagtttgttaaactctaaactgaaatcaagtattatttccccaccaatattcatatccaaaaataactttaaatacacacacacacacacacacacacacttttagtgaactggtttgaatgaaaataaatttatataattattttatataacaaatcagcataaaatggaaaatcaaactgcctctctagatataataaccttcactgactgttggaaatacatggatagctttttaaaatcttcagtgttggagtaacagtcccttacatcttttcagcctcttgagtacaagaagactatcataagagttagttccagattggtgcaagactggaatacacttgactgcttttattaaagccatgagggcataccaagtaattcacccagtatggtcttattgccacccttgaaaatccctgggcatggtccagtccacatagaatgaattcagaaaggtgtctcttgttggtctctagaactatcctcagaaataatagtaaaacagtggtcatgagtagcctcactaggctacttcatgtacattatcttgtttactctctatagcaaccatatgagatgtatataattattaaattgtacagatgggaaaattgaaattcagagagattaaatacaatgcttgctctgtgttacactgttagtaagagagcaatacatgaacccaagtttgatcctcaaaatcacacttttaattacttgatacataatgtcttccaatattgaatctagactagggcaaattctcagcccaaaaccacacttcaatttagcaataatgtcgtgctaggacatgagagggattaacattgaagacacagcctctatctttaagtaattcataatttagccaaatatattaaatatctgtaatataaaacttacctaggaaagtaaaatagagatccaagaatcaggagtcctaaagcatataatgagtctgttcctcttggaagccacacatgtcaaggtcatcagtaagcaggcctactctttcttcatattctgggttaatgttcaccttgactgcttggtaaatttccctcactggtgctgaagtaaccaaaatggggaaggagtgatgaaaactcatctttgagtaagcttagtgggaaatagtatatctgggcctatagagaagttgggtcattacttagaatgacaactggaaaagtacatagactgcttgccaatcagtttgttgtaccatgtacctgttcacagactcttttcaaaaaacaagtttattttactttttttggtactttggtcatgttgtttccttggtaaagatcaaagttgaataaagcttaacaaagtttaataaagaaaaggaataaattactatctaaatgtgttaaaagcaatcaccaagtttaatcacttaaaaaataaatattctcttaacagaaatgtcagcggttacttacaatgcttagcagctaaattccatgagtataacgtttaatgtctttttggtacattaaatattcagtgcctttgatgaagggaacaaactgataatttcattcatgtgcagcaaacatcaaggttacataagtaaattcaaatgtgtcaatctgtaactgtatggagtcctgtattaaatcaagtgataaaatgtacccttctcaaaggctattcatgaataagcataaccttcaactgaggcctgaatagtcatgtgtcagtagggtttttgttaacatttgtatgccaaatttattacgatagctgtgatagagtagaagttatgctagcttgaaatcagaaaactcaacagtgagacttgcatcttaggcagttctactttctggacctctgttttctcaactatttaaatggaaataataaaacttgtgttacaaggattatcaaagtaatatgtgcacttcgaagtgcctgacatatctcagatcttttgaggagattgtgaagccagggaataagtaactgaaacaagatcaaatatccatgtcttaaattgtgattctctaggacagggactcagtaattaaaaatataggcaagggtttgttttggtttttgtttgttaatgatgaaaacatttaaggacgttgagttaactggagataaagcagcagcacgaggagtaatggggagaagggcctgatgagaaggtcagagaagccttttataagtgtctggcttgcactgaatgcccagaaatggaagcgcaaggaaagtgttgtgtgaggaccagggtaattatgcagtgtcaccactactcacagggattatggcctgagaaactaaaatgatacttcttaggtgaccagaggatgggagaacttcttaactggtttggaggtccacataaagaataattggggtctagaattaaggaaggaaaagcaatacaaagaaatggagcagggctatagcagtgaaccaattggttggtaagtgaaacctgtaagatgcctaattgagtaatttaatgactaattttattaggctaaacagaacagaaaccatgctaatctgtaacaaataagtggcgccagcctattacagtgaatgctattggttagactaaagcagataataaaccaagtgtaggaaaaatgacattttctgattacatccagaacaggcatagaaaaggtataataaagcttgaaacaggtggctgacaatgcagaaatcaatcactgaactgaaaaggtaaaatgaacattgttagaggaatttaggattaagatggatgtagagcttgcaaaagaaaacctagctctctaatacttaaagttctctagccctagaaaaaaatacctcagcaagaaattgcaagtaataattgcaccaagagtcagcatctattttaactgtatgtttaattaagtttctaactcaaatgagaaattttgggccatttttgtcaaatttttgcttagatggctacaaatacttagcaattcattttcatagattttgtagcatccacaaagccctccttactgcagagaatgcagaggtatttatccaataaactttcatgtaattgctgctatacagcaaaactatcattaccggtaattaaagttgtgatacctga

SEQ ID NO: 102905 - DNA, 667 bp, Homo sapiens
  Payload ID: 80
  Gene Symbol: NT5DC1
  Gene Name: 5'-nucleotidase domain containing 1
  ENST ID: ENST00000419791
  CDS Start-End: 81-667
gtcctgtcccgcagcgtcccgccagccagctccttgcacccttcgcggccgaggcgctccctggtgctccccgcgcagccatggctcagcacttctccctggccgcctgcgacgtggtcggattcgacctggaccacactctgtgtcgctacaacctgcccgagagcgccccgctcatttataatagctttgcccagttcctagttaaggagaaagggtacgataaggaattgctcaatgtgaccccagaggattgggatttctgttgcaaaggtttggcattggatctagaagatgggaacttccttaaacttgcaaataatggcactgttctcagggcaagccatggcaccaagatgatgactccagaggtgctggcagaggcatatggcaagaaagagtggaagcacttcttgtcggacactggaatggcttgccgctcaggaaagtattacttttacgacaactactttgacctgccaggagctcttctgtgtgccagggtggtggactatttaacaaaactgaacaatggtcaaaaaacatttgatttttggaaggatatagttgctgctatacaacacaattataaaatgtcagcttttaaggtaagaagattggccacatccttgcttcaggatatatctacaagtttcatacttattta

SEQ ID NO: 102906 - DNA, 907 bp, Homo sapiens
  Payload ID: 80
  Gene Symbol: NT5DC1
  Gene Name: 5'-nucleotidase domain containing 1
  ENST ID: ENST00000460749
  CDS Start-End: 1-425
acaattataaaatgtcagcttttaaggaaataaaaagagatccaggcagatatttacatagttgtcctgaatctgtgaaaaaatggcttcgacagctaaagaatgctgggaaaattcttctgttaattaccagttctcacagtgattactgtagacttctctgcgaatatattcttgggaatgattttacagacctttttgacattgtgattacaaatgcattgaagcctggtttcttctcccacttaccaagtcagagacctttccggacactcgagaatgatgaggagcaggaggcactgccatctctggataaacctggctggtactcccaagggaacgctgtccacctctatgaacttctgaagaaaatgactggcaaacctgaacccaagaaaatatttaccagaatttctgtgagctgagagatcgtggggtaacagagccctgctccattggctgtcaccatgccacagtctcctggggactcctgagggttaatggatggagcagtctgacttgcagatgctgattctcatatcccttaactctgttttcacatctgaaaattgagaggttgtttattttggtgacagcatgcattcagatattttcccagctcgtcactatagtaattgggagacagtcctcatcctggaagaactcagaggggatgaaggcacgaggagtcagaggcctgaggagtcagagcctctagagaagaaaggaaaatatgagggaccaaaagcaaaacctttaaatacttcatctaaaaaatggggctctttttttattgattcagttttgggactggaaaatacagaagactccttggtttatacatggtcttgtaagagaatcagtacttacagcactattgcaattccaagtattgaagcaatcgcag

SEQ ID NO: 102907 - DNA, 2047 bp, Homo sapiens
  Payload ID: 81
  Gene Symbol: NT5DC2
  Gene Name: 5'-nucleotidase domain containing 2
  Uniprot ID: Q9H857
  ENST ID: ENST00000307076
  CDS Start-End: 402-1964
acacaggcttgatgctcgctcccgtttctacaggaggttttgacggctggatgctgcagggcatcccctcgcctggaggaggttcacttgtggccaggttcccagcacacccacttgctcactggggccctggggacaccgccacactcgagcccatcctacggcctcaatccttaccagtccccaggccatggactgccacactgtaggtcttcaatcaaggttcagtggagtttcgaatgtacacacaccctgaaagacagcgcggccacctcagaaaacaacgcgcgcccagctggctcccctccgacagggcccacggctactgggtcggcctcctccggaccctgagcacagcctggtatgcgtgcgggctcggaatacggatctgagcagaagaaatgcgagtggagagcggttctgcgcaggaaagaggaattttgttggaaagcctgtcgacgttgctagaaaagaccacagcatctcacgaggggcgtgcgccgggaaaccgggagttgacggacctcctgccccccgaggtctgcagtctcctgaacccagcagccatctacgccaacaacgagatcagcctgcgtgacgttgaggtctacggctttgactacgactacaccctggcccagtatgcagacgcactgcaccccgagatcttcagtaccgcccgtgacatcctgatcgagcactacaagtacccagaagggattcggaagtatgactacaaccccagctttgccatccgtggcctccactatgacattcagaagagccttctgatgaagattgacgccttccactacgtgcagctggggacagcctacaggggcctccagcctgtgccagacgaggaggtgattgagctgtatgggggtacccagcacatcccactataccagatgagtggcttctatggcaagggtccctccattaagcagttcatggacatcttctcgctaccggagatggctctgctgtcctgtgtggtggactactttctgggccacagcctggagtttgaccaagcacatctctacaaggacgtgacggacgccatccgagacgtgcatgtgaagggcctcatgtaccagtggatcgagcaggacatggagaagtacatcctgagaggggatgagacgtttgctgtcctgagccgcctggtggcccatgggaaacagctgttcctcatcaccaacagtcctttcagcttcgtagacaaggggatgcggcacatggtgggtcccgattggcgccagctcttcgatgtggtcattgtccaggcagacaagcccagcttcttcactgaccggcgcaagcctttcagaaaactcgatgagaagggctcacttcagtgggaccggatcacccgcttggaaaagggcaagatctatcggcagggaaacctgtttgacttcttacgcttgacggaatggcgtggcccccgcgtgctctacttcggggaccacctctatagtgatctggcggatctcatgctgcggcacggctggcgcacaggcgccatcatccccgagctggagcgtgagatccgcatcatcaacacggagcagtacatgcactcgctgacgtggcagcaggcgctcacggggctgctggagcgcatgcagacctatcaggacgcggagtcgaggcaggtgctggctgcctggatgaaagagcggcaggagctgaggtgcatcaccaaggccctgttcaatgcgcagttcggcagcatcttccgcaccttccacaaccccacctacttctcaaggcgcctcgtgcgcttctctgacctctacatggcctccctcagctgcctgctcaactaccgcgtggacttcaccttctacccacgccgtacgccgctgcagcacgaggcacccctctggatggaccagctctgcaccggctgcatgaagacccccttccttggtgacatggcccacatccgctgagggcacctttattgtctgggacaggccctcagcccctcctgccccatccacccagacaagcaataaaagtggtctcctccctg

SEQ ID NO: 102908 - DNA, 1795 bp, Homo sapiens
  Payload ID: 81
  Gene Symbol: NT5DC2
  Gene Name: 5'-nucleotidase domain containing 2
  Uniprot ID: Q9H857
  ENST ID: ENST00000422318
  CDS Start-End: 41-1714
ggccgagggcagcgcgggcggcgggcggcgcgcggtgggcatggcgggtgcggggctgcgggcggccgctcggcgctggctgctgtgcggaggccacggcgggccgcgagccgcctcgtcctcgccctcctgccctgggtgcggccccccgggtcccggcgcccactgccccggcgtcccgcgctccgcgcccgcccaggcacccaccagcggcgccgacctcagcgcgcacctatgggctcgctaccaggacatgcggagactggtgcacgacctcctgccccccgaggtctgcagtctcctgaacccagcagccatctacgccaacaacgagatcagcctgcgtgacgttgaggtctacggctttgactacgactacaccctggcccagtatgcagacgcactgcaccccgagatcttcagtaccgcccgtgacatcctgatcgagcactacaagtacccagaagggattcggaagtatgactacaaccccagctttgccatccgtggcctccactatgacattcagaagagccttctgatgaagattgacgccttccactacgtgcagctggggacagcctacaggggcctccagcctgtgccagacgaggaggtgattgagctgtatgggggtacccagcacatcccactataccagatgagtggcttctatggcaagggtccctccattaagcagttcatggacatcttctcgctaccggagatggctctgctgtcctgtgtggtggactactttctgggccacagcctggagtttgaccaagcacatctctacaaggacgtgacggacgccatccgagacgtgcatgtgaagggcctcatgtaccagtggatcgagcaggacatggagaagtacatcctgagaggggatgagacgtttgctgtcctgagccgcctggtggcccatgggaaacagctgttcctcatcaccaacagtcctttcagcttcgtagacaaggggatgcggcacatggtgggtcccgattggcgccagctcttcgatgtggtcattgtccaggcagacaagcccagcttcttcactgaccggcgcaagcctttcagaaaactcgatgagaagggctcacttcagtgggaccggatcacccgcttggaaaagggcaagatctatcggcagggaaacctgtttgacttcttacgcttgacggaatggcgtggcccccgcgtgctctacttcggggaccacctctatagtgatctggcggatctcatgctgcggcacggctggcgcacaggcgccatcatccccgagctggagcgtgagatccgcatcatcaacacggagcagtacatgcactcgctgacgtggcagcaggcgctcacggggctgctggagcgcatgcagacctatcaggacgcggagtcgaggcaggtgctggctgcctggatgaaagagcggcaggagctgaggtgcatcaccaaggccctgttcaatgcgcagttcggcagcatcttccgcaccttccacaaccccacctacttctcaaggcgcctcgtgcgcttctctgacctctacatggcctccctcagctgcctgctcaactaccgcgtggacttcaccttctacccacgccgtacgccgctgcagcacgaggcacccctctggatggaccagctctgcaccggctgcatgaagacccccttccttggtgacatggcccacatccgctgagggcacctttattgtctgggacaggccctcagcccctcctgccccatccacccagacaagcaataaaagtggtctcctccc

SEQ ID NO: 102909 - DNA, 772 bp, Homo sapiens
  Payload ID: 81
  Gene Symbol: NT5DC2
  Gene Name: 5'-nucleotidase domain containing 2
  ENST ID: ENST00000489316
  CDS Start-End: 1-772
ccaggacatgcggagactggtgcacgacctcctgccccccgaggtctgcagtctcctgaacccagcagccatctacgccaacaacgagatcagcctgcgtgacgttgaggtctacggctttgactacgactacaccctggcccagtatgcagacgcactgcaccccgagatcttcagtaccgcccgtgacatcctgatcgagcactacaagagccttctgatgaagattgacgccttccactacgtgcagctggggacagcctacaggggcctccagcctgtgccagacgaggagggtccctccattaagcagttcatggacatcttctcgctaccggagatggctctgctgtcctgtgtggtggactactttctgggccacagcctggagtttgaccaagcacatctctacaaggacgtgacggacgccatccgagacgtgcatgtgaagggcctcatgtaccagtggatcgagcaggacatggagaagtacatcctgagaggggatgagacgtttgctgtcctgagccgcctggtggcccatgggaaacagctgttcctcatcaccaacagtcctttcagcttcgtagacaaggggatgcggcacatggtgggtcccgattggcgccagctcttcgatgtggtcattgtccaggcagacaagcccagcttcttcactgaccggcgcaagcctttcagaaaactcgatgagaagggctcacttcagtgggaccggatcacccgcttggaaaagggcaagatctatcggcag

SEQ ID NO: 102910 - DNA, 582 bp, Homo sapiens
  Payload ID: 81
  Gene Symbol: NT5DC2
  Gene Name: 5'-nucleotidase domain containing 2
  ENST ID: ENST00000471522
  CDS Start-End: 326-582
ctagtctggccatacagagccagcccctctgggttggagtcctcagtgcccacatgacctcctgccccccgaggtctgcagtctcctgaacccagcagccatctacgccaacaacgagatcagcctgcgtgacgttgaggtctacggctttgactacgactacaccctggcccagtatgcagacgcactgcaccccgagatcttcagtaccgcccgtgacatcctgatcgagcactacaagtacccagaagggattcggaagtatgactacaaccccagctttgccatccgtggcctccactatgacattcagaagagccttctgatgaagattgacgccttccactacgtgcagctggggacagcctacaggggcctccagcctgtgccagacgaggagggtccctccattaagcagttcatggacatcttctcgctaccggagatggctctgctgtcctgtgtggtggactactttctgggccacagcctggagtttgaccaagcacatctctacaaggacgtgacggacgccatccgagacgtgcatgtgaagggcctcatgtaccagtggatcgagca

SEQ ID NO: 102911 - DNA, 670 bp, Homo sapiens
  Payload ID: 81
  Gene Symbol: NT5DC2
  Gene Name: 5'-nucleotidase domain containing 2
  ENST ID: ENST00000463947
  CDS Start-End: 1-585
tggcgccagctcttcgatgtggtcattgtccaggcagacaagcccagcttcttcactgaccggcgcaagcctttcagaaaactcgatgagaagggctcacttcagtgggaccggatcacccgcttggaaaagggcaagatctatcggcagggaaacctgtttgacttcttacgcttgacggaatggcgtggcccccgcgtgctctacttcggggaccacctctatagtgatctggcggatctcatgctgcggcacggctggcgcacaggcgccatcatccccgagctggagcgtgagatccgcatcatcaacacggagcagtacatgcactcgctgacgtggcagcaggcgctcacggggctgctggagcgcatgcagacctatcaggacgcggagtcgaggcaggtgctggctgcctggatgaaagagcggcaggagctgagctgcctgctcaactaccgcgtggacttcaccttctacccacgccgtacgccgctgcagcacgaggcacccctctggatggaccagctctgcaccggctgcatgaagacccccttccttggtgacatggcccacatccgctgagggcacctttattgtctgggacaggccctcagcccctcctgccccatccacccagacaagcaataaaagtggtctcctccctgtg

SEQ ID NO: 102912 - DNA, 1639 bp, Homo sapiens
  Payload ID: 81
  Gene Symbol: NT5DC2
  Gene Name: 5'-nucleotidase domain containing 2
  Uniprot ID: Q9H857
  ENST ID: ENST00000459839
  CDS Start-End: 41-1639
ggccgagggcagcgcgggcggcgggcggcgcgcggtgggcatggcgggtgcggggctgcgggcggccgctcggcgctggctgctgtgcggaggccacggcgggccgcgagccgcctcgtcctcgccctcctgccctgggtgcggccccccgggtcccggcgcccactgccccggcgtcccgcgctccgcgcccgcccaggcacccaccagcggcgccgacctcagcgcgcacctatgggctcgctaccaggacatgcggagactggtgcacgacctcctgccccccgaggtctgcagtctcctgaacccagcagccatctacgccaacaacgagatcagcctgcgtgacgttgaggtctacggctttgactacgactacaccctggcccagtatgcagacgcactgcaccccgagatcttcagtaccgcccgtgacatcctgatcgagcactacaagagccttctgatgaagattgacgccttccactacgtgcagctggggacagcctacaggggcctccagcctgtgccagacgaggaggtgattgagctgtatgggggtacccagcacatcccactataccagatgagtggcttctatggcaagggtccctccattaagcagttcatggacatcttctcgctaccggagatggctctgctgtcctgtgtggtggactactttctgggccacagcctggagtttgaccaagcacatctctacaaggacgtgacggacgccatccgagacgtgcatgtgaagggcctcatgtaccagtggatcgagcaggacatggagaagtacatcctgagaggggatgagacgtttgctgtcctgagccgcctggtggcccatgggaaacagctgttcctcatcaccaacagtcctttcagcttcgtagacaaggggatgcggcacatggtgggtcccgattggcgccagctcttcgatgtggtcattgtccaggcagacaagcccagcttcttcactgaccggcgcaagcctttcagaaaactcgatgagaagggctcacttcagtgggaccggatcacccgcttggaaaagggcaagatctatcggcagggaaacctgtttgacttcttacgcttgacggaatggcgtggcccccgcgtgctctacttcggggaccacctctatagtgatctggcggatctcatgctgcggcacggctggcgcacaggcgccatcatccccgagctggagcgtgagatccgcatcatcaacacggagcagtacatgcactcgctgacgtggcagcaggcgctcacggggctgctggagcgcatgcagacctatcaggacgcggagtcgaggcaggtgctggctgcctggatgaaagagcggcaggagctgaggtgcatcaccaaggccctgttcaatgcgcagttcggcagcatcttccgcaccttccacaaccccacctacttctcaaggcgcctcgtgcgcttctctgacctctacatggcctccctcagctgcctgctcaactaccgcgtggacttcaccttctacccacgccgtacgccgctgcagcacgaggcacccctctggatggaccagctctgcaccggctgcatgaagacccccttccttggtgacatggcccacatccgctga

SEQ ID NO: 102913 - DNA, 2004 bp, Homo sapiens
  Payload ID: 81
  Gene Symbol: NT5DC2
  Gene Name: 5'-nucleotidase domain containing 2
  ENST ID: ENST00000492555
  CDS Start-End: 354-689
ggatgctgcagggcatcccctcgcctggaggaggttcacttgtggccaggttcccagcacacccacttgctcactggggccctggggacaccgccacactcgagcccatcctacggcctcaatccttaccagtccccaggccatggactgccacactgtaggtcttcaatcaaggttcagtggagtttcgaatgtacacacaccctgaaagacagcgcggccacctcagaaaacaacgcgcgcccagctggctcccctccgacagggcccacggctactgggtcggcctcctccggaccctgagcacagcctggtatgcgtgcgggctcggaatacggatctgagcagaagaaatgcgagtggagagcggttctgcgcaggaaagaggaattttgttggaaagcctgtcgacgttgctagaaaagaccacagcatctcacgaggggcgtgcgccgggaaaccgggagttgacgggtcagtgcggccagttgccgaggtccgaaccaagcgggcgcagtgaccgtggcccacaaccctgcagcgcacggcccagtcacctggttagcggacgtcggctgccctgcaggcccctcggcctcccccagcgtgggcctggcaccgggaagcgcgggaagggctctttatttgttagaccaacctcctgccccccgaggtctgcagtctcctgaacccagcagccatctacgccaacaacgagatcagcctgcgtgacgttgaggtctacggctttgactacgactacaccctggcccagtatgcagacgcactgcaccccgagatcttcagtaccgcccgtgacatcctgatcgagcactacaagtacccagaagggattcggaagtatgactacaaccccagctttgccatccgtggcctccactatgacattcagaagagccttctgatgaagattgacgccttccactacgtgcagctggggacagcctacagggtccctccattaagcagttcatggacatcttctcgctaccggagatggctctgctgtcctgtgtggtggactactttctgggccacagcctggagtttgaccaagcacatctctacaaggacgtgacggacgccatccgagacgtgcatgtgaagggcctcatgtaccagtggatcgagcaggacatggagaagtacatcctgagaggggatgagacgtttgctgtcctgagccgcctggtggcccatgggaaacagctgttcctcatcaccaacagtcctttcagcttcgtagacaaggggatgcggcacatggtgggtcccgattggcgccagctcttcgatgtggtcattgtccaggcagacaagcccagcttcttcactgaccggcgcaagcctttcagaaaactcgatgagaagggctcacttcagtgggaccggatcacccgcttggaaaagggcaagatctatcggcagggaaacctgtttgacttcttacgcttgacggaatggcgtggcccccgcgtgctctacttcggggaccacctctatagtgatctggcggatctcatgctgcggcacggctggcgcacaggcgccatcatccccgagctggagcgtgagatccgcatcatcaacacggagcagtacatgcactcgctgacgtggcagcaggcgctcacggggctgctggagcgcatgcagacctatcaggacgcggagtcgaggcaggtgctggctgcctggatgaaagagcggcaggagctgaggtgcatcaccaaggccctgttcaatgcgcagttcggcagcatcttccgcaccttccacaaccccacctacttctcaaggcgcctcgtgcgcttctctgacctctacatggcctccctcagctgcctgctcaactaccgcgtggacttcaccttctacccacgccgtacgccgctgcagcacgaggcacccctctggatggaccagctctgcaccggctgcatgaagacccccttccttggtgacatggcccacatccgctga

SEQ ID NO: 102914 - DNA, 7207 bp, Homo sapiens
  Payload ID: 82
  Gene Symbol: NT5DC3
  Gene Name: 5'-nucleotidase domain containing 3
  Uniprot ID: Q86UY8
  ENST ID: ENST00000392876
  CDS Start-End: 42-1688
gcagagcggcgcggcggcggtggcggcagcaggcagcaggcatgaccatggcagcggcggcggtggtggcacgcggggccggggcgagggcagcgacagcggcggctttgcggggtggctgcgggaccgcggctcgggggcggccgtgtgcgggccccgcccggcccttgtgcactgcacccgggaccgccccggacatgaagcgctacctgtgggagcgctaccgggaggcgaagagaagcacagaagaattggttccttccattatgagcaacttgttgaatccagatgccattttctcaaacaatgaaatgagcctgtcagacattgaaatctatggcttcgattatgattacaccttggtgttttattcaaagcacctccacacgctgatatttaatgctgcacgggaccttctcatcaatgaacaccggtatccagcagaaatcaggaagtatgagtatgacccaaattttgcaattcgtggacttcattatgatgtacagcgggcagtattaatgaagatcgatgcttttcattatatccagctgggaactgtctacagaggcctcagtgttgtccctgatgaagaagtcattgaaatgtacgaggggtcccacgtgcccttggagcagatgagtgacttttacggaaagagctctcatggaaacacgatgaagcagttcatggacatcttctccctgcccgagatgaccctcctgtcctgcgtgaatgaatacttcctcaagaacaacatcgactatgagcctgtgcatctgtacaaagatgtcaaggattcaattcgagacgtccacatcaaaggaataatgtacagagcaattgaagcagacattgaaaagtacatctgctatgctgagcagacccgcgcagtgttggccaaactggctgatcatggcaagaagatgtttctcatcaccaatagccccagtagctttgtggacaaagggatgagttatatcgttgggaaagactggagggacctgttcgatgtggtcattgttcaggctgagaagccaaacttctttaatgataagcggaggcctttccgaaagatgaatgagaaaggtgtcttactctgggataaaatccataagttgcagaaaggccagatatacaagcagggtaatttatatgaatttttgaagcttactggatggagaggatccagagtgttgtattttggtgaccatatatacagtgacctggcggatttgaccctaaagcatggctggaggactggtgcaatcatcccagagttgagatctgagctcaaaatcatgaacacggagcaatacattcaaaccatgacctggctgcagaccttgactggcttattggaacagatgcaggttcacagagatgctgagtcacagctggttttgcaggagtggaaaaaggaaaggaaggagatgcgagaaatgaccaagagtttcttcaatgcccagtttggaagcctgttccgcacagaccagaacccaacctacttcctaaggcgcctgtcgcgcttcgctgacatctacatggcgtctctgagctgcctcctgaactatgacgtcagccacactttctacccccggaggactccactgcagcacgaactgcccgcctggtcagaaaggccccccaccttcggaacccctctcctgcaggaggcccaggccaagtagccaagggcaaaaactagaaactgtaactgcccctgattgggcaggcatgatggggttgacttcatgtgggtctgagtgttgcttttggaaaagatacagataagccttttgatatttattttgtaccttacggagaataattctcccaatggttaagacaggagctagcagcccacccctccagcctttccccccatgcagggctgaaaggcaagcttcacattggaactctgattttgcctttttgtttactgaggtcctggaacatcaggtttcctgggataggtgagaccacttgatgccatgtctgtattctagcaggtcaagcttgaaacggttcttgactcctccatggaacatttcctgaacatttacgggctatgcattgggaactgcaggggcacagtgatgggcaaagattagctgcttccagaaggctgatttcgtgggctccacaatggtaaaacgctgctgtgagtggcagagaggttccccaggtgatggccagttcccaaatcatttggtactaaggctttgacattctggcacatcacatcaaatagaacacagcctccctggaaggacttaagtgagaaagaacaagagaagctgcaactcctggacccttttgtcctcagtgtgtggttcctgcgtccttccccagcatggaggagggcaggagagaggagatgagagctctggtcaaaacctgccagctagtggaacagccttctgtagagccttctgcaagaaacgagtgggtttgaagaaccaaaacatttgtggtaggtctcccaggagcttgttaaacctggaaacaccacctgagttggtttcatctgctcattggaagaaagaaaatgaaccaggaaaaagcatctttgtcatgaaatgctatgccatgccacccacccagttgaattggaatcctgttaaaacatgagatttaccagaaacagtcctttgtctagatggaaacaaacaagatcctggcttctctctaatgagttaccaactgagaggtgcttggattggccaggggaggaggaagatggccaccacaacttagccatgtccagccttctcttagatttcactcctgtgatgtttgtgcgactatttgggagtttgtgtagtttgttttttttttttttgttttgttttgtttttttttagatgtctaagatgggaaagggcgaaggacattgaagctaaggaatagatatgacctagctaaccaagcttttctcatttccttctgttttgttttgttgagatggagttttgctcttattgcccaggctggagtgcagtggcacaatctcagctcactgcaacctctgcctcccgggttcaagcgattctcctgcctcagcctcccaagtagctgggattacaggcatgcactaccacacccagctaattttgtatttctagtagagatggggtttctccatgttggtcaggctggtctcgaactcccgacctcagataatctgcccgccttggcctcccaaattgctgggattacaggtgtgagccaccgcacctggcctgcttttttcatttctttctaggggcaatgcaagtggcatgtattccttttgttggagggaagaatccttaattgcacctgcatttgtagtatccttcaatgtaaagtgcatatttactgcactctctgagtgctatgggaatgtctgctgttattagttatggggctgctaatactgttttaattgcatatgctatatcaatacttctgttcagattagcctaatctagtattgctaaaactcattttaagcttttgcggtaacttgtatatattcttaaatctaaaggatggcaggaacatgaggggagcttgtggagagtgcttgcttattcaacatttttattgtgataaatgtatgtaaccatctattgatgaaatccaagtctggcattccatgggctccttgccagatggcagaaacttaatgagttatatagcatcctttgtaatgctgcttgttatagttggaatgtacttgtgatatttggctgtatttaactataatggtgaaggtgaccctttagatccaataaggcttctccccatcttctacattttgttatgaacacagtaaggcacagtagtatgttctttttttggaacagggtaggcattttgtttattgtttgcttgcttctaggtgttttcgccatcagggtgtattggaggctgacacttaatgggtgtgtgttgcgcccagaactgctcggtgtcggggttctaaaagaatgcgctggtgttcttggcttcaagtttctgctttggagaagcagattcaggaagtaggtgttgcttaaaaataattcttggtttttatctaatcagatattcattgattacctaccaggtgccagttatagggtgttttgtttactcaagaatgaagtagaactatttttaaaacctgtttccatgagtgttcacgttaggtgacctaagctttgaaggagaaaaacatttttgggtatgaataatgagttttgtaatcaattcccagttagaagaatttcagtctctgggccattgagcttggcagtgttgagatctcccatgtgacagaagcctgacatctgggccaccaaggctcactgactgtgtaccttgcagactgtagacccatgtcgtggcggtaacggggccgaacacagtcattcccatgtgaacgatggaggcacatcccactttattattaatccttgtatatactcagtcaggacagattttaacttgtcgctgtcatgactttttttttttttttttgaggcaaggtctcgctctgttgcccattctggagtgcagtggtgtgatctcggctcactgcaacctcttgcctcccaggttcaagcaattttcgtgcctcagcctcccgagtagctgggactactggtacatgccaccaggcctggccaagttttgtagttttaatagagatggggtttcaccatgttggccaggctggtctcaaactcctagcctcaagtgttctgcccacctcagccttccaaagtgctgggattctgggtgtgagccactgtcatgcctggcctcgtcatgactcttttctctttttttttttttttttttttgagatttagttttgctctttttgcccaggccggagtgcaatggcacgatcttggctcactccaacctccgcctcctgggttcaagtgattctcctgcctcagcctcccgagtagctgggattacaggtgcccaccaccacatccagctaatttttttgtatttttagtagagacggggtttcaccatgttggccaggctggtctcgaactcctgaccttgggtaatccacctgccttggcctcccaaggtgctgggattacaggcatgagccaccgtgcccagcctatcatgactcaactgggatctggcacactgcactgggtgttttgttctctgatgtgcacattgatgaatgcatattggtacaagggaaatgaatctgttttcagccatttaaaaaattgtgttgtaaagcaaacaaaaatagcttgaacatttaaaaattactgtttaatattgtttgactgattttctaagaattatgtgaacaatgatgagtccagggcagcagccatcacaaatatgacagtccagcaaggcccatggaggtccctttggaagggacttgcacagctgattttctttttccagtgttgtttttacgggtgaaacgtggcttttgaaatactttagttgtttggcttagagctcccactttccccctaacatagtgcctgtctgttttttaaaacattttacccttcggcactattttctgctattcccattaatattatgtaacataaaccacttgctactgatttgggcatattacagactacaattactagttgctttgaatgcattggcactcttaattattgcaaaggagaattgaaaagtagtcttgtggtcctagttaatttagctttgggcaaactaagtggcttttcttctgtcctcttctcaaaaggccttttaagcagcagagactgggctaaatactggaactgaattccacttttctgcctgctcatttgctgccaaagaccacttggggctccttgtctagaatgctctaagacgaaatttggccagacacagggttccttgattgttctgttcaactaatagagaacctacattttgccttcttaatatcgactttcttttgtaccaggtttttctttctttcttttttgccttaggagcttagctcaaagttcagctaacctttgacactactagtgtcatttagtaacagtaatctttgacactactagtgtcatttaggagcttagctcaaagttcagctaacctttgacactgctagtgcgttcaagaaagggtagggaatgaagtacccttaatgcagggtcagcaaacttttcctgtaaaaggccagataggaagtatttttggctttttgggctgtttgcttttgctactactactgtgggaatgaccatggtcatggctgtgttccagcacaacttgatttaccaagacaagctgtgggctgtatttggtcctcaggctgtggcttgctagcccctgctctaatggattgtgttggcggcaatggcaagattcccttgctgagaacatgcagatgaataaccttatagctgggatgcagagaggagaaagttctgtaggtaataagtgcactgtattccctctgagctacttcctgggcatagttacatgtatggccagtgtgtgtacttgagccatcaggctcagacacttgttgaatatacctctcattgcattagtttgtaattgtgctagtgctgggtgctgagctcagctgcccggatgacctttccagactgaaggacatactcccctaacagctgggagtgctgctggctggccatttacttccagcccttatgaggagtttcccctgctgaagagccctgcctgccccagatcatacccccttcctgcctgtaacccttaccggctccatatggggtacaaagggctggcctcctcaccccaacttgggaaaccctctggggccatcccagctccagagccccttgtggggtcagtgagacctcattgtggccacattacagcccagtgcctctccctgacaagcctgtacccagccggctcagcccacagcactgtcctatgaaccttcctgcacgccattctccacctcagtatctgctttcggggaacccaacctgcgacagtgcttctgtgtgttttcagtcctgcaggtttgaactctgactttggagacttttccagttatctcgtggaatgacagattgtgcctgtatgatatcaggcacaattaatgcaaattaggcagacctatttattctagatgtgaatttgctatttattttaaatgttgattttatgtgttatgtgactctgaacttattgccaaataaaagtttgaattgta

SEQ ID NO: 102915 - DNA, 799 bp, Homo sapiens
  Payload ID: 82
  Gene Symbol: NT5DC3
  Gene Name: 5'-nucleotidase domain containing 3
  ENST ID: ENST00000415849
  CDS Start-End: 1-406
ggccaaactggctgatcatggcaagaagatgtttctcatcaccaatagccccagtagctttgtggacaaagggatgagttatatcgttgggaaagactggagggacctgttcgatgtggtcattgttcaggctgagaagccaaacttctttaatgataagcggaggcctttccgaaagatgaatgagaaaggtgtcttactctgggataaaatccataagttgcagaaaggccagatatacaagcagggtaatttatatgaatttttgaagcttactggatggagaggatccagagtgttgtattttggtgaccatatatacagtgacctggcgaccatggttaatgattccagacctagtgtttctgcaggggttgtgactcacggcaattatttccagaactgaaactttcttggaatgaaatgatcaaaggctggggccaaataggttttaattaaatgtaattcattgaattcagcttggtgaataactaaccattaccatcaaaaagatttgaccctaaagcatggctggaggactggtgcaatcatcccagagttgagatctgagctcaaaatcatgaacacggagcaatacattcaaaccatgacctggctgcagaccttgactggcttattggaacagatgcaggttcacagagatgctgagtcacagctggttttgcaggagtggaaaaaggaaaggaaggagatgcgagaaatgaccaagagtttcttcaatgcccagtttggaagcctgttccgcacagaccagaacccaacctacttcctaaggcgc

SEQ ID NO: 102916 - DNA, 2172 bp, Homo sapiens
  Payload ID: 82
  Gene Symbol: NT5DC3
  Gene Name: 5'-nucleotidase domain containing 3
  ENST ID: ENST00000447799
  CDS Start-End: 1-368
aaaccatgacctggctgcagaccttgactggcttattggaacagatgcaggttcacagagatgctgagtcacagctggttttgcaggagtggaaaaaggaaaggaaggagatgcgagaaatgaccaagagtttcttcaatgcccagtttggaagcctgttccgcacagaccagaacccaacctacttcctaaggcgcctgtcgcgcttcgctgacatctacatggcgtctctgagctgcctcctgaactatgacgtcagccacactttctacccccggaggactccactgcagcacgaactgcccgcctggtcagaaaggccccccaccttcggaacccctctcctgcaggaggcccaggccaagtagccaagggcaaaaactagaaactgtaactgcccctgattgggcaggcatgatggggttgacttcatgtgggtctgagtgttgcttttggaaaagatacagataagccttttgatatttattttgtaccttacggagaataattctcccaatggttaagacaggagctagcagcccacccctccagcctttccccccatgcagggctgaaaggcaagcttcacattggaactctgattttgcctttttgtttactgaggtcctggaacatcaggtttcctgggataggtgagaccacttgatgccatgtctgtattctagcaggtcaagcttgaaacggttcttgactcctccatggaacatttcctgaacatttacgggctatgcattgggaactgcaggggcacagtgatgggcaaagattagctgcttccagaaggctgatttcgtgggctccacaatggtaaaacgctgctgtgagtggcagagaggttccccaggtgatggccagttcccaaatcatttggtactaaggctttgacattctggcacatcacatcaaatagaacacagcctccctggaaggacttaagtgagaaagaacaagagaagctgcaactcctggacccttttgtcctcagtgtgtggttcctgcgtccttccccagcatggaggagggcaggagagaggagatgagagctctggtcaaaacctgccagctagtggaacagccttctgtagagccttctgcaagaaacgagtgggtttgaagaaccaaaacatttgtggtgttttcgccatcagggtgtattggaggctgacacttaatgggtgtgtgttgcgcccagaactgctcggtgtcggggttctaaaagaatgcgctggtgttcttggcttcaagtttctgctttggagaagcagattcaggaagaatgcagctatatgtaaaccaaaggaagattttgacttcatcttattcagagctttataaggaattgttcgtcatttcagaagagcacatcctccacaggaggccactcctggtatttgagtcgtgaatcacacccgtgtcagtctgcatttctactggtcatttccatgaagattatatagacacacgtatgtaagactgtacttactgtctgagtccattcatgctgctataacaaaataccatatgctgatttagcttataaacaacagaaatttacttctcactgcccaggaggctggcaagtccaagatcaaggtgccggcagatttggtgtctggtgaggcctgtttcctggttcacagatggtgacttctacatggtagataggttgagggagctctctgaggcctctattataagggcactaatccctttcaggatgcccctcccccttaatcacctcccaaaggcttacaggctcacttaccaccctcctagtgttatcaccttgggggtaaagatttcaacacaggaattttgggggtcacaaacattcagaccatagcacttaacctttattttaaaatgtcagccaggtgcagtggctcatgcttgtaatcctagcacttagggaggccaaggtgggaggattgcttgagctcaggaatttgagaccagcctgggtaacatagtgaaaccccatctctacaaaaaataaaccacattagttgggtttggtgatgggtgcctatagcagcagctacttgggaggctgaggctggaggatcacttgagcccagaaggttgaggcttcagtgagccatgattgagctactgcaatccagtctgggtgacagagtgagaccctgtctc

SEQ ID NO: 102917 - DNA, 1767 bp, Homo sapiens
  Payload ID: 83
  Gene Symbol: NT5DC4
  Gene Name: 5'-nucleotidase domain containing 4
  Uniprot ID: Q86YG4
  ENST ID: ENST00000327581
  CDS Start-End: 52-1338
cctcacaccaacaactgcacctactttcttacagggttggatgcctataacatgcctgcatggatttttgtcaaccgcagcctggcgctggggaagattcgttgctttggcttcgacatggactacactctggctgcctacaagtccccagcttatgaggccctgaccttcgagctgctgctggagcgcctggtgtgcattgggtacccgcatgagatcctgcgctacacctacgaccccaccttccccaccaggcggctggtgttcgatgaactctatgggaacctgctgaaggtggacgcccacgggaatgtgctgctgggtgcctatggcttcaccttcctctcggaggcagagatctggagcttctaccccagcaagttcattcagagggacgacctgcagtgtttctacatactcaacatgctcttcaacctgcctgaaacctacctctatgcctgcttggtggacttcttctctggctgctcccgttacactaattgtgacaccggctatcagcatgggaacctcttcatgtccttccgaagcctcttccaggatgtgactgatgccatgaataacatccaccagtcgggctgtctcaagaagaccctggaggacttggagaaatatgtgaagaaggatccacgcctccccatcctgctggggaagatgaaggaggttgggaaagtgtttctggccaccaacagcagctacaactacaccaatgccatcatgacctacctgttcagcatcagtgaggctgaagcctcgggcaggccctggaggtcctactttgacctgatcgtggtggacacgcagaagccccacttctttgcagaggggttggtcctgaggcaggtcaacacggactcaggaaagctccacgtgggcacctacacagggccccaccagcactgtgctgtctactctggaggctcttcggacatggtgtgcgagctgcttggggttcgggggatggacatcctgtacattggggaccacatttttggggacattctcaagtccaagaagcgtcagggctggcggacttgcctggtggttcctgagctgtcctgggagctggacatctgggcccaggagaaggagcggttggaggagctgaagagactggacacgcacctggcagacatataccagcacatggatgggagcagttgtgagctgcaagtcatcaacttcaccaagagagagatccagatgccacatgagtcagttgtggagcaagaacaggccaatctagaccctgcctcctgcctcctctcctgcaaccagaggtctcttccagcaaagagctgtttgtcttctgccatctaggattccaaggaagtgggacactccagtctaggctgttttggtggaaacaacctttgttcagtattgagtagtgcatttacttgtaataatacaaataagtcagctgatgacaatggctgaaagggccaggtcatggaaaccaagaagtgagaagcatttcaggggatgattcttttcttctttttcctatatgtcctggatgatttttactggtacagctagagaagatgaatttaaattcaaaaataatagtaccttctgtggttctgtttgagtcttgcaagatattaagaacaactttccgcaactcttgtattggctggaaggaaggaagaaaacatacaaaatcttaaaaacattcatgcaaaaaatttgctaaggaactttaacttcaaatacatgttttataataaaagtttccttttaaaa

SEQ ID NO: 102918 - DNA, 1107 bp, Homo sapiens
  Payload ID: 84
  Gene Symbol: NT5C1A
  Gene Name: 5'-nucleotidase, cytosolic IA
  Uniprot ID: Q9BXI3
  ENST ID: ENST00000235628
  CDS Start-End: 1-1107
atggaacctgggcagccccgggagccccaggagccccgcgagcccgggccaggagcggagaccgctgcggccccggtctgggaggaagccaagattttctacgacaacctcgcgcccaagaagaaacccaaatcgcccaagcctcagaatgcagtcaccatcgctgtgtcctcccgagccttgtttcgcatggacgaggagcagcagatctacacggagcagggcgtggaggagtacgtgcgctaccagctggaacatgagaacgaacccttcagtcccgggccagccttcccttttgtgaaggctctggaggccgtgaacaggcggctgcgggagctgtaccctgatagtgaggacgtcttcgacatcgtcctcatgactaacaaccatgctcaagtgggtgtccgcctcatcaacagtatcaaccactatgacctgttcatcgagaggttctgcatgacaggtgggaacagcccgatctgctacctcaaggcctatcacaccaacctctacttgtcagccgatgcggaaaaagtgcgagaagccattgatgaggggatcgcagctgccaccatcttcagccccagcagggatgtggttgtgtcccagagtcagctgcgcgtggccttcgatggggacgccgtgctcttctcggacgagtcggagcgcatcgtcaaggcccacgggctggaccgattcttcgagcatgagaaggcccacgagaacaaacctctggctcagggccccttaaagggctttctggaggcactgggtaggttgcagaagaagttctactccaaaggcctgcggctggagtgcccaattcgtacctacttggtgacagcacgcagtgcagccagttccggggcccgggctctcaagaccctgcgcagctggggcctggagacagatgaagccttgttccttgctggagcgcccaagggccctctccttgagaagatccgcccacacatcttctttgatgaccagatgttccatgtggctggggctcaggagatgggcactgtggccgcccatgtgccttatggtgtggcacagacaccccggcggactgcacctgcaaagcaggccccatctgcacagtag

SEQ ID NO: 102919 - DNA, 2678 bp, Homo sapiens
  Payload ID: 85
  Gene Symbol: NT5C1B
  Gene Name: 5'-nucleotidase, cytosolic IB
  Uniprot ID: Q96P26
  ENST ID: ENST00000304081
  CDS Start-End: 102-1754
attctaaatgcaaagctagactgagcaagggaagtgacaggaaatggagctggggagacaaaaatgtggataacaacaaaagaatttcaacaggtaaaaaaatgagtcaaacatctctcaaacagaaaaagaatgagcctggaatgaggtcctcaaaagagagtctagaagcagaaaaaagaaaggaatctgacaaaacaggagttcgtctgagcaatcagggatcacaagaatcatcactgcggaagacagactctcgagggtaccttgtgcgcagtcaatggtctagaatatcccggagcccatccaccaaggctccatccatagatgagcctagaagcaggaacaccagtgctaagctccccagcagctccacgagctcccggactccatccacctccccaagcctgcatgactcctcaccgccgccgctgtccgggcagccctcgctccagccacccgcgtcgccccagctgccccggtcgctggactcgcggcctcccacgcccccagagcccgatcctggctcccggcgcagcaccaaaatgcaagagaatccggaggcctgggcccaaggcatcgtgcgggaaatccgccagacccgggactcgcagccgctggaatattcgcgcacgtcccccaccgagtggaagtcctccagccagcgcagggggatctaccccgcctccacccagctggaccgcaactctctgtccgagcagcagcagcagcagcgggaggacgaggacgactacgaggctgcctactgggcatccatgaggtcgttctacgagaagaacccgagctgctcgcgcccctggccgcccaaacccaagaacgccatcaccattgctctctcatcctgcgcgctcttcaacatggtggacggcaggaaaatctacgagcaagagggtctggaaaagtacatggagtatcagctcaccaatgagaacgtcatcctgaccccgggcccggcgttccgcttcgtcaaggcactacagtatgtcaatgctagactccgtgatctatatcctgatgaacaggacttatttgatattgtactgatgactaataaccatgcccaagtgggagtgcggcttataaacagcgtcaatcactacggcttactgattgaccgcttctgtctgaccgggggaaaagaccccattggctatttgaaggcatatcttaccaacttgtatattgctgcagattctgaaaaagtgcaagaggcaatacaagaaggtattgcctctgcgacaatgtttgatggagccaaagacatggcttactgtgacactcagctccgtgtagcctttgatggggatgctgtcctcttctctgatgagtctgaacattttaccaaggagcatgggctcgacaaattcttccagtatgatacattatgtgaaagtaagcctcttgctcagggtcccctaaaaggctttctggaagatttaggcagactgcaaaagaagttctatgccaaaaatgaacggttactttgtcctatcaggacctacctggttacagctaggagtgcagccagttcaggcgcccgtgtgctgaagacccttcgacgctggggtctagagatagacgaagctcttttccttgctggagcccccaaaagtcccatcttggtgaagatccggccccacatcttctttgatgaccacatgttccacattgaaggggcacagaggttaggttccatcgcagcttatggctttaataaaaaattcagtagttaggggcagggaggagaaataaagtggtgatagtctggtgttacagaagccacttcttttggctctctaggataattagataggtatttcagaaaattggaccttaaaactttgcttctttggaaaggttttctcctgattttttggaaaaccttttgaaccctcaagttaccatcaaactacttctctttgaactaccaatactgttgaatgccattacacctatctctgtgtaagtcataatgatgactctttaggataagtttagaacttgaatatttgcatgcttaaggcactgttttagaagcttacttagttttataaacactgctcatttttggatgtttgtagataacaatgaattgttacccatcagcattgtagaatagtgtcttcaaaggtagaaggagtatggttaagcacactcttgaaaactggagctttgtattctgtgactgctatggctagctttgtaaccaaagcaaaatgagaatttcactctacctgcatgagtataacaattttgatactgctcatttagaaataaatcatctggttgttcctccagggtactttctaagataagccttaaacagaaacccctaagaaaggttctctgaaaattatttggtgggttaaatgcctctgatccacagagtttcatatttgaagtctccggctttgggcctggcaggctggcacatccatatttgtatggaaaaaaaaaaaaaagaccctacgctaccacttcaaaaagtgacatgaagtgtagtatcctggcccttcattgtcattctctcatgatttttgttttgttttcaacaaaaattggttggtcattaaatatatcatatgttaggcacagtgacctggttattttcacatgttacttcattttcttatcaaattaaatgtttgtgacatagt

SEQ ID NO: 102920 - DNA, 2475 bp, Homo sapiens
  Payload ID: 85
  Gene Symbol: NT5C1B
  Gene Name: 5'-nucleotidase, cytosolic IB
  Uniprot ID: Q96P26
  ENST ID: ENST00000359846
  CDS Start-End: 79-1911
agcaagggaagtgacaggaaatggagctggggagacaaaaatgtggataacaacaaaagaatttcaacaggtaaaaaaatgagtcaaacatctctcaaacagaaaaagaatgagcctggaatgaggtcctcaaaagagagtctagaagcagaaaaaagaaaggaatctgacaaaacaggagttcgtctgagcaatcagatgaggcgtgcagtcaatccgaatcactcgctgagatgttgccccttccagggtcactcgtcgtgtagacgctgcctttgtgcagctgagggaacagcccttggcccctgccacacaatacgtatttatattcacatgtgcctgttgtgggagcagggccagcagatcaccatgatgaggggatcacaagaatcatcactgcggaagacagactctcgagggtaccttgtgcgcagtcaatggtctagaatatcccggagcccatccaccaaggctccatccatagatgagcctagaagcaggaacaccagtgctaagctccccagcagctccacgagctcccggactccatccacctccccaagcctgcatgactcctcaccgccgccgctgtccgggcagccctcgctccagccacccgcgtcgccccagctgccccggtcgctggactcgcggcctcccacgcccccagagcccgatcctggctcccggcgcagcaccaaaatgcaagagaatccggaggcctgggcccaaggcatcgtgcgggaaatccgccagacccgggactcgcagccgctggaatattcgcgcacgtcccccaccgagtggaagtcctccagccagcgcagggggatctaccccgcctccacccagctggaccgcaactctctgtccgagcagcagcagcagcagcgggaggacgaggacgactacgaggctgcctactgggcatccatgaggtcgttctacgagaagaacccgagctgctcgcgcccctggccgcccaaacccaagaacgccatcaccattgctctctcatcctgcgcgctcttcaacatggtggacggcaggaaaatctacgagcaagagggtctggaaaagtacatggagtatcagctcaccaatgagaacgtcatcctgaccccgggcccggcgttccgcttcgtcaaggcactacagtatgtcaatgctagactccgtgatctatatcctgatgaacaggacttatttgatattgtactgatgactaataaccatgcccaagtgggagtgcggcttataaacagcgtcaatcactacggcttactgattgaccgcttctgtctgaccgggggaaaagaccccattggctatttgaaggcatatcttaccaacttgtatattgctgcagattctgaaaaagtgcaagaggcaatacaagaaggtattgcctctgcgacaatgtttgatggagccaaagacatggcttactgtgacactcagctccgtgtagcctttgatggggatgctgtcctcttctctgatgagtctgaacattttaccaaggagcatgggctcgacaaattcttccagtatgatacattatgtgaaagtaagcctcttgctcagggtcccctaaaaggctttctggaagatttaggcagactgcaaaagaagttctatgccaaaaatgaacggttactttgtcctatcaggacctacctggttacagctaggagtgcagccagttcaggcgcccgtgtgctgaagacccttcgacgctggggtctagagatagacgaagctcttttccttgctggagcccccaaaagtcccatcttggtgaagatccggccccacatcttctttgatgaccacatgttccacattgaaggggcacagaggttaggttccatcgcagcttatggctttaataaaaaattcagtagttaggggcagggaggagaaataaagtggtgatagtctggtgttacagaagccacttcttttggctctctaggataattagataggtatttcagaaaattggaccttaaaactttgcttctttggaaaggttttctcctgattttttggaaaaccttttgaaccctcaagttaccatcaaactacttctctttgaactaccaatactgttgaatgccattacacctatctctgtgtaagtcataatgatgactctttaggataagtttagaacttgaatatttgcatgcttaaggcactgttttagaagcttacttagttttataaacactgctcatttttggatgtttgtagataacaatgaattgttacccatcagcattgtagaatagtgtcttcaaaggtagaaggagtatggttaagcacactcttgaaaactggagctttgtattctgtgactgctatggctagctttgtaaccaaagcaaaatgagaatttcactctacctgcatgagtataacaattttgatactgctcatttagaaataaatcatctggttgttcctcca

SEQ ID NO: 102921 - DNA, 2554 bp, Homo sapiens
  Payload ID: 85
  Gene Symbol: NT5C1B
  Gene Name: 5'-nucleotidase, cytosolic IB
  ENST ID: ENST00000406971
  CDS Start-End: 105-716
gacattctaaatgcaaagctagactgagcaagggaagtgacaggaaatggagctggggagacaaaaatgtggataacaacaaaagaatttcaacaggtaaaaaaatgagtcaaacatctctcaaacagaaaaagaatgagcctggaatgaggtcctcaaaagagagtctagaagcagaaaaaagaaaggaatctgacaaaacaggagttcgtctgagcaatcagggatcacaagaatcatcactgcggaagacagactctcgagggtaccttgtgcgcagtcaatggtctagaatatcccggagcccatccaccaaggctccatccatagatgagcctagaagcaggaacaccagtgctaaggtagagctccccagcagccctcgctccagccacccgcgtcgccccagctgccccggtcgctggactcgcggcctcccacgcccccagagcccgatcctggctcccggcgcagcaccaaaatgcaagagaatccggaggcctgggcccaaggcatcgtgcgggaaatccgccagacccgggactcgcagccgctggaatattcgcgcacgtcccccaccgagtggaagtcctccagccagcgcagggggatctaccccgcctccacccagctggaccgcaactctctgtccgagcagcagcagcagcagcgggaggacgaggacgactacgaggctgcctactgggcatccatgaggtcgttctacgagaagaacccgagctgctcgcgcccctggccgcccaaacccaagaacgccatcaccattgctctctcatcctgcgcgctcttcaacatggtggacggcaggaaaatctacgagcaagagggtctggaaaagtacatggagtatcagctcaccaatgagaacgtcatcctgaccccgggcccggcgttccgcttcgtcaaggcactacagtatgtcaatgctagactccgtgatctatatcctgatgaacaggacttatttgatattgtactgatgactaataaccatgcccaagtgggagtgcggcttataaacagcgtcaatcactacggcttactgattgaccgcttctgtctgaccgggggaaaagaccccattggctatttgaaggcatatcttaccaacttgtatattgctgcagattctgaaaaagtgcaagaggcaatacaagaaggtattgcctctgcgacaatgtttgatggagccaaagacatggcttactgtgacactcagctccgtgtagcctttgatggggatgctgtcctcttctctgatgagtctgaacattttaccaaggagcatgggctcgacaaattcttccagtatgatacattatgtgaaagtaagcctcttgctcagggtcccctaaaaggctttctggaagatttaggcagactgcaaaagaagttctatgccaaaaatgaacggttactttgtcctatcaggacctacctggttacagctaggagtgcagccagttcaggcgcccgtgtgctgaagacccttcgacgctggggtctagagatagacgaagctcttttccttgctggagcccccaaaagtcccatcttggtgaagatccggccccacatcttctttgatgaccacatgttccacattgaaggggcacagaggttaggttccatcgcagcttatggctttaataaaaaattcagtagttaggggcagggaggagaaataaagtggtgatagtctggtgttacagaagccacttcttttggctctctaggataattagataggtatttcagaaaattggaccttaaaactttgcttctttggaaaggttttctcctgattttttggaaaaccttttgaaccctcaagttaccatcaaactacttctctttgaactaccaatactgttgaatgccattacacctatctctgtgtaagtcataatgatgactctttaggataagtttagaacttgaatatttgcatgcttaaggcactgttttagaagcttacttagttttataaacactgctcatttttggatgtttgtagataacaatgaattgttacccatcagcattgtagaatagtgtcttcaaaggtagaaggagtatggttaagcacactcttgaaaactggagctttgtattctgtgactgctatggctagctttgtaaccaaagcaaaatgagaatttcactctacctgcatgagtataacaattttgatactgctcatttagaaataaatcatctggttgttcctccagggtactttctaagataagccttaaacagaaacccctaagaaaggttctctgaaaattatttggtgggttaaatgcctctgatccacagagtttcatatttgaagtctccggctttgggcctggcaggctggcacatccatatttgtatggaaaaaaaaaaaaaagaccctacgctaccacttcaaaaagtgacatgaagtgtagtatcctggcccttcattgtcattctctcatgatttttgttttgttttcaacaaaaattggttggtcattaaatatatcatatgttaggcacagtg

SEQ ID NO: 102922 - DNA, 914 bp, Homo sapiens
  Payload ID: 85
  Gene Symbol: NT5C1B
  Gene Name: 5'-nucleotidase, cytosolic IB
  ENST ID: ENST00000418427
  CDS Start-End: 1-796
gaggaagggactccagcccacagccctagatttggcactacagtatgtcaatgctagactccgtgatctatatcctgatgaacaggacttatttgatattgtactgatgactaataaccatgcccaagtgggagtgcggcttataaacagcgtcaatcactacggcttactgattgaccgcttctgtctgaccgggggaaaagaccccattggctatttgaaggcatatcttaccaacttgtatattgctgcagattctgaaaaagtgcaagaggcaatacaagaaggtattgcctctgcgacaatgtttgatggagccaaagacatggcttactgtgacactcagctccgtgtagcctttgatggggatgctgtcctcttctctgatgagtctgaacattttaccaaggagcatgggctcgacaaattcttccagtatgatacattatgtgaaagtaagcctcttgctcagggtcccctaaaaggctttctggaagatttaggcagactgcaaaagaagttctatgccaaaaatgaacggttactttgtcctatcaggacctacctggttacagctaggagtgcagccagttcaggcgcccgtgtgctgaagacccttcgacgctggggtctagagatagacgaagctcttttccttgctggagcccccaaaagtcccatcttggtgaagatccggccccacatcttctttgatgaccacatgttccacattgaaggggcacagaggttaggttccatcgcagcttatggctttaataaaaaattcagtagttaggggcagggaggagaaataaagtggtgatagtctggtgttacagaagccacttcttttggctctctaggataattagataggtatttcagaaaattggaccttaaaactttgcttcttt

SEQ ID NO: 102923 - DNA, 685 bp, Homo sapiens
  Payload ID: 85
  Gene Symbol: NT5C1B
  Gene Name: 5'-nucleotidase, cytosolic IB
  ENST ID: ENST00000416783
  CDS Start-End: 69-685
gtgacaggaaatggagctggggagacaaaaatgtggataacaacaaaagaatttcaacaggtaaaaaaatgagtcaaacatctctcaaacagaaaaagaatgagcctggaatgaggtcctcaaaagagagtctagaagcagaaaaaagaaaggaatctgacaaaacaggagttcgtctgagcaatcagatgaggcgtgcagtcaatccgaatcactcgctgagatgttgccccttccagggtcactcgtcgtgtagacgctgcctttgtgcagctgagggaacagcccttggcccctgccacacaatacgtatttatattcacatgtgcctgttgtgggagcagggccagcagatcaccatgatgagggtgagcagagatcacactaccgattctggaggggaaccacagacaacctggggatcacaagaatcatcactgcggaagacagactctcgagggtaccttgtgcgcagtcaatggtctagaatatcccggagcccatccaccaaggctccatccatagatgagcctagaagcaggaacaccagtgctaagctccccagcagctccacgagctcccggactccatccacctccccaagcctgcatgactcctcaccgccgccgctgtccgggcagccctcgctccagccacccgcgtcgccccagctgccccggtcgct

SEQ ID NO: 102924 - DNA, 3435 bp, Homo sapiens
  Payload ID: 86
  Gene Symbol: NT5C2
  Gene Name: 5'-nucleotidase, cytosolic II
  Uniprot ID: P49902
  ENST ID: ENST00000343289
  CDS Start-End: 96-1781
gggcggggagggcgcgcgttgaggcggctgcggcagttgcgcgctgggattgttgcggtgcgctggagccgaatacaaaatacagttaaaataaaatgtcaacctcctggagtgatcggttacagaatgcagcagatatgcctgctaacatggataagcatgccctgaaaaagtatcgtcgagaagcctatcatcgggtgtttgtgaaccgaagtttagcaatggaaaagataaagtgttttggttttgatatggattatacccttgctgtgtacaagtccccagagtatgagtcccttggttttgagcttactgtggagagattagtttctattggctatccccaggagttgctcagctttgcttatgattctacattccctaccaggggacttgtctttgacacactgtatggaaatcttttgaaagtcgatgcctatggaaacctcttggtctgtgcacatggatttaactttataaggggaccagaaactagagaacagtatccaaataaatttatccagcgagatgatactgaaagattttacattctgaacacactattcaacctaccagagacctacctgttggcctgcctagtagatttttttactaattgtcccagatataccagttgtgaaacaggatttaaagatggggacctcttcatgtcctaccggagtatgttccaggatgtaagagatgctgttgactgggttcattacaagggctcccttaaggaaaagacagttgaaaatcttgagaagtatgtagtcaaagatggaaaactgcctttgcttctgagccggatgaaggaagtagggaaagtatttcttgctaccaacagtgactataaatatacagataaaattatgacttacctgtttgacttcccacatggccccaagcctgggagctcccatcgaccatggcagtcctactttgacttgatcttggtggatgcacggaaaccactcttttttggagaaggcacagtactgcgtcaggtggatactaaaactggcaagctgaaaattggtacctacacagggcccctacagcatggtatcgtctactcaggaggttcttctgatacgatctgtgacctgttgggagccaagggaaaagacattttgtatattggagatcacatttttggggacattttaaaatcaaagaaacggcaagggtggcgaacttttttggtgattcctgaactcgcacaggagctacatgtctggactgacaagagttcacttttcgaagaacttcagagcttggatattttcttggctgaactctacaagcatcttgacagcagtagcaatgagcgtccagacatcagttccatccagagacgtattaagaaagtaactcatgacatggacatgtgctatgggatgatgggaagcctgtttcgcagtggctcccggcagaccctttttgccagtcaagtgatgcgttatgctgacctctatgcagcatctttcatcaacctgctgtattaccctttcagctacctcttcagggctgcccatgtcttgatgcctcatgaatcaacggtggagcacacacacgtagatatcaatgagatggagtctcctcttgccacccggaaccgcacatcagtggatttcaaagacactgactacaagcggcaccagctgacacggtcaattagtgagattaaacctcccaacctcttcccactggccccccaggaaattacacactgccatgacgaagatgatgatgaagaggaggaggaggaggaagaataaggaggaaaaccaaaaccccaagcacccattaaacaagtcctggcaggactcacaggaacaaacgaggtccctgttagggttctactcgggggagggagggggctccatgaaaggtacgtctgaaaagtttctgaagattttattatcatagatacttgttttggttttgtgtatctgtactctctgcagatggtccaaaattgtaatggagtctgtattagaagaaaataagggtaaaatcaggctgaactgcatgtatatggctccactgtggcttgtgacacttttaaaatcatccgtatgtcagtgtatctggatacacgaggaaaaggaaagagtctcagagtggaacaaagagtgggaagaggtgatctgtaatgttacaaattgtgctattactccaaggtccaacttttccagtgcattacatggtattgtatatcagtggagaaatgtattatttccatgatcaaatgtagtctctgttaaggtcaagttttcttttataagcctttaattcatcctcagtgactctggcaaggctgcttctctatcactggctttgcacagaagtatgctctacttgcgttgctttagggcaggattctattttgagggaaaagacagtatccttattaccttttgtttgtttaatagcacaaatgcttatttgttatccaaaaacaacctccttcttatctgtgataaatctatagaaagaatttagctgcaagtggacaaaggaacaagcccccagaaaagaaagggaagaactgccttcttatactacagaacatgcattagtgtgggctatatagctgtggctcatgctacccaattccagatttctttgtcctctaagagttgattgctgtatattaaaattgaacatcagaggatgggaagagggctctgtaagccagaaccttactaaagtagagggcacaatcagtgtgaataaattcacttcagaatctcaagtcaaggccaggcacggcggctcacgcctgtaatcccagcactttgggaggccgagacaggcggatcacctgaggtcgggagttcgagaccagccttaccaacatggagaaaccccatctctactaaaaatacaaaattacctgggcgtggtggtgcatgcctgtaatcccatcatctactcaggaggctgaggcaggagaattgcttgaacccaggaggcggaggttgcagtgagccaggattgtgccattgcactccagcctgggcaacaagaacaaaactccatctcaaaaaataaaaatcccaatcccaagtcgaaatcacctcttgttttaaacaagaatgaatcattactgtgtatgttagggtattaaaactgtttcaccagtacagtgaaagttgtttcaacattttaaacaaacagtggttatagactctttctttaaccattgtatattttcttccattcttgtcattggtcaataggggagggtagattagctgctccagaattcaataaagtgtaatatttctaacggtgactttgacctattctgtagtacaactgtaatagctattggtcttcaagtgggtttagatttggtgacatcagtttgatattctcttaaaggaaataaatattcaagaactgattatgttctaacatgattat

SEQ ID NO: 102925 - DNA, 3365 bp, Homo sapiens
  Payload ID: 86
  Gene Symbol: NT5C2
  Gene Name: 5'-nucleotidase, cytosolic II
  Uniprot ID: P49902
  ENST ID: ENST00000404739
  CDS Start-End: 25-1710
aatacaaaatacagttaaaataaaatgtcaacctcctggagtgatcggttacagaatgcagcagatatgcctgctaacatggataagcatgccctgaaaaagtatcgtcgagaagcctatcatcgggtgtttgtgaaccgaagtttagcaatggaaaagataaagtgttttggttttgatatggattatacccttgctgtgtacaagtccccagagtatgagtcccttggttttgagcttactgtggagagattagtttctattggctatccccaggagttgctcagctttgcttatgattctacattccctaccaggggacttgtctttgacacactgtatggaaatcttttgaaagtcgatgcctatggaaacctcttggtctgtgcacatggatttaactttataaggggaccagaaactagagaacagtatccaaataaatttatccagcgagatgatactgaaagattttacattctgaacacactattcaacctaccagagacctacctgttggcctgcctagtagatttttttactaattgtcccagatataccagttgtgaaacaggatttaaagatggggacctcttcatgtcctaccggagtatgttccaggatgtaagagatgctgttgactgggttcattacaagggctcccttaaggaaaagacagttgaaaatcttgagaagtatgtagtcaaagatggaaaactgcctttgcttctgagccggatgaaggaagtagggaaagtatttcttgctaccaacagtgactataaatatacagataaaattatgacttacctgtttgacttcccacatggccccaagcctgggagctcccatcgaccatggcagtcctactttgacttgatcttggtggatgcacggaaaccactcttttttggagaaggcacagtactgcgtcaggtggatactaaaactggcaagctgaaaattggtacctacacagggcccctacagcatggtatcgtctactcaggaggttcttctgatacgatctgtgacctgttgggagccaagggaaaagacattttgtatattggagatcacatttttggggacattttaaaatcaaagaaacggcaagggtggcgaacttttttggtgattcctgaactcgcacaggagctacatgtctggactgacaagagttcacttttcgaagaacttcagagcttggatattttcttggctgaactctacaagcatcttgacagcagtagcaatgagcgtccagacatcagttccatccagagacgtattaagaaagtaactcatgacatggacatgtgctatgggatgatgggaagcctgtttcgcagtggctcccggcagaccctttttgccagtcaagtgatgcgttatgctgacctctatgcagcatctttcatcaacctgctgtattaccctttcagctacctcttcagggctgcccatgtcttgatgcctcatgaatcaacggtggagcacacacacgtagatatcaatgagatggagtctcctcttgccacccggaaccgcacatcagtggatttcaaagacactgactacaagcggcaccagctgacacggtcaattagtgagattaaacctcccaacctcttcccactggccccccaggaaattacacactgccatgacgaagatgatgatgaagaggaggaggaggaggaagaataaggaggaaaaccaaaaccccaagcacccattaaacaagtcctggcaggactcacaggaacaaacgaggtccctgttagggttctactcgggggagggagggggctccatgaaaggtacgtctgaaaagtttctgaagattttattatcatagatacttgttttggttttgtgtatctgtactctctgcagatggtccaaaattgtaatggagtctgtattagaagaaaataagggtaaaatcaggctgaactgcatgtatatggctccactgtggcttgtgacacttttaaaatcatccgtatgtcagtgtatctggatacacgaggaaaaggaaagagtctcagagtggaacaaagagtgggaagaggtgatctgtaatgttacaaattgtgctattactccaaggtccaacttttccagtgcattacatggtattgtatatcagtggagaaatgtattatttccatgatcaaatgtagtctctgttaaggtcaagttttcttttataagcctttaattcatcctcagtgactctggcaaggctgcttctctatcactggctttgcacagaagtatgctctacttgcgttgctttagggcaggattctattttgagggaaaagacagtatccttattaccttttgtttgtttaatagcacaaatgcttatttgttatccaaaaacaacctccttcttatctgtgataaatctatagaaagaatttagctgcaagtggacaaaggaacaagcccccagaaaagaaagggaagaactgccttcttatactacagaacatgcattagtgtgggctatatagctgtggctcatgctacccaattccagatttctttgtcctctaagagttgattgctgtatattaaaattgaacatcagaggatgggaagagggctctgtaagccagaaccttactaaagtagagggcacaatcagtgtgaataaattcacttcagaatctcaagtcaaggccaggcacggcggctcacgcctgtaatcccagcactttgggaggccgagacaggcggatcacctgaggtcgggagttcgagaccagccttaccaacatggagaaaccccatctctactaaaaatacaaaattacctgggcgtggtggtgcatgcctgtaatcccatcatctactcaggaggctgaggcaggagaattgcttgaacccaggaggcggaggttgcagtgagccaggattgtgccattgcactccagcctgggcaacaagaacaaaactccatctcaaaaaataaaaatcccaatcccaagtcgaaatcacctcttgttttaaacaagaatgaatcattactgtgtatgttagggtattaaaactgtttcaccagtacagtgaaagttgtttcaacattttaaacaaacagtggttatagactctttctttaaccattgtatattttcttccattcttgtcattggtcaataggggagggtagattagctgctccagaattcaataaagtgtaatatttctaacggtgactttgacctattctgtagtacaactgtaatagctattggtcttcaagtgggtttagatttggtgacatcagtttgatattctcttaaaggaaataaatattcaagaactgattatgttctaacatgattata

SEQ ID NO: 102926 - DNA, 856 bp, Homo sapiens
  Payload ID: 86
  Gene Symbol: NT5C2
  Gene Name: 5'-nucleotidase, cytosolic II
  ENST ID: ENST00000452156
  CDS Start-End: 62-856
agttgcgcgctgggattgttgcggtgcgctggagccgaatacaaaatacagttaaaataaaatgtcaacctcctggagtgatcggttacagaatgcagcagatatgcctgctaacatggataagcatgccctgaaaaagtatcgtcgagaagcctatcatcgggtgtttgtgaaccgaagtttagcaatggaaaagataaagtgttttggttttgatatggattatacccttgctgtgtacaagtccccagagtatgagtcccttggttttgagcttactgtggagagattagtttctattggctatccccaggagttgctcagctttgcttatgattctacattccctaccaggggacttgtctttgacacactgtatggaaatcttttgaaagtcgatgcctatggaaacctcttggtctgtgcacatggatttaactttataaggggttctcaggtagctgttcagaagagaccagaaactagagaacagtatccaaataaatttatccagcgagatgatactgaaagattttacattctgaacacactattcaacctaccagagacctacctgttggcctgcctagtagatttttttactaattgtcccagatataccagttgtgaaacaggatttaaagatggggacctcttcatgtcctaccggagtatgttccaggatgtaagagatgctgttgactgggttcattacaagggctcccttaaggaaaagacagttgaaaatcttgagaagtatgtagtcaaagatggaaaactgcctttgcttctgagccggatgaaggaagtagggaaagtatttcttgctaccaacagtgactataaatatacagat

SEQ ID NO: 102927 - DNA, 440 bp, Homo sapiens
  Payload ID: 86
  Gene Symbol: NT5C2
  Gene Name: 5'-nucleotidase, cytosolic II
  ENST ID: ENST00000421281
  CDS Start-End: 1-440
gtactgcgtcaggtggatactaaaactggcaagctgaaaattggtacctacacagggcccctacagcatggtatcgtctactcaggaggttcttctgatacgatctgtgacctgttgggagccaagggaaaagacattttgtatattggagatcacatttttggggacattttaaaatcaaagaaacggcaagggtggcgaacttttttggtgattcctgaactcgcacaggagctacatgtctggactgacaagagttcacttttcgaagaacttcagagcttggatattttcttggctgaactctacaagcatcttgacagcagtagcaatgagcgtccagacatcagttccatccagagacgtattaagatgcctcatgaatcaacggtggagcacacacacgtagatatcaatgagatggagtctcctcttgccac

SEQ ID NO: 102928 - DNA, 597 bp, Homo sapiens
  Payload ID: 86
  Gene Symbol: NT5C2
  Gene Name: 5'-nucleotidase, cytosolic II
  ENST ID: ENST00000458345
  CDS Start-End: 1-525
gtttctattggctatccccaggagttgctcagctttgcttatgattctacattccctaccaggggacttgtctttgacacactgtatggaaatcttttgaaagtcgatgcctatggaaacctcttggtctgtgcacatggatttaactttataaggggttctcaggtagctgttcagaagagaccagaaactagagaacagtatccaaataaatttatccagcgagatgatactgaaagattttacattctgaacacactattcaacctaccagagacctacctgttggcctgcctagtagatttttttactaattgtcccagatataccagttgtgaaacaggatttaaagatggggacctcttcatgtcctaccggagtatgttccaggatgtaagagatgctgttgactgggttcattacaagggctcccttaaggaaaagacagttgaaaatcttgagaagtatgtagtcaaagatagtaaaagtagcagaatacagtattttctcaaagtactgtggtaaagatttcttgttttcagtttttgtgcttcctattttcacccacctcccttatttcaagaaagaacactgaat

SEQ ID NO: 102929 - DNA, 642 bp, Homo sapiens
  Payload ID: 86
  Gene Symbol: NT5C2
  Gene Name: 5'-nucleotidase, cytosolic II
  ENST ID: ENST00000552185
  CDS Start-End: 1-472
gtcccttggttttgagcttactgtggagagattagtttctattggctatccccaggagttgctcagctttgcttatgattctacattccctaccaggggacttgtctttgacacactgtatggaaatcttttgaaagtcgatgcctatggaaacctcttggtctgtgcacatggatttaactttataaggggaccagaaactagagaacagtatccaaataaatttatccagcgagatgatactgaaagattttacattctgaacacactattcaacctaccagagacctacctgttggcctgcctagtagatttttttactaattgtcccagatataccagtgaatttagtgctagtgagagatgccacattgccaacctgagagatgggacagcaccagcagctccatgcaggctctcacctcccacacggcccctctccttgccagtgtgctgcagccaccacttctgattggcttctcctgggaatgaagacggccagcagaggtgctaattgtgacaactgagtgggagttgtgaaacaggatttaaagatggggacctcttcatgtcctaccggagtatgttccaggatgtaagagatgctgttgactgggttcattacaagggctcccttaagga

SEQ ID NO: 102930 - DNA, 902 bp, Homo sapiens
  Payload ID: 86
  Gene Symbol: NT5C2
  Gene Name: 5'-nucleotidase, cytosolic II
  ENST ID: ENST00000461461
  CDS Start-End: 88-276
agggcgcgcgttgaggcggctgcggcagttgcgcgctgggattgttgcggtgcgctggagccgaatacaaaatacagttaaaataaaatgtcaacctcctggagtgatcggttacagaatgcagcagatatgcctgctaacatggataagcatgccctgaaaaagtatcgtcgagaagcctatcatcgggtgtttgtgaaccgaagtttagcaatggaaaagataaagtgttttggttttgatatggattatacccttgctggagagccagtgtaactccttcaagactggagtgacacacactgcatctgcatctgcctcattgtacaagtccccagagtatgagtcccttggttttgagcttactgtggagagattagtttctattggctatccccaggagttgctcagctttgcttatgattctacattccctaccaggggacttgtctttgacacactgtatggaaatcttttgaaagtcgatgcctatggaaacctcttggtctgtgcacatggatttaactttataaggggaccagaaactagagaacagtatccaaataaatttatccagcgagatgatactgaaagattttacattctgaacacactattcaacctaccagagacctacctgttggcctgcctagtagatttttttactaattgtcccagatataccagttgtgaaacaggatttaaagatggggacctcttcatgtcctaccggagtatgttccaggatgtaagagatgctgttgactgggttcattacaagggctcccttaaggaaaagacagttgaaaatcttgagaagtatgtagtcaaagatggaaaactgcctttgcttctgagccggatgaaggaagtagggaaagtatttcttgctaccaacagtg

SEQ ID NO: 102931 - DNA, 249 bp, Homo sapiens
  Payload ID: 86
  Gene Symbol: NT5C2
  Gene Name: 5'-nucleotidase, cytosolic II
  ENST ID: ENST00000470299
  CDS Start-End: 88-222
agggcgcgcgttgaggcggctgcggcagttgcgcgctgggattgttgcggtgcgctggagccgaatacaaaatacagttaaaataaaatgtcaacctcctggagtgatcggttacagaatgcagcagatatgcctgctaacatggataagcatgccctgaaaaagtatcgtcgagaagcctatcatcggagagccagtgtaactccttcaagactggagtgacacacactgcatctgcatctgcctcat

SEQ ID NO: 102932 - DNA, 1670 bp, Homo sapiens
  Payload ID: 87
  Gene Symbol: NT5C3A
  Gene Name: 5'-nucleotidase, cytosolic IIIA
  Uniprot ID: Q9H0P0
  ENST ID: ENST00000242210
  CDS Start-End: 78-1088
cgtgatgctctgggatcccgcgcttccgagactcgcagtctacgcgagctgcctgtttttttcctgcttggacgcgcatgagggccccgtccatggaccgcgcggccgtggcgagggtgggcgcggtagcgagcgccagcgtgtgcgccctggtggcgggggtggtgctggctcagtacatattcaccttgaagaggaagacggggcggaagaccaagatcatcgagatgatgccagaattccagaaaagttcagttcgaatcaagaaccctacaagagtagaagaaattatctgtggtcttatcaaaggaggagctgccaaacttcagataataacggactttgatatgacactcagtagattttcatataaagggaaaagatgcccaacatgtcataatatcattgacaactgtaagctggttacagatgaatgtagaaaaaagttattgcaactaaaggaaaaatattacgctattgaagttgatcctgttcttactgtagaagagaagtacccttatatggtggaatggtatactaaatcacatggtttgcttgttcagcaagctttaccaaaagctaaacttaaagaaattgtggcagaatctgacgttatgctcaaagaaggatatgagaatttctttgataagctccaacaacatagcatccccgtgttcatattttcggctggaatcggcgatgtactagaggaagttattcgtcaagctggtgtttatcatcccaatgtcaaagttgtgtccaattttatggattttgatgaaactggggtgctcaaaggatttaaaggagaactaattcatgtatttaacaaacatgatggtgccttgaggaatacagaatatttcaatcaactaaaagacaatagtaacataattcttctgggagactcccaaggagacttaagaatggcagatggagtggccaatgttgagcacattctgaaaattggatatctaaatgatagagtggatgagcttttagaaaagtacatggactcttatgatattgttttagtacaagatgaatcattagaagtagccaactctattttacagaagattctataaacaagcattctccaagaagacctctctcctgtgggtgcaattgaactgttcatccgttcatcttgctgagagacttatttataatatatccttactctcgaagtgttccctttgtataactgaagtattttcagatatggtgaatgcattgactggaagctccttttctccacctctctcaacacactcctcaccgtatcttttaacccatttaaaaaaaaaaaaaagctaaaattagaaaaataactccctacttttccaaagtgaattttgtagtttaatgttatcatgcagcttttgaggagtcttttacactgggaaagtttgtagaaattttaaaataagttttatgaaatggtgaaataatatgcatgattttaagtattgccatttttgtaatttgggttattatgctgatggtatcaccatctcttgaaattgtgttaggtttggttattttgtctggggaaaaaatatttactggaaaagactagcagttagtgttggaaaaacctggtggtgtttacaatgttgctaatcattacaaaacattctatattgaagcactgataataaatatga

SEQ ID NO: 102933 - DNA, 1909 bp, Homo sapiens
  Payload ID: 87
  Gene Symbol: NT5C3A
  Gene Name: 5'-nucleotidase, cytosolic IIIA
  Uniprot ID: Q9H0P0
  ENST ID: ENST00000381626
  CDS Start-End: 436-1293
ttttctttccagagccagttgccagttctaatagtacagatttaccttctctttaatcgtcacataacttcaattgataatgttatgtagattgacttgtgactagctcagagctagcgaggctgtaaccaagagcatatataaagtactgtgcagcagtgcgtcacaaggtttttgcatagggcttagtcaaggcttttggaaccgccctcagttgcaccttgtgctatattagtacttctcagacaggaagaattttcttttgctggtgtagctcgtccggttaccttcaggaagattggataaccaagaaatgactaatcaagagtctgccgtacatgtgaaaatgtgtagcagaaaccagccttcttcgaagtggtcttggtgtgattctcctatccgttatcaaaaacttgaagctgtgatttgcctgagatgccagaattccagaaaagttcagttcgaatcaagaaccctacaagagtagaagaaattatctgtggtcttatcaaaggaggagctgccaaacttcagataataacggactttgatatgacactcagtagattttcatataaagggaaaagatgcccaacatgtcataatatcattgacaactgtaagctggttacagatgaatgtagaaaaaagttattgcaactaaaggaaaaatattacgctattgaagttgatcctgttcttactgtagaagagaagtacccttatatggtggaatggtatactaaatcacatggtttgcttgttcagcaagctttaccaaaagctaaacttaaagaaattgtggcagaatctgacgttatgctcaaagaaggatatgagaatttctttgataagctccaacaacatagcatccccgtgttcatattttcggctggaatcggcgatgtactagaggaagttattcgtcaagctggtgtttatcatcccaatgtcaaagttgtgtccaattttatggattttgatgaaactggggtgctcaaaggatttaaaggagaactaattcatgtatttaacaaacatgatggtgccttgaggaatacagaatatttcaatcaactaaaagacaatagtaacataattcttctgggagactcccaaggagacttaagaatggcagatggagtggccaatgttgagcacattctgaaaattggatatctaaatgatagagtggatgagcttttagaaaagtacatggactcttatgatattgttttagtacaagatgaatcattagaagtagccaactctattttacagaagattctataaacaagcattctccaagaagacctctctcctgtgggtgcaattgaactgttcatccgttcatcttgctgagagacttatttataatatatccttactctcgaagtgttccctttgtataactgaagtattttcagatatggtgaatgcattgactggaagctccttttctccacctctctcaacacactcctcaccgtatcttttaacccatttaaaaaaaaaaaaaagctaaaattagaaaaataactccctacttttccaaagtgaattttgtagtttaatgttatcatgcagcttttgaggagtcttttacactgggaaagtttgtagaaattttaaaataagttttatgaaatggtgaaataatatgcatgattttaagtattgccatttttgtaatttgggttattatgctgatggtatcaccatctcttgaaattgtgttaggtttggttattttgtctggggaaaaaatatttactggaaaagactagcagttagtgttggaaaaacctggtggtgtttacaatgttgctaatcattacaaaacattctatattgaagcactgataataaatatgaaatgcaaaacctttttaattctatggtcaaaact

SEQ ID NO: 102934 - DNA, 1788 bp, Homo sapiens
  Payload ID: 87
  Gene Symbol: NT5C3A
  Gene Name: 5'-nucleotidase, cytosolic IIIA
  Uniprot ID: Q9H0P0
  ENST ID: ENST00000396152
  CDS Start-End: 304-1197
agagccagttgccagttctaatagtacagatttaccttctctttaatcgtcacataacttcaattgataatgttatgtagattgacttgtgactagctcagagctagcgaggctgtaaccaagagcatatataaagtactgtgcagcagtgcgtcacaaggtttttgcatagggcttagtcaaggcttttggaaccgccctcagttgcaccttgtgctatattagtacttctcagacaggaagaattttcttttgctggtgtagctcgtccggttaccttcaggaagattggataaccaagaaatgactaatcaagagtctgccgtacatgtgaaaatgatgccagaattccagaaaagttcagttcgaatcaagaaccctacaagagtagaagaaattatctgtggtcttatcaaaggaggagctgccaaacttcagataataacggactttgatatgacactcagtagattttcatataaagggaaaagatgcccaacatgtcataatatcattgacaactgtaagctggttacagatgaatgtagaaaaaagttattgcaactaaaggaaaaatattacgctattgaagttgatcctgttcttactgtagaagagaagtacccttatatggtggaatggtatactaaatcacatggtttgcttgttcagcaagctttaccaaaagctaaacttaaagaaattgtggcagaatctgacgttatgctcaaagaaggatatgagaatttctttgataagctccaacaacatagcatccccgtgttcatattttcggctggaatcggcgatgtactagaggaagttattcgtcaagctggtgtttatcatcccaatgtcaaagttgtgtccaattttatggattttgatgaaactggggtgctcaaaggatttaaaggagaactaattcatgtatttaacaaacatgatggtgccttgaggaatacagaatatttcaatcaactaaaagacaatagtaacataattcttctgggagactcccaaggagacttaagaatggcagatggagtggccaatgttgagcacattctgaaaattggatatctaaatgatagagtggatgagcttttagaaaagtacatggactcttatgatattgttttagtacaagatgaatcattagaagtagccaactctattttacagaagattctataaacaagcattctccaagaagacctctctcctgtgggtgcaattgaactgttcatccgttcatcttgctgagagacttatttataatatatccttactctcgaagtgttccctttgtataactgaagtattttcagatatggtgaatgcattgactggaagctccttttctccacctctctcaacacactcctcaccgtatcttttaacccatttaaaaaaaaaaaaaagctaaaattagaaaaataactccctacttttccaaagtgaattttgtagtttaatgttatcatgcagcttttgaggagtcttttacactgggaaagtttgtagaaattttaaaataagttttatgaaatggtgaaataatatgcatgattttaagtattgccatttttgtaatttgggttattatgctgatggtatcaccatctcttgaaattgtgttaggtttggttattttgtctggggaaaaaatatttactggaaaagactagcagttagtgttggaaaaacctggtggtgtttacaatgttgctaatcattacaaaacattctatattgaagcactgataataaatatgaaatgcaaaa

SEQ ID NO: 102935 - DNA, 1759 bp, Homo sapiens
  Payload ID: 87
  Gene Symbol: NT5C3A
  Gene Name: 5'-nucleotidase, cytosolic IIIA
  Uniprot ID: Q9H0P0
  ENST ID: ENST00000405342
  CDS Start-End: 250-1143
cgtgatgctctgggatcccgcgcttccgagactcgcagtctacgcgagctgcctgtttttttcctgcttggacgcgcatgagggccccgtccatggaccgcgcggccgtggcgagggtgggcgcggtagcgagcgccagcgtgtgcgccctggtggcgggggtggtgctggctcagtacatattcaccttgaagaggaagacggggcggaagaccaagatcatcgagatgaagattggataaccaagaaatgactaatcaagagtctgccgtacatgtgaaaatgatgccagaattccagaaaagttcagttcgaatcaagaaccctacaagagtagaagaaattatctgtggtcttatcaaaggaggagctgccaaacttcagataataacggactttgatatgacactcagtagattttcatataaagggaaaagatgcccaacatgtcataatatcattgacaactgtaagctggttacagatgaatgtagaaaaaagttattgcaactaaaggaaaaatattacgctattgaagttgatcctgttcttactgtagaagagaagtacccttatatggtggaatggtatactaaatcacatggtttgcttgttcagcaagctttaccaaaagctaaacttaaagaaattgtggcagaatctgacgttatgctcaaagaaggatatgagaatttctttgataagctccaacaacatagcatccccgtgttcatattttcggctggaatcggcgatgtactagaggaagttattcgtcaagctggtgtttatcatcccaatgtcaaagttgtgtccaattttatggattttgatgaaactggggtgctcaaaggatttaaaggagaactaattcatgtatttaacaaacatgatggtgccttgaggaatacagaatatttcaatcaactaaaagacaatagtaacataattcttctgggagactcccaaggagacttaagaatggcagatggagtggccaatgttgagcacattctgaaaattggatatctaaatgatagagtggatgagcttttagaaaagtacatggactcttatgatattgttttagtacaagatgaatcattagaagtagccaactctattttacagaagattctataaacaagcattctccaagaagacctctctcctgtgggtgcaattgaactgttcatccgttcatcttgctgagagacttatttataatatatccttactctcgaagtgttccctttgtataactgaagtattttcagatatggtgaatgcattgactggaagctccttttctccacctctctcaacacactcctcaccgtatcttttaacccatttaaaaaaaaaaaaaagctaaaattagaaaaataactccctacttttccaaagtgaattttgtagtttaatgttatcatgcagcttttgaggagtcttttacactgggaaagtttgtagaaattttaaaataagttttatgaaatggtgaaataatatgcatgattttaagtattgccatttttgtaatttgggttattatgctgatggtatcaccatctcttgaaattgtgttaggtttggttattttgtctggggaaaaaatatttactggaaaagactagcagttagtgttggaaaaacctggtggtgtttacaatgttgctaatcattacaaaacattctatattgaagcactgataataaatatgaaatgcaaaacctttttaattctatggtcaaaact

SEQ ID NO: 102936 - DNA, 1032 bp, Homo sapiens
  Payload ID: 87
  Gene Symbol: NT5C3A
  Gene Name: 5'-nucleotidase, cytosolic IIIA
  Uniprot ID: Q9H0P0
  ENST ID: ENST00000409467
  CDS Start-End: 175-1032
tttcttttgctggtgtagctcgtccggttaccttcaggaagattggataaccaagaaatgactaatcaagagtctgccgtacatgtgaaaatgcagaaaccagccttcttcgaagtggtcttggtgtgattctcctatccgttatcaaaaacttgaagctgtgatttgcctgagatgccagaattccagaaaagttcagttcgaatcaagaaccctacaagagtagaagaaattatctgtggtcttatcaaaggaggagctgccaaacttcagataataacggactttgatatgacactcagtagattttcatataaagggaaaagatgcccaacatgtcataatatcattgacaactgtaagctggttacagatgaatgtagaaaaaagttattgcaactaaaggaaaaatattacgctattgaagttgatcctgttcttactgtagaagagaagtacccttatatggtggaatggtatactaaatcacatggtttgcttgttcagcaagctttaccaaaagctaaacttaaagaaattgtggcagaatctgacgttatgctcaaagaaggatatgagaatttctttgataagctccaacaacatagcatccccgtgttcatattttcggctggaatcggcgatgtactagaggaagttattcgtcaagctggtgtttatcatcccaatgtcaaagttgtgtccaattttatggattttgatgaaactggggtgctcaaaggatttaaaggagaactaattcatgtatttaacaaacatgatggtgccttgaggaatacagaatatttcaatcaactaaaagacaatagtaacataattcttctgggagactcccaaggagacttaagaatggcagatggagtggccaatgttgagcacattctgaaaattggatatctaaatgatagagtggatgagcttttagaaaagtacatggactcttatgatattgttttagtacaagatgaatcattagaagtagccaactctattttacagaagattctataa

SEQ ID NO: 102937 - DNA, 840 bp, Homo sapiens
  Payload ID: 87
  Gene Symbol: NT5C3A
  Gene Name: 5'-nucleotidase, cytosolic IIIA
  ENST ID: ENST00000409787
  CDS Start-End: 15-632
tggataaccaagaaatgactaatcaagagtctgccgtacatgtgaaaatgatgccagaattccagaaaagttcagttcgaatcaagaaccctacaagagtagaagaaattatctgtggtcttatcaaaggaggagctgccaaacttcagataataacggactttgatatgacactcagtagattttcatataaagggaaaagatgcccaacatgtcataatatcattgacaactgtaagctggttacagatgaatgtagaaaaaagttattgcaactaaaggaaaaatattacgctattgaagttgatcctgttcttactgtagaagagaagtacccttatatggtggaatggtatactaaatcacatggtttgcttgttcagcaagctttaccaaaagctaaacttaaagaaattgtggcagaatctgacgttatgctcaaagaaggatatgagaatttctttgataagctccaacaacatagcatccccgtgttcatattttcggctggaatcggcgatgtactagaggaagttattcgtcaagctggtgtttatcatcccaatgtcaaagttgtgtccaattttatggattttgatgaaactgtaagaatatcaaatcgttcttcataattttaaaatctgaaaatattttaatcatgtaaatttatttattgttacttaatatatatcctatatccagaaattaggccaagccgataggcccactgtgggactccatccttctcagtgttaatatatccatattttaaaaacaatgtgcccttcttaaactttcattccccaagctatagactaataataaaagtagtaaaacttc

SEQ ID NO: 102938 - DNA, 1742 bp, Homo sapiens
  Payload ID: 87
  Gene Symbol: NT5C3A
  Gene Name: 5'-nucleotidase, cytosolic IIIA
  ENST ID: ENST00000456458
  CDS Start-End: 77-241
gtgatgctctgggatcccgcgcttccgagactcgcagtctacgcgagctgcctgtttttttcctgcttggacgcgcatgagggccccgtccatggaccgcgcggccgtggcgagggtgggcgcggtagcgagcgccagcgtgtgcgccctggtggcgggggtggtgctggctcagtacatattcaccttgaagaggaagacggggcggaagaccaagatcatcgagatgaagattggataaccaagaaatgactaatcaagagtctgccgtacatgtgaaaatgatgccagaattccagaaaagttcagttcgaatcaagaaccctacaagagtagaagaaattatctgtggtcttatcaaaggaggagctgccaaacttcagataataacggactttgatatgacactcagtagattttcatataaagggaaaagatgcccaacatgtcataatatcattgacaactgtaagctggttacagatgaatgtagaaaaaagttattgcaactaaaggaaaaatattacgctattgaagttgatcctgttcttactgtagaagagaagtacccttatatggtggaatggtatactaaatcacatggtttgcttgttcagcaagctttaccaaaagctaaacttaaagaaattgtggcagaatctgacgttatgctcaaagaaggatatgagaatttctttgataagctccaacaacatagcatccccgtgttcatattttcggctggaatcggcgatgtactagaggaagttattcgtcaagctggtgtttatcatcccaatgtcaaagttgtgtccaattttatggattttgatgaaactggggtgctcaaaggatttaaaggagaactaattcatgtatttaacaaacatgatggtgccttgaggaatacagaatatttcaatcaactaaaagacaatagtaacataattcttctgggagactcccaaggagacttaagaatggcagatggagtggccaatgttgagcacattctgaaaattggatatctaaatgatagagtggatgagcttttagaaaagtacatggactcttatgatattgttttagtacaagatgaatcattagaagtagccaactctattttacagaagattctataaacaagcattctccaagaagacctctctcctgtgggtgcaattgaactgttcatccgttcatcttgctgagagacttatttataatatatccttactctcgaagtgttccctttgtataactgaagtattttcagatatggtgaatgcattgactggaagctccttttctccacctctctcaacacactcctcaccgtatcttttaacccatttaaaaaaaaaaaaaagctaaaattagaaaaataactccctacttttccaaagtgaattttgtagtttaatgttatcatgcagcttttgaggagtcttttacactgggaaagtttgtagaaattttaaaataagttttatgaaatggtgaaataatatgcatgattttaagtattgccatttttgtaatttgggttattatgctgatggtatcaccatctcttgaaattgtgttaggtttggttattttgtctggggaaaaaatatttactggaaaagactagcagttagtgttggaaaaacctggtggtgtttacaatgttgctaatcattacaaaacattctatattgaagcactgataataaatatgaaatgcaaaacctttttaa

SEQ ID NO: 102939 - DNA, 306 bp, Homo sapiens
  Payload ID: 87
  Gene Symbol: NT5C3A
  Gene Name: 5'-nucleotidase, cytosolic IIIA
  ENST ID: ENST00000449201
  CDS Start-End: 180-306
tttcttttgctggtgtagctcgtccggttaccttcaggaagattggataaccaagaaatgactaatcaagagtctgccgtacatgtgaaaatgtgtagcagaaaccagccttcttcgaagtggtcttggtgtgattctcctatccgttatcaaaaacttgaagctgtgatttgcctgagatgccagaattccagaaaagttcagttcgaatcaagaaccctacaagagtagaagaaattatctgtggtcttatcaaaggaggagctgccaaacttcagataataacggactttgatatgacactca

SEQ ID NO: 102940 - DNA, 1670 bp, Homo sapiens
  Payload ID: 87
  Gene Symbol: NT5C3A
  Gene Name: 5'-nucleotidase, cytosolic IIIA
  ENST ID: ENST00000610140
  CDS Start-End: 75-1070
cgcgcttccgagactcgcagtctacgcgagctgcctgtttttttcctgcttggacgcgcatgagggccccgtccatggaccgcgcggccgtggcgagggtgggcgcggtagcgagcgccagcgtgtgcgccctggtggcgggggtggtgctggctcagtacatattcaccttgaagaggaagacggggcggaagaccaagatcatcgagatgatgccagaattccagaaaagttcagttcgaatcaagaaccctacaagagtagaagaaattatctgtggtcttatcaaaggaggagctgccaaacttcagataataacggactttgatatgacactcagtagattttcatataaagggaaaagatgcccaacatgtcataatatcattgacaactgtaagctggttacagatgaatgtagaaaaaagttattgcaactaaaggaaaaatattacgctattgaagttgatcctgttcttactgtagaagagaagtacccttatatggtggaatggtatactaaatcacatggtttgcttgttcagcaagctttaccaaaagctaaacttaaagaaattgtggcagaatctgacgttatgctcaaagaaggatatgagaatttctttgataagctccaacaacatagcatccccgtgttcatattttcggctggaatcggcgatgtactagaggaagttattcgtcaagctggtgtttatcatcccaatgtcaaagttgtgtccaattttatggattttgatgaaactggggtgctcaaaggatttaaaggagaactaattcatgtatttaacaaacatgatggtgccttgaggaatacagaatatttcaatcaactaaaagacaatagtaacataattcttctgggagactcccaaggagacttaagaatggcagatggagtggccaatgttgagcacattctgaaaattggatatctaaatgatagagtggatgagcttttagaaaagtacatggactcttatgatattgttttagtacaagatgaatcattagaagtagccaactctattttacagaagattctataaacaagcattctccaagaagacctctctcctgtgggtgcaattgaactgttcatccgttcatcttgctgagagacttatttataatatatccttactctcgaagtgttccctttgtataactgaagtattttcagatatggtgaatgcattgactggaagctccttttctccacctctctcaacacactcctcaccgtatcttttaacccatttaaaaaaaaaaaaaagctaaaattagaaaaataactccctacttttccaaagtgaattttgtagtttaatgttatcatgcagcttttgaggagtcttttacactgggaaagtttgtagaaattttaaaataagttttatgaaatggtgaaataatatgcatgattttaagtattgccatttttgtaatttgggttattatgctgatggtatcaccatctcttgaaattgtgttaggtttggttattttgtctggggaaaaaatatttactggaaaagactagcagttagtgttggaaaaacctggtggtgtttacaatgttgctaatcattacaaaacattctatattgaagcactgataataaatatgaaatgcaaaacctttttaa

SEQ ID NO: 102941 - DNA, 1704 bp, Homo sapiens
  Payload ID: 87
  Gene Symbol: NT5C3A
  Gene Name: 5'-nucleotidase, cytosolic IIIA
  Uniprot ID: Q9H0P0
  ENST ID: ENST00000620705
  CDS Start-End: 78-1088
cgtgatgctctgggatcccgcgcttccgagactcgcagtctacgcgagctgcctgtttttttcctgcttggacgcgcatgagggccccgtccatggaccgcgcggccgtggcgagggtgggcgcggtagcgagcgccagcgtgtgcgccctggtggcgggggtggtgctggctcagtacatattcaccttgaagaggaagacggggcggaagaccaagatcatcgagatgatgccagaattccagaaaagttcagttcgaatcaagaaccctacaagagtagaagaaattatctgtggtcttatcaaaggaggagctgccaaacttcagataataacggactttgatatgacactcagtagattttcatataaagggaaaagatgcccaacatgtcataatatcattgacaactgtaagctggttacagatgaatgtagaaaaaagttattgcaactaaaggaaaaatattacgctattgaagttgatcctgttcttactgtagaagagaagtacccttatatggtggaatggtatactaaatcacatggtttgcttgttcagcaagctttaccaaaagctaaacttaaagaaattgtggcagaatctgacgttatgctcaaagaaggatatgagaatttctttgataagctccaacaacatagcatccccgtgttcatattttcggctggaatcggcgatgtactagaggaagttattcgtcaagctggtgtttatcatcccaatgtcaaagttgtgtccaattttatggattttgatgaaactggggtgctcaaaggatttaaaggagaactaattcatgtatttaacaaacatgatggtgccttgaggaatacagaatatttcaatcaactaaaagacaatagtaacataattcttctgggagactcccaaggagacttaagaatggcagatggagtggccaatgttgagcacattctgaaaattggatatctaaatgatagagtggatgagcttttagaaaagtacatggactcttatgatattgttttagtacaagatgaatcattagaagtagccaactctattttacagaagattctataaacaagcattctccaagaagacctctctcctgtgggtgcaattgaactgttcatccgttcatcttgctgagagacttatttataatatatccttactctcgaagtgttccctttgtataactgaagtattttcagatatggtgaatgcattgactggaagctccttttctccacctctctcaacacactcctcaccgtatcttttaacccatttaaaaaaaaaaaaaagctaaaattagaaaaataactccctacttttccaaagtgaattttgtagtttaatgttatcatgcagcttttgaggagtcttttacactgggaaagtttgtagaaattttaaaataagttttatgaaatggtgaaataatatgcatgattttaagtattgccatttttgtaatttgggttattatgctgatggtatcaccatctcttgaaattgtgttaggtttggttattttgtctggggaaaaaatatttactggaaaagactagcagttagtgttggaaaaacctggtggtgtttacaatgttgctaatcattacaaaacattctatattgaagcactgataataaatatgaaatgcaaaacctttttaattctatggtcaaaact

SEQ ID NO: 102942 - DNA, 975 bp, Homo sapiens
  Payload ID: 88
  Gene Symbol: NT5C3B
  Gene Name: 5'-nucleotidase, cytosolic IIIB
  Uniprot ID: Q969T7
  ENST ID: ENST00000435506
  CDS Start-End: 71-973
ggcgacgcctgcgcagtgcggtcgcggggctgtcgttgtcccgcgagccgccgaccaggcctcgaacgggatggcagaggaggtgagcaccctgatgaaggccacggtcctgatgcggcagcctgggcgggtgcaggagatcgtgggcgccctccgcaagggcggcggagaccggttacaggtgatttctgattttgacatgaccttgagcaggtttgcatataatggaaagcgatgcccttcttcttacaatattctggataatagcaagatcatcagtgaggagtgtcggaaagagctcacagcgctccttcaccactattacccaattgagatcgacccacaccggaccgtcaaggagaagctacctcatatggtggaatggtggaccaaagcacacaatctcctatgtcagcagaagattcagaagtttcagatagcccaggtggttagagagtccaatgcaatgctcagggagggatataagaccttcttcaacacactctaccataacaacattccccttttcatcttttctgcgggcattggtgatatcctggaagaaattatccgacagatgaaagtgttccaccccaacatccacatcgtgtctaactacatggattttaatgaagatggttttctccagggatttaagggccagctcatacacacatacaacaagaacagctctgcgtgtgagaactctggttacttccagcaacttgagggcaaaaccaatgtcatcctgctgggagactctatcggggacctcaccatggccgatggggttcctggtgtgcagaacattctcaaaattggcttcctgaatgacaaggtggaggagcggcgggagcgctacatggactcctatgacatcgtgctggagaaggacgagactctggatgtggtcaacgggctactgcagcacatcctgtgccagggggtccagctggagatgcaaggcccctgaag

SEQ ID NO: 102943 - DNA, 922 bp, Homo sapiens
  Payload ID: 88
  Gene Symbol: NT5C3B
  Gene Name: 5'-nucleotidase, cytosolic IIIB
  ENST ID: ENST00000445655
  CDS Start-End: 52-276
ggtcgcggggctgtcgttgtcccgcgagccgccgaccaggcctcgaacgggatggcagaggaggtgaggagggaggaagcgtccggagtggggcgggcccggactccgacccccggggcgcttcgagccccccagctggtcaccgaggcaccgccgcttcacccaggtgagcaccctgatgaaggccacggtcctgatgcggcagcctgggcgggtgcaggagatcgtgggcgccctccgcaagggcggcggagaccggttacaggtgatttctgattttgacatgaccttgagcaggtttgcatataatggaaagcgatgcccttcttcttacaatattctggataatagcaagatcatcagtgaggagtgtcggaaagagctcacagcgctccttcaccactattacccaattgagatcgacccacaccggaccgtcaaggagaagctacctcatatggtggaatggtggaccaaagcacacaatctcctatgtcagcagaagattcagaagtttcagatagcccaggtggttagagagtccaatgcaatgctcagggagggatataagaccttcttcaacacactctaccataacaacattccccttttcatcttttctgcgggcattggtgatatcctggaagaaattatccgacagatgaaagtgttccaccccaacatccacatcgtgtctaactacatggattttaatgaagatggttttctccagggatttaagggccagctcatacacacatacaacaagaacagctctgcgtgtgagaactctggttacttccagcaacttgagggcaaaaccaatgtcatcctgctgggagactctatcggggacctcaccatggccgatggggttcctggtgtgcagaacattctcaaaattggcttcctgaatgacaag

SEQ ID NO: 102944 - DNA, 730 bp, Homo sapiens
  Payload ID: 88
  Gene Symbol: NT5C3B
  Gene Name: 5'-nucleotidase, cytosolic IIIB
  ENST ID: ENST00000415460
  CDS Start-End: 49-730
cgcggggctgtcgttgtcccgcgagccgccgaccaggcctcgaacgggatggcagaggaggtgagcaccctgatgaaggccacggtcctgatgcggcagcctgggcgggtgcaggagatcgtgggcgccctccgcaagggcggcggagaccggttacaggtgatttctgattttgacatgaccttgagcaggtttgcatataatggaaagcgatgcccttcttcttacaatattctggataatagcaagatcatcagtgaggagtgtcggaaagagctcacagcgctccttcaccactattacccaattgagatcgacccacaccggaccgtcaaggagaagctacctcatatggtggaatgggagggatataagaccttcttcaacacactctaccataacaacattccccttttcatcttttctgcgggcattggtgatatcctggaagaaattatccgacagatgaaagtgttccaccccaacatccacatcgtgtctaactacatggattttaatgaagatggttttctccagggatttaagggccagctcatacacacatacaacaagaacagctctgcgtgtgagaactctggttacttccagcaacttgagggcaaaaccaatgtcatcctgctgggagactctatcggggacctcaccatggccgatggggttcctggtgtgcagaacattctcaaaattggcttcctgaatgacaaggtgg

SEQ ID NO: 102945 - DNA, 993 bp, Homo sapiens
  Payload ID: 88
  Gene Symbol: NT5C3B
  Gene Name: 5'-nucleotidase, cytosolic IIIB
  ENST ID: ENST00000521789
  CDS Start-End: 68-670
gacgcctgcgcagtgcggtcgcggggctgtcgttgtcccgcgagccgccgaccaggcctcgaacgggatggcagaggaggtgatttctgattttgacatgaccttgagcaggtttgcatataatggaaagcgatgcccttcttcttacaatattctggataatagcaagatcatcagtgaggagtgtcggaaagagctcacagcgctccttcaccactattacccaattgagatcgacccacaccggaccgtcaaggagaagctacctcatatggtggaatggtggaccaaagcacacaatctcctatgtcagcagaagattcagaagtttcagatagcccaggtggttagagagtccaatgcaatgctcagggagggatataagaccttcttcaacacactctaccataacaacattccccttttcatcttttctgcgggcattggtgatatcctggaagaaattatccgacagatgaaagtgttccaccccaacatccacatcgtgtctaactacatggattttaatgaagatgtggaggagcggcgggagcgctacatggactcctatgacatcgtgctggagaaggacgagactctggatgtggtcaacgggctactgcagcacatcctgtgccagggggtccagctggagatgcaaggcccctgaaggcgcaggctccagcccggcctgcaggccgtggtgaggaggggcgcctccccagagtctgctcccccgtgaacacagagcagaggccagggtggccagcagtggctgggtccttccgcgcccctccgtcctcctttccctgagcaccttcatcaccagaggcttgaaggaaccccgccatgtggcagggcacaggcactgttcctggtgaaccttggaccacagcatgtcagtgctctagggattgtctactccagggattttcttcaaaatttttaaacatgggaagttcaaacaaatataatgtgtgaaacagatcaaaa

SEQ ID NO: 102946 - DNA, 675 bp, Homo sapiens
  Payload ID: 88
  Gene Symbol: NT5C3B
  Gene Name: 5'-nucleotidase, cytosolic IIIB
  ENST ID: ENST00000475053
  CDS Start-End: 54-227
gcggtcgcggggctgtcgttgtcccgcgagccgccgaccaggcctcgaacgggatggcagaggaggtgagcaccctgatgaaggccacggtcctgatgcggcagcctgggcgggtgcaggagatcgtgggcgccctccgcaagggcggcggagaccggttacagatttctcaatatggtcatgctgcttcctctaattggacagaaggcgcccacaccagtacctagggccttatcctccccaagccagcggctccccagtgatttctgattttgacatgaccttgagcaggtttgcatataatggaaagcgatgcccttcttcttacaatattctggataatagcaagatcatcagtgaggagtgtcggaaagagctcacagcgctccttcaccactattacccaattgagatcgacccacaccggaccgtcaaggagaagctacctcatatggtggaatggtggaccaaagcacacaatctcctatgtcagcagaagattcagaagtttcagatagcccaggtggttagagagtccaatgcaatgctcagggagggatataagaccttcttcaacacactctaccataacaacattccccttttcatcttttctgcgggcattggtgatatcctggaagaaattatccgacagatgaaagtgttccaccccaa

SEQ ID NO: 102947 - DNA, 711 bp, Homo sapiens
  Payload ID: 88
  Gene Symbol: NT5C3B
  Gene Name: 5'-nucleotidase, cytosolic IIIB
  ENST ID: ENST00000486304
  CDS Start-End: 1-318
gcacacaatctcctatgtcagcagaagattcagaagtttcagatagcccaggtggttagagagtccaatgcaatgctcagggagggatataagaccttcttcaacacactctaccataacaacattccccttttcatcttttctgcgggcattggtgatatcctggaagaaattatccgacagatgaaagtgttccaccccaacatccacatcgtgtctaactacatggattttaatgaagatgtgagccaaatcctgtttgggctgggaaaggacgaggggtggggaccaccagccagggcagttaactctgcatgaaccctaacctggggaagaaggggagggaagccactctagcttcttcaccctcaggcagttgtttatgggttactttttggccaggcgcggtggctcagacctgtaatcctagcactttgggaggccgaggcgggcggatcacttgaggtcaggagttcgagaccagcctggccaacatggtgaaagtccatctgtactaaaaatacagaaataagccgggcgtggtggtgtgtggctgtaatcccagctccttcgaggctgaggcaggagaattgcctgaacccaggaggcagaggttgcagtgagccaagatcacaccactgcactccatcctgggtgacagagtaagactctgtcttcagaaaaaaacaaaaacaaaaaaactttcaaagg

SEQ ID NO: 102948 - DNA, 3548 bp, Homo sapiens
  Payload ID: 89
  Gene Symbol: NT5E
  Gene Name: 5'-nucleotidase, ecto (CD73)
  Uniprot ID: P21589
  ENST ID: ENST00000257770
  CDS Start-End: 50-1774
gcactcgcccggctcgcccgctttcgcacccagttcacgcgccacagctatgtgtccccgagccgcgcgggcgcccgcgacgctactcctcgccctgggcgcggtgctgtggcctgcggctggcgcctgggagcttacgattttgcacaccaacgacgtgcacagccggctggagcagaccagcgaggactccagcaagtgcgtcaacgccagccgctgcatgggtggcgtggctcggctcttcaccaaggttcagcagatccgccgcgccgaacccaacgtgctgctgctggacgccggcgaccagtaccagggcactatctggttcaccgtgtacaagggcgccgaggtggcgcacttcatgaacgccctgcgctacgatgccatggcactgggaaatcatgaatttgataatggtgtggaaggactgatcgagccactcctcaaagaggccaaatttccaattctgagtgcaaacattaaagcaaaggggccactagcatctcaaatatcaggactttatttgccatataaagttcttcctgttggtgatgaagttgtgggaatcgttggatacacttccaaagaaaccccttttctctcaaatccagggacaaatttagtgtttgaagatgaaatcactgcattacaacctgaagtagataagttaaaaactctaaatgtgaacaaaattattgcactgggacattcgggttttgaaatggataaactcatcgctcagaaagtgaggggtgtggacgtcgtggtgggaggacactccaacacatttctttacacaggcaatccaccttccaaagaggtgcctgctgggaagtacccattcatagtcacttctgatgatgggcggaaggttcctgtagtccaggcctatgcttttggcaaatacctaggctatctgaagatcgagtttgatgaaagaggaaacgtcatctcttcccatggaaatcccattcttctaaacagcagcattcctgaagatccaagcataaaagcagacattaacaaatggaggataaaattggataattattctacccaggaattagggaaaacaattgtctatctggatggctcctctcaatcatgccgctttagagaatgcaacatgggcaacctgatttgtgatgcaatgattaacaacaacctgagacacacggatgaaatgttctggaaccacgtatccatgtgcattttaaatggaggtggtatccggtcgcccattgatgaacgcaacaatggcacaattacctgggagaacctggctgctgtattgccctttggaggcacatttgacctagtccagttaaaaggttccaccctgaagaaggcctttgagcatagcgtgcaccgctacggccagtccactggagagttcctgcaggtgggcggaatccatgtggtgtatgatctttcccgaaaacctggagacagagtagtcaaattagatgttctttgcaccaagtgtcgagtgcccagttatgaccctctcaaaatggacgaggtatataaggtgatcctcccaaacttcctggccaatggtggagatgggttccagatgataaaagatgaattattaagacatgactctggtgaccaagatatcaacgtggtttctacatatatctccaaaatgaaagtaatttatccagcagttgaaggtcggatcaagttttccacaggaagtcactgccatggaagcttttctttaatatttctttcactttgggcagtgatctttgttttataccaatagccaaaaattctccttgcctttaatgtgtgaaactgcattttttcaagtgagattcaaatctgccttttaggacctggctttgtgacagcaaaaaccatctttacaggctcctagaagctgaaggttagagcattataaaatgaagagacagacatgattactcagggtcagcaacctagtgagttagaaaaaaaattaacatagggccctataaggagaaagccaactatgttaagtttacgtgtccaaattttaatgaaattttactaacaattttaaaccatatttttcttcttcatatccatttctaatccatcaaacagcttatgtttacataaaattttatcattcacaaggaagttttaagcacactgtctcatttgatatccacaacttatttttggtaggaaagagagatgtttttcccacctgtcagatgaaaaaactgaagctcaaaaagggttgacttgaccatacagctaatgctgacagatccaagacctagacctaggtcttttgaactcaagtccagcattctcaactatatcaagttactgttcagaatacttaatatctcctctcttcataattatcaatagccccaagctcatggatgacaaatctctgctttatttcttgtctctattttttcactttatagctcctgttataatagcaagtttaatggtataaacacaggataccatcctctcttgcaacacccatgtgcctttgatgagtcaggtagcaagctgtagtagataatgagaaaggccagaggctgcaaaagacagtcaaaggacacgagagaaaggaaggggaagaacaggactccaggactgttttatattatagaaaagcaagagctaaagagcatttacacatgttaaacagatacttgttaagcatagtgcctgacacacggcattagctgttattttatgagattccatcagctctgcctctgtcctctttcttctaacatgaaggtatcatgagaagagaaccttctaacataagctgtaattctaaacctgcacttgtccctctccagcaagaggctagcactgaattcattctactcatactacacacccagttatggaatgtccagagttctcgaagaaaataaatgactttaggaagaggtatacattttttaagtcgctctgcctccaaatctgaacagtcactgtaaatcattcttaagcccagatatgagaacttctgctggaaagtgggaccctctgagtgggtggtcagaaaatacccatgctgatgaaatgacctatgcccaaagaacaaatacttaacgtgggagtggaaccacatgagcctgctcagctctgcataagtaattcaagaaatgggaggcttcaccttaaaaacagtgtgcaaatggcagctagaggttttgataggaagtatgtttgtttcttagtgtttacaaatattaagtactcttgatacaaaatatacttttaaacttcataacctttttataaaagttgttgcagcaaaataatagcctcggttctatgcatatatggattagctataaaaaatgtcaataagattgtacaaggaaaattagagaaagtcacatttagggtttattttttacacttggccagtaaaatagggtaaatcctattagaattttttaaagaactttttttaagtttcctaaatctgtgtgtgtattgtgaagtggtataagaaatgactttgaaccactttgcaattgtagattcccaacaataaaattgaagat

SEQ ID NO: 102949 - DNA, 974 bp, Homo sapiens
  Payload ID: 89
  Gene Symbol: NT5E
  Gene Name: 5'-nucleotidase, ecto (CD73)
  ENST ID: ENST00000369646
  CDS Start-End: 50-844
gcactcgcccggctcgcccgctttcgcacccagttcacgcgccacagctatgtgtccccgagccgcgcgggcgcccgcgacgctactcctcgccctgggcgcggtgctgtggcctgcggctggcgcctgggagcttacgattttgcacaccaacgacgtgcacagccggctggagcagaccagcgaggactccagcaagtgcgtcaacgccagccgctgcatgggtggcgtggctcggctcttcaccaaggttcagcagatccgccgcgccgaacccaacgtgctgctgctggacgccggcgaccagtaccagggcactatctggttcaccgtgtacaagggcgccgaggtggcgcacttcatgaacgccctgcgctacgatgccatggcactgggaaatcatgaatttgataatggtgtggaaggactgatcgagccactcctcaaagaggccaaatttccaattctgagtgcaaacattaaagcaaaggggccactagcatctcaaatatcaggactttatttgccatataaagttcttcctgttggtgatgaagttgtgggaatcgttggatacacttccaaagaaaccccttttctctcaaatccagggacaaatttagtgtttgaagatgaaatcactgcattacaacctgaagtagataagttaaaaactctaaatgtgaacaaaattattgcactgggacattcgggttttgaaatggataaactcatcgctcagaaagtgaggggtgtggacgtcgtggtgggaggacactccaacacatttctttacacaggtaattgtttcaaaaggattgcatgggccaggatgtccagataagcactgtgtctcttttgcctttgtaactgttattactctttttactgctatttaatatgtaatgtatattatatgatctataatatatatgtaatatacattaaatgggaacatgtgcaaatcttacaaa

SEQ ID NO: 102950 - DNA, 3918 bp, Homo sapiens
  Payload ID: 89
  Gene Symbol: NT5E
  Gene Name: 5'-nucleotidase, ecto (CD73)
  Uniprot ID: P21589
  ENST ID: ENST00000369651
  CDS Start-End: 557-2131
actcctcctctctgcccctcagctcgctcatctttcttcccgccccctctcttttccttctttggttctttgaagtgatgagctagcgcaaccacaaaccatacattccttttgtagaaaaacccgtgcctcgaatgaggcgagactcagagaggacccaggcgcggggcggacccctccaattccttcctcgcgcccccgaaagagcggcgcaccagcagccgaactgccggcgcccaggctccctggtccggccgggatgcggccggtacccgctccccgccgggaacaacctctccactcttcctgcagggagctggtgccagccgacagccgcgccagggccgctccgggtaccagggtcggatcgggtgacgtcgcgaacttgcgcctggccgccaagccggcctccaggctgaagaaggacccgccccggccttgacccgggccccgcccctccagccggggcaccgagccccggccctagctgctcgcccctactcgccggcactcgcccggctcgcccgctttcgcacccagttcacgcgccacagctatgtgtccccgagccgcgcgggcgcccgcgacgctactcctcgccctgggcgcggtgctgtggcctgcggctggcgcctgggagcttacgattttgcacaccaacgacgtgcacagccggctggagcagaccagcgaggactccagcaagtgcgtcaacgccagccgctgcatgggtggcgtggctcggctcttcaccaaggttcagcagatccgccgcgccgaacccaacgtgctgctgctggacgccggcgaccagtaccagggcactatctggttcaccgtgtacaagggcgccgaggtggcgcacttcatgaacgccctgcgctacgatgccatggcactgggaaatcatgaatttgataatggtgtggaaggactgatcgagccactcctcaaagaggccaaatttccaattctgagtgcaaacattaaagcaaaggggccactagcatctcaaatatcaggactttatttgccatataaagttcttcctgttggtgatgaagttgtgggaatcgttggatacacttccaaagaaaccccttttctctcaaatccagggacaaatttagtgtttgaagatgaaatcactgcattacaacctgaagtagataagttaaaaactctaaatgtgaacaaaattattgcactgggacattcgggttttgaaatggataaactcatcgctcagaaagtgaggggtgtggacgtcgtggtgggaggacactccaacacatttctttacacaggcaatccaccttccaaagaggtgcctgctgggaagtacccattcatagtcacttctgatgatgggcggaaggttcctgtagtccaggcctatgcttttggcaaatacctaggctatctgaagatcgagtttgatgaaagaggaaacgtcatctcttcccatggaaatcccattcttctaaacagcagcattcctgaagatccaagcataaaagcagacattaacaaatggaggataaaattggataattattctacccaggaattagggaaaacaattgtctatctggatggctcctctcaatcatgccgctttagagaatgcaacatgggcaacctgatttgtgatgcaatgattaacaacaacctgagacacacggatgaaatgttctggaaccacgtatccatgtgcattttaaatggaggtggtatccggtcgcccattgatgaacgcaacaatggaatccatgtggtgtatgatctttcccgaaaacctggagacagagtagtcaaattagatgttctttgcaccaagtgtcgagtgcccagttatgaccctctcaaaatggacgaggtatataaggtgatcctcccaaacttcctggccaatggtggagatgggttccagatgataaaagatgaattattaagacatgactctggtgaccaagatatcaacgtggtttctacatatatctccaaaatgaaagtaatttatccagcagttgaaggtcggatcaagttttccacaggaagtcactgccatggaagcttttctttaatatttctttcactttgggcagtgatctttgttttataccaatagccaaaaattctccttgcctttaatgtgtgaaactgcattttttcaagtgagattcaaatctgccttttaggacctggctttgtgacagcaaaaaccatctttacaggctcctagaagctgaaggttagagcattataaaatgaagagacagacatgattactcagggtcagcaacctagtgagttagaaaaaaaattaacatagggccctataaggagaaagccaactatgttaagtttacgtgtccaaattttaatgaaattttactaacaattttaaaccatatttttcttcttcatatccatttctaatccatcaaacagcttatgtttacataaaattttatcattcacaaggaagttttaagcacactgtctcatttgatatccacaacttatttttggtaggaaagagagatgtttttcccacctgtcagatgaaaaaactgaagctcaaaaagggttgacttgaccatacagctaatgctgacagatccaagacctagacctaggtcttttgaactcaagtccagcattctcaactatatcaagttactgttcagaatacttaatatctcctctcttcataattatcaatagccccaagctcatggatgacaaatctctgctttatttcttgtctctattttttcactttatagctcctgttataatagcaagtttaatggtataaacacaggataccatcctctcttgcaacacccatgtgcctttgatgagtcaggtagcaagctgtagtagataatgagaaaggccagaggctgcaaaagacagtcaaaggacacgagagaaaggaaggggaagaacaggactccaggactgttttatattatagaaaagcaagagctaaagagcatttacacatgttaaacagatacttgttaagcatagtgcctgacacacggcattagctgttattttatgagattccatcagctctgcctctgtcctctttcttctaacatgaaggtatcatgagaagagaaccttctaacataagctgtaattctaaacctgcacttgtccctctccagcaagaggctagcactgaattcattctactcatactacacacccagttatggaatgtccagagttctcgaagaaaataaatgactttaggaagaggtatacattttttaagtcgctctgcctccaaatctgaacagtcactgtaaatcattcttaagcccagatatgagaacttctgctggaaagtgggaccctctgagtgggtggtcagaaaatacccatgctgatgaaatgacctatgcccaaagaacaaatacttaacgtgggagtggaaccacatgagcctgctcagctctgcataagtaattcaagaaatgggaggcttcaccttaaaaacagtgtgcaaatggcagctagaggttttgataggaagtatgtttgtttcttagtgtttacaaatattaagtactcttgatacaaaatatacttttaaacttcataacctttttataaaagttgttgcagcaaaataatagcctcggttctatgcatatatggattagctataaaaaatgtcaataagattgtacaaggaaaattagagaaagtcacatttagggtttattttttacacttggccagtaaaatagggtaaatcctattagaattttttaaagaactttttttaagtttcctaaatctgtgtgtgtattgtgaagtggtataagaaatgactttgaaccactttgcaattgtagattcccaacaataaaattgaagataagctctttggtc

SEQ ID NO: 102951 - DNA, 738 bp, Homo sapiens
  Payload ID: 89
  Gene Symbol: NT5E
  Gene Name: 5'-nucleotidase, ecto (CD73)
  ENST ID: ENST00000437581
  CDS Start-End: 1-539
gaaatcccattcttctaaacagcagcattcctgaagatccaagcataaaagcagacattaacaaatggaggataaaattggataattattctacccaggaattagggaaaacaattgtctatctggatggctcctctcaatcatgccgctttagagaatgcaacatgggcaacctgatttgtgatgcaatgattaacaacaacctgagacacacggatgaaatgttctggaaccacgtatccatgtgcattttaaatggaggtggtatccggtcgcccattgatgaacgcaacaatggcacaattacctgggagaacctggctgctgtattgccctttggaggcacatttgacctagtccagttaaaaggttccaccctgaagaaggcctttgagcatagcgtgcaccgctacggccagtccactggagagttcctgcaggtgggcgatttaaaggaatgctgtccaatctgtattaaccaggatgattcctggaaggagcagcctactgcacagacatacctgaacacctggttctagtcccactgtgacctggggcaagttctcaacccctctgggcacagggagaaaacctttcctgtttatctcatggactgcagtgaaagttgaatggaaataaatgcttcctaaattgccaagggcttctgaaacacttttgttaataattccacagtccagtgaattaatcctttaaaagcaatcttattttacctggaaa

SEQ ID NO: 102952 - DNA, 689 bp, Homo sapiens
  Payload ID: 89
  Gene Symbol: NT5E
  Gene Name: 5'-nucleotidase, ecto (CD73)
  ENST ID: ENST00000416334
  CDS Start-End: 1-689
tggacgtcgtggtgggaggacactccaacacatttctttacacaggcaatccaccttccaaagaggtgcctgctgggaagtacccattcatagtcacttctgatgatgggcggaaggttcctgtagtccaggcctatgcttttggcaaatacctaggctatctgaagatcgagtttgatgaaagaggaaacgtcatctcttcccatggaaatcccattcttctaaacagcagcattcctgaagatccaagcataaaagcagacattaacaaatggaggataaaattggataattattctacccaggaattagggaaaacaattgtctatctggatggctcctctcaatcatgccgctttagagaatgcaacatgggcaacctgatttgtgatgcaatgattaacaacaacctgagacacacggatgaaatgttctggaaccacgtatccatgtgcattttaaatggaggtggtatccggtcgcccattgatgaacgcaacaatggaatccatgtggtgtatgatctttcccgaaaacctggagacagagtagtcaaattagatgttctttgcaccaagtgtcgagtgcccagttatgaccctctcaaaatggacgaggtatataaggtgatcctcccaaacttcctggccaatggtggagatgggttccagatgataaaagatgaatta

SEQ ID NO: 102953 - DNA, 4031 bp, Homo sapiens
  Payload ID: 90
  Gene Symbol: OPLAH
  Gene Name: 5-oxoprolinase (ATP-hydrolysing)
  Uniprot ID: O14841
  ENST ID: ENST00000618853
  CDS Start-End: 105-3971
ggagcgcaggcagagccgaccgcgagcgaccgagccggagccgagcgccagtttttccagggctaccagctgaagagctcctgtgggactccagccccaccaccatgggcagccccgagggccgcttccactttgccatcgaccgtgggggtaccttcacagacgtctttgcccagtgcccaggggggcacgtgcgggtcttaaaactgctctcagaggaccctgccaactatgcggacgcgccaaccgaaggcatccgccgcatcctggagcaggaggccggcatgctcctgccccgggaccagccgctggactccagtcatatcgccagcatccgcatgggcaccacagtggccaccaacgcactgctggagcggaagggggagcgggtggcgctgctggtgacacgtggcttccgagacctgctgcacattggcacccaagcccgtggggacctctttgacctggccgtgcccatgcctgaggtgctgtatgaagaggtgctggaggtggacgaacgcgtggtgctgcaccgtggagaggcgggcaccgggacgcctgtgaaaggccgcacgggggacctgctggaagtgcagcagcctgtggacctgggggccctgcgtgggaagctggaggggctgctatctcgaggcatccgcagcctggctgtggtgctcatgcactcgtacacgtgggcccagcatgagcagcaggtgggtgtgctggcccgggagctgggcttcacgcacgtgtcactgtcctcggaggccatgcccatggtgcgcatcgtccctcgggggcacacggcctgtgccgacgcctacctcacgcccgccatccagcgctacgtgcagggcttctgccgtggcttccagggccaactcaaggatgtgcaggtgttgttcatgcgctccgatggcggcctggcgcccatggacaccttcagcggctccagtgctgtgctctcgggcccggccggcggcgtggtgggctactcagccaccacctaccagcaggagggtggccagcctgtcatcggctttgacatgggaggcacgtccacggatgtgagccgctatgctggggaattcgagcacgtcttcgaggccagcacagctggcgtcaccctccaggccccgcagctggacatcaacaccgtggcagcgggagggggttcccgcctcttcttcaggtctggcctctttgtggttgggcccgagtcagcaggagcccacccaggacccgcctgctaccgcaaagggggccctgtgacagtgacggatgctaatctggtcctgggtcgcctgctgcctgcctccttcccctgcatttttgggccgggagagaaccaaccactttcccctgaggcctcccgcaaagccctggaggctgtggccactgaggtcaacagcttcctgaccaacgggccctgcccggcctccccgctgagcctggaggaggtggccatggggttcgtgcgcgtggccaacgaggccatgtgccggcccatccgtgcactcacgcaggcaagaggccatgacccctcagcccatgtgctggcctgctttgggggagctggtgggcagcatgcatgtgccatcgcccgggccctgggcatggacacggtgcacatccacaggcacagtgggctgctgtcggccctggggctggccctggctgacgtggtgcatgaggcacaggaaccctgctccctgctctacgcgcctgagaccttcgtgcagctggaccagaggctgagccgcctggaggagcagtgtgtggatgctctgcaggcccagggcttccccaggtcccagatcagcactgagagcttcctgcacctgcgctaccagggcacggactgtgctctgatggtgtctgcccaccagcacccagccacagcccgctcgccccgtgcgggggacttcggggcagcctttgtggagcggtacatgagggagtttggctttgtcatacctgagcggccggtggtcgtggacgatgtgcgagtgcggggcaccggccgcagtggtcttcgcctcgaggatgcccccaaagcccagaccgggcctccccgggtggacaagatgacccagtgctactttgaggggggctaccaggagacccctgtgtacctgctggcagagctgggctatgggcacaagctccatgggccctgcctcatcatcgacagtaacagcaccatcctggtggagccaggttgccaggcagaggtgaccaagacaggggacatctgcatctccgtgggggccgaagtccccggcacagtgggcccccagctggaccctatccagctgtccatcttctcacaccgcttcatgagcattgctgagcagatgggccgcatcctgcagcgcacagccatctccaccaacatcaaggagcgtctggacttctcctgtgccctctttgggcccgatggggggctggtgtccaatgccccccacatccctgtgcacctgggtgccatgcaggagacggtgcagttccagattcagcacctgggggccgatctccaccctggcgacgtgctactgagcaaccatcccagtgccgggggcagccacctgccagacctgactgttatcacaccggtgttttggccgggtcagacgcggcctgtgttctatgtggccagccgagggcaccacgcagacatcgggggcatcacaccaggctccatgcccccccactccaccatgctgcaacaggagggtgccgtctttctgtccttcaaacttgtccaggggggcgtcttccaggaggaggcggtgacggaggccctgcgggcgccaggcaaggtccccaactgcagcggaaccagaaacctgcacgacaacctgtcggacctccgtgcccaggtggcagccaaccagaagggcatccagctggtgggggagctcattgggcagtacggcctggacgtggtgcaggcctacatgggccatattcaggcaaacgctgagctggccgtgcgagacatgttgcgtgcctttggaacctcccggcaggcccggggcctgcccctggaggtgtcctcggaagaccacatggacgacggttcccccatccgcctccgtgtgcagatcagcctgagtcagggcagcgccgtgtttgacttcagcggcactgggccggaggtgtttggtaatctcaacgcaccgcgggccgtaaccctgtccgccctcatctactgcctgcgctgtctggtgggccgcgacatcccactcaaccagggctgcctggcgccagtgcgcgtggtcattccccgaggctccatcctggacccgtcgcccgaggcggcggtggtgggcggcaacgtgctcacgtcgcagcgcgtggtggatgtcatcctgggggcctttggggcctgcgccgcctcccagggctgcatgaacaacgtgaccctgggcaacgcccacatgggctactacgagacggtggcgggcggcgcgggcgcgggtcccagctggcacgggcgcagcggtgtgcacagccacatgaccaacacacgcatcaccgaccctgagatcctggagagccggtacccggtcatcctgcgccgcttcgagctgcggcggggctcggggggcagaggccgcttccgaggcggcgacggcgtcacccgcgagctgctctttcgtgaggaggcgctgctgtcagtgctgaccgagcgccgcgccttccggccatacgggctccacgggggcgagcctggcgcccgcggcctaaacctgctgatccgcaaaaacggccggacggtgaatctgggcggcaagacgtcggtgaccgtgtaccccggggatgtgttctgtctccacacgcccggcggcggtggctatggggacccggaggaccccgccccaccgccggggtcgcccccgcaagcactggcctttcccgagcacggcagcgtctatgagtatcgccgggcccaggaggccgtgtgaggatcccgcaataaagatgccttaagtctcccggttctggggacgcagctacggcgccta

SEQ ID NO: 102954 - DNA, 659 bp, Homo sapiens
  Payload ID: 90
  Gene Symbol: OPLAH
  Gene Name: 5-oxoprolinase (ATP-hydrolysing)
  ENST ID: ENST00000567871
  CDS Start-End: 187-659
caggagctgaagctggtgctcaggaaccgcggcagcagcctgggcttctgcagctccgggttcctggctgaggtggctgccagtccctggctacccaggcggagaacgatcaaattcaagaatgctgagagagtttttccagggctaccagctgaagagctcctgtgggactccagccccaccaccatgggcagccccgagggccgcttccactttgccatcgaccgtgggggtaccttcacagacgtctttgcccagtgcccaggggggcacgtgcgggtcttaaaactgctctcagaggaccctgccaactatgcggacgcgccaaccgaaggcatccgccgcatcctggagcaggaggccggcatgctcctgccccgggaccagccgctggactccagtcatatcgccagcatccgcatgggcaccacagtggccaccaacgcactgctggagcggaagggggagcgggtggcgctgctggtgacacgtggcttccgagacctgctgcacattggcacccaagcccgtggggacctctttgacctggccgtgcccatgcctgaggtgctgtatgaagaggtgctggaggtggacgaacgcgtggtgctgcaccgtggagaggcgggcaccgggacgcctgtgaaaggccgcacggg

SEQ ID NO: 102955 - DNA, 2038 bp, Homo sapiens
  Payload ID: 91
  Gene Symbol: PHYKPL
  Gene Name: 5-phosphohydroxy-L-lysine phospho-lyase
  Uniprot ID: Q8IUZ5
  ENST ID: ENST00000308158
  CDS Start-End: 236-1588
agttcctgcgcgggactgccaaggcacgaccacgggccggaaggctgccaggcccagtgggcaagcgaagaaatgaaccaccgcaacgcgggcgcttcggggcggggccgagtgcgaacctgagccccaaatcccgacccaggcaggggcggggcccggagcggggccttggaggcccagcccgcgcggcgacgtctccgcgtggcgtcacggcaccgactgacggccacccaccatggccgcagaccagcgcccgaaggccgacacgctggccctgaggcaacggctcatcagctcttcctgcagactcttttttcccgaggatcctgttaagattgtccgggcccaagggcagtacatgtacgatgaacagggggcagaatacatcgattgcatcagcaatgtggcgcacgttgggcactgccaccctctcgtggtccaagcagcacatgagcagaaccaggtgctcaacaccaacagccggtacctgcatgacaacatcgtggactatgcgcagaggctgtcagagaccctgccggagcagctctgtgtgttctatttcctgaattctgggtcagaagccaatgacctggccctgaggctggctcgccactacacgggacaccaggacgtggtggtattagatcatgcgtatcacggccacctgagctccctgattgacatcagtccctacaagttccgcaacctggatggccagaaggagtgggtccacgtggcacctctcccagacacctaccggggcccctaccgggaggaccaccccaacccagctatggcctatgccaacgaggtgaaacgtgtggtcagcagtgcacaggagaagggcaggaagattgcagccttcttcgctgagtctctgcccagtgtgggagggcagatcattccccctgctggctacttctcccaagtggcagagcacatccgcaaggccggaggggtctttgttgcagatgagatccaggttggctttggccgggtaggcaagcacttctgggccttccagctccagggaaaagacttcgtccctgacatcgtcaccatgggcaagtccattggcaacggccaccctgttgcctgcgtggccgcaacccagcctgtggcgagggcatttgaagccaccggcgttgagtacttcaacacgtttgggggcagcccagtgtcctgcgctgtggggctggccgtcctgaatgtcttggagaaggagcagctccaggatcatgccaccagtgtaggcagcttcctgatgcagctcctcgggcagcaaaaaatcaaacatcccatcgtcggggatgtcaggggtgttgggctcttcattggtgtggatctgatcaaagatgaggccacaaggacaccagcaactgaagaggctgcctacttggtatcaaggctgaaggagaactacgttttgctgagcactgatggccctgggaggaacatcctgaagtttaagcccccaatgtgcttcagcctggacaatgcacggcaggtggtggcaaagctggatgccattctgactgacatggaagagaaggtgagaagttgtgaaacgctgaggctccagccctaagccagccctgctctgcctaagtgtactccagaagaaactcatctcatccaaatacacgctattgagaaggcgagcctgacctccctcttacagataaagtcagctttcagaggctcagggtgggggggcctgcccgaggccataatgctacccaccccctcctcctaaccactggtctgttggaataacccagatgtctgcatcccctcaagtcagtcaatttcctttctgtccactgggggtggaatggggtagggtgggatactttaaagtgctcctgcttaaataaattagaccagaccagtgtatttctaaagaaaatcctgacatgcacacccattaaaaatagtacattttacagtgtcccagtcatacttttaattggcaaattaaaataatgcaatctgatatattctatcctactaaattaaaaatactgaatataaccaa

SEQ ID NO: 102956 - DNA, 739 bp, Homo sapiens
  Payload ID: 91
  Gene Symbol: PHYKPL
  Gene Name: 5-phosphohydroxy-L-lysine phospho-lyase
  ENST ID: ENST00000323594
  CDS Start-End: 81-739
ccggagcggggccttggaggcccagcccgcgcggcgacgtctccgcgtggcgtcacggcaccgactgacggccacccaccatggccgcagaccagcgcccgaaggccgacacgctggccctgaggcaacggctcatcagccaccttttctcaggatccgggagactgacgcggacacatgcagaaatgagcaaggaggccacagaggctgaaaatgctttcagaaacaatccgaagtttcagcgacttgttaccccatctgcttcctgctttgcaaccacctgtggagtggagagacaagttgggcactgccaccctctcgtggtccaagcagcacatgagcagaaccaggtgctcaacaccaacagccggtacctgcatgacaacatcgtggactatgcgcagaggctgtcagagaccctgccggagcagctctgtgtgttctatttcctgaattctgggtcagaagccaatgacctggccctgaggctggctcgccactacacgggacaccaggacgtggtggtattagatcatgcgtatcacggccacctgagctccctgattgacatcagtccctacaagttccgcaacctggatggccagaaggagtgggtccacgtggcacctctcccagacacctaccggggcccctaccgggaggaccaccccaacccagctatggcctatgccaacgaggtgaaacgtgtggtcagcagtgcacaggagaagggcaggaa

SEQ ID NO: 102957 - DNA, 1001 bp, Homo sapiens
  Payload ID: 91
  Gene Symbol: PHYKPL
  Gene Name: 5-phosphohydroxy-L-lysine phospho-lyase
  ENST ID: ENST00000393488
  CDS Start-End: 1-548
tcgtccctgacatcgtcaccatgggcaagtccattggcaacggccaccctgttgcctgcgtggccgcaacccagcctgtggcgagggcatttgaagccaccggcgttgagtacttcaacacgtttgggggcagcccagtgtcctgcgctgtggggctggccgtcctgaatgtcttggagaaggagcagctccaggatcatgccaccagtgtaggcagcttcctgatgcagctcctcgggcagcaaaaaatcaaacatcccatcgtcggggatgtcaggggtgttgggctcttcattggtgtggatctgatcaaagatgaggccacaaggacaccagcaactgaagaggctgcctacttggtatcaaggctgaaggagaactacgttttgctgagcactgatggccctgggaggaacatcctgaagtttaagcccccaatgtgcttcagcctggacaatgcacggcaggtggtggcaaagctggatgccattctgactgacatggaagagaaggtgagaagttgtgaaacgctgaggctccagccctaagccagccctgctctgcctaagtgtactccaggtgagtgggccttgcttcttactcttgaagatgcacagcgggttccttaccatcagcagcaagcagcctcggcaagctgagcctttttttaagacttttttttgttctgactgatgctccttcccaaagaagaaactcatctcatccaaatacacgctattgagaaggcgagcctgacctccctcttacagataaagtcagctttcagaggctcagggtgggggggcctgcccgaggccataatgctacccaccccctcctcctaaccactggtctgttggaataacccagatgtctgcatcccctcaagtcagtcaatttcctttctgtccactgggggtggaatggggtagggtgggatactttaaagtgctcctgcttaaataaattagaccagaccagtgtatttctaaagaaaatcc

SEQ ID NO: 102958 - DNA, 824 bp, Homo sapiens
  Payload ID: 91
  Gene Symbol: PHYKPL
  Gene Name: 5-phosphohydroxy-L-lysine phospho-lyase
  ENST ID: ENST00000476170
  CDS Start-End: 22-393
accgactgacggccacccaccatggccgcagaccagcgcccgaaggccgacacgctggccctgaggcaacggctcatcagctcttcctgcagactcttttttcccgaggatcctgttaagattgtccgggcccaagggcagtacatgtacgatgaacagggggcagaatacatcgattgcatcagcaatgtggcgcacgttgggcactgccaccctctcgtggtccaagcagcacatgagcagaaccaggtgctcaacaccaacagccggtacctgcatgacaacatcgtggactatgcgcagaggctgtcagagaccctgccggagcagctctgtgtgttctatttcctgaattctgggtggggtaacagcagttcaaagaaaggaacttgagcccagacatttgccatgtcaagagctggagcctctggaaagagaagggagctggtgcttcctcagtggtggtggaggaggggcattcttatgccaccagctttattctgtgtggattccagggacttccatgttgccaaatccaaagcaatctctttgctgcattgtcttactctgtcccagcagtaattgacagttaccactctccggaagtggtctgtcatcttgcttcccgggcactgtgctctcctgttttctatcagcttctctagccactccttccctgtcttctttgctgattcctcctctgttccttggggctgatcctgggccacttttctctctgagccctctcctcaggtgatctcttccattctcttggtattacatagcatccatgtgttggtgactcacaaatttttttgagccca

SEQ ID NO: 102959 - DNA, 1539 bp, Homo sapiens
  Payload ID: 91
  Gene Symbol: PHYKPL
  Gene Name: 5-phosphohydroxy-L-lysine phospho-lyase
  ENST ID: ENST00000474052
  CDS Start-End: 241-438
gctcgagttcctgcgcgggactgccaaggcacgaccacgggccggaaggctgccaggcccagtgggcaagcgaagaaatgaaccaccgcaacgcgggcgcttcggggcggggccgagtgcgaacctgagccccaaatcccgacccaggcaggggcggggcccggagcggggccttggaggcccagcccgcgcggcgacgtctccgcgtggcgtcacggcaccgactgacggccacccaccatggccgcagaccagcgcccgaaggccgacacgctggccctgaggcaacggctcatcagctcttcctgcagactcttttttcccgaggatcctgttaagattgtccgggcccaagggcagtacatgtacgatgaacagggggcagaatacatcgattgcatcagcaatgtggcgcacgtgcgtatcacggccacctgagctccctgattgacatcagtccctacaagttccgcaacctggatggccagaaggagtgggtccacgtggtatgcactgcccaactcaacaacagattgcagccttcttcgctgagtctctgcccagtgtgggagggcagatcattccccctgctggctacttctcccaagtggcagactccagggaaaagacttcgtccctgacatcgtcaccatgggcaagtccattggcaacggccaccctgttgcctgcgtggccgcaacccagcctgtggcgagggcatttgaagccaccggcgttgagtacttcaacacgtttgggggcagcccagtgtcctgcgctgtggggctggccgtcctgaatgtcttggagaaggagcagctccaggatcatgccaccagtgtaggcagcttcctgatgcagctcctcgggcagcaaaaaatcaaacatcccatcgtcggggatgtcaggggtgttgggctcttcattggtgtggatctgatcaaagatgaggccacaaggacaccagcaactgaagaggctgcctacttggtatcaaggctgaaggagaactacgttttgctgagcactgatggccctgggaggaacatcctgaagtttaagcccccaatgtgcttcagcctggacaatgcacggcaggtggtggcaaagctggatgccattctgactgacatggaagagaaggtgagaagttgtgaaacgctgaggctccagccctaagccagccctgctctgcctaagtgtactccagaagaaactcatctcatccaaatacacgctattgagaaggcgagcctgacctccctcttacagataaagtcagctttcagaggctcagggtgggggggcctgcccgaggccataatgctacccaccccctcctcctaaccactggtctgttggaataacccagatgtctgcatcccctcaagtcagtcaatttcctttctgtccactgggggtggaatggggtagggtgggatactttaaagtgctcctgcttaaataaattagaccagaccagtgtatttctaaagaaaatcctgacatgcacacccattaaaaatagtacattttaca

SEQ ID NO: 102960 - DNA, 643 bp, Homo sapiens
  Payload ID: 91
  Gene Symbol: PHYKPL
  Gene Name: 5-phosphohydroxy-L-lysine phospho-lyase
  ENST ID: ENST00000510913
  CDS Start-End: 1-348
caagcagcacatgagcagaaccaggtgctcaacaccaacagccggtacctgcatgacaacatcgtggactatgcgcagaggctgtcagagaccctgccggagcagctctgtgtgttctatttcctgaattctgggtcagaagccaatgacctggccctgaggctggctcgccactacacgggacaccaggacgtggtggtattagatcatgcgtatcacggccacctgagctccctgattgacatcagtccctacaagttccgcaacctggatggccagaaggagtgggtccacgtggtatgcactgcccaactcaacaacagtgacatgctcagttctctgggttgaggcatcatcaccctggtggccatgtggaggatggactggaaaaggcattcagttagaagacctctgcaggagtccaaggaagaaacaggcaaatctgcaggaggcagattgcagccttcttcgctgagtctctgcccagtgtgggagggcagatcattccccctgctggctacttctcccaagtggcagagcacatccgcaaggccggaggggtctttgttgcagatgagatccaggttggctttggccgggtaggcaagcacttctgggccttccagctccagggaaaagactt

SEQ ID NO: 102961 - DNA, 1969 bp, Homo sapiens
  Payload ID: 91
  Gene Symbol: PHYKPL
  Gene Name: 5-phosphohydroxy-L-lysine phospho-lyase
  ENST ID: ENST00000493197
  CDS Start-End: 219-386
gccaaggcacgaccacgggccggaaggctgccaggcccagtgggcaagcgaagaaatgaaccaccgcaacgcgggcgcttcggggcggggccgagtgcgaacctgagccccaaatcccgacccaggcaggggcggggcccggagcggggccttggaggcccagcccgcgcggcgacgtctccgcgtggcgtcacggcaccgactgacggccacccaccatggccgcagaccagcgcccgaaggccgacacgctggccctgaggcaacggctcatcagacacgcggccttatggagtccccatgggacggggcagccaccttttctcaggatccgggagactgacgcggacacatgcagaaatgagcaaggaggccacagaggctgaaaatgctttcagaaacaatccgaagtttcagcgacttgttaccccatctgcttcctgctttgcaaccacctgtggagtggagagacaagctcttcctgcagactcttttttcccgaggatcctgttaagattgtccgggcccaagggcagtacatgtacgatgaacagggggcagaatacatcgattgcatcagcaatgtggcgcacgttgggcactgccaccctctcgtggtccaagcagcacatgagcagaaccaggtgctcaacaccaacagccggtacctgcatgacaacatcgtggactatgcgcagaggctgtcagagaccctgccggagcagctctgtgtgttctatttcctgaattctgggatcattgctggagcttagtgaggtcagaagccaatgacctggccctgaggctggctcgccactacacgggacaccaggacgtggtggtattagatcatgcgtatcacggccacctgagctccctgattgacatcagtccctacaagttccgcaacctggatggccagaaggagtgggtccacgtggcacctctcccagacacctaccggggcccctaccgggaggaccaccccaacccagctatggcctatgccaacgaggtgaaacgtgtggtcagcagtgcacaggagaagggcaggaagattgcagccttcttcgctgagtctctgcccagtgtgggagggcagatcattccccctgctggctacttctcccaagtggcagagcacatccgcaaggccggaggggtctttgttgcagatgagatccaggttggctttggccgggtaggcaagcacttctgggccttccagctccagggaaaagacttcgtccctgacatcgtcaccatgggcaagtccattggcaacggccaccctgttgcctgcgtggccgcaacccagcctgtggcgagggcatttgaagccaccggcgttgagtacttcaacacgtttgggggcagcccagtgtcctgcgctgtggggctggccgtcctgaatgtcttggagaaggagcagctccaggatcatgccaccagtgtaggcagcttcctgatgcagctcctcgggcagcaaaaaatcaaacatcccatcgtcggggatgtcaggggtgttgggctcttcattggtgtggatctgatcaaagatgaggccacaaggacaccagcaactgaagaggctgcctacttggtatcaagacatggaagagaaggtgagaagttgtgaaacgctgaggctccagccctaagccagccctgctctgcctaagtgtactccagaagaaactcatctcatccaaatacacgctattgagaaggcgagcctgacctccctcttacagataaagtcagctttcagaggctcagggtgggggggcctgcccgaggccataatgctacccaccccctcctcctaaccactggtctgttggaataacccagatgtctgcatcccctcaagtcagtcaatttcctttctgtccactgggggtggaatggggtagggtgggatactttaaagtgctcctgcttaaataaattagaccagaccagtgta

SEQ ID NO: 102962 - DNA, 731 bp, Homo sapiens
  Payload ID: 91
  Gene Symbol: PHYKPL
  Gene Name: 5-phosphohydroxy-L-lysine phospho-lyase
  ENST ID: ENST00000506045
  CDS Start-End: 1-87
attgcagccttcttcgctgagtctctgcccagtgtgggagggcagatcattccccctgctggctacttctcccaagtggcagaatgagatccaggttggctttggccgggtaggcaagcacttctgggccttccagctccagggaaaagacttcgtccctgacatcgtcaccatgggcaagtccattggcaacggccaccctgttgcctgcgtggccgcaacccagcctgtggcgagggcatttgaagccaccggcgttgagtacttcaacacgtttgggggcagcccagtgtcctgcgctgtggggctggccgtcctgaatgtcttggagaaggagcagctccaggatcatgccaccagtgtaggcagcttcctgatgcagctcctcgggcagcaaaaaatcaaacatcccatcgtcggggatgtcaggggtgttgggctcttcattggtgtggatctgatcaaagatgaggccacaaggacaccagcaactgaagaggctgcctacttggtatcaaggctgaaggagaactacgttttgctgagcactgatggccctgggaggaacatcctgaagtttaagcccccaatgtgcttcagcctggacaatgcacggcaggtggtggcaaagctggatgccattctgactgacatggaagagaaggtgagaagttgtgaaacgctgaggctccagccctaagccagccctgctctgcctaagtgtactccag

SEQ ID NO: 102963 - DNA, 1057 bp, Homo sapiens
  Payload ID: 92
  Gene Symbol:
  Gene Name: 60S ribosomal protein L7a  [Source:UniProtKB/Swiss-Prot
  Acc:P62424]
  ENST ID: ENST00000625844
  CDS Start-End: 483-1057
tgagctgtagttccgtggcactatagccaggttccggctgtatccgctgccatcctcctccaggcgcggcctcggagggcctcctgctcctcctggcgctaggagagccccactcggtgtggcacggagacaccgaggtggattagagccccacttggtgtggcacggagacattgagatggactagagccccgggcggccgagagcggaatgcgttgttcccggtgtcgcagggctgggtgtcgcaggcctggagcaccgcagtgcggggctcggagccctagcgtctctcgggcttgctgggggccgctccagaggccttgtgagcgacgagttctgagcccgcccctgttgcttctagagcctgtggggccgcgactcagaggagtcatgagtccggggtgtctcctgggtgggcgacgcgaagagagcgtggtctcgggcttagccttgctctggccactcggggttcccggggctgcatgcttgtgcggctgaatgtgagatgctcctgtcgaggggtggtgctggggggttgcagaaagctgctcgccagcttagttcagccgaaaggaaagaaggccaagggaaagaaggtggctccggccccagctgtcgtgaagaagcaggaggctaagaaagtggtgaatcccctgtttgagaaaaggcctaagaattttggcattggacaggacatccagcccaaaagagacctcacccgctttgtgaaatggccccgctatatcaggttgcagcggcagagagccatcctctataagcggctgaaagtgcctcctgcgattaaccagttcacccaggccctggaccgccaaacagctactcagctgcttaagctggcccacaagtacagaccagagacaaagcaagagaagaagcagagactgttggcccgggccgagaagaaggctgctggcaaaggggacgtcccaacgaagagaccacctgtccttcgagcaggagttaacaccgtcaccaccttggtggagaacaagaaagctcagctggtggtgattgcacacgacgtggatcccatcga

SEQ ID NO: 102964 - DNA, 680 bp, Homo sapiens
  Payload ID: 92
  Gene Symbol:
  Gene Name: 60S ribosomal protein L7a  [Source:UniProtKB/Swiss-Prot
  Acc:P62424]
  ENST ID: ENST00000627260
  CDS Start-End: 165-620
ccgaaaggaaagaaggccaagggaaagaaggtggctccggccccagctgtcgtgaagaagcaggaggctaagaaagtggtgaatcccctgtttgagaaaaggcctaagaattttggcattggacaggacatccagcccaaaagagacctcacccgctttgtgaaatggccccgctatatcaggctgctggcaaaggggacgtcccaacgaagagaccacctgtccttcgagcaggagttaacaccgtcaccaccttggtggagaacaagaaagctcagctggtggtgattgcacacgacgtggatcccatcgagctggttgtcttcttgcctgccctgtgtcgtaaaatgggggtcccttactgcattatcaagggaaaggcaagactgggacgtctagtccacaggaagacctgcaccactgtcgccttcacacaggtgaactcggaagacaaaggcgctttggctaagctggtggaagctatcaggaccaattacaatgacagatacgatgagatccgccgtcactggggtggcaatgtcctgggtcctaagtctgtggctcgtatcgccaagctcgaaaaggcaaaggctaaagaacttgccactaaactgggttaaatgtacactgttgagttttctgtacataaaaataattgaaataatacaaattttccttca

SEQ ID NO: 102965 - DNA, 891 bp, Homo sapiens
  Payload ID: 92
  Gene Symbol:
  Gene Name: 60S ribosomal protein L7a  [Source:UniProtKB/Swiss-Prot
  Acc:P62424]
  Uniprot ID: P62424
  ENST ID: ENST00000630979
  CDS Start-End: 31-831
tttcctttctctctcctcccgccgcccaagatgccgaaaggaaagaaggccaagggaaagaaggtggctccggccccagctgtcgtgaagaagcaggaggctaagaaagtggtgaatcccctgtttgagaaaaggcctaagaattttggcattggacaggacatccagcccaaaagagacctcacccgctttgtgaaatggccccgctatatcaggttgcagcggcagagagccatcctctataagcggctgaaagtgcctcctgcgattaaccagttcacccaggccctggaccgccaaacagctactcagctgcttaagctggcccacaagtacagaccagagacaaagcaagagaagaagcagagactgttggcccgggccgagaagaaggctgctggcaaaggggacgtcccaacgaagagaccacctgtccttcgagcaggagttaacaccgtcaccaccttggtggagaacaagaaagctcagctggtggtgattgcacacgacgtggatcccatcgagctggttgtcttcttgcctgccctgtgtcgtaaaatgggggtcccttactgcattatcaagggaaaggcaagactgggacgtctagtccacaggaagacctgcaccactgtcgccttcacacaggtgaactcggaagacaaaggcgctttggctaagctggtggaagctatcaggaccaattacaatgacagatacgatgagatccgccgtcactggggtggcaatgtcctgggtcctaagtctgtggctcgtatcgccaagctcgaaaaggcaaaggctaaagaacttgccactaaactgggttaaatgtacactgttgagttttctgtacataaaaataattgaaataatacaaattttccttca

SEQ ID NO: 102966 - DNA, 1156 bp, Homo sapiens
  Payload ID: 93
  Gene Symbol: PFKFB1
  Gene Name: 6-phosphofructo-2-kinase/fructose-2,6-biphosphatase 1
  ENST ID: ENST00000374992
  CDS Start-End: 72-887
gacagctagtaagataggaagtgaggccaggtaccttgtgggcagtgatgtcattcggtgcgactcctaagatgtctccagagatgggagagctcacccaaaccaggttgcagaagatctggattccacacagcagcggcagcagcaggctgcaacggagaaggggctcatccataccccagtttaccaattcccccacaatggtgatcatggtgggtttaccagctcgaggcaagacctatatctccacaaagctcacacgatatctcaactggataggaacaccaactaaagacaacatggaagccctgcaaatcaggaagcagtgcgccctggcagccctgaaggatgttcacaactatctcagccatgaggaaggtcatgttgcggtttttgatgccaccaacactaccagagaacgacggtcactgatcctgcagtttgcaaaagaacatggttacaagggtgtctgtgaggagatgacctatgaagaaatccaggaacattaccctgaagaatttgcactgcgagaccaagataaatatcgctaccgctatcccaagggagagtcctatgaggatctggttcagcgtctggagccagtgataatggagctagaacgacaggagaatgtactggtgatctgccaccaggctgtcatgcggtgcctcctggcctatttcctggataaaagttcagatgagcttccatatctcaagtgccctctgcacacagtgctcaaactcactcctgtggcttatggctgcaaagtggaatccatctacctgaatgtggaggccgtgaacacacaccgggagaagcctgagaatgtggacatcacccgggaacctgaggaagccctggatactgtcccagcccactactgagccctttccaagaagtcaaactgcctgtgtcctcatcgccttccacctttaggaaatgctatctttgctcttctcctactctgccttggcctcactgaggcaccccacttccagtgaagaagtcctccgcaactcccaaacaagcctcgcttgctggccgcaaccaaggagctatctagctctggaggaaactttctttcttaattcctattctctgacgaataaagacttactgcctacaagaggagaggaggaggtcatggcgaggc

SEQ ID NO: 102967 - DNA, 1929 bp, Homo sapiens
  Payload ID: 93
  Gene Symbol: PFKFB1
  Gene Name: 6-phosphofructo-2-kinase/fructose-2,6-biphosphatase 1
  Uniprot ID: P16118
  ENST ID: ENST00000375006
  CDS Start-End: 72-1487
gacagctagtaagataggaagtgaggccaggtaccttgtgggcagtgatgtcattcggtgcgactcctaagatgtctccagagatgggagagctcacccaaaccaggttgcagaagatctggattccacacagcagcggcagcagcaggctgcaacggagaaggggctcatccataccccagtttaccaattcccccacaatggtgatcatggtgggtttaccagctcgaggcaagacctatatctccacaaagctcacacgatatctcaactggataggaacaccaactaaagtgtttaatttaggccagtatcgacgagaggcagtgagctacaagaactatgaattctttcttccagacaacatggaagccctgcaaatcaggaagcagtgcgccctggcagccctgaaggatgttcacaactatctcagccatgaggaaggtcatgttgcggtttttgatgccaccaacactaccagagaacgacggtcactgatcctgcagtttgcaaaagaacatggttacaaggtgtttttcattgagtccatttgtaatgaccctggcataattgcagaaaacatcaggcaagtgaaacttggcagccctgattatatagactgtgaccgggaaaaggttctggaagactttctaaagagaattgagtgctatgaggtcaactaccaacccttggatgaggaactggacagccacctgtcctacatcaagatcttcgacgtgggcacacgctacatggtgaaccgagtgcaggatcacatccagagccgcacagtctactacctcatgaatatccatgtcacacctcgctccatctacctttgccgacatggcgagagtgaactcaacatcagaggccgcatcggaggtgactctggcctctcagttcgcggcaagcagtatgcctatgccctggccaacttcattcagtcccagggcatcagctccctgaaggtgtggaccagtcacatgaagaggaccatccagacagctgaggccctgggtgtcccctatgagcagtggaaggccctgaatgagattgatgcgggtgtctgtgaggagatgacctatgaagaaatccaggaacattaccctgaagaatttgcactgcgagaccaagataaatatcgctaccgctatcccaagggagagtcctatgaggatctggttcagcgtctggagccagtgataatggagctagaacgacaggagaatgtactggtgatctgccaccaggctgtcatgcggtgcctcctggcctatttcctggataaaagttcagatgagcttccatatctcaagtgccctctgcacacagtgctcaaactcactcctgtggcttatggctgcaaagtggaatccatctacctgaatgtggaggccgtgaacacacaccgggagaagcctgagaatgtggacatcacccgggaacctgaggaagccctggatactgtcccagcccactactgagccctttccaagaagtcaaactgcctgtgtcctcatcgccttccacctttaggaaatgctatctttgctcttctcctactctgccttggcctcactgaggcaccccacttccagtgaagaagtcctccgcaactcccaaacaagcctcgcttgctggccgcaaccaaggagctatctagctctggaggaaactttctttcttaattcctattctctgacgaataaagacttactgcctacaagaggagaggaggaggtcatggcgaggcttttccagttgttctcaaggtactgaccctaatcctgacccagctctgctgctgtgagggcatggaatgggtgaggatttcctggagggaaaagttctacagtagcacctccaaagatgggggagaagataggtgcctgtgagttcctgtgggccttgttccagcaaggtggc

SEQ ID NO: 102968 - DNA, 1591 bp, Homo sapiens
  Payload ID: 93
  Gene Symbol: PFKFB1
  Gene Name: 6-phosphofructo-2-kinase/fructose-2,6-biphosphatase 1
  Uniprot ID: P16118
  ENST ID: ENST00000545676
  CDS Start-End: 102-1322
gggaaccaacgaacacctccaggcttcctctttgatgccacccactggacctgccttgggggtctgtaaatgcaagagaaccgagtgttggataattagcgatggaagaaaaaacctctagaataaaagtgtttaatttaggccagtatcgacgagaggcagtgagctacaagaactatgaattctttcttccagacaacatggaagccctgcaaatcaggaagcagtgcgccctggcagccctgaaggatgttcacaactatctcagccatgaggaaggtcatgttgcggtttttgatgccaccaacactaccagagaacgacggtcactgatcctgcagtttgcaaaagaacatggttacaaggtgtttttcattgagtccatttgtaatgaccctggcataattgcagaaaacatcaggcaagtgaaacttggcagccctgattatatagactgtgaccgggaaaaggttctggaagactttctaaagagaattgagtgctatgaggtcaactaccaacccttggatgaggaactggacagccacctgtcctacatcaagatcttcgacgtgggcacacgctacatggtgaaccgagtgcaggatcacatccagagccgcacagtctactacctcatgaatatccatgtcacacctcgctccatctacctttgccgacatggcgagagtgaactcaacatcagaggccgcatcggaggtgactctggcctctcagttcgcggcaagcagtatgcctatgccctggccaacttcattcagtcccagggcatcagctccctgaaggtgtggaccagtcacatgaagaggaccatccagacagctgaggccctgggtgtcccctatgagcagtggaaggccctgaatgagattgatgcgggtgtctgtgaggagatgacctatgaagaaatccaggaacattaccctgaagaatttgcactgcgagaccaagataaatatcgctaccgctatcccaagggagagtcctatgaggatctggttcagcgtctggagccagtgataatggagctagaacgacaggagaatgtactggtgatctgccaccaggctgtcatgcggtgcctcctggcctatttcctggataaaagttcagatgagcttccatatctcaagtgccctctgcacacagtgctcaaactcactcctgtggcttatggctgcaaagtggaatccatctacctgaatgtggaggccgtgaacacacaccgggagaagcctgagaatgtggacatcacccgggaacctgaggaagccctggatactgtcccagcccactactgagccctttccaagaagtcaaactgcctgtgtcctcatcgccttccacctttaggaaatgctatctttgctcttctcctactctgccttggcctcactgaggcaccccacttccagtgaagaagtcctccgcaactcccaaacaagcctcgcttgctggccgcaaccaaggagctatctagctctggaggaaactttctttcttaattcctattctctgacgaataaagacttactgcctacaagaggagaggaggaggtcatggcgaggc

SEQ ID NO: 102969 - DNA, 1353 bp, Homo sapiens
  Payload ID: 93
  Gene Symbol: PFKFB1
  Gene Name: 6-phosphofructo-2-kinase/fructose-2,6-biphosphatase 1
  ENST ID: ENST00000614686
  CDS Start-End: 603-1337
ggtgcgactcctaagatgtctccagagatgggagagctcacccaaaccaggttgcagaagatctggattccacacagcagcggcagcagcaggctgcaacggagaaggggctcatccataccccagtttaccaattcccccacaatggtgatcatggtgggtttaccagctcgaggcaagacctatatctccacaaagctcacacgatatctcaactggataggaacaccaactaaaggcagtgcgccctggcagccctgaaggatgttcacaactatctcagccatgaggaaggtcatgttgcggtttttgatgccaccaacactaccagagaacgacggtcactgatcctgcagtttgcaaaagaacatggttacaaggtgtttttcattgagtccatttgtaatgaccctggcataattgcagaaaacatcaggcaagtgaaacttggcagccctgattatatagactgtgaccgggaaaaggttctggaagactttctaaagagaattgagtgctatgaggtcaactaccaacccttggatgaggaactggacagccacctgtcctacatcaagatcttcgacgtgggcacacgctacatggtgaaccgagtgcaggatcacatccagagccgcacagtctactacctcatgaatatccatgtcacacctcgctccatctacctttgccgacatggcgagagtgaactcaacatcagaggccgcatcggaggtgactctggcctctcagttcgcggcaagcagtatgcctatgccctggccaacttcattcagtcccagggcatcagctccctgaaggtgtggaccagtcacatgaagaggaccatccagacagctgaggccctgggtgtcccctatgagcagtggaaggccctgaatgagattgatgcgggtgtctgtgaggagatgacctatgaagaaatccaggaacattaccctgaagaatttgcactgcgagaccaagataaatatcgctaccgctatcccaagggagagtcctatgaggatctggttcagcgtctggagccagtgataatggagctagaacgacaggagaatgtactggtgatctgccaccaggctgtcatgcggtgcctcctggcctatttcctggataaaagttcagatgagcttccatatctcaagtgccctctgcacacagtgctcaaactcactcctgtggcttatggctgcaaagtggaatccatctacctgaatgtggaggccgtgaacacacaccgggagaagcctgagaatgtggacatcacccgggaacctgaggaagccctggatactgtcccagcccactactgagccctttccaagaagt

SEQ ID NO: 102970 - DNA, 3494 bp, Homo sapiens
  Payload ID: 94
  Gene Symbol: PFKFB2
  Gene Name: 6-phosphofructo-2-kinase/fructose-2,6-biphosphatase 2
  Uniprot ID: O60825
  ENST ID: ENST00000367079
  CDS Start-End: 74-1489
gttacagggcaggcgccggggccaaggcagggagggatcttaggagagatcgtaggacatctgaagagctgccatgtctggggcatcttcctcagaacagaacaacaacagctatgaaaccaaaaccccaaatcttcgaatgtcagagaagaaatgttcatgggcctcctacatgaccaactccccgactctgatcgttatgattggtttgccagcccggggtaaaacctacgtgtccaagaaactaacacgctacctcaactggattggagtccccaccaaagtgtttaatcttggggtgtatcggcgtgaagcagtcaagtcctataagtcctacgacttctttcggcatgacaatgaggaggccatgaagatccgcaaacagtgtgctctggtggcgctggaagatgttaaggcgtatctcactgaggagaatggtcagattgcggtgtttgatgccaccaatacaacccgggagaggagggacatgattttgaactttgctgaacagaattccttcaaggtattctttgtggaatccgtctgtgatgatcctgatgtcattgctgccaatattctggaggttaaggtatcaagccctgactatcctgaaaggaacagagagaacgtgatggaggacttcctgaagagaattgaatgctacaaagttacctaccgacctcttgacccagacaactatgacaaggatctttctttcatcaaggtgataaacgtgggccagcgatttttagtcaacagagtccaggactacatccagagcaagatagtctactacctcatgaatatccacgtccagcctcgcaccatttacctttgccggcatggagaaagcgagttcaatctcttggggaagattgggggtgactctggcctctcggtgcggggaaagcagtttgcccaagctctaaggaaatttctggaggaacaggaaataacagacctcaaagtgtggacaagccagttgaagaggaccatacagactgctgaatctctcggggtgccctatgagcagtggaagattctgaatgagattgatgctggtgtgtgtgaagagatgacctatgcagagattgagaaacggtacccagaagagtttgcacttcgagatcaagagaagtatctgtatcgatatcctggtggggagtcataccaggacctggtgcagcggctggagcctgtcatcatggagctggaacgtcagggcaatgtcctcgtcatctcccaccaggctgtcatgcgctgcctcctggcctacttcttggataagggcgcagatgagctaccatacttgagatgccctctccataccatcttcaaacttactcctgtggcctatgggtgcaaagtggaaacaattaaacttaacgtggaggctgtgaacacgcaccgtgacaagccaactgcagcagagaccacactggctgtgcgcagacgcccctccgcagcgtccctcatgttgccttgctaatgatgtggatgttcaggcctcacctctccaaacgactgggatctactgaaaagcttgggatgtcagcttcacagaggctagaacaggaagttaagtgggaactggactttgggggccaccaaaacgaggcctggagaaacgtcaccatatttcctcccctcctgcctaatgggaatatcagttacactgaaaaatttaacttccctgtgcctcaaaacatttagcaacctgaaccagtgactttttgtcatctctgtgctgagtttggtccaagttggtcaatctcattctgtataggcatttaacatcctacctgtgactgtctgcatcctttgctggctcttttttgcccaaagtgcaaatgcacttcttcagatttacttttcaagtgagaaggtaagagctggtctctgccactgttccaggcgagcaggctagagtctaatatacttatgctagcagttaccatttgccacattggaagcaagagacaaatcaccaggtgaatggagggtcttctgagaaattcagtccctaaaacatcttctctgccttgatagaagaacagtgtcagtggcaaccttttcatttagagaagtttttcttgttccaggcccttcaggacaggatctgactgcaagactccccaaaatgggtacccatcttctaagttcccttttgtagctactgtacttttgacttgatgcatgtgcctctcatgcatcaagatggggctgatgtggttctcctgggtggttgggaatgtggactagacagaaaagtagagtgccatttatatcacgtgagtaagtcaagaaagctccttgagaatcagcccgatcagggagtgttttggcttcagaacaggtggaaggagacacgcccctctgtgggctctgtcaccatgatacagtccttgagagagctgtggctgtgacttggagggcagtagtctcctgatacctgcctcttggccactggtcactattgtggtcactgatctctcatataaaagtgagggtggcggggtcatggaccagcgcctcagtgcattagtcattcgcttttccttacagacaaatcagataactcttccccagtgattgtcaaatgtatgaatgtatctctgtaaatgtggttttgacatgtcactgttactgaaggagagtatggaatccccacaggatattatatcttgcaaggaaagtctattttttaaagaatagtatgtttttagctttacttttctttcttttccttttcactcaaatgctcacttgctgggcaaaagggtgagtagcaagaaaagtaatgatatgtagcttttctcaaatggttcttttatactgtggatgatacaggactctgttacctaagatgtgataagctgggctgcaggcggttcagcatccagcaactaggagctgcttttctacgtacaaagctgccttcaggaaggctccttaccctgtagcagatgattttcatctggctgcctaccgcatgctgtactataatgatttagttgtgatatggatttctctctgcatcgaaaactgtcttttgatgatcagacaatgtttatatttagttatttattctatccatgtaaggcatttttgagttttcttgtcactgtttgcatgtatttaatcagaatgtaatataatttatgttgtcaggtttttttttgtttgtttgtttggggttttttttgtagaaatttaggtagttagagcttttaagtctaatgtcatattaacttaagttaaatttccagaacgtagatatctgtcttctgtaaaaggaaaataacgatgttaagggacagtgaattttttttgaatactttgtttctcattgatttttattgtaagtgtaaaccaagagatgcatttctctggagaagtgtttatctcctggattaataaaatcatgctaaaatatgcgagtaatatgtattgcttttgtaataagaacataaaataaaattatttttaattaa

SEQ ID NO: 102971 - DNA, 7094 bp, Homo sapiens
  Payload ID: 94
  Gene Symbol: PFKFB2
  Gene Name: 6-phosphofructo-2-kinase/fructose-2,6-biphosphatase 2
  Uniprot ID: O60825
  ENST ID: ENST00000367080
  CDS Start-End: 125-1642
ggcgactgtagcgccggtcccggccacaagctgtcggctcggttcggtcgcgttacagggcaggcgccggggccaaggcagggagggatcttaggagagatcgtaggacatctgaagagctgccatgtctggggcatcttcctcagaacagaacaacaacagctatgaaaccaaaaccccaaatcttcgaatgtcagagaagaaatgttcatgggcctcctacatgaccaactccccgactctgatcgttatgattggtttgccagcccggggtaaaacctacgtgtccaagaaactaacacgctacctcaactggattggagtccccaccaaagtgtttaatcttggggtgtatcggcgtgaagcagtcaagtcctataagtcctacgacttctttcggcatgacaatgaggaggccatgaagatccgcaaacagtgtgctctggtggcgctggaagatgttaaggcgtatctcactgaggagaatggtcagattgcggtgtttgatgccaccaatacaacccgggagaggagggacatgattttgaactttgctgaacagaattccttcaaggtattctttgtggaatccgtctgtgatgatcctgatgtcattgctgccaatattctggaggttaaggtatcaagccctgactatcctgaaaggaacagagagaacgtgatggaggacttcctgaagagaattgaatgctacaaagttacctaccgacctcttgacccagacaactatgacaaggatctttctttcatcaaggtgataaacgtgggccagcgatttttagtcaacagagtccaggactacatccagagcaagatagtctactacctcatgaatatccacgtccagcctcgcaccatttacctttgccggcatggagaaagcgagttcaatctcttggggaagattgggggtgactctggcctctcggtgcggggaaagcagtttgcccaagctctaaggaaatttctggaggaacaggaaataacagacctcaaagtgtggacaagccagttgaagaggaccatacagactgctgaatctctcggggtgccctatgagcagtggaagattctgaatgagattgatgctggtgtgtgtgaagagatgacctatgcagagattgagaaacggtacccagaagagtttgcacttcgagatcaagagaagtatctgtatcgatatcctggtggggagtcataccaggacctggtgcagcggctggagcctgtcatcatggagctggaacgtcagggcaatgtcctcgtcatctcccaccaggctgtcatgcgctgcctcctggcctacttcttggataagggcgcagatgagctaccatacttgagatgccctctccataccatcttcaaacttactcctgtggcctatgggtgcaaagtggaaacaattaaacttaacgtggaggctgtgaacacgcaccgtgacaagccaactaacaacttccccaagaaccaaacccctgtaaggatgagaaggaacagctttacgcctctgtccagttcgaatacaataaggcgtccaagaaattacagtgttgggagccggcccctcaagcccctcagccctctccgtgcccaggacatgcaagaaggggccgactagccgaagacccaagtcagcattccggtggtgtaactgtgtgtttccctccagccctggcctcctgcccttgtcactaatcaccaaggagtcattaacttcctccctctatgcccacccctgacacttcaccattaatcttaacacagaacatgaggttatgtgtttataggacaacttaagctgttcttcagtttgaaacatcttttcacccaggggcaagttagcaaattgagtcttttaggacagattctcagatgggatgatctggaggaggaggaaaaagatacactcccttggggctgagcatgccccacactcttggatcttctctctgttccctggtgtcttcactaatgtcctcatgttggtgaagtgttgggggatggagggcgggtgagcagtcgggggacaaaaagtctatttttccttcacttttgtctcttcaatgtgtgttttcctcacactccttacttgactgctttcttcccccactttcatgtcccctctggattgtccagtgtaatgcatggcattgtggtgtctgtctaggaaggaaggggtgattgacaagagacaagtctggcccagttaatgctttctgcagtgggtctaaatggatctggactggaggagtctttcctttcctttctcccttcctctccagccaggtcctgtaagggccagcccagactacaggacatccacagaatattctggagcttgcaagtagacatagggtgagagttcttgcctcctttcatgagaaacagttctaagtcttcgatgccctgggagaatctggctctgagcatgtgggaaatgtcttggtttttatttttaatttagagtcaggcctgggtcttttgaggtctgcagagtggggtttaggagagtagggtgggctctagctcttgcagggctcttagagagcagtcatgtcttttctcccatgactctcaggttctttgccaatcacagcaacttttcctgccaaagccagtatcctctggggctgtttagaagggcagttagattcaggagtcaccactgatgtttgagttgctcaaggcaagaggcagagaagagttcactaaaactgcttatttttgaataatttcagcacactgtccttaagaagaaagaaacatcaaaacaaaatagtttttacatgaccatttttttcccaaatgtggaaaagcttgatgatgaatttaatctctctcattggagtattcttttgttcataaagagaaactatctcatcttgatgtccagagaagtccttggaaccctgtgggatctagctcgtaactgtttgtatttctctattcacttctgtcatttcattttctttgtagggttaaacagaaaatgtttagggaagaaattcttagccccttgatgaccatgatggcttattctctttcccaattttgcatgcaaaatgtacgaatatatgtatgtttttctgagaggcaagtttagggttctcatgggattttaaaaagagataggtgactccccaccttaaagttatctgctggtcttttagaggtaaccagtgagaaggagttagctattttccaagggtgttttcatttggtaatggaagactttttgctgtggttctcatccaggagtattccttagaattgcctttaggattgttgaatcataaacatgcctgtgtccaccttatgcttaatactgactcagaatctctgggatctgggtctggacatgcatgtatttaagtagcttcccggatgattctgattcatagctcgggttaagaactccaccttaggaagttaggtggaaaaatactggatagtagtttctcagacaaaagtgtcagcctaggaattctgaattcctcatagtcctgaaaggacagttctttgggtttgatgtttgagcagatcataatgttaaatgatataaccccctggaaggcaggctgctgtgttttagagggttattctaggttctagtcccatctttaaccctttacattgctgagtgatgtggaacaaatcactgaattaaataattgtctctagagagcagctggggattttaagcaccctggagagaggtgcagaccctgccaggatgataaaggttgtcatcactggcaactgactcctgaccccgggtcctttactcgtatgtcccaagtaggataccataggcagcttctaaaggctgcttacctagattcttctcaaaattgtgtccaagatgttaagtaacctgctattcctgtttagtggttacataacatgtacttagtgtctttgtggagctttgggctggtaggggcagggataggggaaagctaaacagaagtagaagaaaaggtccttgtccagaggaaggttattttaagagacaggacatgtaatttataacaaatggacatttgcaatatagcaacagtctgagtctagaagtgttcaaccatcacatcgcttctcctgacttttctgttgtcctatggctatgagactacaggggttgggggatggggatgcccccaccaccaccagtgtgagaatgagatatggttggggaggcgtgtttggcacttttacaaggttgcattgtccacatttgcttggatggtggcatctgtagcccaaatgggcattcagtcttttcttctgctgtgaggtaagagtaattcagacctaatgaatgagaagagggagcactttgatccacagactttggattaacactgtacccactcttagcaaaaggggacttctctaacaagctagcattgtgttaacctgtcattaacccagcattagagacaggtcactgggatgttcattctggctctcagcctgctgttatttccccactctcacctgtgctagttcgctttctccagaagaggagctgaggtggtcttatcctcagataggacatgagaaattggaatttggcaagcaagggcttcagcatcctttagtttctaaagcaagatcccttcagagaagtctagcaggaagaagccaggagaatgtagaatggaaaagagctcttactccaaattttagagaagtttcagctctacttctcatcttttctctcctggtcttacttgaatgcatgttggtaatctgtatacattactatgactgtgtctatcacaagtcctacaaaataaaaatggacttaaaagtactctctgctgaggctgtaagttttgttttgtgagaaataggtaaagacattagcatttaatctactggaataagctggttgctgtggcttatacctgtagtcccagatacttgggaggctgaggcaggagaatcacttgagaccagcctgggcaatatagtgagacctcacctctaaaaaagttttttataaatttacttgtctaaagtggggaaagggaaattattctgttttcttattcttgcttcaagactatgacagatttgaaagagaattctaaagcagatttagagaacctgcttctcttcttatctcctaatccctaaattgtaatttagctcttatctgtattgttgttttgttttggtaaagggatgatttttacattgagttttaaagtagaataagaaaagcttctaaaaacttgcattgtgctagggatctgccctatatctttgcctctggtgtttcgttgttgttgttattgtttgtttgtttccaaagaagttggagttaaggacacaatatatttgtacccctagactgaatgggtgagtattccatatgaggatctgggtaatcctctttgcaacccacatttggtcttcagagacactggcattttgaagaaacatatgatatagctgtttggaaataaattcatctatgttactttttttttcttttttttttttttttatgagcaggagatcttaattgacagaaactcattggtggttggagtggccaatgggcacgggaaaaagtatccagtaatcagaagaattgtatctgggttatgtaatcttatgcacattccattgtctttgccaagcccagaagccatgttgtgttcattgttaagaaatttgatagatttacccagcttttctatgtattttgacttattgaaaatatgtaacaactgagtcgggttgcagcactggtggggtagaatcgactttccctgaaggtgacacagatgtcagaattgtgtccagggatttaatttagacccatactgtccaggagactgtctctagttggatctctgtgctgactgactgacagacagactttagtgtctgtgtgctgactgacagactctagtagtgtctatatgttgaccaactggtagaccaggaggatctgtgtgctgattgactctagtaggatctgtttgtcactgacagactgtagtagtgtctgtgtgctgactgatagatagactatagtaaaatttgggtgttgcctgactaacggtctagggtctgtaagctgacagtctgcctgctttctgattgtatccattgaagtgtatgtacattatggtaattctctgtctattaaatgtgtctaacaaaggaaggaattaagcactccacgtgttttctttataggggagttctgtacactatgattttaaatagatatttcttatatagtagtggccaaattctcattattttgtacaagataaaggttatgcatcacttttatggtattttgtgaactcagctaagggaatgcctgttcagagcctggagttgttacctttacttgaagtcatctcatccagtcccctgctttagggcaggacttcagttccactgttcatttctgaagcttctgtgtccccagcttaccctgttctgaaatgttgtattccattggacagggctgctatttttagtcagccatgcatttggattttacacttaatctagtaagtaaaaatgagaagaaaatttggcatttaaaaattgattttaagggttggcaaaagtattttttccagtaagcctttcactggatatctgtgaccaatgtttacctacgcaatgtttttgtatctgaattgcttatgtacgttttttattatattgacctaacaagaagatcaacttatgctggtatggtgatggttttgctatggcaaaatcaaagggctgatcatacatggtgccctttgggaagggggatggtgtggggctgagcacctctgggttgaatgggaatgggtcagattgggaagcctaggaagagagttctactgtagatttcctaggcactgctctgttgaaataggaacataagtctttagcaacattctgatttaatcgggtgacactgataacaaagtatgccactcagatccatttaaagtgtgcataactgtatttgaaatgtgtttttgtgtgcgtgtgtgtagaatgggtaaataaaattgttgagtaacttgaacctatcagaa

SEQ ID NO: 102972 - DNA, 1876 bp, Homo sapiens
  Payload ID: 94
  Gene Symbol: PFKFB2
  Gene Name: 6-phosphofructo-2-kinase/fructose-2,6-biphosphatase 2
  ENST ID: ENST00000411990
  CDS Start-End: 273-563
agtgcaaccagagtcacacccatggatgaagtcaatgaagttgatccagctccatagcctccaagacggccatcaaacctgtttttcaccacattttacagtattgcctcactatagaagtctggatcgcttgctacaatttgtgctatgaggcgtctcatctcaggggcacaagctggattcaagactcctccttcgacgacatagtacacactagtaaagaggcaagagttgtctgctgggaccacggttctgacatctgaagagctgccatgtctggggcatcttcctcagaacagaacaacaacagctatgaaaccaaaaccccaaatcttcgaatgtcagagaagaaatgttcatgggcctcctacatgaccaactccccgactctgatcgttatgattggtttgccagcccggggtaaaacctacgtgtccaagaaactaacacgctacctcaactggattggagtccccaccaaaggccaagaaacaagtcccatttggtggggccatcatattattttgctgctgaaggatttgggtgtcttctacagtgtttaatcttggggtgtatcggcgtgaagcagtcaagtcctataagtcctacgacttctttcggcatgacaatgaggaggccatgaagatccgcaaacagtgtgctctggtggcgctggaagatgttaaggcgtatctcactgaggagaatggtcagattgcggtgtttgatgccaccaatacaacccgggagaggagggacatgattttgaactttgctgaacagaattccttcaaggtattctttgtggaatccgtctgtgatgatcctgatgtcattgctgccaatattctggaggttaaggtatcaagccctgactatcctgaaaggaacagagagaacgtgatggaggacttcctgaagagaattgaatgctacaaagttacctaccgacctcttgacccagacaactatgacaaggatctttctttcatcaaggtgataaacgtgggccagcgatttttagtcaacagagtccaggactacatccagagcaagatagtctactacctcatgaatatccacgtccagcctcgcaccatttacctttgccggcatggagaaagcgagttcaatctcttggggaagattgggggtgactctggcctctcggtgcggggaaagcagtttgcccaagctctaaggaaatttctggaggaacaggaaataacagacctcaaagtgtggacaagccagttgaagaggaccatacagactgctgaatctctcggggtgccctatgagcagtggaagattctgaatgagattgatgctggtgtgtgtgaagagatgacctatgcagagattgagaaacggtacccagaagagtttgcacttcgagatcaagagaagtatctgtatcgatatcctggtggggagtcataccaggacctggtgcagcggctggagcctgtcatcatggagctggaacgtcagggcaatgtcctcgtcatctcccaccaggctgtcatgcgctgcctcctggcctacttcttggataagggcgcagatgagctaccatacttgagatgccctctccataccatcttcaaacttactcctgtggcctatgggtgcaaagtggaaacaattaaacttaacgtggaggctgtgaacacgcaccgtgacaagccaactgcagcagagaccacactggctgtgcgcagacgcccctccgcagcgtccctcatgttgccttgctaatgatgtggatgttcaggcctcacctctccaaacgactgggatctactgaaaagcttgggatgtcagcttcacagaggctagaacaggaagttaagtgggaactggactttggggg

SEQ ID NO: 102973 - DNA, 543 bp, Homo sapiens
  Payload ID: 94
  Gene Symbol: PFKFB2
  Gene Name: 6-phosphofructo-2-kinase/fructose-2,6-biphosphatase 2
  ENST ID: ENST00000545806
  CDS Start-End: 169-543
gatgtcataatactaacaaaacaggaagggcatctccaaatcagcagttcagtgcaaccagagtcacacccatggatgaagtcaatgaagttgatccagctccatagcctccaagacggccatcaaacctgtttttcaccacattttacagacatctgaagagctgccatgtctggggcatcttcctcagaacagaacaacaacagctatgaaaccaaaaccccaaatcttcgaatgtcagagaagaaatgttcatgggcctcctacatgaccaactccccgactctgatcgttatgattggtttgccagcccggggtaaaacctacgtgtccaagaaactaacacgctacctcaactggattggagtccccaccaaagtgtttaatcttggggtgtatcggcgtgaagcagtcaagtcctataagtcctacgacttctttcggcatgacaatgaggaggccatgaagatccgcaaacagtgtgctctggtggcgctggaagatgttaaggcgtatctcactgaggagaatggtcagattgcg

SEQ ID NO: 102974 - DNA, 523 bp, Homo sapiens
  Payload ID: 94
  Gene Symbol: PFKFB2
  Gene Name: 6-phosphofructo-2-kinase/fructose-2,6-biphosphatase 2
  ENST ID: ENST00000464777
  CDS Start-End: 110-244
ggtcccggccacaagctgtcggctcggttcggtcgcgttacagggcaggcgccggggccaaggcagggagggatcttaggagagatcgtaggacatctgaagagctgccatgtctggggcatcttcctcagaacagaacaacaacagctatgaaaccaaaaccccaaatcttcgaatgtcagagaagaaatgttgctggagtgcagtgacgggatcatggctcactgcaaccttgaactcctgagctcaagcaatcctcctgagtagctgggactatagcatgggcctcctacatgaccaactccccgactctgatcgttatgattggtttgccagcccggggtaaaacctacgtgtccaagaaactaacacgctacctcaactggattggagtccccaccaaagtgtttaatcttggggtgtatcggcgtgaagcagtcaagtcctataagtcctacgacttctttcggcatgacaatgaggaggccatgaagatccgcaatgtgctctggtggcgctggaa

SEQ ID NO: 102975 - DNA, 554 bp, Homo sapiens
  Payload ID: 94
  Gene Symbol: PFKFB2
  Gene Name: 6-phosphofructo-2-kinase/fructose-2,6-biphosphatase 2
  ENST ID: ENST00000618513
  CDS Start-End: 408-554
agtgcaaccagagtcacacccatggatgaagtcaatgaagttgatccagctccatagaaatataccaagtctctaacattccaagagagttggaaaggaggcctggactacagaaaagggaggatttccaaagtcagtcaaaagcctgaaagaataagacttcctggttgatataggtcatcatttgaggggcctccaagacggccatcaaacctgtttttcaccacattttacagtattgcctcactatagaagtctggatcgcttgctacaatttgtgctatgaggcgtctcatctcaggggcacaagctggattcaagactcctccttcgacgacatagtacacactagtaaagaggcaagagttgtctgctgggaccacggttctgacatctgaagagctgccatgtctggggcatcttcctcagaacagaacaacaacagctatgaaaccaaaaccccaaatcttcgaatgtcagagaagaaatgttcatgggcctcctacatgaccaactccccgactctgatcgttatgattggtttgccagcccgg

SEQ ID NO: 102976 - DNA, 1964 bp, Homo sapiens
  Payload ID: 95
  Gene Symbol: PFKFB3
  Gene Name: 6-phosphofructo-2-kinase/fructose-2,6-biphosphatase 3
  Uniprot ID: Q16875
  ENST ID: ENST00000360521
  CDS Start-End: 362-1906
tctttaaaagccggcggtgcgcggggcatcccagccaagccggagaggaggcgagcagcagggcctggtggcgagagcgcggctgtcactgcgcccgagcatcccagagctttccgagcggacgagccggccgtgccgggcatccccagcctcgctaccctcgcagcacacgtcgagccccgcacaggcgagggtccggaacttagcccaaagcacgtttcccctggcagcgcaggaaacgcccggccgcgcgccggcgcacgcccccctctcctcctttgttccgggggtcggcggccgctctcctgccagcgtcgggatctcggccccgggaggcgggccgtcgggcgcagccgcgaagatgccgttggaactgacgcagagccgagtgcagaagatctgggtgcccgtggaccacaggccctcgttgcccagatcctgtgggccaaagctgaccaactcccccaccgtcatcgtcatggtgggcctccccgcccggggcaagacctacatctccaagaagctgactcgctacctcaactggattggcgtccccacaaaagtgttcaacgtcggggagtatcgccgggaggctgtgaagcagtacagctcctacaacttcttccgccccgacaatgaggaagccatgaaagtccggaagcaatgtgccttagctgccttgagagatgtcaaaagctacctggcgaaagaagggggacaaattgcggttttcgatgccaccaatactactagagagaggagacacatgatccttcattttgccaaagaaaatgactttaaggcgtttttcatcgagtcggtgtgcgacgaccctacagttgtggcctccaatatcatggaagttaaaatctccagcccggattacaaagactgcaactcggcagaagccatggacgacttcatgaagaggatcagttgctatgaagccagctaccagcccctcgaccccgacaaatgcgacagggacttgtcgctgatcaaggtgattgacgtgggccggaggttcctggtgaaccgggtgcaggaccacatccagagccgcatcgtgtactacctgatgaacatccacgtgcagccgcgtaccatctacctgtgccggcacggcgagaacgagcacaacctccagggccgcatcgggggcgactcaggcctgtccagccggggcaagaagtttgccagtgctctgagcaagttcgtggaggagcagaacctgaaggacctgcgcgtgtggaccagccagctgaagagcaccatccagacggccgaggcgctgcggctgccctacgagcagtggaaggcgctcaatgagatcgacgcgggcgtctgtgaggagctgacctacgaggagatcagggacacctaccctgaggagtatgcgctgcgggagcaggacaagtactattaccgctaccccaccggggagtcctaccaggacctggtccagcgcttggagccagtgatcatggagctggagcggcaggagaatgtgctggtcatctgccaccaggccgtcctgcgctgcctgcttgcctacttcctggataagagtgcagaggagatgccctacctgaaatgccctcttcacaccgtcctgaaactgacgcctgtcgcttatggctgccgtgtggaatccatctacctgaacgtggagtccgtctgcacacaccgggagaggtcagaggatgcaaagaagggacctaacccgctcatgagacgcaatagtgtcaccccgctagccagccccgaacccaccaaaaagcctcgcatcaacagctttgaggagcatgtggcctccacctcggccgccctgcccagctgcctgcccccggaggtgcccacgcagctgcctggacaacctttgctagggcaagcctgtctaacatgaaaggctcccggagcagcgctgactcctccaggaaacactgaggcagacgtgtcggttc

SEQ ID NO: 102977 - DNA, 4483 bp, Homo sapiens
  Payload ID: 95
  Gene Symbol: PFKFB3
  Gene Name: 6-phosphofructo-2-kinase/fructose-2,6-biphosphatase 3
  Uniprot ID: Q16875
  ENST ID: ENST00000379775
  CDS Start-End: 331-1893
cagccaagccggagaggaggcgagcagcagggcctggtggcgagagcgcggctgtcactgcgcccgagcatcccagagctttccgagcggacgagccggccgtgccgggcatccccagcctcgctaccctcgcagcacacgtcgagccccgcacaggcgagggtccggaacttagcccaaagcacgtttcccctggcagcgcaggaaacgcccggccgcgcgccggcgcacgcccccctctcctcctttgttccgggggtcggcggccgctctcctgccagcgtcgggatctcggccccgggaggcgggccgtcgggcgcagccgcgaagatgccgttggaactgacgcagagccgagtgcagaagatctgggtgcccgtggaccacaggccctcgttgcccagatcctgtgggccaaagctgaccaactcccccaccgtcatcgtcatggtgggcctccccgcccggggcaagacctacatctccaagaagctgactcgctacctcaactggattggcgtccccacaaaagtgttcaacgtcggggagtatcgccgggaggctgtgaagcagtacagctcctacaacttcttccgccccgacaatgaggaagccatgaaagtccggaagcaatgtgccttagctgccttgagagatgtcaaaagctacctggcgaaagaagggggacaaattgcggttttcgatgccaccaatactactagagagaggagacacatgatccttcattttgccaaagaaaatgactttaaggcgtttttcatcgagtcggtgtgcgacgaccctacagttgtggcctccaatatcatggaagttaaaatctccagcccggattacaaagactgcaactcggcagaagccatggacgacttcatgaagaggatcagttgctatgaagccagctaccagcccctcgaccccgacaaatgcgacagggacttgtcgctgatcaaggtgattgacgtgggccggaggttcctggtgaaccgggtgcaggaccacatccagagccgcatcgtgtactacctgatgaacatccacgtgcagccgcgtaccatctacctgtgccggcacggcgagaacgagcacaacctccagggccgcatcgggggcgactcaggcctgtccagccggggcaagaagtttgccagtgctctgagcaagttcgtggaggagcagaacctgaaggacctgcgcgtgtggaccagccagctgaagagcaccatccagacggccgaggcgctgcggctgccctacgagcagtggaaggcgctcaatgagatcgacgcgggcgtctgtgaggagctgacctacgaggagatcagggacacctaccctgaggagtatgcgctgcgggagcaggacaagtactattaccgctaccccaccggggagtcctaccaggacctggtccagcgcttggagccagtgatcatggagctggagcggcaggagaatgtgctggtcatctgccaccaggccgtcctgcgctgcctgcttgcctacttcctggataagagtgcagaggagatgccctacctgaaatgccctcttcacaccgtcctgaaactgacgcctgtcgcttatggctgccgtgtggaatccatctacctgaacgtggagtccgtctgcacacaccgggagaggtcagaggatgcaaagaagggacctaacccgctcatgagacgcaatagtgtcaccccgctagccagccccgaacccaccaaaaagcctcgcatcaacagctttgaggagcatgtggcctccacctcggccgccctgcccagctgcctgcccccggaggtgcccacgcagctgcctggacaaaacatgaaaggctcccggagcagcgctgactcctccaggaaacactgaggcagacgtgtcggttccattccatttccatttctgcagcttagcttgtgtcctgccctccgcccgaggcaaaacgtatcctgaggacttcttccggagagggtggggtggagcagcgggggagccttggccgaagagaaccatgcttggcaccgtctgtgtcccctcggccgctggacaccagaaagccacgtgggtccctggcgccctgcctttagccgtggggcccccacctccactctctgggtttcctaggaatgtccagcctcggagaccttcacaaagccttgggagggtgatgagtgctggtcctgacaggaggccgctggggacactgtgctgttttgtttcgtttctgtgatctcccggcacgtttggagctgggaagaccacactggtggcagaatcctaaaattaaaggaggcaggctcctagttgctgaaagttaaggaatgtgtaaaacctccacgtgactgtttggtgcatcttgacctgggaagacgcctcatgggaacgaacttggacaggtgttgggttgaggcctcttctgcaggaagtccctgagctgagacgcaagttggctgggtggtccgcaccctggctctcctgcaggtccacacaccttccaggcctgtggcctgcctccaaagatgtgcaagggcaggctggctgcacggggagagggaagtattttgccgaaatatgagaactggggcctcctgctcccagggagctccagggcccctctctcctcccacctggacttggggggaactgagaaacactttcctggagctgctggcttttgcacttttttgatggcagaagtgtgacctgagagtcccaccttctcttcaggaacgtagatgttggggtgtcttgccctggggggcttggaacctctgaaggtggggagcggaacacctggcatccttccccagcacttgcattaccgtccctgctcttcccaggtggggacagtggcccaagcaaggcctcactcgcagccacttcttcaagagctgcctgcacactgtcttggagcatctgccttgtgcctggcactctgccggtgccttgggaaggtcggaagagtggactttgtcctggccttcccttcatggcgtctatgacacttttgtggtgatggaaagcatgggacctgtcgtctcagcctgttggtttctcctcattgcctcaaaccctggggtaggtgggacggggggtctcgtgcccagatgaaaccatttggaaactcggcagcagagtttgtccaaatgacccttttcaggatgtctcaaagcttgtgccaaaggtcacttttctttcctgccttctgctgtgagccctgagatcctcctcccagctcaagggacaggtcctgggtgagggtgggagatttagacacctgaaactgggcgtggagagaagagccgttgctgtttgttttttgggaagagcttttaaagaatgcatgtttttttcctggttggaattgagtaggaactgaggctgtgcttcaggtatggtacaatcaagtgggggattttcatgctgaaccattcaagccctccccgcccgttgcacccactttggctggcgtctgctggagaggatgtctctgtccgcattcccgtgcagctccaggctcgcgcagttttctctctctccctggatgttgagtctcatcagaatatgtgggtagggggtggacgtgcacgggtgcatgattgtgcttaacttggttgtatttttcgatttgacatggaaggcctgttgctttgctcttgagaatagtttctcgtgtccccctcgcaggcctcattctttgaacatcgactctgaagtttgatacagataggggcttgatagctgtggtcccctctcccctctgactacctaaaatcaatacctaaatacagaagccttggtctaacacgggacttttagtttgcgaagggcctagatagggagagaggtaacatgaatctggacagggagggagatactatagaaaggagaacactgcctactttgcaagccagtgacctgccttttgaggggacattggacgggggccgggggcgggggttgggtttgagctacagtcatgaacttttggcgtctactgattcctccaactctccaccccacaaaataacggggaccaatatttttaactttgcctatttgtttttgggtgagtttcccccctccttattctgtcctgagaccacgggcaaagctcttcattttgagagagaagaaaaactgtttggaaccacaccaatgatatttttctttgtaatacttgaaatttatttttttattattttgatagcagatgtgctatttatttatttaatatgtataaggagcctaaacaatagaaagctgtagagattgggtttcattgttaattggtttgggagcctcctatgtgtgacttatgacttctctgtgttctgtgtatttgtctgaattaatgacctgggatataaagctatgctagctttcaaacaggagatgcctttcagaaatttgtatattttgcagttgccagaccaataaaatacctggttgaaataca

SEQ ID NO: 102978 - DNA, 1999 bp, Homo sapiens
  Payload ID: 95
  Gene Symbol: PFKFB3
  Gene Name: 6-phosphofructo-2-kinase/fructose-2,6-biphosphatase 3
  ENST ID: ENST00000317350
  CDS Start-End: 396-1937
gaggctgacgtacgcgtctgcggccagcccggactctttaaaagccggcggtgcgcggggcatcccagccaagccggagaggaggcgagcagcagggcctggtggcgagagcgcggctgtcactgcgcccgagcatcccagagctttccgagcggacgagccggccgtgccgggcatccccagcctcgctaccctcgcagcacacgtcgagccccgcacaggcgagggtccggaacttagcccaaagcacgtttcccctggcagcgcaggaaacgcccggccgcgcgccggcgcacgcccccctctcctcctttgttccgggggtcggcggccgctctcctgccagcgtcgggatctcggccccgggaggcgggccgtcgggcgcagccgcgaagatgccgttggaactgacgcagagccgagtgcagaagatctgggtgcccgtggaccacaggccctcgttgcccagatcctgtgggccaaagctgaccaactcccccaccgtcatcgtcatggtgggcctccccgcccggggcaagacctacatctccaagaagctgactcgctacctcaactggattggcgtccccacaaaagtgttcaacgtcggggagtatcgccgggaggctgtgaagcagtacagctcctacaacttcttccgccccgacaatgaggaagccatgaaagtccggaagcaatgtgccttagctgccttgagagatgtcaaaagctacctggcgaaagaagggggacaaattgcggttttcgatgccaccaatactactagagagaggagacacatgatccttcattttgccaaagaaaatgactttaaggcgtttttcatcgagtcggtgtgcgacgaccctacagttgtggcctccaatatcatggaagttaaaatctccagcccggattacaaagactgcaactcggcagaagccatggacgacttcatgaagaggatcagttgctatgaagccagctaccagcccctcgaccccgacaaatgcgacagggacttgtcgctgatcaaggtgattgacgtgggccggaggttcctggtgaaccgggtgcaggaccacatccagagccgcatcgtgtactacctgatgaacatccacgtgcagccgcgtaccatctacctgtgccggcacggcgagaacgagcacaacctccagggccgcatcgggggcgactcaggcctgtccagccggggcaagaagtttgccagtgctctgagcaagttcgtggaggagcagaacctgaaggacctgcgcgtgtggaccagccagctgaagagcaccatccagacggccgaggcgctgcggctgccctacgagcagtggaaggcgctcaatgagatcgacgcgggcgtctgtgaggagctgacctacgaggagatcagggacacctaccctgaggagtatgcgctgcgggagcaggacaagtactattaccgctaccccaccggggagtcctaccaggacctggtccagcgcttggagccagtgatcatggagctggagcggcaggagaatgtgctggtcatctgccaccaggccgtcctgcgctgcctgcttgcctacttcctggataagagtgcagaggagatgccctacctgaaatgccctcttcacaccgtcctgaaactgacgcctgtcgcttatggctgccgtgtggaatccatctacctgaacgtggagtccgtctgcacacaccgggagaggtcagaggatgcaaagaagggacctaacccgctcatgagacgcaatagtgtcaccccgctagccagccccgaacccaccaaaaagcctcgcatcaacagctttgaggagcatgtggcctccacctcggccgccctgcccagctgcctgcccccggaggtgcccacgcagctgcctggacaacctttgctagggcaagcctgtctgtaagtatctctccgatcatcgctgctgcttgcactgctttcttcctgcttgctcatttggcctcc

SEQ ID NO: 102979 - DNA, 2181 bp, Homo sapiens
  Payload ID: 95
  Gene Symbol: PFKFB3
  Gene Name: 6-phosphofructo-2-kinase/fructose-2,6-biphosphatase 3
  ENST ID: ENST00000379785
  CDS Start-End: 396-1976
gaggctgacgtacgcgtctgcggccagcccggactctttaaaagccggcggtgcgcggggcatcccagccaagccggagaggaggcgagcagcagggcctggtggcgagagcgcggctgtcactgcgcccgagcatcccagagctttccgagcggacgagccggccgtgccgggcatccccagcctcgctaccctcgcagcacacgtcgagccccgcacaggcgagggtccggaacttagcccaaagcacgtttcccctggcagcgcaggaaacgcccggccgcgcgccggcgcacgcccccctctcctcctttgttccgggggtcggcggccgctctcctgccagcgtcgggatctcggccccgggaggcgggccgtcgggcgcagccgcgaagatgccgttggaactgacgcagagccgagtgcagaagatctgggtgcccgtggaccacaggccctcgttgcccagatcctgtgggccaaagctgaccaactcccccaccgtcatcgtcatggtgggcctccccgcccggggcaagacctacatctccaagaagctgactcgctacctcaactggattggcgtccccacaaaagtgttcaacgtcggggagtatcgccgggaggctgtgaagcagtacagctcctacaacttcttccgccccgacaatgaggaagccatgaaagtccggaagcaatgtgccttagctgccttgagagatgtcaaaagctacctggcgaaagaagggggacaaattgcggttttcgatgccaccaatactactagagagaggagacacatgatccttcattttgccaaagaaaatgactttaaggcgtttttcatcgagtcggtgtgcgacgaccctacagttgtggcctccaatatcatggaagttaaaatctccagcccggattacaaagactgcaactcggcagaagccatggacgacttcatgaagaggatcagttgctatgaagccagctaccagcccctcgaccccgacaaatgcgacagggacttgtcgctgatcaaggtgattgacgtgggccggaggttcctggtgaaccgggtgcaggaccacatccagagccgcatcgtgtactacctgatgaacatccacgtgcagccgcgtaccatctacctgtgccggcacggcgagaacgagcacaacctccagggccgcatcgggggcgactcaggcctgtccagccggggcaagaagtttgccagtgctctgagcaagttcgtggaggagcagaacctgaaggacctgcgcgtgtggaccagccagctgaagagcaccatccagacggccgaggcgctgcggctgccctacgagcagtggaaggcgctcaatgagatcgacgcgggcgtctgtgaggagctgacctacgaggagatcagggacacctaccctgaggagtatgcgctgcgggagcaggacaagtactattaccgctaccccaccggggagtcctaccaggacctggtccagcgcttggagccagtgatcatggagctggagcggcaggagaatgtgctggtcatctgccaccaggccgtcctgcgctgcctgcttgcctacttcctggataagagtgcagaggagatgccctacctgaaatgccctcttcacaccgtcctgaaactgacgcctgtcgcttatggctgccgtgtggaatccatctacctgaacgtggagtccgtctgcacacaccgggagaggtcagaggatgcaaagaagggacctaacccgctcatgagacgcaatagtgtcaccccgctagccagccccgaacccaccaaaaagcctcgcatcaacagctttgaggagcatgtggcctccacctcggccgccctgcccagctgcctgcccccggaggtgcccacgcagctgcctggacaacctttgctagggcaagcctgtctacgaactgtctgtcacattttctcaaagttttctccttactaactgtggaagaacatgaaaggctcccggagcagcgctgactcctccaggaaacactgaggcagacgtgtcggttccattccatttccatttctgcagcttagcttgtgtcctgccctccgcccgaggcaaaacgtatcctgaggacttcttccggagagggtggggtggagcagcgggggagccttggccgaagagaaccatgctt

SEQ ID NO: 102980 - DNA, 4157 bp, Homo sapiens
  Payload ID: 95
  Gene Symbol: PFKFB3
  Gene Name: 6-phosphofructo-2-kinase/fructose-2,6-biphosphatase 3
  Uniprot ID: Q16875
  ENST ID: ENST00000379789
  CDS Start-End: 65-1567
gccgcttggacgtcgtcctgtctgggtgtcgcgggccggccccgcggggagcgcccccggcgcgatgcccttcaggaaagcctgtgggccaaagctgaccaactcccccaccgtcatcgtcatggtgggcctccccgcccggggcaagacctacatctccaagaagctgactcgctacctcaactggattggcgtccccacaaaagtgttcaacgtcggggagtatcgccgggaggctgtgaagcagtacagctcctacaacttcttccgccccgacaatgaggaagccatgaaagtccggaagcaatgtgccttagctgccttgagagatgtcaaaagctacctggcgaaagaagggggacaaattgcggttttcgatgccaccaatactactagagagaggagacacatgatccttcattttgccaaagaaaatgactttaaggcgtttttcatcgagtcggtgtgcgacgaccctacagttgtggcctccaatatcatggaagttaaaatctccagcccggattacaaagactgcaactcggcagaagccatggacgacttcatgaagaggatcagttgctatgaagccagctaccagcccctcgaccccgacaaatgcgacagggacttgtcgctgatcaaggtgattgacgtgggccggaggttcctggtgaaccgggtgcaggaccacatccagagccgcatcgtgtactacctgatgaacatccacgtgcagccgcgtaccatctacctgtgccggcacggcgagaacgagcacaacctccagggccgcatcgggggcgactcaggcctgtccagccggggcaagaagtttgccagtgctctgagcaagttcgtggaggagcagaacctgaaggacctgcgcgtgtggaccagccagctgaagagcaccatccagacggccgaggcgctgcggctgccctacgagcagtggaaggcgctcaatgagatcgacgcgggcgtctgtgaggagctgacctacgaggagatcagggacacctaccctgaggagtatgcgctgcgggagcaggacaagtactattaccgctaccccaccggggagtcctaccaggacctggtccagcgcttggagccagtgatcatggagctggagcggcaggagaatgtgctggtcatctgccaccaggccgtcctgcgctgcctgcttgcctacttcctggataagagtgcagaggagatgccctacctgaaatgccctcttcacaccgtcctgaaactgacgcctgtcgcttatggctgccgtgtggaatccatctacctgaacgtggagtccgtctgcacacaccgggagaggtcagaggatgcaaagaagggacctaacccgctcatgagacgcaatagtgtcaccccgctagccagccccgaacccaccaaaaagcctcgcatcaacagctttgaggagcatgtggcctccacctcggccgccctgcccagctgcctgcccccggaggtgcccacgcagctgcctggacaaaacatgaaaggctcccggagcagcgctgactcctccaggaaacactgaggcagacgtgtcggttccattccatttccatttctgcagcttagcttgtgtcctgccctccgcccgaggcaaaacgtatcctgaggacttcttccggagagggtggggtggagcagcgggggagccttggccgaagagaaccatgcttggcaccgtctgtgtcccctcggccgctggacaccagaaagccacgtgggtccctggcgccctgcctttagccgtggggcccccacctccactctctgggtttcctaggaatgtccagcctcggagaccttcacaaagccttgggagggtgatgagtgctggtcctgacaggaggccgctggggacactgtgctgttttgtttcgtttctgtgatctcccggcacgtttggagctgggaagaccacactggtggcagaatcctaaaattaaaggaggcaggctcctagttgctgaaagttaaggaatgtgtaaaacctccacgtgactgtttggtgcatcttgacctgggaagacgcctcatgggaacgaacttggacaggtgttgggttgaggcctcttctgcaggaagtccctgagctgagacgcaagttggctgggtggtccgcaccctggctctcctgcaggtccacacaccttccaggcctgtggcctgcctccaaagatgtgcaagggcaggctggctgcacggggagagggaagtattttgccgaaatatgagaactggggcctcctgctcccagggagctccagggcccctctctcctcccacctggacttggggggaactgagaaacactttcctggagctgctggcttttgcacttttttgatggcagaagtgtgacctgagagtcccaccttctcttcaggaacgtagatgttggggtgtcttgccctggggggcttggaacctctgaaggtggggagcggaacacctggcatccttccccagcacttgcattaccgtccctgctcttcccaggtggggacagtggcccaagcaaggcctcactcgcagccacttcttcaagagctgcctgcacactgtcttggagcatctgccttgtgcctggcactctgccggtgccttgggaaggtcggaagagtggactttgtcctggccttcccttcatggcgtctatgacacttttgtggtgatggaaagcatgggacctgtcgtctcagcctgttggtttctcctcattgcctcaaaccctggggtaggtgggacggggggtctcgtgcccagatgaaaccatttggaaactcggcagcagagtttgtccaaatgacccttttcaggatgtctcaaagcttgtgccaaaggtcacttttctttcctgccttctgctgtgagccctgagatcctcctcccagctcaagggacaggtcctgggtgagggtgggagatttagacacctgaaactgggcgtggagagaagagccgttgctgtttgttttttgggaagagcttttaaagaatgcatgtttttttcctggttggaattgagtaggaactgaggctgtgcttcaggtatggtacaatcaagtgggggattttcatgctgaaccattcaagccctccccgcccgttgcacccactttggctggcgtctgctggagaggatgtctctgtccgcattcccgtgcagctccaggctcgcgcagttttctctctctccctggatgttgagtctcatcagaatatgtgggtagggggtggacgtgcacgggtgcatgattgtgcttaacttggttgtatttttcgatttgacatggaaggcctgttgctttgctcttgagaatagtttctcgtgtccccctcgcaggcctcattctttgaacatcgactctgaagtttgatacagataggggcttgatagctgtggtcccctctcccctctgactacctaaaatcaatacctaaatacagaagccttggtctaacacgggacttttagtttgcgaagggcctagatagggagagaggtaacatgaatctggacagggagggagatactatagaaaggagaacactgcctactttgcaagccagtgacctgccttttgaggggacattggacgggggccgggggcgggggttgggtttgagctacagtcatgaacttttggcgtctactgattcctccaactctccaccccacaaaataacggggaccaatatttttaactttgcctatttgtttttgggtgagtttcccccctccttattctgtcctgagaccacgggcaaagctcttcattttgagagagaagaaaaactgtttggaaccacaccaatgatatttttctttgtaatacttgaaatttatttttttattattttgatagcagatgtgctatttatttatttaatatgtataaggagcctaaacaatagaaagctgtagagattgggtttcattgttaattggtttgggagcctcctatgtgtgacttatgacttctctgtgttctgtgtatttgtctgaattaatgacctgggatataaagctatgctagctttcaaacaggagatgcctttcagaaatttgtatattttgcagttgccagaccaataaaatacctggttgaaataca

SEQ ID NO: 102981 - DNA, 595 bp, Homo sapiens
  Payload ID: 95
  Gene Symbol: PFKFB3
  Gene Name: 6-phosphofructo-2-kinase/fructose-2,6-biphosphatase 3
  ENST ID: ENST00000450232
  CDS Start-End: 1-430
cgtggaggagcagaacctgaaggacctgcgcgtgtggaccagccagctgaagagcaccatccagacggccgaggcgctgcggctgccctacgagcagtggaaggcgctcaatgagatcgacgcgtcctaccaggacctggtccagcgcttggagccagtgatcatggagctggagcggcaggagaatgtgctggtcatctgccaccaggccgtcctgcgctgcctgcttgcctacttcctggataagagtgcagaggagatgccctacctgaaatgccctcttcacaccgtcctgaaactgacgcctgtcgcttatggctgccgtgtggaatccatctacctgaacgtggagtccgtctgcacacaccgggagaggtcagagaacatgaaaggctcccggagcagcgctgactcctccaggaaacactgaggcagacgtgtcggttccattccatttccatttctgcagcttagcttgtgtcctgccctccgcccgaggcaaaacgtatcctgaggacttcttccggagagggtggggtggagcagcgggggagccttggccgaagagaaccatgcttggcaccgtctgtgtccc

SEQ ID NO: 102982 - DNA, 244 bp, Homo sapiens
  Payload ID: 95
  Gene Symbol: PFKFB3
  Gene Name: 6-phosphofructo-2-kinase/fructose-2,6-biphosphatase 3
  ENST ID: ENST00000441697
  CDS Start-End: 1-96
atctacctgaacgtggagtccgtctgcacacaccgggagaggtcagagaacatgaaaggctcccggagcagcgctgactcctccaggaaacactgaggcagacgtgtcggttccattccatttccatttctgcagcttagcttgtgtcctgccctccgcccgaggcaaaacgtatcctgaggacttcttccggagagggtggggtggagcagcgggggagccttggccgaagagaaccatgctt

SEQ ID NO: 102983 - DNA, 513 bp, Homo sapiens
  Payload ID: 95
  Gene Symbol: PFKFB3
  Gene Name: 6-phosphofructo-2-kinase/fructose-2,6-biphosphatase 3
  ENST ID: ENST00000414237
  CDS Start-End: 1-279
atctacctgaacgtggagtccgtctgcacacaccgggagaggtcagaggatgcaaagaagggacctaacccgctcatgagacgcaatagtgtcaccccgctagccagccccgaacccaccaaaaagcctcgcatcaacagctttgaggagcatgtggcctccacctcggccgccctgcccagctgcctgcccccggaggtgcccacgcagctgcctggacaacctttgctagggcaagcctgtctaaactggaaaggtgtgatgaggaatgcagcctgagatgctgaaaagaatgactggctttggaaatgggagagaacatgaaaggctcccggagcagcgctgactcctccaggaaacactgaggcagacgtgtcggttccattccatttccatttctgcagcttagcttgtgtcctgccctccgcccgaggcaaaacgtatcctgaggacttcttccggagagggtggggtggagcagcgggggagccttggccgaagagaaccatgctt

SEQ ID NO: 102984 - DNA, 2063 bp, Homo sapiens
  Payload ID: 95
  Gene Symbol: PFKFB3
  Gene Name: 6-phosphofructo-2-kinase/fructose-2,6-biphosphatase 3
  ENST ID: ENST00000477914
  CDS Start-End: 396-1763
gaggctgacgtacgcgtctgcggccagcccggactctttaaaagccggcggtgcgcggggcatcccagccaagccggagaggaggcgagcagcagggcctggtggcgagagcgcggctgtcactgcgcccgagcatcccagagctttccgagcggacgagccggccgtgccgggcatccccagcctcgctaccctcgcagcacacgtcgagccccgcacaggcgagggtccggaacttagcccaaagcacgtttcccctggcagcgcaggaaacgcccggccgcgcgccggcgcacgcccccctctcctcctttgttccgggggtcggcggccgctctcctgccagcgtcgggatctcggccccgggaggcgggccgtcgggcgcagccgcgaagatgccgttggaactgacgcagagccgagtgcagaagatctgggtgcccgtggaccacaggccctcgttgcccagatcctgtgggccaaagctgaccaactcccccaccgtcatcgtcatggtgggcctccccgcccggggcaagacctacatctccaagaagctgactcgctacctcaactggattggcgtccccacaaaagtgttcaacgtcggggagtatcgccgggaggctgtgaagcagtacagctcctacaacttcttccgccccgacaatgaggaagccatgaaagtccggaagcaatgtgccttagctgccttgagagatgtcaaaagctacctggcgaaagaagggggacaaattgcggttttcgatgccaccaatactactagagagaggagacacatgatccttcattttgccaaagaaaatgactttaaggcgtttttcatcgagtcggtgtgcgacgaccctacagttgtggcctccaatatcatggaagttaaaatctccagcccggattacaaagactgcaactcggcagaagccatggacgacttcatgaagaggatcagttgctatgaagccagctaccagcccctcgaccccgacaaatgcgacagggacttgtcgctgatcaaggtgattgacgtgggccggaggttcctggtgaaccgggtgcaggaccacatccagagccgcatcgtgtactacctgatgaacatccacgtgcagccgcgtaccatctacctgtgccggcacggcgagaacgagcacaacctccagggccgcatcgggggcgactcaggcctgtccagccggggcaagaagtttgccagtgctctgagcaagttcgtggaggagcagaacctgaaggacctgcgcgtgtggaccagccagctgaagagcaccatccagacggccgaggcgctgcggctgccctacgagcagtggaaggcgctcaatgagatcgacgcgggcgtctgtgaggagctgacctacgaggagatcagggacacctaccctgaggagtatgcgctgcgggagcaggacaagtactattaccgctaccccaccggggagtcctaccaggacctggtccagcgcttggagccagtgatcatggagctggagcggcaggagaatgtgctggtcatctgccaccaggccgtcctgcgctgcctgcttgcctacttcctggataagagtgcagaggagatgccctacctgaaatgccctcttcacaccgtcctgaaactgacgcctgtcgcttatggctgccgtgtggaatccatctacctgaacgtggagtccgtctgcacacaccgggagaggtcagaggctgccaaaagtacaacactgtgctagtactagtcagacctttctcttagaccgagcgtgactttctgtcatggcgttcccgaaacaggatgcaaagaagggacctaacccgctcatgagacgcaatagtgtcaccccgctagccagccccgaacccaccaaaaagcctcgcatcaacagctttgaggagcatgtggcctccacctcggccgccctgcccagctgcctgcccccggaggtgcccacgcagctgcctggacaaaacatgaaaggctcccggagcagcgctgactcctccaggaaacactgaggcagacgtgtcggttc

SEQ ID NO: 102985 - DNA, 2098 bp, Homo sapiens
  Payload ID: 95
  Gene Symbol: PFKFB3
  Gene Name: 6-phosphofructo-2-kinase/fructose-2,6-biphosphatase 3
  ENST ID: ENST00000461744
  CDS Start-End: 396-1763
gaggctgacgtacgcgtctgcggccagcccggactctttaaaagccggcggtgcgcggggcatcccagccaagccggagaggaggcgagcagcagggcctggtggcgagagcgcggctgtcactgcgcccgagcatcccagagctttccgagcggacgagccggccgtgccgggcatccccagcctcgctaccctcgcagcacacgtcgagccccgcacaggcgagggtccggaacttagcccaaagcacgtttcccctggcagcgcaggaaacgcccggccgcgcgccggcgcacgcccccctctcctcctttgttccgggggtcggcggccgctctcctgccagcgtcgggatctcggccccgggaggcgggccgtcgggcgcagccgcgaagatgccgttggaactgacgcagagccgagtgcagaagatctgggtgcccgtggaccacaggccctcgttgcccagatcctgtgggccaaagctgaccaactcccccaccgtcatcgtcatggtgggcctccccgcccggggcaagacctacatctccaagaagctgactcgctacctcaactggattggcgtccccacaaaagtgttcaacgtcggggagtatcgccgggaggctgtgaagcagtacagctcctacaacttcttccgccccgacaatgaggaagccatgaaagtccggaagcaatgtgccttagctgccttgagagatgtcaaaagctacctggcgaaagaagggggacaaattgcggttttcgatgccaccaatactactagagagaggagacacatgatccttcattttgccaaagaaaatgactttaaggcgtttttcatcgagtcggtgtgcgacgaccctacagttgtggcctccaatatcatggaagttaaaatctccagcccggattacaaagactgcaactcggcagaagccatggacgacttcatgaagaggatcagttgctatgaagccagctaccagcccctcgaccccgacaaatgcgacagggacttgtcgctgatcaaggtgattgacgtgggccggaggttcctggtgaaccgggtgcaggaccacatccagagccgcatcgtgtactacctgatgaacatccacgtgcagccgcgtaccatctacctgtgccggcacggcgagaacgagcacaacctccagggccgcatcgggggcgactcaggcctgtccagccggggcaagaagtttgccagtgctctgagcaagttcgtggaggagcagaacctgaaggacctgcgcgtgtggaccagccagctgaagagcaccatccagacggccgaggcgctgcggctgccctacgagcagtggaaggcgctcaatgagatcgacgcgggcgtctgtgaggagctgacctacgaggagatcagggacacctaccctgaggagtatgcgctgcgggagcaggacaagtactattaccgctaccccaccggggagtcctaccaggacctggtccagcgcttggagccagtgatcatggagctggagcggcaggagaatgtgctggtcatctgccaccaggccgtcctgcgctgcctgcttgcctacttcctggataagagtgcagaggagatgccctacctgaaatgccctcttcacaccgtcctgaaactgacgcctgtcgcttatggctgccgtgtggaatccatctacctgaacgtggagtccgtctgcacacaccgggagaggtcagaggctgccaaaagtacaacactgtgctagtactagtcagacctttctcttagaccgagcgtgactttctgtcatggcgttcccgaaacaggatgcaaagaagggacctaacccgctcatgagacgcaatagtgtcaccccgctagccagccccgaacccaccaaaaagcctcgcatcaacagctttgaggagcatgtggcctccacctcggccgccctgcccagctgcctgcccccggaggtgcccacgcagctgcctggacaacctttgctagggcaagcctgtctgtaagtatctctccgatcatcgctgctgcttgcactgctttcttcctgcttgctcatttggcctcctgcctgttaaa

SEQ ID NO: 102986 - DNA, 536 bp, Homo sapiens
  Payload ID: 95
  Gene Symbol: PFKFB3
  Gene Name: 6-phosphofructo-2-kinase/fructose-2,6-biphosphatase 3
  ENST ID: ENST00000475881
  CDS Start-End: 1-186
atctacctgaacgtggagtccgtctgcacacaccgggagaggtcagagggtctcagtctgttccccaggctggagtgcggtggcgcagtcacggctcactgcagcctcaacctcctgggttcaagtgatcctcccgcctcagcctcccgcgtagctgagactacaggatgcaaagaagggacctaacccgctcatgagacgcaatagtgtcaccccgctagccagccccgaacccaccaaaaagcctcgcatcaacagctttgaggagcatgtggcctccacctcggccgccctgcccagctgcctgcccccggaggtgcccacgcagctgcctggacaaaacatgaaaggctcccggagcagcgctgactcctccaggaaacactgaggcagacgtgtcggttccattccatttccatttctgcagcttagcttgtgtcctgccctccgcccgaggcaaaacgtatcctgaggacttcttccggagagggtggggtggagcagcgggggagccttggccgaagagaaccatgctt

SEQ ID NO: 102987 - DNA, 2131 bp, Homo sapiens
  Payload ID: 95
  Gene Symbol: PFKFB3
  Gene Name: 6-phosphofructo-2-kinase/fructose-2,6-biphosphatase 3
  ENST ID: ENST00000467491
  CDS Start-End: 396-1763
gaggctgacgtacgcgtctgcggccagcccggactctttaaaagccggcggtgcgcggggcatcccagccaagccggagaggaggcgagcagcagggcctggtggcgagagcgcggctgtcactgcgcccgagcatcccagagctttccgagcggacgagccggccgtgccgggcatccccagcctcgctaccctcgcagcacacgtcgagccccgcacaggcgagggtccggaacttagcccaaagcacgtttcccctggcagcgcaggaaacgcccggccgcgcgccggcgcacgcccccctctcctcctttgttccgggggtcggcggccgctctcctgccagcgtcgggatctcggccccgggaggcgggccgtcgggcgcagccgcgaagatgccgttggaactgacgcagagccgagtgcagaagatctgggtgcccgtggaccacaggccctcgttgcccagatcctgtgggccaaagctgaccaactcccccaccgtcatcgtcatggtgggcctccccgcccggggcaagacctacatctccaagaagctgactcgctacctcaactggattggcgtccccacaaaagtgttcaacgtcggggagtatcgccgggaggctgtgaagcagtacagctcctacaacttcttccgccccgacaatgaggaagccatgaaagtccggaagcaatgtgccttagctgccttgagagatgtcaaaagctacctggcgaaagaagggggacaaattgcggttttcgatgccaccaatactactagagagaggagacacatgatccttcattttgccaaagaaaatgactttaaggcgtttttcatcgagtcggtgtgcgacgaccctacagttgtggcctccaatatcatggaagttaaaatctccagcccggattacaaagactgcaactcggcagaagccatggacgacttcatgaagaggatcagttgctatgaagccagctaccagcccctcgaccccgacaaatgcgacagggacttgtcgctgatcaaggtgattgacgtgggccggaggttcctggtgaaccgggtgcaggaccacatccagagccgcatcgtgtactacctgatgaacatccacgtgcagccgcgtaccatctacctgtgccggcacggcgagaacgagcacaacctccagggccgcatcgggggcgactcaggcctgtccagccggggcaagaagtttgccagtgctctgagcaagttcgtggaggagcagaacctgaaggacctgcgcgtgtggaccagccagctgaagagcaccatccagacggccgaggcgctgcggctgccctacgagcagtggaaggcgctcaatgagatcgacgcgggcgtctgtgaggagctgacctacgaggagatcagggacacctaccctgaggagtatgcgctgcgggagcaggacaagtactattaccgctaccccaccggggagtcctaccaggacctggtccagcgcttggagccagtgatcatggagctggagcggcaggagaatgtgctggtcatctgccaccaggccgtcctgcgctgcctgcttgcctacttcctggataagagtgcagaggagatgccctacctgaaatgccctcttcacaccgtcctgaaactgacgcctgtcgcttatggctgccgtgtggaatccatctacctgaacgtggagtccgtctgcacacaccgggagaggtcagaggctgccaaaagtacaacactgtgctagtactagtcagacctttctcttagaccgagcgtgactttctgtcatggcgttcccgaaacaggatgcaaagaagggacctaacccgctcatgagacgcaatagtgtcaccccgctagccagccccgaacccaccaaaaagcctcgcatcaacagctttgaggagcatgtggcctccacctcggccgccctgcccagctgcctgcccccggaggtgcccacgcagctgcctggacaacctttgctagggcaagcctgtctacgaactgtctgtcacattttctcaaagttttctccttactaactgtggaagaacatgaaaggctcccggagcagcgctgactcctccaggaaacactgaggcagacgtg

SEQ ID NO: 102988 - DNA, 2086 bp, Homo sapiens
  Payload ID: 95
  Gene Symbol: PFKFB3
  Gene Name: 6-phosphofructo-2-kinase/fructose-2,6-biphosphatase 3
  ENST ID: ENST00000490474
  CDS Start-End: 396-1763
gaggctgacgtacgcgtctgcggccagcccggactctttaaaagccggcggtgcgcggggcatcccagccaagccggagaggaggcgagcagcagggcctggtggcgagagcgcggctgtcactgcgcccgagcatcccagagctttccgagcggacgagccggccgtgccgggcatccccagcctcgctaccctcgcagcacacgtcgagccccgcacaggcgagggtccggaacttagcccaaagcacgtttcccctggcagcgcaggaaacgcccggccgcgcgccggcgcacgcccccctctcctcctttgttccgggggtcggcggccgctctcctgccagcgtcgggatctcggccccgggaggcgggccgtcgggcgcagccgcgaagatgccgttggaactgacgcagagccgagtgcagaagatctgggtgcccgtggaccacaggccctcgttgcccagatcctgtgggccaaagctgaccaactcccccaccgtcatcgtcatggtgggcctccccgcccggggcaagacctacatctccaagaagctgactcgctacctcaactggattggcgtccccacaaaagtgttcaacgtcggggagtatcgccgggaggctgtgaagcagtacagctcctacaacttcttccgccccgacaatgaggaagccatgaaagtccggaagcaatgtgccttagctgccttgagagatgtcaaaagctacctggcgaaagaagggggacaaattgcggttttcgatgccaccaatactactagagagaggagacacatgatccttcattttgccaaagaaaatgactttaaggcgtttttcatcgagtcggtgtgcgacgaccctacagttgtggcctccaatatcatggaagttaaaatctccagcccggattacaaagactgcaactcggcagaagccatggacgacttcatgaagaggatcagttgctatgaagccagctaccagcccctcgaccccgacaaatgcgacagggacttgtcgctgatcaaggtgattgacgtgggccggaggttcctggtgaaccgggtgcaggaccacatccagagccgcatcgtgtactacctgatgaacatccacgtgcagccgcgtaccatctacctgtgccggcacggcgagaacgagcacaacctccagggccgcatcgggggcgactcaggcctgtccagccggggcaagaagtttgccagtgctctgagcaagttcgtggaggagcagaacctgaaggacctgcgcgtgtggaccagccagctgaagagcaccatccagacggccgaggcgctgcggctgccctacgagcagtggaaggcgctcaatgagatcgacgcgggcgtctgtgaggagctgacctacgaggagatcagggacacctaccctgaggagtatgcgctgcgggagcaggacaagtactattaccgctaccccaccggggagtcctaccaggacctggtccagcgcttggagccagtgatcatggagctggagcggcaggagaatgtgctggtcatctgccaccaggccgtcctgcgctgcctgcttgcctacttcctggataagagtgcagaggagatgccctacctgaaatgccctcttcacaccgtcctgaaactgacgcctgtcgcttatggctgccgtgtggaatccatctacctgaacgtggagtccgtctgcacacaccgggagaggtcagaggctgccaaaagtacaacactgtgctagtactagtcagacctttctcttagaccgagcgtgactttctgtcatggcgttcccgaaacaggatgcaaagaagggacctaacccgctcatgagacgcaatagtgtcaccccgctagccagccccgaacccaccaaaaagcctcgcatcaacagctttgaggagcatgtggcctccacctcggccgccctgcccagctgcctgcccccggaggtgcccacgcagctgcctggacaacctttgctagggcaagcctgtctaacatgaaaggctcccggagcagcgctgactcctccaggaaacactgaggcagacgtgtcggttc

SEQ ID NO: 102989 - DNA, 4271 bp, Homo sapiens
  Payload ID: 95
  Gene Symbol: PFKFB3
  Gene Name: 6-phosphofructo-2-kinase/fructose-2,6-biphosphatase 3
  Uniprot ID: Q16875
  ENST ID: ENST00000536985
  CDS Start-End: 64-1668
agcgtgggctcctggcggtgaagggggtggctgctgactctcctgtcccgttggggtagagagatgggggagggtggccagaaggaaggtgacagccagcaagcaggggctctgccactcctctgtcagctggacacgtttagtcccaaggccactgtcttcggtgtctccattaatccagcctgtgggccaaagctgaccaactcccccaccgtcatcgtcatggtgggcctccccgcccggggcaagacctacatctccaagaagctgactcgctacctcaactggattggcgtccccacaaaagtgttcaacgtcggggagtatcgccgggaggctgtgaagcagtacagctcctacaacttcttccgccccgacaatgaggaagccatgaaagtccggaagcaatgtgccttagctgccttgagagatgtcaaaagctacctggcgaaagaagggggacaaattgcggttttcgatgccaccaatactactagagagaggagacacatgatccttcattttgccaaagaaaatgactttaaggcgtttttcatcgagtcggtgtgcgacgaccctacagttgtggcctccaatatcatggaagttaaaatctccagcccggattacaaagactgcaactcggcagaagccatggacgacttcatgaagaggatcagttgctatgaagccagctaccagcccctcgaccccgacaaatgcgacagggacttgtcgctgatcaaggtgattgacgtgggccggaggttcctggtgaaccgggtgcaggaccacatccagagccgcatcgtgtactacctgatgaacatccacgtgcagccgcgtaccatctacctgtgccggcacggcgagaacgagcacaacctccagggccgcatcgggggcgactcaggcctgtccagccggggcaagaagtttgccagtgctctgagcaagttcgtggaggagcagaacctgaaggacctgcgcgtgtggaccagccagctgaagagcaccatccagacggccgaggcgctgcggctgccctacgagcagtggaaggcgctcaatgagatcgacgcgggcgtctgtgaggagctgacctacgaggagatcagggacacctaccctgaggagtatgcgctgcgggagcaggacaagtactattaccgctaccccaccggggagtcctaccaggacctggtccagcgcttggagccagtgatcatggagctggagcggcaggagaatgtgctggtcatctgccaccaggccgtcctgcgctgcctgcttgcctacttcctggataagagtgcagaggagatgccctacctgaaatgccctcttcacaccgtcctgaaactgacgcctgtcgcttatggctgccgtgtggaatccatctacctgaacgtggagtccgtctgcacacaccgggagaggtcagaggatgcaaagaagggacctaacccgctcatgagacgcaatagtgtcaccccgctagccagccccgaacccaccaaaaagcctcgcatcaacagctttgaggagcatgtggcctccacctcggccgccctgcccagctgcctgcccccggaggtgcccacgcagctgcctggacaaaacatgaaaggctcccggagcagcgctgactcctccaggaaacactgaggcagacgtgtcggttccattccatttccatttctgcagcttagcttgtgtcctgccctccgcccgaggcaaaacgtatcctgaggacttcttccggagagggtggggtggagcagcgggggagccttggccgaagagaaccatgcttggcaccgtctgtgtcccctcggccgctggacaccagaaagccacgtgggtccctggcgccctgcctttagccgtggggcccccacctccactctctgggtttcctaggaatgtccagcctcggagaccttcacaaagccttgggagggtgatgagtgctggtcctgacaggaggccgctggggacactgtgctgttttgtttcgtttctgtgatctcccggcacgtttggagctgggaagaccacactggtggcagaatcctaaaattaaaggaggcaggctcctagttgctgaaagttaaggaatgtgtaaaacctccacgtgactgtttggtgcatcttgacctgggaagacgcctcatgggaacgaacttggacaggtgttgggttgaggcctcttctgcaggaagtccctgagctgagacgcaagttggctgggtggtccgcaccctggctctcctgcaggtccacacaccttccaggcctgtggcctgcctccaaagatgtgcaagggcaggctggctgcacggggagagggaagtattttgccgaaatatgagaactggggcctcctgctcccagggagctccagggcccctctctcctcccacctggacttggggggaactgagaaacactttcctggagctgctggcttttgcacttttttgatggcagaagtgtgacctgagagtcccaccttctcttcaggaacgtagatgttggggtgtcttgccctggggggcttggaacctctgaaggtggggagcggaacacctggcatccttccccagcacttgcattaccgtccctgctcttcccaggtggggacagtggcccaagcaaggcctcactcgcagccacttcttcaagagctgcctgcacactgtcttggagcatctgccttgtgcctggcactctgccggtgccttgggaaggtcggaagagtggactttgtcctggccttcccttcatggcgtctatgacacttttgtggtgatggaaagcatgggacctgtcgtctcagcctgttggtttctcctcattgcctcaaaccctggggtaggtgggacggggggtctcgtgcccagatgaaaccatttggaaactcggcagcagagtttgtccaaatgacccttttcaggatgtctcaaagcttgtgccaaaggtcacttttctttcctgccttctgctgtgagccctgagatcctcctcccagctcaagggacaggtcctgggtgagggtgggagatttagacacctgaaactgggcgtggagagaagagccgttgctgtttgttttttgggaagagcttttaaagaatgcatgtttttttcctggttggaattgagtaggaactgaggctgtgcttcaggtatggtacaatcaagtgggggattttcatgctgaaccattcaagccctccccgcccgttgcacccactttggctggcgtctgctggagaggatgtctctgtccgcattcccgtgcagctccaggctcgcgcagttttctctctctccctggatgttgagtctcatcagaatatgtgggtagggggtggacgtgcacgggtgcatgattgtgcttaacttggttgtatttttcgatttgacatggaaggcctgttgctttgctcttgagaatagtttctcgtgtccccctcgcaggcctcattctttgaacatcgactctgaagtttgatacagataggggcttgatagctgtggtcccctctcccctctgactacctaaaatcaatacctaaatacagaagccttggtctaacacgggacttttagtttgcgaagggcctagatagggagagaggtaacatgaatctggacagggagggagatactatagaaaggagaacactgcctactttgcaagccagtgacctgccttttgaggggacattggacgggggccgggggcgggggttgggtttgagctacagtcatgaacttttggcgtctactgattcctccaactctccaccccacaaaataacggggaccaatatttttaactttgcctatttgtttttgggtgagtttcccccctccttattctgtcctgagaccacgggcaaagctcttcattttgagagagaagaaaaactgtttggaaccacaccaatgatatttttctttgtaatacttgaaatttatttttttattattttgatagcagatgtgctatttatttatttaatatgtataaggagcctaaacaatagaaagctgtagagattgggtttcattgttaattggtttgggagcctcctatgtgtgacttatgacttctctgtgttctgtgtatttgtctgaattaatgacctgggatataaagctatgctagctttcaaacaggagatgcctttcagaaatttgtatattttgcagttgccagaccaataaaatacctggttgaaatacatggacgaagtaaa

SEQ ID NO: 102990 - DNA, 1752 bp, Homo sapiens
  Payload ID: 95
  Gene Symbol: PFKFB3
  Gene Name: 6-phosphofructo-2-kinase/fructose-2,6-biphosphatase 3
  ENST ID: ENST00000625260
  CDS Start-End: 385-1752
acgcgtctgcggccagcccggactctttaaaagccggcggtgcgcggggcatcccagccaagccggagaggaggcgagcagcagggcctggtggcgagagcgcggctgtcactgcgcccgagcatcccagagctttccgagcggacgagccggccgtgccgggcatccccagcctcgctaccctcgcagcacacgtcgagccccgcacaggcgagggtccggaacttagcccaaagcacgtttcccctggcagcgcaggaaacgcccggccgcgcgccggcgcacgcccccctctcctcctttgttccgggggtcggcggccgctctcctgccagcgtcgggatctcggccccgggaggcgggccgtcgggcgcagccgcgaagatgccgttggaactgacgcagagccgagtgcagaagatctgggtgcccgtggaccacaggccctcgttgcccagatcctgtgggccaaagctgaccaactcccccaccgtcatcgtcatggtgggcctccccgcccggggcaagacctacatctccaagaagctgactcgctacctcaactggattggcgtccccacaaaagtgttcaacgtcggggagtatcgccgggaggctgtgaagcagtacagctcctacaacttcttccgccccgacaatgaggaagccatgaaagtccggaagcaatgtgccttagctgccttgagagatgtcaaaagctacctggcgaaagaagggggacaaattgcggttttcgatgccaccaatactactagagagaggagacacatgatccttcattttgccaaagaaaatgactttaaggcgtttttcatcgagtcggtgtgcgacgaccctacagttgtggcctccaatatcatggaagttaaaatctccagcccggattacaaagactgcaactcggcagaagccatggacgacttcatgaagaggatcagttgctatgaagccagctaccagcccctcgaccccgacaaatgcgacagggacttgtcgctgatcaaggtgattgacgtgggccggaggttcctggtgaaccgggtgcaggaccacatccagagccgcatcgtgtactacctgatgaacatccacgtgcagccgcgtaccatctacctgtgccggcacggcgagaacgagcacaacctccagggccgcatcgggggcgactcaggcctgtccagccggggcaagaagtttgccagtgctctgagcaagttcgtggaggagcagaacctgaaggacctgcgcgtgtggaccagccagctgaagagcaccatccagacggccgaggcgctgcggctgccctacgagcagtggaaggcgctcaatgagatcgacgcgggcgtctgtgaggagctgacctacgaggagatcagggacacctaccctgaggagtatgcgctgcgggagcaggacaagtactattaccgctaccccaccggggagtcctaccaggacctggtccagcgcttggagccagtgatcatggagctggagcggcaggagaatgtgctggtcatctgccaccaggccgtcctgcgctgcctgcttgcctacttcctggataagagtgcagaggagatgccctacctgaaatgccctcttcacaccgtcctgaaactgacgcctgtcgcttatggctgccgtgtggaatccatctacctgaacgtggagtccgtctgcacacaccgggagaggtcagaggctgccaaaagtacaacactgtgctag

SEQ ID NO: 102991 - DNA, 1965 bp, Homo sapiens
  Payload ID: 95
  Gene Symbol: PFKFB3
  Gene Name: 6-phosphofructo-2-kinase/fructose-2,6-biphosphatase 3
  ENST ID: ENST00000626882
  CDS Start-End: 385-1965
acgcgtctgcggccagcccggactctttaaaagccggcggtgcgcggggcatcccagccaagccggagaggaggcgagcagcagggcctggtggcgagagcgcggctgtcactgcgcccgagcatcccagagctttccgagcggacgagccggccgtgccgggcatccccagcctcgctaccctcgcagcacacgtcgagccccgcacaggcgagggtccggaacttagcccaaagcacgtttcccctggcagcgcaggaaacgcccggccgcgcgccggcgcacgcccccctctcctcctttgttccgggggtcggcggccgctctcctgccagcgtcgggatctcggccccgggaggcgggccgtcgggcgcagccgcgaagatgccgttggaactgacgcagagccgagtgcagaagatctgggtgcccgtggaccacaggccctcgttgcccagatcctgtgggccaaagctgaccaactcccccaccgtcatcgtcatggtgggcctccccgcccggggcaagacctacatctccaagaagctgactcgctacctcaactggattggcgtccccacaaaagtgttcaacgtcggggagtatcgccgggaggctgtgaagcagtacagctcctacaacttcttccgccccgacaatgaggaagccatgaaagtccggaagcaatgtgccttagctgccttgagagatgtcaaaagctacctggcgaaagaagggggacaaattgcggttttcgatgccaccaatactactagagagaggagacacatgatccttcattttgccaaagaaaatgactttaaggcgtttttcatcgagtcggtgtgcgacgaccctacagttgtggcctccaatatcatggaagttaaaatctccagcccggattacaaagactgcaactcggcagaagccatggacgacttcatgaagaggatcagttgctatgaagccagctaccagcccctcgaccccgacaaatgcgacagggacttgtcgctgatcaaggtgattgacgtgggccggaggttcctggtgaaccgggtgcaggaccacatccagagccgcatcgtgtactacctgatgaacatccacgtgcagccgcgtaccatctacctgtgccggcacggcgagaacgagcacaacctccagggccgcatcgggggcgactcaggcctgtccagccggggcaagaagtttgccagtgctctgagcaagttcgtggaggagcagaacctgaaggacctgcgcgtgtggaccagccagctgaagagcaccatccagacggccgaggcgctgcggctgccctacgagcagtggaaggcgctcaatgagatcgacgcgggcgtctgtgaggagctgacctacgaggagatcagggacacctaccctgaggagtatgcgctgcgggagcaggacaagtactattaccgctaccccaccggggagtcctaccaggacctggtccagcgcttggagccagtgatcatggagctggagcggcaggagaatgtgctggtcatctgccaccaggccgtcctgcgctgcctgcttgcctacttcctggataagagtgcagaggagatgccctacctgaaatgccctcttcacaccgtcctgaaactgacgcctgtcgcttatggctgccgtgtggaatccatctacctgaacgtggagtccgtctgcacacaccgggagaggtcagaggatgcaaagaagggacctaacccgctcatgagacgcaatagtgtcaccccgctagccagccccgaacccaccaaaaagcctcgcatcaacagctttgaggagcatgtggcctccacctcggccgccctgcccagctgcctgcccccggaggtgcccacgcagctgcctggacaacctttgctagggcaagcctgtctacgaactgtctgtcacattttctcaaagttttctccttactaa

SEQ ID NO: 102992 - DNA, 3586 bp, Homo sapiens
  Payload ID: 96
  Gene Symbol: PFKFB4
  Gene Name: 6-phosphofructo-2-kinase/fructose-2,6-biphosphatase 4
  Uniprot ID: Q16877
  ENST ID: ENST00000232375
  CDS Start-End: 114-1523
gggctgtcgcggcttgaggaggggcggggcccaaggggcgggacctcgggtggcccgaggtggcccggctgctgggttggaagcggcgcagtccgactcatcccggccccgggatggcgtccccacgggaattgacacagaaccccctgaagaagatctggatgccatacagcaatgggcggcccgctctgcacgcttgccagcgcggtgtgtgcatgaccaactgcccaactctcattgtcatggtgggcctgcccgccaggggcaagacctacatctccaagaagctgactcgatacctgaactggattggtgtgcccactcgggagttcaatgttggccagtatcgccgggacgtggtcaagacctacaaatcttttgaattttttctccccgacaatgaagagggcctgaaaatcaggaagcagtgtgccctggcagccctccgtgacgtccggcggttccttagtgaggaggggggacatgtggcggtttttgatgccacaaacaccacccgagaacggagagcgaccatctttaattttggagaacagaatggctacaagaccttttttgtcgagtccatctgtgtggatcctgaggtcatagctgccaacatcgtgcaagtgaaactgggcagccctgactatgtcaaccgcgacagtgatgaggctacggaggacttcatgaggcgcattgagtgctatgagaactcctacgagtcgctagatgaggacctggatagggacctgtcctatatcaagatcatggatgtgggccagagctacgtggtgaaccgtgtggctgaccacatccagagccgcatcgtatattacctcatgaacatccacgtgaccccccgctccatctacctctgccggcacggggagagcgagctcaacctcaagggccggattggcggggacccaggactgtcccctcggggcagggagtttgccaagagtctagcccagttcatcagtgaccaaaatatcaaggatctgaaggtctggacaagccagatgaagaggacaatccagacggctgaggcactgggtgtgccctatgaacagtggaaggtcctcaacgagatcgatgcgggcgtctgtgaggaaatgacctacgaggaaattcaggataattatccactggagttcgccctgcgggaccaggacaagtaccggtaccggtaccctaaaggggagtcctacgaggacctggtccagagactggagcctgtcatcatggagctggagaggcaagagaatgtgctggtcatctgccaccaggctgtgatgcgctgcctgctggcctacttcctcgacaaggcagcagaacagctgccctacctcaagtgtccgctgcacacagtcctgaagctgactcctgtggcatatggttgtaaagtggagtccatattcctgaacgtggctgctgtgaacacgcaccgggacaggcctcagaacgtggacatctcaagacctccagaggaagcccttgtcacggtgcctgctcaccagtgaccatgttcatccactgtgaccactaggcaggcactgctctctgcagagggggtcattccaggccctccagtgtgtgtgatagtcaccatgccatgcagggatattcttgaagccacacatggctggcggaacccagagcccccaccccagcccacctggctctttgttgacagtcggcgacaaggttgtgcgtggctcctgacctgctgctaagagtcacttgaccagactgcatctgcatgggctgcgcggaggttgcccagccccagtttcttccggcgcagctcttaggtgttcactctcgccagctcagttggctttgtgaagtgtgaaaccctacaatgtgaaaggaaagtgcttgctgtgatgttcctactgtggcccagctgcccagcatggacctggtgactctccacagggcctctaccatcctctctgtggccacttcctgagccagaggccaggtcttcatggggccctgagcttctgctgcctctggtgagagggagagcccttcccatccttacccaccaggaactagagccccaaccacagcagatgcttcctgggcagccactggccaggccgttgtatccatgtcacccttagttgtgggcattcatgaaagcaatgcgcttgcttcagcacattgggatgcacagaaacgtgagggcaggggggcagttgtggtcgcccctccccagttgtgcatgtacccggctacttaggtatgcttaggggagctggtggccaggggtgccccttcaggcctgctctcacagtgaaaccacttcaagacagggcaggaagttaccttcctggtgcacacaccgaagtgctcgagggagaggctgccgccccctctccccttccctggctgtggacactggcagccaatggggaggcggcctctcccctgttgctgcccgtgtccacacaggaatgtacactggtggcagaaacatgcatttgccataaataattcagaaacacttgtatggtcctgtaaaacttctctggtgtttgttgacttctgcctgtgggtctgaggaagggagaaggcagaacccataggcagtccctgggcaagggaggattttcccggccgcagcacagccttccattcatgtgcacgtgagtctggtgaaaatggccttgtgaagtccagtgtctgtcatgcccctgagttcttttggtcccagagaggcagcctgggcagtctgtttacagctggcaaacagactggctggcaagttgtggggctgggtcagaaagtgtctggacttgtaatcgggtgccctgctgtccacaggtggactctggggaagccaggcccctggatcccaagtcctttgtgtccggagcctttcctggcctgtgcctggagggtagcacatctttccagcctcccagggctttgcagcctgcagatgccacctgtccctgagagaagttagcgtccctggccctggccggtggtctctcatccttgtgtgctgctctgctaagagatgtccaaggcggagccggggcaagatccttccagactcatctgtcagagccccaagccctttagacccagagcccaaggaccatgcctttgggacattaggactgcagcctttgcttctgtgtattttggagttttggtgacttttgtcacctggacacactcatttgttagccatagtgggttcccttggtcagcaacagtgcatgtacctctggatgtcatctgaggtgagaccaccgaggccttttctctctgtgtacagaggggagttaggagttgctggactggatgcattacgaggactggggacagggtagagggacatccagggatcagggcatgagtgggggcaaccccccggcctctgccctggcatggtctccgcatgggctgaggtgtagctgattggctgccacatttcggccatgctggctggcgtgcccatgttgcagatattttcccgagttccccagaatggatggtattgaatctcagccacatgcaacactgtgtccagcattctttgcaataaatactttttaaaaaataa

SEQ ID NO: 102993 - DNA, 1491 bp, Homo sapiens
  Payload ID: 96
  Gene Symbol: PFKFB4
  Gene Name: 6-phosphofructo-2-kinase/fructose-2,6-biphosphatase 4
  Uniprot ID: Q16877
  ENST ID: ENST00000383734
  CDS Start-End: 114-1418
gggctgtcgcggcttgaggaggggcggggcccaaggggcgggacctcgggtggcccgaggtggcccggctgctgggttggaagcggcgcagtccgactcatcccggccccgggatggcgtccccacgggaattgacacagaaccccctgaagaagatctggatgccatacagcaatgggcggcccgctctgcacgcttgccagcgcggtgtgtgcatgaccaactgcccaactctcattgtcatggtgggcctgcccgccaggggcaagacctacatctccaagaagctgactcgatacctgaactggattggtgtgcccactcgggagttcaatgttggccagtatcgccgggacgtggtcaagacctacaaatcttttgaattttttctccccgacaatgaagagggcctgaaaatcaggaagcagtgtgccctggcagccctccgtgacgtccggcggttccttagtgaggaggggggacatgtggcggtttttgatgccacaaacaccacccgagaacggagagcgaccatctttaattttggagaacagaatggctacaagaccttttttgtcgagtccatctgtgtggatcctgaggtcatagctgccaacatcgtgcaagtgaaactgggcagccctgactatgtcaaccgcgacagtgatgaggctacggaggacttcatgaggcgcattgagtgctatgagaactcctacgagtcgctagatgaggacctggatagggacctgtcctatatcaagatcatggatgtgggccagagctacgtggtgaaccgtgtggctgaccacatccagagccgcatcgtatattacctcatgaacatccacgtgaccccccgctccatctacctctgccggcacggggagagcgagctcaacctcaagggccggattggcggggacccaggactgtcccctcggggcagggagtttgccaagagtctagcccagttcatcagtgaccaaaatatcaaggatctgaaggtctggacaagccagatgaagaggacaatccagacggctgaggcactgggtgtgccctatgaacagtggaaggtcctcaacgagatcgatgcgtcctacgaggacctggtccagagactggagcctgtcatcatggagctggagaggcaagagaatgtgctggtcatctgccaccaggctgtgatgcgctgcctgctggcctacttcctcgacaaggcagcagaacagctgccctacctcaagtgtccgctgcacacagtcctgaagctgactcctgtggcatatggttgtaaagtggagtccatattcctgaacgtggctgctgtgaacacgcaccgggacaggcctcagaacgtggacatctcaagacctccagaggaagcccttgtcacggtgcctgctcaccagtgaccatgttcatccactgtgaccactaggcaggcactgctctctgcagagggggtcattccaggccctccagtgt

SEQ ID NO: 102994 - DNA, 1575 bp, Homo sapiens
  Payload ID: 96
  Gene Symbol: PFKFB4
  Gene Name: 6-phosphofructo-2-kinase/fructose-2,6-biphosphatase 4
  ENST ID: ENST00000416568
  CDS Start-End: 114-1502
gggctgtcgcggcttgaggaggggcggggcccaaggggcgggacctcgggtggcccgaggtggcccggctgctgggttggaagcggcgcagtccgactcatcccggccccgggatggcgtccccacgggaattgacacagaaccccctgaagaagatctggatgccatacagcaatgggcggcccgctctgcacgcttgccagcgcggtgtgtgcatgaccaactgcccaactctcattgtcatggtgggcctgcccgccaggggcaagacctacatctccaagaagctgactcgatacctgaactggattggtgtgcccactcgggagttcaatgttggccagtatcgccgggacgtggtcaagacctacaaatcttttgaattttttctccccgacaatgaagagggcctgaaaatcaggaagcagtgtgccctggcagccctccgtgacgtccggcggttccttagtgaggaggggggacatgtggcggtttttgatgccacaaacaccacccgagaacggagagcgaccatctttaattttggagaacagaatggctacaagaccttttttgtcgagtccatctgtgtggatcctgaggtcatagctgccaacatcgtgcaagtgaaactgggcagccctgactatgtcaaccgcgacagtgatgaggctacggaggacttcatgaggcgcattgagtgctatgagaactcctacgagtcgctagatgaggacctggatagggacctgtcctatatcaagatcatggatgtgggccagagctacgtggtgaaccgtgtggctgaccacatccagagccgcatcgtatattacctcatgaacatccacgtgaccccccgctccatctacctctgccggcacggggagagcgagctcaacctcaagggccggattggcggggacccaggactgtcccctcggggcagggagtttgccaagagtctagcccagttcatcagtgaccaaaatatcaaggatctgaaggtctggacaagccagatgaagaggacaatccagacggctgaggcactgggtgtgccctatgaacagtggaagggcgtctgtgaggaaatgacctacgaggaaattcaggataattatccactggagttcgccctgcgggaccaggacaagtaccggtaccggtaccctaaaggggagtcctacgaggacctggtccagagactggagcctgtcatcatggagctggagaggcaagagaatgtgctggtcatctgccaccaggctgtgatgcgctgcctgctggcctacttcctcgacaaggcagcagaacagctgccctacctcaagtgtccgctgcacacagtcctgaagctgactcctgtggcatatggttgtaaagtggagtccatattcctgaacgtggctgctgtgaacacgcaccgggacaggcctcagaacgtggacatctcaagacctccagaggaagcccttgtcacggtgcctgctcaccagtgaccatgttcatccactgtgaccactaggcaggcactgctctctgcagagggggtcattccaggccctccagtgt

SEQ ID NO: 102995 - DNA, 1744 bp, Homo sapiens
  Payload ID: 96
  Gene Symbol: PFKFB4
  Gene Name: 6-phosphofructo-2-kinase/fructose-2,6-biphosphatase 4
  ENST ID: ENST00000417753
  CDS Start-End: 114-230
gggctgtcgcggcttgaggaggggcggggcccaaggggcgggacctcgggtggcccgaggtggcccggctgctgggttggaagcggcgcagtccgactcatcccggccccgggatggcgtccccacgggaattgacacagaaccccctgaagaagatctggatgccatacagcaatgggcggcccgctctgcacgcttgccagcgcggtgaactttcaaaggtgggctagttttccaacaggaggaagggtgcctcttggccttaaagctgagcttgggcaggaacttcagcagagatgtgctcaggatagagacagaaaagtatgccgtgtgggcctgtgtctgtgtcccgggacattgtgcatgaccaactgcccaactctcattgtcatggtgggcctgcccgccaggggcaagacctacatctccaagaagctgactcgatacctgaactggattggtgtgcccactcgggagttcaatgttggccagtatcgccgggacgtggtcaagacctacaaatcttttgaattttttctccccgacaatgaagagggcctgaaaatcaggaagcagtgtgccctggcagccctccgtgacgtccggcggttccttagtgaggaggggggacatgtggcggtttttgatgccacaaacaccacccgagaacggagagcgaccatctttaattttggagaacagaatggctacaagaccttttttgtcgagtccatctgtgtggatcctgaggtcatagctgccaacatcgtgcaagtgaaactgggcagccctgactatgtcaaccgcgacagtgatgaggctacggaggacttcatgaggcgcattgagtgctatgagaactcctacgagtcgctagatgaggacctggatagggacctgtcctatatcaagatcatggatgtgggccagagctacgtggtgaaccgtgtggctgaccacatccagagccgcatcgtatattacctcatgaacatccacgtgaccccccgctccatctacctctgccggcacggggagagcgagctcaacctcaagggccggattggcggggacccaggactgtcccctcggggcagggagtttgccaagagtctagcccagttcatcagtgaccaaaatatcaaggatctgaaggtctggacaagccagatgaagaggacaatccagacggctgaggcactgggtgtgccctatgaacagtggaaggtcctcaacgagatcgatgcgggcgtctgtgaggaaatgacctacgaggaaattcaggataattatccactggagttcgccctgcgggaccaggacaagtaccggtaccggtaccctaaaggggagtcctacgaggacctggtccagagactggagcctgtcatcatggagctggagaggcaagagaatgtgctggtcatctgccaccaggctgtgatgcgctgcctgctggcctacttcctcgacaaggcagcagaacagctgccctacctcaagtgtccgctgcacacagtcctgaagctgactcctgtggcatatggttgtaaagtggagtccatattcctgaacgtggctgctgtgaacacgcaccgggacaggcctcagaacgtggacatctcaagacctccagaggaagcccttgtcacggtgcctgctcaccagtgaccatgttcatccactgtgaccactaggcaggcactgctctctgcagagggggtcattccaggccctccagtgt

SEQ ID NO: 102996 - DNA, 567 bp, Homo sapiens
  Payload ID: 96
  Gene Symbol: PFKFB4
  Gene Name: 6-phosphofructo-2-kinase/fructose-2,6-biphosphatase 4
  ENST ID: ENST00000412035
  CDS Start-End: 41-567
gaactgggcccacttgttccaaaacgggcgggtagtgtgcatgaccaactgcccaactctcattgtcatggtgggcctgcccgccaggggcaagacctacatctccaagaagctgactcgatacctgaactggattggtgtgcccactcgggagttcaatgttggccagtatcgccgggacgtggtcaagacctacaaatcttttgaattttttctccccgacaatgaagagggcctgaaaatcaggaagcagtgtgccctggcagccctccgtgacgtccggcggttccttagtgaggaggggggacatgtggcggtttttgatgccacaaacaccacccgagaacggagagcgaccatctttaattttggagaacagaatggctacaagaccttttttgtcgagtccatctgtgtggatcctgaggtcatagctgccaacatcgtgcaagtgaaactgggcagccctgactatgtcaaccgcgacagtgatgaggctacggaggacttcatgaggcgcattgagtgctatgagaactcctacgagtcgctagatgaggacctgga

SEQ ID NO: 102997 - DNA, 1733 bp, Homo sapiens
  Payload ID: 96
  Gene Symbol: PFKFB4
  Gene Name: 6-phosphofructo-2-kinase/fructose-2,6-biphosphatase 4
  ENST ID: ENST00000445633
  CDS Start-End: 114-356
gggctgtcgcggcttgaggaggggcggggcccaaggggcgggacctcgggtggcccgaggtggcccggctgctgggttggaagcggcgcagtccgactcatcccggccccgggatggcgtccccacgggaattgacacagaaccccctgaagaagatctggatgccatacagcaatgggcggcccgctctgcacgcttgccagcgcggtggtgggctagttttccaacaggaggaagggtgcctcttggccttaaagctgagcttgggcaggaacttcagcagagatgtgctcaggatagagacagaaaagtatgccgtgtgggcctgtgtctgtgtcccgggacattgtgcatgaccaactgcccaactctcattgtcatggtgggcctgcccgccaggggcaagacctacatctccaagaagctgactcgatacctgaactggattggtgtgcccactcgggagttcaatgttggccagtatcgccgggacgtggtcaagacctacaaatcttttgaattttttctccccgacaatgaagagggcctgaaaatcaggaagcagtgtgccctggcagccctccgtgacgtccggcggttccttagtgaggaggggggacatgtggcggtttttgatgccacaaacaccacccgagaacggagagcgaccatctttaattttggagaacagaatggctacaagaccttttttgtcgagtccatctgtgtggatcctgaggtcatagctgccaacatcgtgcaagtgaaactgggcagccctgactatgtcaaccgcgacagtgatgaggctacggaggacttcatgaggcgcattgagtgctatgagaactcctacgagtcgctagatgaggacctggatagggacctgtcctatatcaagatcatggatgtgggccagagctacgtggtgaaccgtgtggctgaccacatccagagccgcatcgtatattacctcatgaacatccacgtgaccccccgctccatctacctctgccggcacggggagagcgagctcaacctcaagggccggattggcggggacccaggactgtcccctcggggcagggagtttgccaagagtctagcccagttcatcagtgaccaaaatatcaaggatctgaaggtctggacaagccagatgaagaggacaatccagacggctgaggcactgggtgtgccctatgaacagtggaaggtcctcaacgagatcgatgcgggcgtctgtgaggaaatgacctacgaggaaattcaggataattatccactggagttcgccctgcgggaccaggacaagtaccggtaccggtaccctaaaggggagtcctacgaggacctggtccagagactggagcctgtcatcatggagctggagaggcaagagaatgtgctggtcatctgccaccaggctgtgatgcgctgcctgctggcctacttcctcgacaaggcagcagaacagctgccctacctcaagtgtccgctgcacacagtcctgaagctgactcctgtggcatatggttgtaaagtggagtccatattcctgaacgtggctgctgtgaacacgcaccgggacaggcctcagaacgtggacatctcaagacctccagaggaagcccttgtcacggtgcctgctcaccagtgaccatgttcatccactgtgaccactaggcaggcactgctctctgcagagggggtcattccaggccctccagtgt

SEQ ID NO: 102998 - DNA, 1011 bp, Homo sapiens
  Payload ID: 96
  Gene Symbol: PFKFB4
  Gene Name: 6-phosphofructo-2-kinase/fructose-2,6-biphosphatase 4
  ENST ID: ENST00000452531
  CDS Start-End: 58-1011
gggttaccccactctggagctgcagggggcagtggccctggccagtttggttgcaggatggacagaggctcgttaggaggcagctccctgaccgacctggggccggggagcagcaggcgggtgtgcatgaccaactgcccaactctcattgtcatggtgggcctgcccgccaggggcaagacctacatctccaagaagctgactcgatacctgaactggattggtgtgcccactcgggagttcaatgttggccagtatcgccgggacgtggtcaagacctacaaatcttttgaattttttctccccgacaatgaagagggcctgaaaatcaggaagcagtgtgccctggcagccctccgtgacgtccggcggttccttagtgaggaggggggacatgtggcggtttttgatgccacaaacaccacccgagaacggagagcgaccatctttaattttggagaacagaatggctacaagaccttttttgtcgagtccatctgtgtggatcctgaggtcatagctgccaacatcgtgcaagtgaaactgggcagccctgactatgtcaaccgcgacagtgatgaggctacggaggacttcatgaggcgcattgagtgctatgagaactcctacgagtcgctagatgaggacctggatagggacctgtcctatatcaagatcatggatgtgggccagagctacgtggtgaaccgtgtggctgaccacatccagagccgcatcgtatattacctcatgaacatccacgtgaccccccgctccatctacctctgccggcacggggagagcgagctcaacctcaagggccggattggcggggacccaggactgtcccctcggggcagggagtttgccaagagtctagcccagttcatcagtgaccaaaatatcaaggatctgaaggtctggacaagccagatgaagaggacaatccagacggctgaggcactgggtgtgccctatgaacagtggaaggtcctcaacgagatcgatgcg

SEQ ID NO: 102999 - DNA, 636 bp, Homo sapiens
  Payload ID: 96
  Gene Symbol: PFKFB4
  Gene Name: 6-phosphofructo-2-kinase/fructose-2,6-biphosphatase 4
  ENST ID: ENST00000422701
  CDS Start-End: 250-636
gggactgggaagagtttgagctttgagaactggccaccacatggcttctaggctgggacactgggaggaagtccagtggtcagtgcagagggcaccctgggagccaaccagggtcaggccagccaggttcatggtgggcagaggctgagcagaacatgttcacacgtgtgtacagacatcccagcatacttcccacgcctgggacagaacagctggctcactttcggatatactgaggaggaaaaagccatgagggccagagattctaccgggcatccgctgatgctgagagagcagacgctgggacagcatctccatggagaggacacaggggagtgggagcacacatgtgaagtgtgcatgaccaactgcccaactctcattgtcatggtgggcctgcccgccaggggcaagacctacatctccaagaagctgactcgatacctgaactggattggtgtgcccactcgggagttcaatgttggccagtatcgccgggacgtggtcaagacctacaaatcttttgaattttttctccccgacaatgaagagggcctgaaaatcaggaagcagtgtgccctggcagccctccgtgacgtccggcggttccttagtgaggaggggggacatgtggcg

SEQ ID NO: 103000 - DNA, 1028 bp, Homo sapiens
  Payload ID: 97
  Gene Symbol: PGLS
  Gene Name: 6-phosphogluconolactonase
  Uniprot ID: O95336
  ENST ID: ENST00000252603
  CDS Start-End: 45-821
acggccgtagggagcgcttcctcctccccgccgccgccctcgccatggccgcgccggccccgggcctcatctcggtgttctcgagttcccaggagctgggtgcggcgctagcgcagctggtggcccagcgcgcagcatgctgcctggcaggggcccgcgcccgtttcgcgctcggcctgtcgggcgggagcctcgtctcgatgctagcccgcgagctacccgccgccgtcgcccctgccgggccagctagcttagcgcgctggacgctgggcttctgcgacgagcgcctcgtgcccttcgatcacgccgagagcacgtacggcctctaccggacgcatcttctctccagactgccgatcccagaaagccaggtgatcaccattaaccccgagctgcctgtggaggaggcggctgaggactacgccaagaagctgagacaggcattccaaggggactccatcccggttttcgacctgctgatcctgggggtgggccccgatggtcacacctgctcactcttcccagaccaccccctcctacaggagcgggagaagattgtggctcccatcagtgactccccgaagccaccgccacagcgtgtgaccctcacactacctgtcctgaatgcagcacgaactgtcatctttgtggcaactggagaaggcaaggcagctgttctgaagcgcattttggaggaccaggaggaaaacccgctgcccgccgccctggtccagccccacaccgggaaactgtgctggttcttggacgaggcggccgcccgcctcctgaccgtgcccttcgagaagcattccactttgtagctggccagagggacgccgcagctgggaccaggcacgcggcccatggggctgggcccctgctggccgccactctccgggctctcctttcaaaaagccacgtcgtgctgctgctggaagccaacagcctccggccagcagccctacccggggctcaacacacaggctgtggctctggacatccggatattaaaaggagcgttgctggaa

SEQ ID NO: 103001 - DNA, 880 bp, Homo sapiens
  Payload ID: 97
  Gene Symbol: PGLS
  Gene Name: 6-phosphogluconolactonase
  ENST ID: ENST00000594761
  CDS Start-End: 38-577
tagggagcgcttcctcctccccgccgccgccctcgccatggccgcgccggccccgggcctcatctcggtgttctcgagttcccaggagctgggtgcggcgctagcgcagctggtggcccagcgcgcagcatgctgcctggcaggggcccgcgcccgtttcgcgctcggcctgtcgggcgggagcctcgtctcgatgctagcccgcgagctacccgccgccgtcgcccctgccgggccagctagcttagcgcgctggacgctgggcttctgcgacgagcgcctcgtgcccttcgatcacgccgagagcacgtacggcctctaccggacgcatcttctctccagactgccgatcccagaaagccaggtgatcaccattaaccccgagctgcctgtggaggaggcggctgaggactacgccaagaagctgagacaggaactgccccagggatcactggcagatccctttgaggaatcccctcttcgaggccacagccctgccctggggagcctgaaggccactcggcctctgttgcccaggcattccaaggggactccatcccggttttcgacctgctgatcctgggggtgggccccgatggtcacacctgctcactcttcccagaccaccccctcctacaggagcgggagaagattgtggctcccatcagtgactccccgaagccaccgccacagcgtgtgaccctcacactacctgtcctgaatgcagcacgaactgtcatctttgtggcaactggagaaggcaaggcagctgttctgaagcgcattttggaggaccaggaggaaaacccgctgcccgccgccctggtccagccccacaccgggaaactgtgctggttcttggacgaggcggccgcccgcc

SEQ ID NO: 103002 - DNA, 651 bp, Homo sapiens
  Payload ID: 97
  Gene Symbol: PGLS
  Gene Name: 6-phosphogluconolactonase
  ENST ID: ENST00000595782
  CDS Start-End: 1-444
gccgggccagctagcttagcgcgctggacgctgggcttctgcgacgagcgcctcgtgcccttcgatcacgccgagagcacgtacggcctctaccggacgcatcttctctccagactgccgatcccagaaagccaggtgatcaccattaaccccgagctgcctgtggaggaggcggctgaggactacgccaagaagctgagacaggcattccaaggggactccatcccggttttcgacctgctgatcctgggggtgggccccgatggtcacacctgctcactcttcccagaccaccccctcctacagcgcattttggaggaccaggaggaaaacccgctgcccgccgccctggtccagccccacaccgggaaactgtgctggttcttggacgaggcggccgcccgcctcctgaccgtgcccttcgagaagcattccactttgtagctggccagagggacgccgcagctgggaccaggcacgcggcccatggggctgggcccctgctggccgccactctccgggctctcctttcaaaaagccacgtcgtgctgctgctggaagccaacagcctccggccagcagccctacccggggctcaacacacaggctgtggctctggacatccggatattaaaaggagcgttgctggaa

SEQ ID NO: 103003 - DNA, 651 bp, Homo sapiens
  Payload ID: 97
  Gene Symbol: PGLS
  Gene Name: 6-phosphogluconolactonase
  ENST ID: ENST00000600923
  CDS Start-End: 4-651
gccatggccgcgccggccccgggcctcatctcggtgttctcgagttcccaggagctgggtgcggcgctagcgcagctggtggcccagcgcgcagcatgctgcctggcaggggcccgcgcccgtttcgcgctcggcctgtcgggcgggagcctcgtctcgatgctagcccgcgagctacccgccgccgtcgcccctgccgggccagctagcttagcgcgctggacgctgggcttctgcgacgagcgcctcgtgcccttcgatcacgccgagagcacgtacggcctctaccggatggagaaactgaggccagaagagacgcatcttctctccagactgccgatcccagaaagccaggtgatcaccattaaccccgagctgcctgtggaggaggcggctgaggactacgccaagaagctgagacaggcattccaaggggactccatcccggttttcgacctgctgatcctgggggtgggccccgatggtcacacctgctcactcttcccagaccaccccctcctacaggagcgggagaagattgtggctcccatcagtgactccccgaagccaccgccacagcgtgtgaccctcacactacctgtcctgaatgcagcacgaactgtcatctttgtggcaactggagaaggcaag

SEQ ID NO: 103004 - DNA, 935 bp, Homo sapiens
  Payload ID: 98
  Gene Symbol: PTS
  Gene Name: 6-pyruvoyltetrahydropterin synthase
  Uniprot ID: Q03393
  ENST ID: ENST00000280362
  CDS Start-End: 80-517
gcgcagccgcggtgggaggaggcaccggccgcgcggcgggaggaggtgccggccgagcaccgcagacagcgccgggaagatgagcacggaaggtggtggccgtcgctgccaggcacaagtgtcccgccgcatctccttcagcgcgagccaccgattgtacagtaaatttctaagtgatgaagaaaacttgaaactgtttgggaaatgcaacaatccaaatggccatgggcacaattataaagttgtggtgacagtacatggagagattgaccctgctacgggaatggttatgaatctggctgatctcaaaaaatatatggaggaggcgattatgcagccccttgatcataagaatctggatatggatgtgccatactttgcagatgtggtgagcacgactgaaaatgtagctgtttatatctgggacaacctccagaaagttcttcctgtaggagttctttataaagtaaaagtatacgaaactgacaataatattgtggtttataaaggagaatagctattggggttagcattgcacaaagcccagtttctttctgtgtttgaaaaagattttgatccccttggaatattaagaggtcaacacgtgattgttgtacgtacacattgtgctctggagtgcctatttattgaaatcattgtaagacctgttataaatttaagtctatttaaaactaaacttgtaatatacatcctgaaaatcatttagagagtcttttatttataaattaaaaatcacttcattttcacaaaatgttttggtgtgggattatttgaaagcaaaagaaatctaattttgttttctccattacctcattttagtattaatttttacttggtataatatacatggttaaaatgcttatgtgacttcgagtaggtgaatcttaaagaaataaaattcaagtgaccacaaa

SEQ ID NO: 103005 - DNA, 625 bp, Homo sapiens
  Payload ID: 98
  Gene Symbol: PTS
  Gene Name: 6-pyruvoyltetrahydropterin synthase
  ENST ID: ENST00000525803
  CDS Start-End: 13-198
agcgccgggaagatgagcacggaaggtggtggccgtcgctgccaggcacaagtgtcccgccgcatctccttcagcgcgagccaccgattgtacagtaaatttctaagtgatgaagaaaacttgaaactgtttgggaaatgcaacaatccaaatggccatgggcacaattataaaggaggcgattatgcagccccttgatcataagaatctggatatggatgtgccatactttgcagatgtggtgagcacgactgaaaatgtagctgtttatatctgggacaacctccagaaagttcttcctgtaggagttctttataaagtaaaagtatacgaaactgacaataatattgtggtttataaaggagaatagctattggggttagcattgcacaaagcccagtttctttctgtgtttgaaaaagattttgatccccttggaatattaagaggtcaacacgtgattgttgtacgtacacattgtgctctggagtgcctatttattgaaatcattgtaagacctgttataaatttaagtctatttaaaactaaacttgtaatatacatcctgaaaatcatttagagagtcttttatttataaattaaaaatcacttcattttcacaaaa

SEQ ID NO: 103006 - DNA, 986 bp, Homo sapiens
  Payload ID: 98
  Gene Symbol: PTS
  Gene Name: 6-pyruvoyltetrahydropterin synthase
  ENST ID: ENST00000531673
  CDS Start-End: 57-224
accggccgcgcggcgggaggaggtgccggccgagcaccgcagacagcgccgggaagatgagcacggaaggtggtggccgtcgctgccaggcacaagtgtcccgccgcatctccttcagcgcgagccaccgattgtacagtaaatttctaagtgatgaagaaaacttgaaactgtttgggaaatgcaacaatccaaatggccatgggcacaattataaagattgaccctgctacgggaatggttatgaatctggctgatctcaaaaaatatatggaggaggcgattatgcagccccttgatcataagaatctggatatggatgtgccatactttgcagatgtggtgagttctccctggtctataacaggaatgccccttacccagcagcaggcagatatggccatgggtcaagacatcctgcttcatgaggaaaccttgttcccaccactgattcagactgcgtaacccttccagtgtttacccagagcatcagcagcaacttctgtggccatacacttctcataaacagcaaggcctcttcacagagcatctcccaacatgacggcctgcttcagcagagtgagcaggtactgggaggaggagatgaaccctgctcctgtggaggctatgaggtattgatgtcgtgtacacatccaaggggtggtctaattatttacaactaggctcctgaaaatcagccctgaatccagctttctaccttctcttttcaatatcatttaattaattgagtcacagaaacagcctttaattcatttaattcccttacattcttctaacttctgccatatatctcgtgatctgtgatttttccttttgcactgatttgatactatgtagtagcaactaaatatcgttacttataccatagcagctaatctttcttatcaacaaaaacaaataatgtccacattcctgaaaacaattaggctctatttctagccttgtgaacaaatgcaattttgtca

SEQ ID NO: 103007 - DNA, 696 bp, Homo sapiens
  Payload ID: 98
  Gene Symbol: PTS
  Gene Name: 6-pyruvoyltetrahydropterin synthase
  ENST ID: ENST00000524931
  CDS Start-End: 208-441
attgtaggcactcagtaatgttgaattgaaaagtggaaggcccatgagcagatcagttgctgtggaacaagggggttgaagttaagtaaatttctaagtgatgaagaaaacttgaaactgtttgggaaatgcaacaatccaaatggccatgggcacaattataaagttgtggtgacagtacatggagagattgaccctgctacgggaatggttatgaatctggctgatctcaaaaaatatatggaggaggcgattatgcagccccttgatcataagaatctggatatggatgtgccatactttgcagatgtggtgagcacgactgaaaatgtagctgtttatatctgggacaacctccagaaagttcttcctgtaggagttctttataaagtaaaagtatacgaaactgacaataatattgtggtttataaaggagaatagctattggggttagcattgcacaaagcccagtttctttctgtgtttgaaaaagattttgatccccttggaatattaagaggtcaacacgtgattgttgtacgtacacattgtgctctggagtgcctatttattgaaatcattgtaagacctgttataaatttaagtctatttaaaactaaacttgtaatatacatcctgaaaatcatttagagagtcttttatttataaattaaaaatcacttcattttcacaaaa

SEQ ID NO: 103008 - DNA, 846 bp, Homo sapiens
  Payload ID: 98
  Gene Symbol: PTS
  Gene Name: 6-pyruvoyltetrahydropterin synthase
  ENST ID: ENST00000528679
  CDS Start-End: 78-245
gcagccgcggtgggaggaggcaccggccgcgcggcgggaggaggtgccggccgagcaccgcagacagcgccgggaagatgagcacggaaggtggtggccgtcgctgccaggcacaagtgtcccgccgcatctccttcagcgcgagccaccgattgtacagtaaatttctaagtgatgaagaaaacttgaaactgtttgggaaatgcaacaatccaaatggccatgggcacaattataaagattgaccctgctacgggaatggttatgaatctggctgatctcaaaaaatatatggaggaggcgattatgcagccccttgatcataagaatctggatatggatgtgccatactttgcagatgtggtgagcacgactgaaaatgtagctgtttatatctgggacaacctccagaaagttcttcctgtaggagttctttataaagtaaaagtatacgaaactgacaataatattgtggtttataaaggagaatagctattggggttagcattgcacaaagcccagtttctttctgtgtttgaaaaagattttgatccccttggaatattaagaggtcaacacgtgattgttgtacgtacacattgtgctctggagtgcctatttattgaaatcattgtaagacctgttataaatttaagtctatttaaaactaaacttgtaatatacatcctgaaaatcatttagagagtcttttatttataaattaaaaatcacttcattttcacaaaatgttttggtgtgggattatttgaaagcaaaagaaatctaattttgttttctccattacctcattttagtattaatttttacttggtataatatacatgg

SEQ ID NO: 103009 - DNA, 2666 bp, Homo sapiens
  Payload ID: 99
  Gene Symbol: DHCR7
  Gene Name: 7-dehydrocholesterol reductase
  Uniprot ID: Q9UBM7
  ENST ID: ENST00000355527
  CDS Start-End: 278-1705
aggcaatcgctgacatcatccgggggcgggcgcccctgccctgcgggtgactccgacccctggctagagggtaggcggcgtggagcagcgcgcgcaagcgaggccaggggaaggtgggcgcaggtgaggggccgaggtgtgcgcaggactttagccggttgagaaggatcaagcaggcatttggagcacaggtgtctagaaacttttaaggggccggttcaagaaggaaaagttcccttctgctgtgaaactatttggcaagaggctggagggcccaatggctgcaaaatcgcaacccaacattcccaaagccaagagtctagatggcgtcaccaatgacagaaccgcatctcaagggcagtggggccgtgcctgggaggtggactggttttcactggcgagcgtcatcttcctactgctgttcgcccccttcatcgtctactacttcatcatggcttgtgaccagtacagctgcgccctgactggccctgtggtggacatcgtcaccggacatgctcggctctcggacatctgggccaagactccacctataacgaggaaagccgcccagctctataccttgtgggtcaccttccaggtgcttctgtacacgtctctccctgacttctgccataagtttctacccggctacgtaggaggcatccaggagggggccgtgactcctgcaggggttgtgaacaagtatcagatcaatggcctgcaagcctggctcctcacgcacctgctctggtttgcaaacgctcatctcctgtcctggttctcgcccaccatcatcttcgacaactggatcccactgctgtggtgcgccaacatccttggctatgccgtctccaccttcgccatggtcaagggctacttcttccccaccagcgccagagactgcaaattcacaggcaatttcttttacaactacatgatgggcatcgagtttaaccctcggatcgggaagtggtttgacttcaagctgttcttcaatgggcgccccgggatcgtcgcctggaccctcatcaacctgtccttcgcagcgaagcagcgggagctccacagccatgtgaccaatgccatggtcctggtcaacgtcctgcaggccatctacgtgattgacttcttctggaacgaaacctggtacctgaagaccattgacatctgccatgaccacttcgggtggtacctgggctggggcgactgtgtctggctgccttatctttacacgctgcagggtctgtacttggtgtaccaccccgtgcagctgtccaccccgcacgccgtgggcgtcctgctgctgggcctggtgggctactacatcttccgggtggccaaccaccagaaggacctgttccgccgcacggatgggcgctgcctcatctggggcaggaagcccaaggtcatcgagtgctcctacacatccgccgatgggcagaggcaccacagcaagctgctggtgtcgggcttctggggcgtggcccgccacttcaactacgtcggcgacctgatgggcagcctggcctactgcctggcctgtggcggcggccacctgctgccctacttctacatcatctacatggccatcctgctgacccaccgctgcctccgggacgagcaccgctgcgccagcaagtacggccgggactgggagcgctacaccgccgcagtgccttaccgcctgctgcctggaatcttctaagggcacgccctagggagaagccctgtggggctgtcaagagcgtgttctgccaggtccatgggggctggcatcccagctccaactcgaggagcctcagtttcctcatctgtaaactggagagagcccagcacttggcaggtgtccagtacctaatcacgctctgttccttgcttttgccttcaagggaattccgagtgtccagcactgccgtattgccagcacagacggattttctctaatcagtgtccctggggcaggaggatgacccagtcacctttactagtcctttggagacaatttacctgtattaggagcccaggccacgctacactctgcccacactggtgagcaggaggtcttcccacgccctgtcattaggctgcatttactcttgctaaataaaagtgggagtggggcgtgcgcgttatccatgtattgcctttcagctctagatccccctcccctgcctgctctgcagtcgtgggtggggcccgtgcgccgtttctccttggtagcgtgcacggtgttgaactgggacactggggagaaaggggctttcatgtcgtttccttcctgctcctgctgcacagctgccaggagtgctctgcctggagtctgcagacctcagagaggtcccagcaccggctgtggcctttcaggtgtaggcaggtgggctctgcttcccgattccctgtgagcgcccaccctctcgaaagaattttctgcttgccctatgactgtgcagactctggctcgagcaacccggggaacttcaccctcaggggcctcccacaccttctccagcgaggaggtctcagtcccagcctcgggagggcacctccttttctgtgctttcttccctgaggcattcttcctcatccctagggtgttgtgtagaactctttttaaactctatgctccgagtagagttcatctttatattaaacttcccctgttcaaa

SEQ ID NO: 103010 - DNA, 2601 bp, Homo sapiens
  Payload ID: 99
  Gene Symbol: DHCR7
  Gene Name: 7-dehydrocholesterol reductase
  Uniprot ID: Q9UBM7
  ENST ID: ENST00000407721
  CDS Start-End: 213-1640
gcgggtgactccgacccctggctagagggtaggcggcgtggagcagcgcgcgcaagcgaggccaggggaaggtgggcgcaggactttagccggttgagaaggatcaagcaggcatttggagcacaggtgtctagaaacttttaaggggccggttcaagaaggaaaagttcccttctgctgtgaaactatttggcaagaggctggagggcccaatggctgcaaaatcgcaacccaacattcccaaagccaagagtctagatggcgtcaccaatgacagaaccgcatctcaagggcagtggggccgtgcctgggaggtggactggttttcactggcgagcgtcatcttcctactgctgttcgcccccttcatcgtctactacttcatcatggcttgtgaccagtacagctgcgccctgactggccctgtggtggacatcgtcaccggacatgctcggctctcggacatctgggccaagactccacctataacgaggaaagccgcccagctctataccttgtgggtcaccttccaggtgcttctgtacacgtctctccctgacttctgccataagtttctacccggctacgtaggaggcatccaggagggggccgtgactcctgcaggggttgtgaacaagtatcagatcaatggcctgcaagcctggctcctcacgcacctgctctggtttgcaaacgctcatctcctgtcctggttctcgcccaccatcatcttcgacaactggatcccactgctgtggtgcgccaacatccttggctatgccgtctccaccttcgccatggtcaagggctacttcttccccaccagcgccagagactgcaaattcacaggcaatttcttttacaactacatgatgggcatcgagtttaaccctcggatcgggaagtggtttgacttcaagctgttcttcaatgggcgccccgggatcgtcgcctggaccctcatcaacctgtccttcgcagcgaagcagcgggagctccacagccatgtgaccaatgccatggtcctggtcaacgtcctgcaggccatctacgtgattgacttcttctggaacgaaacctggtacctgaagaccattgacatctgccatgaccacttcgggtggtacctgggctggggcgactgtgtctggctgccttatctttacacgctgcagggtctgtacttggtgtaccaccccgtgcagctgtccaccccgcacgccgtgggcgtcctgctgctgggcctggtgggctactacatcttccgggtggccaaccaccagaaggacctgttccgccgcacggatgggcgctgcctcatctggggcaggaagcccaaggtcatcgagtgctcctacacatccgccgatgggcagaggcaccacagcaagctgctggtgtcgggcttctggggcgtggcccgccacttcaactacgtcggcgacctgatgggcagcctggcctactgcctggcctgtggcggcggccacctgctgccctacttctacatcatctacatggccatcctgctgacccaccgctgcctccgggacgagcaccgctgcgccagcaagtacggccgggactgggagcgctacaccgccgcagtgccttaccgcctgctgcctggaatcttctaagggcacgccctagggagaagccctgtggggctgtcaagagcgtgttctgccaggtccatgggggctggcatcccagctccaactcgaggagcctcagtttcctcatctgtaaactggagagagcccagcacttggcaggtgtccagtacctaatcacgctctgttccttgcttttgccttcaagggaattccgagtgtccagcactgccgtattgccagcacagacggattttctctaatcagtgtccctggggcaggaggatgacccagtcacctttactagtcctttggagacaatttacctgtattaggagcccaggccacgctacactctgcccacactggtgagcaggaggtcttcccacgccctgtcattaggctgcatttactcttgctaaataaaagtgggagtggggcgtgcgcgttatccatgtattgcctttcagctctagatccccctcccctgcctgctctgcagtcgtgggtggggcccgtgcgccgtttctccttggtagcgtgcacggtgttgaactgggacactggggagaaaggggctttcatgtcgtttccttcctgctcctgctgcacagctgccaggagtgctctgcctggagtctgcagacctcagagaggtcccagcaccggctgtggcctttcaggtgtaggcaggtgggctctgcttcccgattccctgtgagcgcccaccctctcgaaagaattttctgcttgccctatgactgtgcagactctggctcgagcaacccggggaacttcaccctcaggggcctcccacaccttctccagcgaggaggtctcagtcccagcctcgggagggcacctccttttctgtgctttcttccctgaggcattcttcctcatccctagggtgttgtgtagaactctttttaaactctatgctccgagtagagttcatctttatattaaacttcccctgttcaaa

SEQ ID NO: 103011 - DNA, 979 bp, Homo sapiens
  Payload ID: 99
  Gene Symbol: DHCR7
  Gene Name: 7-dehydrocholesterol reductase
  ENST ID: ENST00000534795
  CDS Start-End: 1-349
cttttacaactacatgatgggcatcgagtttaaccctcggatcgggaagtggtttgacttcaagctgttcttcaatgggcgccccgggatcgtcgcctggaccctcatcaacctgtccttcgcagcgaagcagcgggagctccacagccatgtgaccaatgccatggtcctggtcaacgtcctgcaggccatctacgtgattgacttcttctggaacgaaacctggtacctgaagaccattgacatctgccatgaccacttcgggtggtacctgggctggggcgactgtgtctggctgccttatctttacacgctgcagatgagaaatgctgctgtggaggctgagtagaggcaggaagagctgccttccctttaagacttggagatgaccctggggagggcagcaaaggcgtctgcagaaccatctgggctgtttccccctggacaggactgcagggagctgcagggagctgcagggaggttcaccacggccctctgtaccttggaatacactaagatctccagggtgtggtggtcctatgcccacacatcccactgttaggagtgtcctcacagttatatcctgccatgtgcgaaatggctgcaagttcaaggctgtgcattgcagtgtcctgtgcaaaaaaaccgtgaaaagatcgggaacaagttatgcaaatcaagaggtgactgtttaattaagtgcatccacatgatggaatgttataaagctctcaaaaagaataggacagtcaactgatgatgaatcacattaacttaataaggaagaaaaaccactttattatatgaaatagatggagaaaaaaggacactaattcataataaaaacgcaaagacatccatagaaaacctacagctaacttcatatttaatgatgagatattggattctctcatcataagatcaagaacatggcaagaattttcactgccacttcttccaaattacattagagatccta

SEQ ID NO: 103012 - DNA, 507 bp, Homo sapiens
  Payload ID: 99
  Gene Symbol: DHCR7
  Gene Name: 7-dehydrocholesterol reductase
  ENST ID: ENST00000531364
  CDS Start-End: 191-507
gtggagcagcgcgcgcaagcgaggccaggggaaggtgggcgcaggtgaggggccgaggtgtgcgcagccggttgagaaggatcaagcaggcatttggagcacaggtgtctagaaacttttaaggggccggttcaagaaggaaaagttcccttctgctgtgaaactatttggcaagaggctggagggcccaatggctgcaaaatcgcaacccaacattcccaaagccaagagtctagatggcgtcaccaatgacagaaccgcatctcaagggcagtggggccgtgcctgggaggtggactggttttcactggcgagcgtcatcttcctactgctgttcgcccccttcatcgtctactacttcatcatggcttgtgaccagtacagctgcgccctgactggccctgtggtggacatcgtcaccggacatgctcggctctcggacatctgggccaagactccacctataacgaggaaagccgcccagctctataccttgtgggtcacctt

SEQ ID NO: 103013 - DNA, 837 bp, Homo sapiens
  Payload ID: 99
  Gene Symbol: DHCR7
  Gene Name: 7-dehydrocholesterol reductase
  ENST ID: ENST00000533800
  CDS Start-End: 1-666
atcaacctgtccttcgcagcgaagcagcgggagctccacagccatgtgaccaatgccatggtcctggtcaacgtcctgcaggccatctacgtgattgacttcttctggaacgaaacctggtacctgaagaccattgacatctgccatgaccacttcgggtggtacctgggctggggcgactgtgtctggctgccttatctttacacgctgcagggtctgtacttggtgtaccaccccgtgcagctgtccaccccgcacgccgtgggcgtcctgctgctgggcctggtgggctactacatcttccgggtggccaaccaccagaaggacctgttccgccgcacggatgggcgctgcctcatctggggcaggaagcccaaggtcatcgagtgctcctacacatccgccgatgggcagaggcaccacagcaagctgctggtgtcgggcttctggggcgtggcccgccacttcaactacgtcggcgacctgatgggcagcctggcctactgcctggcctgtggcggcggccacctgctgccctacttctacatcatctacatggccatcctgctgacccaccgctgcctccgggacgagcaccgctgcgccagcaaggaattccgagtgtccagcactgccgtattgccagcacagacggattttctctaatcagtgtccctggggcaggaggatgacccagtcacctttactagtcctttggagacaatttacctgtattaggagcccaggccacgctacactctgcccacactggtgagcaggaggtcttcccacgccctgtcattaggctgcatttactcttgctaaataaaagtggga

SEQ ID NO: 103014 - DNA, 1005 bp, Homo sapiens
  Payload ID: 99
  Gene Symbol: DHCR7
  Gene Name: 7-dehydrocholesterol reductase
  ENST ID: ENST00000527316
  CDS Start-End: 230-1005
gactccgacccctggctagagggtaggcggcgtggagcagcgcgcgcaagcgaggccaggggaaggtgggcgcaggtgaggggccgaggtgtgcgcaggactttagccggttgagaaggatcaagcaggcatttggagcacaggtgtctagaaacttttaaggggccggttcaagaaggaaaagttcccttctgctgtgaaactatttggcaagaggctggagggcccaatggctgcaaaatcgcaacccaacattcccaaagccaagagtctagatggcgtcaccaatgacagaaccgcatctcaagggcagtggggccgtgcctgctgcgccctgactggccctgtggtggacatcgtcaccggacatgctcggctctcggacatctgggccaagactccacctataacgaggaaagccgcccagctctataccttgtgggtcaccttccaggtgcttctgtacacgtctctccctgacttctgccataagtttctacccggctacgtaggaggcatccaggagggggccgtgactcctgcaggggttgtgaacaagtatcagatcaatggcctgcaagcctggctcctcacgcacctgctctggtttgcaaacgctcatctcctgtcctggttctcgcccaccatcatcttcgacaactggatcccactgctgtggtgcgccaacatccttggctatgccgtctccaccttcgccatggtcaagggctacttcttccccaccagcgccagagactgcaaattcacaggcaatttcttttacaactacatgatgggcatcgagtttaaccctcggatcgggaagtggtttgacttcaagctgttcttcaatgggcgccccgggatcgtcgcctggaccctcatcaacctgtccttcgcagcgaagcagcgggagctccacagccatgtgaccaatgccatggtcctggtcaacgtcctgcaggccatctacgtgattgacttcttctggaacgaaacctggta

SEQ ID NO: 103015 - DNA, 525 bp, Homo sapiens
  Payload ID: 99
  Gene Symbol: DHCR7
  Gene Name: 7-dehydrocholesterol reductase
  ENST ID: ENST00000529990
  CDS Start-End: 306-525
gtaggcggcgtggagcagcgcgcgcaagcgaggccaggggaaggtgggcgcaggtgaggggccgaggtgtgcgcaggactttagccggttgagaaggatcaagcaggcatttggagcacaggtgtctagaaacttttaaggggccggttcaagaaggaaaagttcccttctgctgtgaaactatttggcaagaggctggagggcccaatggctgcaaaatcgcaacccaacattcccaaagccaagagtctagatggcgtcaccaatgacagaaccgcatctcaagggcagtggggccgtgcctgatgggccccagtgtgactgcctgcatccgtcctcgcagggaggtggactggttttcactggcgagcgtcatcttcctactgctgttcgcccccttcatcgtctactacttcatcatggcttgtgaccagtacagctgcgccctgactggccctgtggtggacatcgtcaccggacatgctcggctctcggacatctgggccaagactccacctataacga

SEQ ID NO: 103016 - DNA, 968 bp, Homo sapiens
  Payload ID: 99
  Gene Symbol: DHCR7
  Gene Name: 7-dehydrocholesterol reductase
  ENST ID: ENST00000526780
  CDS Start-End: 476-968
acgagccggcgtctgagggatgctctgtccccgcgctgtctggagcttccccgggcgaaggctgcctggctccggggtcggctcctggccccatgccgcgctccgcggcggctctttctcctgccccacctgttgttcgcctccctctttgtcagtgctgagccaggcacagcagctttgcgatgggactggcttgtccgccgtcctccctgacatgcggctgttgaagccctgagcactggaccttctgcctcttgcttgactcctactgtgggccttgagcttctgccctctcctgaaatgtcagctgcctgcggtcttattcatttttgtgttccttgcaggactttagccggttgagaaggatcaagcaggcatttggagcacaggtgtctagaaacttttaaggggccggttcaagaaggaaaagttcccttctgctgtgaaactatttggcaagaggctggagggcccaatggctgcaaaatcgcaacccaacattcccaaagccaagagtctagatggcgtcaccaatgacagaaccgcatctcaagggcagtggggccgtgcctgggaggtggactggttttcactggcgagcgtcatcttcctactgctgttcgcccccttcatcgtctactacttcatcatggcttgtgaccagtacagctgcgccctgactggccctgtggtggacatcgtcaccggacatgctcggctctcggacatctgggccaagactccacctataacgaggaaagccgcccagctctataccttgtgggtcaccttccaggtgcttctgtacacgtctctccctgacttctgccataagtttctacccggctacgtaggaggcatccaggagggggccgtgactcctgcaggggttgtgaacaagtatcagatcaatggcctgcaagcctggctcctcacgcacctgctctggtttgcaaacgctcatctcc

SEQ ID NO: 103017 - DNA, 520 bp, Homo sapiens
  Payload ID: 99
  Gene Symbol: DHCR7
  Gene Name: 7-dehydrocholesterol reductase
  ENST ID: ENST00000525346
  CDS Start-End: 200-520
gcgcaagcgaggccaggggaaggtgggcgcaggtgaggggccgaggtgtgcgcaggtgagtggccaaggactttagccggttgagaaggatcaagcaggcatttggagcacaggtgtctagaaacttttaaggggccggttcaagaaggaaaagttcccttctgctgtgaaactatttggcaagaggctggagggcccaatggctgcaaaatcgcaacccaacattcccaaagccaagagtctagatggcgtcaccaatgacagaaccgcatctcaagggcagtggggccgtgcctgggaggtggactggttttcactggcgagcgtcatcttcctactgctgttcgcccccttcatcgtctactacttcatcatggcttgtgaccagtacagctgcgccctgactggccctgtggtggacatcgtcaccggacatgctcggctctcggacatctgggccaagactccacctataacgaggaaagccgcccagctctataccttgtgggtcaccttccag

SEQ ID NO: 103018 - DNA, 996 bp, Homo sapiens
  Payload ID: 99
  Gene Symbol: DHCR7
  Gene Name: 7-dehydrocholesterol reductase
  ENST ID: ENST00000525137
  CDS Start-End: 1-738
acaggcaatttcttttacaactacatgatgggcatcgagtttaaccctcggatcgggaagtggtttgacttcaagctgttcttcaatgggcgccccgggatcgtcgcctggaccctcatcaacctgtccttcgcagcgaagcagcgggagctccacagccatgtgaccaatgccatggtcctggtcaacgtcctgcaggccatctacgtgattgacttcttctggaacgaaacctggtacctgaagaccattgacatctgccatgaccacttcgggtggtacctgggctggggcgactgtgtctggctgccttatctttacacgctgcagaagagaacacggaggcaaggcgtgtgtcagaggcagagctggggtttgaccccaggccgctgggcccccgagcccacactcctgtcctctccctgggcaaagcaccgcttgaccccttccccctcgccccccagggtctgtacttggtgtaccaccccgtgcagctgtccaccccgcacgccgtgggcgtcctgctgctgggcctggtgggctactacatcttccgggtggccaaccaccagaaggacctgttccgccgcacggatgggcgctgcctcatctggggcaggaagcccaaggtcatcgagtgctcctacacatccgccgatgggcagaggcaccacagcaagctgctggtgtcgggcttctggggcgtggcccgccacttcaactacgtcggcgacctgatgggcagcctggcctactgcctggcctgtggcggcggccacctgctgccctacttctacatcatctacatggccatcctgctgacccaccgctgcctccgggacgagcaccgctgcgccagcaagtacggccgggactgggagcgctacaccgccgcagtgccttaccgcctgctgcctggaatcttctaagggcacgccctagggagaagccctgtggggctgtcaagagcgtgttctgccaggtccatgggggctg

SEQ ID NO: 103019 - DNA, 579 bp, Homo sapiens
  Payload ID: 99
  Gene Symbol: DHCR7
  Gene Name: 7-dehydrocholesterol reductase
  ENST ID: ENST00000527452
  CDS Start-End: 307-579
atgaaacgttccaaatacaccaaaagtggagagtacggtaggagcgctccatcgtgcccgcgggacagcagacgatagcaatcgattctccgtgctgggaatcccgccaccctgggcggatggcgctgaattcttgggaaccctctcctgcccctttcactcctgtaccacgtgtgactttagccggttgagaaggatcaagcaggcatttggagcacaggtgtctagaaacttttaaggggccggttcaagaaggaaaagttcccttctgctgtgaaactatttggcaagaggctggagggcccaatggctgcaaaatcgcaacccaacattcccaaagccaagagtctagatggcgtcaccaatgacagaaccgcatctcaagggcagtggggccgtgcctgggaggtggactggttttcactggcgagcgtcatcttcctactgctgttcgcccccttcatcgtctactacttcatcatggcttgtgaccagtacagctgcgccctgactggccctgtggtggacatcgtcaccggacatgctcggctctcggacatctgggccaagactccacct

SEQ ID NO: 103020 - DNA, 1950 bp, Homo sapiens
  Payload ID: 100
  Gene Symbol: OGG1
  Gene Name: 8-oxoguanine DNA glycosylase
  Uniprot ID: O15527
  ENST ID: ENST00000349503
  CDS Start-End: 344-1417
ctacttccggtggtgctgtggtctgcccctggagaacccagaagaacacagctgtgcgcgcccacaggctctgggggcgggagaagataagtcgcaaggagggggcgggacctacacctcaggaaagccggagaattggggcacgaagcggggctttgatgacccgcaaagggcgaggcatgcaggaggtggaggaattaagtgaaacagggaaggttgttaaacagcaccgtgtgggcgaggccttaagggtcgtggtccttgtctgggcggggtctttgggcgtcgacgaggcctggttctgggtaggcggggctactacggggcggtgcctgctgtggaaatgcctgcccgcgcgcttctgcccaggcgcatggggcatcgtactctagcctccactcctgccctgtgggcctccatcccgtgccctcgctctgagctgcgcctggacctggttctgccttctggacaatctttccggtggagggagcaaagtcctgcacactggagtggtgtactagcggatcaagtatggacactgactcagactgaggagcagctccactgcactgtgtaccgaggagacaagagccaggctagcaggcccacaccagacgagctggaggccgtgcgcaagtacttccagctagatgttaccctggctcaactgtatcaccactggggttccgtggactcccacttccaagaggtggctcagaaattccaaggtgtgcgactgctgcgacaagaccccatcgaatgccttttctcttttatctgttcctccaacaacaacatcgcccgcatcactggcatggtggagcggctgtgccaggcttttggacctcggctcatccagcttgatgatgtcacctaccatggcttccccagcctgcaggccctggctgggccagaggtggaggctcatctcaggaagctgggcctgggctatcgtgcccgttacgtgagtgccagtgcccgagccatcctggaagaacagggcgggctagcctggctgcagcagctacgagagtcctcatatgaggaggcccacaaggccctctgcatcctgcctggagtgggcaccaagggcctccttggcaatgcatttgatggccaccagcttctgcgtcctcttatcttctgccaggatcacctccgagaaggcccccctatcgggagaggggattcacaaggtgaagaactggaaccccagcttccctccagcctctcctccattccctatgggttctgtgaccactgctggaccaaggacgtggatgaccctcccctagtcactcatccatcccctggctccagagatggtcacatgacccaggcctggccagtcaaagtagtctctcccctggccacagtaattggtcatgtgatgcaagccagcttactagcactttgagaatgagtctcctgttgagctggtaggatgtaagcctggagctaatggcgatcatctttgccaccacctggggagagcctgcttgggaatgaaattaacacaaaggaagtccaacctgagaaatggccaaatatatttcctgataacattatgtggccctctggatccagccatgcctgaggtctacccctgggcttttggattatgtgtacagttggttcatccctttttctgctaattcgagtcatggctaatttaacaccctttagaaccttaaagaaccatcagcatcacccgggaacttttttagaaatgcaaaatctctactgctttggatcctgggtcaaaaaaaagaaaaaaaaaagaaatgcaaaactttaggccctgccccagatttactaaatcaatctgcagtttaacaaaatcctcaggtgatttgtatgctcattgaactttaagaagcagtgttttagaacaggttcttaaaaaggaacaaataaactcatttaactaaagttaactgattaaagagg

SEQ ID NO: 103021 - DNA, 2191 bp, Homo sapiens
  Payload ID: 100
  Gene Symbol: OGG1
  Gene Name: 8-oxoguanine DNA glycosylase
  Uniprot ID: O15527
  ENST ID: ENST00000302008
  CDS Start-End: 215-1285
ggagaattggggcacgaagcggggctttgatgacccgcaaagggcgaggcatgcaggaggtggaggaattaagtgaaacagggaaggttgttaaacagcaccgtgtgggcgaggccttaagggtcgtggtccttgtctgggcggggtctttgggcgtcgacgaggcctggttctgggtaggcggggctactacggggcggtgcctgctgtggaaatgcctgcccgcgcgcttctgcccaggcgcatggggcatcgtactctagcctccactcctgccctgtgggcctccatcccgtgccctcgctctgagctgcgcctggacctggttctgccttctggacaatctttccggtggagggagcaaagtcctgcacactggagtggtgtactagcggatcaagtatggacactgactcagactgaggagcagctccactgcactgtgtaccgaggagacaagagccaggctagcaggcccacaccagacgagctggaggccgtgcgcaagtacttccagctagatgttaccctggctcaactgtatcaccactggggttccgtggactcccacttccaagaggtggctcagaaattccaaggtgtgcgactgctgcgacaagaccccatcgaatgccttttctcttttatctgttcctccaacaacaacatcgcccgcatcactggcatggtggagcggctgtgccaggcttttggacctcggctcatccagcttgatgatgtcacctaccatggcttccccagcctgcaggccctggctgggccagaggtggaggctcatctcaggaagctgggcctgggctatcgtgcccgttacgtgagtgccagtgcccgagccatcctggaagaacagggcgggctagcctggctgcagcagctacgagagtcctcatatgaggaggcccacaaggccctctgcatcctgcctggagtgggcaccaaggtggctgactgcatctgcctgatggccctagacaagccccaggctgtgcccgtggatgtccatatgtggcacattgcccaacgtgactacagctggcaccctaccacgtcccaggcgaagggaccgagcccccagaccaacaaggaactgggaaactttttccggagcctgtggggaccttatgctggctgggcccaagcgctctgtcaggtcatcaccacttttatgacctttctcggaccccataggctggatcagatgcctcctgaagaattacagacttcttcctctagacttggagggcctccttggcaatgcatttgatggccaccagcttctgcgtcctcttatcttctgccaggatcacctccgagaaggcccccctatcgggagaggggattcacaaggtgaagaactggaaccccagcttccctccagcctctcctccattccctatgggttctgtgaccactgctggaccaaggacgtggatgaccctcccctagtcactcatccatcccctggctccagagatggtcacatgacccaggcctggccagtcaaagtagtctctcccctggccacagtaattggtcatgtgatgcaagccagcttactagcactttgagaatgagtctcctgttgagctggtaggatgtaagcctggagctaatggcgatcatctttgccaccacctggggagagcctgcttgggaatgaaattaacacaaaggaagtccaacctgagaaatggccaaatatatttcctgataacattatgtggccctctggatccagccatgcctgaggtctacccctgggcttttggattatgtgtacagttggttcatccctttttctgctaattcgagtcatggctaatttaacaccctttagaaccttaaagaaccatcagcatcacccgggaacttttttagaaatgcaaaatctctactgctttggatcctgggtcaaaaaaaagaaaaaaaaaagaaatgcaaaactttaggccctgccccagatttactaaatcaatctgcagtttaacaaaatcctcaggtgatttgtatgctcattgaactttaagaagcagtgttttagaacaggttcttaaaaaggaacaaataaactcatttaactaaagttaactgattaaagaggatttgctagggtattctttccacatctgtttgctttctctgggagaataagaagtcataagtcaaagaa

SEQ ID NO: 103022 - DNA, 1655 bp, Homo sapiens
  Payload ID: 100
  Gene Symbol: OGG1
  Gene Name: 8-oxoguanine DNA glycosylase
  Uniprot ID: O15527
  ENST ID: ENST00000302003
  CDS Start-End: 344-1576
ctacttccggtggtgctgtggtctgcccctggagaacccagaagaacacagctgtgcgcgcccacaggctctgggggcgggagaagataagtcgcaaggagggggcgggacctacacctcaggaaagccggagaattggggcacgaagcggggctttgatgacccgcaaagggcgaggcatgcaggaggtggaggaattaagtgaaacagggaaggttgttaaacagcaccgtgtgggcgaggccttaagggtcgtggtccttgtctgggcggggtctttgggcgtcgacgaggcctggttctgggtaggcggggctactacggggcggtgcctgctgtggaaatgcctgcccgcgcgcttctgcccaggcgcatggggcatcgtactctagcctccactcctgccctgtgggcctccatcccgtgccctcgctctgagctgcgcctggacctggttctgccttctggacaatctttccggtggagggagcaaagtcctgcacactggagtggtgtactagcggatcaagtatggacactgactcagactgaggagcagctccactgcactgtgtaccgaggagacaagagccaggctagcaggcccacaccagacgagctggaggccgtgcgcaagtacttccagctagatgttaccctggctcaactgtatcaccactggggttccgtggactcccacttccaagaggtggctcagaaattccaaggtgtgcgactgctgcgacaagaccccatcgaatgccttttctcttttatctgttcctccaacaacaacatcgcccgcatcactggcatggtggagcggctgtgccaggcttttggacctcggctcatccagcttgatgatgtcacctaccatggcttccccagcctgcaggccctggctgggccagaggtggaggctcatctcaggaagctgggcctgggctatcgtgcccgttacgtgagtgccagtgcccgagccatcctggaagaacagggcgggctagcctggctgcagcagctacgagagtcctcatatgaggaggcccacaaggccctctgcatcctgcctggagtgggcaccaaggtggctgactgcatctgcctgatggccctagacaagccccaggctgtgcccgtggatgtccatatgtggcacattgcccaacgtgactacagctggcaccctaccacgtcccaggcgaagggaccgagcccccagaccaacaaggaactgggaaactttttccggagcctgtggggaccttatgctggctgggcccaagcgactccaccctcctacaggtgctgttcagtgccgacctgcgccaatcccgccatgctcaggagccaccagcaaagcgcagaaagggttccaaagggccggaaggctagatggggcaccctggacaaagaaattccccaagcaccttcccctccattccccacttctctctccccatccccacccagtctcatgttggggaggggcctccctgtgactacctcaaaggccaggcacccccaaatcaagcagtcagtttgcacaacaagatggggtgggggatattgagggagacagcgctaaggatggttttatcttccctttattacaagaaggaacaataaaatagaaacatttgtatggaaaa

SEQ ID NO: 103023 - DNA, 2220 bp, Homo sapiens
  Payload ID: 100
  Gene Symbol: OGG1
  Gene Name: 8-oxoguanine DNA glycosylase
  Uniprot ID: O15527
  ENST ID: ENST00000302036
  CDS Start-End: 344-1618
ctacttccggtggtgctgtggtctgcccctggagaacccagaagaacacagctgtgcgcgcccacaggctctgggggcgggagaagataagtcgcaaggagggggcgggacctacacctcaggaaagccggagaattggggcacgaagcggggctttgatgacccgcaaagggcgaggcatgcaggaggtggaggaattaagtgaaacagggaaggttgttaaacagcaccgtgtgggcgaggccttaagggtcgtggtccttgtctgggcggggtctttgggcgtcgacgaggcctggttctgggtaggcggggctactacggggcggtgcctgctgtggaaatgcctgcccgcgcgcttctgcccaggcgcatggggcatcgtactctagcctccactcctgccctgtgggcctccatcccgtgccctcgctctgagctgcgcctggacctggttctgccttctggacaatctttccggtggagggagcaaagtcctgcacactggagtggtgtactagcggatcaagtatggacactgactcagactgaggagcagctccactgcactgtgtaccgaggagacaagagccaggctagcaggcccacaccagacgagctggaggccgtgcgcaagtacttccagctagatgttaccctggctcaactgtatcaccactggggttccgtggactcccacttccaagaggtggctcagaaattccaaggtgtgcgactgctgcgacaagaccccatcgaatgccttttctcttttatctgttcctccaacaacaacatcgcccgcatcactggcatggtggagcggctgtgccaggcttttggacctcggctcatccagcttgatgatgtcacctaccatggcttccccagcctgcaggccctggctgggccagaggtggaggctcatctcaggaagctgggcctgggctatcgtgcccgttacgtgagtgccagtgcccgagccatcctggaagaacagggcgggctagcctggctgcagcagctacgagagtcctcatatgaggaggcccacaaggccctctgcatcctgcctggagtgggcaccaaggtggctgactgcatctgcctgatggccctagacaagccccaggctgtgcccgtggatgtccatatgtggcacattgcccaacgtgactacagctggcaccctaccacgtcccaggcgaagggaccgagcccccagaccaacaaggaactgggaaactttttccggagcctgtggggaccttatgctggctgggcccaagcgggcctccttggcaatgcatttgatggccaccagcttctgcgtcctcttatcttctgccaggatcacctccgagaaggcccccctatcgggagaggggattcacaaggtgaagaactggaaccccagcttccctccagcctctcctccattccctatgggttctgtgaccactgctggaccaaggacgtggatgaccctcccctagtcactcatccatcccctggctccagagatggtcacatgacccaggcctggccagtcaaagtagtctctcccctggccacagtaattggtcatgtgatgcaagccagcttactagcactttgagaatgagtctcctgttgagctggtaggatgtaagcctggagctaatggcgatcatctttgccaccacctggggagagcctgcttgggaatgaaattaacacaaaggaagtccaacctgagaaatggccaaatatatttcctgataacattatgtggccctctggatccagccatgcctgaggtctacccctgggcttttggattatgtgtacagttggttcatccctttttctgctaattcgagtcatggctaatttaacaccctttagaaccttaaagaaccatcagcatcacccgggaacttttttagaaatgcaaaatctctactgctttggatcctgggtcaaaaaaaagaaaaaaaaaagaaatgcaaaactttaggccctgccccagatttactaaatcaatctgcagtttaacaaaatcctcaggtgatttgtatgctcattgaactttaagaagcagtgttttagaacaggttcttaaaaaggaacaaataaactcatttaactaaagttaactgattaaagaggatttgctagggtattctttccacatctgtttgctttctctgggagaataagaagtcataagtcaaagaa

SEQ ID NO: 103024 - DNA, 1744 bp, Homo sapiens
  Payload ID: 100
  Gene Symbol: OGG1
  Gene Name: 8-oxoguanine DNA glycosylase
  Uniprot ID: O15527
  ENST ID: ENST00000344629
  CDS Start-End: 344-1381
ctacttccggtggtgctgtggtctgcccctggagaacccagaagaacacagctgtgcgcgcccacaggctctgggggcgggagaagataagtcgcaaggagggggcgggacctacacctcaggaaagccggagaattggggcacgaagcggggctttgatgacccgcaaagggcgaggcatgcaggaggtggaggaattaagtgaaacagggaaggttgttaaacagcaccgtgtgggcgaggccttaagggtcgtggtccttgtctgggcggggtctttgggcgtcgacgaggcctggttctgggtaggcggggctactacggggcggtgcctgctgtggaaatgcctgcccgcgcgcttctgcccaggcgcatggggcatcgtactctagcctccactcctgccctgtgggcctccatcccgtgccctcgctctgagctgcgcctggacctggttctgccttctggacaatctttccggtggagggagcaaagtcctgcacactggagtggtgtactagcggatcaagtatggacactgactcagactgaggagcagctccactgcactgtgtaccgaggagacaagagccaggctagcaggcccacaccagacgagctggaggccgtgcgcaagtacttccagctagatgttaccctggctcaactgtatcaccactggggttccgtggactcccacttccaagaggtggctcagaaattccaaggtgtgcgactgctgcgacaagaccccatcgaatgccttttctcttttatctgttcctccaacaacaacatcgcccgcatcactggcatggtggagcggctgtgccaggcttttggacctcggctcatccagcttgatgatgtcacctaccatggcttccccagcctgcaggccctggctgggccagaggtggaggctcatctcaggaagctgggcctgggctatcgtgcccgttacgtgagtgccagtgcccgagccatcctggaagaacagggcgggctagcctggctgcagcagctacgagagtcctcatatgaggaggcccacaaggccctctgcatcctgcctggagtgggcaccaaggtggctgactgcatctgcctgatggccctagacaagccccaggctgtgcccgtggatgtccatatgtggcacattgcccaacgtgactacagctggcaccctaccacgtcccaggcgaagggaccgagcccccagaccaacaaggaactgggaaactttttccggagcctgtggggaccttatgctggctgggcccaagcggtgctgttcagtgccgacctgcgccaatcccgccatgctcaggagccaccagcaaagcgcagaaagggttccaaagggccggaaggctagatggggcaccctggacaaagaaattccccaagcaccttcccctccattccccacttctctctccccatccccacccagtctcatgttggggaggggcctccctgtgactacctcaaaggccaggcacccccaaatcaagcagtcagtttgcacaacaagatggggtgggggatattgagggagacagcgctaaggatggttttatcttccctttattacaagaaggaacaataaaatagaaacatttgtatggaaaatgcagtgaggagtggtagggaagcaggtgaggaggggacagggcagagaaactcccggttcagggagggaaggggagcaggctgcccccaagccctcccacgcaga

SEQ ID NO: 103025 - DNA, 1392 bp, Homo sapiens
  Payload ID: 100
  Gene Symbol: OGG1
  Gene Name: 8-oxoguanine DNA glycosylase
  ENST ID: ENST00000352937
  CDS Start-End: 1-790
cgtgcgcaagtacttccagctagatgttaccctggctcaactgtatcaccactggggttccgtggactcccacttccaagaggtggctcagaaattccaaggtgtgcgactgctgcgacaagaccccatcgaatgccttttctcttttatctgttcctccaacaacaacatcgcccgcatcactggcatggtggagcggctgtgccaggcttttggacctcggctcatccagcttgatgatgtcacctaccatggcttccccagcctgcaggccctggctgggccagaggtggaggctcatctcaggaagctgggcctgggctatcgtgcccgttacgtgagtgccagtgcccgagccatcctggaagaacagggcgggctagcctggctgcagcagctacgagagtcctcatatgaggaggcccacaaggccctctgcatcctgcctggagtgggcaccaagggcctccttggcaatgcatttgatggccaccagcttctgcgtcctcttatcttctgccaggatcacctccgagaaggcccccctatcgggagaggggattcacaaggtgaagaactggaaccccagcttccctccagcctctcctccattccctatgggttctgtgaccactgctggaccaaggacgtggatgaccctcccctagtcactcatccatcccctggctccagagatggtcacatgacccaggcctggccagtcaaagtagtctctcccctggccacagtaattggtcatgtgatgcaagccagcttactagcactttgagaatgagtctcctgttgagctggtaggatgtaagcctggagctaatggcgatcatctttgccaccacctggggagagcctgcttgggaatgaaattaacacaaaggaagtccaacctgagaaatggccaaatatatttcctgataacattatgtggccctctggatccagccatgcctgaggtctacccctgggcttttggattatgtgtacagttggttcatccctttttctgctaattcgagtcatggctaatttaacaccctttagaaccttaaagaaccatcagcatcacccgggaacttttttagaaatgcaaaatctctactgctttggatcctgggtcaaaaaaaagaaaaaaaaaagaaatgcaaaactttaggccctgccccagatttactaaatcaatctgcagtttaacaaaatcctcaggtgatttgtatgctcattgaactttaagaagcagtgttttagaacaggttcttaaaaaggaacaaataaactcatttaactaaagttaactgattaaagaggatttgctagggtattctttccacatctgtttgctttctctgggagaataagaagtcataagtcaaagaa

SEQ ID NO: 103026 - DNA, 1815 bp, Homo sapiens
  Payload ID: 100
  Gene Symbol: OGG1
  Gene Name: 8-oxoguanine DNA glycosylase
  Uniprot ID: O15527
  ENST ID: ENST00000339511
  CDS Start-End: 307-1281
ccagaagaacacagctgtgcgcgcccacaggctctgggggcgggagaagataagtcgcaaggagggggcgggacctacacctcaggaaagccggagaattggggcacgaagcggggctttgatgacccgcaaagggcgaggcatgcaggaggtggaggaattaagtgaaacagggaaggttgttaaacagcaccgtgtgggcgaggccttaagggtcgtggtccttgtctgggcggggtctttgggcgtcgacgaggcctggttctgggtaggcggggctactacggggcggtgcctgctgtggaaatgcctgcccgcgcgcttctgcccaggcgcatggggcatcgtactctagcctccactcctgccctgtgggcctccatcccgtgccctcgctctgagctgcgcctggacctggttctgccttctggacaatctttccggtggagggagcaaagtcctgcacactggagtggtgtactagcggatcaagtatggacactgactcagactgaggagcagctccactgcactgtgtaccgaggagacaagagccaggctagcaggcccacaccagacgagctggaggccgtgcgcaagtacttccagctagatgttaccctggctcaactgtatcaccactggggttccgtggactcccacttccaagaggtggctcagaaattccaaggtgtgcgactgctgcgacaagaccccatcgaatgccttttctcttttatctgttcctccaacaacaacatcgcccgcatcactggcatggtggagcggctgtgccaggcttttggacctcggctcatccagcttgatgatgtcacctaccatggcttccccagcctgcaggccctggctgggccagaggtggaggctcatctcaggaagctgggcctgggctatcgtgcccgttacgtgagtgccagtgcccgagccatcctggaagaacagggcgggctagcctggctgcagcagctacgagagtcctcatatgaggaggcccacaaggccctctgcatcctgcctggagtgggcaccaaggtggctgactgcatctgcctgatggccctagacaagccccaggctgtgcccgtggatgtccatatgtggcacattgcccaacgtgactacagctggcaccctaccacgtcccaggcgaagggaccgagcccccagaccaacaaggaactgggaaactttttccggagcctgtggggaccttatgctggctgggcccaagcggtgagtgtacctaggtgtcctccctaggtttcctctcctccagcccagacccagtggactcttccaccaccgccccaggtggccctaaaggactctccagccacccctgtcccaaccccagtggattctcattgccttcggccctgttccccaaggactcttccacctcccaacactgtcactagtctcaccagccctgaccccagtgtaccctcctccccacacagactccaccctcctacaggtgctgttcagtgccgacctgcgccaatcccgccatgctcaggagccaccagcaaagcgcagaaagggttccaaagggccggaaggctagatggggcaccctggacaaagaaattccccaagcaccttcccctccattccccacttctctctccccatccccacccagtctcatgttggggaggggcctccctgtgactacctcaaaggccaggcacccccaaatcaagcagtcagtttgcacaacaagatggggtgggggatattgagggagacagcgctaaggatggttttatcttccctttattacaagaagga

SEQ ID NO: 103027 - DNA, 1069 bp, Homo sapiens
  Payload ID: 100
  Gene Symbol: OGG1
  Gene Name: 8-oxoguanine DNA glycosylase
  Uniprot ID: O15527
  ENST ID: ENST00000383826
  CDS Start-End: 201-788
cgaagcggggctttgatgacccgcaaagggcgaggcatgcaggaggtggaggaattaagtgaaacagggaaggttgttaaacagcaccgtgtgggcgaggccttaagggtcgtggtccttgtctgggcggggtctttgggcgtcgacgaggcctggttctgggtaggcggggctactacggggcggtgcctgctgtggaaatgcctgcccgcgcgcttctgcccaggcgcatggggcatcgtactctagcctccactcctgccctgtgggcctccatcccgtgccctcgctctgagctgcgcctggacctggttctgccttctggacaatctttccggtggagggagcaaagtcctgcacactggagtggtgtactagcggatcaagtatggacactgactcagactgaggagcagctccactgcactgtgtaccgaggagacaagagccaggctagcaggcccacaccagacgagctggaggccgtgcgcaagtacttccagctagatgttaccctggctcaactgtatcaccactggggttccgtggactcccacttccaagaggtggctcagaaattccaaggtgtgcgactgctgcgacaagaccccatcgaatgccttttctcttttatctgttcctccaacaacaacatcgcccgcatcactggcatggtggagcggctgtgccaggcttttggacctcggctcatccagcttgatgatgtcacctaccatggcttccccagcctgcaggccctggctgggcctccttggcaatgcatttgatggccaccagcttctgcgtcctcttatcttctgccaggatcacctccgagaaggcccccctatcgggagaggggattcacaaggtgaagaactggaaccccagcttccctccagcctctcctccattccctatgggttctgtgaccactgctggaccaaggacgtggatgaccctcccctagtcactcatccatcccctggctccagagatggtcacatgacccaggcctggccagtcaaagtagtctctcccctggccacagtaattggtcatgtgatgc

SEQ ID NO: 103028 - DNA, 860 bp, Homo sapiens
  Payload ID: 100
  Gene Symbol: OGG1
  Gene Name: 8-oxoguanine DNA glycosylase
  ENST ID: ENST00000441094
  CDS Start-End: 1-668
tgccctgtgggcctccatcccgtgccctcgctctgagctgcgcctggacctggttctgccttctggacaatctttccggtgtgcgactgctgcgacaagaccccatcgaatgccttttctcttttatctgttcctccaacaacaacatcgcccgcatcactggcatggtggagcggctgtgccaggcttttggacctcggctcatccagcttgatgatgtcacctaccatggcttccccagcctgcaggccctggctgggccagaggtggaggctcatctcaggaagctgggcctgggctatcgtgcccgttacgtgagtgccagtgcccgagccatcctggaagaacagggcgggctagcctggctgcagcagctacgagagtcctcatatgaggaggcccacaaggccctctgcatcctgcctggagtgggcaccaaggtggctgactgcatctgcctgatggccctagacaagccccaggctgtgcccgtggatgtccatatgtggcacattgcccaacgtgactacagctggcaccctaccacgtcccaggcgaagggaccgagcccccagaccaacaaggaactgggaaactttttccggagcctgtggggaccttatgctggctgggcccaagcggtgagtgtacctaggtgtcctccctaggtttcctctcctccagcccagacccagtggactcttccaccaccgccccaggtggccctaaaggactctccagccacccctgtcccaaccccagtggattctcattgccttcggccctgttccccaaggactcttccacctcccaacactgtcactagtctcaccagccctgaccccagtgtaccctcctcc

SEQ ID NO: 103029 - DNA, 747 bp, Homo sapiens
  Payload ID: 100
  Gene Symbol: OGG1
  Gene Name: 8-oxoguanine DNA glycosylase
  ENST ID: ENST00000429146
  CDS Start-End: 1-505
ggcctccatcccgtgccctcgctctgagctgcgcctggacctggttctgccttctggacaatctttccggtggagggagcaaagtcctgcacactggagtggtgtactagcggatcaagtatggacactgactcagactgaggagcagctccactgcactgtgtaccgaggagacaagagccaggctagcaggcccacaccagacgagctggaggccgtgcgcaagtacttccagctagatgttaccctggctcaactgtatcaccactggggttccgtggactcccacttccaagaggtggctcagaaattccaaggtgtgcgactgctgcgacaagaccccatcgaatgccttttctcttttatctgttcctccaacaacaacatcgcccgcatcactggcatggtggagcggctgtgccaggcttttggacctcggctcatccagcttgatgatgtcacctaccatggcttccccagcctgcaggccctggctggtggctgactgcatctgcctgatggccctagacaagccccaggctgtgcccgtggatgtccatatgtggcacattgcccaacgtgactacagctggcaccctaccacgtcccaggcgaagggaccgagcccccagaccaacaaggaactgggaaactttttccggagcctgtggggaccttatgctggctgggcccaagcggtgagtgtacctaggtgtcctccctaggtttcctctcctccagcccaga

SEQ ID NO: 103030 - DNA, 930 bp, Homo sapiens
  Payload ID: 100
  Gene Symbol: OGG1
  Gene Name: 8-oxoguanine DNA glycosylase
  ENST ID: ENST00000425665
  CDS Start-End: 205-363
ggcacgaagcggggctttgatgacccgcaaagggcgaggcatgcaggaggtggaggaattaagtgaaacagggaaggttgttaaacagcaccgtgtgggcgaggccttaagggtcgtggtccttgtctgggcggggtctttgggcgtcgacgaggcctggttctgggtaggcggggctactacggggcggtgcctgctgtggaaatgcctgcccgcgcgcttctgcccaggcgcatggggcatcgtactctagcctccactcctgccctgtgggcctccatcccgtgccctcgctctgagctgcgcctggacctggttctgccttctggacaatctttccggtggctgactgcatctgcctgatggccctagacaagccccaggctgtgcccgtggatgtccatatgtggcacattgcccaacgtgactacagctggcaccctaccacgtcccaggcgaagggaccgagcccccagaccaacaaggaactgggaaactttttccggagcctgtggggaccttatgctggctgggcccaagcggtgagtgtacctaggtgtcctccctaggtttcctctcctccagcccagacccagtggactcttccaccaccgccccaggtggccctaaaggactctccagccacccctgtcccaaccccagtggattctcattgccttcggccctgttccccaaggactcttccacctcccaacactgtcactagtctcaccagccctgaccccagtgtaccctcctccccacacagactccaccctcctacaggtgctgttcagtgccgacctgcgccaatcccgccatgctcaggagccaccagcaaagcgcagaaagggttccaaagggccggaaggctagatggggcaccctggacaaagaaattccccaagcaccttcccctccattccccac

SEQ ID NO: 103031 - DNA, 874 bp, Homo sapiens
  Payload ID: 100
  Gene Symbol: OGG1
  Gene Name: 8-oxoguanine DNA glycosylase
  ENST ID: ENST00000426518
  CDS Start-End: 1-386
acgagctggaggccgtgcgcaagtacttccagctagatgttaccctggctcaactgtatcaccactggggttccgtggactcccacttccaagaggtggctcagaaattccaaggtgtgcgactgctgcgacaagaccccatcgaatgccttttctcttttatctgttcctccaacaacaacatcgcccgcatcactggcatggtggagcggctgtgccaggcttttggacctcggctcatccagcttgatgatgtcacctaccatggcttccccagcctgcaggccctggctggtgttccggtgccagcagaaggcctgcttacgtcggcatctgcattccagagccccctaaggtctaggcagcctgaggctgacaggagataaatttttaagaaatcagataagtgaagtgaaagagagagatcaaagtgttgtggcagcacaaaggagagactgactaactttctgctggggaatctgaaagagtgctttggtggaggtaacatgagatcagggccttgaagggtgagtcaagtctgtcaaggagacaagagggagagaagagcttgccagaggcccagagaccagcgaggaggctgtggtgtcctggaatgagggcgagatacttggtgggactggtcaacacggcaatgaagagggatatggccgaggaaaatggagaggggcactggagctgtgccagcaaggactgggatgcgtggacttgatcctgtagataacgggaggaagaaaggcctggatgcagcgccatgtcatgagcacatctgatcatgacagctcacctatgggaggattctccctcaacatttttctgtattttctaaattttctttaatggagcatgttttatt

SEQ ID NO: 103032 - DNA, 396 bp, Homo sapiens
  Payload ID: 100
  Gene Symbol: OGG1
  Gene Name: 8-oxoguanine DNA glycosylase
  ENST ID: ENST00000416333
  CDS Start-End: 1-396
tgatgatgtcacctaccatggcttccccagcctgcaggccctggctggtggctgactgcatctgcctgatggccctagacaagccccaggctgtgcccgtggatgtccatatgtggcacattgcccaacgtgactacagctggcaccctaccacgtcccaggcgaagggaccgagcccccagaccaacaaggaactgggaaactttttccggagcctgtggggaccttatgctggctgggcccaagcgactccaccctcctacaggtgctgttcagtgccgacctgcgccaatcccgccatgctcaggagccaccagcaaagcgcagaaagggttccaaagggccggaaggctagatggggcaccctggacaaagaaattccccaagcaccttccc

SEQ ID NO: 103033 - DNA, 1948 bp, Homo sapiens
  Payload ID: 100
  Gene Symbol: OGG1
  Gene Name: 8-oxoguanine DNA glycosylase
  Uniprot ID: O15527
  ENST ID: ENST00000449570
  CDS Start-End: 216-1184
cggagaattggggcacgaagcggggctttgatgacccgcaaagggcgaggcatgcaggaggtggaggaattaagtgaaacagggaaggttgttaaacagcaccgtgtgggcgaggccttaagggtcgtggtccttgtctgggcggggtctttgggcgtcgacgaggcctggttctgggtaggcggggctactacggggcggtgcctgctgtggaaatgcctgcccgcgcgcttctgcccaggcgcatggggcatcgtactctagcctccactcctgccctgtgggcctccatcccgtgccctcgctctgagctgcgcctggacctggttctgccttctggacaatctttccggtggagggagcaaagtcctgcacactggagtggtgtactagcggatcaagtatggacactgactcagactgaggagcagctccactgcactgtgtaccgaggagacaagagccaggctagcaggcccacaccagacgagctggaggccgtgcgcaagtacttccagctagatgttaccctggctcaactgtatcaccactggggttccgtggactcccacttccaagaggtggctcagaaattccaaggtgtgcgactgctgcgacaagaccccatcgaatgccttttctcttttatctgttcctccaacaacaacatcgcccgcatcactggcatggtggagcggctgtgccaggcttttggacctcggctcatccagcttgatgatgtcacctaccatggcttccccagcctgcaggccctggctgggccagaggtggaggctcatctcaggaagctgggcctgggctatcgtgcccgttacgtgagtgccagtgcccgagccatcctggaagaacagggcgggctagcctggctgcagcagctacgagagtcctcatatgaggaggcccacaaggccctctgcatcctgcctggagtgggcaccaaggtggctgactgcatctgcctgatggccctagacaagccccaggctgtgcccgtggatgtccatatgtggcacattgcccaacgtgactacagctggcaccctaccacgtcccaggcgaagggaccgagcccccagaccaacaaggaactgggaaactttttccggagcctgtggggaccttatgctggctgggcccaagcggctggatcagatgcctcctgaagaattacagacttcttcctctagacttggagggcctccttggcaatgcatttgatggccaccagcttctgcgtcctcttatcttctgccaggatcacctccgagaaggcccccctatcgggagaggggattcacaaggtgaagaactggaaccccagcttccctccagcctctcctccattccctatgggttctgtgaccactgctggaccaaggacgtggatgaccctcccctagtcactcatccatcccctggctccagagatggtcacatgacccaggcctggccagtcaaagtagtctctcccctggccacagtaattggtcatgtgatgcaagccagcttactagcactttgagaatgagtctcctgttgagctggtaggatgtaagcctggagctaatggcgatcatctttgccaccacctggggagagcctgcttgggaatgaaattaacacaaaggaagtccaacctgagaaatggccaaatatatttcctgataacattatgtggccctctggatccagccatgcctgaggtctacccctgggcttttggattatgtgtacagttggttcatccctttttctgctaattcgagtcatggctaatttaacaccctttagaaccttaaagaaccatcagcatcacccgggaacttttttagaaatgcaaaatctctactgctttggatcctgggtcaaaaaaaagaaaaaaaaaagaaatgcaaaactttaggccctgccccagatttactaaatc

SEQ ID NO: 103034 - DNA, 2380 bp, Homo sapiens
  Payload ID: 101
  Gene Symbol: AKAP1
  Gene Name: A kinase (PRKA) anchor protein 1
  Uniprot ID: Q92667
  ENST ID: ENST00000314126
  CDS Start-End: 63-1844
cccacccttggtggcagaaccgagcactacccagcaaggtgtaattacttcaagcctccaggatggcaatccagttccgttcgctcttccccttggcattgcctgggatgctggcgctcctcggctggtggtggtttttctctcgtaaaaaaggccatgtcagcagccatgatgagcagcaggtggaggctggtgctgtgcagctgagggctgaccctgccatcaaggaacctctccccgtggaagacgtctgtcccaaagtagtgtccacaccccccagtgtcacagagcctccagaaaaggaactgtccaccgtgagcaagctgcctgcagagcccccagcattgctccagacacacccaccttgccgaagatcagagtcctcgggcattcttcctaacaccacagacatgagattgcgaccaggaacacgcagagatgacagtacaaagctggagctagccctgacaggtggtgaagccaaatcgattcctctagagtgccccctttcatccccaaagggtgtactattctccagcaaatcagctgaggtgtgtaagcaagattcccccttcagcagggtgccaaggaaggtccagccaggctaccccgtagtccccgcagagaagcgtagctctggggagagggcaagagagacaggtggggccgaagggactggtgatgccgtgttgggggaaaaggtgcttgaagaagctctgttgtctcgggagcatgtcttggaattggagaacagcaagggccccagcctggcctctttagagggggaagaagataaggggaagagcagctcatcccaggtggtggggccagtgcaggaggaagagtatgtagcagagaagttgccaagtaggttcatcgagtcggctcacacagagctggcaaaggacgatgcggcgccagcacccccagtcgcagacgccaaagcccaggatagaggtgtcgagggagaactgggcaatgaggagagcttggatagaaatgaggagggcttggatagaaatgaggagggcttggatagaaatgaggagagcttggatagaaatgaggagggcttggatagaaatgaggagattaagcgggctgccttccagataatctcccaagtgatctcagaagcaaccgaacaggtgctggccaccacggttggcaaggttgcaggtcgtgtgtgtcaggccagtcagctccaagggcagaaggaagagagctgtgtcccagttcaccagaaaactgtcttgggcccagacactgcggagcctgccacagcagaggcagctgttgccccgccggatgctggcctccccttgccaggcctaccagcagagggctcaccaccaccaaagacctacgtgagctgcctgaagagccttctgtccagccccaccaaggacagtaagccaaatatctctgcacaccacatctccctggcctcctgcctggcactgaccacccccagtgaagagttgccggaccgggcaggcatcctggtggaagatgccacctgtgtcacctgcatgtcagacagcagccaaagtgtccctttggtggcttctccaggacactgctcagattctttcagcacttcagggcttgaagactcttgcacagagaccagctcgagccccagggacaaggccatcaccccgccactgccagaaagtactgtgcccttcagcaatggggtgctgaagggggagttgtcagacttgggggctgaggatggatggaccatggatgcggaagcagatcattcaggagttgcagctccacccccgggaaagcggggcactttgataacgaggtgtcctgggtttttcgagtgctgaccccagcgtagacagttcagaccgctaacttacaggttctgacaggaacagcatggattccgtggatagctgttgcagtctcaagaagactgagagcttccaaaatgcccaggcaggctccaaccctaagaaggtcgacctcatcatctgggagatcgaggtgccaaagcacttagtcggtcggctaattggcaagcaggggcgctatgtgagttttctgaagcaaacatctggtgccaagatctacatttcaaccctgccttacacccagagcgtccagatctgccacatagaaggctctcaacatcatgtagacaaagcgctgaacttgattgggaagaagttcaaagagctgaacctcaccaatatctacgctcccccattgccttcactggcactgccttctctgccgatgacatcctggctcatgctgcctgatggcatcaccgtggaggtcattgtggtcaaccaggtcaatgccgggcacctgttcgtgcagcagcacacacaccctaccttccacgcgctgcgcagcc

SEQ ID NO: 103035 - DNA, 3970 bp, Homo sapiens
  Payload ID: 101
  Gene Symbol: AKAP1
  Gene Name: A kinase (PRKA) anchor protein 1
  Uniprot ID: Q92667
  ENST ID: ENST00000337714
  CDS Start-End: 234-2945
acaagggcgaggggcggggcctgcgtcgcgctgcgggcacgtcgccgcgcgtcttcagtatttaatgtctctgtgttccacccgcctgggctagcacgtgggggagctgcggaagcgcggcgctgcgggccgggccgcggggcacagccgggggccggcggcggcgcgcggactccgcatcccgcaccccgatggtagccgaggagctggtgtaattacttcaagcctccaggatggcaatccagttccgttcgctcttccccttggcattgcctgggatgctggcgctcctcggctggtggtggtttttctctcgtaaaaaaggccatgtcagcagccatgatgagcagcaggtggaggctggtgctgtgcagctgagggctgaccctgccatcaaggaacctctccccgtggaagacgtctgtcccaaagtagtgtccacaccccccagtgtcacagagcctccagaaaaggaactgtccaccgtgagcaagctgcctgcagagcccccagcattgctccagacacacccaccttgccgaagatcagagtcctcgggcattcttcctaacaccacagacatgagattgcgaccaggaacacgcagagatgacagtacaaagctggagctagccctgacaggtggtgaagccaaatcgattcctctagagtgccccctttcatccccaaagggtgtactattctccagcaaatcagctgaggtgtgtaagcaagattcccccttcagcagggtgccaaggaaggtccagccaggctaccccgtagtccccgcagagaagcgtagctctggggagagggcaagagagacaggtggggccgaagggactggtgatgccgtgttgggggaaaaggtgcttgaagaagctctgttgtctcgggagcatgtcttggaattggagaacagcaagggccccagcctggcctctttagagggggaagaagataaggggaagagcagctcatcccaggtggtggggccagtgcaggaggaagagtatgtagcagagaagttgccaagtaggttcatcgagtcggctcacacagagctggcaaaggacgatgcggcgccagcacccccagtcgcagacgccaaagcccaggatagaggtgtcgagggagaactgggcaatgaggagagcttggatagaaatgaggagggcttggatagaaatgaggagggcttggatagaaatgaggagagcttggatagaaatgaggagggcttggatagaaatgaggagattaagcgggctgccttccagataatctcccaagtgatctcagaagcaaccgaacaggtgctggccaccacggttggcaaggttgcaggtcgtgtgtgtcaggccagtcagctccaagggcagaaggaagagagctgtgtcccagttcaccagaaaactgtcttgggcccagacactgcggagcctgccacagcagaggcagctgttgccccgccggatgctggcctccccttgccaggcctaccagcagagggctcaccaccaccaaagacctacgtgagctgcctgaagagccttctgtccagccccaccaaggacagtaagccaaatatctctgcacaccacatctccctggcctcctgcctggcactgaccacccccagtgaagagttgccggaccgggcaggcatcctggtggaagatgccacctgtgtcacctgcatgtcagacagcagccaaagtgtccctttggtggcttctccaggacactgctcagattctttcagcacttcagggcttgaagactcttgcacagagaccagctcgagccccagggacaaggccatcaccccgccactgccagaaagtactgtgcccttcagcaatggggtgctgaagggggagttgtcagacttgggggctgaggatggatggaccatggatgcggaagcagatcattcaggaggttctgacaggaacagcatggattccgtggatagctgttgcagtctcaagaagactgagagcttccaaaatgcccaggcaggctccaaccctaagaaggtcgacctcatcatctgggagatcgaggtgccaaagcacttagtcggtcggctaattggcaagcaggggcgctatgtgagttttctgaagcaaacatctggtgccaagatctacatttcaaccctgccttacacccagagcgtccagatctgccacatagaaggctctcaacatcatgtagacaaagcgctgaacttgattgggaagaagttcaaagagctgaacctcaccaatatctacgctcccccattgccttcactggcactgccttctctgccgatgacatcctggctcatgctgcctgatggcatcaccgtggaggtcattgtggtcaaccaggtcaatgccgggcacctgttcgtgcagcagcacacacaccctaccttccacgcgctgcgcagcctcgaccagcagatgtacctctgttactctcagcctggaatccccaccttgcccaccccagtggaaataacggtcatctgtgccgcccctggtgcggacggggcctggtggcgagcccaagtggttgcctcctacgaggagaccaacgaagtggagattcgatacgtggactacggcggatataagagggtgaaagtagacgtgctccggcaaatcaggtctgactttgtcaccctgccgtttcagggagcagaagtccttctggacagtgtgatgcccctgtcagacgatgaccagttttcaccggaagcagatgccgccatgagcgagatgacggggaatacagcactgcttgctcaggtgacaagttacagtccaactggtcttcctctgattcagctgtggagtgtggttggagatgaagtggtgttgataaaccggtccctggtggagcgaggccttgcccagtgggtagacagctactacacaagcctttgacccccatgctgcttcctgagagtctttttttgcactgttgaaattgggcttggcactcaagtcaaagatgaacatcggaataacaaacattgtcctctccagaaagtcctttctttctccatactgtagtcctattgagaagacatttcgtctctgagaaaaaaggatggaactatgggttctcttcgcaaagccaaaggatagtgtttaacaagccagctggcttatgctggttctcagctgtttaaaaaaaaaaaaaaaaaggaatagaaacagtttcaaccagattgtcctattccccctgttccattcccctcttcttccttctatctccttccccggcaaaaaccaaacaaactggcagacaggccagggatgtatgttgcttgcttgagagggtttcttttacttcaaaatctttcttcagggagcaagacatgaactgactaattggtatccactacttgtacagcttacataaatgagttgatgatatttaaccagtttttataaacttcatttaggtctctaaacacagactttttaaattgcaactgtaaatatgaaatggtcatcacatctgaccttggtcagtggggaggggaactggtatcctgccaagcctggttgtaatttgtaaccattttctatttgtgcaaactctgtaaatatgtgtttaaacaaatgtaatattttgtacaagatacactggagaacaaagggaactcaagattcttccagccacatgtcacctgtaggtagaagtaaactctgcagtgcagcttctgctcttggcccctctggccagggcccctgtggcttcctgcacactggacaggtgactgtatggtagagactgtgatctgggaactttttgctgtacaaatctgtttaaaaaaaaaaaaaagtaactcattgaattaacttgcagtggtgtgtttgattcttttttagactggcttcagcattgtgcagtttaaaaataagtaagtaacttacataaatcttcaattgtatgaactgca

SEQ ID NO: 103036 - DNA, 4089 bp, Homo sapiens
  Payload ID: 101
  Gene Symbol: AKAP1
  Gene Name: A kinase (PRKA) anchor protein 1
  Uniprot ID: Q92667
  ENST ID: ENST00000481416
  CDS Start-End: 253-2034
atttgggatctctagggtacccacatgaagtcatagcttactgtgacttacacaggcccctgaggatgaaggtaacagtcctgtgagcactgaggctgggctgggaccaacacctgagccatggctccagcactctgattcctggcccagccatgctgctgagggtgcacagcccaggcctaccatcgcccccacccttggtggcagaaccgagcactacccagcaaggtgtaattacttcaagcctccaggatggcaatccagttccgttcgctcttccccttggcattgcctgggatgctggcgctcctcggctggtggtggtttttctctcgtaaaaaaggccatgtcagcagccatgatgagcagcaggtggaggctggtgctgtgcagctgagggctgaccctgccatcaaggaacctctccccgtggaagacgtctgtcccaaagtagtgtccacaccccccagtgtcacagagcctccagaaaaggaactgtccaccgtgagcaagctgcctgcagagcccccagcattgctccagacacacccaccttgccgaagatcagagtcctcgggcattcttcctaacaccacagacatgagattgcgaccaggaacacgcagagatgacagtacaaagctggagctagccctgacaggtggtgaagccaaatcgattcctctagagtgccccctttcatccccaaagggtgtactattctccagcaaatcagctgaggtgtgtaagcaagattcccccttcagcagggtgccaaggaaggtccagccaggctaccccgtagtccccgcagagaagcgtagctctggggagagggcaagagagacaggtggggccgaagggactggtgatgccgtgttgggggaaaaggtgcttgaagaagctctgttgtctcgggagcatgtcttggaattggagaacagcaagggccccagcctggcctctttagagggggaagaagataaggggaagagcagctcatcccaggtggtggggccagtgcaggaggaagagtatgtagcagagaagttgccaagtaggttcatcgagtcggctcacacagagctggcaaaggacgatgcggcgccagcacccccagtcgcagacgccaaagcccaggatagaggtgtcgagggagaactgggcaatgaggagagcttggatagaaatgaggagggcttggatagaaatgaggagggcttggatagaaatgaggagagcttggatagaaatgaggagggcttggatagaaatgaggagattaagcgggctgccttccagataatctcccaagtgatctcagaagcaaccgaacaggtgctggccaccacggttggcaaggttgcaggtcgtgtgtgtcaggccagtcagctccaagggcagaaggaagagagctgtgtcccagttcaccagaaaactgtcttgggcccagacactgcggagcctgccacagcagaggcagctgttgccccgccggatgctggcctccccttgccaggcctaccagcagagggctcaccaccaccaaagacctacgtgagctgcctgaagagccttctgtccagccccaccaaggacagtaagccaaatatctctgcacaccacatctccctggcctcctgcctggcactgaccacccccagtgaagagttgccggaccgggcaggcatcctggtggaagatgccacctgtgtcacctgcatgtcagacagcagccaaagtgtccctttggtggcttctccaggacactgctcagattctttcagcacttcagggcttgaagactcttgcacagagaccagctcgagccccagggacaaggccatcaccccgccactgccagaaagtactgtgcccttcagcaatggggtgctgaagggggagttgtcagacttgggggctgaggatggatggaccatggatgcggaagcagatcattcaggagttgcagctccacccccgggaaagcggggcactttgataacgaggtgtcctgggtttttcgagtgctgaccccagcgtagacagttcagaccgctaacttacaggttctgacaggaacagcatggattccgtggatagctgttgcagtctcaagaagactgagagcttccaaaatgcccaggcaggctccaaccctaagaaggtcgacctcatcatctgggagatcgaggtgccaaagcacttagtcggtcggctaattggcaagcaggggcgctatgtgagttttctgaagcaaacatctggtgccaagatctacatttcaaccctgccttacacccagagcgtccagatctgccacatagaaggctctcaacatcatgtagacaaagcgctgaacttgattgggaagaagttcaaagagctgaacctcaccaatatctacgctcccccattgccttcactggcactgccttctctgccgatgacatcctggctcatgctgcctgatggcatcaccgtggaggtcattgtggtcaaccaggtcaatgccgggcacctgttcgtgcagcagcacacacaccctaccttccacgcgctgcgcagcctcgaccagcagatgtacctctgttactctcagcctggaatccccaccttgcccaccccagtggaaataacggtcatctgtgccgcccctggtgcggacggggcctggtggcgagcccaagtggttgcctcctacgaggagaccaacgaagtggagattcgatacgtggactacggcggatataagagggtgaaagtagacgtgctccggcaaatcaggtctgactttgtcaccctgccgtttcagggagcagaagtccttctggacagtgtgatgcccctgtcagacgatgaccagttttcaccggaagcagatgccgccatgagcgagatgacggggaatacagcactgcttgctcaggtgacaagttacagtccaactggtcttcctctgattcagctgtggagtgtggttggagatgaagtggtgttgataaaccggtccctggtggagcgaggccttgcccagtgggtagacagctactacacaagcctttgacccccatgctgcttcctgagagtctttttttgcactgttgaaattgggcttggcactcaagtcaaagatgaacatcggaataacaaacattgtcctctccagaaagtcctttctttctccatactgtagtcctattgagaagacatttcgtctctgagaaaaaaggatggaactatgggttctcttcgcaaagccaaaggatagtgtttaacaagccagctggcttatgctggttctcagctgtttaaaaaaaaaaaaaaaaaggaatagaaacagtttcaaccagattgtcctattccccctgttccattcccctcttcttccttctatctccttccccggcaaaaaccaaacaaactggcagacaggccagggatgtatgttgcttgcttgagagggtttcttttacttcaaaatctttcttcagggagcaagacatgaactgactaattggtatccactacttgtacagcttacataaatgagttgatgatatttaaccagtttttataaacttcatttaggtctctaaacacagactttttaaattgcaactgtaaatatgaaatggtcatcacatctgaccttggtcagtggggaggggaactggtatcctgccaagcctggttgtaatttgtaaccattttctatttgtgcaaactctgtaaatatgtgtttaaacaaatgtaatattttgtacaagatacactggagaacaaagggaactcaagattcttccagccacatgtcacctgtaggtagaagtaaactctgcagtgcagcttctgctcttggcccctctggccagggcccctgtggcttcctgcacactggacaggtgactgtatggtagagactgtgatctgggaactttttgctgtacaaatctgtttaaaaaaaaaaaaaagtaactcattgaattaacttgcagtggtgtgtttgattcttttttagactggcttcagcattgtgcagtttaaaaataagtaagtaacttacataaatcttcaattgtatgaact

SEQ ID NO: 103037 - DNA, 3153 bp, Homo sapiens
  Payload ID: 101
  Gene Symbol: AKAP1
  Gene Name: A kinase (PRKA) anchor protein 1
  Uniprot ID: Q92667
  ENST ID: ENST00000539273
  CDS Start-End: 211-2922
gtgacttacacaggcccctgaggatgaaggtaacagtcctgtgagcactgaggctgggctgggaccaacacctgagccatggctccagcactctgattcctggcccagccatgctgctgagggtgcacagcccaggcctaccatcgcccccacccttggtggcagaaccgagcactacccagcaaggtgtaattacttcaagcctccaggatggcaatccagttccgttcgctcttccccttggcattgcctgggatgctggcgctcctcggctggtggtggtttttctctcgtaaaaaaggccatgtcagcagccatgatgagcagcaggtggaggctggtgctgtgcagctgagggctgaccctgccatcaaggaacctctccccgtggaagacgtctgtcccaaagtagtgtccacaccccccagtgtcacagagcctccagaaaaggaactgtccaccgtgagcaagctgcctgcagagcccccagcattgctccagacacacccaccttgccgaagatcagagtcctcgggcattcttcctaacaccacagacatgagattgcgaccaggaacacgcagagatgacagtacaaagctggagctagccctgacaggtggtgaagccaaatcgattcctctagagtgccccctttcatccccaaagggtgtactattctccagcaaatcagctgaggtgtgtaagcaagattcccccttcagcagggtgccaaggaaggtccagccaggctaccccgtagtccccgcagagaagcgtagctctggggagagggcaagagagacaggtggggccgaagggactggtgatgccgtgttgggggaaaaggtgcttgaagaagctctgttgtctcgggagcatgtcttggaattggagaacagcaagggccccagcctggcctctttagagggggaagaagataaggggaagagcagctcatcccaggtggtggggccagtgcaggaggaagagtatgtagcagagaagttgccaagtaggttcatcgagtcggctcacacagagctggcaaaggacgatgcggcgccagcacccccagtcgcagacgccaaagcccaggatagaggtgtcgagggagaactgggcaatgaggagagcttggatagaaatgaggagggcttggatagaaatgaggagggcttggatagaaatgaggagagcttggatagaaatgaggagggcttggatagaaatgaggagattaagcgggctgccttccagataatctcccaagtgatctcagaagcaaccgaacaggtgctggccaccacggttggcaaggttgcaggtcgtgtgtgtcaggccagtcagctccaagggcagaaggaagagagctgtgtcccagttcaccagaaaactgtcttgggcccagacactgcggagcctgccacagcagaggcagctgttgccccgccggatgctggcctccccttgccaggcctaccagcagagggctcaccaccaccaaagacctacgtgagctgcctgaagagccttctgtccagccccaccaaggacagtaagccaaatatctctgcacaccacatctccctggcctcctgcctggcactgaccacccccagtgaagagttgccggaccgggcaggcatcctggtggaagatgccacctgtgtcacctgcatgtcagacagcagccaaagtgtccctttggtggcttctccaggacactgctcagattctttcagcacttcagggcttgaagactcttgcacagagaccagctcgagccccagggacaaggccatcaccccgccactgccagaaagtactgtgcccttcagcaatggggtgctgaagggggagttgtcagacttgggggctgaggatggatggaccatggatgcggaagcagatcattcaggaggttctgacaggaacagcatggattccgtggatagctgttgcagtctcaagaagactgagagcttccaaaatgcccaggcaggctccaaccctaagaaggtcgacctcatcatctgggagatcgaggtgccaaagcacttagtcggtcggctaattggcaagcaggggcgctatgtgagttttctgaagcaaacatctggtgccaagatctacatttcaaccctgccttacacccagagcgtccagatctgccacatagaaggctctcaacatcatgtagacaaagcgctgaacttgattgggaagaagttcaaagagctgaacctcaccaatatctacgctcccccattgccttcactggcactgccttctctgccgatgacatcctggctcatgctgcctgatggcatcaccgtggaggtcattgtggtcaaccaggtcaatgccgggcacctgttcgtgcagcagcacacacaccctaccttccacgcgctgcgcagcctcgaccagcagatgtacctctgttactctcagcctggaatccccaccttgcccaccccagtggaaataacggtcatctgtgccgcccctggtgcggacggggcctggtggcgagcccaagtggttgcctcctacgaggagaccaacgaagtggagattcgatacgtggactacggcggatataagagggtgaaagtagacgtgctccggcaaatcaggtctgactttgtcaccctgccgtttcagggagcagaagtccttctggacagtgtgatgcccctgtcagacgatgaccagttttcaccggaagcagatgccgccatgagcgagatgacggggaatacagcactgcttgctcaggtgacaagttacagtccaactggtcttcctctgattcagctgtggagtgtggttggagatgaagtggtgttgataaaccggtccctggtggagcgaggccttgcccagtgggtagacagctactacacaagcctttgacccccatgctgcttcctgagagtctttttttgcactgttgaaattgggcttggcactcaagtcaaagatgaacatcggaataacaaacattgtcctctccagaaagtcctttctttctccatactgtagtcctattgagaagacatttcgtctctgagaaaaaaggatggaactatgggttctcttcgcaaagccaaaggatagtgtttaacaagccagctggcttatgct

SEQ ID NO: 103038 - DNA, 532 bp, Homo sapiens
  Payload ID: 101
  Gene Symbol: AKAP1
  Gene Name: A kinase (PRKA) anchor protein 1
  ENST ID: ENST00000572814
  CDS Start-End: 121-532
aacttaaccggagcgtgcacacccgcctgcgaggctgacccgagcgcgtcccacccaaggtcgcccagccccgcgggcgtttacttttcaaaggtcgtgtaattacttcaagcctccaggatggcaatccagttccgttcgctcttccccttggcattgcctgggatgctggcgctcctcggctggtggtggtttttctctcgtaaaaaaggccatgtcagcagccatgatgagcagcaggtggaggctggtgctgtgcagctgagggctgaccctgccatcaaggaacctctccccgtggaagacgtctgtcccaaagtagtgtccacaccccccagtgtcacagagcctccagaaaaggaactgtccaccgtgagcaagctgcctgcagagcccccagcattgctccagacacacccaccttgccgaagatcagagtcctcgggcattcttcctaacaccacagacatgagattgcgaccaggaacacgcagagatgacagtacaaagctggagctagccctgacaggtg

SEQ ID NO: 103039 - DNA, 442 bp, Homo sapiens
  Payload ID: 101
  Gene Symbol: AKAP1
  Gene Name: A kinase (PRKA) anchor protein 1
  ENST ID: ENST00000572560
  CDS Start-End: 1-418
tggtgcggacggggcctggtggcgagcccaagtggttgcctcctacgaggagaccaacgaagtggagattcgatacgtggactacggcggatataagagggtgaaagtagacgtgctccggcaaatcaggtctgactttgtcaccctgccgtttcagggagcagaagtccttctggacagtgtgatgcccctgtcagacgatgaccagttttcaccggaagcagatgccgccatgagcgagatgacggggaatacagcactgcttgctcaggtgacaagttacagtccaactggtcttcctctgattcagctgtggagtgtggttggagatgaagtggtgttgataaaccggtccctggtggagcgaggccttgcccaactggcttcagcattgtgcagtttaaaaataagtaagtaacttacataaatcttcaattgtatg

SEQ ID NO: 103040 - DNA, 614 bp, Homo sapiens
  Payload ID: 101
  Gene Symbol: AKAP1
  Gene Name: A kinase (PRKA) anchor protein 1
  ENST ID: ENST00000576295
  CDS Start-End: 1-614
gcagagaagcgtagctctggggagagggcaagagagacaggtggggccgaagggactggtgatgccgtgttgggggaaaaggtgcttgaagaagctctgttgtctcgggagcatgtcttggaattggagaacagcaagggccccagcctggcctctttagagggggaagaagataaggggaagagcagctcatcccaggtggtggggccagtgcaggaggaagagtatgtagcagagaagttgccaagtaggttcatcgagtcggctcacacagagctggcaaaggacgatgcggcgccagcacccccagtcgcagacgccaaagcccaggatagaggtgtcgagggagaactgggcaatgaggagagcttggatagaaatgaggaggacttgggggctgaggatggatggaccatggatgcggaagcagatcattcaggaggttctgacaggaacagcatggattccgtggatagctgttgcagtctcaagaagactgagagcttccaaaatgcccaggcaggctccaaccctaagaaggtcgacctcatcatctgggagatcgaggtgccaaagcacttagtcggtcggctaattggcaagcaggggcgcta

SEQ ID NO: 103041 - DNA, 568 bp, Homo sapiens
  Payload ID: 101
  Gene Symbol: AKAP1
  Gene Name: A kinase (PRKA) anchor protein 1
  ENST ID: ENST00000570423
  CDS Start-End: 548-568
actgtcctcgggggcggggggcgagggcgcgacgcccgggtcgcctctctgcacctcaacttaaccggagcgtgcacacccgcctgcgaggctgacccgagcgcgtcccacccaaggtcgcccagccccgcgggcgtttacttttcaaaggtcgtgtgtacacagtctgagccggagctgccccttcacttctggagcctcgcccaacttctcaccctcggctcgcccgccggcgcagcccctgggagttccgtgcggcgagccaggggaactgggaagatgggccgggacatcggccggttgtgatccaaccgtgtttcgggctgagggaccgttcgaaccgaattggggtctggagggagggataggagaagaaaggtgctgatcgtggtaggcggtgctgtggcgactcggaacggcatgggagccctgggcgtttcgggatcttcctctcctgggggatgtcctgggtggcggcgccttcctgccgccgttaacacaaacccggtggacttcgctccaggtgtaattacttcaagcctccaggatggcaatccagttccgttcg

SEQ ID NO: 103042 - DNA, 710 bp, Homo sapiens
  Payload ID: 101
  Gene Symbol: AKAP1
  Gene Name: A kinase (PRKA) anchor protein 1
  ENST ID: ENST00000572156
  CDS Start-End: 163-710
ggactactgtgataccacttaaatgttgagaagttcaggtttacaaaaaaaaacacctcagggcaaagagagcaactccgaagagtctggcccagtgcaggaaggaagatgtcagaagagccttgtaaggctaaaggggtgtaattacttcaagcctccaggatggcaatccagttccgttcgctcttccccttggcattgcctgggatgctggcgctcctcggctggtggtggtttttctctcgtaaaaaaggccatgtcagcagccatgatgagcagcaggtggaggctggtgctgtgcagctgagggctgaccctgccatcaaggaacctctccccgtggaagacgtctgtcccaaagtagtgtccacaccccccagtgtcacagagcctccagaaaaggaactgtccaccgtgagcaagctgcctgcagagcccccagcattgctccagacacacccaccttgccgaagatcagagtcctcgggcattcttcctaacaccacagacatgagattgcgaccaggaacacgcagagatgacagtacaaagctggagctagccctgacaggtggtgaagccaaatcgattcctctagagtgccccctttcatccccaaagggtgtactattctccagcaaatcagctgaggtgtgtaagcaagattcccccttcagcagggtgccaaggaaggtccagccaggctaccc

SEQ ID NO: 103043 - DNA, 650 bp, Homo sapiens
  Payload ID: 101
  Gene Symbol: AKAP1
  Gene Name: A kinase (PRKA) anchor protein 1
  ENST ID: ENST00000575322
  CDS Start-End: 92-650
ctctggcgcagctgggagaggcgcggcggaggcactgccgggagcggccggcggcgcgcacgcgcaggtgtaattacttcaagcctccaggatggcaatccagttccgttcgctcttccccttggcattgcctgggatgctggcgctcctcggctggtggtggtttttctctcgtaaaaaaggccatgtcagcagccatgatgagcagcaggtggaggctggtgctgtgcagctgagggctgaccctgccatcaaggaacctctccccgtggaagacgtctgtcccaaagtagtgtccacaccccccagtgtcacagagcctccagaaaaggaactgtccaccgtgagcaagctgcctgcagagcccccagcattgctccagacacacccaccttgccgaagatcagagtcctcgggcattcttcctaacaccacagacatgagattgcgaccaggaacacgcagagatgacagtacaaagctggagctagccctgacaggtggtgaagccaaatcgattcctctagagtgccccctttcatccccaaagggtgtactattctccagcaaatcagctgaggtgtgtaagcaagattcccccttcagcagggtgccaaggaaggtccagccaggctaccccgtagtccccg

SEQ ID NO: 103044 - DNA, 3098 bp, Homo sapiens
  Payload ID: 101
  Gene Symbol: AKAP1
  Gene Name: A kinase (PRKA) anchor protein 1
  Uniprot ID: Q92667
  ENST ID: ENST00000572557
  CDS Start-End: 141-2852
gaactccatgtacccaggaaggcattcctggcacctgtgttgtgaccatctttagaaacctggcggaattcacttgtaaagcaagatggttgtcaaggccagaggtgaggggcaaggtgtaattacttcaagcctccaggatggcaatccagttccgttcgctcttccccttggcattgcctgggatgctggcgctcctcggctggtggtggtttttctctcgtaaaaaaggccatgtcagcagccatgatgagcagcaggtggaggctggtgctgtgcagctgagggctgaccctgccatcaaggaacctctccccgtggaagacgtctgtcccaaagtagtgtccacaccccccagtgtcacagagcctccagaaaaggaactgtccaccgtgagcaagctgcctgcagagcccccagcattgctccagacacacccaccttgccgaagatcagagtcctcgggcattcttcctaacaccacagacatgagattgcgaccaggaacacgcagagatgacagtacaaagctggagctagccctgacaggtggtgaagccaaatcgattcctctagagtgccccctttcatccccaaagggtgtactattctccagcaaatcagctgaggtgtgtaagcaagattcccccttcagcagggtgccaaggaaggtccagccaggctaccccgtagtccccgcagagaagcgtagctctggggagagggcaagagagacaggtggggccgaagggactggtgatgccgtgttgggggaaaaggtgcttgaagaagctctgttgtctcgggagcatgtcttggaattggagaacagcaagggccccagcctggcctctttagagggggaagaagataaggggaagagcagctcatcccaggtggtggggccagtgcaggaggaagagtatgtagcagagaagttgccaagtaggttcatcgagtcggctcacacagagctggcaaaggacgatgcggcgccagcacccccagtcgcagacgccaaagcccaggatagaggtgtcgagggagaactgggcaatgaggagagcttggatagaaatgaggagggcttggatagaaatgaggagggcttggatagaaatgaggagagcttggatagaaatgaggagggcttggatagaaatgaggagattaagcgggctgccttccagataatctcccaagtgatctcagaagcaaccgaacaggtgctggccaccacggttggcaaggttgcaggtcgtgtgtgtcaggccagtcagctccaagggcagaaggaagagagctgtgtcccagttcaccagaaaactgtcttgggcccagacactgcggagcctgccacagcagaggcagctgttgccccgccggatgctggcctccccttgccaggcctaccagcagagggctcaccaccaccaaagacctacgtgagctgcctgaagagccttctgtccagccccaccaaggacagtaagccaaatatctctgcacaccacatctccctggcctcctgcctggcactgaccacccccagtgaagagttgccggaccgggcaggcatcctggtggaagatgccacctgtgtcacctgcatgtcagacagcagccaaagtgtccctttggtggcttctccaggacactgctcagattctttcagcacttcagggcttgaagactcttgcacagagaccagctcgagccccagggacaaggccatcaccccgccactgccagaaagtactgtgcccttcagcaatggggtgctgaagggggagttgtcagacttgggggctgaggatggatggaccatggatgcggaagcagatcattcaggaggttctgacaggaacagcatggattccgtggatagctgttgcagtctcaagaagactgagagcttccaaaatgcccaggcaggctccaaccctaagaaggtcgacctcatcatctgggagatcgaggtgccaaagcacttagtcggtcggctaattggcaagcaggggcgctatgtgagttttctgaagcaaacatctggtgccaagatctacatttcaaccctgccttacacccagagcgtccagatctgccacatagaaggctctcaacatcatgtagacaaagcgctgaacttgattgggaagaagttcaaagagctgaacctcaccaatatctacgctcccccattgccttcactggcactgccttctctgccgatgacatcctggctcatgctgcctgatggcatcaccgtggaggtcattgtggtcaaccaggtcaatgccgggcacctgttcgtgcagcagcacacacaccctaccttccacgcgctgcgcagcctcgaccagcagatgtacctctgttactctcagcctggaatccccaccttgcccaccccagtggaaataacggtcatctgtgccgcccctggtgcggacggggcctggtggcgagcccaagtggttgcctcctacgaggagaccaacgaagtggagattcgatacgtggactacggcggatataagagggtgaaagtagacgtgctccggcaaatcaggtctgactttgtcaccctgccgtttcagggagcagaagtccttctggacagtgtgatgcccctgtcagacgatgaccagttttcaccggaagcagatgccgccatgagcgagatgacggggaatacagcactgcttgctcaggtgacaagttacagtccaactggtcttcctctgattcagctgtggagtgtggttggagatgaagtggtgttgataaaccggtccctggtggagcgaggccttgcccagtgggtagacagctactacacaagcctttgacccccatgctgcttcctgagagtctttttttgcactgttgaaattgggcttggcactcaagtcaaagatgaacatcggaataacaaacattgtcctctccagaaagtcctttctttctccatactgtagtcctattgagaagacatttcgtctctgagaaaaaaggatggaactatgggttctcttcgcaaagccaaaggatagtgtttaacaagccagctggcttatgctggttctcagctgttt

SEQ ID NO: 103045 - DNA, 3105 bp, Homo sapiens
  Payload ID: 101
  Gene Symbol: AKAP1
  Gene Name: A kinase (PRKA) anchor protein 1
  Uniprot ID: Q92667
  ENST ID: ENST00000571629
  CDS Start-End: 343-3054
gtcactgtcctcgggggcggggggcgagggcgcgacgcccgggtcgcctctctgcacctcaacttaaccggagcgtgcacacccgcctgcgaggctgacccgagcgcgtcccacccaaggtcgcccagccccgcgggcgtttacttttcaaagggagggataggagaagaaaggtgctgatcgtggtaggcggtgctgtggcgactcggaacggcatgggagccctgggcgtttcgggatcttcctctcctgggggatgtcctgggtggcggcgccttcctgccgccgttaacacaaacccggtggacttcgctccaggtgtaattacttcaagcctccaggatggcaatccagttccgttcgctcttccccttggcattgcctgggatgctggcgctcctcggctggtggtggtttttctctcgtaaaaaaggccatgtcagcagccatgatgagcagcaggtggaggctggtgctgtgcagctgagggctgaccctgccatcaaggaacctctccccgtggaagacgtctgtcccaaagtagtgtccacaccccccagtgtcacagagcctccagaaaaggaactgtccaccgtgagcaagctgcctgcagagcccccagcattgctccagacacacccaccttgccgaagatcagagtcctcgggcattcttcctaacaccacagacatgagattgcgaccaggaacacgcagagatgacagtacaaagctggagctagccctgacaggtggtgaagccaaatcgattcctctagagtgccccctttcatccccaaagggtgtactattctccagcaaatcagctgaggtgtgtaagcaagattcccccttcagcagggtgccaaggaaggtccagccaggctaccccgtagtccccgcagagaagcgtagctctggggagagggcaagagagacaggtggggccgaagggactggtgatgccgtgttgggggaaaaggtgcttgaagaagctctgttgtctcgggagcatgtcttggaattggagaacagcaagggccccagcctggcctctttagagggggaagaagataaggggaagagcagctcatcccaggtggtggggccagtgcaggaggaagagtatgtagcagagaagttgccaagtaggttcatcgagtcggctcacacagagctggcaaaggacgatgcggcgccagcacccccagtcgcagacgccaaagcccaggatagaggtgtcgagggagaactgggcaatgaggagagcttggatagaaatgaggagggcttggatagaaatgaggagggcttggatagaaatgaggagagcttggatagaaatgaggagggcttggatagaaatgaggagattaagcgggctgccttccagataatctcccaagtgatctcagaagcaaccgaacaggtgctggccaccacggttggcaaggttgcaggtcgtgtgtgtcaggccagtcagctccaagggcagaaggaagagagctgtgtcccagttcaccagaaaactgtcttgggcccagacactgcggagcctgccacagcagaggcagctgttgccccgccggatgctggcctccccttgccaggcctaccagcagagggctcaccaccaccaaagacctacgtgagctgcctgaagagccttctgtccagccccaccaaggacagtaagccaaatatctctgcacaccacatctccctggcctcctgcctggcactgaccacccccagtgaagagttgccggaccgggcaggcatcctggtggaagatgccacctgtgtcacctgcatgtcagacagcagccaaagtgtccctttggtggcttctccaggacactgctcagattctttcagcacttcagggcttgaagactcttgcacagagaccagctcgagccccagggacaaggccatcaccccgccactgccagaaagtactgtgcccttcagcaatggggtgctgaagggggagttgtcagacttgggggctgaggatggatggaccatggatgcggaagcagatcattcaggaggttctgacaggaacagcatggattccgtggatagctgttgcagtctcaagaagactgagagcttccaaaatgcccaggcaggctccaaccctaagaaggtcgacctcatcatctgggagatcgaggtgccaaagcacttagtcggtcggctaattggcaagcaggggcgctatgtgagttttctgaagcaaacatctggtgccaagatctacatttcaaccctgccttacacccagagcgtccagatctgccacatagaaggctctcaacatcatgtagacaaagcgctgaacttgattgggaagaagttcaaagagctgaacctcaccaatatctacgctcccccattgccttcactggcactgccttctctgccgatgacatcctggctcatgctgcctgatggcatcaccgtggaggtcattgtggtcaaccaggtcaatgccgggcacctgttcgtgcagcagcacacacaccctaccttccacgcgctgcgcagcctcgaccagcagatgtacctctgttactctcagcctggaatccccaccttgcccaccccagtggaaataacggtcatctgtgccgcccctggtgcggacggggcctggtggcgagcccaagtggttgcctcctacgaggagaccaacgaagtggagattcgatacgtggactacggcggatataagagggtgaaagtagacgtgctccggcaaatcaggtctgactttgtcaccctgccgtttcagggagcagaagtccttctggacagtgtgatgcccctgtcagacgatgaccagttttcaccggaagcagatgccgccatgagcgagatgacggggaatacagcactgcttgctcaggtgacaagttacagtccaactggtcttcctctgattcagctgtggagtgtggttggagatgaagtggtgttgataaaccggtccctggtggagcgaggccttgcccagtgggtagacagctactacacaagcctttgacccccatgctgcttcctgagagtctttttttgcactgttgaaattgggctt

SEQ ID NO: 103046 - DNA, 588 bp, Homo sapiens
  Payload ID: 101
  Gene Symbol: AKAP1
  Gene Name: A kinase (PRKA) anchor protein 1
  ENST ID: ENST00000574683
  CDS Start-End: 304-588
agttttggggttacgatgtgctaggagaggcagtggctggatgcctcgaacgcgggctttctggcgttcaactcttttgtgccctagctgaaggtcttcctgtttcccttccagggagggataggagaagaaaggtgctgatcgtggtaggcggtgctgtggcgactcggaacggcatgggagccctgggcgtttcgggatcttcctctcctgggggatgtcctgggtggcggcgccttcctgccgccgttaacacaaacccggtggacttcgctccaggtgtaattacttcaagcctccaggatggcaatccagttccgttcgctcttccccttggcattgcctgggatgctggcgctcctcggctggtggtggtttttctctcgtaaaaaaggccatgtcagcagccatgatgagcagcaggtggaggctggtgctgtgcagctgagggctgaccctgccatcaaggaacctctccccgtggaagacgtctgtcccaaagtagtgtccacaccccccagtgtcacagagcctccagaaaaggaactgtccaccgtgagcaagctgcctgcagagcccccagcattg

SEQ ID NO: 103047 - DNA, 565 bp, Homo sapiens
  Payload ID: 101
  Gene Symbol: AKAP1
  Gene Name: A kinase (PRKA) anchor protein 1
  ENST ID: ENST00000576591
  CDS Start-End: 317-565
aacagtcctgtgagcactgaggctgggctgggaccaacacctgagccatggctccagcactctgattcctggcccagccatgctgctgagggtgcacagcccaggcctaccatcgcccccacccttggtggcagaaccgagcactacccagcaagggctggtgctgccttggccttgggcttttaaaagcttaccagatgatgctaatgtgaagccaagttggagaaccggttgtgaaagaaattaaaaatctctcctcccaaaaggaggaagtaagactctttatctgtaggtgtaattacttcaagcctccaggatggcaatccagttccgttcgctcttccccttggcattgcctgggatgctggcgctcctcggctggtggtggtttttctctcgtaaaaaaggccatgtcagcagccatgatgagcagcaggtggaggctggtgctgtgcagctgagggctgaccctgccatcaaggaacctctccccgtggaagacgtctgtcccaaagtagtgtccacaccccccagtgtcacagagcctccagaaaaggaactgtcc

SEQ ID NO: 103048 - DNA, 484 bp, Homo sapiens
  Payload ID: 101
  Gene Symbol: AKAP1
  Gene Name: A kinase (PRKA) anchor protein 1
  ENST ID: ENST00000573085
  CDS Start-End: 344-484
gtcgcctctctgcacctcaacttaaccggagcgtgcacacccgcctgcgaggctgacccgagcgcgtcccacccaaggtcgcccagccccgcgggcgtttacttttcaaaggtcgtgtgtacacagtctgagccggagctgccccttcacttctggagcctcgcccaacttctcaccctcggctcgcccgccggcgcagcccctgggagttccgtgcggcgagccaggggaactgggaagatgggccgggacatcggccggttgtgatccaaccgtgtttcgggctgagggaccgttcgaaccgaattggggtctggaggtgtaattacttcaagcctccaggatggcaatccagttccgttcgctcttccccttggcattgcctgggatgctggcgctcctcggctggtggtggtttttctctcgtaaaaaaggccatgtcagcagccatgatgagcagcaggtggaggctggtgctgtgcag

SEQ ID NO: 103049 - DNA, 570 bp, Homo sapiens
  Payload ID: 101
  Gene Symbol: AKAP1
  Gene Name: A kinase (PRKA) anchor protein 1
  ENST ID: ENST00000575032
  CDS Start-End: 1-540
gtcattgtggtcaaccaggtcaatgccgggcacctgttcgtgcagcagcacacacaccctaccttccacgcgctgcgcagcctcgaccagcagatgtacctctgttactctcagcctggaatccccaccttgcccaccccagtggaaataacggtcatctgtgccgcccctggtgcggacggggcctggtggcgagcccaagtggttgcctcctacgaggagaccaacgaagtggagattcgatacgtggactacggcggatataagagggtgaaagtagacgtgctccggcaaatcaggtctgactttgtcaccctgccgtttcagggagcagaagtccttctggacagtgtgatgcccctgtcagacgatgaccagttttcaccggaagcagatgccgccatgagcgagatgacggggaatacagcactgcttgctcaggtgacaagttacagtccaactggtcttcctctgattcagctgtggagtgtggttggagatgaaactggcttcagcattgtgcagtttaaaaataagtaagtaacttacataaatcttcaattgtatgaa

SEQ ID NO: 103050 - DNA, 578 bp, Homo sapiens
  Payload ID: 101
  Gene Symbol: AKAP1
  Gene Name: A kinase (PRKA) anchor protein 1
  ENST ID: ENST00000575186
  CDS Start-End: 556-578
actgtcctcgggggcggggggcgagggcgcgacgcccgggtcgcctctctgcacctcaacttaaccggagcgtgcacacccgcctgcgaggctgacccgagcgcgtcccacccaaggtcgcccagccccgcgggcgtttacttttcaaaggtcgtgtgtacacagtctgagccggagctgccccttcacttctggagcctcgcccaacttctcaccctcggctcgcccgccggcgcagcccctgggagttccgtgcggcgagccaggggaactgggaagatgggccgggacatcggccggttgtgatccaaccgtgtttcgggctgagggaccgttcgaaccgaattggggtctggaggcccctgaggatgaaggtaacagtcctgtgagcactgaggctgggctgggaccaacacctgagccatggctccagcactctgattcctggcccagccatgctgctgagggtgcacagcccaggcctaccatcgcccccacccttggtggcagaaccgagcactacccagcaaggtgtaattacttcaagcctccaggatggcaatccagttccgttcgct

SEQ ID NO: 103051 - DNA, 1580 bp, Homo sapiens
  Payload ID: 101
  Gene Symbol: AKAP1
  Gene Name: A kinase (PRKA) anchor protein 1
  ENST ID: ENST00000573326
  CDS Start-End: 1-1083
ctccccttgccaggcctaccagcagagggctcaccaccaccaaagacctacgtgagctgcctgaagagccttctgtccagccccaccaaggacagtaagccaaatatctctgcacaccacatctccctggcctcctgcctggcactgaccacccccagtgaagagttgccggaccgggcaggcatcctggtggaagatgccacctgtgtcacctgcatgtcagacagcagccaaagtgtccctttggtggcttctccaggacactgctcagattctttcagcacttcagggcttgaagactcttgcacagagaccagctcgagccccagggacaaggccatcaccccgccactgccagaaagtactgtgcccttcagcaatggggtgctgaagggggagttgtcagacttgggggctgaggatggatggaccatggatgcggaagcagatcattcaggaggttctgacaggaacagcatggattccgtggatagctgttgcagtctcaagaagactgagagcttccaaaatgcccaggcaggctccaaccctaagaaggtcgacctcatcatctgggagatcgaggtgccaaagcacttagtcggtcggctaattggcaagcaggggcgctatgtgagttttctgaagcaaacatctggtgccaagatctacatttcaaccctgccttacacccagagcgtccagatctgccacatagaaggctctcaacatcatgtagacaaagcgctgaacttgattgggaagaagttcaaagagctgaacctcaccaatatctacgctcccccattgccttcactggcactgccttctctgccgatgacatcctggctcatgctgcctgatggcatcaccgtggaggtcattgtggtcaaccaggtcaatgccgggcacctgttcgtgcagcagcacacacaccctaccttccacgcgctgcgcagcctcgaccagcagatgtacctctgttactctcagcctggaatccccaccttgcccaccccagtggaaagtctgactttgtcaccctgccgtttcagggagcagaagtccttctggacagtgtgatgcccctgtcagacgatgaccagttttcaccggaagcagatgccgccatgagcgagatgacggggaatacagcactgcttgctcaggtgacaagttacagtccaactggtcttcctctgattcagctgtggagtgtggttggagatgaagtggtgttgataaaccggtccctggtggagcgaggccttgcccagtgggtagacagctactacacaagcctttgacccccatgctgcttcctgagagtctttttttgcactgttgaaattgggcttggcactcaagtcaaagatgaacatcggaataacaaacattgtcctctccagaaagtcctttctttctccatactgtagtcctattgagaagacatttcgtctctgagaaaaaaggatggaactatgggttctcttcgcaaagccaaaggatagtgtttaacaagccagctggcttatgctggttctcagctgtttaaaaaaaaaaaaaaaaaggaatagaaa

SEQ ID NO: 103052 - DNA, 4285 bp, Homo sapiens
  Payload ID: 101
  Gene Symbol: AKAP1
  Gene Name: A kinase (PRKA) anchor protein 1
  Uniprot ID: Q92667
  ENST ID: ENST00000621116
  CDS Start-End: 556-3267
actgtcctcgggggcggggggcgagggcgcgacgcccgggtcgcctctctgcacctcaacttaaccggagcgtgcacacccgcctgcgaggctgacccgagcgcgtcccacccaaggtcgcccagccccgcgggcgtttacttttcaaaggtcgtgtgtacacagtctgagccggagctgccccttcacttctggagcctcgcccaacttctcaccctcggctcgcccgccggcgcagcccctgggagttccgtgcggcgagccaggggaactgggaagatgggccgggacatcggccggttgtgatccaaccgtgtttcgggctgagggaccgttcgaaccgaattggggtctggaggcccctgaggatgaaggtaacagtcctgtgagcactgaggctgggctgggaccaacacctgagccatggctccagcactctgattcctggcccagccatgctgctgagggtgcacagcccaggcctaccatcgcccccacccttggtggcagaaccgagcactacccagcaaggtgtaattacttcaagcctccaggatggcaatccagttccgttcgctcttccccttggcattgcctgggatgctggcgctcctcggctggtggtggtttttctctcgtaaaaaaggccatgtcagcagccatgatgagcagcaggtggaggctggtgctgtgcagctgagggctgaccctgccatcaaggaacctctccccgtggaagacgtctgtcccaaagtagtgtccacaccccccagtgtcacagagcctccagaaaaggaactgtccaccgtgagcaagctgcctgcagagcccccagcattgctccagacacacccaccttgccgaagatcagagtcctcgggcattcttcctaacaccacagacatgagattgcgaccaggaacacgcagagatgacagtacaaagctggagctagccctgacaggtggtgaagccaaatcgattcctctagagtgccccctttcatccccaaagggtgtactattctccagcaaatcagctgaggtgtgtaagcaagattcccccttcagcagggtgccaaggaaggtccagccaggctaccccgtagtccccgcagagaagcgtagctctggggagagggcaagagagacaggtggggccgaagggactggtgatgccgtgttgggggaaaaggtgcttgaagaagctctgttgtctcgggagcatgtcttggaattggagaacagcaagggccccagcctggcctctttagagggggaagaagataaggggaagagcagctcatcccaggtggtggggccagtgcaggaggaagagtatgtagcagagaagttgccaagtaggttcatcgagtcggctcacacagagctggcaaaggacgatgcggcgccagcacccccagtcgcagacgccaaagcccaggatagaggtgtcgagggagaactgggcaatgaggagagcttggatagaaatgaggagggcttggatagaaatgaggagggcttggatagaaatgaggagagcttggatagaaatgaggagggcttggatagaaatgaggagattaagcgggctgccttccagataatctcccaagtgatctcagaagcaaccgaacaggtgctggccaccacggttggcaaggttgcaggtcgtgtgtgtcaggccagtcagctccaagggcagaaggaagagagctgtgtcccagttcaccagaaaactgtcttgggcccagacactgcggagcctgccacagcagaggcagctgttgccccgccggatgctggcctccccttgccaggcctaccagcagagggctcaccaccaccaaagacctacgtgagctgcctgaagagccttctgtccagccccaccaaggacagtaagccaaatatctctgcacaccacatctccctggcctcctgcctggcactgaccacccccagtgaagagttgccggaccgggcaggcatcctggtggaagatgccacctgtgtcacctgcatgtcagacagcagccaaagtgtccctttggtggcttctccaggacactgctcagattctttcagcacttcagggcttgaagactcttgcacagagaccagctcgagccccagggacaaggccatcaccccgccactgccagaaagtactgtgcccttcagcaatggggtgctgaagggggagttgtcagacttgggggctgaggatggatggaccatggatgcggaagcagatcattcaggaggttctgacaggaacagcatggattccgtggatagctgttgcagtctcaagaagactgagagcttccaaaatgcccaggcaggctccaaccctaagaaggtcgacctcatcatctgggagatcgaggtgccaaagcacttagtcggtcggctaattggcaagcaggggcgctatgtgagttttctgaagcaaacatctggtgccaagatctacatttcaaccctgccttacacccagagcgtccagatctgccacatagaaggctctcaacatcatgtagacaaagcgctgaacttgattgggaagaagttcaaagagctgaacctcaccaatatctacgctcccccattgccttcactggcactgccttctctgccgatgacatcctggctcatgctgcctgatggcatcaccgtggaggtcattgtggtcaaccaggtcaatgccgggcacctgttcgtgcagcagcacacacaccctaccttccacgcgctgcgcagcctcgaccagcagatgtacctctgttactctcagcctggaatccccaccttgcccaccccagtggaaataacggtcatctgtgccgcccctggtgcggacggggcctggtggcgagcccaagtggttgcctcctacgaggagaccaacgaagtggagattcgatacgtggactacggcggatataagagggtgaaagtagacgtgctccggcaaatcaggtctgactttgtcaccctgccgtttcagggagcagaagtccttctggacagtgtgatgcccctgtcagacgatgaccagttttcaccggaagcagatgccgccatgagcgagatgacggggaatacagcactgcttgctcaggtgacaagttacagtccaactggtcttcctctgattcagctgtggagtgtggttggagatgaagtggtgttgataaaccggtccctggtggagcgaggccttgcccagtgggtagacagctactacacaagcctttgacccccatgctgcttcctgagagtctttttttgcactgttgaaattgggcttggcactcaagtcaaagatgaacatcggaataacaaacattgtcctctccagaaagtcctttctttctccatactgtagtcctattgagaagacatttcgtctctgagaaaaaaggatggaactatgggttctcttcgcaaagccaaaggatagtgtttaacaagccagctggcttatgctggttctcagctgtttaaaaaaaaaaaaaaaaaggaatagaaacagtttcaaccagattgtcctattccccctgttccattcccctcttcttccttctatctccttccccggcaaaaaccaaacaaactggcagacaggccagggatgtatgttgcttgcttgagagggtttcttttacttcaaaatctttcttcagggagcaagacatgaactgactaattggtatccactacttgtacagcttacataaatgagttgatgatatttaaccagtttttataaacttcatttaggtctctaaacacagactttttaaattgcaactgtaaatatgaaatggtcatcacatctgaccttggtcagtggggaggggaactggtatcctgccaagcctggttgtaatttgtaaccattttctatttgtgcaaactctgtaaatatgtgtttaaacaaatgtaatattttgtacaagatacactggagaacaaagggaactcaagattcttccagccacatgtcacctgtaggtagaagtaaactctgcagtgcagcttctgctcttggcccctctggccagggcccctgtggcttcctgcacactggacaggtgactgtatggtagagactgtgatctgggaactttttgctgtacaaatctgtttaaaaaaaaaaaaaagtaactcattgaattaacttgcagtggtgtgtttgattcttttttagactggcttcagcattgtgcagtttaaaaataagtaagtaacttacataaatcttcaattgtatg

SEQ ID NO: 103053 - DNA, 4072 bp, Homo sapiens
  Payload ID: 102
  Gene Symbol: AKAP10
  Gene Name: A kinase (PRKA) anchor protein 10
  Uniprot ID: O43572
  ENST ID: ENST00000225737
  CDS Start-End: 159-2147
aaggaccggaactccgggcgggcggcttgttgataatatggcggctggagctgcctgggcatcccgaggaggcggtggggcccactcccggaagaagggtcccttttcgcgctagtgcagcggcccctctggacccggaagtccgggccggttgctgaatgaggggagccgggccctccccgcgccagtccccccgcaccctccgtcccgacccgggccccgccatgtccttcttccggcggaaagtgaaaggcaaagaacaagagaagacctcagatgtgaagtccattaaagcttcaatatccgtacattccccacaaaaaagcactaaaaatcatgccttgctggaggctgcaggaccaagtcatgttgcaatcaatgccatttctgccaacatggactccttttcaagtagcaggacagccacacttaagaagcagccaagccacatggaggccgctcattttggtgacctgggcagatcttgtctggactaccagactcaagagaccaaatcaagcctttctaagacccttgaacaagtcttgcacgacactattgtcctcccttacttcattcaattcatggaacttcggcgaatggagcatttggtgaaattttggttagaggctgaaagttttcattcaacaacttggtcgcgaataagagcacacagtctaaacacagtgaagcagagctcactggctgagcctgtctctccatctaaaaagcatgaaactacagcgtcttttttaactgattctcttgataagagattggaggattctggctcagcacagttgtttatgactcattcagaaggaattgacctgaataatagaactaacagcactcagaatcacttgctgctttcccaggaatgtgacagtgcccattctctccgtcttgaaatggccagagcaggaactcaccaagtttccatggaaacccaagaatcttcctctacacttacagtagccagtagaaatagtcccgcttctccactaaaagaattgtcaggaaaactaatgaaaagtatagaacaagatgcagtgaatacttttaccaaatatatatctccagatgctgctaaaccaataccaattacagaagcaatgagaaatgacatcatagcaaggatttgtggagaagatggacaggtggatcccaactgtttcgttttggcacagtccatagtctttagtgcaatggagcaagagcactttagtgagtttctgcgaagtcaccatttctgtaaataccagattgaagtgctgaccagtggaactgtttacctggctgacattctcttctgtgagtcagccctcttttatttctctgagtacatggaaaaagaggatgcagtgaatatcttacaattctggttggcagcagataacttccagtctcagcttgctgccaaaaagggccaatatgatggacaggaggcacagaatgatgccatgattttatatgacaagtacttctccctccaagccacacatcctcttggatttgatgatgttgtacgattagaaattgaatccaatatctgcagggaaggtgggccactccccaactgtttcacaactccattacgtcaggcctggacaaccatggagaaggtctttttgcctggctttttgtccagcaatctttattataaatatttgaatgatctcatccattcggttcgaggagatgaatttctgggcgggaacgtgtcgctgactgctcctggctctgttggccctcctgatgagtctcacccagggagttctgacagctctgcgtctcagtccagtgtgaaaaaagccagtattaaaatactgaaaaattttgatgaagcgataattgtggatgcggcaagtctggatccagaatctttatatcaacggacatatgccgggaagatgacatttggaagagtcagtgacttggggcaattcatccgagaatctgagcctgaacctgatgtaaggaaatcaaaaggatccatgttctcacaagctatgaagaaatgggtgcaaggaaatactgatgaggcccaggaagagctagcttggaagattgctaaaatgatagtcagtgacattatgcagcaggctcagtatgatcaaccgttagagaaatctacaaagttatgactcaaaacttgagataaaggaaatctgcttgtgaaaaataagagaacttttttcccttggttggattcttcaacacagccaatgaaaacagcactatatttctgatctgtcactgttgtttccaggagagaatgggagacaatcctagacttccaccataatgcagttacctgtaggcataattgatgcacatgatgttcacacagtgagagtcttaaagatacaaaatggtattgtttacattactagaaaattattagttttccaatggcaataacccatttatgagagtgttttagcctactggaatagacagggaccacatcctctgggaagcagataagcatagaactgatacttgatgcacactcgtagtggtaactcatccctaatcagcattgtaaagcaggtgccagaggtggtttgctttgtccttccaaagcaggtgagtcagccccaccgagagccaggcagctttgagtggcagcgtggtgctagcagcttcagcggaacagggtgagagttaattatgcagtcttcttgacagcggcattaatttggaaggaaactgacaagtcatgggtcaagtttcagtgacttcctccttcctctgatggcagtatatagttttcacattttaattcctcctcctgagatgcactatacttaaaaccattctctcccctgctaacagaagggtgtgaatctggtttactttgagcattaggatttgcccctttggaattctgcactccagttacttaactttcccttcagaatacatgtggaaagaaagaaagaaatagcgatgactccacttttgcccctgtggcaccttgaacaaagcagttcttcccaaattatactttttttttttttaaataaggtgagcaggatgactggggagagagaaacatttgactttgactgcctcccccattctttgctgtgagctggaaagtgtgcagttggtcgtctttcttctcctttctttaggatagtaagagactcactcactgcacttctgctcagttggcttctgcatcgggatcacacagccatcagcaggactgcccagttggtgagcacactccattgaccacgtggcgccagcgcttcctcaatgcacatgattgagaggaaagaaagttctcttagatgttactgcttttgctcagactttgcaaaaaaaaaaatatatatatatatgtataaatatataattattaatcacttttgtccttgagaaagtcttgaatgaacagagaatttattccattgcaatatttgattgtatagaggcacactgtttcatcgacagaagaagcaaaaaggctttgtgtaagtttttggtactatgtaccacctctgttattcttttaaagctgaagtattcatgtacttaaaccatattatatttaattgtgtttgattttaaaatatatatatatgaattctatttaaaattgtgtcaactttctgctttcagggcatttatggctcttctgttgaaatatattgatctttccaaatattttcatttgctttctaaaaacccagaacatgagccactactggactttgccttgtgtttgaagtgtatggcataaacccaaggtttttattagtcatctatgctgtgattaattcattttgttcttttaacaaaatatttccatccacttcacattgcttcaatctttaacagaaaagcaatataaaggttatagaataaaatgtggttttgggcaactcttgctgcctctgcatgttttggaataacaatttctacaagactctaggctgtttaaactagtgctttcagttaagataaattctaatcatttctttgtatatacattttgtgcttctgagctagagatgccaagtagttgtaaactgcttataaagagaatagcagcaaa

SEQ ID NO: 103054 - DNA, 1815 bp, Homo sapiens
  Payload ID: 102
  Gene Symbol: AKAP10
  Gene Name: A kinase (PRKA) anchor protein 10
  ENST ID: ENST00000395536
  CDS Start-End: 1-1815
atgaggggagccgggccctccccgcgccagtccccccgcaccctccgtcccgacccgggccccgccatgtccttcttccggcggaaagtgaaaggcaaagaacaagagaagacctcagatgtgaagtccattaaagcttcaatatccgtacattccccacaaaaaagcactaaaaatcatgccttgctggaggctgcaggaccaagtcatgttgcaatcaatgccatttctgccaacatggactccttttcaagtagcaggacagccacacttaagaagcagccaagccacatggaggccgctcattttggtgacctgggcagatcttgtctggactaccagactcaagagaccaaatcaagcctttctaagacccttgaacaagtcttgcacgacactattgtcctcccttacttcattcaattcatggaacttcggcgaatggagcatttggtgaaattttggttagaggctgaaagttttcattcaacaacttggtcgcgaataagagcacacagtctaaacacagtgaagcagagctcactggctgagcctgtctctccatctaaaaagcatgaaactacagcgtcttttttaactgattctcttgataagagattggaggattctggctcagcacagttgtttatgactcattcagaaggaattgacctgaataatagaactaacagcactcagaatcacttgctgctttcccaggaatgtgacagtgcccattctctccgtcttgaaatggccagagcaggaactcaccaagtttccatggaaacccaagaatcttcctctacacttacagtagccagtagaaatagtcccgcttctccactaaaagaattgtcaggaaaactaatgaaaagtatagaacaagatgcagtgaatacttttaccaaatatatatctccagatgctgctaaaccaataccaattacagaagcaatgagaaatgacatcatagcaaggatttgtggagaagatggacaggtggatcccaactgtttcgttttggcacagtccatagtctttagtgcaatggagcaagagcactttagtgagtttctgcgaagtcaccatttctgtaaataccagattgaagtgctgaccagtggaactgtttacctggctgacattctcttctgtgagtcagccctcttttatttctctgagtacatggaaaaagaggatgcagtgaatatcttacaattctggttggcagcagataacttccagtctcagcttgctgccaaaaagggccaatatgatggacaggaggcacagaatgatgccatgattttatatgacaagtacttctccctccaagccacacatcctcttggatttgatgatgttgtacgattagaaattgaatccaatatctgcagggaaggtgggccactccccaactgtttcacaactccattacgtcaggcctggacaaccatggagaagtccagtgtgaaaaaagccagtattaaaatactgaaaaattttgatgaagcgataattgtggatgcggcaagtctggatccagaatctttatatcaacggacatatgccgggaagatgacatttggaagagtcagtgacttggggcaattcatccgagaatctgagcctgaacctgatgtaaggaaatcaaaaggatccatgttctcacaagctatgaagaaatgggtgcaaggaaatactgatgaggcccaggaagagctagcttggaagattgctaaaatgatagtcagtgacattatgcagcaggctcagtatgatcaaccgttagagaaatctacaaagttatga

SEQ ID NO: 103055 - DNA, 565 bp, Homo sapiens
  Payload ID: 102
  Gene Symbol: AKAP10
  Gene Name: A kinase (PRKA) anchor protein 10
  ENST ID: ENST00000576896
  CDS Start-End: 150-565
aactccgggcgggcggcttgttgataatatggcggctggagctgcctgggcatcccgaggaggcggtggggcccactcccggaagaagggtcccttttcgcgctagtgcagcggcccctctggacccggaagtccgggccggttgctgaatgaggggagccgggccctccccgcgccagtccccccgcaccctccgtcccgacccgggccccgccatgtccttcttccggcggaaagtgaaaggcaaagaacaagagaagacctcagatgtgaagtccattaaagcactaaaaatcatgccttgctggaggctgcaggaccaagtcatgttgcaatcaatgccatttctgccaacatggactccttttcaagtagcaggacagccacacttaagaagcagccaagccacatggaggccgctcattttggtgacctgggcagatcttgtctggactaccagactcaagagaccaaatcaagcctttctaagacccttgaacaagtcttgcacgacactattgtcctcccttacttcattcaattcatggaacttcggcgaatggag

SEQ ID NO: 103056 - DNA, 559 bp, Homo sapiens
  Payload ID: 102
  Gene Symbol: AKAP10
  Gene Name: A kinase (PRKA) anchor protein 10
  ENST ID: ENST00000572341
  CDS Start-End: 150-350
aactccgggcgggcggcttgttgataatatggcggctggagctgcctgggcatcccgaggaggcggtggggcccactcccggaagaagggtcccttttcgcgctagtgcagcggcccctctggacccggaagtccgggccggttgctgaatgaggggagccgggccctccccgcgccagtccccccgcaccctccgtcccgacccgggccccgccatgtccttcttccggcggaaagtgaaaggcaaagaacaagagaagacctcagatgtgaagtccattaaaggctgcaggaccaagtcatgttgcaatcaatgccatttctgccaacatggactccttttcaagtagcaggacagccacacttaagaagcagccaagccacatggaggccgctcattttggtgacctgggcagatcttgtctggactaccagactcaagagaccaaatcaagcctttctaagacccttgaacaagtcttgcacgacactattgtcctcccttacttcattcaattcatggaacttcggcgaatggagcatttggtgaaattttggt

SEQ ID NO: 103057 - DNA, 564 bp, Homo sapiens
  Payload ID: 102
  Gene Symbol: AKAP10
  Gene Name: A kinase (PRKA) anchor protein 10
  ENST ID: ENST00000571858
  CDS Start-End: 150-341
aactccgggcgggcggcttgttgataatatggcggctggagctgcctgggcatcccgaggaggcggtggggcccactcccggaagaagggtcccttttcgcgctagtgcagcggcccctctggacccggaagtccgggccggttgctgaatgaggggagccgggccctccccgcgccagtccccccgcaccctccgtcccgacccgggccccgccatgtccttcttccggcggaaagtgaaaggcaaagaacaagagaagacctcagatgtgaagtccattaaagtagagacagagtttcaccatgttagccagtatggtctcgatctcctgaccttgtgatccgcccgcctcggcctcccaaagtgctgggattacaagcgtgagccaccgcacccggcccttcaatatccgtacattccccacaaaaaagcactaaaaatcatgccttgctggaggctgcaggaccaagtcatgttgcaatcaatgccatttctgccaacatggactccttttcaagtagcaggacagccacacttaagaagcagccaagccacatggaggc

SEQ ID NO: 103058 - DNA, 236 bp, Homo sapiens
  Payload ID: 102
  Gene Symbol: AKAP10
  Gene Name: A kinase (PRKA) anchor protein 10
  ENST ID: ENST00000583951
  CDS Start-End: 1-236
ctggctctgttggccctcctgatgagtctcacccagggagttctgacagctctgcgtctcaggaagatgacatttggaagagtcagtgacttggggcaattcatccgagaatctgagcctgaacctgatgtaaggaaatcaaaaggatccatgttctcacaagctatgaagaaatgggtgcaaggaaatactgatgaggcccaggaagagctagcttggaagattgctaaaatgat

SEQ ID NO: 103059 - DNA, 1319 bp, Homo sapiens
  Payload ID: 102
  Gene Symbol: AKAP10
  Gene Name: A kinase (PRKA) anchor protein 10
  ENST ID: ENST00000582611
  CDS Start-End: 150-602
aactccgggcgggcggcttgttgataatatggcggctggagctgcctgggcatcccgaggaggcggtggggcccactcccggaagaagggtcccttttcgcgctagtgcagcggcccctctggacccggaagtccgggccggttgctgaatgaggggagccgggccctccccgcgccagtccccccgcaccctccgtcccgacccgggccccgccatgtccttcttccggcggaaagtgaaaggcaaagaacaagagaagacctcagatgtgaagtccattaaagcttcaatatccgtacattccccacaaaaaagcactaaaaatcatgccttgctggaggctgcaggaccaagtcatgttgcaatcaatgccatttctgccaacatggactccttttcaagtagcaggacagccacacttaagaagcagccaagccacatggaggccgctcattttggtgacctggatcttgtctggactaccagactcaagagaccaaatcaagcctttctaagacccttgaacaagtcttgcacgacactattgtcctcccttacttcattcaattcatggaacttcggcgaatggagcatttggtgaaattttggttagaggctgaaagttttcattcaacaacttggtcgcgaataagagcacacagtctaaacacagtgaagcagagctcactggctgagcctgtctctccatctaaaaagcatgaaactacagcgtcttttttaactgattctcttgataagagattggaggattctggctcagcacagttgtttatgactcattcagaaggaattgacctgaataatagaactaacagcactcagaatcacttgctgctttcccaggaatgtgacagtgcccattctctccgtcttgaaatggccagagcaggaactcaccaagtttccatggaaacccaagaatcttcctctacacttacagtagccagtagaaatagtcccgcttctccactaaaagaattgtcaggaaaactaatgaaaagtatagaacaagatgcagtgaatacttttaccaaatatatatctccagatgctgctaaaccaataccaattacagaagcaatgagaaatgacatcatagcaaggatttgtggagaagatggacaggtggatcccaactgtttcgttttggcacagtccatagtctttagtgcaatggagcaagagcactttagtgagtttctgcgaagtcaccatttctgtaaataccagattgaagtgctgaccagtggaactgtttacctggctgacattctcttctgtgagtcagccctctttt

SEQ ID NO: 103060 - DNA, 720 bp, Homo sapiens
  Payload ID: 102
  Gene Symbol: AKAP10
  Gene Name: A kinase (PRKA) anchor protein 10
  ENST ID: ENST00000460046
  CDS Start-End: 1-179
ccaaatatatatctccagatgctgctaaaccaataccaattacagaagcaatgagaaatgacatcatagcaaggatttgtggagaagatggacaggtggatcccaactgtttcgttttggcacagtccatagtctttagtgcaatggagcaagatacatggaaaaagaggatgcagtgaatatcttacaattctggttggcagcagataacttccagtctcagcttgctgccaaaaagggccaatatgatggacaggaggcacagaatgatgccatgattttatatgacaagtacttctccctccaagccacacatcctcttggatttgatgatgttgtacgattagaaattgaatccaatatctgcagggaaggtgggccactccccaactgtttcacaactccattacgtcaggcctggacaaccatggagaaggtaacccagaacttcaaacgtatcaaactacaagaagttttattggtagaactcataaaatataaggtgggaaaaccaagcagaatagcacagtggaaattgaagcagtccagcaaagtgattaagagcagaggccttgagtctggcctggtatgtacagtcacgtgccacataacattttagtcaacagtggactgcgtgtacgatggtcctgtacgattataatggatcaaagctggtagtgcaataataacaaaagttagaaaaaataaattttaataagt

SEQ ID NO: 103061 - DNA, 475 bp, Homo sapiens
  Payload ID: 102
  Gene Symbol: AKAP10
  Gene Name: A kinase (PRKA) anchor protein 10
  ENST ID: ENST00000578898
  CDS Start-End: 1-94
gctgactgctcctggctctgttggccctcctgatgagtctcacccagggagttctgacagctctgcgtctcagtgtgaaaaaagccagtattaaaatactgaaaaattttgatgaagcgataattgtggatgcggcaagtctggatccagaatctttatatcaacggacatatgccgggaagatgacatttggaagagtcagtgacttggggcaattcatccgagaatctgagcctgaacctgatgtaaggaaatcaaaaggatccatgttctcacaagctatgaagaaatgggtgcaaggaaatactgatgaggcccaggaagagctagcttggaagattgctaaaatgatagtcagtgacattatgcagcaggctcagtatgatcaaccgttagagaaatctacaaagttatgactcaaaacttgagataaaggaaatctgcttgtgaaaaataagagaacttttttcccttg

SEQ ID NO: 103062 - DNA, 9920 bp, Homo sapiens
  Payload ID: 103
  Gene Symbol: AKAP11
  Gene Name: A kinase (PRKA) anchor protein 11
  Uniprot ID: Q9UKA4
  ENST ID: ENST00000025301
  CDS Start-End: 176-5881
gcttgcttgcccggctcgctcacgggtcgttgaggccggtgacatgtctgtgagctgcggaggctgcggcccccagatctttctctttgacactttgcaataaaaaagggcagtgagattgaataggtgttttgtggattaactcttcattgattatatacaacaaaaaatagttatggcgactttcagaaacaatcacatgaagactaaagcatctgtcagaaaaagcttcagtgaagatgtgttccagtctgtaaagtctttattgcagagtcagaaggaactatgcagtgtaacagcagaggactgtttacagcaggatgagcatgccaatttaactgaggtcacatttctgggttttaatgaagagacagatgctgctcatatacaggatttagctgcagtttctttggaacttccagatattctgaattcactccacttctgcagtctaaatgaaaatgaaattatttgtatgaagaatataaataaaccattagatataagcagtgatcctctaaatcagagtcatccttctggaatgctttgtgtcatgagagtgtcacctacatcaccaagacttaggattgattttatctttagtctcctaagtaaatatgctactggtataaggtacaccttggacacattcttgcatcagaagcaccaacttgagaccactgatgaagatgatgatgatactaaccagtctgtgtcatccatagaggatgactttgtcactgcttttgagcacttagaagaggaagagacttcaaagccatacaatgatggaatgaacattactgtgctaaggagccagtgtgatgctgcttcccagacggttactggtcatcatttagaaacccatgatttaaagattctcattagctctggacagcagaagtcattggctaaaccctcaacttcctcagtgaatgtcctgggacataaagaactaccttctgtgaaaacttcagtcacaacatcaatttcagagccttggacccaaaggagtttctataggtcatctaatgcttcagataaagatagtgatttacagaaaacatttttttcgtcttctcctgcctactcatctgaatcagaatgttcaagtccaagtcctgttattttcttggatgaagagggatatcaaaaaagcttaaaagcaaaacttgagctgcctaaaattcctgtgatgaaagatgatatagaggattcagactcagaagtaagtgaattttttgatagttttgatcagtttgatgaactagaacaaactttagagacttgcctgtttaacaaagatcccgtcatagggaagtcatcgcagaggaaagggcacaaacatggaaagtcatgtatgaatcctcaaaaattcaagtttgatcgtccagctctcccagctaatgttagaaagccaactcctcgtaaaccagaatctccatatggtaacctgtgtgatgctccggattctcctcgcccagtgaaggcatcaagggaagatagtggtttatttagtcctattcgatcctctgcttttagtcctcttggaggctgtactccagctgaatgtttttgccaaacagatattggtggagataggattcatgaaaatcatgattctgtttattacacctatgaagactatgcaaaaagcatttcatgtgaagtactaggctcagttcttcgtacccaccatactaataccctatcaaatattaacagtattaaacatggagaaaataaaactgtaacttttaagcatggaaaccttgatcaaaaaaataaatctaaaaataaatccttaatgattaaagatagcattcaaaaatttgcagcagatcttgtggaaaaaagttttggcagtgcatttaaagacttacagaaaggagtctcttcatgtaccaatgctttgtaccacttagccatcaaattgacatcatctgttttgcagatggcatttgatgagctgagaaggcagcgtgcattttcactaaaagaacgtgccattagtggcctggctaactttttggtgagtgaagctttatcaaatgccttaaaagatttacagtatgtaaagaagcagatattcacaaacacagttgctaggtttgctgcagatcttgctgaagagcttgtttttgaaggcatcatggaggtgtgtcagttttcatatcctcaaacgcctgcatctccacagtgtgggtcgtttgactttgaagacaaagtagtgaagttgtatgcaaaagatttgtctgaatctgtaatacaggaagcattcattgagctatcacaagttgatgtgacctttacaacaaaggcagcagttagtgtctctacggataatatcaagtatgtgagtgcagaaagtgtagtgccatcgacacaggctgtcacgttttccccttcttttcacaatcaagcaattatggtgacaaaaccagtgcaggaatataaaaaggaatacacagtgcagcaggccttgttttgtacttctggaattgttacttctataccggtgcccttggcaggaagtgcccttctcccatatcatatttcatctactgcatgtcaggccaaggctcatctgtcatctgatgatagtaattcaaatggtgattctgcccaagtgcatattgccacaaaaaacagagaagaaaaagcagcttgtctcagaaatatttgtttaccttcagaacacaatccaggtaatcagaatgattttaaaccaactaatgacgatattgaaatgcagagttcctcaaaattaccaaatgatcctgcaattattagcaacttttctgcagcagtggtgcatacgatagtaaatgaaactttagagtcaatgacatcattggaagttacaaaaatggttgatgaacgtacagattatttaactaaatctttaaaggagaaaacccctccattttcccactgtgatcaggcagtgctgcaatgcagtgaagctagtagcaataaggacatgtttgctgaccggttatctaaatctattattaaacattccatagataagagcaaatcagtgatcccaaatatagataaaaatgcagtatacaaggaaagcttgcctgtttctggagaagaatcacagttgacaccagaaaagtctcccaaatttcctgactctcagaatcagttaactcactgctcactttcagctgcaaaggattgtgttccagaatgtaaagtttctatggttcatggatcctccctagagacactgccatcttgtccagctgtgacaggtcagaaatctgacttgaaggaatctgctaaggatcaaccactgaaaaagcataacttgaatagtacatcacttgaggccttgtcttttggacaggaaaacccctttcctcattcacatactttctcatctacagcacttacctgtgtagatggtttgcatgtggaagataaacagaaagtcagagacagaaatgtaatacctgatactcctccatcaactcctctagtaccatcccgggctagttctgaatgggatatcaagaagttaactaaaaagctcaagggagaattagccaaagagtttgcacctgctacaccaccttctactccacacaactcatctgttggtagtttgtctgagaatgaacaaaatactatagaaaaagaagagttcatgttgaaactcatgcgatctctttctgaagaagttgagagtagtgaaagtggagagctcccagaagtggatgtgaagtcggagcactcagggaagaaggttcagtttgcagaagcattagctacacacatcctttctcttgcaactgaaatggcagcttcccatttagataacaaaataattcaagaacccaaggttaaaaacccttgcttaaatgtgcaaagtcaaagaagtgtgtcgcctacttttttaaacccctcagacgaaaatttgaaaacattatgcaattttgcgggtgatctggcagcagaagtcattacagaagctgagaaaatagcaaaagtccgaaattgtatgcttttcaagcaaaagaagaacagttgttatgctgatggtgacgaagattataaagtagaagagaagttggatatagaggctgtagtgcacccaagagaagtggatccgtttattctttcattaccaccaagttcttgtatgtcaggtctgatgtataagtatcccagctgtgaaagtgtgacagatgaatatgcaggtcaccttattcagatactaaaacaggaaggtggtaatagtgagttgataatggatcagtatgccaataggcttgcctaccgatctgttaaatcaggattacaggaagcagctaagacaaccaaagtgcagtgcaactcaagaatgttccctgtgccaagttcacaagtgaaaacaaacaaggaactgttaatgttttcaaacaaagagcaccaccaagaagcagacaaaaagagacaaagtaaaagaaatgaaggttacttttgtaaaaatcaaacttgtgaaaggaccctggatccatatagaaatgaggtctcccaactgtatagtttttcaacctctctggttcacagcataacaaaagatgctaaggaagagttgacagcctctctagttggcctaccaaaatccttaacagattcttgcttgtttgaaaaatctggatatgaagaagataatgagtgtcacgttacaccagaattgcctaagtctcttcagccttcctcacaaaatcacaggttttaccacagcactggcagtttaaatggatatggttgtggagacaatgttgttcaagctgtagaacagtatgccaaaaaagtagtggatgacactctagagctaactctaggatctacagtgttccgagtgtctgagaccacaaaatcagcagacagggtcacttatgcagaaaagttgtcacctcttacaggtcaagcttgcagatactgtgaccttaaagaactccacaattgcactggaaattcatctcagcactttttcagacagggttctctcgccagtagtaagccagcttctaatccaaaatttagcagccgctatcagaaatctaggatttttcatctcagtgtccctcagattcatgttaatcttgataagaaggcagtgcttgctgagaagatagttgctgaagccattgaaaaagctgagcgagagctgagcagtaccagcctggcagccgacagtgggatcggacaggagggtgccagctttgctgaaagccttgccacagaaaccatgacagcagctgtcacaaatgttgggcatgctgttagcagttcaaaagaaatagaagactttcagtcaaccgagtctgtcagtagccagcagatgaacctcagtattggtgatgacagcactggtagctggtccaatttaagttttgaagatgaacaccaagatgaaagcagcagttttcatcatctaagtgaaagtaatggtaacagcagtagctggagcagtcttggtttagaaggagatttgtatgaggacaatttatcctttccaacatcagacagtgatggaccagatgataaagatgaagagcatgaggacgaagtagaaggtttggggcaagatggaaagacactgctaattacgaatattgacatggagccatgcacggtagacccccagctaaggattattcttcagtggctcattgcctctgaggctgaagttgcagaactttattttcatgactctgcaaataaggagtttatgctactttcaaaacaattacaagagaaaggatggaaagtgggagacctcctgcaggctgtgcttcaatactatgaagtgatggaaaaagcttccagtgaggagagatgcaagtcgctgtttgattggctcttggaaaatgcatagagcaaaccccaaaccagtatattttagtatttgtttggggaggggaacaagccaataaagatgtttaggataaaatttgaatagtgaatattaacatcgtaagtcagttgggaggcaagtaaatatagctttctgagcgctttgtgttatcactcggtgtatatagttcatacttttgtaatctgtcaaaatactaccttcatttattcttctatacacatgtgtagtgtgtcaagaccctaagaacatgtatttgaaggaaggtctaaccagggggttttcaggggcattgtctgaccacattctttttgtatccaaatagtgctgctagaaactgcactgaagtggctgaggataggttccagtgatagagttataattttgctcctttgcaaacaaatggtatctaattaataactagtctgacatcagaaaataaaattgaggctgatttttaaaaatttctagtagatttttggcctttcctgtttttaaaaatcagtttcattttcatatttcatagatcagctattggtagctttttgatttccccaaactatttaatttcttagcagaaacattagtattttaggtttctataaacactataagtgatagtttcccccatcctttcattgacattatttgccaatgctgccagtcattctggcatgaaaggtgtgtgtgtgtgtgtgtgtgtgtgtgtgtgtgtgtgtgtgtgtaagggagtactttaaccttgccagtttgttccctcttttattttactgttttctttttagaaacccactgttaaaatttaaaaaggtgctttaaaataaaacgcctataaagattgtgcagtaagaatttttattgacaataattaaaattttttttgacaattttgggttcccaacttatcttacaagtgaaaacttaaattgtaaaacatgttgaaattttaaaaattaatgttaatatggaaatgcatttagagaagcccagtagtttttattgttggatttttgaaaaaacctctaccaagaatgtggtgttttttttgtttgtttgtttgtttgttttagaaaaattgggatttccccccaccccgccccacccagataaactatatctacactgtctcgtcaagttctctgacacgatctttctgggctctacatttcctactagtttgtgtccagaaactgcaagttgacatgaatagaggacaaaggttgtgtcttgcttttgtctctctcttccctccctgcaactctctctcccctcctcccactctcttccccctcccccctcctcccactgtctctcacctcccccaccccccactctctctcatctctcgctgtgtcctgtgtatgtgtgggtgtgtgtgtatttgggtgtgtaaatgttggttcttccactactggattttgtaatctaggataaatcactttttttggggactttgattttgctccattacgttttcattttttctgagcactgactgttctgaaagctgcacaaaacgtagaaagaagacatagcgcctgccagggaataggaaatgagggcacttacacattaatgtgaattagtaattgtggtatagaaatgttttatagtgaaagattcaaatttgcttttcaagaaaaatgccaaaagctatttaaataattcgaggttacatcgtaggttttgatttttctcaatttaagatacagaaatacagcaagccttaatataaagtttcctaaagtttcttcaagtattttttaaggtggagaaatgcaggaattgtataaccagaattgttcctgcctttagcttttcagaacttgagatgtggcagcactggactgggtttttttaaatgttaggactaggaatgtttgctcttgttaattatgaattaattgattattaagtttagaatgcatttttacaagtatctaactatcaaattgtgtttagtaacttgagtgtatgcacaagtttgatcaacagcaaaatagagttctgaatttcttttaaagtgatgatatattattttgtgaaactttgtgtttgaaaatgtttatttctgtttatggtgtaatcattctgaggtgaggcttttcttatttcctttgcattttgctagagctgtgctgagttcagcatttgcttatttaaccactacataatgacagaccagttattaggtattagcatgtgtggtaataataatagtggaacttcacacttacatcaattcagtgcaggggcatagaataaaatattaaatattggcagatgtatgaaaagaagtgtgagttaaaaatattgaatattggcaggtgtgaaaacaagtgtcaaaattcctcatatagagaaaataattttgagtttagagtattatcttttaattaagtgtagtctaaacttaactttctgtaaaggcactttgtggtttttccaaagatgttctagatctatttggttgctctatagtcaaacagctcttttgaagacaactgtcttattttattacaaattggcttgacatatttatactgtaacattgtaatattgctgtgctgtacattttggcccttacgaaatacgtctttttcagaactgttaaagttttgatgtacatcgagctgaattctgtttttaccagtttcaaaaccttcaagtgatatgtggaaaaaagtgaatgagacctctgatagggggttttcagaaccttgttcacaccaaaatgtgacagttctttcatgttttcctaaaccaagttaaaattacatgtatattttggtgttaaggttgatttttaagatacttctgatttgtacaaaaggaatgtttcctttataaatcacagaagaaaatgacaatatctgttggatatttgatataatttaatggtgttataaaacctttaagaggattcatggtgaatatatgtgataacatctttatactttgaaaaatgttccacttacccttcagatatttgttgtaagttaattcaattcttaatactttaattttgctccaacaagggctttatgttgctggtaagagaatttatttactaaatgcactatgtataaagtgaaagatagtttacttatctgactttgatattagatggctgacattagtgcacataatgcagagtttaaccttgattcttcaacagagtccagatttaaatgtctacttagttaattagttagctgatattcttccacaattaatatattcaatttcccatcagtatatcactttaaattttatgtttttctaaggaaactttccacagaattttaaacaactgatgcatccatactcagggtgtagggagaatactttgcatttaaaaaccctgtccacctgtcaccagcacaagagaattagagcttcagtgagaatttagaaaaattatactaaagtgagatgcattttttctcattttcagcaagactcctctaagcatttactcatttactgtattcctgctctgaagatgtggatacagaattagtcactcttgtcactttatttatttattggtttttttttaaccatctgtgtacattcctttcatagggtagagttctagttctagaagttcttattttgtttttgttgtaatgtttgaatactatttaatatccggttttaatattgctggatttgctacctttggttacttgtgcagtgttaaaagtaatccactttcttgtttaatataccagatacatagcaaaagcagcttggaataattatagctgtttatttggctgtgctcagttactatattaagatcttgtactgtgtaacagtaactcttttttgcttttcagtaatttaatatgttcacttaacaaaatacgaactttgagatgcactaaagttttgtttcagcagtggctcaaaaaatttcagaaattacttttgtaattatttgcaattaattgttcttttatcttacaattgtttaagcctgtgatctttcttctcccagctaagagttcttcaataaatttaagaaatacctggt

SEQ ID NO: 103063 - DNA, 6597 bp, Homo sapiens
  Payload ID: 104
  Gene Symbol: AKAP12
  Gene Name: A kinase (PRKA) anchor protein 12
  Uniprot ID: Q02952
  ENST ID: ENST00000253332
  CDS Start-End: 190-5538
ttcttttaaggagtttgccgcgagcgcgtctccttcattcgcaggctgggcgcgttcgcagtcggctggcggcgaaggaaggcgctctcgggacctcgcgggcgcgcgtcttttggctcttgcccctgtccctgcggcttggggaaggcgtaacccggcggctaggcgcgggagaagtgcggaggagccatgggcgccgggagctccaccgagcagcgcagcccggagcagccgcccgaggggagctccacgccggctgagcccgagcccagcggcggcggcccctcggccgaggcggcgccagacaccaccgcggaccccgccatcgctgcctcggaccccgccaccaagctcctacagaagaatggtcagctgtccaccatcaatggcgtagctgagcaagatgagctcagcctccaggagggtgacctaaatggccagaaaggagccctgaacggtcaaggagccctaaacagccaggaggaagaagaagtcattgtcacagaggttggacagagagactctgaagatgtgagcaaaagagactccgataaagagatggctactaagtcagcggttgttcacgacatcacagatgatgggcaggaggagacacccgaaataatcgaacagattccttcttcagaaagcaatttagaagagctaacacaacccactgagtcccaggctaatgatattggatttaagaaggtgtttaagtttgttggctttaaattcactgtgaaaaaggataagacagagaagcctgacactgtccagctactcactgtgaagaaagatgaaggggagggagcagcaggggctggcgaccacaaggaccccagccttggggctggagaagcagcatccaaagaaagcgaacccaaacaatctacagagaaacccgaagagaccctgaagcgtgagcaaagccacgcagaaatttctcccccagccgaatctggccaagcagtggaggaatgcaaagaggaaggagaagagaaacaagaaaaagaacctagcaagtctgcagaatctccgactagtcccgtgaccagtgaaacaggatcaaccttcaaaaaattcttcactcaaggttgggccggctggcgcaaaaagaccagtttcaggaagccgaaggaggatgaagtggaagcttcagagaagaaaaaggaacaagagccagaaaaagtagacacagaagaagacggaaaggcagaggttgcctccgagaaactgaccgcctccgagcaagcccacccacaggagccggcagaaagtgcccacgagccccggttatcagctgaatatgagaaagttgagctgccctcagaggagcaagtcagtggctcgcagggaccttctgaagagaaacctgctccgttggcgacagaagtgtttgatgagaaaatagaagtccaccaagaagaggttgtggccgaagtccacgtcagcaccgtggaggagagaaccgaagagcagaaaacggaggtggaagaaacagcagggtctgtgccagctgaagaattggttgaaatggatgcagaacctcaggaagctgaacctgccaaggagctggtgaagctcaaagaaacgtgtgtttccggagaggaccctacacagggagctgacctcagtcctgatgagaaggtgctgtccaaaccccccgaaggcgttgtgagtgaggtggaaatgctgtcatcacaggagagaatgaaggtgcagggaagtccactaaagaagctttttaccagcactggcttaaaaaagctttctggaaagaaacagaaagggaaaagaggaggaggagacgaggaatcaggggagcacactcaggttccagccgattctccggacagccaggaggagcaaaagggcgagagctctgcctcatcccctgaggagcccgaggagatcacgtgtctggaaaagggcttagccgaggtgcagcaggatggggaagctgaagaaggagctacttccgatggagagaaaaaaagagaaggtgtcactccctgggcatcattcaaaaagatggtgacgcccaagaagcgtgttagacggccttcggaaagtgataaagaagatgagctggacaaggtcaagagcgctaccttgtcttccaccgagagcacagcctctgaaatgcaagaagaaatgaaagggagcgtggaagagccaaagccggaagaaccaaagcgcaaggtggatacctcagtatcttgggaagctttaatttgtgtgggatcatccaagaaaagagcaaggagagggtcctcttctgatgaggaagggggaccaaaagcaatgggaggagaccaccagaaagctgatgaggccggaaaagacaaagagacggggacagacgggatccttgctggttcccaagaacatgatccagggcagggaagttcctccccggagcaagctggaagccctaccgaaggggagggcgtttccacctgggagtcatttaaaaggttagtcacgccaagaaaaaaatcaaagtccaagctggaagagaaaagcgaagactccatagctgggtctggtgtagaacattccactccagacactgaacccggtaaagaagaatcctgggtctcaatcaagaagtttattcctggacgaaggaagaaaaggccagatgggaaacaagaacaagcccctgttgaagacgcagggccaacaggggccaacgaagatgactctgatgtcccggccgtggtccctctgtctgagtatgatgctgtagaaagggagaaaatggaggcacagcaagcccaaaaaagcgcagagcagcccgagcagaaggcagccactgaggtgtccaaggagctcagcgagagtcaggttcatatgatggcagcagctgtcgctgacgggacgagggcagctaccattattgaagaaaggtctccttcttggatatctgcttcagtgacagaacctcttgaacaagtagaagctgaagccgcactgttaactgaggaggtattggaaagagaagtaattgcagaagaagaaccccccacggttactgaacctctgccagagaacagagaggcccggggcgacacggtcgttagtgaggcggaattgacccccgaagctgtgacagctgcagaaactgcagggccattgggtgccgaagaaggaaccgaagcatctgctgctgaagagaccacagaaatggtgtcagcagtctcccagttaaccgactccccagacaccacagaggaggccactccggtgcaggaggtggaaggtggcgtacctgacatagaagagcaagagaggcggactcaagaggtcctccaggcagtggcagaaaaagtgaaagaggaatcccagctgcctggcaccggtgggccagaagatgtgcttcagcctgtgcagagagcagaggcagaaagaccagaagagcaggctgaagcgtcgggtctgaagaaagagacggatgtagtgttgaaagtagatgctcaggaggcaaaaactgagccttttacacaagggaaggtggtggggcagaccaccccagaaagctttgaaaaagctcctcaagtcacagagagcatagagtccagtgagcttgtaaccacttgtcaagccgaaaccttagctggggtaaaatcacaggagatggtgatggaacaggctatcccccctgactcggtggaaacccctacagacagtgagactgatggaagcacccccgtagccgactttgacgcaccaggcacaacccagaaagacgagattgtggaaatccatgaggagaatgaggtcgcatctggtacccagtcagggggcacagaagcagaggcagttcctgcacagaaagagaggcctccagcaccttccagttttgtgttccaggaagaaactaaagaacaatcaaagatggaagacactctagagcatacagataaagaggtgtcagtggaaactgtatccattctgtcaaagactgaggggactcaagaggctgaccagtatgctgatgagaaaaccaaagacgtaccatttttcgaaggacttgaggggtctatagacacaggcataacagtcagtcgggaaaaggtcactgaagttgcccttaaaggtgaagggacagaagaagctgaatgtaaaaaggatgatgctcttgaactgcagagtcacgctaagtctcctccatcccccgtggagagagagatggtagttcaagtcgaaagggagaaaacagaagcagagccaacccatgtgaatgaagagaagcttgagcacgaaacagctgttaccgtatctgaagaggtcagtaagcagctcctccagacagtgaatgtgcccatcatagatggggcaaaggaagtcagcagtttggaaggaagccctcctccctgcctaggtcaagaggaggcagtatgcaccaaaattcaagttcagagctctgaggcatcattcactctaacagcggctgcagaggaggaaaaggtcttaggagaaactgccaacattttagaaacaggtgaaacgttggagcctgcaggtgcacatttagttctggaagagaaatcctctgaaaaaaatgaagactttgccgctcatccaggggaagatgctgtgcccacagggcccgactgtcaggcaaaatcgacaccagtgatagtatctgctactaccaagaaaggcttaagttccgacctggaaggagagaaaaccacatcactgaagtggaagtcagatgaagtcgatgagcaggttgcttgccaggaggtcaaagtgagtgtagcaattgaggatttagagcctgaaaatgggattttggaacttgagaccaaaagcagtaaacttgtccaaaacatcatccagacagccgttgaccagtttgtacgtacagaagaaacagccaccgaaatgttgacgtctgagttacagacacaagctcacgtgataaaagctgacagccaggacgctggacaggaaacggagaaagaaggagaggaacctcaggcctctgcacaggatgaaacaccaattacttcagccaaagaggagtcagagtcaaccgcagtgggacaagcacattctgatatttccaaagacatgagtgaagcctcagaaaagaccatgactgttgaggtagaaggttccactgtaaatgatcagcagctggaagaggtcgtcctcccatctgaggaagagggaggtggagctggaacaaagtctgtgccagaagatgatggtcatgccttgttagcagaaagaatagagaagtcactagttgaaccgaaagaagatgaaaaaggtgatgatgttgatgaccctgaaaaccagaactcagccctggctgatactgatgcctcaggaggcttaaccaaagagtccccagatacaaatggaccaaaacaaaaagagaaggaggatgcccaggaagtagaattgcaggaaggaaaagtgcacagtgaatcagataaagcgatcacaccccaagcacaggaggagttacagaaacaagagagagaatctgcaaagtcagaacttacagaatcttaaaacatcatgcagttaaactcattgtctgtttggaagaccagaatgtgaagacaagtagtagaagaaaatgaatgctgctgctgagactgaagaccagtatttcagaactttgagaattggagagcaggcacatcaactgatctcatttctagagagcccctgacaatcctgaggcttcatcaggagctagagccatttaacatttcctctttccaagaccaacctacaattttcccttgataaccatataaattctgatttaaggtcctaaattcttaacctggaactggagttggcaatacctagttctgcttctgaaactggagtatcattctttacatatttatatgtatgttttaagtagtcctcctgtatctattgtatatttttttcttaatgtttaaggaaatgtgcaggatactacatgctttttgtatcacacagtatatgatggggcatgtgccatagtgcaggcttggggagctttaagcctcagttatataacccacgaaaaacagagcctcctagatgtaacattcctgatcaaggtacaattctttaaaattcactaatgattgaggtccatatttagtggtactctgaaattggtcactttcctattacacggagtgtgctaaaactaaaaagcattttgaaacatacagaatgttctattgtcattgggaaatttttctttctaacccagtggaggttagaaagaagttatattctggtagcaaattaactttacatcctttttcctacttgttatggttgtttggaccgataagtgtgcttaatcctgaggcaaagtagtgaatatgttttatatgttatgaagaaaagaattgttgtaagtttttgattctactcttatatgctggactgcattcacacatggcatgaaataagtcaggttctttacaaatggtattttgatagatactggattgtgtttgtgccatatttgtgccattcttttaagaacaatgttgcaacacattcatttggataagttgtgatttgacgactgatttaaataaaatatttgcttcactt

SEQ ID NO: 103064 - DNA, 6287 bp, Homo sapiens
  Payload ID: 104
  Gene Symbol: AKAP12
  Gene Name: A kinase (PRKA) anchor protein 12
  Uniprot ID: Q02952
  ENST ID: ENST00000354675
  CDS Start-End: 174-5228
ggcagctccgagggcacctccggttctcccccatcctccgggagtgtctgggcgctcagtccgctctgatcccgccgaaaccacctgcggttggcaggcaggagactaggcgtctgccggggagggcagggacccgctaagctgatctcctgtacagtagtgctacttaaaatatgctggggaccatcaccatcacagttggacagagagactctgaagatgtgagcaaaagagactccgataaagagatggctactaagtcagcggttgttcacgacatcacagatgatgggcaggaggagacacccgaaataatcgaacagattccttcttcagaaagcaatttagaagagctaacacaacccactgagtcccaggctaatgatattggatttaagaaggtgtttaagtttgttggctttaaattcactgtgaaaaaggataagacagagaagcctgacactgtccagctactcactgtgaagaaagatgaaggggagggagcagcaggggctggcgaccacaaggaccccagccttggggctggagaagcagcatccaaagaaagcgaacccaaacaatctacagagaaacccgaagagaccctgaagcgtgagcaaagccacgcagaaatttctcccccagccgaatctggccaagcagtggaggaatgcaaagaggaaggagaagagaaacaagaaaaagaacctagcaagtctgcagaatctccgactagtcccgtgaccagtgaaacaggatcaaccttcaaaaaattcttcactcaaggttgggccggctggcgcaaaaagaccagtttcaggaagccgaaggaggatgaagtggaagcttcagagaagaaaaaggaacaagagccagaaaaagtagacacagaagaagacggaaaggcagaggttgcctccgagaaactgaccgcctccgagcaagcccacccacaggagccggcagaaagtgcccacgagccccggttatcagctgaatatgagaaagttgagctgccctcagaggagcaagtcagtggctcgcagggaccttctgaagagaaacctgctccgttggcgacagaagtgtttgatgagaaaatagaagtccaccaagaagaggttgtggccgaagtccacgtcagcaccgtggaggagagaaccgaagagcagaaaacggaggtggaagaaacagcagggtctgtgccagctgaagaattggttgaaatggatgcagaacctcaggaagctgaacctgccaaggagctggtgaagctcaaagaaacgtgtgtttccggagaggaccctacacagggagctgacctcagtcctgatgagaaggtgctgtccaaaccccccgaaggcgttgtgagtgaggtggaaatgctgtcatcacaggagagaatgaaggtgcagggaagtccactaaagaagctttttaccagcactggcttaaaaaagctttctggaaagaaacagaaagggaaaagaggaggaggagacgaggaatcaggggagcacactcaggttccagccgattctccggacagccaggaggagcaaaagggcgagagctctgcctcatcccctgaggagcccgaggagatcacgtgtctggaaaagggcttagccgaggtgcagcaggatggggaagctgaagaaggagctacttccgatggagagaaaaaaagagaaggtgtcactccctgggcatcattcaaaaagatggtgacgcccaagaagcgtgttagacggccttcggaaagtgataaagaagatgagctggacaaggtcaagagcgctaccttgtcttccaccgagagcacagcctctgaaatgcaagaagaaatgaaagggagcgtggaagagccaaagccggaagaaccaaagcgcaaggtggatacctcagtatcttgggaagctttaatttgtgtgggatcatccaagaaaagagcaaggagagggtcctcttctgatgaggaagggggaccaaaagcaatgggaggagaccaccagaaagctgatgaggccggaaaagacaaagagacggggacagacgggatccttgctggttcccaagaacatgatccagggcagggaagttcctccccggagcaagctggaagccctaccgaaggggagggcgtttccacctgggagtcatttaaaaggttagtcacgccaagaaaaaaatcaaagtccaagctggaagagaaaagcgaagactccatagctgggtctggtgtagaacattccactccagacactgaacccggtaaagaagaatcctgggtctcaatcaagaagtttattcctggacgaaggaagaaaaggccagatgggaaacaagaacaagcccctgttgaagacgcagggccaacaggggccaacgaagatgactctgatgtcccggccgtggtccctctgtctgagtatgatgctgtagaaagggagaaaatggaggcacagcaagcccaaaaaagcgcagagcagcccgagcagaaggcagccactgaggtgtccaaggagctcagcgagagtcaggttcatatgatggcagcagctgtcgctgacgggacgagggcagctaccattattgaagaaaggtctccttcttggatatctgcttcagtgacagaacctcttgaacaagtagaagctgaagccgcactgttaactgaggaggtattggaaagagaagtaattgcagaagaagaaccccccacggttactgaacctctgccagagaacagagaggcccggggcgacacggtcgttagtgaggcggaattgacccccgaagctgtgacagctgcagaaactgcagggccattgggtgccgaagaaggaaccgaagcatctgctgctgaagagaccacagaaatggtgtcagcagtctcccagttaaccgactccccagacaccacagaggaggccactccggtgcaggaggtggaaggtggcgtacctgacatagaagagcaagagaggcggactcaagaggtcctccaggcagtggcagaaaaagtgaaagaggaatcccagctgcctggcaccggtgggccagaagatgtgcttcagcctgtgcagagagcagaggcagaaagaccagaagagcaggctgaagcgtcgggtctgaagaaagagacggatgtagtgttgaaagtagatgctcaggaggcaaaaactgagccttttacacaagggaaggtggtggggcagaccaccccagaaagctttgaaaaagctcctcaagtcacagagagcatagagtccagtgagcttgtaaccacttgtcaagccgaaaccttagctggggtaaaatcacaggagatggtgatggaacaggctatcccccctgactcggtggaaacccctacagacagtgagactgatggaagcacccccgtagccgactttgacgcaccaggcacaacccagaaagacgagattgtggaaatccatgaggagaatgaggtcgcatctggtacccagtcagggggcacagaagcagaggcagttcctgcacagaaagagaggcctccagcaccttccagttttgtgttccaggaagaaactaaagaacaatcaaagatggaagacactctagagcatacagataaagaggtgtcagtggaaactgtatccattctgtcaaagactgaggggactcaagaggctgaccagtatgctgatgagaaaaccaaagacgtaccatttttcgaaggacttgaggggtctatagacacaggcataacagtcagtcgggaaaaggtcactgaagttgcccttaaaggtgaagggacagaagaagctgaatgtaaaaaggatgatgctcttgaactgcagagtcacgctaagtctcctccatcccccgtggagagagagatggtagttcaagtcgaaagggagaaaacagaagcagagccaacccatgtgaatgaagagaagcttgagcacgaaacagctgttaccgtatctgaagaggtcagtaagcagctcctccagacagtgaatgtgcccatcatagatggggcaaaggaagtcagcagtttggaaggaagccctcctccctgcctaggtcaagaggaggcagtatgcaccaaaattcaagttcagagctctgaggcatcattcactctaacagcggctgcagaggaggaaaaggtcttaggagaaactgccaacattttagaaacaggtgaaacgttggagcctgcaggtgcacatttagttctggaagagaaatcctctgaaaaaaatgaagactttgccgctcatccaggggaagatgctgtgcccacagggcccgactgtcaggcaaaatcgacaccagtgatagtatctgctactaccaagaaaggcttaagttccgacctggaaggagagaaaaccacatcactgaagtggaagtcagatgaagtcgatgagcaggttgcttgccaggaggtcaaagtgagtgtagcaattgaggatttagagcctgaaaatgggattttggaacttgagaccaaaagcagtaaacttgtccaaaacatcatccagacagccgttgaccagtttgtacgtacagaagaaacagccaccgaaatgttgacgtctgagttacagacacaagctcacgtgataaaagctgacagccaggacgctggacaggaaacggagaaagaaggagaggaacctcaggcctctgcacaggatgaaacaccaattacttcagccaaagaggagtcagagtcaaccgcagtgggacaagcacattctgatatttccaaagacatgagtgaagcctcagaaaagaccatgactgttgaggtagaaggttccactgtaaatgatcagcagctggaagaggtcgtcctcccatctgaggaagagggaggtggagctggaacaaagtctgtgccagaagatgatggtcatgccttgttagcagaaagaatagagaagtcactagttgaaccgaaagaagatgaaaaaggtgatgatgttgatgaccctgaaaaccagaactcagccctggctgatactgatgcctcaggaggcttaaccaaagagtccccagatacaaatggaccaaaacaaaaagagaaggaggatgcccaggaagtagaattgcaggaaggaaaagtgcacagtgaatcagataaagcgatcacaccccaagcacaggaggagttacagaaacaagagagagaatctgcaaagtcagaacttacagaatcttaaaacatcatgcagttaaactcattgtctgtttggaagaccagaatgtgaagacaagtagtagaagaaaatgaatgctgctgctgagactgaagaccagtatttcagaactttgagaattggagagcaggcacatcaactgatctcatttctagagagcccctgacaatcctgaggcttcatcaggagctagagccatttaacatttcctctttccaagaccaacctacaattttcccttgataaccatataaattctgatttaaggtcctaaattcttaacctggaactggagttggcaatacctagttctgcttctgaaactggagtatcattctttacatatttatatgtatgttttaagtagtcctcctgtatctattgtatatttttttcttaatgtttaaggaaatgtgcaggatactacatgctttttgtatcacacagtatatgatggggcatgtgccatagtgcaggcttggggagctttaagcctcagttatataacccacgaaaaacagagcctcctagatgtaacattcctgatcaaggtacaattctttaaaattcactaatgattgaggtccatatttagtggtactctgaaattggtcactttcctattacacggagtgtgctaaaactaaaaagcattttgaaacatacagaatgttctattgtcattgggaaatttttctttctaacccagtggaggttagaaagaagttatattctggtagcaaattaactttacatcctttttcctacttgttatggttgtttggaccgataagtgtgcttaatcctgaggcaaagtagtgaatatgttttatatgttatgaagaaaagaattgttgtaagtttttgattctactcttatatgctggactgcattcacacatggcatgaaataagtcaggttctttacaaatggtattttgatagatactggattgtgtttgtgccatatttgtgccattcttttaagaacaatgttgcaacacattcatttggataagttgtgatttgacgactgatttaaataaaatatttgcttcactt

SEQ ID NO: 103065 - DNA, 6190 bp, Homo sapiens
  Payload ID: 104
  Gene Symbol: AKAP12
  Gene Name: A kinase (PRKA) anchor protein 12
  Uniprot ID: Q02952
  ENST ID: ENST00000359755
  CDS Start-End: 98-5131
agtgagtagcacgtgcacccaagcggcagttcgccccgcagcgatggcggacacggaatcccgagggccaccaactgtcccttaggaccggcccgagatggttggacagagagactctgaagatgtgagcaaaagagactccgataaagagatggctactaagtcagcggttgttcacgacatcacagatgatgggcaggaggagacacccgaaataatcgaacagattccttcttcagaaagcaatttagaagagctaacacaacccactgagtcccaggctaatgatattggatttaagaaggtgtttaagtttgttggctttaaattcactgtgaaaaaggataagacagagaagcctgacactgtccagctactcactgtgaagaaagatgaaggggagggagcagcaggggctggcgaccacaaggaccccagccttggggctggagaagcagcatccaaagaaagcgaacccaaacaatctacagagaaacccgaagagaccctgaagcgtgagcaaagccacgcagaaatttctcccccagccgaatctggccaagcagtggaggaatgcaaagaggaaggagaagagaaacaagaaaaagaacctagcaagtctgcagaatctccgactagtcccgtgaccagtgaaacaggatcaaccttcaaaaaattcttcactcaaggttgggccggctggcgcaaaaagaccagtttcaggaagccgaaggaggatgaagtggaagcttcagagaagaaaaaggaacaagagccagaaaaagtagacacagaagaagacggaaaggcagaggttgcctccgagaaactgaccgcctccgagcaagcccacccacaggagccggcagaaagtgcccacgagccccggttatcagctgaatatgagaaagttgagctgccctcagaggagcaagtcagtggctcgcagggaccttctgaagagaaacctgctccgttggcgacagaagtgtttgatgagaaaatagaagtccaccaagaagaggttgtggccgaagtccacgtcagcaccgtggaggagagaaccgaagagcagaaaacggaggtggaagaaacagcagggtctgtgccagctgaagaattggttgaaatggatgcagaacctcaggaagctgaacctgccaaggagctggtgaagctcaaagaaacgtgtgtttccggagaggaccctacacagggagctgacctcagtcctgatgagaaggtgctgtccaaaccccccgaaggcgttgtgagtgaggtggaaatgctgtcatcacaggagagaatgaaggtgcagggaagtccactaaagaagctttttaccagcactggcttaaaaaagctttctggaaagaaacagaaagggaaaagaggaggaggagacgaggaatcaggggagcacactcaggttccagccgattctccggacagccaggaggagcaaaagggcgagagctctgcctcatcccctgaggagcccgaggagatcacgtgtctggaaaagggcttagccgaggtgcagcaggatggggaagctgaagaaggagctacttccgatggagagaaaaaaagagaaggtgtcactccctgggcatcattcaaaaagatggtgacgcccaagaagcgtgttagacggccttcggaaagtgataaagaagatgagctggacaaggtcaagagcgctaccttgtcttccaccgagagcacagcctctgaaatgcaagaagaaatgaaagggagcgtggaagagccaaagccggaagaaccaaagcgcaaggtggatacctcagtatcttgggaagctttaatttgtgtgggatcatccaagaaaagagcaaggagagggtcctcttctgatgaggaagggggaccaaaagcaatgggaggagaccaccagaaagctgatgaggccggaaaagacaaagagacggggacagacgggatccttgctggttcccaagaacatgatccagggcagggaagttcctccccggagcaagctggaagccctaccgaaggggagggcgtttccacctgggagtcatttaaaaggttagtcacgccaagaaaaaaatcaaagtccaagctggaagagaaaagcgaagactccatagctgggtctggtgtagaacattccactccagacactgaacccggtaaagaagaatcctgggtctcaatcaagaagtttattcctggacgaaggaagaaaaggccagatgggaaacaagaacaagcccctgttgaagacgcagggccaacaggggccaacgaagatgactctgatgtcccggccgtggtccctctgtctgagtatgatgctgtagaaagggagaaaatggaggcacagcaagcccaaaaaagcgcagagcagcccgagcagaaggcagccactgaggtgtccaaggagctcagcgagagtcaggttcatatgatggcagcagctgtcgctgacgggacgagggcagctaccattattgaagaaaggtctccttcttggatatctgcttcagtgacagaacctcttgaacaagtagaagctgaagccgcactgttaactgaggaggtattggaaagagaagtaattgcagaagaagaaccccccacggttactgaacctctgccagagaacagagaggcccggggcgacacggtcgttagtgaggcggaattgacccccgaagctgtgacagctgcagaaactgcagggccattgggtgccgaagaaggaaccgaagcatctgctgctgaagagaccacagaaatggtgtcagcagtctcccagttaaccgactccccagacaccacagaggaggccactccggtgcaggaggtggaaggtggcgtacctgacatagaagagcaagagaggcggactcaagaggtcctccaggcagtggcagaaaaagtgaaagaggaatcccagctgcctggcaccggtgggccagaagatgtgcttcagcctgtgcagagagcagaggcagaaagaccagaagagcaggctgaagcgtcgggtctgaagaaagagacggatgtagtgttgaaagtagatgctcaggaggcaaaaactgagccttttacacaagggaaggtggtggggcagaccaccccagaaagctttgaaaaagctcctcaagtcacagagagcatagagtccagtgagcttgtaaccacttgtcaagccgaaaccttagctggggtaaaatcacaggagatggtgatggaacaggctatcccccctgactcggtggaaacccctacagacagtgagactgatggaagcacccccgtagccgactttgacgcaccaggcacaacccagaaagacgagattgtggaaatccatgaggagaatgaggtcgcatctggtacccagtcagggggcacagaagcagaggcagttcctgcacagaaagagaggcctccagcaccttccagttttgtgttccaggaagaaactaaagaacaatcaaagatggaagacactctagagcatacagataaagaggtgtcagtggaaactgtatccattctgtcaaagactgaggggactcaagaggctgaccagtatgctgatgagaaaaccaaagacgtaccatttttcgaaggacttgaggggtctatagacacaggcataacagtcagtcgggaaaaggtcactgaagttgcccttaaaggtgaagggacagaagaagctgaatgtaaaaaggatgatgctcttgaactgcagagtcacgctaagtctcctccatcccccgtggagagagagatggtagttcaagtcgaaagggagaaaacagaagcagagccaacccatgtgaatgaagagaagcttgagcacgaaacagctgttaccgtatctgaagaggtcagtaagcagctcctccagacagtgaatgtgcccatcatagatggggcaaaggaagtcagcagtttggaaggaagccctcctccctgcctaggtcaagaggaggcagtatgcaccaaaattcaagttcagagctctgaggcatcattcactctaacagcggctgcagaggaggaaaaggtcttaggagaaactgccaacattttagaaacaggtgaaacgttggagcctgcaggtgcacatttagttctggaagagaaatcctctgaaaaaaatgaagactttgccgctcatccaggggaagatgctgtgcccacagggcccgactgtcaggcaaaatcgacaccagtgatagtatctgctactaccaagaaaggcttaagttccgacctggaaggagagaaaaccacatcactgaagtggaagtcagatgaagtcgatgagcaggttgcttgccaggaggtcaaagtgagtgtagcaattgaggatttagagcctgaaaatgggattttggaacttgagaccaaaagcagtaaacttgtccaaaacatcatccagacagccgttgaccagtttgtacgtacagaagaaacagccaccgaaatgttgacgtctgagttacagacacaagctcacgtgataaaagctgacagccaggacgctggacaggaaacggagaaagaaggagaggaacctcaggcctctgcacaggatgaaacaccaattacttcagccaaagaggagtcagagtcaaccgcagtgggacaagcacattctgatatttccaaagacatgagtgaagcctcagaaaagaccatgactgttgaggtagaaggttccactgtaaatgatcagcagctggaagaggtcgtcctcccatctgaggaagagggaggtggagctggaacaaagtctgtgccagaagatgatggtcatgccttgttagcagaaagaatagagaagtcactagttgaaccgaaagaagatgaaaaaggtgatgatgttgatgaccctgaaaaccagaactcagccctggctgatactgatgcctcaggaggcttaaccaaagagtccccagatacaaatggaccaaaacaaaaagagaaggaggatgcccaggaagtagaattgcaggaaggaaaagtgcacagtgaatcagataaagcgatcacaccccaagcacaggaggagttacagaaacaagagagagaatctgcaaagtcagaacttacagaatcttaaaacatcatgcagttaaactcattgtctgtttggaagaccagaatgtgaagacaagtagtagaagaaaatgaatgctgctgctgagactgaagaccagtatttcagaactttgagaattggagagcaggcacatcaactgatctcatttctagagagcccctgacaatcctgaggcttcatcaggagctagagccatttaacatttcctctttccaagaccaacctacaattttcccttgataaccatataaattctgatttaaggtcctaaattcttaacctggaactggagttggcaatacctagttctgcttctgaaactggagtatcattctttacatatttatatgtatgttttaagtagtcctcctgtatctattgtatatttttttcttaatgtttaaggaaatgtgcaggatactacatgctttttgtatcacacagtatatgatggggcatgtgccatagtgcaggcttggggagctttaagcctcagttatataacccacgaaaaacagagcctcctagatgtaacattcctgatcaaggtacaattctttaaaattcactaatgattgaggtccatatttagtggtactctgaaattggtcactttcctattacacggagtgtgctaaaactaaaaagcattttgaaacatacagaatgttctattgtcattgggaaatttttctttctaacccagtggaggttagaaagaagttatattctggtagcaaattaactttacatcctttttcctacttgttatggttgtttggaccgataagtgtgcttaatcctgaggcaaagtagtgaatatgttttatatgttatgaagaaaagaattgttgtaagtttttgattctactcttatatgctggactgcattcacacatggcatgaaataagtcaggttctttacaaatggtattttgatagatactggattgtgtttgtgccatatttgtgccattcttttaagaacaatgttgcaacacattcatttggataagttgtgatttgacgactgatttaaataaaatatttgcttcactt

SEQ ID NO: 103066 - DNA, 8432 bp, Homo sapiens
  Payload ID: 104
  Gene Symbol: AKAP12
  Gene Name: A kinase (PRKA) anchor protein 12
  Uniprot ID: Q02952
  ENST ID: ENST00000402676
  CDS Start-End: 241-5589
gggactcggactcgctcctgggcgagctgaaagtcggctgcagcagaagctcctgccttgggagtttgccgcgagcgcgtctccttcattcgcaggctgggcgcgttcgcagtcggctggcggcgaaggaaggcgctctcgggacctcgcgggcgcgcgtcttttggctcttgcccctgtccctgcggcttggggaaggcgtaacccggcggctaggcgcgggagaagtgcggaggagccatgggcgccgggagctccaccgagcagcgcagcccggagcagccgcccgaggggagctccacgccggctgagcccgagcccagcggcggcggcccctcggccgaggcggcgccagacaccaccgcggaccccgccatcgctgcctcggaccccgccaccaagctcctacagaagaatggtcagctgtccaccatcaatggcgtagctgagcaagatgagctcagcctccaggagggtgacctaaatggccagaaaggagccctgaacggtcaaggagccctaaacagccaggaggaagaagaagtcattgtcacagaggttggacagagagactctgaagatgtgagcaaaagagactccgataaagagatggctactaagtcagcggttgttcacgacatcacagatgatgggcaggaggagacacccgaaataatcgaacagattccttcttcagaaagcaatttagaagagctaacacaacccactgagtcccaggctaatgatattggatttaagaaggtgtttaagtttgttggctttaaattcactgtgaaaaaggataagacagagaagcctgacactgtccagctactcactgtgaagaaagatgaaggggagggagcagcaggggctggcgaccacaaggaccccagccttggggctggagaagcagcatccaaagaaagcgaacccaaacaatctacagagaaacccgaagagaccctgaagcgtgagcaaagccacgcagaaatttctcccccagccgaatctggccaagcagtggaggaatgcaaagaggaaggagaagagaaacaagaaaaagaacctagcaagtctgcagaatctccgactagtcccgtgaccagtgaaacaggatcaaccttcaaaaaattcttcactcaaggttgggccggctggcgcaaaaagaccagtttcaggaagccgaaggaggatgaagtggaagcttcagagaagaaaaaggaacaagagccagaaaaagtagacacagaagaagacggaaaggcagaggttgcctccgagaaactgaccgcctccgagcaagcccacccacaggagccggcagaaagtgcccacgagccccggttatcagctgaatatgagaaagttgagctgccctcagaggagcaagtcagtggctcgcagggaccttctgaagagaaacctgctccgttggcgacagaagtgtttgatgagaaaatagaagtccaccaagaagaggttgtggccgaagtccacgtcagcaccgtggaggagagaaccgaagagcagaaaacggaggtggaagaaacagcagggtctgtgccagctgaagaattggttgaaatggatgcagaacctcaggaagctgaacctgccaaggagctggtgaagctcaaagaaacgtgtgtttccggagaggaccctacacagggagctgacctcagtcctgatgagaaggtgctgtccaaaccccccgaaggcgttgtgagtgaggtggaaatgctgtcatcacaggagagaatgaaggtgcagggaagtccactaaagaagctttttaccagcactggcttaaaaaagctttctggaaagaaacagaaagggaaaagaggaggaggagacgaggaatcaggggagcacactcaggttccagccgattctccggacagccaggaggagcaaaagggcgagagctctgcctcatcccctgaggagcccgaggagatcacgtgtctggaaaagggcttagccgaggtgcagcaggatggggaagctgaagaaggagctacttccgatggagagaaaaaaagagaaggtgtcactccctgggcatcattcaaaaagatggtgacgcccaagaagcgtgttagacggccttcggaaagtgataaagaagatgagctggacaaggtcaagagcgctaccttgtcttccaccgagagcacagcctctgaaatgcaagaagaaatgaaagggagcgtggaagagccaaagccggaagaaccaaagcgcaaggtggatacctcagtatcttgggaagctttaatttgtgtgggatcatccaagaaaagagcaaggagagggtcctcttctgatgaggaagggggaccaaaagcaatgggaggagaccaccagaaagctgatgaggccggaaaagacaaagagacggggacagacgggatccttgctggttcccaagaacatgatccagggcagggaagttcctccccggagcaagctggaagccctaccgaaggggagggcgtttccacctgggagtcatttaaaaggttagtcacgccaagaaaaaaatcaaagtccaagctggaagagaaaagcgaagactccatagctgggtctggtgtagaacattccactccagacactgaacccggtaaagaagaatcctgggtctcaatcaagaagtttattcctggacgaaggaagaaaaggccagatgggaaacaagaacaagcccctgttgaagacgcagggccaacaggggccaacgaagatgactctgatgtcccggccgtggtccctctgtctgagtatgatgctgtagaaagggagaaaatggaggcacagcaagcccaaaaaagcgcagagcagcccgagcagaaggcagccactgaggtgtccaaggagctcagcgagagtcaggttcatatgatggcagcagctgtcgctgacgggacgagggcagctaccattattgaagaaaggtctccttcttggatatctgcttcagtgacagaacctcttgaacaagtagaagctgaagccgcactgttaactgaggaggtattggaaagagaagtaattgcagaagaagaaccccccacggttactgaacctctgccagagaacagagaggcccggggcgacacggtcgttagtgaggcggaattgacccccgaagctgtgacagctgcagaaactgcagggccattgggtgccgaagaaggaaccgaagcatctgctgctgaagagaccacagaaatggtgtcagcagtctcccagttaaccgactccccagacaccacagaggaggccactccggtgcaggaggtggaaggtggcgtacctgacatagaagagcaagagaggcggactcaagaggtcctccaggcagtggcagaaaaagtgaaagaggaatcccagctgcctggcaccggtgggccagaagatgtgcttcagcctgtgcagagagcagaggcagaaagaccagaagagcaggctgaagcgtcgggtctgaagaaagagacggatgtagtgttgaaagtagatgctcaggaggcaaaaactgagccttttacacaagggaaggtggtggggcagaccaccccagaaagctttgaaaaagctcctcaagtcacagagagcatagagtccagtgagcttgtaaccacttgtcaagccgaaaccttagctggggtaaaatcacaggagatggtgatggaacaggctatcccccctgactcggtggaaacccctacagacagtgagactgatggaagcacccccgtagccgactttgacgcaccaggcacaacccagaaagacgagattgtggaaatccatgaggagaatgaggtcgcatctggtacccagtcagggggcacagaagcagaggcagttcctgcacagaaagagaggcctccagcaccttccagttttgtgttccaggaagaaactaaagaacaatcaaagatggaagacactctagagcatacagataaagaggtgtcagtggaaactgtatccattctgtcaaagactgaggggactcaagaggctgaccagtatgctgatgagaaaaccaaagacgtaccatttttcgaaggacttgaggggtctatagacacaggcataacagtcagtcgggaaaaggtcactgaagttgcccttaaaggtgaagggacagaagaagctgaatgtaaaaaggatgatgctcttgaactgcagagtcacgctaagtctcctccatcccccgtggagagagagatggtagttcaagtcgaaagggagaaaacagaagcagagccaacccatgtgaatgaagagaagcttgagcacgaaacagctgttaccgtatctgaagaggtcagtaagcagctcctccagacagtgaatgtgcccatcatagatggggcaaaggaagtcagcagtttggaaggaagccctcctccctgcctaggtcaagaggaggcagtatgcaccaaaattcaagttcagagctctgaggcatcattcactctaacagcggctgcagaggaggaaaaggtcttaggagaaactgccaacattttagaaacaggtgaaacgttggagcctgcaggtgcacatttagttctggaagagaaatcctctgaaaaaaatgaagactttgccgctcatccaggggaagatgctgtgcccacagggcccgactgtcaggcaaaatcgacaccagtgatagtatctgctactaccaagaaaggcttaagttccgacctggaaggagagaaaaccacatcactgaagtggaagtcagatgaagtcgatgagcaggttgcttgccaggaggtcaaagtgagtgtagcaattgaggatttagagcctgaaaatgggattttggaacttgagaccaaaagcagtaaacttgtccaaaacatcatccagacagccgttgaccagtttgtacgtacagaagaaacagccaccgaaatgttgacgtctgagttacagacacaagctcacgtgataaaagctgacagccaggacgctggacaggaaacggagaaagaaggagaggaacctcaggcctctgcacaggatgaaacaccaattacttcagccaaagaggagtcagagtcaaccgcagtgggacaagcacattctgatatttccaaagacatgagtgaagcctcagaaaagaccatgactgttgaggtagaaggttccactgtaaatgatcagcagctggaagaggtcgtcctcccatctgaggaagagggaggtggagctggaacaaagtctgtgccagaagatgatggtcatgccttgttagcagaaagaatagagaagtcactagttgaaccgaaagaagatgaaaaaggtgatgatgttgatgaccctgaaaaccagaactcagccctggctgatactgatgcctcaggaggcttaaccaaagagtccccagatacaaatggaccaaaacaaaaagagaaggaggatgcccaggaagtagaattgcaggaaggaaaagtgcacagtgaatcagataaagcgatcacaccccaagcacaggaggagttacagaaacaagagagagaatctgcaaagtcagaacttacagaatcttaaaacatcatgcagttaaactcattgtctgtttggaagaccagaatgtgaagacaagtagtagaagaaaatgaatgctgctgctgagactgaagaccagtatttcagaactttgagaattggagagcaggcacatcaactgatctcatttctagagagcccctgacaatcctgaggcttcatcaggagctagagccatttaacatttcctctttccaagaccaacctacaattttcccttgataaccatataaattctgatttaaggtcctaaattcttaacctggaactggagttggcaatacctagttctgcttctgaaactggagtatcattctttacatatttatatgtatgttttaagtagtcctcctgtatctattgtatatttttttcttaatgtttaaggaaatgtgcaggatactacatgctttttgtatcacacagtatatgatggggcatgtgccatagtgcaggcttggggagctttaagcctcagttatataacccacgaaaaacagagcctcctagatgtaacattcctgatcaaggtacaattctttaaaattcactaatgattgaggtccatatttagtggtactctgaaattggtcactttcctattacacggagtgtgctaaaactaaaaagcattttgaaacatacagaatgttctattgtcattgggaaatttttctttctaacccagtggaggttagaaagaagttatattctggtagcaaattaactttacatcctttttcctacttgttatggttgtttggaccgataagtgtgcttaatcctgaggcaaagtagtgaatatgttttatatgttatgaagaaaagaattgttgtaagtttttgattctactcttatatgctggactgcattcacacatggcatgaaataagtcaggttctttacaaatggtattttgatagatactggattgtgtttgtgccatatttgtgccattcttttaagaacaatgttgcaacacattcatttggataagttgtgatttgacgactgatttaaataaaatatttgcttcacttagatttgctggttttattagataccaggaagcctgggacatatgtgtaccacattagaattctaaagataatgattgataagctagaactttctgatgtagtcattacatgaaaccccttgtcactggtttgtgtgttcagaggaagccatggccgagatagctttcctgaaataaaccagtagcttttcagattgacgttcttgctacaattgtaccatctggtaattcctgaaaatgtcaatttttttgtgttaatatttttggtttcaaacaataacaaatgtctctagaaagaaattttaagaaagcttaattaatagtaaaaatgcctttcctgaaataatcttggaaaattttttaaatgtcaaaatgatgagtcatgctaatacattgagggtttgtttttttgtttgtttgtttgtttgtttttgagacagagtttcgctcttgttgcccaggctggagtgcaatggcacgatctcagctcaccgcaacctccacctcccggattccagcgattctcctgcctcagcctacattaagggttttgtcagacaattgtcacacgaagaatagtgtcacttatctactcttgacacacagaactggcctggcatatagctttccagattttactcaaacttggtactccagtttgaaaatttaaattttgactgctgattagctggaaagcctagttttaatggaaagaaagtttgcttttaaaactgaaagtagtttctttttgctaacaaatctaacttcatacataattggccatattagtaaaacacctcatgatagcagtgtatatatagtcttgtttgtagttggaagtcatcttttaggagttattctcaaatatatataatagctacccatgcatcattattaaaatccccaaattcaaaaaacctctgatatatatatataatttttttttttttttttttttggccaactgagattgaaatccaagtgctggtttctagttctgaacatcaactaaagagttttggaaatgacagcaatttataacaagttcatattgacttcctctctatggcaggaagacattctgtgctgttttgaacagattaaagatttgtgtagtttgtgggaaattgacgtttttgtttaaattccacccgcgtttgtcttttcctaccacctgtggccaggtgctcgctggccatcacagttgcgattccatgagtagctgctttatgactgctttttgtactatctggatgtgcccagagttacttctgtacaagctctgtatctatgtccgttgagaacattattttaacaagaagaacaccaacagtagcatgaaatataatactgttttataattctaaagctgctgttaatttatgaagtacataataatctaatgtaaactgcagaagtcagagcaagtgcctacattttgttatttttggcattactacagagccatgtacaatagaaagcaatgcaagacttgtaaactctcaccacttcttgtaatatcaaatgttccccctcaggttattttgcttatggtacccatgagttgcctctctctgtacatagataaattgttccaatattttcctttgatgtttggaactacagatagtcaagggctggaaattttagttttcaatataagcttccagcttagcaattacctctagtcgaagacaatatttgattcctagttctgtttggggcaaattttcatttatctaaataaaatgcaatctaattaaatgccatggattttctttctgt

SEQ ID NO: 103067 - DNA, 9468 bp, Homo sapiens
  Payload ID: 105
  Gene Symbol: AKAP13
  Gene Name: A kinase (PRKA) anchor protein 13
  Uniprot ID: Q12802
  ENST ID: ENST00000361243
  CDS Start-End: 82-8535
tgtctttctccgcggcgaaggtgaagagttgtcccagctcggcccgcgggggagccccgggagccgcacgtgtcctgggtcatgaaacttaatccacagcaagctcccttatatggtgattgtgttgttacagtgctgcttgctgaagaggacaaagctgaagatgatgtagtgttttacttggtatttttgggttccaccctccgtcactgtacaagtactcggaaggtcagttctgatacattggagaccattgctcctggtcatgattgttgtgaaacagtgaaggtgcagctctgtgcttccaaagagggccttcccgtgtttgtggtggctgaagaagactttcatttcgtccaggatgaagcgtatgatgcagctcaattcctagcaaccagtgctggaaatcagcaggctttgaactttacccgttttcttgaccagtcaggacccccatctggggatgtgaattcccttgataagaagttggtgctggcattcaggcacctgaagctgcccacggagtggaatgtattggggacagatcagagtttgcatgatgctggcccgcgagagacattgatgcattttgctgtgcggctgggactgctgaggttgacgtggttcctgttgcagaagccaggtggccgcggagctctcagtatccacaaccaggaaggggcgacgcctgtgagcttggccttggagcgaggctatcacaagctgcaccagcttctaaccgaggagaatgctggagaaccagactcctggagcagtttatcctatgaaataccgtatggagactgttctgtgaggcatcatcgagagttggacatctatacattaacctctgagtctgattcacatcatgaacacccatttcctggagacggttgcactggaccaatttttaaacttatgaacatccaacagcaactaatgaaaacaaacctcaagcagatggacagtcttatgcccttaatgatgacagcacaggatccttccagtgccccagagacagatggccagtttcttccctgtgcaccggagcccacggaccctcagcgactttcttcttctgaagagactgagagcactcagtgctgcccagggagccctgttgcacagactgaaagtccctgtgatttgtcaagcatagttgaggaggagaatacagaccgttcctgtaggaagaaaaataaaggcgtggaaagaaaaggggaagaggtggagccagcacctattgtggactctggaactgtatctgatcaagacagctgccttcagagcttgcctgattgtggagtaaagggcacggaaggcctttcgtcctgtggaaacagaaatgaagaaactggaacaaaatcttctggaatgcccacagaccaggagtccctgagcagtggagatgctgtgcttcagagagacttggtcatggagccaggcacagcccagtattcctctggaggtgaactgggaggcatttcaacaacaaatgtcagtaccccagacactgcaggggaaatggaacatgggctcatgaacccagatgccactgtttggaagaatgtgcttcagggaggggaaagtacaaaggaaagatttgagaactctaatattggcacagctggagcctctgacgtgcacgtcacaagtaagcctgtggataaaatcagtgttccaaactgtgcccctgctgccagttccctggatggtaacaaacctgctgagtcttcacttgcatttagtaatgaagaaacctccactgaaaaaacagcagaaacggaaacttcacgaagtcgtgaggagagtgctgatgctccagtagatcagaattctgtggtgattccagctgctgcaaaagacaagatttcagatggattagaaccttatactctcttagcagcaggcataggtgaggcaatgtcaccctcagatttagcccttcttgggctggaagaagatgtaatgccacaccagaactcagaaacaaattcatctcatgctcaaagccaaaagggcaaatcctcacccatttgttctacaactggagacgataaactttgtgcagactctgcatgtcaacagaacacagtgacttctagtggcgatttggttgcaaaactgtgtgataacatagttagcgagtccgaaagcaccacagcaaggcaacccagctcacaagatccacccgatgcctcccactgtgaagacccacaggctcatacagtcacctctgaccctgtaagggatacccaggaacgtgcggatttttgtcctttcaaagtggtggataacaaaggccaacgaaaagatgtgaaactagataaacctttaacaaatatgcttgaggtggtttcacatccacatccagttgtccctaaaatggagaaagaactggtgccagaccaggcagtaatatcagacagtactttctctctggcaaacagtccaggcagtgaatcagtaaccaaggatgacgcactttcttttgtcccctcccagaaagaaaagggaacagcaactcctgaactacatacagctacagattatagagatggcccagatggaaattcgaatgagcctgatacgcggccactagaagacagggcagtaggcctgtccacatcctccactgctgcagagcttcagcacgggatggggaataccagtctcacaggacttggtggagagcatgagggtcccgcccctccagcaatcccagaagctctgaatatcaaggggaacactgactcttccctgcaaagtgtgggtaaggccactttggctttagattcagttttgactgaagaaggaaaacttctggtggtttcagaaagctctgcagctcaggaacaagataaggataaagcggtgacctgttcctctattaaggaaaatgctctctcttcaggaactttgcaggaagagcagagaacaccacctcctggacaagatactcaacaatttcatgaaaaatcaatctcagctgactgtgccaaggacaaagcacttcagctaagtaattcaccgggtgcatcctctgcctttcttaaggcagaaactgaacataacaaggaagtggccccacaagtctcactgctgactcaaggtggggctgcccagagcctggtgccaccaggagcaagtctggccacagagtcaaggcaggaagccttgggggcagagcacaacagctccgctctgttgccatgtctgttgccagatgggtctgatgggtccgatgctcttaactgcagtcagccttctcctctggatgttggagtgaagaacactcaatcccagggaaaaactagtgcctgtgaggtgagtggagatgtgacggtggatgttacaggggttaatgctctacaaggtatggctgagcccagaagagagaatatatcacacaacacccaagacatcctgattccaaacgtcttgttgagccaagagaagaatgccgttctaggtttgccagtggctctacaggacaaagctgtgactgacccacagggagttggaaccccagagatgatacctcttgattgggagaaagggaagctggagggagcagaccacagctgtaccatgggtgacgctgaggaagcccaaatagacgatgaagcacatcctgtcctactgcagcctgttgccaaggagctccccacagacatggagctctcagcccatgatgatggggccccagctggtgtgagggaagtcatgcgagccccgccttcaggcagggaaaggagcactccctctctaccttgcatggtctctgcccaggacgcacctctgcctaagggggcagacttgatagaggaggctgccagccgtatagtggatgctgtcatcgaacaagtcaaggccgctggagcactgcttactgagggggaggcctgtcacatgtcactgtccagccctgagttgggtcctctcactaaaggactagagagtgcttttacagaaaaagtgagtactttcccacctggggagagcctaccaatgggcagtactcctgaggaagccacggggagccttgcaggatgttttgctggaagggaggagccagagaagatcattttacctgtccaggggcctgagccagcagcagaaatgccagacgtgaaagctgaagatgaagtggattttagagcaagttcaatttctgaagaagtggctgtagggagcatagctgctacactgaagatgaagcaaggcccaatgacccaggcgataaaccgagaaaactggtgtacaatagagccatgccctgatgcagcatctcttctggcttccaagcagagcccagaatgtgagaacttcctggatgttggactgggcagagagtgtacctcaaaacaaggtgtacttaaaagagaatctgggagtgattctgacctctttcactcacccagtgatgacatggacagcatcatcttcccaaagccagaggaagagcatttggcctgtgatatcaccggatccagttcatccaccgatgacacggcttcactggaccgacattcttctcatggcagtgatgtgtctctctcccagattttaaagccaaacaggtcaagagatcggcaaagccttgatggattctacagccatgggatgggagctgagggtcgagaaagtgagagtgagcctgctgacccaggcgacgtggaggaggaggagatggacagtatcactgaagtgcctgcaaactgctctgtcctaaggagctccatgcgctctctttctcccttccggaggcacagctgggggcctgggaaaaatgcagccagcgatgcagaaatgaaccaccggagtatgagctggtgcccctctggtgtgcagtactctgctggcctgagtgctgactttaattacagaagtttcagtctagaaggcttgacaggaggagctggtgtcggaaacaagccatcctcatctctagaagtaagctctgcaaatgccgaagagctcagacacccattcagtggtgaggaacgggttgactctttggtgtcactttcagaagaggatctggagtcagaccagagagaacataggatgtttgatcagcagatatgtcacagatctaagcagcagggatttaattactgtacatcagccatttcctctccattgacaaaatccatctcattaatgacaatcagccatcctggattggacaattcacggcccttccacagtaccttccacaataccagtgctaatctgactgagagtataacagaagagaactataatttcctgccacatagcccctccaagaaagattctgaatggaagagtggaacaaaagtcagtcgtacattcagctacatcaagaataaaatgtctagcagcaagaagagcaaagaaaaggaaaaagaaaaagataagattaaggagaaggagaaagattctaaagacaaggagaaagataagaagactgtcaacgggcacactttcagttccattcctgttgtgggtcccatcagctgtagccagtgtatgaagcccttcaccaacaaagatgcctatacttgtgcaaattgcagtgcttttgtccacaaaggctgccgagaaagtctagcctcctgtgcaaaggtcaaaatgaagcagcccaaagggagccttcaggcacatgacacatcatcactgcccacggtcattatgagaaacaagccctcacagcccaaggagcgtcctcggtccgcagtcctcctggtggatgaaaccgctaccaccccaatatttgccaatagacgatcccagcagagtgtctcgctctccaaaagtgtctccatacagaacattactggagttggcaatgatgagaacatgtcaaacacctggaaattcctgtctcattcaacagactcactaaataaaatcagcaaggtcaatgagtcaacagaatcacttactgatgagggagtaggtacagacatgaatgaaggacaactactgggagactttgagattgagtccaaacagctggaagcagagtcttggagtcggataatagacagcaagtttctaaaacagcaaaagaaagatgtggtcaaacggcaagaagtaatatatgagttgatgcagacagagtttcatcatgtccgcactctcaagatcatgagtggtgtgtacagccaggggatgatggcggatctgctttttgagcagcagatggtagaaaagctgttcccctgtttggatgagctgatcagtatccatagccaattcttccagaggattctggagcggaagaaggagtctctggtggataaaagtgaaaagaactttctcatcaagaggataggggatgtgcttgtaaatcagttttcaggtgagaatgcagaacgtttaaagaagacatatggcaagttttgtgggcaacataaccagtctgtaaactacttcaaagacctttatgccaaggataagcgttttcaagcctttgtaaagaagaagatgagcagttcagttgttagaaggcttggaattccagagtgcatattgcttgtaactcagcggattaccaagtacccagttttattccaaagaatattgcagtgtaccaaagacaatgaagtggagcaggaagatctagcacagtccttgagcctggtgaaggatgtgattggagctgtagacagcaaagtggcaagttatgaaaagaaagtgcgtctcaatgagatttatacaaagacagatagcaagtcaatcatgaggatgaagagtggtcagatgtttgccaaggaagatttgaaacggaagaagcttgtacgtgatgggagtgtgtttctgaagaatgcagcaggaaggttgaaagaggttcaagcagttcttctcactgacattttagttttccttcaagaaaaagaccagaagtacatctttgcatcattggaccagaagtcaacagtgatctctttaaagaagctgattgtgagagaagtggcacatgaggagaaaggtttattcctgatcagcatggggatgacagatccagagatggtagaagtccatgccagctccaaagaggaacgaaacagctggattcagatcattcaggacacaatcaacaccctgaacagagatgaagatgaaggaattcctagtgagaatgaggaagaaaagaaaatgttggacaccagagcccgagaattaaaagaacaacttcaccagaaggaccaaaaaatcctactcttgttggaagagaaggagatgattttccgggacatggctgagtgcagcacccctctcccagaggattgctccccaacacatagccctagagttctcttccgctccaacacagaagaggctctcaaaggaggacctttaatgaaaagtgcaataaatgaggtggagatccttcagggtttggtgagtggaaatctgggaggcacacttgggccgactgtcagcagccccattgagcaagatgtggtcggtcccgtttccctgccccggagagcagagacctttggaggatttgacagccatcagatgaatgcttcaaaaggaggcgagaaggaagagggagatgatggccaagatcttaggagaacggaatcagatagtggcctaaaaaagggtggaaatgctaacctggtatttatgcttaaaagaaacagtgagcaggttgtccagagcgttgttcatctctacgagctcctcagcgctctgcagggtgtggtgctgcagcaggacagctacattgaggaccagaaactggtgctgagcgagagggcgctcactcgcagcttgtcccgcccgagctccctcattgagcaggagaagcagcgcagcctggagaagcagcgccaggacctggccaacctgcagaagcagcaggcccagtacctcgaggagaagcgcaggcgcgagcgtgagtgggaagctcgtgagagggagctgcgggagcgggaggccctcctggcccagcgcgaggaggaggtgcagcaggggcagcaggacctggaaaaggagcgggaggagctccagcagaagaagggcacataccagtatgacctggagcgactgcgtgctgcccagaaacagcttgagagggaacaggagcagctgcgccgggaggcagagcggctcagccagcggcagacagaacgggacctgtgtcaggtttcccatccacataccaagctgatgaggatcccatcgttcttccccagtcctgaggagcccccctcgccatctgcaccttccatagccaaatcagggtcattggactcagaactttcagtgtccccaaaaaggaacagcatctctcggacacacaaagataaggggccttttcacatactgagttcaaccagccagacaaacaaaggaccagaagggcagagccaggcccctgcgtccacctctgcctctacccgcctgtttgggttaacaaagccaaaggaaaagaaggagaaaaaaaagaagaacaaaaccagccgctctcagcccggtgatggtcccgcgtcagaagtatcagcagagggtgaagagatcttctgctgaccctcttcctctctgctgaggcagctgcctcctgatcctggccagcccacctctcctgctgtccccgcgtgcacaagtctcttacactggacgcccactgctcctcagcgtccagtcctcctgggcggccccaggtcctggacaataagcaacagatgatattgagtgtcgggtggggaaggaggcccagactctgcttcggccatgatttgtgactgcccaggactctcaggttgggctggccctactcaggattacactgaaagtaatggcctcgtaagtacaggtgatggttttggacacgtcaggaattcctaaaggctgaaagagtgtatccaagtaaggtctgaacctccgaatgccttttatttgggggaacacaaaaccaaacagcagatgttttggacttgatctgtgtacgtacatggggacctgtctgcatatacacacggggaatgccagaagaaggcccagtctgcaccaggcgtctggtcaacttagcacaagggcagtgcctggacggacccggagcccccgcatatcagcagttcacccagtactcctcagagactggtttccctctaaacccatcccgggcacataccacccgtgttttgcatgtatttctcatttcattttagggatgacaaacatttgtgaaaccagtgagagaaggcttgatgtgtataaaagacgtgatgtgcaccacctcgatctcggtgtttcaggcactaaagcaacaaaacaacccatagtatctcattctgtcatcagatccagaagaaatatcctggttttccagcatgtttacccacatgttttggccatggataaagtgaagaggcctactcaccattatccctgcagcgtgacaccttttgattgtcactgaccactcagaaggggccacggcctcctggctgtgttcctgag

SEQ ID NO: 103068 - DNA, 9128 bp, Homo sapiens
  Payload ID: 105
  Gene Symbol: AKAP13
  Gene Name: A kinase (PRKA) anchor protein 13
  ENST ID: ENST00000394510
  CDS Start-End: 143-4447
ttttaatagagaggagtctggaaggcagagatctccaccacctaaccgtgagaaatttggaactaaggacttgcactggtccccaagttaacagtggatatacttcctgcattttctctgttctttcttgcatttgggcaaaatgtatgaacggcacaagaggcgctacagcctctgtgacatctccaaggtggacaggactgtggacgtggtattgctgaagataaaccgagaaaactggtgtacaatagagccatgccctgatgcagcatctcttctggcttccaagcagagcccagaatgtgagaacttcctggatgttggactgggcagagagtgtacctcaaaacaaggtgtacttaaaagagaatctgggagtgattctgacctctttcactcacccagtgatgacatggacagcatcatcttcccaaagccagaggaagagcatttggcctgtgatatcaccggatccagttcatccaccgatgacacggcttcactggaccgacattcttctcatggcagtgatgtgtctctctcccagattttaaagccaaacaggtcaagagatcggcaaagccttgatggattctacagccatgggatgggagctgagggtcgagaaagtgagagtgagcctgctgacccaggcgacgtggaggaggaggagatggacagtatcactgaagtgcctgcaaactgctctgtcctaaggagctccatgcgctctctttctcccttccggaggcacagctgggggcctgggaaaaatgcagccagcgatgcagaaatgaaccaccggagtttcagtctagaaggcttgacaggaggagctggtgtcggaaacaagccatcctcatctctagaagtaagctctgcaaatgccgaagagctcagacacccattcagtggtgaggaacgggttgactctttggtgtcactttcagaagaggatctggagtcagaccagagagaacataggatgtttgatcagcagatatgtcacagatctaagcagcagggatttaattactgtacatcagccatttcctctccattgacaaaatccatctcattaatgacaatcagccatcctggattggacaattcacggcccttccacagtaccttccacaataccagtgctaatctgactgagagtataacagaagagaactataatttcctgccacatagcccctccaagaaagattctgaatggaagagtggaacaaaagtcagtcgtacattcagctacatcaagaataaaatgtctagcagcaagaagagcaaagaaaaggaaaaagaaaaagataagattaaggagaaggagaaagattctaaagacaaggagaaagataagaagactgtcaacgggcacactttcagttccattcctgttgtgggtcccatcagctgtagccagtgtatgaagcccttcaccaacaaagatgcctatacttgtgcaaattgcagtgcttttgtccacaaaggctgccgagaaagtctagcctcctgtgcaaaggtcaaaatgaagcccaaagggagccttcaggcacatgacacatcatcactgcccacggtcattatgagaaacaagccctcacagcccaaggagcgtcctcggtccgcagtcctcctggtggatgaaaccgctaccaccccaatatttgccaatagacgatcccagcagagtgtctcgctctccaaaagtgtctccatacagaacattactggagttggcaatgatgagaacatgtcaaacacctggaaattcctgtctcattcaacagactcactaaataaaatcagcaaggtcaatgagtcaacagaatcacttactgatgagggagtaggtacagacatgaatgaaggacaactactgggagactttgagattgagtccaaacagctggaagcagagtcttggagtcggataatagacagcaagtttctaaaacagcaaaagaaagatgtggtcaaacggcaagaagtaatatatgagttgatgcagacagagtttcatcatgtccgcactctcaagatcatgagtggtgtgtacagccaggggatgatggcggatctgctttttgagcagcagatggtagaaaagctgttcccctgtttggatgagctgatcagtatccatagccaattcttccagaggattctggagcggaagaaggagtctctggtggataaaagtgaaaagaactttctcatcaagaggataggggatgtgcttgtaaatcagttttcaggtgagaatgcagaacgtttaaagaagacatatggcaagttttgtgggcaacataaccagtctgtaaactacttcaaagacctttatgccaaggataagcgttttcaagcctttgtaaagaagaagatgagcagttcagttgttagaaggcttggaattccagagtgcatattgcttgtaactcagcggattaccaagtacccagttttattccaaagaatattgcagtgtaccaaagacaatgaagtggagcaggaagatctagcacagtccttgagcctggtgaaggatgtgattggagctgtagacagcaaagtggcaagttatgaaaagaaagtgcgtctcaatgagatttatacaaagacagatagcaagtcaatcatgaggatgaagagtggtcagatgtttgccaaggaagatttgaaacggaagaagcttgtacgtgatgggagtgtgtttctgaagaatgcagcaggaaggttgaaagaggttcaagcagttcttctcactgacattttagttttccttcaagaaaaagaccagaagtacatctttgcatcattggaccagaagtcaacagtgatctctttaaagaagctgattgtgagagaagtggcacatgaggagaaaggtttattcctgatcagcatggggatgacagatccagagatggtagaagtccatgccagctccaaagaggaacgaaacagctggattcagatcattcaggacacaatcaacaccctgaacagagatgaagatgaaggaattcctagtgagaatgaggaagaaaagaaaatgttggacaccagagcccgagaattaaaagaacaacttcaccagaaggaccaaaaaatcctactcttgttggaagagaaggagatgattttccgggacatggctgagtgcagcacccctctcccagaggattgctccccaacacatagccctagagttctcttccgctccaacacagaagaggctctcaaaggaggacctttaatgaaaagtgcaataaatgaggtggagatccttcagggtttggtgagtggaaatctgggaggcacacttgggccgactgtcagcagccccattgagcaagatgtggtcggtcccgtttccctgccccggagagcagagacctttggaggatttgacagccatcagatgaatgcttcaaaaggaggcgagaaggaagagggagatgatggccaagatcttaggagaacggaatcagatagtggcctaaaaaagggtggaaatgctaacctggtatttatgcttaaaagaaacagtgagcaggttgtccagagcgttgttcatctctacgagctcctcagcgctctgcagggtgtggtgctgcagcaggacagctacattgaggaccagaaactggtgctgagcgagagggcgctcactcgcagcttgtcccgcccgagctccctcattgagcaggagaagcagcgcagcctggagaagcagcgccaggacctggccaacctgcagaagcagcaggcccagtacctcgaggagaagcgcaggcgcgagcgtgagtgggaagctcgtgagagggagctgcgggagcgggaggccctcctggcccagcgcgaggaggaggtgcagcaggggcagcaggacctggaaaaggagcgggaggagctccagcagaagaagggcacataccagtatgacctggagcgactgcgtgctgcccagaaacagcttgagagggaacaggagcagctgcgccgggaggcagagcggctcagccagcggcagacagaacgggacctgtgtcaggtttcccatccacataccaagctgatgaggatcccatcgttcttccccagtcctgaggagcccccctcgccatctgcaccttccatagccaaatcagggtcattggactcagaactttcagtgtccccaaaaaggaacagcatctctcggacacacaaagataaggggccttttcacatactgagttcaaccagccagacaaacaaaggaccagaagggcagagccaggcccctgcgtccacctctgcctctacccgcctgtttgggttaacaaagccaaaggaaaagaaggagaaaaaaaagaagaacaaaaccagccgctctcagcccggtgatggtcccgcgtcagaagtatcagcagagggtgaagagatcttctgctgaccctcttcctctctgctgaggcagctgcctcctgatcctggccagcccacctctcctgctgtccccgcgtgcacaagtctcttacactggacgcccactgctcctcagcgtccagtcctcctgggcggccccaggtcctggacaataagcaacagatgatattgagtgtcgggtggggaaggaggcccagactctgcttcggccatgatttgtgactgcccaggactctcaggttgggctggccctactcaggattacactgaaagtaatggcctcgtaagtacaggtgatggttttggacacgtcaggaattcctaaaggctgaaagagtgtatccaagtaaggtctgaacctccgaatgccttttatttgggggaacacaaaaccaaacagcagatgttttggacttgatctgtgtacgtacatggggacctgtctgcatatacacacggggaatgccagaagaaggcccagtctgcaccaggcgtctggtcaacttagcacaagggcagtgcctggacggacccggagcccccgcatatcagcagttcacccagtactcctcagagactggtttccctctaaacccatcccgggcacataccacccgtgttttgcatgtatttctcatttcattttagggatgacaaacatttgtgaaaccagtgagagaaggcttgatgtgtataaaagacgtgatgtgcaccacctcgatctcggtgtttcaggcactaaagcaacaaaacaacccatagtatctcattctgtcatcagatccagaagaaatatcctggttttccagcatgtttacccacatgttttggccatggataaagtgaagaggcctactcaccattatccctgcagcgtgacaccttttgattgtcactgaccactcagaaggggccacggcctcctggctgtgttcctgagcccccgtcgtgcctctcccagacagcagctgtctggcccttgctgggtgagggcacaccactgccaggggtcagcctcgcacccaggccaggcagaagctgtgctctgaagctaggacagctggctgagaagtgggttcaggcgaagggtgaagccatgtgtagcagttcctgccagtgcagatctggagaggagctggcccggaaggcgtggttgtgaaagcgcccttcttatgttaggaggccttggcaaaattggatttcttcaaaaatacatgtaaaggtctgttgttgaattgtactctgcccctggaagcagatacagatggctgcctgctgctcggctttgcttttgcttttcccaccgtgttttcatctttgttcacttgaggctttccccagctggtgtgtgcaggacagttcatggtaatgttgccctctgaggccccgtacaccagaagggaggccctggaaaattttgtgcttccaacgtggccttcaattcttgcttttttgcccctcggaagcatggggcttttgagcacacttaaaaaaagaaaaatctgtaacttggtgcttattgatgaattgcaagctggccttgcagatggagatatttatctttcagtttatttgaaagaggtctggtttaaaatttgtagcctacatttgttttatttattgtatttgtgtgtttgtgtttgtttttttttaagggtgagccaggtctagcccaacagtctaaactatccagtcaataccgagtgaagtggcagccagcactgttcactctgtgtcttttgaagtgccttgaaggcccagatgaaattttaaagggagggggtccatgtccttccctcccccaccccgcctcattctttaatcaaaggatgtcttctcccttgtttgagaatgaagaaactcgccacctctgacctacctttgcctttttctgtcatggagaatactcacccttcagaaacagaccaaaggccaaaacctgctgatttttctattgaaaatatgtccccttgcaaagaccctaaacaaaaagttaagtttctttctttcacctatttgtacaactccaagttacagctgaatctgtcgtgactttcctgagatctacccggggcttggctgtctgttctgggcactggctccgagttcccctcctgggatttgcaggagggcagtactgaacctgcattcttctccttgtaaatgtaggccgggtgcccctgttctccgggtttggaacaatacgaggttggtgctgatgggatttacttgcgtacgtgctcttcacaaaaacaccgtggatgctgaagttagagcacgtcgccacagagcttgacatcaatgttagagggtctcttactccccgcccagctgtgatgtttcatctgctttggttgttttggtggtcttttttaaaaatagagatttcacatctgcccagaccccactcaaaacgatttggtcaggttctggttggacaagtttaaaatcaaagtagtgcccggaattccctcaaaccacccaacttcatccaggaatacagtctgcagtgcagcaacagaaccgcttaccaagaactgtgcttacatacctttgtcatctctcttccccccttggaagttgtcctcagggggatttgttcctgtcctggggatttacctgggatggtggctgcctgtgcttttgctcatggccttgacagtgctctagttgctggatctaatggcctgtcttggtttctatcacatgagaaggggttgtttttttggggtgactcggactgaattccccatactgtttccacgccgggacaccatgttctccatcaagctaaagaaatcacgtgcctgaaactgtgcttaagttttgggggaaagatggagttcctatccagagcccccagatttccagaatcgagtgagcttcctggaaggagactgcgtcttctctcaattccagtcatctcagtcgttgtcgttaggtgacatgtgcactttaaatgctctcatcggttggcttcattttcaagacaatcaaatgtattgactgtgttttcttcttagaaaatggagagggttaaaaacatgcaaactgccactttcaacctttgccagtattccctctacccccgtgagagctatctggggggaagaatccttaccaaggtttttttggaaaggtacgaatcttaacttttttccccttctgtgtctcagggtaatactattcagagtcgcccctttgctcattttctcccgtatttgttaccttcctgaggcctcagtattagtcgtgagcacaaagttttgagacctttggcgttgtttcttgatgtgggaggggaggtgttagtgcatgcaagggttgaactagatagaccctgccttagtagagggtgggactataaccttagaggccagaacttgatccagaagttgctgtccacagaagtgctttctatttcatcatttttgtttctagggctctttttctgtagccaggtcttcccaaggattttagtatttgcattggagttgaggtttactctaatgatggtggcccagctgtgcccagaggacagccaggcaggccctgggagggagtttagaaagacagtcctggtgaatgggcttcaagtggtcacaaagagggtggctgtgaggtgaccccagacactgcagaacgatgtgcaccctctgcgttttggatgtccttggaatgtgggagcctagaaataaccctgtggatggaattggggcagcggctgctggagatctgtgtgccttgccttccttcagcaggaccgtctaggtgcgcagccacctatggatgcgtcccagccagccccgtcgctctcgtccatcctcagagacaaagaagagggcagggagtttgggcttggttttgaactttcctttcaatgtagcaaagcattcctagttaaccagagccttggaatctactgcctgctggccaggctttaaaatgaaaagtgttttaatgctgccataaaagggaggcgggggggaggaagggaaaataaaggcatctttccaagtactcatctaatttaattgtcaaaagattgataggccatgaattacttctccatctcactaagggttaaaggcgtgcaaccccccactggctgtgtcccctgccaccgaagtgagtgacctgccctacaaccaggtgggaccacctgtgctgcagtccggaggggcttctgcaggaagcactcaccccccacaccttccccggcctgagcttcccctacctttcgtcaccacctgagggcatgagcacaggccatggggcgtgcctggtgagtctgcctgtggttcaggcttagcctgtggtctcctgtgtgctgctgcccgcatgggatgcgcaggggaggcgtggggatccgcaggagggtggttgggatacaccggatacctctgctctcattgcttgtttgcaaatgctctatggacatttgtgtgctaaatcctattaaataaaaaagacgggttaaaacccagatgctgtatattcatttgtaattatgtataaagtgaagcagttttaaactgtaaagatttttttcagtgtgttttctcgaattttgccacaacatactggcttcgtattttatttatctttctttctagttaccagcttcagacccttgtaaagtctccctcagccctttcaaaaaataataaatttcctgtgaagttctg

SEQ ID NO: 103069 - DNA, 13215 bp, Homo sapiens
  Payload ID: 105
  Gene Symbol: AKAP13
  Gene Name: A kinase (PRKA) anchor protein 13
  Uniprot ID: Q12802
  ENST ID: ENST00000394518
  CDS Start-End: 96-8537
gagcggccgcctattgtctttctccgcggcgaaggtgaagagttgtcccagctcggcccgcgggggagccccgggagccgcacgtgtcctgggtcatgaaacttaatccacagcaagctcccttatatggtgattgtgttgttacagtgctgcttgctgaagaggacaaagctgaagatgatgtagtgttttacttggtatttttgggttccaccctccgtcactgtacaagtactcggaaggtcagttctgatacattggagaccattgctcctggtcatgattgttgtgaaacagtgaaggtgcagctctgtgcttccaaagagggccttcccgtgtttgtggtggctgaagaagactttcatttcgtccaggatgaagcgtatgatgcagctcaattcctagcaaccagtgctggaaatcagcaggctttgaactttacccgttttcttgaccagtcaggacccccatctggggatgtgaattcccttgataagaagttggtgctggcattcaggcacctgaagctgcccacggagtggaatgtattggggacagatcagagtttgcatgatgctggcccgcgagagacattgatgcattttgctgtgcggctgggactgctgaggttgacgtggttcctgttgcagaagccaggtggccgcggagctctcagtatccacaaccaggaaggggcgacgcctgtgagcttggccttggagcgaggctatcacaagctgcaccagcttctaaccgaggagaatgctggagaaccagactcctggagcagtttatcctatgaaataccgtatggagactgttctgtgaggcatcatcgagagttggacatctatacattaacctctgagtctgattcacatcatgaacacccatttcctggagacggttgcactggaccaatttttaaacttatgaacatccaacagcaactaatgaaaacaaacctcaagcagatggacagtcttatgcccttaatgatgacagcacaggatccttccagtgccccagagacagatggccagtttcttccctgtgcaccggagcccacggaccctcagcgactttcttcttctgaagagactgagagcactcagtgctgcccagggagccctgttgcacagactgaaagtccctgtgatttgtcaagcatagttgaggaggagaatacagaccgttcctgtaggaagaaaaataaaggcgtggaaagaaaaggggaagaggtggagccagcacctattgtggactctggaactgtatctgatcaagacagctgccttcagagcttgcctgattgtggagtaaagggcacggaaggcctttcgtcctgtggaaacagaaatgaagaaactggaacaaaatcttctggaatgcccacagaccaggagtccctgagcagtggagatgctgtgcttcagagagacttggtcatggagccaggcacagcccagtattcctctggaggtgaactgggaggcatttcaacaacaaatgtcagtaccccagacactgcaggggaaatggaacatgggctcatgaacccagatgccactgtttggaagaatgtgcttcagggaggggaaagtacaaaggaaagatttgagaactctaatattggcacagctggagcctctgacgtgcacgtcacaagtaagcctgtggataaaatcagtgttccaaactgtgcccctgctgccagttccctggatggtaacaaacctgctgagtcttcacttgcatttagtaatgaagaaacctccactgaaaaaacagcagaaacggaaacttcacgaagtcgtgaggagagtgctgatgctccagtagatcagaattctgtggtgattccagctgctgcaaaagacaagatttcagatggattagaaccttatactctcttagcagcaggcataggtgaggcaatgtcaccctcagatttagcccttcttgggctggaagaagatgtaatgccacaccagaactcagaaacaaattcatctcatgctcaaagccaaaagggcaaatcctcacccatttgttctacaactggagacgataaactttgtgcagactctgcatgtcaacagaacacagtgacttctagtggcgatttggttgcaaaactgtgtgataacatagttagcgagtccgaaagcaccacagcaaggcaacccagctcacaagatccacccgatgcctcccactgtgaagacccacaggctcatacagtcacctctgaccctgtaagggatacccaggaacgtgcggatttttgtcctttcaaagtggtggataacaaaggccaacgaaaagatgtgaaactagataaacctttaacaaatatgcttgaggtggtttcacatccacatccagttgtccctaaaatggagaaagaactggtgccagaccaggcagtaatatcagacagtactttctctctggcaaacagtccaggcagtgaatcagtaaccaaggatgacgcactttcttttgtcccctcccagaaagaaaagggaacagcaactcctgaactacatacagctacagattatagagatggcccagatggaaattcgaatgagcctgatacgcggccactagaagacagggcagtaggcctgtccacatcctccactgctgcagagcttcagcacgggatggggaataccagtctcacaggacttggtggagagcatgagggtcccgcccctccagcaatcccagaagctctgaatatcaaggggaacactgactcttccctgcaaagtgtgggtaaggccactttggctttagattcagttttgactgaagaaggaaaacttctggtggtttcagaaagctctgcagctcaggaacaagataaggataaagcggtgacctgttcctctattaaggaaaatgctctctcttcaggaactttgcaggaagagcagagaacaccacctcctggacaagatactcaacaatttcatgaaaaatcaatctcagctgactgtgccaaggacaaagcacttcagctaagtaattcaccgggtgcatcctctgcctttcttaaggcagaaactgaacataacaaggaagtggccccacaagtctcactgctgactcaaggtggggctgcccagagcctggtgccaccaggagcaagtctggccacagagtcaaggcaggaagccttgggggcagagcacaacagctccgctctgttgccatgtctgttgccagatgggtctgatgggtccgatgctcttaactgcagtcagccttctcctctggatgttggagtgaagaacactcaatcccagggaaaaactagtgcctgtgaggtgagtggagatgtgacggtggatgttacaggggttaatgctctacaaggtatggctgagcccagaagagagaatatatcacacaacacccaagacatcctgattccaaacgtcttgttgagccaagagaagaatgccgttctaggtttgccagtggctctacaggacaaagctgtgactgacccacagggagttggaaccccagagatgatacctcttgattgggagaaagggaagctggagggagcagaccacagctgtaccatgggtgacgctgaggaagcccaaatagacgatgaagcacatcctgtcctactgcagcctgttgccaaggagctccccacagacatggagctctcagcccatgatgatggggccccagctggtgtgagggaagtcatgcgagccccgccttcaggcagggaaaggagcactccctctctaccttgcatggtctctgcccaggacgcacctctgcctaagggggcagacttgatagaggaggctgccagccgtatagtggatgctgtcatcgaacaagtcaaggccgctggagcactgcttactgagggggaggcctgtcacatgtcactgtccagccctgagttgggtcctctcactaaaggactagagagtgcttttacagaaaaagtgagtactttcccacctggggagagcctaccaatgggcagtactcctgaggaagccacggggagccttgcaggatgttttgctggaagggaggagccagagaagatcattttacctgtccaggggcctgagccagcagcagaaatgccagacgtgaaagctgaagatgaagtggattttagagcaagttcaatttctgaagaagtggctgtagggagcatagctgctacactgaagatgaagcaaggcccaatgacccaggcgataaaccgagaaaactggtgtacaatagagccatgccctgatgcagcatctcttctggcttccaagcagagcccagaatgtgagaacttcctggatgttggactgggcagagagtgtacctcaaaacaaggtgtacttaaaagagaatctgggagtgattctgacctctttcactcacccagtgatgacatggacagcatcatcttcccaaagccagaggaagagcatttggcctgtgatatcaccggatccagttcatccaccgatgacacggcttcactggaccgacattcttctcatggcagtgatgtgtctctctcccagattttaaagccaaacaggtcaagagatcggcaaagccttgatggattctacagccatgggatgggagctgagggtcgagaaagtgagagtgagcctgctgacccaggcgacgtggaggaggaggagatggacagtatcactgaagtgcctgcaaactgctctgtcctaaggagctccatgcgctctctttctcccttccggaggcacagctgggggcctgggaaaaatgcagccagcgatgcagaaatgaaccaccggagttcaatgcgagttcttggggatgttgtcaggagacctcccattcataggagaagtttcagtctagaaggcttgacaggaggagctggtgtcggaaacaagccatcctcatctctagaagtaagctctgcaaatgccgaagagctcagacacccattcagtggtgaggaacgggttgactctttggtgtcactttcagaagaggatctggagtcagaccagagagaacataggatgtttgatcagcagatatgtcacagatctaagcagcagggatttaattactgtacatcagccatttcctctccattgacaaaatccatctcattaatgacaatcagccatcctggattggacaattcacggcccttccacagtaccttccacaataccagtgctaatctgactgagagtataacagaagagaactataatttcctgccacatagcccctccaagaaagattctgaatggaagagtggaacaaaagtcagtcgtacattcagctacatcaagaataaaatgtctagcagcaagaagagcaaagaaaaggaaaaagaaaaagataagattaaggagaaggagaaagattctaaagacaaggagaaagataagaagactgtcaacgggcacactttcagttccattcctgttgtgggtcccatcagctgtagccagtgtatgaagcccttcaccaacaaagatgcctatacttgtgcaaattgcagtgcttttgtccacaaaggctgccgagaaagtctagcctcctgtgcaaaggtcaaaatgaagcagcccaaagggagccttcaggcacatgacacatcatcactgcccacggtcattatgagaaacaagccctcacagcccaaggagcgtcctcggtccgcagtcctcctggtggatgaaaccgctaccaccccaatatttgccaatagacgatcccagcagagtgtctcgctctccaaaagtgtctccatacagaacattactggagttggcaatgatgagaacatgtcaaacacctggaaattcctgtctcattcaacagactcactaaataaaatcagcaaggtcaatgagtcaacagaatcacttactgatgagggagtaggtacagacatgaatgaaggacaactactgggagactttgagattgagtccaaacagctggaagcagagtcttggagtcggataatagacagcaagtttctaaaacagcaaaagaaagatgtggtcaaacggcaagaagtaatatatgagttgatgcagacagagtttcatcatgtccgcactctcaagatcatgagtggtgtgtacagccaggggatgatggcggatctgctttttgagcagcagatggtagaaaagctgttcccctgtttggatgagctgatcagtatccatagccaattcttccagaggattctggagcggaagaaggagtctctggtggataaaagtgaaaagaactttctcatcaagaggataggggatgtgcttgtaaatcagttttcaggtgagaatgcagaacgtttaaagaagacatatggcaagttttgtgggcaacataaccagtctgtaaactacttcaaagacctttatgccaaggataagcgttttcaagcctttgtaaagaagaagatgagcagttcagttgttagaaggcttggaattccagagtgcatattgcttgtaactcagcggattaccaagtacccagttttattccaaagaatattgcagtgtaccaaagacaatgaagtggagcaggaagatctagcacagtccttgagcctggtgaaggatgtgattggagctgtagacagcaaagtggcaagttatgaaaagaaagtgcgtctcaatgagatttatacaaagacagatagcaagtcaatcatgaggatgaagagtggtcagatgtttgccaaggaagatttgaaacggaagaagcttgtacgtgatgggagtgtgtttctgaagaatgcagcaggaaggttgaaagaggttcaagcagttcttctcactgacattttagttttccttcaagaaaaagaccagaagtacatctttgcatcattggaccagaagtcaacagtgatctctttaaagaagctgattgtgagagaagtggcacatgaggagaaaggtttattcctgatcagcatggggatgacagatccagagatggtagaagtccatgccagctccaaagaggaacgaaacagctggattcagatcattcaggacacaatcaacaccctgaacagagatgaagatgaaggaattcctagtgagaatgaggaagaaaagaaaatgttggacaccagagcccgagaattaaaagaacaacttcaccagaaggaccaaaaaatcctactcttgttggaagagaaggagatgattttccgggacatggctgagtgcagcacccctctcccagaggattgctccccaacacatagccctagagttctcttccgctccaacacagaagaggctctcaaaggaggacctttaatgaaaagtgcaataaatgaggtggagatccttcagggtttggtgagtggaaatctgggaggcacacttgggccgactgtcagcagccccattgagcaagatgtggtcggtcccgtttccctgccccggagagcagagacctttggaggatttgacagccatcagatgaatgcttcaaaaggaggcgagaaggaagagggagatgatggccaagatcttaggagaacggaatcagatagtggcctaaaaaagggtggaaatgctaacctggtatttatgcttaaaagaaacagtgagcaggttgtccagagcgttgttcatctctacgagctcctcagcgctctgcagggtgtggtgctgcagcaggacagctacattgaggaccagaaactggtgctgagcgagagggcgctcactcgcagcttgtcccgcccgagctccctcattgagcaggagaagcagcgcagcctggagaagcagcgccaggacctggccaacctgcagaagcagcaggcccagtacctcgaggagaagcgcaggcgcgagcgtgagtgggaagctcgtgagagggagctgcgggagcgggaggccctcctggcccagcgcgaggaggaggtgcagcaggggcagcaggacctggaaaaggagcgggaggagctccagcagaagaagggcacataccagtatgacctggagcgactgcgtgctgcccagaaacagcttgagagggaacaggagcagctgcgccgggaggcagagcggctcagccagcggcagacagaacgggacctgtgtcaggtttcccatccacataccaagctgatgaggatcccatcgttcttccccagtcctgaggagcccccctcgccatctgcaccttccatagccaaatcagggtcattggactcagaactttcagtgtccccaaaaaggaacagcatctctcggacacacaaagataaggggccttttcacatactgagttcaaccagccagacaaacaaaggaccagaagggcagagccaggcccctgcgtccacctctgcctctacccgcctgtttgggttaacaaagccaaaggaaaagaaggagaaaaaaaagaagaacaaaaccagccgctctcagcccggtgatggtcccgcgtcagaagtatcagcagagggtgaagagatcttctgctgaccctcttcctctctgctgaggcagctgcctcctgatcctggccagcccacctctcctgctgtccccgcgtgcacaagtctcttacactggacgcccactgctcctcagcgtccagtcctcctgggcggccccaggtcctggacaataagcaacagatgatattgagtgtcgggtggggaaggaggcccagactctgcttcggccatgatttgtgactgcccaggactctcaggttgggctggccctactcaggattacactgaaagtaatggcctcgtaagtacaggtgatggttttggacacgtcaggaattcctaaaggctgaaagagtgtatccaagtaaggtctgaacctccgaatgccttttatttgggggaacacaaaaccaaacagcagatgttttggacttgatctgtgtacgtacatggggacctgtctgcatatacacacggggaatgccagaagaaggcccagtctgcaccaggcgtctggtcaacttagcacaagggcagtgcctggacggacccggagcccccgcatatcagcagttcacccagtactcctcagagactggtttccctctaaacccatcccgggcacataccacccgtgttttgcatgtatttctcatttcattttagggatgacaaacatttgtgaaaccagtgagagaaggcttgatgtgtataaaagacgtgatgtgcaccacctcgatctcggtgtttcaggcactaaagcaacaaaacaacccatagtatctcattctgtcatcagatccagaagaaatatcctggttttccagcatgtttacccacatgttttggccatggataaagtgaagaggcctactcaccattatccctgcagcgtgacaccttttgattgtcactgaccactcagaaggggccacggcctcctggctgtgttcctgagcccccgtcgtgcctctcccagacagcagctgtctggcccttgctgggtgagggcacaccactgccaggggtcagcctcgcacccaggccaggcagaagctgtgctctgaagctaggacagctggctgagaagtgggttcaggcgaagggtgaagccatgtgtagcagttcctgccagtgcagatctggagaggagctggcccggaaggcgtggttgtgaaagcgcccttcttatgttaggaggccttggcaaaattggatttcttcaaaaatacatgtaaaggtctgttgttgaattgtactctgcccctggaagcagatacagatggctgcctgctgctcggctttgcttttgcttttcccaccgtgttttcatctttgttcacttgaggctttccccagctggtgtgtgcaggacagttcatggtaatgttgccctctgaggccccgtacaccagaagggaggccctggaaaattttgtgcttccaacgtggccttcaattcttgcttttttgcccctcggaagcatggggcttttgagcacacttaaaaaaagaaaaatctgtaacttggtgcttattgatgaattgcaagctggccttgcagatggagatatttatctttcagtttatttgaaagaggtctggtttaaaatttgtagcctacatttgttttatttattgtatttgtgtgtttgtgtttgtttttttttaagggtgagccaggtctagcccaacagtctaaactatccagtcaataccgagtgaagtggcagccagcactgttcactctgtgtcttttgaagtgccttgaaggcccagatgaaattttaaagggagggggtccatgtccttccctcccccaccccgcctcattctttaatcaaaggatgtcttctcccttgtttgagaatgaagaaactcgccacctctgacctacctttgcctttttctgtcatggagaatactcacccttcagaaacagaccaaaggccaaaacctgctgatttttctattgaaaatatgtccccttgcaaagaccctaaacaaaaagttaagtttctttctttcacctatttgtacaactccaagttacagctgaatctgtcgtgactttcctgagatctacccggggcttggctgtctgttctgggcactggctccgagttcccctcctgggatttgcaggagggcagtactgaacctgcattcttctccttgtaaatgtaggccgggtgcccctgttctccgggtttggaacaatacgaggttggtgctgatgggatttacttgcgtacgtgctcttcacaaaaacaccgtggatgctgaagttagagcacgtcgccacagagcttgacatcaatgttagagggtctcttactccccgcccagctgtgatgtttcatctgctttggttgttttggtggtcttttttaaaaatagagatttcacatctgcccagaccccactcaaaacgatttggtcaggttctggttggacaagtttaaaatcaaagtagtgcccggaattccctcaaaccacccaacttcatccaggaatacagtctgcagtgcagcaacagaaccgcttaccaagaactgtgcttacatacctttgtcatctctcttccccccttggaagttgtcctcagggggatttgttcctgtcctggggatttacctgggatggtggctgcctgtgcttttgctcatggccttgacagtgctctagttgctggatctaatggcctgtcttggtttctatcacatgagaaggggttgtttttttggggtgactcggactgaattccccatactgtttccacgccgggacaccatgttctccatcaagctaaagaaatcacgtgcctgaaactgtgcttaagttttgggggaaagatggagttcctatccagagcccccagatttccagaatcgagtgagcttcctggaaggagactgcgtcttctctcaattccagtcatctcagtcgttgtcgttaggtgacatgtgcactttaaatgctctcatcggttggcttcattttcaagacaatcaaatgtattgactgtgttttcttcttagaaaatggagagggttaaaaacatgcaaactgccactttcaacctttgccagtattccctctacccccgtgagagctatctggggggaagaatccttaccaaggtttttttggaaaggtacgaatcttaacttttttccccttctgtgtctcagggtaatactattcagagtcgcccctttgctcattttctcccgtatttgttaccttcctgaggcctcagtattagtcgtgagcacaaagttttgagacctttggcgttgtttcttgatgtgggaggggaggtgttagtgcatgcaagggttgaactagatagaccctgccttagtagagggtgggactataaccttagaggccagaacttgatccagaagttgctgtccacagaagtgctttctatttcatcatttttgtttctagggctctttttctgtagccaggtcttcccaaggattttagtatttgcattggagttgaggtttactctaatgatggtggcccagctgtgcccagaggacagccaggcaggccctgggagggagtttagaaagacagtcctggtgaatgggcttcaagtggtcacaaagagggtggctgtgaggtgaccccagacactgcagaacgatgtgcaccctctgcgttttggatgtccttggaatgtgggagcctagaaataaccctgtggatggaattggggcagcggctgctggagatctgtgtgccttgccttccttcagcaggaccgtctaggtgcgcagccacctatggatgcgtcccagccagccccgtcgctctcgtccatcctcagagacaaagaagagggcagggagtttgggcttggttttgaactttcctttcaatgtagcaaagcattcctagttaaccagagccttggaatctactgcctgctggccaggctttaaaatgaaaagtgttttaatgctgccataaaagggaggcgggggggaggaagggaaaataaaggcatctttccaagtactcatctaatttaattgtcaaaagattgataggccatgaattacttctccatctcactaagggttaaaggcgtgcaaccccccactggctgtgtcccctgccaccgaagtgagtgacctgccctacaaccaggtgggaccacctgtgctgcagtccggaggggcttctgcaggaagcactcaccccccacaccttccccggcctgagcttcccctacctttcgtcaccacctgagggcatgagcacaggccatggggcgtgcctggtgagtctgcctgtggttcaggcttagcctgtggtctcctgtgtgctgctgcccgcatgggatgcgcaggggaggcgtggggatccgcaggagggtggttgggatacaccggatacctctgctctcattgcttgtttgcaaatgctctatggacatttgtgtgctaaatcctattaaataaaaaagacgggttaaaacccagatgctgtatattcatttgtaattatgtataaagtgaagcagttttaaactgtaaagatttttttcagtgtgttttctcgaattttgccacaacatactggcttcgtattttatttatctttctttctagttaccagcttcagacccttgtaaagtctccctcagccctttcaaaaaataataaatttcctgtgaagtt

SEQ ID NO: 103070 - DNA, 558 bp, Homo sapiens
  Payload ID: 105
  Gene Symbol: AKAP13
  Gene Name: A kinase (PRKA) anchor protein 13
  ENST ID: ENST00000558166
  CDS Start-End: 280-558
attgtgtgtttgccgcaaattaaaacctcagctctgtatcttgccttctgctggaggtttgtaagcttgctcctgctaaccacttcattgtctgagagagaaacggagaatgctggagaaccagactcctggagcagtttatcctatgaaataccgtatggagactgttctgtgaggcatcatcgagagttggacatctatacattaacctctgagtctgattcacatcatgaacacccatttcctggagacggttgcactggaccaatttttaaacttatgaacatccaacagcaactaatgaaaacaaacctcaagcagatggacagtcttatgcccttaatgatgacagcacaggatccttccagtgccccagagacagatggccagtttcttccctgtgcaccggagcccacggaccctcagcgactttcttcttctgaagagactgagagcactcagtgctgcccagggagccctgttgcacagactgaaagtccctgtgatttgtcaagcatagttgaggaggagaatacagaccgttcctgtaggaagaaa

SEQ ID NO: 103071 - DNA, 447 bp, Homo sapiens
  Payload ID: 105
  Gene Symbol: AKAP13
  Gene Name: A kinase (PRKA) anchor protein 13
  ENST ID: ENST00000558811
  CDS Start-End: 9-447
aaaagaggatgggcttgcgatattcggggtgcttgggcagccatgtggagaatgctggagaaccagactcctggagcagtttatcctatgaaataccgtatggagactgttctgtgaggcatcatcgagagttggacatctatacattaacctctgagtctgattcacatcatgaacacccatttcctggagacggttgcactggaccaatttttaaacttatgaacatccaacagcaactaatgaaaacaaacctcaagcagatggacagtcttatgcccttaatgatgacagcacaggatccttccagtgccccagagacagatggccagtttcttccctgtgcaccggagcccacggaccctcagcgactttcttcttctgaagagactgagagcactcagtgctgcccagggagccctgttgcacagactgaaagtccctgtg

SEQ ID NO: 103072 - DNA, 827 bp, Homo sapiens
  Payload ID: 105
  Gene Symbol: AKAP13
  Gene Name: A kinase (PRKA) anchor protein 13
  ENST ID: ENST00000559486
  CDS Start-End: 1-827
cccagtgatgacatggacagcatcatcttcccaaagccagaggaagagcatttggcctgtgatatcaccggatccagttcatccaccgatgacacggcttcactggaccgacattcttctcatggcagtgatgtgtctctctcccagattttaaagccaaacaggtcaagagatcggcaaagccttgatggattctacagccatgggatgggagctgagggtcgagaaagtgagagtgagcctgctgacccaggcgacgtggaggaggaggagatggacagtatcactgaagtgcctgcaaactgctctgtcctaaggagctccatgcgctctctttctcccttccggaggcacagctgggggcctgggaaaaatgcagccagcgatgcagaaatgaaccaccggagttcaatgcgagttcttggggatgttgtcaggagacctcccattcataggagaagtatgagctggtgcccctctggtgtgcagtactctgctggcctgagtgctgactttaattacagaagtttcagtctagaaggcttgacaggaggagctggtgtcggaaacaagccatcctcatctctagaagtaagctctgcaaatgccgaagagctcagacacccattcagtggtgaggaacgggttgactctttggtgtcactttcagaagaggatctggagtcagaccagagagaacataggatgtttgatcagcagatatgtcacagatctaagcagcagggatttaattactgtacatcagccatttcctctccattgacaaaatccatctcattaatgacaatcagccatcctggattgga

SEQ ID NO: 103073 - DNA, 322 bp, Homo sapiens
  Payload ID: 105
  Gene Symbol: AKAP13
  Gene Name: A kinase (PRKA) anchor protein 13
  ENST ID: ENST00000560256
  CDS Start-End: 209-322
gttgtcccagctcggcccgcgggggagccccgggagccgcacgggacatgtatagtttcaccatgttggccaggatggtctgaaactccttatctgaagtgatcagcctgccttgacctcccaaaattctgggattacaggcgtgtgccaccgcgtctgtcctaaggagacacactgtttctctggcttattaagagtgtcctgggtcatgaaacttaatccacagcaagctcccttatatggtgattgtgttgttacagtgctgcttgctgaagaggacaaagctgaagatgatgtagtgttttacttggtatttttgggt

SEQ ID NO: 103074 - DNA, 3765 bp, Homo sapiens
  Payload ID: 105
  Gene Symbol: AKAP13
  Gene Name: A kinase (PRKA) anchor protein 13
  Uniprot ID: Q12802
  ENST ID: ENST00000560302
  CDS Start-End: 171-710
gaagcgcctgtgctctgccgagactgccgtgcccattgctcgcctcggtcgccgccgctttagccgcctccgggggagcggccgcctattgtctttctccgcggcgaaggtgaagagttgtcccagctcggcccgcgggggagccccgggagccgcacgtgtcctgggtcatgaaacttaatccacagcaagctcccttatatggtgattgtgttgttacagtgctgcttgctgaagaggacaaagctgaagatgatgtagtgttttacttggtatttttgggttccaccctccgtcactgtacaagtactcggaaggtcagttctgatacattggagaccattgctcctggtcatgattgttgtgaaacagtgaaggtgcagctctgtgcttccaaagagggccttcccgtgtttgtggtggctgaagaagactttcatttcgtccaggatgaagcgtatgatgcagctcaattcctagcaaccagtgctggaaatcagcaggctttgaactttacccgttttcttgaccagtcaggacccccatctggggatgtgaattcccttgataagaagttggtgctggcattcaggcacctgaagctgcccacggagtggaatgtattggggacagatcagagtttgcatggtgagaatttatatgatctacaaacacactttaagtttgtgatatttctactttttttttaatggggctacttttctatggtcatcatattcaggtcttccacagaggctgcgtaaatcttagaattactgtaggaaagtggcctcaatggcatctcttctaggttcttcaattgagctgttaagcatgttgttgcagcgaaatgaccctagggattacccaaggagagtggcacgtcaccttcctgtgggtctggatttcagatttgatctctcaagtgtagaaagtgacatgctcttcatgaggagagtagcagagttactttttggtgtttaatgatcaaagacatggttttcattattgtattctgaagttctctaaagatagcctggaagtgaaggagaggaaagattgggcagtgagtgggaggagcatgagaacagggtgtgctctgagaaaccacacacttccttaaccaggttagtgtcactcttactgactttatctgttggccctccctatgagagttcactgaagaaaggactttttgtttgttttttgtttttttttgagaacgggctttcactcttgtagtccaggctggagtgcagtggcatgatctcggctcactgcagcctccacctcctgggttcaggtgattctgctgcctcagcctcccaaatagctgggattacaggcatgtaccaccatgcctagcaaatttttttttttttttaattagagacagggtttcaccgtgttagtcaggctggtctcgaactcctgacctcaggtaatctacccacctcggcctcccaaagtgctgggattataggcatgagccactgcgcccggccagaactccactttttcaaaaatatttacatagtaagtcctcttactcaaacaagggttttcccacataattctagtagccaatgacatctacttgatgtcataattgtatagatattttttaatgaaacataatgtgtacctggagttcaataagtaacatccagtttcccttctgagttcaagtccaattgaacgatttgggagtcctgagatagaaaccaaaatgtttattactgatgaaatctagattggaagcctgatgttagagctcctgccagaagggtctgcttgtactttctatgtcttcaatgaaagagctggtcagtcacaccattgccctgtagagtccacccagccttgagtattgaattattttgggtaagcagaccacaagtcactctccccacaggtgagcagttcctgaggagaaatacccagaggggcctgagccatagcatagttagtttctacactcagatgaattttgtcttcttccatggaagaatggtaaagaggtctttgccagctttgattctcttaaatctacactaaatttaacagttaaacctgtggtcagccgtcagaacggtgtcccatactgtcaggtgcatactgtcagattctacctggatagtcctgcccaggtaaaacctgaaaggaagtatcaaatcaaggaagaaaggatttatccttttcttcttctttttttaagtatagtgtccaagaaacttctgtcttgctaatatttagagatcagaatatttgacattctgaaaaggcactcatgccttatataaacctggtgatgggccttaatacctctagctcctcctatttctgtattgatacaggaatgtttattctggctgcctttcacaaatcagtgtcaagatagtactgcattagttatttgtggggcttatggtgttttatggttttgttttgtcttgtttaaagaggggcccaggagttggatagttttatgttgccatgattaaaaacaactattagaaaaagcaaacatctgaaactttggacatatcacttcctctttctctctcttttttttttttttttttgagatagagtcttgctctgtcgcccaggctggagtgcaatggtgcaatctcggctcactgcaacctccatctcctgggttgaagcgattctcctgccttagcctcccaagtagctgggaatacaggcacatgccaccacaccctgctgcttttttgtgtgttttagtagagacggggtttcaccatgttgcccaggctggtcttgaactcctgagctcaggcaatccacccgcctcagcctcccaaagtgctaggattacaggcgtgagccactgtgcccggccacttcctctctttgggccttaacttccttgtctttaataggagggaattggccagctttaatttttttttgtactgtcagtgtactggtaaattttctgttgcacaaaattgctcaagcagtgctaacaaaggccaaaccaaatttgaacacttgaggaaggaaatacatattaaaaccacaatgagatatcattacacatttatcataatggctaagatgaagaataccaagtgctggcaaagatgaagaacatatcatatgttgcttgtaggaatgcaaaatgtataaccactctagaaatatttggcagtttcttgtaaagttaaacatacacttagcgtatgacccagtaatcccacttttgggtgtttatcctagagaaatgaaaatctgtagtcaccaaaaagtctgtgcacggacgtgctcatagtaatgttattcataatcttcaaaaactggaaataacccagatttccctcactgagtgaatacagaagcaaactataatatatccatacagtggaatactactcagcaataaaaagaagcaaactgttgacatgtgcaacaacttggatgtgttttaaatgcattatgcgggaaaatgaagtcagtttccaaaggttccatactatgtgattctatttatatgatattctggaagatgcaaaattatagaaaaagagaacagatgagtagttgctaggggctgggagtgggggaagtctgactggaaagaggtatcatgagggaattctttgggttgttggagttgttttgtcttgttcgtggtggtggctgtaagaatctatgcatgtgttaaaactcataggagtgtacatcccctaaaggtgaattttattgtacatatatttaaaataataaaataacaaa

SEQ ID NO: 103075 - DNA, 5459 bp, Homo sapiens
  Payload ID: 105
  Gene Symbol: AKAP13
  Gene Name: A kinase (PRKA) anchor protein 13
  ENST ID: ENST00000559362
  CDS Start-End: 224-5459
tgcgcggactggagctgtgtgcagggccagcgcggagcccgagcagccgcggtgaagcgcctgtgctctgccgagactgccgtgcccattgctcgcctcggtcgccgccgctttagccgcctccgggggagcggccgcctattgtctttctccgcggcgaaggtgaagagttgtcccagctcggcccgcgggggagccccgggagccgcacgtgtcctgggtcatgaaacttaatccacagcaagctcccttatatggtgattgtgttgttacagtgctgcttgctgaagaggacaaagctgaagatgatgtagtgttttacttggtatttttgggttccaccctccgtcactgtacaagtactcggaaggtcagttctgatacattggagaccattgctcctggtcatgattgttgtgaaacagtgaaggtgcagctctgtgcttccaaagagggccttcccgtgtttgtggtggctgaagaagactttcatttcgtccaggatgaagcgtatgatgcagctcaattcctagcaaccagtgctggaaatcagcaggctttgaactttacccgttttcttgaccagtcaggacccccatctggggatgtgaattcccttgataagaagttggtgctggcattcaggcacctgaagctgcccacggagtggaatgtattggggacagatcagagtttgcatgatgctggcccgcgagagacattgatgcattttgctgtgcggctgggactgctgaggttgacgtggttcctgttgcagaagccaggtggccgcggagctctcagtatccacaaccaggaaggggcgacgcctgtgagcttggccttggagcgaggctatcacaagctgcaccagcttctaaccgaggagaatgctggagaaccagactcctggagcagtttatcctatgaaataccgtatggagactgttctgtgaggcatcatcgagagttggacatctatacattaacctctgagtctgattcacatcatgaacacccatttcctggagacggttgcactggaccaatttttaaacttatgaacatccaacagcaactaatgaaaacaaacctcaagcagatggacagtcttatgcccttaatgatgacagcacaggatccttccagtgccccagagacagatggccagtttcttccctgtgcaccggagcccacggaccctcagcgactttcttcttctgaagagactgagagcactcagtgctgcccagggagccctgttgcacagactgaaagtccctgtgatttgtcaagcatagttgaggaggagaatacagaccgttcctgtaggaagaaaaataaaggcgtggaaagaaaaggggaagaggtggagccagcacctattgtggactctggaactgtatctgatcaagacagctgccttcagagcttgcctgattgtggagtaaagggcacggaaggcctttcgtcctgtggaaacagaaatgaagaaactggaacaaaatcttctggaatgcccacagaccaggagtccctgagcagtggagatgctgtgcttcagagagacttggtcatggagccaggcacagcccagtattcctctggaggtgaactgggaggcatttcaacaacaaatgtcagtaccccagacactgcaggggaaatggaacatgggctcatgaacccagatgccactgtttggaagaatgtgcttcagggaggggaaagtacaaaggaaagatttgagaactctaatattggcacagctggagcctctgacgtgcacgtcacaagtaagcctgtggataaaatcagtgttccaaactgtgcccctgctgccagttccctggatggtaacaaacctgctgagtcttcacttgcatttagtaatgaagaaacctccactgaaaaaacagcagaaacggaaacttcacgaagtcgtgaggagagtgctgatgctccagtagatcagaattctgtggtgattccagctgctgcaaaagacaagatttcagatggattagaaccttatactctcttagcagcaggcataggtgaggcaatgtcaccctcagatttagcccttcttgggctggaagaagatgtaatgccacaccagaactcagaaacaaattcatctcatgctcaaagccaaaagggcaaatcctcacccatttgttctacaactggagacgataaactttgtgcagactctgcatgtcaacagaacacagtgacttctagtggcgatttggttgcaaaactgtgtgataacatagttagcgagtccgaaagcaccacagcaaggcaacccagctcacaagatccacccgatgcctcccactgtgaagacccacaggctcatacagtcacctctgaccctgtaagggatacccaggaacgtgcggatttttgtcctttcaaagtggtggataacaaaggccaacgaaaagatgtgaaactagataaacctttaacaaatatgcttgaggtggtttcacatccacatccagttgtccctaaaatggagaaagaactggtgccagaccaggcagtaatatcagacagtactttctctctggcaaacagtccaggcagtgaatcagtaaccaaggatgacgcactttcttttgtcccctcccagaaagaaaagggaacagcaactcctgaactacatacagctacagattatagagatggcccagatggaaattcgaatgagcctgatacgcggccactagaagacagggcagtaggcctgtccacatcctccactgctgcagagcttcagcacgggatggggaataccagtctcacaggacttggtggagagcatgagggtcccgcccctccagcaatcccagaagctctgaatatcaaggggaacactgactcttccctgcaaagtgtgggtaaggccactttggctttagattcagttttgactgaagaaggaaaacttctggtggtttcagaaagctctgcagctcaggaacaagataaggataaagcggtgacctgttcctctattaaggaaaatgctctctcttcaggaactttgcaggaagagcagagaacaccacctcctggacaagatactcaacaatttcatgaaaaatcaatctcagctgactgtgccaaggacaaagcacttcagctaagtaattcaccgggtgcatcctctgcctttcttaaggcagaaactgaacataacaaggaagtggccccacaagtctcactgctgactcaaggtggggctgcccagagcctggtgccaccaggagcaagtctggccacagagtcaaggcaggaagccttgggggcagagcacaacagctccgctctgttgccatgtctgttgccagatgggtctgatgggtccgatgctcttaactgcagtcagccttctcctctggatgttggagtgaagaacactcaatcccagggaaaaactagtgcctgtgaggtgagtggagatgtgacggtggatgttacaggggttaatgctctacaaggtatggctgagcccagaagagagaatatatcacacaacacccaagacatcctgattccaaacgtcttgttgagccaagagaagaatgccgttctaggtttgccagtggctctacaggacaaagctgtgactgacccacagggagttggaaccccagagatgatacctcttgattgggagaaagggaagctggagggagcagaccacagctgtaccatgggtgacgctgaggaagcccaaatagacgatgaagcacatcctgtcctactgcagcctgttgccaaggagctccccacagacatggagctctcagcccatgatgatggggccccagctggtgtgagggaagtcatgcgagccccgccttcaggcagggaaaggagcactccctctctaccttgcatggtctctgcccaggacgcacctctgcctaagggggcagacttgatagaggaggctgccagccgtatagtggatgctgtcatcgaacaagtcaaggccgctggagcactgcttactgagggggaggcctgtcacatgtcactgtccagccctgagttgggtcctctcactaaaggactagagagtgcttttacagaaaaagtgagtactttcccacctggggagagcctaccaatgggcagtactcctgaggaagccacggggagccttgcaggatgttttgctggaagggaggagccagagaagatcattttacctgtccaggggcctgagccagcagcagaaatgccagacgtgaaagctgaagatgaagtggattttagagcaagttcaatttctgaagaagtggctgtagggagcatagctgctacactgaagatgaagcaaggcccaatgacccaggcgataaaccgagaaaactggtgtacaatagagccatgccctgatgcagcatctcttctggcttccaagcagagcccagaatgtgagaacttcctggatgttggactgggcagagagtgtacctcaaaacaaggtgtacttaaaagagaatctgggagtgattctgacctctttcactcacccagtgatgacatggacagcatcatcttcccaaagccagaggaagagcatttggcctgtgatatcaccggatccagttcatccaccgatgacacggcttcactggaccgacattcttctcatggcagtgatgtgtctctctcccagattttaaagccaaacaggtcaagagatcggcaaagccttgatggattctacagccatgggatgggagctgagggtcgagaaagtgagagtgagcctgctgacccaggcgacgtggaggaggaggagatggacagtatcactgaagtgcctgcaaactgctctgtcctaaggagctccatgcgctctctttctcccttccggaggcacagctgggggcctgggaaaaatgcagccagcgatgcagaaatgaaccaccggagtttcagtctagaaggcttgacaggaggagctggtgtcggaaacaagccatcctcatctctagaagtaagctctgcaaatgccgaagagctcagacacccattcagtggtgaggaacgggttgactctttggtgtcactttcagaagaggatctggagtcagaccagagagaacataggatgtttgatcagcagatatgtcacagatctaagcagcagggatttaattactgtacatcagccatttcctctccattgacaaaatccatctcattaatgacaatcagccatcctggattggacaattcacggcccttccacagtaccttccacaataccagtgctaatctgactgagagtataacagaagagaactataatttcctgccacatagcccctccaagaaagattctgaatggaagagtggaacaaaagtcagtcgtacattcagctacatcaagaataaaatgtctagcagcaagaagagcaaag

SEQ ID NO: 103076 - DNA, 4290 bp, Homo sapiens
  Payload ID: 105
  Gene Symbol: AKAP13
  Gene Name: A kinase (PRKA) anchor protein 13
  ENST ID: ENST00000560579
  CDS Start-End: 1-4290
atgttgtatataaaccgagaaaactggtgtacaatagagccatgccctgatgcagcatctcttctggcttccaagcagagcccagaatgtgagaacttcctggatgttggactgggcagagagtgtacctcaaaacaaggtgtacttaaaagagaatctgggagtgattctgacctctttcactcacccagtgatgacatggacagcatcatcttcccaaagccagaggaagagcatttggcctgtgatatcaccggatccagttcatccaccgatgacacggcttcactggaccgacattcttctcatggcagtgatgtgtctctctcccagattttaaagccaaacaggtcaagagatcggcaaagccttgatggattctacagccatgggatgggagctgagggtcgagaaagtgagagtgagcctgctgacccaggcgacgtggaggaggaggagatggacagtatcactgaagtgcctgcaaactgctctgtcctaaggagctccatgcgctctctttctcccttccggaggcacagctgggggcctgggaaaaatgcagccagcgatgcagaaatgaaccaccggagttcaatgcgagttcttggggatgttgtcaggagacctcccattcataggagaagtttcagtctagaaggcttgacaggaggagctggtgtcggaaacaagccatcctcatctctagaagtaagctctgcaaatgccgaagagctcagacacccattcagtggtgaggaacgggttgactctttggtgtcactttcagaagaggatctggagtcagaccagagagaacataggatgtttgatcagcagatatgtcacagatctaagcagcagggatttaattactgtacatcagccatttcctctccattgacaaaatccatctcattaatgacaatcagccatcctggattggacaattcacggcccttccacagtaccttccacaataccagtgctaatctgactgagagtataacagaagagaactataatttcctgccacatagcccctccaagaaagattctgaatggaagagtggaacaaaagtcagtcgtacattcagctacatcaagaataaaatgtctagcagcaagaagagcaaagaaaaggaaaaagaaaaagataagattaaggagaaggagaaagattctaaagacaaggagaaagataagaagactgtcaacgggcacactttcagttccattcctgttgtgggtcccatcagctgtagccagtgtatgaagcccttcaccaacaaagatgcctatacttgtgcaaattgcagtgcttttgtccacaaaggctgccgagaaagtctagcctcctgtgcaaaggtcaaaatgaagcagcccaaagggagccttcaggcacatgacacatcatcactgcccacggtcattatgagaaacaagccctcacagcccaaggagcgtcctcggtccgcagtcctcctggtggatgaaaccgctaccaccccaatatttgccaatagacgatcccagcagagtgtctcgctctccaaaagtgtctccatacagaacattactggagttggcaatgatgagaacatgtcaaacacctggaaattcctgtctcattcaacagactcactaaataaaatcagcaaggtcaatgagtcaacagaatcacttactgatgagggagtaggtacagacatgaatgaaggacaactactgggagactttgagattgagtccaaacagctggaagcagagtcttggagtcggataatagacagcaagtttctaaaacagcaaaagaaagatgtggtcaaacggcaagaagtaatatatgagttgatgcagacagagtttcatcatgtccgcactctcaagatcatgagtggtgtgtacagccaggggatgatggcggatctgctttttgagcagcagatggtagaaaagctgttcccctgtttggatgagctgatcagtatccatagccaattcttccagaggattctggagcggaagaaggagtctctggtggataaaagtgaaaagaactttctcatcaagaggataggggatgtgcttgtaaatcagttttcaggtgagaatgcagaacgtttaaagaagacatatggcaagttttgtgggcaacataaccagtctgtaaactacttcaaagacctttatgccaaggataagcgttttcaagcctttgtaaagaagaagatgagcagttcagttgttagaaggcttggaattccagagtgcatattgcttgtaactcagcggattaccaagtacccagttttattccaaagaatattgcagtgtaccaaagacaatgaagtggagcaggaagatctagcacagtccttgagcctggtgaaggatgtgattggagctgtagacagcaaagtggcaagttatgaaaagaaagtgcgtctcaatgagatttatacaaagacagatagcaagtcaatcatgaggatgaagagtggtcagatgtttgccaaggaagatttgaaacggaagaagcttgtacgtgatgggagtgtgtttctgaagaatgcagcaggaaggttgaaagaggttcaagcagttcttctcactgacattttagttttccttcaagaaaaagaccagaagtacatctttgcatcattggaccagaagtcaacagtgatctctttaaagaagctgattgtgagagaagtggcacatgaggagaaaggtttattcctgatcagcatggggatgacagatccagagatggtagaagtccatgccagctccaaagaggaacgaaacagctggattcagatcattcaggacacaatcaacaccctgaacagagatgaagatgaaggaattcctagtgagaatgaggaagaaaagaaaatgttggacaccagagcccgagaattaaaagaacaacttcaccagaaggaccaaaaaatcctactcttgttggaagagaaggagatgattttccgggacatggctgagtgcagcacccctctcccagaggattgctccccaacacatagccctagagttctcttccgctccaacacagaagaggctctcaaaggaggacctttaatgaaaagtgcaataaatgaggtggagatccttcagggtttggtgagtggaaatctgggaggcacacttgggccgactgtcagcagccccattgagcaagatgtggtcggtcccgtttccctgccccggagagcagagacctttggaggatttgacagccatcagatgaatgcttcaaaaggaggcgagaaggaagagggagatgatggccaagatcttaggagaacggaatcagatagtggcctaaaaaagggtggaaatgctaacctggtatttatgcttaaaagaaacagtgagcaggttgtccagagcgttgttcatctctacgagctcctcagcgctctgcagggtgtggtgctgcagcaggacagctacattgaggaccagaaactggtgctgagcgagagggcgctcactcgcagcttgtcccgcccgagctccctcattgagcaggagaagcagcgcagcctggagaagcagcgccaggacctggccaacctgcagaagcagcaggcccagtacctcgaggagaagcgcaggcgcgagcgtgagtgggaagctcgtgagagggagctgcgggagcgggaggccctcctggcccagcgcgaggaggaggtgcagcaggggcagcaggacctggaaaaggagcgggaggagctccagcagaagaagggcacataccagtatgacctggagcgactgcgtgctgcccagaaacagcttgagagggaacaggagcagctgcgccgggaggcagagcggctcagccagcggcagacagaacgggacctgtgtcaggtttcccatccacataccaagctgatgaggatcccatcgttcttccccagtcctgaggagcccccctcgccatctgcaccttccatagccaaatcagggtcattggactcagaactttcagtgtccccaaaaaggaacagcatctctcggacacacaaagataaggggccttttcacatactgagttcaaccagccagacaaacaaaggaccagaagggcagagccaggcccctgcgtccacctctgcctctacccgcctgtttgggttaacaaagccaaaggaaaagaaggagaaaaaaaagaagaacaaaaccagccgctctcagcccggtgatggtcccgcgtcagaagtatcagcagagggtgaagagatcttctgctga

SEQ ID NO: 103077 - DNA, 660 bp, Homo sapiens
  Payload ID: 105
  Gene Symbol: AKAP13
  Gene Name: A kinase (PRKA) anchor protein 13
  ENST ID: ENST00000557852
  CDS Start-End: 162-660
aggaaacaagcagcctcagccctccctccttccctttctcagccagtctctggcttcctcttacgatttcactaatggcagctcaaagctgctgagctctgccctgacggcatgcgcccccgcttctgtgagagcacgcttcctggcatgggggtcgaatcatgtcgataaaatgggctcggtttcatgaagtaccccacataacagtgagattcataggaccaaagcatggggaggaaaaggaaaaagaaaaagataagattaaggagaaggagaaagattctaaagacaaggagaaagataagaagactgtcaacgggcacactttcagttccattcctgttgtgggtcccatcagctgtagccagtgtatgaagcccttcaccaacaaagatgcctatacttgtgcaaattgcagtgcttttgtccacaaaggctgccgagaaagtctagcctcctgtgcaaaggtcaaaatgaagcagcccaaagggagccttcaggcacatgacacatcatcactgcccacggtcattatgagaaacaagccctcacagcccaaggagcgtcctcggtccgcagtcctcctggtggatgaaaccgctaccaccccaatatttgccaatagacgatcccagcagagtgtctcgctctccaaaagtg

SEQ ID NO: 103078 - DNA, 3297 bp, Homo sapiens
  Payload ID: 105
  Gene Symbol: AKAP13
  Gene Name: A kinase (PRKA) anchor protein 13
  ENST ID: ENST00000560676
  CDS Start-End: 397-3297
atcggccgttatgcttagccagtttattctttatttttttactggagtcattgccagtgatggaaacggtgtttgcttctctttcagtcaagatctgcacaaagtatagcattaggtggtatttattgtttatattatgagttctacattcatctttccagcactctgaagttatcagcaagttctcagtcagttcaaggcattggattctgcttgatttctttttaattcattgtttttgacccctttgagagttttaatagagaggagtctggaaggcagagatctccaccacctaaccgtgagaaatttggaactaaggacttgcactggtccccaagttaacagtggatatacttcctgcattttctctgttctttcttgcatttgggcaaaatgtatgaacggcacaagaggcgctacagcctctgtgacatctccaaggtggacaggactgtggacgtggtattgctgaagataaaccgagaaaactggtgtacaatagagccatgccctgatgcagcatctcttctggcttccaagcagagcccagaatgtgagaacttcctggatgttggactgggcagagagtgtacctcaaaacaaggtgtacttaaaagagaatctgggagtgattctgacctctttcactcacccagtgatgacatggacagcatcatcttcccaaagccagaggaagagcatttggcctgtgatatcaccggatccagttcatccaccgatgacacggcttcactggaccgacattcttctcatggcagtgatgtgtctctctcccagattttaaagccaaacaggtcaagagatcggcaaagccttgatggattctacagccatgggatgggagctgagggtcgagaaagtgagagtgagcctgctgacccaggcgacgtggaggaggaggagatggacagtatcactgaagtgcctgcaaactgctctgtcctaaggagctccatgcgctctctttctcccttccggaggcacagctgggggcctgggaaaaatgcagccagcgatgcagaaatgaaccaccggagtttcagtctagaaggcttgacaggaggagctggtgtcggaaacaagccatcctcatctctagaagtaagctctgcaaatgccgaagagctcagacacccattcagtggtgaggaacgggttgactctttggtgtcactttcagaagaggatctggagtcagaccagagagaacataggatgtttgatcagcagatatgtcacagatctaagcagcagggatttaattactgtacatcagccatttcctctccattgacaaaatccatctcattaatgacaatcagccatcctggattggacaattcacggcccttccacagtaccttccacaataccagtgctaatctgactgagagtataacagaagagaactataatttcctgccacatagcccctccaagaaagattctgaatggaagagtggaacaaaagtcagtcgtacattcagctacatcaagaataaaatgtctagcagcaagaagagcaaagaaaaggaaaaagaaaaagataagattaaggagaaggagaaagattctaaagacaaggagaaagataagaagactgtcaacgggcacactttcagttccattcctgttgtgggtcccatcagctgtagccagtgtatgaagcccttcaccaacaaagatgcctatacttgtgcaaattgcagtgcttttgtccacaaaggctgccgagaaagtctagcctcctgtgcaaaggtcaaaatgaagcccaaagggagccttcaggcacatgacacatcatcactgcccacggtcattatgagaaacaagccctcacagcccaaggagcgtcctcggtccgcagtcctcctggtggatgaaaccgctaccaccccaatatttgccaatagacgatcccagcagagtgtctcgctctccaaaagtgtctccatacagaacattactggagttggcaatgatgagaacatgtcaaacacctggaaattcctgtctcattcaacagactcactaaataaaatcagcaaggtcaatgagtcaacagaatcacttactgatgagggagtaggtacagacatgaatgaaggacaactactgggagactttgagattgagtccaaacagctggaagcagagtcttggagtcggataatagacagcaagtttctaaaacagcaaaagaaagatgtggtcaaacggcaagaagtaatatatgagttgatgcagacagagtttcatcatgtccgcactctcaagatcatgagtggtgtgtacagccaggggatgatggcggatctgctttttgagcagcagatggtagaaaagctgttcccctgtttggatgagctgatcagtatccatagccaattcttccagaggattctggagcggaagaaggagtctctggtggataaaagtgaaaagaactttctcatcaagaggataggggatgtgcttgtaaatcagttttcaggtgagaatgcagaacgtttaaagaagacatatggcaagttttgtgggcaacataaccagtctgtaaactacttcaaagacctttatgccaaggataagcgttttcaagcctttgtaaagaagaagatgagcagttcagttgttagaaggcttggaattccagagtgcatattgcttgtaactcagcggattaccaagtacccagttttattccaaagaatattgcagtgtaccaaagacaatgaagtggagcaggaagatctagcacagtccttgagcctggtgaaggatgtgattggagctgtagacagcaaagtggcaagttatgaaaagaaagtgcgtctcaatgagatttatacaaagacagatagcaagtcaatcatgaggatgaagagtggtcagatgtttgccaaggaagatttgaaacggaagaagcttgtacgtgatgggagtgtgtttctgaagaatgcagcaggaaggttgaaagaggttcaagcagttcttctcactgacattttagttttccttcaagaaaaagaccagaagtacatctttgcatcattggaccagaagtcaacagtgatctctttaaagaagctgattgtgagagaagtggcacatgaggagaaaggtttattcctgatcagcatggggatgacagatccagagatggtagaagtccatgccagctccaaagaggaacgaaacagctggattcagatcattcaggacacaatcaacaccctgaacagagatgaagatgaaggaattcctagtgag

SEQ ID NO: 103079 - DNA, 425 bp, Homo sapiens
  Payload ID: 105
  Gene Symbol: AKAP13
  Gene Name: A kinase (PRKA) anchor protein 13
  ENST ID: ENST00000612418
  CDS Start-End: 227-425
gtctaaaactctcttttctcttggctcttcttattcgagtgatgaggaggaggagttgcataattcacggcccttccacagtaccttccacaataccagtgctaatctgactgagagtataacagaagagaactataatttcctgccacatagcccctccaagaaagattctgaatggaagagtggaacaaaagtcagtcgtacattcagctacatcaagaataaaatgtctagcagcaagaagagcaaagaaaaggaaaaagaaaaagataagattaaggagaaggagaaagattctaaagacaaggagaaagataagaagactgtcaacgggcacactttcagttccattcctgttgtgggtcccatcagctgtagccagtgtatgaagcccttcaccaacaaagatgcctatacttgtgcaa

SEQ ID NO: 103080 - DNA, 553 bp, Homo sapiens
  Payload ID: 105
  Gene Symbol: AKAP13
  Gene Name: A kinase (PRKA) anchor protein 13
  ENST ID: ENST00000560340
  CDS Start-End: 258-553
tcacacagcagcctgttccatctgtgggtaaccatgttccgaggcagcaaagagaaaccgctattgctccgtggaaataaactatctgaataaaacttcttaacgggggttgaggctgaagctgaaacgggagtcggacacgatcttggctcctgaagtctttaaaggtcagtttgatgcacacttctataccaccacctgttaccagctgtagacagaagacctatctccatgcttgcccctaggcttttgtagaaatgccagacgtgaaagctgaagatgaagtggattttagagcaagttcaatttctgaagaagtggctgtagggagcatagctgctacactgaagatgaagcaaggcccaatgacccaggcgataaaccgagaaaactggtgtacaatagagccatgccctgatgcagcatctcttctggcttccaagcagagcccagaatgtgagaacttcctggatgttggactgggcagagagtgtacctcaaaacaaggtgtacttaaaagagaatctgggagtgattctgacctctttcactc

SEQ ID NO: 103081 - DNA, 608 bp, Homo sapiens
  Payload ID: 106
  Gene Symbol: AKAP14
  Gene Name: A kinase (PRKA) anchor protein 14
  Uniprot ID: Q86UN6
  ENST ID: ENST00000334356
  CDS Start-End: 86-499
actgagagaatcctgagacatccccagccacctaccactgctcctgttccaagcaaagaagatctgctcactccggaaaaagaaaatgagtgagactcaaaattcaacaagccagaaagcaatggatgaggataacaaagccgcaagccaaacaatgccgaatacacaagacaagaactacgaggatgaattgactcaagtagctctagctctggttgaggatgtcatcaattatgctgttaagattgtggaagaggagcgaaaccctttgaaaaacatcaagtggatgactcacggtgaattcactgtggaaaagggtcttaaacaaattgacgaatatttttcggatgcacccattgttgtttcttatgtaggtgaccaccaagcattagttcacagaccaggaatggttcgctttcgagaaaactggcagaagaatcttactgatgccaaatatagtttcatggagtcattccccttcttattcaatcgtgtctgatacttacaggatgtcttaggattgtttttctcatcaggatacattaaaaatacaatacagcacgtcaaaccacagaatatttattgagtaataaacttgtggcacacaa

SEQ ID NO: 103082 - DNA, 412 bp, Homo sapiens
  Payload ID: 106
  Gene Symbol: AKAP14
  Gene Name: A kinase (PRKA) anchor protein 14
  Uniprot ID: Q86UN6
  ENST ID: ENST00000371422
  CDS Start-End: 86-355
actgagagaatcctgagacatccccagccacctaccactgctcctgttccaagcaaagaagatctgctcactccggaaaaagaaaatgagtgagactcaaaattcaacaagccagaaagcaatggatgaggataacaaagccgcaagccaaacaatgccgaatacacaagacaagaactacgaggatgaattgactcaagtagctctagctctggttgaggatgtcatcaattatgctgttaagattgtggaagaggagcgaaaccctttgaaaaacatcaagtggatgactcacggtgaattcactgtggaaaagggtcttaaacaaattgacgaatatttttcggtaagttaggccgaccactccagcatggtacaccggtgtgaagaacaataaagagactctcagcag

SEQ ID NO: 103083 - DNA, 793 bp, Homo sapiens
  Payload ID: 106
  Gene Symbol: AKAP14
  Gene Name: A kinase (PRKA) anchor protein 14
  Uniprot ID: Q86UN6
  ENST ID: ENST00000371425
  CDS Start-End: 275-688
ttgtgaggagtaaatgacttcagacactgaaggcttaacacagtgactggcatatcatagggatgcccaatacataccagctgtgaggcttatcaccactgttcttcctggcatggccctgtaagctcatcttcggctgaagagaagctagcacttgcaaacattccatctggcaatctgagagaagctactgagagaatcctgagacatccccagccacctaccactgctcctgttccaagcaaagaagatctgctcactccggaaaaagaaaatgagtgagactcaaaattcaacaagccagaaagcaatggatgaggataacaaagccgcaagccaaacaatgccgaatacacaagacaagaactacgaggatgaattgactcaagtagctctagctctggttgaggatgtcatcaattatgctgttaagattgtggaagaggagcgaaaccctttgaaaaacatcaagtggatgactcacggtgaattcactgtggaaaagggtcttaaacaaattgacgaatatttttcggatgcacccattgttgtttcttatgtaggtgaccaccaagcattagttcacagaccaggaatggttcgctttcgagaaaactggcagaagaatcttactgatgccaaatatagtttcatggagtcattccccttcttattcaatcgtgtctgatacttacaggatgtcttaggattgtttttctcatcaggatacattaaaaatacaatacagcacgtcaaaccacagaatatttattgagtaataaacttgtggcac

SEQ ID NO: 103084 - DNA, 977 bp, Homo sapiens
  Payload ID: 106
  Gene Symbol: AKAP14
  Gene Name: A kinase (PRKA) anchor protein 14
  Uniprot ID: Q86UN6
  ENST ID: ENST00000371431
  CDS Start-End: 275-868
ttgtgaggagtaaatgacttcagacactgaaggcttaacacagtgactggcatatcatagggatgcccaatacataccagctgtgaggcttatcaccactgttcttcctggcatggccctgtaagctcatcttcggctgaagagaagctagcacttgcaaacattccatctggcaatctgagagaagctactgagagaatcctgagacatccccagccacctaccactgctcctgttccaagcaaagaagatctgctcactccggaaaaagaaaatgagtgagactcaaaattcaacaagccagaaagcaatggatgaggataacaaagccgcaagccaaacaatgccgaatacacaagacaagaactacgaggatgaattgactcaagtagctctagctctggttgaggatgtcatcaattatgctgttaagattgtggaagaggagcgaaaccctttgaaaaacatcaagtggatgactcacggtgaattcactgtggaaaagggtcttaaacaaattgacgaatatttttcgaagtgtgtttctaaaaaatgctgggcacatggcgtagagtttgtagagaggaaagacttaattcacagcttcctctacatctactatgtacactggagtatctcaactgctgacctacccgtagcacgaatctctgctggtacctacttcaccatgaaggtctccaaaaccaaaccaccggatgcacccattgttgtttcttatgtaggtgaccaccaagcattagttcacagaccaggaatggttcgctttcgagaaaactggcagaagaatcttactgatgccaaatatagtttcatggagtcattccccttcttattcaatcgtgtctgatacttacaggatgtcttaggattgtttttctcatcaggatacattaaaaatacaatacagcacgtcaaaccacagaatatttattgagtaataaacttgtggcacacaa

SEQ ID NO: 103085 - DNA, 3204 bp, Homo sapiens
  Payload ID: 107
  Gene Symbol: AKAP17A
  Gene Name: A kinase (PRKA) anchor protein 17A
  Uniprot ID: Q02040
  ENST ID: ENST00000313871
  CDS Start-End: 197-2284
agtggaaatgcgtcatagagggcgggcggcgacggcggtggcggcgtcggaggcgcctccgggggacggtggcggctcccggcggtgaggccgcgcctgtccggggatcgtcgagggacggcgggagcttgggccagcggcggcggcggcctgggacgcaggcggagccccgcgcaggcccaaggtcccggaggctatggcagcggctaccatcgtgcacgacacgtctgaggccgtggagctctgccctgcttacggcttgtacctgaagcccatcaccaagatgaccatcagcgtggcactcccgcagctgaagcagccggggaagtccatctccaactgggaggtgatggagaggctgaagggcatggtgcagaaccaccagttctccacgctgcgtatttccaagagcaccatggacttcatccgcttcgagggggaggtggagaacaagagcctggtcaagtcttttctggcctgcctggacggcaagaccatcaagctcagcggcttctccgacatcctgaaggtgcgcgcggccgagttcaagatcgacttccccacccgccacgactgggactccttcttccgcgacgccaaggacatgaacgagaccctgccgggggagcggccggacaccatccacctggaggggctgccctgcaagtggttcgccctgaaggagtcgggctccgagaagcccagcgaggacgtcctggtcaaggtgtttgagaagttcggggagatccggaatgtggacatccccatgctggacccctaccgggaggagatgacgggccgcaacttccacaccttcagtttcggggggcacttgaacttcgaggcctatgtgcagtaccgcgagtacatgggcttcatccaggccatgagcgccctgcgcgggatgaaactcatgtacaagggcgaggacggcaaggccgtggcctgcaacatcaaggtttcttttgattcgaccaaacacctgagtgatgcctcaattaagaagcggcagctggagaggcagaagcttcaggaactggagcagcaaagagaagaacaaaagcgcagagagaaggaagcggaggagaggcagcgagcggaggaaaggaaacaaaaggagctggaagagctggagcgagagaggaaaagagaagagaagcttcgcaagagggagcagaagcagagggaccgtgagctgcgccggaatcagaagaagctggagaagctgcaggcggaggagcagaagcagctgcaggagaagatcaagctggaggagcgcaagctgctgctggcccagaggaacctgcagtccatccggctcatcgccgagctgctcagcagagccaaggctgtgaagctacgggaacaggagcagaaggaggagaagctgaggctccagcagcaggaggagcggcggcggctgcaggaggccgagctgcggcgcgtggaggaggagaaggagcgcgcgctgggcctgcagcggaaagagcgggagctgcgcgagcggctgctgagcatcctgctgagcaagaagccggacgacagccacacacacgacgagctgggcgtggcacacgccgacctgctgcagcccgtcctggacatcctgcagaccgtgtcgtccggctgtgtgagcgccaccacgctgcaccccctcgggggccagcccccggccggtgcccccaaggagagcccggcccacccagaggccgacggcgctcccaaaagcgtgaacgggagcgtggccgaggaggccccatgcaaggaggttcagagctcctgtcgtgtggtccccgaggatggctctccagagaagaggtgcccgggcggcgtcctctcctgcattcctgacaacaaccaacagcccaagggcatccctgcctgcgagcagaatgtctccagaaaggacacccggtcagaacaggacaagtgcaaccgggagcccagcaagggccggggccgggccaccggagacgggcttgctgaccggcacaagcgggagaggagccgggccaggcgggccagcagcagggaggacgggaggccacgcaaggagcggcggccccacaagaagcacgcctacaaggatgacagcccccgccggcgcagcacgagcccggaccacacccggtcccggaggtcccacagcaaagacaggcaccggagggagcggagccgggagcggaggggcagcgccagcaggaagcacagccgccaccgccgccgaagcgagcggtcgcgctcccggtccccgagcaggcaccgcagtacctggaacaggtaatgacgggcacggcctccccacggcctgtccgggaaagaccaggacctgctcgagcctcctggccgctccttggccgctctccgtccacccctgcaaagccaagacccttctgcagccacgaatgtccacggagcccgccggcaggaaggaagacaccatgctttagagatccatctttctccactcaccgcagcgtacttggcacttcagtttcaaacacgtagtcctttaaaacttgatccgatagctttaatgcggccggtcctctctcagtcaggaaaattgcacagaccgacagtcgtgaggatggcagagctgctgcattcccccacacggggatttctgtgtctgcttggcgacctccctgcgtgcacggcctaggaggtgcacgggccaccatagtcacactggcactgaaaagaaagcgttgccctggtgattctttcccccccgtttgtaatgttaactgatcaggaagtgcagtttgggtgggatgccgaatcgtcgtgctgacattgagtcacggatgaggaaggtacaagtcctttaagatcaaaactcaaacgggccgttctttctaaggtgtcggtatgtggggagtggtacaaaatggtctgatgctccttcaaaaacattcactttttacaacgtcaaggaattaagcataaaaaagattggttaaaagctttggtttctagtaaaggttagtgtgtgtggtttttttaagaagctgttttgctaaattatttttacttggaatgtttcaaacagatttcaggctgcaaacttgttttataatcgtttgcttctccaagtgaagctcagaaatacctaaaaatagctgtaacgttcgcgttaggaaagatggtgtttattccagtttgcatttttatggtgaaataaaatccttttccaatgaa

SEQ ID NO: 103086 - DNA, 2187 bp, Homo sapiens
  Payload ID: 107
  Gene Symbol: AKAP17A
  Gene Name: A kinase (PRKA) anchor protein 17A
  ENST ID: ENST00000381261
  CDS Start-End: 165-1505
cggcggtggcggcgtcggaggcgcctccgggggacggtggcggctcccggcggtgaggccgcgcctgtccggggatcgtcgagggacggcgggagcttgggccagcggcggcggcggcctgggacgcaggcggagccccgcgcaggcccaaggtcccggaggctatggcagcggctaccatcgtgcacgacacgtctgaggccgtggagctctgccctgcttacggcttgtacctgaagcccatcaccaagatgaccatcagcgtggcactcccgcagctgaagcagccggggaagtccatctccaactgggaggtgatggagaggctgaagggcatggtgcagaaccaccagttctccacgctgcgtatttccaagagcaccatggacttcatccgcttcgagggggaggtggagaacaagagcctggtcaagtcttttctggcctgcctggacggcaagaccatcaagctcagcggcttctccgacatcctgaaggtgcgcgcggccgagttcaagatcgacttccccacccgccacgactgggactccttcttccgcgacgccaaggacatgaacgagaccctgccgggggagcggccggacaccatccacctggaggggctgccctgcaagtggttcgccctgaaggagtcgggctccgagaagcccagcgaggacgtcctggtcaaggtgtttgagaagttcggggagatccggaatgtggacatccccatgctggacccctaccgggaggagatgacgggccgcaacttccacaccttcagtttcggggggcacttgaacttcgaggcctatgtgcagtaccgcgagtacatgggcttcatccaggccatgagcgccctgcgcgggatgaaactcatgtacaagggcgaggacggcaaggccgtggcctgcaacatcaaggtttcttttgattcgaccaaacacctgagtgatgcctcaattaagaagcggcagctggagaggcagaagcttcaggaactggagcagcaaagagaagaacaaaagcgcagagagaaggaagcggaggagaggcagcgagcggaggaaaggaaacaaaaggagctggaagagctggagcgagagaggaaaagagaagagaagcttcgcaagagggagcagaagcagagggaccgtgagctgcgccggaatcagaagaagctggagaagctgcaggcggaggagcagaagcagctgcaggagaagatcaagctggaggagcgcaagctgctgctggcccagaggaacctgcagtccatccggctcatcgccgagctgctcagcagagccaaggtacccgggggctccctctgcagccgccagccgcgcccgggctgccctcagtgccctcccctgaaatgcgggcggcgtcacggcgccgtttccccgccggctgcagctgtagctacgaaaccagctttaatgccgaggatgacggctccttcccgggagggtgtagcgctcgtctgtcgttcccgatgatttcagagctgtgacggtttccttttgcaaagctggtgcattcaggttccccgagcaggctggcagcctcccgggggccagggcagaggctctctgtttcctttgggtcggggcagtggcagagagtgcagggggccgctccctctggcccgcgcctctgtgtgtggtcagctggcctggctgtgacctcaccagtggcccagagcagaggggcaaggtgggctggggggagggctgagcgcacagagggggcctgccgtgggcccgggtccctcctccgcagcgtgaacctgacaggtctcaccagcgccggtactgacgaccccctcagcaccaagagcctccctgctcctcctgcaggcgcgactggtaactcccatgagcccggggccagggcccacagacagacagacctccccaggacagacgtccccggcacgctccttgtcctcaggagggctgcgtccccctggagtccaacgcggggcgaccccataacctgttgtctgattacagttgtgataagtccccgggaaggagcatgacaagaggctgagacatgtggcagcccagtccttacctcatggtgaatattgaagacactaacccaggctaggccaggctcgccccgcagctacggcggtggcatgcgtctgcggcgtcatctcagctccctgttgct

SEQ ID NO: 103087 - DNA, 3232 bp, Homo sapiens
  Payload ID: 107
  Gene Symbol: AKAP17A
  Gene Name: A kinase (PRKA) anchor protein 17A
  Uniprot ID: Q02040
  ENST ID: ENST00000474361
  CDS Start-End: 167-1324
gacggcggtggcggcgtcggaggcgcctccgggggacggtggcggctcccggcggtgaggccgcgcctgtccggggatcgtcgagggacggcgggagcttgggccagcggcggcggcggcctgggacgcaggcggagccccgcgcaggcccaaggtcccggaggctatggcagcggctaccatcgtgcacgacacgtctgaggccgtggagctctgccctgcttacggcttgtacctgaagcccatcaccaagatgaccatcagcgtggcactcccgcagctgaagcagccggggaagtccatctccaactgggaggtgatggagaggctgaagggcatggtgcagaaccaccagttctccacgctgcgtatttccaagagcaccatggacttcatccgcttcgagggggaggtggagaacaagagcctggtcaagtcttttctggcctgcctggacggcaagaccatcaagctcagcggcttctccgacatcctgaaggtgcgcgcggccgagttcaagatcgacttccccacccgccacgactgggactccttcttccgcgacgccaaggacatgaacgagaccctgccgggggagcggccggacaccatccacctggaggggctgccctgcaagtggttcgccctgaaggagtcgggctccgagaagcccagcgaggacgtcctggtcaaggtgtttgagaagttcggggagatccggaatgtggacatccccatgctggacccctaccgggaggagatgacgggccgcaacttccacaccttcagtttcggggggcacttgaacttcgaggcctatgtgcagtaccgcgagtacatgggcttcatccaggccatgagcgccctgcgcgggatgaaactcatgtacaagggcgaggacggcaaggccgtggcctgcaacatcaaggtttcttttgattcgaccaaacacctgagtgatgcctcaattaagaagcggcagctggagaggcagaagcttcaggaactggagcagcaaagagaagaacaaaagcgcagagagaaggaagcggaggagaggcagcgagcggaggaaaggaaacaaaaggagctggaagagctggagcgagagaggaaaagagaagagaagcttcgcaagagggagcagaagcagagggaccgtgagctgcgccggaatcagaagaagctggagaagctgcaggcggaggagcagaagcagctgcaggagaagatcaagctggaggagcgcaagctgctgctggcccagaggaacctgcagtccatccggctcatcgccgagctgctcagcagagccaagttgtgataagtccccgggaaggagcatgacaagaggctgagacatgtggcagcccagtccttacctcatggctgtgaagctacgggaacaggagcagaaggaggagaagctgaggctccagcagcaggaggagcggcggcggctgcaggaggccgagctgcggcgcgtggaggaggagaaggagcgcgcgctgggcctgcagcggaaagagcgggagctgcgcgagcggctgctgagcatcctgctgagcaagaagccggacgacagccacacacacgacgagctgggcgtggcacacgccgacctgctgcagcccgtcctggacatcctgcagaccgtgtcgtccggctgtgtgagcgccaccacgctgcaccccctcgggggccagcccccggccggtgcccccaaggagagcccggcccacccagaggccgacggcgctcccaaaagcgtgaacgggagcgtggccgaggaggccccatgcaaggaggttcagagctcctgtcgtgtggtccccgaggatggctctccagagaagaggtgcccgggcggcgtcctctcctgcattcctgacaacaaccaacagcccaagggcatccctgcctgcgagcagaatgtctccagaaaggacacccggtcagaacaggacaagtgcaaccgggagcccagcaagggccggggccgggccaccggagacgggcttgctgaccggcacaagcgggagaggagccgggccaggcgggccagcagcagggaggacgggaggccacgcaaggagcggcggccccacaagaagcacgcctacaaggatgacagcccccgccggcgcagcacgagcccggaccacacccggtcccggaggtcccacagcaaagacaggcaccggagggagcggagccgggagcggaggggcagcgccagcaggaagcacagccgccaccgccgccgaagcgagcggtcgcgctcccggtccccgagcaggcaccgcagtacctggaacaggtaatgacgggcacggcctccccacggcctgtccgggaaagaccaggacctgctcgagcctcctggccgctccttggccgctctccgtccacccctgcaaagccaagacccttctgcagccacgaatgtccacggagcccgccggcaggaaggaagacaccatgctttagagatccatctttctccactcaccgcagcgtacttggcacttcagtttcaaacacgtagtcctttaaaacttgatccgatagctttaatgcggccggtcctctctcagtcaggaaaattgcacagaccgacagtcgtgaggatggcagagctgctgcattcccccacacggggatttctgtgtctgcttggcgacctccctgcgtgcacggcctaggaggtgcacgggccaccatagtcacactggcactgaaaagaaagcgttgccctggtgattctttcccccccgtttgtaatgttaactgatcaggaagtgcagtttgggtgggatgccgaatcgtcgtgctgacattgagtcacggatgaggaaggtacaagtcctttaagatcaaaactcaaacgggccgttctttctaaggtgtcggtatgtggggagtggtacaaaatggtctgatgctccttcaaaaacattcactttttacaacgtcaaggaattaagcataaaaaagattggttaaaagctttggtttctagtaaaggttagtgtgtgtggtttttttaagaagctgttttgctaaattatttttacttggaatgtttcaaacagatttcaggctgcaaacttgttttataatcgtttgcttctccaagtgaagctcagaaatacctaaaaatagctgtaacgttcgcgttaggaaagatggtgtttattccagtttgcatttttatggtgaaataaaatcc

SEQ ID NO: 103088 - DNA, 3101 bp, Homo sapiens
  Payload ID: 108
  Gene Symbol: AKAP2
  Gene Name: A kinase (PRKA) anchor protein 2
  Uniprot ID: Q9Y2D5
  ENST ID: ENST00000259318
  CDS Start-End: 208-2787
aggaatttgtccagcttgagccagggtgcacgcaggaatctgtctggaaaaaggcagttctcactgaggaggtttgaggcgcgcgctctgggcaggaagcctccccagctttctgaggatgatatctggctaaaaagcgagggagacaactatagtgccaccctcctggagcctgctgccagctctctttccccagatcacaaaaacatggaaattgaggtgtctgttgcagaatgtaaaagtgttcctggaatcacctctaccccacatcccatggaccatccctccgctttctattcacccccgcataatggcctccttactgatcaccacgaatccctggataatgatgttgccagagagatccgctatctagatgaggtgctagaggccaactgctgtgattctgctgtggatggaacgtacaatggaacatcctccccagagcctggtgcagtggttctggtgggcggcctaagcccccctgtccacgaggcgacccagccagaacccactgaaagaacagctagccggcaggcacctcctcacatcgagctcagtaatagcagccctgaccccatggcagaggcagaaagaacaaatggccattcccccagccagcctagagatgcgctgggggacagcctgcaggtgcctgtcagccccagctccacaaccagctcacggtgttcttcccgagatggagagttcactctcaccacactgaaaaaggaggccaagtttgagctgcgtgccttccatgaggacaagaagccctccaagctctttgaggatgacgagcatgagaaagaacaatactgcattagaaaagtgaggccttcagaggagatgctggagctggaaaaggagaggagagagctcatccgcagccaggccgtcaagaagaatcctggcattgcagcaaaatggtggaatcccccgcaggaaaaaaccatcgaggagcagctggacgaggaacatctggagtcgcacaaaaagtacaaggagcgcaaagagagaagggcacagcaggaacagttgctgctgcagaagcagttacagcagcagcagcagcagcccccatcgcagctctgcacagcccctgcctcttctcatgaacgcgcaagcatgattgacaaagcaaaggaggacattgtcacagagcagatagatttctctgctgctcgcaaacaatttcagctgatggagaattccaggcaagcggtggccaagggccagagtacacccaggctgttctccatcaagcctttctacaggcctctggggtcagtcaactcagacaagccactgactaatccgagaccaccttctgtcgggggacctccagaagacagtggtgcctcagccgccaagggacagaaatcccccggtgccctggagaccccatcggcagcaggaagccagggcaacacagcctctcaggggaaggaagggccctacagcgagccttctaaacgtgggcccttatctaaactgtgggctgaggatggagaatttacgagcgcccgggctgtcctcactgtggtcaaggatgatgaccatgggattttggatcagttctcaagatctgtcaatgtctccttgacccaagaggagcttgactctggtctggacgaattgtcggtgaggtctcaggataccacagtcctggagaccctatccaatgatttcagcatggacaacatcagtgacagcggggcatccaatgagacaaccaatgccctccaggaaaattcactggctgatttttctctgccccagacaccacaaactgacaacccctcagagggccgaggagaaggcgtctccaagtcatttagtgatcatggtttctattccccttcctccacgctgggggactctccgttggttgatgaccccttggagtatcaggctggcctcctggtgcagaatgccattcaacaagccatagccgagcaggtggataaagctgtgtccaaaaccagcagggatggagcagagcaacagggacctgaagcgactgtagaggaagctgaagctgcggctttcggctcagaaaagcctcagagcatgtttgagccacctcaggtgtcttctcctgttcaagagaaaagggatgtattaccaaagattctgcctgctgaagacagggcgctcagggaaagggggcccccccagccactgccagctgtgcagcccagtggcccgattaacatggaggagaccaggcccgaaggaagctatttcagcaagtactcggaggcagctgagctgagaagcacagcctccctcctggccactcaagaatctgacgtgatggttgggcctttcaagctgaggtccaggaaacagcggactttgtccatgattgaggaagagatccgagcagctcaggaaagggaagaggagctgaagaggcagagacaagtcttgcagagtacgcagagccccaggacaaagaatgccccatcactgccctccagaacatgctacaaaactgctccagggaaaatagagaaagtcaaacctcctccatcccccaccactgaaggccccagcttgcagcctgacttagcccctgaagaggctgccggaacccagcggcccaagaatctgatgcagaccctcatggaagactatgagacacacaaatctaaaaggcgcgagagaatggatgatagtagtgtcctcgaggccacacgggttaatcgaagaaagagcgcactggctttgcgctgggaagcagggatctatgccaaccaggaggaagaagacaacgaataaacttccttcaacccaggaagcgtctttggtgcttgggagaccaagaaaccaagaaattaacaactgaaagcattttaatggactatttattaaagtgcaaacaaactcagcaatccttatgtagaccagaagctgcaatatacaatgatgaaaatgaaacgaaaaggaagtccccccatcagactctggacacccaggaatcaaaagagaaaggacttttttggtgactcaatcccagtgtctggtttggggccaatctacaatggatccaaaaggacaaaacatgttacaagcaaatcaacatagttgctgca

SEQ ID NO: 103089 - DNA, 6866 bp, Homo sapiens
  Payload ID: 108
  Gene Symbol: AKAP2
  Gene Name: A kinase (PRKA) anchor protein 2
  Uniprot ID: Q9Y2D5
  ENST ID: ENST00000374525
  CDS Start-End: 5-2851
gcagatgcgctggccccagcccggggctgccgctcgccttcccccggagtctcctggacccccggagtctcctggacccccggagcgggaggcagcggccgcgcggcgctggactggagcagaaccccaggactgcgcccccgggagcgggcgcccagagaagcctccccagctttctgaggatgatatctggctaaaaagcgagggagacaactatagtgccaccctcctggagcctgctgccagctctctttccccagatcacaaaaacatggaaattgaggtgtctgttgcagaatgtaaaagtgttcctggaatcacctctaccccacatcccatggaccatccctccgctttctattcacccccgcataatggcctccttactgatcaccacgaatccctggataatgatgttgccagagagatccgctatctagatgaggtgctagaggccaactgctgtgattctgctgtggatggaacgtacaatggaacatcctccccagagcctggtgcagtggttctggtgggcggcctaagcccccctgtccacgaggcgacccagccagaacccactgaaagaacagctagccggcaggcacctcctcacatcgagctcagtaatagcagccctgaccccatggcagaggcagaaagaacaaatggccattcccccagccagcctagagatgcgctgggggacagcctgcaggtgcctgtcagccccagctccacaaccagctcacggtgttcttcccgagatggagagttcactctcaccacactgaaaaaggaggccaagtttgagctgcgtgccttccatgaggacaagaagccctccaagctctttgaggatgacgagcatgagaaagaacaatactgcattagaaaagtgaggccttcagaggagatgctggagctggaaaaggagaggagagagctcatccgcagccaggccgtcaagaagaatcctggcattgcagcaaaatggtggaatcccccgcaggaaaaaaccatcgaggagcagctggacgaggaacatctggagtcgcacaaaaagtacaaggagcgcaaagagagaagggcacagcaggaacagttgctgctgcagaagcagttacagcagcagcagcagcagcccccatcgcagctctgcacagcccctgcctcttctcatgaacgcgcaagcatgattgacaaagcaaaggaggacattgtcacagagcagatagatttctctgctgctcgcaaacaatttcagctgatggagaattccaggcaagcggtggccaagggccagagtacacccaggctgttctccatcaagcctttctacaggcctctggggtcagtcaactcagacaagccactgactaatccgagaccaccttctgtcgggggacctccagaagacagtggtgcctcagccgccaagggacagaaatcccccggtgccctggagaccccatcggcagcaggaagccagggcaacacagcctctcaggggaaggaagggccctacagcgagccttctaaacgtgggcccttatctaaactgtgggctgaggatggagaatttacgagcgcccgggctgtcctcactgtggtcaaggatgatgaccatgggattttggatcagttctcaagatctgtcaatgtctccttgacccaagaggagcttgactctggtctggacgaattgtcggtgaggtctcaggataccacagtcctggagaccctatccaatgatttcagcatggacaacatcagtgacagcggggcatccaatgagacaaccaatgccctccaggaaaattcactggctgatttttctctgccccagacaccacaaactgacaacccctcagagggccgaggagaaggcgtctccaagtcatttagtgatcatggtttctattccccttcctccacgctgggggactctccgttggttgatgaccccttggagtatcaggctggcctcctggtgcagaatgccattcaacaagccatagccgagcaggtggataaagctgtgtccaaaaccagcagggatggagcagagcaacagggacctgaagcgactgtagaggaagctgaagctgcggctttcggctcagaaaagcctcagagcatgtttgagccacctcaggtgtcttctcctgttcaagagaaaagggatgtattaccaaagattctgcctgctgaagacagggcgctcagggaaagggggcccccccagccactgccagctgtgcagcccagtggcccgattaacatggaggagaccaggcccgaaggaagctatttcagcaagtactcggaggcagctgagctgagaagcacagcctccctcctggccactcaagaatctgacgtgatggttgggcctttcaagctgaggtccaggaaacagcggactttgtccatgattgaggaagagatccgagcagctcaggaaagggaagaggagctgaagaggcagagacaagtcttgcagagtacgcagagccccaggacaaagaatgccccatcactgccctccagaacatgctacaaaactgctccagggaaaatagagaaagtcaaacctcctccatcccccaccactgaaggccccagcttgcagcctgacttagcccctgaagaggctgccggaacccagcggcccaagaatctgatgcagaccctcatggaagactatgagacacacaaatctaaaaggcgcgagagaatggatgatagtagtgtcctcgaggccacacgggttaatcgaagaaagagcgcactggctttgcgctgggaagcagggatctatgccaaccaggaggaagaagacaacgaataaacttccttcaacccaggaagcgtctttggtgcttgggagaccaagaaaccaagaaattaacaactgaaagcattttaatggactatttattaaagtgcaaacaaactcagcaatccttatgtagaccagaagctgcaatatacaatgatgaaaatgaaacgaaaaggaagtccccccatcagactctggacacccaggaatcaaaagagaaaggacttttttggtgactcaatcccagtgtctggtttggggccaatctacaatggatccaaaaggacaaaacatgttacaagcaaatcaacatagttgctgcaggcggaactgagaccagcctctctgggcgatgaaggacaatggtggtagggccacttagagagcagtagggcccaggctggtgcagcctacatggcacaggatatttccctgcaccagtttcccacctgtcacttgcagcatcagagggtgttgcattaactccattttctccagcagccataaaatgaatggcgtttctctccatatttgcccagaagaggcagttatgattccacttctcctacatttaattatttttaattgagaacaactcatgatcacaattcataaaatccatattttaagacaatagttcttcatgtcacaaacacaatctattctacatgaggaggctgagaaaggggaagagaaaaacaaaccaaatggatgatgttagctttaggatcgtgtctgcttataatattcactgatctgcagtttatgagaacacattttcacagttatgtttcttcataggaaaactatatttagtgggcaacaactatttttatgatgggatgggggagtatatacacgtatagaatctgtacgcgttgaacaacttggttcaagatggtgggggcatttttagagcggcaataattgaaaaaaaaggcgaactctgccttggagaggtagatgataagaaataaaaaggtgtttataactattttgtattataaagtgggccttagagataggaagaagaatgatggattccttttggatcaatcagaaaggaaacacgaaagaaaagtcaggaaggtagagagagaaaaagggagggaaggagaaagaatgggaataaaataaggaggtaagagatactatttttgctgagcaaccagtgtgtttcaggatgatacaaagaaaaatatagaatagaaataagtgcaggcttggaatcagctacaaatcctaaagatggggtgtgtgtggatgtgtgtgtgtgtgtgtgtacaccattgtgtgtttgtaaaatgtgtatgttcatgagtaagggtgtgtgtgtgtgtgtattaaaattccagagtgaccgtggcacttgggtgtacaggtaattcctccagagctgtttgctggcttcaggagtggagtgagaatttcttttttatgaaaagggatataaaggcaccgagctgatgcagtatttgtaatattaagttgacctaacaaggtatttgcatgagtcacaattacaaagttttgagcggttttgtaatttgacatttaggagagtctcctatttattctcatactttacattcatgcttagtatactatagaggatgccagctttaatctttctgtcatttaaagcaatatgataagggtattcaataattgggtgccctaaatttctggatgagaaaattttcaattctggccatgagaaagaaaaaaaaataaacagccttctttttttttcctttgttttaaaactgtggttttttaaaaaagcaataattaactcagacctcactaaaaatcatttttgtttttatattgttatgtcataagctctattatgttattctaacaagtagcaatttcacaaaatttgtatgtagatgttaacgcacatttcctttgcttcttttattagactagtgttgactttggggggggacatttattcacaaatgagaagtaggcacaaagtaaaaaatggaaccatctactaacaaggatcctttaaaactgccaagggagctctaacttgaagccacatcctacagatggcagcccaaatagcacatgggcaattggcaccatctttatatggttgagtctcctgaatattttgaatgaattctcaacaaaatgtgctagccactggggacgcaaaacaagtaagatccctgttgcaagaaattcattttatagtgagggaggttggcatggagactaaaattctcaggaaaatgagatccgtgttagattagaagtcctgatgtgaaatgggaggactcaggaaggaggatcgtctttacctgaggatttctagccagaggtcccagatgcctgggctgagaacccagcgataagggggcgttcccaaagcagacacagggataagaacagaggaggcagcagcattgcacagccccaggcacagtggcagttaggatggctggagagtaggatagttctatgggttgcccaaaaaatgtgatgcgcttcatgttttctctgactcatggatctggtagagaccatagacatgatatagactaacttccccatttttcacaagaggaaaccatccttatgacttaccttaaagttttttgttctgttttgaaggaaaccatgtgcttcatgaaacctacagttgacaagagaatgtacagctaagagaaaagcttaagaggccacactattcgcggaatggctttagaggcagatgaagtggtctttgaccacagttgattgaaccagagcacttattgcttaaagaataacagagttctagagctgggggttcttgggccatgctccgtgtgtggataaggaaagaaatactgtttctgggactctcccacagtcacaaagctgttttcactgtggcccctacatctcttaacttttgctattactcctatgctgccttccggattactgctgtctatcttcttgctccactcactgaagatcctattataatcccatgaaaatgtaaattacagtttacttgggagagccagattttctctgtgctcttgagttttttattcattcaagaaaccttgggccaccgctttgtacatagcaccgtgctaggctctgggatcccaaatggacccttttaactttctgaagatgggaccgtcccctggaggaaagtcattcctgcctaatccatcgagagaaagaggcttacgaaaaactttgcctctgatgctcagccccacccccaaatagcacacaagcttgttaaccccacctcttacaaaatgtttagattctgtaggtgttaaaagcctttctggaagtattgcattctgccgtgtttataggtgttcactttcctccagagctgattaactactgacatgacttggctttctcatccagaaattatggaaacagggtctgtcagtggcaggaggccgtgctgtgttttacttggatgacacaatgcagtttacttgcctcttcatacccatgcatgctgctcaccctagacaatgacatataagccgtatatagatcaatgtccacatatatatacacacacacatatatatatataaagtgtaacaaggaacactaaaacagtgttgattcttgtctctgaagacaaataattaaaccttttttttcccaactaaagaatggatttaattaaactatgtattgaaaaaaaagtagcctaagtgttagagatggtgaatatattccattttagttaaagaacaaatttcctgaattttaagcattcagtgagctgccaattttgattttgtgttgctctttacccaaattattttttctttgtttttctttttttgggggaggaggggaaaaaagcagcaatactgtgtttggaaattatactctgtatctggttttcctgtgtatgttaaccacttaaatgttattatcctgctttggttttagagtgattgtgaggcattcaatgcaagtatacagttattttctcattaaaatccaatgtgtgttgagtttttataaa

SEQ ID NO: 103090 - DNA, 4400 bp, Homo sapiens
  Payload ID: 108
  Gene Symbol: AKAP2
  Gene Name: A kinase (PRKA) anchor protein 2
  Uniprot ID: Q9Y2D5
  ENST ID: ENST00000434623
  CDS Start-End: 103-2988
tactggaggggaagcgaggaggcggggaaggggcgggccccaggagcaggcgggcggggctccccgccctccagcgcgcccggaggctaccactccctgcagatgcgctggccccagcccggggctgccgctcgccttcccccggagtctcctggacccccggagtctcctggacccccggagcgggaggcagcggccgcgcggcgctggactggagcagaaccccaggactgcgcccccgggagcgggcgcccagagaagcctccccagctttctgaggatgatatctggctaaaaagcgagggagacaactatagtgccaccctcctggagcctgctgccagctctctttccccagatcacaaaaacatggaaattgaggtgtctgttgcagaatgtaaaagtgttcctggaatcacctctaccccacatcccatggaccatccctccgctttctattcacccccgcataatggcctccttactgatcaccacgaatccctggataatgatgttgccagagagatccgctatctagatgaggtgctagaggccaactgctgtgattctgctgtggatggaacgtacaatggaacatcctccccagagcctggtgcagtggttctggtgggcggcctaagcccccctgtccacgaggcgacccagccagaacccactgaaagaacagctagccggcaggcacctcctcacatcgagctcagtaatagcagccctgaccccatggcagaggcagaaagaacaaatggccattcccccagccagcctagagatgcgctgggggacagcctgcaggtgcctgtcagccccagctccacaaccagctcacggtgttcttcccgagatggagagttcactctcaccacactgaaaaaggaggccaagtttgagctgcgtgccttccatgaggacaagaagccctccaagctctttgaggatgacgagcatgagaaagaacaatactgcattagaaaagtgaggccttcagaggagatgctggagctggaaaaggagaggagagagctcatccgcagccaggccgtcaagaagaatcctggcattgcagcaaaatggtggaatcccccgcaggaaaaaaccatcgaggagcagctggacgaggaacatctggagtcgcacaaaaagtacaaggagcgcaaagagagaagggcacagcaggaacagttgctgctgcagaagcagttacagcagcagcagcagcagcccccatcgcagctctgcacagcccctgcctcttctcatgaacgcgcaagcatgattgacaaagcaaaggaggacattgtcacagagcagatagatttctctgctgctcgcaaacaatttcagctgatggagaattccaggcaagcggtggccaagggccagagtacacccaggctgttctccatcaagcctttctacaggcctctggggtcagtcaactcagacaagccactgactaatccgagaccaccttctgtcgggggacctccagaagacagtggtgcctcagccgccaagggacagaaatcccccggtgccctggagaccccatcggcagcaggaagccagggcaacacagcctctcaggggaaggaagggccctacagcgagccttctaaacgtgggcccttatctaaactgtgggctgaggatggagaatttacgagcgcccgggctgtcctcactgtggtcaaggatgatgaccatgggattttggatcagttctcaagatctgtcaatgtctccttgacccaagaggagcttgactctggtctggacgaattgtcggtgaggtctcaggataccacagtcctggagaccctatccaatgatttcagcatggacaacatcagtgacagcggggcatccaatgagacaaccaatgccctccaggaaaattcactggctgatttttctctgccccagacaccacaaactgacaacccctcagagggccgaggagaaggcgtctccaagtcatttagtgatcatggtttctattccccttcctccacgctgggggactctccgttggttgatgaccccttggagtatcaggctggcctcctggtgcagaatgccattcaacaagccatagccgagcaggtggataaagctgtgtccaaaaccagcagggatggagcagagcaacagggacctgaagcgactgtagaggaagctgaagctgcggctttcggctcagaaaagcctcagagcatgtttgagccacctcaggtgtcttctcctgttcaagagaaaagggatgtattaccaaagattctgcctgctgaagacagggcgctcagggaaagggggcccccccagccactgccagctgtgcagcccagtggcccgattaacatggaggagaccaggcccgaaggaagctatttcagcaagtactcggaggcagctgagctgagaagcacagcctccctcctggccactcaagaatctgacgtgatggttgggcctttcaagctgaggtccaggaaacagcggactttgtccatgattgaggaagagatccgagcagctcaggaaagggaagaggagctgaagaggcagagacaagtcttgcagagtacgcagagccccaggacaaagaatgccccatcactgccctccagaacatgctacaaaactgctccagggaaaatagagaaagtcaaacctcctccatcccccaccactgaaggccccagcttgcagcctgacttagcccctgaagaggctgccggaacccagcggcccaagaatctgatgcagaccctcatggaagactatgagacacacaaatctaaaaggcgcgagagaatggatgatagtagttacacttctaagttactgtcttgcaaggtgacttccgaggtcctcgaggccacacgggttaatcgaagaaagagcgcactggctttgcgctgggaagcagggatctatgccaaccaggaggaagaagacaacgaataaacttccttcaacccaggaagcgtctttggtgcttgggagaccaagaaaccaagaaattaacaactgaaagcattttaatggactatttattaaagtgcaaacaaactcagcaatccttatgtagaccagaagctgcaatatacaatgatgaaaatgaaacgaaaaggaagtccccccatcagactctggacacccaggaatcaaaagagaaaggacttttttggtgactcaatcccagtgtctggtttggggccaatctacaatggatccaaaaggacaaaacatgttacaagcaaatcaacatagttgctgcaggcggaactgagaccagcctctctgggcgatgaaggacaatggtggtagggccacttagagagcagtagggcccaggctggtgcagcctacatggcacaggatatttccctgcaccagtttcccacctgtcacttgcagcatcagagggtgttgcattaactccattttctccagcagccataaaatgaatggcgtttctctccatatttgcccagaagaggcagttatgattccacttctcctacatttaattatttttaattgagaacaactcatgatcacaattcataaaatccatattttaagacaatagttcttcatgtcacaaacacaatctattctacatgaggaggctgagaaaggggaagagaaaaacaaaccaaatggatgatgttagctttaggatcgtgtctgcttataatattcactgatctgcagtttatgagaacacattttcacagttatgtttcttcataggaaaactatatttagtgggcaacaactatttttatgatgggatgggggagtatatacacgtatagaatctgtacgcgttgaacaacttggttcaagatggtgggggcatttttagagcggcaataattgaaaaaaaaggcgaactctgccttggagaggtagatgataagaaataaaaaggtgtttataactattttgtattataaagtgggccttagagataggaagaagaatgatggattccttttggatcaatcagaaaggaaacacgaaagaaaagtcaggaaggtagagagagaaaaagggagggaaggagaaagaatgggaataaaataaggaggtaagagatactatttttgctgagcaaccagtgtgtttcaggatgatacaaagaaaaatatagaatagaaataagtgcaggcttggaatcagctacaaatcctaaagatggggtgtgtgtggatgtgtgtgtgtgtgtgtgtacaccattgtgtgtttgtaaaatgtgtatgttcatgagtaagggtgtgtgtgtgtgtgtattaaaattccagagtgaccgtggcacttgggtgtacaggtaattcctccagagctgtttgctggcttcaggagtggag

SEQ ID NO: 103091 - DNA, 2520 bp, Homo sapiens
  Payload ID: 108
  Gene Symbol: AKAP2
  Gene Name: A kinase (PRKA) anchor protein 2
  ENST ID: ENST00000480388
  CDS Start-End: 185-2520
aggtgtgtgcgggcaggtacaggatgcgagctcagtcctgcttcccctgaaatcctgtgacctggcagagggctgtgttcctgtgtccttacatcggatgtcctactgaagaaagggaaactgggacgaagctgtaggcacagtgggttctgaagatcagatataactgagggaaagttaggtcatgattgccacctggatgctgttctctctcttcacgaagcctccccagctttctgaggatgatatctggctaaaaagcgagggagacaactatagtgccaccctcctggagcctgctgccagctctctttccccagatcacaaaaacatggaaattgaggtgtctgttgcagaatgtaaaagtgttcctggaatcacctctaccccacatcccatggaccatccctccgctttctattcacccccgcataatggcctccttactgatcaccacgaatccctggataatgatgttgccagagagatccgctatctagatgaggtgctagaggccaactgctgtgattctgctgtggatggaacgtacaatggaacatcctccccagagcctggtgcagtggttctggtgggcggcctaagcccccctgtccacgaggcgacccagccagaacccactgaaagaacagctagccggcaggcacctcctcacatcgagctcagtaatagcagccctgaccccatggcagaggcagaaagaacaaatggccattcccccagccagcctagagatgcgctgggggacagcctgcaggtgcctgtcagccccagctccacaaccagctcacggtgttcttcccgagatggagagttcactctcaccacactgaaaaaggaggccaagtttgagctgcgtgccttccatgaggacaagaagccctccaagctctttgaggatgacgagcatgagaaagaacaatactgcattagaaaagtgaggccttcagaggagatgctggagctggaaaaggagaggagagagctcatccgcagccaggccgtcaagaagaatcctggcattgcagcaaaatggtggaatcccccgcaggaaaaaaccatcgaggagcagctggacgaggaacatctggagtcgcacaaaaagtacaaggagcgcaaagagagaagggcacagcaggaacagttgctgctgcagaagcagttacagcagcagcagcagcagcccccatcgcagctctgcacagcccctgcctcttctcatgaacgcgcaagcatgattgacaaagcaaaggaggacattgtcacagagcagatagatttctctgctgctcgcaaacaatttcagctgatggagaattccaggcaagcggtggccaagggccagagtacacccaggctgttctccatcaagcctttctacaggcctctggggtcagtcaactcagacaagccactgactaatccgagaccaccttctgtcgggggacctccagaagacagtggtgcctcagccgccaagggacagaaatcccccggtgccctggagaccccatcggcagcaggaagccagggcaacacagcctctcaggggaaggaagggccctacagcgagccttctaaacgtgggcccttatctaaactgtgggctgaggatggagaatttacgagcgcccgggctgtcctcactgtggtcaaggatgatgaccatgggattttggatcagttctcaagatctgtcaatgtctccttgacccaagaggagcttgactctggtctggacgaattgtcggtgaggtctcaggataccacagtcctggagaccctatccaatgatttcagcatggacaacatcagtgacagcggggcatccaatgagacaaccaatgccctccaggaaaattcactggctgatttttctctgccccagacaccacaaactgacaacccctcagagggccgaggagaaggcgtctccaagtcatttagtgatcatggtttctattccccttcctccacgctgggggactctccgttggttgatgaccccttggagtatcaggctggcctcctggtgcagaatgccattcaacaagccatagccgagcaggtggataaagctgtgtccaaaaccagcagggatggagcagagcaacagggacctgaagcgactgtagaggaagctgaagctgcggctttcggctcagaaaagcctcagagcatgtttgagccacctcaggtgtcttctcctgttcaagagaaaagggatgtattaccaaagattctgcctgctgaagacagggcgctcagggaaagggggcccccccagccactgccagctgtgcagcccagtggcccgattaacatggaggagaccaggcccgaaggaagctatttcagcaagtactcggaggcagctgagctgagaagcacagcctccctcctggccactcaagaatctgacgtgatggttgggcctttcaagctgaggtccaggaaacagcggactttgtccatgattgaggaagagatccgagcagctca

SEQ ID NO: 103092 - DNA, 572 bp, Homo sapiens
  Payload ID: 108
  Gene Symbol: AKAP2
  Gene Name: A kinase (PRKA) anchor protein 2
  ENST ID: ENST00000495980
  CDS Start-End: 3-167
agatgcgctggccccagcccggggctgccgctcgccttcccccggagtctcctggacccccggagtctcctggacccccggagcgggaggcagcggccgcgcggcgctggactggagcagaaccccaggactgcgcccccgggagcgggcgcccagagggaaaatagagaaagtcaaacctcctccatcccccaccactgaaggccccagcttgcagcctgacttagcccctgaagaggctgccggaacccagcggcccaagaatctgatgcagaccctcatggaagactatgagacacacaaatctaaaaggcgcgagagaatggatgatagtagtgtcctcgaggccacacgggttaatcgaagaaagagcgcactggctttgcgctgggaagcagggatctatgccaaccaggaggaagaagacaacgaataaacttccttcaacccaggaagcgtctttggtgcttgggagaccaagaaaccaagaaattaacaactgaaagcattttaatggactatttattaaagtgcaaacaaactcagcaatccttatgtagaccagaagctgc

SEQ ID NO: 103093 - DNA, 3339 bp, Homo sapiens
  Payload ID: 109
  Gene Symbol: AKAP3
  Gene Name: A kinase (PRKA) anchor protein 3
  Uniprot ID: O75969
  ENST ID: ENST00000228850
  CDS Start-End: 548-3109
gtctgcgcaagcgctaaccaagaaacgacggtttcgggtagattgttggttaagaagaaagctgggaaagtgaaggagagggggaagaaaggaagtgaaaagactttggctgttggaatctcagatctggaataggctgtataggctatttataatctctaattgccgaggaacctgaagttcagagttaaccagtgactgactcaggacatgcaaaatggcaagacccgaggtagaagagctcacctttcctgactctcagtttcctgttccctgaaaatgtaagctaagctggcagccctgtcccagcaagggggaggtacatggaaggccacaggaagaaacaagatcttgagctgagcaagaacatcccagcatcttcattgactttaaaagtatattctggagtcttccgtggttcactattccagtactacagagattccttatattacatggcaggaggggggtaaactgagggatagtgaagacaacaataaattaatcaagagctttcctcatatctcagaacctatcctctgtaagaatgtcagaaaaggttgactggttacaaagccaaaatggagtatgcaaagttgatgtctattctcctggagacaaccaagcccaggactggaaaatggacacctccacggatcctgtcagagtgctcagctggctccgcagagacctggagaagagtacagcagagttccaagatgttcggttcaaacccggagaatcatttggtggggaaacgtccaactcaggagacccacacaaaggtttctctgtagactattacaacaccaccaccaagggcactccagaaagattgcattttgagatgactcacaaagagattccttgccagggccccagggcccaacttggcaacgggagttcagtagatgaagtttccttctatgctaaccgcctcacgaatctagtcatagccatggcccgcaaagagatcaatgagaagatcgatggctctgaaaacaaatgtgtctatcagtcattgtacatggggaatgaacccacacccaccaaaagcctcagtaagatagcatcagagcttgtgaatgagaccgtctctgcatgttccaggaatgctgccccagacaaggctcctggctctggagacagagtctcgggatcatcacaaagtcccccaaatttgaaatacaagtccactttgaagatcaaggagagcaccaaagaaagacagggtccagatgacaagcctccttctaagaagtctttcttctataaggaagtgtttgaatctcgtaatggagattatgccagagagggtggaaggttctttcctcgggagagaaagaggtttcgagggcaggaaaggcctgatgactttacggcttctgttagtgaagggatcatgacctatgctaacagtgtggtatctgatatgatggtctccatcatgaagacactgaagatccaagtgaaagacacaaccattgccaccatcctactgaagaaggttctgctcaagcatgcaaaagaggtggtctcggatctcatcgactccttcttgaggaatctccacagcgtcacagggaccctcatgactgacacacagtttgtctcggctgtgaaaagaactgtcttctctcatggaagccaaaaggccacagatatcatggatgccatgctaaggaagctgtacaatgtaatgtttgccaagaaagtccctgagcatgtcaggaaagcccaagacaaggctgagagttattccctcatctccatgaaaggaatgggtgatcctaaaaaccgaaatgtgaactttgccatgaaatctgaaactaaattgagagaaaaaatgtattctgaacccaaatcagaggaggagacttgtgcgaaaactctgggtgagcacattatcaaagaggggcttaccttgtggcataaaactcagcagaaagaatgtaaatctctaggtttccagcatgcagcatttgaagctcccaacacacagcgtaagcctgcatcagacatttcctttgagtaccctgaagatattggcaacctcagccttcctccatatcctccagagaaacctgagaattttatgtatgattcagactcctgggccgaggacctgatcgtgtctgccctgcttctgattcaatatcacctggcccagggaggaagaagggatgcacggagcttcgttgaagctgctggcaccaccaactttcctgccaatgaacctcctgtagctcccgatgaatcttgccttaagtctgctcccattgtaggtgaccaagaacaagcagaaaagaaggacctaaggagtgttttctttaatttcatccggaacttacttagtgagaccattttcaagcgtgaccagagccctgaacccaaggtgccggaacagccagttaaggaagataggaagttgtgtgaaagaccgttggcgtcttctccccccaggctatatgaggatgatgagacccctggtgccctttctgggctgaccaagatggctgtcagccagatagatggccacatgagtgggcagatggtagaacatctgatgaactcagtgatgaagctgtgtgtcatcattgctaagtcctgtgatgcttcgttggcagagctgggagatgacaagtctggagatgccagtaggctaacttcggccttcccagatagtttatatgagtgcttaccagccaagggcacagggtcagcagaagctgtcctgcagaatgcctatcaagctatccataatgaaatgagaggcacatcaggacagccccctgaagggtgtgcagcacccacggtgattgtcagcaatcacaacctaacggacacagttcagaacaagcaactccaagccgtccttcaatgggtagctgcctctgagctcaatgtccctattttgtattttgctggtgatgatgaagggatccaggagaagctacttcagctctcagctgctgctgtggacaaaggatgcagtgtgggcgaggttctgcagtcggtgctgcgctatgagaaggagcgccagctgaatgaggcggtggggaatgtcacaccgctgcagctgctggactggctgatggtgaacctgtaatcggcaaccccactgctttcccctcttctggcagtggggccggcccttatccccgcccttctttctcacttccacatctccccctctatatcctcacagagccctaacattatcttcacaccactctcatcaaagacatgtcatcttgtgctagccactggattttgcagattttcctgtccatgcaagcaaggacgtaaaattaaaaaattacaattaaagggctccac

SEQ ID NO: 103094 - DNA, 528 bp, Homo sapiens
  Payload ID: 109
  Gene Symbol: AKAP3
  Gene Name: A kinase (PRKA) anchor protein 3
  ENST ID: ENST00000536414
  CDS Start-End: 239-528
aagaaacaagatcttgagctgagcaagaacatcccagcatcttcattgactttaaaagtatattctggagtcttccgtggttcactattccagtactacagagtcatttttatctgtgtctttccattgcagattccttatattacatggcaggaggggggtaaactgagggatagtgaagacaacaataaattaatcaagagctttcctcatatctcagaacctatcctctgtaagaatgtcagaaaaggttgactggttacaaagccaaaatggagtatgcaaagttgatgtctattctcctggagacaaccaagcccaggactggaaaatggacacctccacggatcctgtcagagtgctcagctggctccgcagagacctggagaagagtacagcagagttccaagatgttcggttcaaacccggagaatcatttggtggggaaacgtccaactcaggagacccacacaaaggtttctctgtagactattacaacaccaccaccaagggcactccagaaagatt

SEQ ID NO: 103095 - DNA, 3318 bp, Homo sapiens
  Payload ID: 109
  Gene Symbol: AKAP3
  Gene Name: A kinase (PRKA) anchor protein 3
  Uniprot ID: O75969
  ENST ID: ENST00000545990
  CDS Start-End: 526-3087
gtctgcgcaagcgctaaccaagaaacgacggtttcgggtagattgttggttaagaagaaagctgggaaagtgaaggagagggggaagaaaggaagtgaaaagactttggctgttggaatctcagatctggaataggctgtataggctatttataatctctaattgccgaggaacctgaagttcagagttaaccagtgactgactcaggacatgcaaaatggcaagacccgaggtagaagagctcacctttcctgactctcagtttcctgttccctgaaaattcccagcaagggggaggtacatggaaggccacaggaagaaacaagatcttgagctgagcaagaacatcccagcatcttcattgactttaaaagtatattctggagtcttccgtggttcactattccagtactacagagattccttatattacatggcaggaggggggtaaactgagggatagtgaagacaacaataaattaatcaagagctttcctcatatctcagaacctatcctctgtaagaatgtcagaaaaggttgactggttacaaagccaaaatggagtatgcaaagttgatgtctattctcctggagacaaccaagcccaggactggaaaatggacacctccacggatcctgtcagagtgctcagctggctccgcagagacctggagaagagtacagcagagttccaagatgttcggttcaaacccggagaatcatttggtggggaaacgtccaactcaggagacccacacaaaggtttctctgtagactattacaacaccaccaccaagggcactccagaaagattgcattttgagatgactcacaaagagattccttgccagggccccagggcccaacttggcaacgggagttcagtagatgaagtttccttctatgctaaccgcctcacgaatctagtcatagccatggcccgcaaagagatcaatgagaagatcgatggctctgaaaacaaatgtgtctatcagtcattgtacatggggaatgaacccacacccaccaaaagcctcagtaagatagcatcagagcttgtgaatgagaccgtctctgcatgttccaggaatgctgccccagacaaggctcctggctctggagacagagtctcgggatcatcacaaagtcccccaaatttgaaatacaagtccactttgaagatcaaggagagcaccaaagaaagacagggtccagatgacaagcctccttctaagaagtctttcttctataaggaagtgtttgaatctcgtaatggagattatgccagagagggtggaaggttctttcctcgggagagaaagaggtttcgagggcaggaaaggcctgatgactttacggcttctgttagtgaagggatcatgacctatgctaacagtgtggtatctgatatgatggtctccatcatgaagacactgaagatccaagtgaaagacacaaccattgccaccatcctactgaagaaggttctgctcaagcatgcaaaagaggtggtctcggatctcatcgactccttcttgaggaatctccacagcgtcacagggaccctcatgactgacacacagtttgtctcggctgtgaaaagaactgtcttctctcatggaagccaaaaggccacagatatcatggatgccatgctaaggaagctgtacaatgtaatgtttgccaagaaagtccctgagcatgtcaggaaagcccaagacaaggctgagagttattccctcatctccatgaaaggaatgggtgatcctaaaaaccgaaatgtgaactttgccatgaaatctgaaactaaattgagagaaaaaatgtattctgaacccaaatcagaggaggagacttgtgcgaaaactctgggtgagcacattatcaaagaggggcttaccttgtggcataaaactcagcagaaagaatgtaaatctctaggtttccagcatgcagcatttgaagctcccaacacacagcgtaagcctgcatcagacatttcctttgagtaccctgaagatattggcaacctcagccttcctccatatcctccagagaaacctgagaattttatgtatgattcagactcctgggccgaggacctgatcgtgtctgccctgcttctgattcaatatcacctggcccagggaggaagaagggatgcacggagcttcgttgaagctgctggcaccaccaactttcctgccaatgaacctcctgtagctcccgatgaatcttgccttaagtctgctcccattgtaggtgaccaagaacaagcagaaaagaaggacctaaggagtgttttctttaatttcatccggaacttacttagtgagaccattttcaagcgtgaccagagccctgaacccaaggtgccggaacagccagttaaggaagataggaagttgtgtgaaagaccgttggcgtcttctccccccaggctatatgaggatgatgagacccctggtgccctttctgggctgaccaagatggctgtcagccagatagatggccacatgagtgggcagatggtagaacatctgatgaactcagtgatgaagctgtgtgtcatcattgctaagtcctgtgatgcttcgttggcagagctgggagatgacaagtctggagatgccagtaggctaacttcggccttcccagatagtttatatgagtgcttaccagccaagggcacagggtcagcagaagctgtcctgcagaatgcctatcaagctatccataatgaaatgagaggcacatcaggacagccccctgaagggtgtgcagcacccacggtgattgtcagcaatcacaacctaacggacacagttcagaacaagcaactccaagccgtccttcaatgggtagctgcctctgagctcaatgtccctattttgtattttgctggtgatgatgaagggatccaggagaagctacttcagctctcagctgctgctgtggacaaaggatgcagtgtgggcgaggttctgcagtcggtgctgcgctatgagaaggagcgccagctgaatgaggcggtggggaatgtcacaccgctgcagctgctggactggctgatggtgaacctgtaatcggcaaccccactgctttcccctcttctggcagtggggccggcccttatccccgcccttctttctcacttccacatctccccctctatatcctcacagagccctaacattatcttcacaccactctcatcaaagacatgtcatcttgtgctagccactggattttgcagattttcctgtccatgcaagcaaggacgtaaaattaaaaaattacaattaaagggctccaca

SEQ ID NO: 103096 - DNA, 631 bp, Homo sapiens
  Payload ID: 109
  Gene Symbol: AKAP3
  Gene Name: A kinase (PRKA) anchor protein 3
  ENST ID: ENST00000540967
  CDS Start-End: 147-631
ctctccagtcccagcaagggggaggtacatggaaggccacaggaagaaacaagatcttgagctgagcaagaacatcccagcatcttcattgactttaaaagtatattctggagtcttccgtggttcactattccagtactacagagatgtcagaaaaggttgactggttacaaagccaaaatggagtatgcaaagttgatgtctattctcctggagacaaccaagcccaggactggaaaatggacacctccacggatcctgtcagagtgctcagctggctccgcagagacctggagaagagtacagcagagttccaagatgttcggttcaaacccggagaatcatttggtggggaaacgtccaactcaggagacccacacaaaggtttctctgtagactattacaacaccaccaccaagggcactccagaaagattgcattttgagatgactcacaaagagattccttgccagggccccagggcccaacttggcaacgggagttcagtagatgaagtttccttctatgctaaccgcctcacgaatctagtcatagccatggcccgcaaagagatcaatgagaagatcgatggctctgaaaacaaatgtgtctatcagtcattgtacatggg

SEQ ID NO: 103097 - DNA, 2881 bp, Homo sapiens
  Payload ID: 110
  Gene Symbol: AKAP4
  Gene Name: A kinase (PRKA) anchor protein 4
  Uniprot ID: Q5JQC9
  ENST ID: ENST00000358526
  CDS Start-End: 125-2689
ccagctggcagtcaaggctgtaggagggcatggagagttgaagaaaaaagcagtatcttgaggcagactggaagagtcatcacagcatccaaatcaacaagaaaacatcattccagggtcctacatgatggcgtactctgatactacaatgatgtctgatgatattgactggttacgcagccacaggggtgtgtgcaaggtagatctctacaacccagaaggacagcaagatcaggaccggaaagtgatatgctttgtcgatgtgtccaccctgaatgtagaagataaagattacaaggatgctgctagttccagctcagaaggcaacttaaacctgggaagtctggaagaaaaagagattatcgtgatcaaggacactgagaagaaagaccagtctaagacagagggatctgtatgccttttcaaacaagctccctctgatcctgtaagtgtcctcaactggcttctcagtgatctccagaagtatgccttgggtttccaacatgcactgagcccctcaacctctacctgtaaacataaagtaggagacacagagggcgaatatcacagagcatcctctgagaactgctacagtgtctatgccgatcaagtgaacatagattatttgatgaacagacctcaaaacctacgtctagaaatgacagcagctaaaaacaccaacaataatcaaagtccttcagctcctccagccaaacctcctagcactcagagagcagtcatttcccctgatggagaatgttctatagatgacctttccttctacgtcaaccgactatcttctctggtaatccagatggcccataaggaaatcaaggagaagttggaaggtaaaagcaaatgccttcatcattcaatctgtccatcccctgggaacaaagagagaatcagtccccgaactcctgcgagcaagattgcttctgaaatggcctatgaagctgtggaactgacagctgcagaaatgcgtggcactggagaggagtccagggaaggtggccagaaaagctttctatatagcgaattatccaacaagagcaaaagtggagacaaacagatgtcccagagagagagcaaagaatttgcagattccatcagcaaggggctcatggtttatgcaaatcaggtggcatctgacatgatggtctctctcatgaagaccttgaaagtgcacagctctgggaagccaattccagcatctgtggtcctgaagagggtgttgctaaggcacaccaaggagattgtgtccgatttgattgattcttgcatgaagaacctgcataatattactggggtcctgatgactgactcagactttgtctcagctgtcaagagaaatctgttcaaccagtggaaacaaaatgctacagacatcatggaggccatgctgaagcgcttggtcagtgcccttataggtgaggagaaggagactaagtctcagagtctgtcatatgcatctttaaaagctgggtcccatgatcccaaatgcaggaatcagagtcttgaattctccaccatgaaagctgaaatgaaagagagggacaaaggcaaaatgaaatcagacccatgcaagtcactgactagtgctgagaaagtcggtgaacacattctcaaagagggcctaaccatctggaaccaaaagcaaggaaactcatgcaaggtggctaccaaagcatgcagcaataaagatgagaaaggagaaaagatcaatgcttccacagattcactggccaaggacctgattgtctctgcccttaagctgatccagtaccatctgacccagcagactaagggcaaagatacatgtgaagaagactgtcctggttccaccatgggctatatggctcagagtactcaatatgaaaagtgtggaggtggccaaagtgccaaagcactttcagtgaaacaactagaatctcacagagcccctggaccatccacctgtcaaaaggagaaccaacacctggactcccagaaaatggatatgtcaaacatcgttctaatgctgattcagaaactgcttaatgagaaccccttcaaatgtgaggatccatgcgaaggtgagaacaagtgttctgagcccagggcaagcaaagcagcttccatgtccaacagatctgacaaagcggaagaacaatgccaggagcatcaagaacttgactgtaccagtgggatgaagcaagcgaacgggcaatttatagataaactagtagaatctgtgatgaagctctgccttatcatggctaagtatagcaacgatggggcagcccttgctgagttggaagaacaagcagcctcggcaaataagcccaatttcaggggcaccagatgcattcacagtggtgcaatgccacagaactatcaagactctcttggacatgaagtaattgtcaataatcagtgctctacaaatagcttgcagaagcagctccaggctgtcctgcagtggattgcagcctcccagtttaacgtgcccatgctctacttcatgggagataaggatggacaactggaaaagcttcctcaggtttcagctaaagcagcagagaaggggtacagtgtaggaggtcttcttcaagaggtcatgaagtttgccaaggaacggcaaccagatgaagctgtgggaaaggtggccaggaaacagttgctggactggctgctcgctaacctgtgagctgatccttgactcctcttcatcttagcccccctagcagcattccatcccagccagagcacccccaccatcaggccagtcaactgcacaatacacaactgtatttcccaatacacttgagcagttgcctgtgaatgtaagaggtgtcaacaaactgggaaataaaataaaaaaaaataataataaatgtgt

SEQ ID NO: 103098 - DNA, 2864 bp, Homo sapiens
  Payload ID: 110
  Gene Symbol: AKAP4
  Gene Name: A kinase (PRKA) anchor protein 4
  Uniprot ID: Q5JQC9
  ENST ID: ENST00000376064
  CDS Start-End: 144-2681
agtctggtccaacagctgacaggggtggcagccaactgcaggtgcccaagaacttggcacttctcagttccatctaaaggggcacatctcccttctgggtgtcacgttttcagccaaacatctaaaagaacttcatcatcaagatgtctgatgatattgactggttacgcagccacaggggtgtgtgcaaggtagatctctacaacccagaaggacagcaagatcaggaccggaaagtgatatgctttgtcgatgtgtccaccctgaatgtagaagataaagattacaaggatgctgctagttccagctcagaaggcaacttaaacctgggaagtctggaagaaaaagagattatcgtgatcaaggacactgagaagaaagaccagtctaagacagagggatctgtatgccttttcaaacaagctccctctgatcctgtaagtgtcctcaactggcttctcagtgatctccagaagtatgccttgggtttccaacatgcactgagcccctcaacctctacctgtaaacataaagtaggagacacagagggcgaatatcacagagcatcctctgagaactgctacagtgtctatgccgatcaagtgaacatagattatttgatgaacagacctcaaaacctacgtctagaaatgacagcagctaaaaacaccaacaataatcaaagtccttcagctcctccagccaaacctcctagcactcagagagcagtcatttcccctgatggagaatgttctatagatgacctttccttctacgtcaaccgactatcttctctggtaatccagatggcccataaggaaatcaaggagaagttggaaggtaaaagcaaatgccttcatcattcaatctgtccatcccctgggaacaaagagagaatcagtccccgaactcctgcgagcaagattgcttctgaaatggcctatgaagctgtggaactgacagctgcagaaatgcgtggcactggagaggagtccagggaaggtggccagaaaagctttctatatagcgaattatccaacaagagcaaaagtggagacaaacagatgtcccagagagagagcaaagaatttgcagattccatcagcaaggggctcatggtttatgcaaatcaggtggcatctgacatgatggtctctctcatgaagaccttgaaagtgcacagctctgggaagccaattccagcatctgtggtcctgaagagggtgttgctaaggcacaccaaggagattgtgtccgatttgattgattcttgcatgaagaacctgcataatattactggggtcctgatgactgactcagactttgtctcagctgtcaagagaaatctgttcaaccagtggaaacaaaatgctacagacatcatggaggccatgctgaagcgcttggtcagtgcccttataggtgaggagaaggagactaagtctcagagtctgtcatatgcatctttaaaagctgggtcccatgatcccaaatgcaggaatcagagtcttgaattctccaccatgaaagctgaaatgaaagagagggacaaaggcaaaatgaaatcagacccatgcaagtcactgactagtgctgagaaagtcggtgaacacattctcaaagagggcctaaccatctggaaccaaaagcaaggaaactcatgcaaggtggctaccaaagcatgcagcaataaagatgagaaaggagaaaagatcaatgcttccacagattcactggccaaggacctgattgtctctgcccttaagctgatccagtaccatctgacccagcagactaagggcaaagatacatgtgaagaagactgtcctggttccaccatgggctatatggctcagagtactcaatatgaaaagtgtggaggtggccaaagtgccaaagcactttcagtgaaacaactagaatctcacagagcccctggaccatccacctgtcaaaaggagaaccaacacctggactcccagaaaatggatatgtcaaacatcgttctaatgctgattcagaaactgcttaatgagaaccccttcaaatgtgaggatccatgcgaaggtgagaacaagtgttctgagcccagggcaagcaaagcagcttccatgtccaacagatctgacaaagcggaagaacaatgccaggagcatcaagaacttgactgtaccagtgggatgaagcaagcgaacgggcaatttatagataaactagtagaatctgtgatgaagctctgccttatcatggctaagtatagcaacgatggggcagcccttgctgagttggaagaacaagcagcctcggcaaataagcccaatttcaggggcaccagatgcattcacagtggtgcaatgccacagaactatcaagactctcttggacatgaagtaattgtcaataatcagtgctctacaaatagcttgcagaagcagctccaggctgtcctgcagtggattgcagcctcccagtttaacgtgcccatgctctacttcatgggagataaggatggacaactggaaaagcttcctcaggtttcagctaaagcagcagagaaggggtacagtgtaggaggtcttcttcaagaggtcatgaagtttgccaaggaacggcaaccagatgaagctgtgggaaaggtggccaggaaacagttgctggactggctgctcgctaacctgtgagctgatccttgactcctcttcatcttagcccccctagcagcattccatcccagccagagcacccccaccatcaggccagtcaactgcacaatacacaactgtatttcccaatacacttgagcagttgcctgtgaatgtaagaggtgtcaacaaactgggaaataaaataaaaaaaaataataa

SEQ ID NO: 103099 - DNA, 783 bp, Homo sapiens
  Payload ID: 110
  Gene Symbol: AKAP4
  Gene Name: A kinase (PRKA) anchor protein 4
  ENST ID: ENST00000448865
  CDS Start-End: 144-783
agtctggtccaacagctgacaggggtggcagccaactgcaggtgcccaagaacttggcacttctcagttccatctaaaggggcacatctcccttctgggtgtcacgttttcagccaaacatctaaaagaacttcatcatcaagatgtctgatgatattgactggttacgcagccacaggggtgtgtgcaaggtagatctctacaacccagaaggacagcaagatcaggaccggaaagtgatatgctttgtcgatgtgtccaccctgaatgtagaagataaagattacaaggatgctgctagttccagctcagaaggcaacttaaacctgggaagtctggaagaaaaagagattatcgtgatcaaggacactgagaagaaagaccagtctaagacagagggatctgtatgccttttcaaacaagctccctctgatcctgtaagtgtcctcaactggcttctcagtgatctccagaagtatgccttgggtttccaacatgcactgagcccctcaacctctacctgtaaacataaagtaggagacacagagggcgaatatcacagagcatcctctgagaactgctacagtgtctatgccgatcaagtgaacatagattatttgatgaacagacctcaaaacctacgtctagaaatgacagcagctaaaaacaccaacaataatcaaaatacatgtgaagaagactgtcctggttccaccatgggctatatggctcagagtactcaatatgaaaagtgtggaggtggccaaagtgccaaagcacttt

SEQ ID NO: 103100 - DNA, 892 bp, Homo sapiens
  Payload ID: 110
  Gene Symbol: AKAP4
  Gene Name: A kinase (PRKA) anchor protein 4
  ENST ID: ENST00000437370
  CDS Start-End: 130-892
gctgacaggggtggcagccaactgcaggtgcccaagaacttggcacttctcagttccatctaaaggggcacatctcccttctgggtgtcacgttttcagccaaacatctaaaagaacttcatcatcaagatgtctgatgatattgactggttacgcagccacaggggtgtgtgcaaggtagatctctacaacccagaaggacagcaagatcaggaccggaaagtgatatgctttgtcgatgtgtccaccctgaatgtagaagataaagattacaaggatgctgctagttccagctcagaaggcaacttaaacctgggaagtctggaagaaaaagagattatcgtgatcaaggacactgagaagaaagaccagtctaagacagagggatctgtatgccttttcaaacaagctccctctgatcctgtaagtgtcctcaactggcttctcagtgatctccagaagtatgccttgggtttccaacatgcactgagcccctcaacctctacctgtaaacataaagtaggagacacagagggcgaatatcacagagcatcctctgagaactgctacagtgtctatgccgatcaagtgaacatagattatttgatgaacagacctcaaaacctacgtctagaaatgacagcagctaaaaacaccaacaataatcaaagtccttcagctcctccagccaaacctcctagcactcagagagcagtcatttcccctgatggagaatgttctatagatgacctttccttctacgtcaaccgactatcttctctggtaatccagatggcccataaggaaatcaaggagaagttggaaggtaaaagcaaatgccttcatcattcaatctgtccatcccctgggaacaaagagagaatcagtcccc

SEQ ID NO: 103101 - DNA, 2601 bp, Homo sapiens
  Payload ID: 111
  Gene Symbol: AKAP5
  Gene Name: A kinase (PRKA) anchor protein 5
  Uniprot ID: P24588
  ENST ID: ENST00000320636
  CDS Start-End: 1289-2572
tttttttactaatgaaacactgcagattagtatccccaaacaattcattttctgacgaaactcttaaagcccagtttcagaacataagctttaagcaacaagcaatcttgtgttaatctgagctctgttacagctctgccgtaatctcagccaaattgcttcatctgtacgtggtgataccaccatctttgtaatattgtggtgaggattagagatgtatgtaaaagtgcatgcactgcctaatacccaagaattgctcaataaatgtcagctattactactcttactgacttccaactatgtgcagattatggtggaaacatgtgatacagcagatacagtacttaaatgaaaatgtcaaaattgtacaactaatttaagagtgggaaatgacagtaatgctaaattttcctaagaatatgtatgaaaaatagcacttccttgatggaacatacatttttagaacagaaaccttatgttataatggtaaaactagagagtcaaagtctctagttctaactctggctatgaccttatctagttgcatggcttttgacaagacaactgctcccctctggagttcagttttgtcatctggctggatttgagtaatctcaaataatctctaaagtcctttgcagctttaaaattatctattgagtgtgataaagattacatcagcttgcttttcatcctgcacttcatttttggttcttgttgtttgcttaacttgcactttagagtcataagcaattcacacagacaacacaactaaagaactgataatatcagacttgcagggtaatccaaaatgaagtttcaacaaggaggataaaacaaaatagaatcacactgaactctttaatagggccaaagtaaaccccaatgtttattctccagtcatttcattaagttattatatggaaaatatgcctggtagaatcttatacattcactgaaatagtctccacagaaaataataggctcatagtgaaataaaataccactttcttttctctcatcaggttgatctttaaataaagcaaaaatttatccaaagaagggctttcatcaagaaattaaagagagaaattacaagccatagagaaactgggcatttctatactagagaaaccacctaaaacaactgtatggagtaagatgaaaggtatgaatatgcctggaagaaattttacctagtgtgacatttttgctcatctttttgtcacaaaaggctgctaaggaagagagaatacagttttctagagaataagagtgcagtgtaaaaatggaaaccacaatttcagaaattcatgtagaaaacaaggatgagaagagatcagcagaaggtagtcctggggctgaaaggcagaaggaaaaggcatccatgctttgcttcaagagaagaaagaaagcagccaaagcactgaagcccaaagctggctctgaagctgctgatgtggcaaggaagtgtccacaagaagcaggagcttctgatcagccagagcccacacggggggcctgggcctcactcaaacgtcttgtaacacgcaggaaaaggtcagagtcttcaaagcagcaaaagccattggagggtgaaatgcaacctgcaataaatgctgaggatgctgatctttctaagaaaaaggcaaaatctagacttaagattccctgcataaaattcccaagagggccaaaaaggagtaatcattccaaaattatagaagactcagactgcagcatcaaagtccaggaagaagctgaaattttggatatacaaacacagaccccattgaatgatcaggcaacaaaggctaagtcaacccaggatctaagtgaaggcatctcacggaaagatggtgatgaggtctgtgaatcaaatgtgagcaatagcacaacttctggagagaaagtgatttcagtagaacttggattagataatgggcattctgctattcaaacgggaactctaatccttgaagaaattgaaacgatcaaggaaaaacaagatgttcaaccccagcaagcaagcccacttgaaacttcagaaacagaccatcagcagccagtactttctgatgttcctcctttacctgcaattccagatcaacaaattgtggaagaagccagtaacagtaccctagaaagtgcaccaaatggaaaagactatgaaagtacagagattgtagctgaagaaactaagccaaaagatactgaattgagccaagaatcagattttaaagaaaatgggatcactgaagagaaatccaaatcagaagaaagcaaaagaatggagccaattgctattattattacagacactgaaatcagtgaatttgatgttacaaaatctaaaaatgtccctaagcaattcttaatttcagctgaaaatgagcaagtaggggtttttgctaatgataatggttttgaggatagaacttcagaacaatatgaaacactcttaattgaaacagcctcttctctagtcaagaatgctattcagttgtcaatagaacagctggttaatgaaatggcctctgatgataataaaataaacaatcttctacagtgacttactctccagagtcacggcagaaaaaa

SEQ ID NO: 103102 - DNA, 6487 bp, Homo sapiens
  Payload ID: 111
  Gene Symbol: AKAP5
  Gene Name: A kinase (PRKA) anchor protein 5
  Uniprot ID: P24588
  ENST ID: ENST00000394718
  CDS Start-End: 379-1662
gcagagggcgccttgctccgggtgcgaccgcggctccctggaggcctgggcggcgggccccgcgagcgcgccgccacctcgggagcagtgttggccaaggaccccgacgccctacgttgatctttaaataaagcaaaaatttatccaaagaagggctttcatcaagaaattaaagagagaaattacaagccatagagaaactgggcatttctatactagagaaaccacctaaaacaactgtatggagtaagatgaaaggtatgaatatgcctggaagaaattttacctagtgtgacatttttgctcatctttttgtcacaaaaggctgctaaggaagagagaatacagttttctagagaataagagtgcagtgtaaaaatggaaaccacaatttcagaaattcatgtagaaaacaaggatgagaagagatcagcagaaggtagtcctggggctgaaaggcagaaggaaaaggcatccatgctttgcttcaagagaagaaagaaagcagccaaagcactgaagcccaaagctggctctgaagctgctgatgtggcaaggaagtgtccacaagaagcaggagcttctgatcagccagagcccacacggggggcctgggcctcactcaaacgtcttgtaacacgcaggaaaaggtcagagtcttcaaagcagcaaaagccattggagggtgaaatgcaacctgcaataaatgctgaggatgctgatctttctaagaaaaaggcaaaatctagacttaagattccctgcataaaattcccaagagggccaaaaaggagtaatcattccaaaattatagaagactcagactgcagcatcaaagtccaggaagaagctgaaattttggatatacaaacacagaccccattgaatgatcaggcaacaaaggctaagtcaacccaggatctaagtgaaggcatctcacggaaagatggtgatgaggtctgtgaatcaaatgtgagcaatagcacaacttctggagagaaagtgatttcagtagaacttggattagataatgggcattctgctattcaaacgggaactctaatccttgaagaaattgaaacgatcaaggaaaaacaagatgttcaaccccagcaagcaagcccacttgaaacttcagaaacagaccatcagcagccagtactttctgatgttcctcctttacctgcaattccagatcaacaaattgtggaagaagccagtaacagtaccctagaaagtgcaccaaatggaaaagactatgaaagtacagagattgtagctgaagaaactaagccaaaagatactgaattgagccaagaatcagattttaaagaaaatgggatcactgaagagaaatccaaatcagaagaaagcaaaagaatggagccaattgctattattattacagacactgaaatcagtgaatttgatgttacaaaatctaaaaatgtccctaagcaattcttaatttcagctgaaaatgagcaagtaggggtttttgctaatgataatggttttgaggatagaacttcagaacaatatgaaacactcttaattgaaacagcctcttctctagtcaagaatgctattcagttgtcaatagaacagctggttaatgaaatggcctctgatgataataaaataaacaatcttctacagtgacttactctccagagtcacggcagaaaaaacaagcttaatgaagaattcttttatacatttgtggcatttcttactcagtaacaaatgagagatttatcatctctagaacttaaaaggtacaattccagcgcagaagtgctaaagattaagtcaagtttataaaactctaccactgaaatgcagtcacttctggattggaggaagtcagcacagattgcagtgtaaaatgacataacatacagggagttgctaaaatggcatatggagattggagtgctttgggggaggaaggtgtatttattgagcacttatggtatgccataagctttttaatgacctctgatataacaaagtctggtttccttttgataattcagctctgtgtataggctaacatcacattaagtttttaaaaacttattttttacagtgcacatatatgtttaaaatggtgaataaggtgagctacttttgtgaatgtgatttgtaattgttacattcctaagcagcaggcttaactcaaaaaatacattgcattttcccaatttcagcagatagtgtgcagaatatgcatattgatattaaacgtgagtggtttcctagtcttaagtctcttataagcgctatttggccaggggcagtggctcacgcctataatcccagcactttgggaggccaaggcgggtggatcagctaaggtcaggagttcgagaccagcctggccaatgtggtgaaaccccatctctactgaaaatacaaaaattagctgggcgtggtggtgcacgcctgtaatcccagctacttgggaggctgaggcaggagaattgcttgaacccgagaggtggaggttgcagggagccaagattgcaccactgcactccagtctgggcaacagagcgagactccttctcaaaaaaaaaaaaaaaaaaaaagagaaccattcacaaatccttcaatcaggcaaattgttactaagtgcaaaagtgtagaaacagggagagtgggtttttcccccgcttttctttctgcctcaacagatctgtatatatccatttctgcatggatttatctgtgaaaagttaaaaaatgaaacagcaaaaacaaaacaaggggaatattattcttcatccaggagaagggaaaattcccaagtaaattatcacagataatataggattcatcttgcagaattacttctttaagagccatattcatcaacttctctccaaagaggggagagtagattcaaagccagcctggtagtaatggtcctggaaaatcctaataatctagtgcaaatatttattctcggccaaaaatgagccatgaatgtgggtgaatagaaaagtgaaaagttattgctaaagcacattataatttaaatgtcagtattccttcatgtctgtgtgttgagaccagtaaaaagcattttacatgaatattgaaagttaactttttcatcactattttcttttcttttttttttttttttgagatggagtctcactctgtcgcccaggctggagtgcagtggcgcgatcttggctcactgcaagctccacctcctgggttcacaccattcttctgcctcagcctcccaagtagctgggactacaggcgcccactacaacgctcggctaattttttgtatttttagtagagatggggtttcaccgtgttagccaggatggtcttgatctcctgacctcatgatcctcccgcctcggcctcctaaagtgctgggattacaggcatgagccaccgcacccggccttcatcactattttcaatccagatatactttacaaaaatgagaagggcttatttgcatttttatttacatattgaaagggaagcatctgatctcatcaatgattgccatattttttgaaaaagtaatcctatttcaatctttccttgtgtgaaatggccataataccagagtgcacttccctacctcacaggttaggattcaaagtgtgtattcccccattgtgtaaattgagtgattgtgttactacttgaaacagatgaagtaataaagatgaagtatgagatgtaaggtatttgttcaagagctccacttggaggaaataatgcacattagatgattttaaatgatctgggtgaattcttgcattgtgtatggattgcatatagaaagtatttgctactttgtcctacagaatcatcttcatttctttctgtaaatacatattgagacctctaacaaaagaaactaatctgacttggaaattgaaccaaatcatggatattattagcaagattctttgctgaagtgcaaaaatatttcccccagattttcctaccttcatgcttataatccggggaggagggtggaaatcctgagcaagatgaaaagtgtcattcaaaacacatgacccaagaagtcaatttcttttaattgtacaacttttaaacattaaaaacaaaaaagacgagtcatcttctctgaaaacactctttaactcactatatgtggtgctaatggacttggacagctaccagctatcatatttaaaagtgaaccattttaaaaacctgactaaggttggtgcattttacagtgtattgaagaatcctgccctcatttactgcaaggatgcctccaagccaatacacttgcattgtaaatgtttagtaatctcatgaacaagcaaaaagtatagtacttagcagttattggaaatattttgggggatttttaaaaaaacagataaatggtaaatatgtgcaatgaattttttggttaagaaagtaaaattttatctaatactaggtttttacttttttcactgtggtttgatatatatttttggttagaatgtactgattgtttttatgataagatgtatattttacttgcattcattcttaagaggtttctgtttttctattgagaatatctgttgaattaagtaggatttcagttagaaaaaggaattccgaaattaactggtctcaatctgattatatgtgctacatggccaaatcctattacagtgaattctaaggtgattcaaattgttttattgttatagaaatatgcagaaatcagatggcttcagagtcataaaatatttttcttgtaatagtatttaagcaatttgaccttatatgcaaacgttaagtgaatataaataagttctgtttcaattcatgtccatttaacaacattaaaataattattaggaacaccacatgaattttctttacatttgctgtggtataaattctgcttttaatgaatgtttatttatttattagccaaaattcagtttctctttgaacccagaattttgcaaagctgggggttggggagggggattattagctacttgttaactttttcagcatattatcattcctcttttaagactcaagtattattcactttgcttcttacaacccagagaatgtgaaaattctcctctattttatgtagcactattcacttaacattttttcaaagcactttataggatataaaaatagtacccggtaacatttaagtaaaggtagcagaaaacaaaagaactttcaaacagaaattatgttccctgccacctcctccacctcaaagaataataagcatgtggcataaatggagttgttcagaaaagctgtctgcataattttccttcaaggtaatgtatttgacagcatgaagtttgtgatgatcttacttggtctactactcagcggagtcttagaatctcttttatttacttctgagagattgttatttcaccagtatatgtgaacaggcttgctaaaggcattaaagatatggatcatggaggcaccaaatttggcttctgtatgcaatccagcattaacttcatccatacatttctaacttcatccataaatttctaacttcaagttaccttattttttatagttaagaatgtttttcgaggtttacaacagaatttaaaaaataattgttaggctttagaatcccactgtttgaaaagatccttttaatgtcaactttattgaaatatgtagtctactttctaatttcatctgataatatagcaggatttgatttttctgcctgccatttgtgcatttaaaaaaaaatcctcatttaagatttagagttctttaggttcaaattcctatgatgttttattgggtaacatgaactctcttatacataattcaaaatttcaatccatggtatattttatggtacattttgaaaagaaaatttgtaatgctccttagttacaaaaattagaaggaagctacataaaattcaggtgtcctaattaaattcaatttgattcaacacacgtattaggcataactcatacctaacactatttgataagggagacaggctccctgccatccaagaactcaacctagggagcagtgacaacagaaaccgggttgggttaaggcaaagagccatggataatgctgcaacatgagtggcacagaggggagtacacagagagagcaattaatttggtgtggggaaggtggtgatctgaatacagcagcagtttgaaagtgttccgtttttaaataaacagtatgcttattttgatttgtgactaggtgtagaaaaaagcctgcatagtgttacatatttatagtagttctttgtaaaaatgttaagtggatgagctattatgaaagtaaaagtttcattttttctcattaaaattagtactaaattactatggatcagatgataatattaaatagtactctgtagaaaaaaggtttcaagttgaattaatttatgtactgattattaatacagaataaatgttatattgactca

SEQ ID NO: 103103 - DNA, 15006 bp, Homo sapiens
  Payload ID: 112
  Gene Symbol: AKAP6
  Gene Name: A kinase (PRKA) anchor protein 6
  Uniprot ID: Q13023
  ENST ID: ENST00000280979
  CDS Start-End: 171-7130
agtctttcccataatgagctgcatcatctgaactgatgtcacagcatcatgcagcaggtcaaacaaggcatctcctagtattgcatcctacagatgtgctgtaaacatcaaaagaagacggtgggatcaggagatgctgttttggaaagaagtgaggtttagacttctccatgttaaccatgagcgtgacactttcccccctgaggtcacaggacctggatcccatggctactgatgcttcacccatggccatcaacatgacacccactgtggagcagggtgagggagaagaggcaatgaaggacatggactctgaccagcagtatgaaaagccacccccactacacacaggggctgactggaagattgtcctccacttacctgaaattgagacctggctccggatgacctcagagagggtccgagacctaacctattcagtccagcaggattcggacagcaagcatgtggatgtacatctagttcaactaaaggacatttgtgaagatatttctgatcatgttgagcaaatccatgccctccttgaaacagagttctccctaaagctgctgtcttactctgtcaacgtgatagtggacatccacgcagtgcagctcctctggcaccagcttcgagtctcagtgctggttctgcgggagcgcattctgcaaggtctgcaggacgccaatggcaactacactaggcagacggacattctgcaagctttctctgaagagacaaaagagggccggcttgattctctaacagaagtggatgactcaggacaattaaccatcaaatgttctcaaaattacttgtctctggattgtggcattactgcattcgaactgtctgactacagtccaagtgaggatttgctcagtgggctaggtgacatgacctctagccaagtcaaaaccaaaccctttgactcttggagctacagtgagatggaaaaggagtttcctgagcttatccgaagtgttggtttacttacggtagctgctgactctatctctaccaatggcagtgaagcagttactgaggaggtatctcaagtatctctctcagtagacgacaaaggtggatgtgaggaagacaatgcttctgcagtcgaagagcaaccaggcttaacactgggggtgtcatcatcttcaggagaagctctgacaaatgctgctcaaccctcctctgagactgtgcagcaagaatccagttcctcctcccatcatgatgcaaagaatcagcagcctgttccttgtgaaaatgcaacccccaaacgaaccatcagagattgctttaattataacgaggactctcccacgcagcctacattgccaaaaagaggactttttcttaaagaggaaacttttaagaatgatctgaaaggcaatggtggaaagaggcaaatggttgatctaaagcctgagatgagcagaagcaccccttcgctagtagatcctcctgacagatccaaactttgcctggtattgcagtcttcttaccccaacagcccttctgctgccagccagtcttatgagtgtttacacaaggtggggaatgggaaccttgaaaacacagtcaaatttcacattaaagaaatttcttccagcctgggaaggcttaacgactgctataaagagaaatctcgacttaaaaagccacacaagacctcagaagaggtgcctccatgccgaacacctaaacgggggactggttcaggcaaacaagctaaaaatacaaagagctcagcagtgccaaatggagagctttcttatacttccaaggccatagaggggccacaaacaaattctgcttccacatcctcacttgagccttgtaatcagagaagttggaatgccaaattgcaattgcagtcagaaacatccagttcaccagcttttactcagagcagtgaatcctctgttggctcagacaacatcatgtctccggtgccacttctttcaaaacacaaaagcaaaaaaggtcaagcctcctctccaagtcacgtcactaggaatggtgaggttgtggaggcctggtatggctctgatgaatacctagcactgccctctcaccttaagcagacagaagtattggctttgaagttggaaaacctaacaaagcttctgcctcagaaacccagaggagaaaccatccagaatattgatgactgggaactgtctgaaatgaattcagattctgaaatctatccaacctatcatgtcaaaaagaagcatacaaggctaggcagggtgtctccaagctcatctagtgacatagcctcttcactaggggagagcattgaatctgggcccctgagtgacattctttctgatgaggagtccagtatgcctctcgctggcatgaaaaagtatgctgatgagaagtcagaaagagcttcatcctctgagaaaaatgagagccattctgccactaaatcagctttaattcagaaactgatgcaagatattcagcaccaagacaactatgaagccatatgggaaaaaatagaggggtttgtaaacaaactggatgaattcattcaatggttaaatgaagccatggaaactacagaaaattggactccccctaaagcagagatggatgaccttaaactgtatctggagacacacttgagttttaagttgaatgtagacagtcattgtgctctcaaggaagctgtggaggaggaaggacaccaacttcttgagcttattgcatctcacaaagcaggactgaaggacatgctgcggatgattgcaagtcaatggaaggagctgcagaggcaaatcaaacggcagcacagctggattctcagggctctggataccatcaaagccgagatactggctactgatgtgtctgtggaggatgaggaagggactggaagccccaaggctgaggttcaactatgctacctggaagcacaaagagatgctgttgagcagatgtccctcaagctgtacagcgagcagtataccagcagcagcaagcgaaaggaagagtttgctgatatgtcaaaagttcattcagtgggaagcaatgggcttctggactttgattcagaatatcaggagctctgggattggctgattgacatggagtcccttgtgatggacagccacgacctgatgatgtcagaggagcagcagcagcatctttacaagcgatacagtgtggaaatgtccatcagacacctgaaaaagacggagctgcttagtaaggttgaagctttgaagaaaggtggcgttttactaccaaatgatctccttgaaaaagtggattcaattaatgaaaaatgggaactgcttgggaaaaccctaggagagaagatccaggacacaatggcagggcacagtgggtcgagtccacgtgacctgctctctcctgaaagtggaagcctggtaaggcagctggaggtcaggatcaaagaactgaaaggatggctaagagatacagagcttttcatcttcaattcctgtctgagacaagaaaaggaaggaacaatgaatactgagaaacaactgcaatactttaagtccctctgtcgtgaaatcaagcaacgacgtcgaggagttgcctccattctgcgactatgccagcatcttttggatgaccgggagacttgcaatctgaatgcagaccaccagcccatgcagctgatcattgtaaatcttgaaagaaggtgggaagccattgtcatgcaagccgtccagtggcaaacacgtctacaaaagaagatgggaaaggaatctgagactttgaatgtgattgatcctggcttgatggacctaaatgggatgagtgaggatgccctggaatgggatgaaatggacataagtaacaagttaattagtttgaatgaggaatcaaatgaccttgatcaagaactccaacctgttatcccttccttgaagcttggagagacaagtaatgaggaccctggttatgacgaggaggctgataaccatgggggatctcagtatgcctcaaatattactgccccctctagtccacacatttaccaggtgtacagcctccacaatgttgaactctatgaggacaaccacatgccatttctgaaaaacaatccaaaggtcactggcatgacacagcctaatgttttaactaagagtctcagtaaagactcttcattttcatctaccaaatctttgccagatcttctaggtggttccaatttggtaaagccctgcgcatgtcatggaggagacatgagccagaattcaggcagtgagagtggaattgtcagtgaaggagacacagaaaccactaccaactctgaaatgtgcttgctcaatgcagtggatgggtccccaagtaaccttgaaactgaacatctggacccacaaatgggagatgcagttaacgtgttaaagcaaaaatttacagatgagggggaaagcattaagcttccaaatagctctcagtcgtccatttcaccagtgggttgtgtaaatggaaaagttggagatttaaacagtattaccaaacatacccctgactgtttgggagaagaattacaaggaaaacatgatgtgtttacattttatgattactcatacctccaaggctcaaaactcaaattaccaatgataatgaaacagtcacaaagcgaaaaagcgcatgtggaggatcccctgcttcgtggtttttattttgataaaaaatcatgcaaatctaaacatcagactacagagttacaaccagatgtacctccccatgaaaggattttggcaagtgcatctcatgaaatggatcgcatttcatataaaagtggcaatatagaaaagacattcactggcatgcagaatgccaaacagctctcccttttatctcatagttcatctattgagtccctttctccagggggtgatttatttggattgggcatctttaaaaatggcagtgacagcctccagcgaagcacttctttagaaagttggttgacttcctataaaagcaatgaagatctctttagctgtcacagctctggggatataagcgtgagcagtggctcagttggtgaactaagtaaaagaacattagatctcctgaatcgtttggagaatatccagagcccctcagagcaaaagataaaacgaagtgtttctgatatcactcttcaaagcagttcccaaaagatgtcctttactggccagatgtcattggacatagcatcttctatcaatgaagactcagcggcatctctaacagaacttagcagcagtgacgagctctctctttgctcagaggatattgtgttacacaagaacaagatcccggaatcgaatgcatcgttcaggaagcgtctgactcgttcagtggctgatgaaagcgatgtcaatgtcagcatgattgttaatgtctcttgcacctctgcttgcactgatgatgaagatgacagcgacctgctctccagctctacccttaccttgactgaagaagagctgtgcatcaaagatgaggatgacgactccagtattgcaacagatgatgaaatttatgaagactgcaccttgatgtcagggctagactacataaagaatgaattacagacctggattaggccaaaattgtctttgacaagagataagaaaaggtgcaatgtcagtgatgagatgaagggcagtaaagatataagtagcagtgagatgaccaatccctctgatactctgaatattgagacccttctaaatggctctgtaaaacgtgtctctgaaaataatggaaatggtaagaattcatctcatacccatgagttagggacaaagcgtgaaaataagaaaactattttcaaagttaataaagatccatatgtggctgacatggaaaatggcaatattgaaggtattccagaaaggcaaaagggaaaaccgaatgtgacttcaaaggtatcagaaaatcttggttcacatgggaaagagatttcagagagtgagcattgtaagtgtaaagcacttatggatagtttagatgattcaaatactgctggcaaggaatttgtttcccaagatgttagacatcttccaaagaaatgtccaaatcaccaccattttgaaaatcaaagcactgcctctactcccactgagaagtctttctcagaactggctttagaaaccaggtttaacaacagacaagactctgatgcactgaaatcatctgatgatgcaccgagtatggctggaaaatctgctggttgttgcctagcacttgaacaaaacggaacagaggaaaatgcttctatcagcaacatttcctgttgcaactgtgagccagatgttttccatcaaaaagatgccgaagattgttcagtacacaactttgttaaggaaatcattgacatggcttcgacagccctaaaaagtaaatctcaacctgaaaacgaggtggctgctcctacttcattaactcaaatcaaggagaaagtgttggagcattctcaccggcccatccagctgagaaaaggggacttttattcgtacttatctctctcatctcatgacagtgattgtggggaggtcaccaattacatagaagagaaaagcagcactccattgccactagacaccactgactcgggcttagatgacaaggaagatattgaatgcttttttgaggcctgtgttgagggtgactctgatggagaggagccttgtttctctagtgctcctccaaatgaatctgcagttcccagcgaagctgcaatgccactacaagcaacagcatgttcttctgagttcagtgatagttctctttcagctgatgatgcagatacagtggctctttcaagtccttcctctcaggaaagagctgaggttggaaaggaagtgaatggtttgccccaaacttccagtggctgtgcagaaaacttagagtttactccttcaaagcttgacagtgaaaaggaaagttccggaaaaccaggtgaatctggaatgccagaagaacataatgctgcttcagccaaatctaaagttcaagacctctccttgaaggcaaatcagccaacagacaaggccgcattgcatcccagccccaaaactttaacctgtgaagaaaatcttctaaaccttcatgaaaaacgacatagaaatatgcataggtagaatgtaccccctccccaagcatgaaaatcatctcactgaaagatacgcctggctgcaactcaggggtggcctcatcctcccgccctgggctggcctctggttccatcacgtttgtcactgccgtttattacattgacttctcccaagatgaatcttccttccaaatgtgttttctccacacaagccttgtgatctgaatgtgtgcgctggttctctttaggtgatcgtctttgaagttcagcaaagctgcttgttctcccatggattcctgtcccaagctacctctaccaaccctctctctccagctagacttttctctttgcctcctcccttcccttccactctttaaagttctgcagttcaccaactggtagtccattaaattctcctgtctagaatgacccccccaccagtacttgaccaatttcatgtatcaatctggatttttttttaacggtataatgactgtgtttattgaaagagttttacctaaaaagccaacatttgaattggttgcagcatagagaagaaacactggtccttctttcaaaattaagcaactattaaaagcgccattttatttatttcatttaaaaaataatctatgcagcatttcaagaaacaaccatatggtgttgtatattataaactggtgacattctactattgaattatgtacaacattttcattttttatgcttcttgaggtggtaatgagaaaaaagttttttaaaaaagtgtgccttgctgtatttcttataccatttattaaaaagctgctttcacggtaaaattatgttggtttgaaaggaggaaatagcaaggttaagatgtgtgaataatttctgtatatatgtataaccaagtacaaacattgatgtataatgacagtataaaatgctttcatgtttgtgatgtctagtgatgtggaaaatataagccttaaatccattagattgcatggtaattaaaattggcataataaacacagattattgggggaaaaggaaaattagtgatctcttctactatgttctttaccaaattgttgcatctggttctgaaaaagtatagcatgtagcagcttccaaacatattcatattgcttaagaggcttaacattacctaaactagagactagacgtaaagccttcagttttcaaaatctttctggtcactataaagatcttggaacagcaaatgattaaatgtcagttcccctaaaccaataaacatttatactagattttttatttccacttatcattaatgatttaatgttggatttcaggtaccttgtatgtcttaatttattttaaatatttattttgaatgagtttgatagaaagctagtagaaaagtacagaaaatttgactattatttatagatttcaggtatatttatatgtgtaaaagaaattgacaaagaaatatttcatctggcctttactgactcctgttaaatgcagttttaaatttatatcgtaacacctacttaagtgcctgacacagtaggtattcaataaaaatttactgaattaaaggattaaattaggtgacatggtgacatctatccctttattttgacactaaaacatggacacaactagaaagaggtacaatgcaatataaagtcacaatagataatatatatcaaatttctaaaaggtaaagaatgttgtgggttcatgcagtcacaggaatgacaatcattcaacagatagttcagaaacactttttatctgcaaggcactattctagatccagaagatgcaatgttgaacaaacagacaaagccctgccctcagaaggctgtcctgcattaggaacaagtgaacacgcaaatgacatgaagtatttgttgcagagctgaggaacagagcaaatgtagtgatagaagcgcaatgagagaagcagcagtgggtacaaggaggaagaaaaagggcttgcagagagtggaaagttagtggaatattcatgaaacttcattgcaggggtaatagaagaaaaagtaaattgggaggacttaatggaaggtcttttaaaaagttaacttggagcttctgtatgtaaaatgctaggtaataaggacactttgtacaggctgttttgcacctgattttatttatcattagtgccacgccaagatcatttagacgatgcttatctgtaattctaccactttaataactatttgtatttttatgccccttctgatcttttccatatgtatttctaaatggataaattattctaggcttcttaataggtagtaatttgttcaaaagcggttttagccagacatctagttgcagtgttcaagaggattatgggggaaagagattagagataattgtctagttagggggcagctggagaaaataagctaagtttgcaataacagagtacacaagtatagtggcccaggatgtagtgaaagaacaaatcctagagtctttgaaatttctaagggcattctagacctctgttgggatatggtattattttacatactgacacaacctaaattttctttgggtagtaactaatgtcaagtctacatcgactggtaaaacattcaaagaacaaactgacaatgatgttctacctacttgttacatgctcatggaagaccgtgcagtattgaaagtatttgttaattatctgcttagtattaacactaaatttgtagaatgactttcaggtttgttgaacaatgccttttcaggttggaagaagaaaaatagcctcaatctcccaccccatgtaggcactacctccccaattacccttagaaaatgatcacaccaactctgcctacacacttccagtgatagtggctcattgtctgttaaggcaaactgttccactgttgggcatatctctttgttagaaagttctttcttaggttgctaaaatctgcctagtaccccgctaccctgttctgtcttatggagcagcccagattatctttactccctctttctcatggcaaccctgaagataatcaaggccagttactcatcatctcccaaccactgtttcctcaactgcccttcatatgtcatggttttcagatccattccaacctgactgaatgttaacagacagaattcttcacattaaggaactgtcttcatcatcatacatgtagaaaagaatctgaacatttaagtgcgaagttttctctagaaatatattcaagatatgtttattctattattgtaaatttcaaacaataaataaataagaatccatgacttccttcagtggcccagtccagtgcctaagtcatctggaatcttctccttacatcgaatacaaacctaacctgtttccaagtagggcactccctccgcttatttattcatttattcagccattcagcaaacatttattaaatggctacctatgtgaggcactatatttggcattaggtatataaaggcaactaacacatggtatctgtctccaaaggtttacagcttttcttctgaaagtgccttttgtgtccttgaatagagtgattatgacttttgtctcaattaaatgatgacctcatttagtttctgatgaagtttctctacatttaagaaaatctagtgagcaaaacggtatacaaaaaatcatctggatctgactaccagaaaaagtaaagtggttttaattacagaaagaaaaatatttgttagatttctggtcactgaataaatatgcatcttatacaacacagaacaacctaaatttagggcttctggaaacctgagtttgatgactttgttgtgtttggttcatccggactaggtttcacccattctataattcctagaaacaaactagatgaaaatatcaatgaaatgatccaggtctgtcttacaagtcaatttgctttagcttccaaaagaagttgaaattttttagaattttaaagaaaaactcacttttcaagtgtcatataattcttatattttaaatataaatcgaaccaactaaatttaccgctatatttttttctacatattcttttttcaattttcattttgaaaaaattcagacctatgtaaaagttgagagtagaacaaagatacttggtactcatccctcaggttcatttattgttaatatttcaccatatttacttcatctctgtatacacacacacttttttgtatgattaaatcatttgaaattaaattgtagagtatgatacttcatctgcaaatacttcagcatgtgttagctgagaacatgggtattcttctgcaagtctacaataccatcttcatactcaagaaatgtaacattggctggtcatggtggctcacgcctgtaatcccagcactttgggaggccaaggcgtgtggatcacctaaggtcaggagttcgagatcagcctggccaacatggtgaaaccccgtctctactaaaaatacaaaaattagccaggcgtggtagctgtaatcccagctacttgggaggctgaggcaggagaattgcttgaagccaggaggcagaggttgcagtgagccgagattgcaccactgcactccagcctgggcaagaagagtgaaattttgtctcaaaaaaaaaaatgtaatattaatacaataatacctgatagtttatattcaagtttctctaactacccaaattatgtcctcttatagttgtttttgttttaatacagtattcaaacaaagatcacacactgcttttagtttccaagtctttttttttttttttttttttaaatcttgcatagtttccctgtgcttttactctatttttctttgggcttttataacatcgacagttctgaaaagtccaggccagttttgcagaatgatccacaatcttgatgggtctagttgttttctcattgttaaactcagggtaaacttttttttgtcaagtaaatacataggtgactttgcattcacagccactctttaatgaagattgattgaataactgacattcctgatatgttttaaagttcacagcttactctttcagcccatgcttcatccatctaaggcaagggtcagcaaactgtggcacgtgggccaaattcagctcgttgcctgttctggtttgacccatttgaacaattgacgagcttcaaacaatttttacattttttagtagttaaacaaaagaatacttcatgacatgtgaaaatcatatgaaatttaaattttggtgtccatgtataaagttttattagaacacatccacgcacatttgtttccatagtctacggatgctttgacactatacaaagttacgtacttgcaacaaaagccatatggcctgcaaaacctaaaacatttactatctggatcattacagaaagttttctgatccctggtctatgatattctaaattccgacacattttcttaggatagatttccatttgcaaattcagtgtaagacataaacaccggcaatagttgtgttttttttttctttttacttcctagattttattgcattctcaacttgtttcatattaccttaaaaaataaagtgcacttaaagattgtttcacatccacagtttgtttaaggatttaaatttagttcactattactgcctggctttgattgatttagagggttagtcaattacagactaaataattagttcaatcaaaaccatcagaaaaattgacacaaactcacttccatgcaccagtaaactggaatcctttctttaaatgtttttctaaagcaatccgaggaattaaattcaggccatttcacagtcagtttttttcaaattcatttttcaactcaaaggcaaaaccatgatcaaaatattgtatatagtacaccttcagttcccaactgctgaatttaccaaggaattaagtattcaccacaaaccctggtgtggccataggtggacactctaattaaaaagaagatgttcaaaaagaatagtccttcttttctttcttaaattcacctttgatagcactgccacacttctgggaagggaacgttcaaggaaaccgtatagccacttcttttttaaaagcagccacataccttctatataacaatggccctttagtttgagagttgccacatatttgcatttccagagtaaaataataggatgacatgggcaggtcaggcccacaatagtatggtttctttggcaaaggcattttggccaatgccgtaagaccattctggcccttgattaatgggttctcaccaaagcagaaattacgcagagcttatttgtccttgcattttgaagtaaatcattgcctgcataaagcaactcttttgtctcttttccattgcaacacacaggagttggaatgtgttcatacgtgtaagactgtcttagtctgcccagactgcttggactgtgttgtttataaacaacagaatttactgctcaaagttctggagactgggaagttcaagatcaagatgctagcagattcagtgtctgaggagggctcactttctgtttcattgatgcaccttactgcatcctcatctggtggaaggggcagtgaacaagctcccttgggccccttttacgaaagcactaattccattcatgaagacttcacaacttaatcacctcccaaaggctccatctcttaatacgatcacattggggattaggtttcaacataccaattttgggggtacacaaatattgaggtgatagacacttccaggcttttgccaaacattagtaaacaatttccagtgaatactctgccccattctctcctactcaagcagagtatcttaaggcagcagattggagtgacgttactttaagggtaactttgaagccaatctaattcatactcaaaaaagtattccaaaattttggtactctattatgggttacaaaccccttgtgacaccatatttaagagccactgctattgaggcttgcactctcttgcttgaaatgaggtgctcccaaacctgggagatggctcccaaagaacaagagaatcaaccccatcgtgcatttatgtgctgccccaggtaatccacaggcacaaagaacttgagcttcctggtgtgttcttcagaaaaaaaggaattcaaaaagcaaatgtaaaatggaacagaacttggcctcaaagtgatgttggaaaaatagccagtcctgatgacttggtcgaggtaacttgctttgcccactgttaactacagagccatatgataatggaacatcaaggttttccagataaacccaaagccttttgtgtctataccttgtaacctgtcatgttcatcaacgttttagactgtaccattgctctttctcccttctttattcattttatatggggacgtttgactaggatcaccagatgtagatttggtaatttttccataccattaagatgtatgataatggattttattaatttaacacaaatgcataaaaatatgatgtaataagaaacaatcctgaaattattaaaacatttctttgtccttacttaaacctaacctgccattttaaaagacacctaactctataaacaaatgggccattacagacgtaaaacaaatattattcagtgaaatttattcaaggacttaaaatgattgaaggcattaggaacataaaaatgcataagatcctcttttaaatcccaatattccctaaccactggtttataaaaaatactctaaggtttatagaattagtttggttccgttagttgatcaagttacttacactaagtcagcaattcaaaacaaataattccctctgtgtgtgtttgtttgcttgcaaatatgtttcattttaaagtgtctttttatatagaaagccaagttggtggaatttatcttgtcattaaaatgatgtgaaaatc

SEQ ID NO: 103104 - DNA, 5259 bp, Homo sapiens
  Payload ID: 112
  Gene Symbol: AKAP6
  Gene Name: A kinase (PRKA) anchor protein 6
  Uniprot ID: Q13023
  ENST ID: ENST00000557354
  CDS Start-End: 100-3327
ctcctagtattgcatcctacagatgtgctgtaaacatcaaaagaagacggtgggatcaggagatgctgttttggaaagaagtgaggtttagacttctccatgttaaccatgagcgtgacactttcccccctgaggtcacaggacctggatcccatggctactgatgcttcacccatggccatcaacatgacacccactgtggagcagggtgagggagaagaggcaatgaaggacatggactctgaccagcagtatgaaaagccacccccactacacacaggggctgactggaagattgtcctccacttacctgaaattgagacctggctccggatgacctcagagagggtccgagacctaacctattcagtccagcaggattcggacagcaagcatgtggatgtacatctagttcaactaaaggacatttgtgaagatatttctgatcatgttgagcaaatccatgccctccttgaaacagagttctccctaaagctgctgtcttactctgtcaacgtgatagtggacatccacgcagtgcagctcctctggcaccagcttcgagtctcagtgctggttctgcgggagcgcattctgcaaggtctgcaggacgccaatggcaactacactaggcagacggacattctgcaagctttctctgaagagacaaaagagggccggcttgattctctaacagaagtggatgactcaggacaattaaccatcaaatgttctcaaaattacttgtctctggattgtggcattactgcattcgaactgtctgactacagtccaagtgaggatttgctcagtgggctaggtgacatgacctctagccaagtcaaaaccaaaccctttgactcttggagctacagtgagatggaaaaggagtttcctgagcttatccgaagtgttggtttacttacggtagctgctgactctatctctaccaatggcagtgaagcagttactgaggaggtatctcaagtatctctctcagtagacgacaaaggtggatgtgaggaagacaatgcttctgcagtcgaagagcaaccaggcttaacactgggggtgtcatcatcttcaggagaagctctgacaaatgctgctcaaccctcctctgagactgtgcagcaagaatccagttcctcctcccatcatgatgcaaagaatcagcagcctgttccttgtgaaaatgcaacccccaaacgaaccatcagagattgctttaattataacgaggactctcccacgcagcctacattgccaaaaagaggactttttcttaaagaggaaacttttaagaatgatctgaaaggcaatggtggaaagaggcaaatggttgatctaaagcctgagatgagcagaagcaccccttcgctagtagatcctcctgacagatccaaactttgcctggtattgcagtcttcttaccccaacagcccttctgctgccagccagtcttatgagtgtttacacaaggtggggaatgggaaccttgaaaacacagtcaaatttcacattaaagaaatttcttccagcctgggaaggcttaacgactgctataaagagaaatctcgacttaaaaagccacacaagacctcagaagaggtgcctccatgccgaacacctaaacgggggactggttcaggcaaacaagctaaaaatacaaagagctcagcagtgccaaatggagagctttcttatacttccaaggccatagaggggccacaaacaaattctgcttccacatcctcacttgagccttgtaatcagagaagttggaatgccaaattgcaattgcagtcagaaacatccagttcaccagcttttactcagagcagtgaatcctctgttggctcagacaacatcatgtctccggtgccacttctttcaaaacacaaaagcaaaaaaggtcaagcctcctctccaagtcacgtcactaggaatggtgaggttgtggaggcctggtatggctctgatgaatacctagcactgccctctcaccttaagcagacagaagtattggctttgaagttggaaaacctaacaaagcttctgcctcagaaacccagaggagaaaccatccagaatattgatgactgggaactgtctgaaatgaattcagattctgaaatctatccaacctatcatgtcaaaaagaagcatacaaggctaggcagggtgtctccaagctcatctagtgacatagcctcttcactaggggagagcattgaatctgggcccctgagtgacattctttctgatgaggagtccagtatgcctctcgctggcatgaaaaagtatgctgatgagaagtcagaaagagcttcatcctctgagaaaaatgagagccattctgccactaaatcagctttaattcagaaactgatgcaagatattcagcaccaagacaactatgaagccatatgggaaaaaatagaggggtttgtaaacaaactggatgaattcattcaatggttaaatgaagccatggaaactacagaaaattggactccccctaaagcagagatggatgaccttaaactgtatctggagacacacttgagttttaagttgaatgtagacagtcattgtgctctcaaggaagctgtggaggaggaaggacaccaacttcttgagcttattgcatctcacaaagcaggactgaaggacatgctgcggatgattgcaagtcaatggaaggagctgcagaggcaaatcaaacggcagcacagctggattctcagggctctggataccatcaaagccgagatactggctactgatgtgtctgtggaggatgaggaagggactggaagccccaaggctgaggttcaactatgctacctggaagcacaaagagatgctgttgagcagatgtccctcaagctgtacagcgagcagtataccagcagcagcaagcgaaaggaagagtttgctgatatgtcaaaagttcattcagtgggaagcaatgggcttctggactttgattcagaatatcaggagctctgggattggctgattgacatggagtcccttgtgatggacagccacgacctgatgatgtcagaggagcagcagcagcatctttacaagcgatacagtgtggaaatgtccatcagacacctgaaaaagacggagctgcttagtaaggttgaagctttgaagaaaggtggcgttttactaccaaatgatctccttgaaaaagtggattcaattaatgaaaaatgggaactgcttggggtatttgcatttttattactgtttgtaggttatgtgtacattttttgcgtagtgaagtactctgtccgatttctaatttgaggcacaaatatctctctctttcaattcactacctacgtttcaaacaagctattcatgctattatgggaaagacactgcttttcctcttctgttgattttttttttttctgagcttgtcccctctcagattttaataattttggttctttaatacatgaaaaagtaagtaaaatatgccatgtattatgggtatgcaccaagtcaactataatacagtatatctgatatatactgactgtcatgcttgaatgaatgttaatagaatttattctgaaggtacatgtgagagacatctactgtttaactatttactgtacccttaagatgaaaagtggagttgtcactacagctttcaagtcacactaaagccaccaaaacaaagatgcaaatttgacccaaatctgaattgcagaattgaatcagcctgtgttttgtgcctcaatttccagctcacttttaacaaaagccaaaaaaaaaaaaagtttcatgtaattcatttcacgcaatgatgggctgggtctcagccaaagactgagatgcaagaatctggcaaaaaggcaatatagagattctgttacccagagaccaggatggcactgtgcaggagacagtactgtccttttgttggaagacagctgagagaaaagttaaactgtattttttcatcagcttctctcctaaattgccttcacttcaaatcaagggtaagctatatttgtcaattacctaaataattaattataacagccaagtatggacgatgtcagttatggagcataattttgcatgccttccatttttctaccttttaaaaaaaattttagataaataatactccaaaaatattttgaataaaaagctcttcatgtaccttgatgatttggaggaatgccagtattctgtttatgccatgcctaatctaggagattaaaaaactgcaggtttaagtccttgtttctcatttaaattcactacactctgcagttgtgcaaagtaacttaaaatgttaaaagtttttcatctaacatattgttgccttttaataataattaatggctttcactttataatacggtgacttaaatcaaaacctgccgtattctacagcattcattgatctcaaacaggagaaatgtggttagtgtatgacattttaaaaggttgtttactacatagataagaatggcaaccttatgtgcttgataaagtagcgataagtctgtttacattgcattttaatatatccattggtaatttgataaataacaataatatttttagaaaattgtttaagttatgtcacatgtattgcttcctcaacagaattttaagtcaacattattttgaaaaaagaaataatatttagctatcctttatgaatcagagactttaaaaatagttgccattttgacaaaaacatcattcaaatacaacatgcaggtttgcagtgagagagtagggtgagggaagatttttttaaatcctgtaccacactaacaccaccaggcatactgttttaattggcatgattacattttaattggcatgaaaaaaattaaagacaaggattttaacttctaacaatagtaaaatagaggtatatggtttttaatattactttcatctaaggtgaacagtgtggaatggaaatacattagaatgaaatgtcagtggtgcgtacagtttaatctgtgaaattgtgtcccctgtgctgcatattactctgtctcaattgcatattaaacaaccctatcaaggcaggcattggcatctgctgtgctgacacaaattgtgaattaaatgaaattgatgtcctctgtcgtatatttatgaagacggaccattctctgaagtattctgtttatgaagaatttatgattgcaaactgttccagaacaaaaaagtggcaataaattcttttttgtgacccta

SEQ ID NO: 103105 - DNA, 562 bp, Homo sapiens
  Payload ID: 112
  Gene Symbol: AKAP6
  Gene Name: A kinase (PRKA) anchor protein 6
  ENST ID: ENST00000557102
  CDS Start-End: 239-562
agtattgcatcctacagatgtgctgtaaacatcaaaagaagacggtgggatcaggagatgtttggacagctctttattcagaacatcaaggactgttgacagttgaataaaaagggcggaggcttatgggattgctaatgagatacaaagccaccttggaataaaaataaatttctctctgttggctcctccggccatggagagctgttttggaaagaagtgaggtttagacttctccatgttaaccatgagcgtgacactttcccccctgaggtcacaggacctggatcccatggctactgatgcttcacccatggccatcaacatgacacccactgtggagcagggtgagggagaagaggcaatgaaggacatggactctgaccagcagtatgaaaagccacccccactacacacaggggctgactggaagattgtcctccacttacctgaaattgagacctggctccggatgacctcagagagggtccgagacctaacctattcagtccagcaggattcggacagcaagcatgtggatgtacatctagttcaactaaag

SEQ ID NO: 103106 - DNA, 2274 bp, Homo sapiens
  Payload ID: 112
  Gene Symbol: AKAP6
  Gene Name: A kinase (PRKA) anchor protein 6
  ENST ID: ENST00000553547
  CDS Start-End: 1205-2274
acatatgtggctttcatcccagcacattgggcaggacaccactgttttcttcgtttggttaatagttacacttccttgacacctcatacagctgggtcatggatctgctgctgttctcaatgtgagcatcactgtctttttttctttttctttttctttttttgggacaggatctctgtcacccaggctggagtgcggtggcacgatctcagctcactgcagcctccacctcctgggttcaagcgattctcctgcctcagcctctcaagtagctgggattacaggcatgcaccaccgtgcctggctaatttttgtatttttggtagaaacggggtttcactatgttggccaggctggtctcaaactcctgatctcaggtgatccacccgcctcggcctcccaaagtgctgggattacaggtgtgagccacggtgcccagcccactgtcttttttcatcaatgctaagagaatttaattctttccacatgaagcgattctacttcctcaacacgtgtttcgttttgtgacacaacaacttggaggaggtgaaattcattaacaaggaataaatatcttctctttatggagccacttccttaacccctcaaatcttcctagaccacttccatccaacgtagaataagtgaaccatatgaaattgctgtttttgtgggtcaaaggcaattgaatggtagtctcacatggttcaacatctgtatacaagcaagttctctgatgaaaaagctgagtgactgcgagtaccattcttagaattctttaggagagaagaaagatttcaaggacatttgtgaagatatttctgatcatgttgagcaaatccatgccctccttgaaacagagttctccctaaagctgctgtcttactctgtcaacgtgatagtggacatccacgcagtgcagctcctctggcaccagcttcgagtctcagtgctggttctgcgggagcgcattctgcaaggtctgcaggacgccaatggcaactacactaggcagacggacattctgcaagctttctctgaagagacaaaagagggccggcttgattctctaacagaagtggatgactcaggacaattaaccatcaaatgttctcaaaattacttgtctctggattgtggcattactgcattcgaactgtctgactacagtccaagtgaggatttgctcagtgggctaggtgacatgacctctagccaagtcaaaaccaaaccctttgactcttggagctacagtgagatggaaaaggagtttcctgagcttatccgaagtgttggtttacttacggtagctgctgactctatctctaccaatggcagtgaagcagttactgaggaggtatctcaagtatctctctcagtagacgacaaaggtggatgtgaggaagacaatgcttctgcagtcgaagagcaaccaggcttaacactgggggtgtcatcatcttcaggagaagctctgacaaatgctgctcaaccctcctctgagactgtgcagcaagaatccagttcctcctcccatcatgatgcaaagaatcagcagcctgttccttgtgaaaatgcaacccccaaacgaaccatcagagattgctttaattataacgaggactctcccacgcagcctacattgccaaaaagaggactttttcttaaagaggaaacttttaagaatgatctgaaaggcaatggtggaaagaggcaaatggttgatctaaagcctgagatgagcagaagcaccccttcgctagtagatcctcctgacagatccaaactttgcctggtattgcagtcttcttaccccaacagcccttctgctgccagccagtcttatgagtgtttacacaaggtggggaatgggaaccttgaaaacacagtcaaatttcacattaaagaaatttcttccagcctgggaaggcttaacgactgctataaagagaaatctcgacttaaaaagccacacaagacctcagaagaggtgcctccatgccgaacacctaaacgggggactggttcaggcaaacaagctaaaaatacaaagagctcagcagtgccaaatggagagctttcttatacttccaaggccatagaggggccacaaacaaattctgcttccacatcctcacttgagccttgtaatcagagaagttggaatgccaaattgcaattgcagtcagaaacatccagttcaccagcttttactcagagcagtgaatcctctgttggctcagacaacatcatgtctccggtgccacttctttc

SEQ ID NO: 103107 - DNA, 582 bp, Homo sapiens
  Payload ID: 112
  Gene Symbol: AKAP6
  Gene Name: A kinase (PRKA) anchor protein 6
  ENST ID: ENST00000554410
  CDS Start-End: 507-582
accatgagtagggtgttgatgatgaagttggaagatttgtgaatttatcctgtgttacttctgggattcagaatgctcagtgctggcatggaggaactcacatcgacatttgtgaagatatttctgatcatgttgagcaaatccatgccctccttgaaacagagttctccctaaagctgctgtcttactctgtcaacgtgatagtggacatccacgcagtgcagctcctctggcaccagcttcgagtctcagtgctggttctgcgggagcgcattctgcaaggtctgcaggacgccaatggcaactacactaggcagacggacattctgcaagctttctctgaagagacaaaagagggccggcttgattctctaacagaagtggatgactcaggacaattaaccatcaaatgttctcaaaattacttgtctctggattgtggcattactgcattcgaactgtctgactacagtccaagtgaggatttgctcagtgggctaggtgacatgacctctagccaagtcaaaaccaaaccctttgactcttggagctacagtgagatggaaaaggagtttcctgagc

SEQ ID NO: 103108 - DNA, 4601 bp, Homo sapiens
  Payload ID: 112
  Gene Symbol: AKAP6
  Gene Name: A kinase (PRKA) anchor protein 6
  ENST ID: ENST00000557272
  CDS Start-End: 44-3781
caggagatgctgttttggaaagaagtgaggtttagacttctccatgttaaccatgagcgtgacactttcccccctgaggtcacaggacctggatcccatggctactgatgcttcacccatggccatcaacatgacacccactgtggagcagggtgagggagaagaggcaatgaaggacatggactctgaccagcagtatgaaaagccacccccactacacacaggggctgactggaagattgtcctccacttacctgaaattgagacctggctccggatgacctcagagagggtccgagacctaacctattcagtccagcaggattcggacagcaagcatgtggatgtacatctagttcaactaaaggacatttgtgaagatatttctgatcatgttgagcaaatccatgccctccttgaaacagagttctccctaaagctgctgtcttactctgtcaacgtgatagtggacatccacgcagtgcagctcctctggcaccagcttcgagtctcagtgctggttctgcgggagcgcattctgcaaggtctgcaggacgccaatggcaactacactaggcagacggacattctgcaagctttctctgaagagacaaaagagggccggcttgattctctaacagaagtggatgactcaggacaattaaccatcaaatgttctcaaaattacttgtctctggattgtggcattactgcattcgaactgtctgactacagtccaagtgaggatttgctcagtgggctaggtgacatgacctctagccaagtcaaaaccaaaccctttgactcttggagctacagtgagatggaaaaggagtttcctgagcttatccgaagtgttggtttacttacggtagctgctgactctatctctaccaatggcagtgaagcagttactgaggaggtatctcaagtatctctctcagtagacgacaaaggtggatgtgaggaagacaatgcttctgcagtcgaagagcaaccaggcttaacactgggggtgtcatcatcttcaggagaagctctgacaaatgctgctcaaccctcctctgagactgtgcagcaagaatccagttcctcctcccatcatgatgcaaagaatcagcagcctgttccttgtgaaaatgcaacccccaaacgaaccatcagagattgctttaattataacgaggactctcccacgcagcctacattgccaaaaagaggactttttcttaaagaggaaacttttaagaatgatctgaaaggcaatggtggaaagaggcaaatggttgatctaaagcctgagatgagcagaagcaccccttcgctagtagatcctcctgacagatccaaactttgcctggtattgcagtcttcttaccccaacagcccttctgctgccagccagtcttatgagtgtttacacaaggtggggaatgggaaccttgaaaacacagtcaaatttcacattaaagaaatttcttccagcctgggaaggcttaacgactgctataaagagaaatctcgacttaaaaagccacacaagacctcagaagaggtgcctccatgccgaacacctaaacgggggactggttcaggcaaacaagctaaaaatacaaagagctcagcagtgccaaatggagagctttcttatacttccaaggccatagaggggccacaaacaaattctgcttccacatcctcacttgagccttgtaatcagagaagttggaatgccaaattgcaattgcagtcagaaacatccagttcaccagcttttactcagagcagtgaatcctctgttggctcagacaacatcatgtctccggtgccacttctttcaaaacacaaaagcaaaaaaggtcaagcctcctctccaagtcacgtcactaggaatggtgaggttgtggaggcctggtatggctctgatgaatacctagcactgccctctcaccttaagcagacagaagtattggctttgaagttggaaaacctaacaaagcttctgcctcagaaacccagaggagaaaccatccagaatattgatgactgggaactgtctgaaatgaattcagattctgaaatctatccaacctatcatgtcaaaaagaagcatacaaggctaggcagggtgtctccaagctcatctagtgacatagcctcttcactaggggagagcattgaatctgggcccctgagtgacattctttctgatgaggagtccagtatgcctctcgctggcatgaaaaagtatgctgatgagaagtcagaaagagcttcatcctctgagaaaaatgagagccattctgccactaaatcagctttaattcagaaactgatgcaagatattcagcaccaagacaactatgaagccatatgggaaaaaatagaggggtttgtaaacaaactggatgaattcattcaatggttaaatgaagccatggaaactacagaaaattggactccccctaaagcagagatggatgaccttaaactgtatctggagacacacttgagttttaagttgaatgtagacagtcattgtgctctcaaggaagctgtggaggaggaaggacaccaacttcttgagcttattgcatctcacaaagcaggactgaaggacatgctgcggatgattgcaagtcaatggaaggagctgcagaggcaaatcaaacggcagcacagctggattctcagggctctggataccatcaaagccgagatactggctactgatgtgtctgtggaggatgaggaagggactggaagccccaaggctgaggttcaactatgctacctggaagcacaaagagatgctgttgagcagatgtccctcaagctgtacagcgagcagtataccagcagcagcaagcgaaaggaagagtttgctgatatgtcaaaagttcattcagtgggaagcaatgggcttctggactttgattcagaatatcaggagctctgggattggctgattgacatggagtcccttgtgatggacagccacgacctgatgatgtcagaggagcagcagcagcatctttacaagcgatacagtgtggaaatgtccatcagacacctgaaaaagacggagctgcttagtaaggttgaagctttgaagaaaggtggcgttttactaccaaatgatctccttgaaaaagtggattcaattaatgaaaaatgggaactgcttgggaaaaccctaggagagaagatccaggacacaatggcagggcacagtgggtcgagtccacgtgacctgctctctcctgaaagtggaagcctggtaaggcagctggaggtcaggatcaaagaactgaaaggatggctaagagatacagagcttttcatcttcaattcctgtctgagacaagaaaaggaaggaacaatgaatactgagaaacaactgcaatactttaagtccctctgtcgtgaaatcaagcaacgacgtcgaggagttgcctccattctgcgactatgccagcatcttttggatgaccgggagacttgcaatctgaatgcagaccaccagcccatgcagctgatcattgtaaatcttgaaagaaggtgggaagccattgtcatgcaagccgtccagtggcaaacacgtctacaaaagaagatgggaaaggaatctatacgcctggctgcaactcaggggtggcctcatcctcccgccctgggctggcctctggttccatcacgtttgtcactgccgtttattacattgacttctcccaagatgaatcttccttccaaatgtgttttctccacacaagccttgtgatctgaatgtgtgcgctggttctctttaggtgatcgtctttgaagttcagcaaagctgcttgttctcccatggattcctgtcccaagctacctctaccaaccctctctctccagctagacttttctctttgcctcctcccttcccttccactctttaaagttctgcagttcaccaactggtagtccattaaattctcctgtctagaatgacccccccaccagtacttgaccaatttcatgtatcaatctggatttttttttaacggtataatgactgtgtttattgaaagagttttacctaaaaagccaacatttgaattggttgcagcatagagaagaaacactggtccttctttcaaaattaagcaactattaaaagcgccattttatttatttcatttaaaaaataatctatgcagcatttcaagaaacaaccatatggtgttgtatattataaactggtgacattctactattgaattatgtacaacattttcattttttatgcttcttgaggtggtaatgagaaaaaagttttttaaaaaagtgtgccttgctgtatttcttataccatttattaaaaagctgctttcacggtaaaattatgttggtttgaaaggaggaaatagcaaggttaagatgtgtgaataatttctgtatatatgtataaccaagtacaaacattgatgtataatgacagtataaaatgctttcatgtttgtgatgtctagtgatgtggaaaatataagccttaaatccattagattgcatggtaattaaaattggcataataaacacagattattgggggaaaaggaaaa

SEQ ID NO: 103109 - DNA, 356 bp, Homo sapiens
  Payload ID: 112
  Gene Symbol: AKAP6
  Gene Name: A kinase (PRKA) anchor protein 6
  ENST ID: ENST00000554740
  CDS Start-End: 1-356
tgaatactgagaaacaactgcaatactttaagtccctctgtcgtgaaatcaagcaacgacgtcgaggagttgcctccattctgcgactatgccagcatcttttggatgaccgggagacttgcaatctgaatgcagaccaccagcccatgcagctgatcattgtaaatcttgaaagaaggtgggaagccattgtcatgcaagccgtccagtggcaaacacgtctacaaaagaagatgggaaaggaatctgtgagtgatgctttttttaagcataattgtctgtcattttctcagacaaaaaataattctttcaggcttggaaacggtgttcatcttataaatggttttactaactaa

SEQ ID NO: 103110 - DNA, 876 bp, Homo sapiens
  Payload ID: 112
  Gene Symbol: AKAP6
  Gene Name: A kinase (PRKA) anchor protein 6
  ENST ID: ENST00000556638
  CDS Start-End: 736-876
agtctgggagctgagtgactgaggatttgaaaccttgctatagttacagttcataacaagtgtctaggcagttagaccttaagtgttcaggtatggaaagaaagtcatatgttatgttttagattctgtttgtaaagctggttaactagagacagctgatgaaaaaccaaatcgacttgagttacaagatctgggctttctctgctctgctttcaacctgttggttggtggtggagtagctgacagaagcgaatggcttggctgagggacatgaagtgacagcagcctgtttaggaccacaccacattttggacctcttgctgtgcagttcaggacatttgtgaagatatttctgatcatgttgagcaaatccatgccctccttgaaacagagttctccctaaagctgctgtcttactctgtcaacgtgatagtggacatccacgcagtgcagctcctctggcaccagcttcgagtctcagtgctggttctgcgggagcgcattctgcaaggtctgcaggacgccaatggcaactacactaggcagacggacattctgcaagctttctctgaagagacaaaagagggccggcttgattctctaacagaagtggatgactcaggacaattaaccatcaaatgttctcaaaattacttgtctctggattgtggcattactgcattcgaactgtctgactacagtccaagtgaggatttgctcagtgggctaggtgacatgacctctagccaagtcaaaaccaaaccctttgactcttggagctacagtgagatggaaaaggagtttcctgagcttatccgaagtgttggtttacttacggtagctgctgactctatctctaccaatggcagtgaagca

SEQ ID NO: 103111 - DNA, 2238 bp, Homo sapiens
  Payload ID: 113
  Gene Symbol: AKAP7
  Gene Name: A kinase (PRKA) anchor protein 7
  ENST ID: ENST00000263050
  CDS Start-End: 175-429
tatctttcttgttttgctttcaaatggattgtcctcttccaagtggtttcaaacttaatcacagaatgacaatcagtggtgaagggagtgaaaaaaatagatcctgatttatatgaaaagtttatcagtcacagatttggagaagaaatattatatcgcatagatctttgctccatgctgaagaaaaaacaaagtaatggttattatcactgtgaatcttccattgtgattggtgaaaagaacggaggggagcccgatgacgctgaactagtaaggctcagtaagaggctggtggagaacgcggtgctcaaggctgtccagcagtatctggaggaaacacagaataaaaacaagccgggggaggggagctctgtgaaaaccgaagcagctgatcagaatggcaatgacaatgagaacaacaggaaatgagcccggaacgcaggcccccatgtctctgtgcaaagcctccctgcttccctctgctgagtctagggactgacttgcagcgtgctgtttaagttaagtttctctggtgcaatctgtgaagattgcctaatacttttcatgatcgatgtgttcgcattgctgaaacacaacagaagaaaaatggagtgctgggactggcagaggaaattaattgatgaaagaagaatggcccaagtttcattcgccctcagccacgcacaagggaaagggaactttgggttatgcctcctggacgcaaattaaaggccgagaaagaggccttgccatcaatggaatactgccatttatattgcttagcagggcatttgactactttatctgaggccagaactctcacacacagctatcaagtgctaagtttaaaataatcactgttggaattgtcatctgtacaattagtccataatgtttcatgtttgtcctaagtgtgctgttgctatgcagtgtgatctttatttatagtaaattatgtttcatgtaaatgatatatttttggtgaaatgcaaccttttctataaaatgtgggcaacattttaaagtttttttaaaatcctattttgataagtcagtatgccatatttaatgaaatgttattatataatttttttttcttaggcaagaaacctattggaattcgagacttaattaatgaagctttgcatcgagaaacgatgggtctgaagtccaaagtgaaacagataaaggaacttttattaaagcctgagactcaggccagaattaggagggagctttttgaaggaagacttattaacaacagtaattcagcaaatgacgttgatttcagcacaactttgacataagctctacattgcgattgtgacaacatagcttatgaaatcttttcagcttattaagtagctctttggtaaacaccaaagaagtttctgatagtgtctgcacaacagcaaaccaacatttggtgaggaattagcaatttcttgccaaagaaaattgattctgcccaattattttttgagctacacttgtgttttagaatatctgtttctgtaatattgagagttattttatagaaatgatttcttaattagctgttgtgagatatttctcgggtccttgcagaaaaaaacatacagactgtgaacaaatcattcacaaacagaataaaacagagccaacaacagtattttaagggtcacttgcctcctgttgacacaattgttgctaaatcaaaagaagcgttgtccaggtgtgtctacatctagtgttacttttaatgagaatttgaatgtttattgaacaatagtacttgaatgaacatttataaatgtaattattgcgatcactggttaagaatgttttatatatccttataatatttttcactgatcaaaatgttgttctgctttttcatttcttaaggaatacatgtttgggatttttattttttacgtgtccgaagataagctccaggtcttatcgtatcccttgccatctgaacttgtttgcactgcttctgtttgaaagagcatcttgaaaaacttccccggtatgatgattgttggtaacaactttttctatagtcattgatggagtagatcatgatggaggggaaatcactggagatcaaatatgtaaaatcatttcaaatataaaatccagtttactcatggattttagctattttttcactgggtaaattatactacatttatttacaaatgagtttatgcattttcatggctcttaataaacatattgttttcccttgtt

SEQ ID NO: 103112 - DNA, 2461 bp, Homo sapiens
  Payload ID: 113
  Gene Symbol: AKAP7
  Gene Name: A kinase (PRKA) anchor protein 7
  Uniprot ID: O43687
  ENST ID: ENST00000342266
  CDS Start-End: 410-655
aattactgcagttgtctgtaggagaaagggctcattgtggtttttctcgactacctttcttaaagacatatgcaaatagccagacagaacacatggcactgacctatggccagggactcacagttttgtgagaatacgggagcgtatagccacttccttcactgaatgccagtcccagagcagttgcattaggctggaggactggaggtggagccttttttgctcacggcagcaagttcccttctcctttctctcccccggcggcgtgtgcattggctcttcaagctgcctgtgctgctccgtggagtgaaaaaggcagggtgtgctcgcagactgtgctataaactgcaatttctatttggggtcctcacggagaagaacaccaggaaagacagacaggaccagtgccatgggccagctttgctgctttcctttctcaagagatgaaggaaaaatcagtgaaaagaacggaggggagcccgatgacgctgaactagtaaggctcagtaagaggctggtggagaacgcggtgctcaaggctgtccagcagtatctggaggaaacacagaataaaaacaagccgggggaggggagctctgtgaaaaccgaagcagctgatcagaatggcaatgacaatgagaacaacaggaaatgagcccggaacgcaggcccccatgtctctgtgcaaagcctccctgcttccctctgctgagtctagggactgacttgcagcgtgctgtttaagttaagtttctctggtgcaatctgtgaagattgcctaatacttttcatgatcgatgtgttcgcattgctgaaacacaacagaagaaaaatggagtgctgggactggcagaggaaattaattgatgaaagaagaatggcccaagtttcattcgccctcagccacgcacaagggaaagggaactttgggttatgcctcctggacgcaaattaaaggccgagaaagaggccttgccatcaatggaatactgccatttatattgcttagcagggcatttgactactttatctgaggccagaactctcacacacagctatcaagtgctaagtttaaaataatcactgttggaattgtcatctgtacaattagtccataatgtttcatgtttgtcctaagtgtgctgttgctatgcagtgtgatctttatttatagtaaattatgtttcatgtaaatgatatatttttggtgaaatgcaaccttttctataaaatgtgggcaacattttaaagtttttttaaaatcctattttgataagtcagtatgccatatttaatgaaatgttattatataatttttttttcttaggcaagaaacctattggaattcgagacttaattaatgaagctttgcatcgagaaacgatgggtctgaagtccaaagtgaaacagataaaggaacttttattaaagcctgagactcaggccagaattaggagggagctttttgaaggaagacttattaacaacagtaattcagcaaatgacgttgatttcagcacaactttgacataagctctacattgcgattgtgacaacatagcttatgaaatcttttcagcttattaagtagctctttggtaaacaccaaagaagtttctgatagtgtctgcacaacagcaaaccaacatttggtgaggaattagcaatttcttgccaaagaaaattgattctgcccaattattttttgagctacacttgtgttttagaatatctgtttctgtaatattgagagttattttatagaaatgatttcttaattagctgttgtgagatatttctcgggtccttgcagaaaaaaacatacagactgtgaacaaatcattcacaaacagaataaaacagagccaacaacagtattttaagggtcacttgcctcctgttgacacaattgttgctaaatcaaaagaagcgttgtccaggtgtgtctacatctagtgttacttttaatgagaatttgaatgtttattgaacaatagtacttgaatgaacatttataaatgtaattattgcgatcactggttaagaatgttttatatatccttataatatttttcactgatcaaaatgttgttctgctttttcatttcttaaggaatacatgtttgggatttttattttttacgtgtccgaagataagctccaggtcttatcgtatcccttgccatctgaacttgtttgcactgcttctgtttgaaagagcatcttgaaaaacttccccggtatgatgattgttggtaacaactttttctatagtcattgatggagtagatcatgatggaggggaaatcactggagatcaaatatgtaaaatcatttcaaatataaaatccagtttactcatggattttagctattttttcactgggtaaattatactacatttatttacaaatgagtttatgcattttcatggctcttaataaacatattgttttccctt

SEQ ID NO: 103113 - DNA, 2954 bp, Homo sapiens
  Payload ID: 113
  Gene Symbol: AKAP7
  Gene Name: A kinase (PRKA) anchor protein 7
  Uniprot ID: Q9P0M2
  ENST ID: ENST00000431975
  CDS Start-End: 99-1145
gccctggcctccgcctcggcctcgcctccagccccgggacgcggcccgccaccgccgctgccgccagcccagacgcgccgcccgcatgcgccgcgaccatggagcgccccgaagcgggaggaattaattccaatgagtgtgaaaatgtatcaagaaaaaagaaaatgtcagaggaatttgaagccaatactatggattctctggtagacatgccatttgctactgtagatattcaggatgactgtggaatcactgatgaacctcaaataaatttgaagagaagtcaagaaaatgaatgggtcaagagtgatcaagtaaagaagaggaaaaaaaagagaaaagattatcaacccaactatttcctgtccattccaatcaccaacaaagagattataaaaggaattaagatcctgcagaatgcaataatacaacaagatgagcgactggccaaagcaatggtcagtgatggttcctttcatattaccctgctggtgatgcaattattaaatgaagatgaagtaaacattggtattgatgctcttttggaattgaaaccattcatagaagaactcctccagggaaaacatttgactttgccctttcaagggattggtacttttggaaatcaggttggatttgtgaagctggcagaaggagatcatgtaaactcacttttggagatagcagagactgcaaataggacatttcaagaaaaaggcatcctggtaggagagagcagaagttttaaacctcatttgaccttcatgaagttgtcaaaatcaccgtggctccgtaagaatggagtgaaaaaaatagatcctgatttatatgaaaagtttatcagtcacagatttggagaagaaatattatatcgcatagatctttgctccatgctgaagaaaaaacaaagtaatggttattatcactgtgaatcttccattgtgattggtgaaaagaacggaggggagcccgatgacgctgaactagtaaggctcagtaagaggctggtggagaacgcggtgctcaaggctgtccagcagtatctggaggaaacacagaataaaaacaagccgggggaggggagctctgtgaaaaccgaagcagctgatcagaatggcaatgacaatgagaacaacaggaaatgagcccggaacgcaggcccccatgtctctgtgcaaagcctccctgcttccctctgctgagtctagggactgacttgcagcgtgctgtttaagttaagtttctctggtgcaatctgtgaagattgcctaatacttttcatgatcgatgtgttcgcattgctgaaacacaacagaagaaaaatggagtgctgggactggcagaggaaattaattgatgaaagaagaatggcccaagtttcattcgccctcagccacgcacaagggaaagggaactttgggttatgcctcctggacgcaaattaaaggccgagaaagaggccttgccatcaatggaatactgccatttatattgcttagcagggcatttgactactttatctgaggccagaactctcacacacagctatcaagtgctaagtttaaaataatcactgttggaattgtcatctgtacaattagtccataatgtttcatgtttgtcctaagtgtgctgttgctatgcagtgtgatctttatttatagtaaattatgtttcatgtaaatgatatatttttggtgaaatgcaaccttttctataaaatgtgggcaacattttaaagtttttttaaaatcctattttgataagtcagtatgccatatttaatgaaatgttattatataatttttttttcttaggcaagaaacctattggaattcgagacttaattaatgaagctttgcatcgagaaacgatgggtctgaagtccaaagtgaaacagataaaggaacttttattaaagcctgagactcaggccagaattaggagggagctttttgaaggaagacttattaacaacagtaattcagcaaatgacgttgatttcagcacaactttgacataagctctacattgcgattgtgacaacatagcttatgaaatcttttcagcttattaagtagctctttggtaaacaccaaagaagtttctgatagtgtctgcacaacagcaaaccaacatttggtgaggaattagcaatttcttgccaaagaaaattgattctgcccaattattttttgagctacacttgtgttttagaatatctgtttctgtaatattgagagttattttatagaaatgatttcttaattagctgttgtgagatatttctcgggtccttgcagaaaaaaacatacagactgtgaacaaatcattcacaaacagaataaaacagagccaacaacagtattttaagggtcacttgcctcctgttgacacaattgttgctaaatcaaaagaagcgttgtccaggtgtgtctacatctagtgttacttttaatgagaatttgaatgtttattgaacaatagtacttgaatgaacatttataaatgtaattattgcgatcactggttaagaatgttttatatatccttataatatttttcactgatcaaaatgttgttctgctttttcatttcttaaggaatacatgtttgggatttttattttttacgtgtccgaagataagctccaggtcttatcgtatcccttgccatctgaacttgtttgcactgcttctgtttgaaagagcatcttgaaaaacttccccggtatgatgattgttggtaacaactttttctatagtcattgatggagtagatcatgatggaggggaaatcactggagatcaaatatgtaaaatcatttcaaatataaaatccagtttactcatggattttagctattttttcactgggtaaattatactacatttatttacaaatgagtttatgcattttcatggctcttaataaacatattgttttcccttgtt

SEQ ID NO: 103114 - DNA, 670 bp, Homo sapiens
  Payload ID: 113
  Gene Symbol: AKAP7
  Gene Name: A kinase (PRKA) anchor protein 7
  Uniprot ID: O43687
  ENST ID: ENST00000474850
  CDS Start-End: 139-453
attggctcttcaagctgcctgtgctgctccgtggagtgaaaaaggcagggtgtgctcgcagactgtgctataaactgcaatttctatttggggtcctcacggagaagaacaccaggaaagacagacaggaccagtgccatgggccagctttgctgctttcctttctcaagagatgaaggaaaaatcagtgagttggaaagctcgtcctctgcagtcctacagagatacagcaaggatatacccagttggtcaagtggtgaaaagaacggaggggagcccgatgacgctgaactagtaaggctcagtaagaggctggtggagaacgcggtgctcaaggctgtccagcagtatctggaggaaacacagaataaaaacaagccgggggaggggagctctgtgaaaaccgaagcagctgatcagaatggcaatgacaatgagaacaacaggaaatgagcccggaacgcaggcccccatgtctctgtgcaaagcctccctgcttccctctgctgagtctagggactgacttgcagcgtgctgtttaagttaagtttctctggtgcaatctgtgaagattgcctaatacttttcatgatcgatgtgttcgcattgctgaaacacaacagaagaaaaatggagtgctgggactggcagaggaaattaattgatgaaa

SEQ ID NO: 103115 - DNA, 2008 bp, Homo sapiens
  Payload ID: 113
  Gene Symbol: AKAP7
  Gene Name: A kinase (PRKA) anchor protein 7
  ENST ID: ENST00000541650
  CDS Start-End: 28-1080
gacgcgccgcccgcatgcgccgcgaccatggagcgccccgaagcgggaattaattccaatgagtgtgaaaatgtatcaagaaaaaagaaaatgtcagaggaatttgaagccaatactatggattctctggtagacatgccatttgctactgtagatattcaggatgactgtggaatcactgatgaacctcaaataaatttgaagagaagtcaagaaaatgaatgggtcaagagtgatcaagtaaagaagaggaaaaaaaagagaaaagattatcaacccaactatttcctgtccattccaatcaccaacaaagagattataaaaggaattaagatcctgcagaatgcaataatacaacaagatgagcgactggccaaagcaatggtcagtgatggttcctttcatattaccctgctggtgatgcaattattaaatgaagatgaagtaaacattggtattgatgctcttttggaattgaaaccattcatagaagaactcctccagggaaaacatttgactttgccctttcaagggattggtacttttggaaatcaggttggatttgtgaagctggcagaaggagatcatgtaaactcacttttggagatagcagagactgcaaataggacatttcaagaaaaaggcatcctggtaggagagagcagaagttttaaacctcatttgaccttcatgaagttgtcaaaatcaccgtggctccgtaagaatggagtgaaaaaaatagatcctgatttatatgaaaagtttatcagtcacagatttggagaagaaatattatatcgcatagatctttgctccatgctgaagaaaaaacaaagtaatggttattatcactgtgaatcttccattgtgattggcaagaaacctattggaattcgagacttaattaatgaagctttgcatcgagaaacgatgggtctgaagtccaaagtgaaacagataaaggaacttttattaaagcctgagactcaggccagaattaggagggagctttttgaaggaagacttattaacaacagtaattcagcaaatgacgttgatttcagcacaactttgacataagctctacattgcgattgtgacaacatagcttatgaaatcttttcagcttattaagtagctctttggtaaacaccaaagaagtttctgatagtgtctgcacaacagcaaaccaacatttggtgaggaattagcaatttcttgccaaagaaaattgattctgcccaattattttttgagctacacttgtgttttagaatatctgtttctgtaatattgagagttattttatagaaatgatttcttaattagctgttgtgagatatttctcgggtccttgcagaaaaaaacatacagactgtgaacaaatcattcacaaacagaataaaacagagccaacaacagtattttaagggtcacttgcctcctgttgacacaattgttgctaaatcaaaagaagcgttgtccaggtgtgtctacatctagtgttacttttaatgagaatttgaatgtttattgaacaatagtacttgaatgaacatttataaatgtaattattgcgatcactggttaagaatgttttatatatccttataatatttttcactgatcaaaatgttgttctgctttttcatttcttaaggaatacatgtttgggatttttattttttacgtgtccgaagataagctccaggtcttatcgtatcccttgccatctgaacttgtttgcactgcttctgtttgaaagagcatcttgaaaaacttccccggtatgatgattgttggtaacaactttttctatagtcattgatggagtagatcatgatggaggggaaatcactggagatcaaatatgtaaaatcatttcaaatataaaatccagtttactcatggattttagctattttttcactgggtaaattatactacatttatttacaaatgagtttatgcattttcatggctcttaataaacatattgttttccctt

SEQ ID NO: 103116 - DNA, 535 bp, Homo sapiens
  Payload ID: 113
  Gene Symbol: AKAP7
  Gene Name: A kinase (PRKA) anchor protein 7
  ENST ID: ENST00000479599
  CDS Start-End: 1-155
tcactgatgaacctcaaataaatttgaagagaagtcaagaaaatgaatgggtcaagagtgatcaagtaaagaagaggaaaaaaaagagaaaagattatcaacccaactatttcctgtccattccaatcaccaacaaagagaggagcaggtgctgagagaggaagggagatggtggaccaggtctgtggggatttctcctggatgcagattctgtttttctaatgtgtgcatttggacttctttgcaactcttcatggtaatgcccctccccacagattataaaaggaattaagatcctgcagaatgcaataatacaacaagatgagcgactggccaaagcaatggtcagtgatggttcctttcatattaccctgctggtgatgcaattattaaatgaagatgaagtaaacattggtattgatgctcttttggaattgaaaccattcatagaagaactcctccagggaaaacatttgactttgccctttcaagggattggtacttttggaaatcaggttggatttgtgaagctggc

SEQ ID NO: 103117 - DNA, 1006 bp, Homo sapiens
  Payload ID: 113
  Gene Symbol: AKAP7
  Gene Name: A kinase (PRKA) anchor protein 7
  ENST ID: ENST00000537868
  CDS Start-End: 163-426
cttcctgtcgctcttcaaggtttccaaaagaccatctttcagcagttgcctcaattaaggccttggaaccagggagtgaaaaaaatagatcctgatttatatgaaaagtttatcagtcacagatttggagaagaaatattatatcgcatagatctttgctccatgctgaagaaaaaacaaagtaatggttattatcactgtgaatcttccattgtgattggcaagaaacctattggaattcgagacttaattaatgaagctttgcatcgagaaacgatgggtctgaagtccaaagtgaaacagataaaggaacttttattaaagcctgagactcaggccagaattaggagggagctttttgaaggaagacttattaacaacagtaattcagcaaatgacgttgatttcagcacaactttgacataagctctacattgcgattgtgacaacatagcttatgaaatcttttcagcttattaagtagctctttggtaaacaccaaagaagtttctgatagtgtctgcacaacagcaaaccaacatttggtgaggaattagcaatttcttgccaaagaaaattgattctgcccaattattttttgagctacacttgtgttttagaatatctgtttctgtaatattgagagttattttatagaaatgatttcttaattagctgttgtgagatatttctcgggtccttgcagaaaaaaacatacagactgtgaacaaatcattcacaaacagaataaaacagagccaacaacagtattttaagggtcacttgcctcctgttgacacaattgttgctaaatcaaaagaagcgttgtccaggtgtgtctacatctagtgttacttttaatgagaatttgaatgtttattgaacaatagtacttgaatgaacatttataaatgtaattattgcgatcactggttaagaatgttttatatatccttataatatttttcactgatcaaaatgttgttctgctttttcatttcttaag

SEQ ID NO: 103118 - DNA, 3670 bp, Homo sapiens
  Payload ID: 114
  Gene Symbol: AKAP8
  Gene Name: A kinase (PRKA) anchor protein 8
  Uniprot ID: O43823
  ENST ID: ENST00000269701
  CDS Start-End: 62-2140
tgaacgcatgcgtgctgtggtcgcctagtaaacggggctgctggtgggccgcgtcgaagacatggaccagggctacggaggctacggggcgtggagtgctggacctgccaacacccagggtgcatatggaactggtgtggccagctggcaaggttatgaaaactacaattactatggcgcccagaacaccagtgtcaccacaggcgcaacctacagctacggcccagcctcgtgggaggccgccaaggccaatgatggcggcctggcggccggggcccctgccatgcacatggcctcttacggcccagagccatgcaccgacaattccgactccctcattgccaagatcaaccagcgtttggacatgatgtccaaggaaggaggcaggggcgggagcggcggcggtggggagggcatacaggaccgggagagctccttccgcttccagccgttcgagtcctatgactccaggccctgcctgccggagcacaacccctaccgccccagctacagctacgactatgagttcgacctggggtccgaccgcaatggcagctttggggggcagtacagtgaatgccgagacccagcccgggagcggggctcccttgatggcttcatgcggggccggggccagggccgcttccaggaccggagcaaccctggcaccttcatgcgcagcgaccccttcgtgccccccgctgcgtcctctgagcccctgtccacgccctggaacgagctgaactacgtgggtggacggggcctgggagggccctcccccagccggccacctccgtccctcttctcccagtccatggctcccgactacggcgtgatgggcatgcagggggcgggcggctatgacagcaccatgccctacggatgtggccgctcgcagcctcggatgcgggatcgggatcggcccaagaggagagggtttgaccgcttcggaccagatggcacgggcaggaaacggaagcagttccaactttacgaggagccagacaccaaactggcccgggttgacagtgaaggagatttctccgaaaatgatgacgcagctggtgacttccgctcaggagatgaagaattcaagggtgaggatgaactctgcgactctgggaggcaaagaggagagaaggaggacgaggacgaggatgtgaagaagagaagggaaaagcaaaggagaagagacaggacgcgggaccgtgcagccgacagaattcagtttgcctgttctgtatgcaagttccgtagctttgatgacgaagagatccagaagcatctgcaaagcaaatttcacaaagagaccctgcggttcataagcaccaagctgcccgacaagaccgtggagttcctccaggaatacattgtaaacagaaataagaaaattgagaagcggcgtcaggaattgatggagaaagaaaccgcaaaaccaaaaccagatcctttcaaagggattggccaggagcacttcttcaagaagatcgaggctgctcactgcctggcctgcgacatgctaattcctgcacagccgcagctcctccagcggcacctgcactccgtggaccacaatcacaaccgcaggttggctgctgaacagttcaagaaaaccagtctccatgtggctaagagtgttttgaacaacagacatatagtgaagatgctggaaaaatacctcaagggtgaggaccctttcaccagtgaaactgttgatccagaaatggaaggagatgacaatttaggaggtgaggataagaaagagacacctgaggaggtggccgcggacgtcttagcagaggtgattacagcagcagtgagggccgtagatggggaaggagcgcccgctccagagagcagcggggagccggctgaggacgaaggccccacggacacagcggaggccggtagtgatcctcaagccgaacagctgctggaagagcaggtgccctgtggaacggcacatgagaagggcgtccccaaggccagaagtgaggctgcagaggctggaaatggcgccgagacaatggcagcagaggcagaaagtgcccaaaccagagttgctcctgccccagctgccgcggatgctgaagtggaacaaactgatgcagagtctaaagacgctgttcccacagaatgatgctcatttccctgttccagggaaggcgttgggatgatggatgcgttggtctttctcccttggtttgtaagcagtacaagggcgtgtgctcccagaatatgctgtaatctaattttggtgaagagacccagcgtttcctcctgagcagtgcctctcacggcttgtctcatgcagtcgtgtggcttcttgcccaggtttcaaagctgaagtacattgtccttagcggctgtaacatgtctcttgacagtagtgcacttggaataataaaggttgggtgattatatcttgatgatacattacttgttcaatacagccactgatggaatgcttccttttttatttttttccttaatttttttttttatttggttgggaacagctgaatactaggaatatatcttgctctatagaggatttttttttgtatgtttcaagcttcagcctttaacctatacctttgtagtgcaccatatggtgtgtgactttcacaggacttcgcagcacctggttcacatgtggcactgaccgcgtcacatccacgcactcccaaaggccagaagtatctgaccgacctacgccactggaaacacacccaccgcaacctcaagaaccagactgtgcagagggcattgcgtcccaatctttagtccttgctgaatcagttctctaatattttacctcatttgtgttccacctctagattacttcaggtttttttcctttaaaattagttactaccactcaaatgtatttacaaagagaatttggccaggcacggtgatgcatacctataatcccagcacttcgggaggccgtggtgagaggatagcttaagcccaggagttcaagaccaacctggacaacatagcaagaccccatctcttaaaaaaaaaggaaagaaaacttgatgtgattgccataggtggaataatccaacataaattgccatagatagaaggtatctgtaatatatatatatatatataaaatgaaatatatgtttcattttagagaaataactattactttagatctttccaaatctgagaaagggaggctagcatgtgttcaaggttagcacgcaacagaatttcctaaaatcagaagaattggaagatcctccccttttgaaatggccctgctgtgtcagtttccctgtggccttttgaactgtacatctcacatgttgggaaacgctggccactgggaaatcattagaaaggaggctgtagaatatttgccgagcctctactgtataccaggggctaactcaccaagcacattctaggaattgggccctgctcatgaggagccttagtggagattccaggtgaatatttatgaaaaagtcaacattagaactgaaaatggaaataaactgcttgaaaagacgatggtgcctctgggtcatttctgctcagcatccgtttgtgttgtgtagatgcgtcttaatcgcagggtgagcatgccttttaagcttgttctcttaaggcaaaaatgtcggtagcattaaacagtagtgcagaaaaa

SEQ ID NO: 103119 - DNA, 860 bp, Homo sapiens
  Payload ID: 114
  Gene Symbol: AKAP8
  Gene Name: A kinase (PRKA) anchor protein 8
  ENST ID: ENST00000599883
  CDS Start-End: 68-469
gtgcgctgaacgcatgcgtgctgtggtcgcctagtaaacggggctgctggtgggccgcgtcgaagacatggaccagggctacggaggctacggggcgtggagtgctggacctgccaacacccagggtgcatatggaactggtgtggccagctggcaagctccttccgcttccagccgttcgagtcctatgactccaggccctgcctgccggagcacaacccctaccgccccagctacagctacgactatgagttcgacctggggtccgaccgcaatggcagctttggggggcagtacagtgaatgccgagacccagcccgggagcggggctcccttgatggcttcatgcggggccggggccagggccgcttccaggaccggagcaaccctggcaccttcatgcgcagcgaccccttcgtgccccccgctgcgtcctctgagcccctgtccacgccctggaacgagctgaactacgtgggtggacggggcctgggagggccctcccccagccggccacctccgtccctcttctcccagtccatggctcccgactacggcgtgatgggcatgcagggggcgggcggctatgacagcaccatgccctacggatgtggccgctcgcagcctcggatgcgggatcgggatcggcccaagaggagagggtttgaccgcttcggaccagatggcacgggcaggaaacggaagcagttccaactttacgaggagccagacaccaaactggcccgggttgacagtgaaggagatttctccgaaaatgatgacgcagctggtgacttccgctcaggagatgaagaattcaagggtgaggatgaactctgcgactctgggaggcaaagagg

SEQ ID NO: 103120 - DNA, 3071 bp, Homo sapiens
  Payload ID: 114
  Gene Symbol: AKAP8
  Gene Name: A kinase (PRKA) anchor protein 8
  ENST ID: ENST00000598597
  CDS Start-End: 1-535
gcggggccggggccagggccgcttccaggaccggagcaaccctggcaccttcatgcgcagcgaccccttcgtgccccccgctgcgtcctctgagcccctgtccacgccctggaacgagctgaactacgtgggtggacggggcctgggagggccctcccccagccggccacctccgtccctcttctcccagtccatggctcccgactacggcgtgatgggcatgcagggggcgggcggctatgacagcaccatgccctacggatgtggccgctcgcagcctcggatgcgggatcgggatcggcccaagaggagagggtttgaccgcttcggaccagatggcacgggcaggaaacggaagcagttccaactttacgaggagccagacaccaaactggcccgggttgacagtgaaggagatttctccgaaaatgatgacgcagctggtgacttccgctcaggagatgaagaattcaagggtgaggatgaactctgcgactctgggaggcaaagaggtcctgctacctacccgggatgactttgctattaaacagcagtcatagtttcaggcagtgacctcttgccaaaaatcccacacgcccttttgagaggcttctgagcagcgcacgccggtcgccatcttcgtgggacagtctcgggactggcatcaggggagagaaggaggacgaggacgaggatgtgaagaagagaagggaaaagcaaaggagaagagacaggacgcgggaccgtgcagccgacagaattcagtttgcctgttctgtatgcaagttccgtagctttgatgacgaagagatccagaagcatctgcaaagcaaatttcacaaagagaccctgcggttcataagcaccaagctgcccgacaagaccgtggagttcctccaggaatacattgtaaacagaaataagaaaattgagaagcggcgtcaggaattgatggagaaagaaaccgcaaaaccaaaaccagatcctttcaaagggattggccaggagcacttcttcaagaagatcgaggctgctcactgcctggcctgcgacatgctaattcctgcacagccgcagctcctccagcggcacctgcactccgtggaccacaatcacaaccgcaggttggctgctgaacagttcaagaaaaccagtctccatgtggctaagagtgttttgaacaacagacatatagtgaagatgctggaaaaatacctcaagggtgaggaccctttcaccagtgaaactgttgatccagaaatggaaggagatgacaatttaggaggtgaggataagaaagagacacctgaggaggtggccgcggacgtcttagcagaggtgattacagcagcagtgagggccgtagatggggaaggagcgcccgctccagagagcagcggggagccggctgaggacgaaggccccacggacacagcggaggccggtagtgatcctcaagccgaacagctgctggaagagcaggtgccctgtggaacggcacatgagaagggcgtccccaaggccagaagtgaggctgcagaggctggaaatggcgccgagacaatggcagcagaggcagaaagtgcccaaaccagagttgctcctgccccagctgccgcggatgctgaagtggaacaaactgatgcagagtctaaagacgctgttcccacagaatgatgctcatttccctgttccagggaaggcgttgggatgatggatgcgttggtctttctcccttggtttgtaagcagtacaagggcgtgtgctcccagaatatgctgtaatctaattttggtgaagagacccagcgtttcctcctgagcagtgcctctcacggcttgtctcatgcagtcgtgtggcttcttgcccaggtttcaaagctgaagtacattgtccttagcggctgtaacatgtctcttgacagtagtgcacttggaataataaaggttgggtgattatatcttgatgatacattacttgttcaatacagccactgatggaatgcttccttttttatttttttccttaatttttttttttatttggttgggaacagctgaatactaggaatatatcttgctctatagaggatttttttttgtatgtttcaagcttcagcctttaacctatacctttgtagtgcaccatatggtgtgtgactttcacaggacttcgcagcacctggttcacatgtggcactgaccgcgtcacatccacgcactcccaaaggccagaagtatctgaccgacctacgccactggaaacacacccaccgcaacctcaagaaccagactgtgcagagggcattgcgtcccaatctttagtccttgctgaatcagttctctaatattttacctcatttgtgttccacctctagattacttcaggtttttttcctttaaaattagttactaccactcaaatgtatttacaaagagaatttggccaggcacggtgatgcatacctataatcccagcacttcgggaggccgtggtgagaggatagcttaagcccaggagttcaagaccaacctggacaacatagcaagaccccatctcttaaaaaaaaaggaaagaaaacttgatgtgattgccataggtggaataatccaacataaattgccatagatagaaggtatctgtaatatatatatatatatataaaatgaaatatatgtttcattttagagaaataactattactttagatctttccaaatctgagaaagggaggctagcatgtgttcaaggttagcacgcaacagaatttcctaaaatcagaagaattggaagatcctccccttttgaaatggccctgctgtgtcagtttccctgtggccttttgaactgtacatctcacatgttgggaaacgctggccactgggaaatcattagaaaggaggctgtagaatatttgccgagcctctactgtataccaggggctaactcaccaagcacattctaggaattgggccctgctcatgaggagccttagtggagattccaggtgaatatttatgaaaaagtcaacattagaactgaaaatggaaataaactgcttgaaaagacga

SEQ ID NO: 103121 - DNA, 2146 bp, Homo sapiens
  Payload ID: 115
  Gene Symbol: AKAP8L
  Gene Name: A kinase (PRKA) anchor protein 8-like
  Uniprot ID: Q9ULX6
  ENST ID: ENST00000397410
  CDS Start-End: 132-2072
gagccaatgcggtcgggaggcggggctcgggtgtgtgtggaggggaccctgtggttagcagcagctatcgcagcgtcggatgttcagagcagcagaagccggcgtcgtcggatgttgtgttgcccgccaccatgagctacacaggctttgtccagggatctgaaaccactttgcagtcgacatactcggataccagcgctcagcccacctgtgattatggatatggaacttggaactctgggacaaatagaggctacgagggctatggctatggctatggctatggccaggataacaccaccaactatgggtatggtatggccacttcacactcttgggaaatgcctagctctgacacaaatgcaaacactagtgcctcgggtagcgccagtgccgattccgttttatccagaattaaccagcgcttagatatggtgccgcatttggagacagacatgatgcaaggaggcgtgtacggctcaggtggagaaaggtatgactcttatgagtcctgcgactcgagggccgtcctgagtgagcgcgacctgtaccggtcaggctatgactacagcgagcttgaccctgagatggaaatggcctatgagggccaatacgatgcctaccgcgaccagttccgcatgcgtggcaacgacaccttcggtcccagggcacagggctgggcccgggatgcccggagcggccggccaatggcctcaggctatgggcgcatgtgggaagaccccatgggggcccggggccagtgcatgtctggtgcctctcggctgccctccctcttctcccagaacatcatccccgagtacggcatgttccagggcatgcgaggtgggggcgccttcccgggcggctcccgctttggtttcgggtttggcaatggcatgaagcagatgaggcggacctggaagacctggaccacagccgacttccgaaccaagaagaagaagagaaagcagggcggcagtcctgatgagccagatagcaaagccacccgcacggactgctcggacaacagcgactcagacaatgatgagggcaccgagggggaagccacagagggccttgaaggcaccgaggctgtggagaagggctccagagtggacggagaggatgaggagggaaaagaggatgggagagaagaaggcaaagaggatccagagaagggggccctaaccacccaggatgaaaatggccagaccaagcgcaagttgcaggcaggcaagaagagtcaggacaagcagaaaaagcggcagcgagaccgcatggtggaaaggatccagtttgtgtgttctctgtgcaaataccggaccttctatgaggacgagatggccagccatcttgacagcaagttccacaaggaacactttaagtacgtaggcaccaagctccctaagcagacggctgactttctgcaggagtacgtcactaacaagaccaagaagacagaggagctccgaaaaaccgtggaggaccttgatggcctcatccagcaaatctacagagaccaggatctgacccaggaaattgccatggagcattttgtgaagaaggtggaggcagcccattgtgcagcctgcgacctcttcattcccatgcagtttgggatcatccagaagcatctgaagaccatggatcacaaccggaaccgcaggctcatgatggagcagtccaagaagtcctccctcatggtggcccgcagtattctcaacaacaagctcatcagcaagaagctggagcgctacctgaagggcgagaaccctttcaccgacagccccgaggaggagaaggagcaggaggaggctgagggcggtgccctggacgagggggcgcagggcgaagcggcagggatctcggagggcgcagagggcgtgccggcgcagcctcccgtgcccccagagccagcccccggggccgtgtcgccgccaccgccgccgcccccagaggaggaggaggagggcgccgtgcccttgctgggaggggcgctgcaacgccagatccgcggcatcccgggcctcgacgtggaggacgacgaggagggcggcgggggcgccccgtgacccgagctcggggcgggcggagcccgcgtggccgaagctggaaaccaaacctaataaagttttcccatcccacc

SEQ ID NO: 103122 - DNA, 553 bp, Homo sapiens
  Payload ID: 115
  Gene Symbol: AKAP8L
  Gene Name: A kinase (PRKA) anchor protein 8-like
  ENST ID: ENST00000596195
  CDS Start-End: 66-553
atcgcagcgtcggatgttcagagcagcagaagccggcgtcgtcggatgttgtgttgcccgccaccatgagctacacaggctttgtccagggatctgaaaccactttgcagtcgacatactcggataccagcgctcagcccacctgtgattatggctacgagggctatggctatggctatggctatggccaggataacaccaccaactatgggtatggtatggccacttcacactcttgggaaatgcctagctctgacacaaatgcaaacactagtgcctcgggtagcgccagtgccgattccgttttatccagaattaaccagcgcttagatatggtgccgcatttggagacagacatgatgcaaggaggcgtgtacggctcaggtggagaaaggtatgactcttatgagtcctgcgactcgagggccgtcctgagtgagcgcgacctgtaccggtcaggctatgactacagcgagcttgaccctgagatggaaatggcctatgagggccaatacgatgcctaccgcgaccagttccgcatgcgtggcaacga

SEQ ID NO: 103123 - DNA, 2251 bp, Homo sapiens
  Payload ID: 115
  Gene Symbol: AKAP8L
  Gene Name: A kinase (PRKA) anchor protein 8-like
  ENST ID: ENST00000594594
  CDS Start-End: 199-399
actgatatgaggaggcatagagatagacagcggttccttccaatagacgtgaagccgaggccggtatgagccaatgcggtcgggaggcggggctcgggtgtgtgtggaggggaccctgtggttagcagcagctatcgcagcgtcggatgttcagagcagcagaagccggcgtcgtcggatgttgtgttgcccgccaccatgagctacacaggctttgtccagggatctgaaaccactttgcagtcgacatactcggataccagcgctcagcccacctgtgattatggatatggaacttggaactctgggacaaatagaggctacgagggctatggctatggctatggctatggccaggataacaccaccaactatgggtatgaattaaccagcgcttagatatggtgccgcatttggagacagacatgatgcaaggaggcgtgtacggctcaggtggagaaaggtatgactcttatgagtcctgcgactcgagggccgtcctgagtgagcgcgacctgtaccggtcaggctatgactacagcgagcttgaccctgagatggaaatggcctatgagggccaatacgatgcctaccgcgaccagttccgcatgcgtggcaacgacaccttcggtcccagggcacagggctgggcccgggatgcccggagcggccggccaatggcctcaggctatgggcgcatgtgggaagaccccatgggggcccggggccagtgcatgtctggtgcctctcggctgccctccctcttctcccagaacatcatccccgagtacggcatgttccagggcatgcgaggtgggggcgccttcccgggcggctcccgctttggtttcgggtttggcaatggcatgaagcagatgaggcggacctggaagacctggaccacagccgacttccgaaccaagaagaagaagagaaagcagggcggcagtcctgatgagccagatagcaaagccacccgcacggactgctcggacaacagcgactcagacaatgatgagggcaccgagggggaagccacagagggccttgaaggcaccgaggctgtggagaagggctccagagtggacggagaggatgaggagggaaaagaggatgggagagaagaaggcaaagaggatccagagaagggggccctaaccacccaggatgaaaatggccagaccaagcgcaagttgcaggcaggcaagaagagtcaggacaagcagaaaaagcggcagcgagaccgcatggtggaaagggctcccgcactggcgcttgcctcctccgcctcagactcttgctcttgctggaccttcctcagcctcgccggcgcccggcccctgggctctccagacaaagctgaccccgtggcccagataaggacgtccggcagaggatccagtttgtgtgttctctgtgcaaataccggaccttctatgaggacgagatggccagccatcttgacagcaagttccacaaggaacactttaagtacgtaggcaccaagctccctaagcagacggctgactttctgcaggagtacgtcactaacaagaccaagaagacagaggagctccgaaaaaccgtggaggaccttgatggcctcatccagcaaatctacagagaccaggatctgacccaggaaattgccatggagcattttgtgaagaaggtggaggcagcccattgtgcagcctgcgacctcttcattcccatgcagtttgggatcatccagaagcatctgaagaccatggatcacaaccggaaccgcaggctcatgatggagcagtccaagaagtcctccctcatggtggcccgcagtattctcaacaacaagctcatcagcaagaagctggagcgctacctgaagggcgagaaccctttcaccgacagccccgaggaggagaaggagcaggaggaggctgagggcggtgccctggacgagggggcgcagggcgaagcggcagggatctcggagggcgcagagggcgtgccggcgcagcctcccgtgcccccagagccagcccccggggccgtgtcgccgccaccgccgccgcccccagaggaggaggaggagggcgccgtgcccttgctgggaggggcgctgcaacgccagatccgcggcatcccgggcctcgacgtggaggacgacgaggagggcggcgggggcgccccgtgacccgagctcggggcgggcggagcccgcgtggccgaagctggaaaccaaacctaataaagttttcccatccca

SEQ ID NO: 103124 - DNA, 548 bp, Homo sapiens
  Payload ID: 115
  Gene Symbol: AKAP8L
  Gene Name: A kinase (PRKA) anchor protein 8-like
  ENST ID: ENST00000595067
  CDS Start-End: 66-548
atcgcagcgtcggatgttcagagcagcagaagccggcgtcgtcggatgttgtgttgcccgccaccatgagctacacaggctttgtccagggatctgaaaccactttgcagtcgacatactcggataccagcgctcagcccacctgtgattatgatacccttgtatctgtgtttgtctctgtctctgtctgcctcccctctgcctgcccccaccatctgtctgtctctgtctccctcactgcaggctacgagggctatggctatggctatggctatggccaggataacaccaccaactatgggtatggtatggccacttcacactcttgggaaatgcctagctctgacacaaatgcaaacactagtgcctcgggtagcgccagtgccgattccgttttatccagaattaaccagcgcttagatatggtgccgcatttggagacagacatgatgcaaggaggcgtgtacggctcaggtggagaaaggtatgactcttatgagtcctgcgactcgagggccgtcctgagtgagcgcgacctgtaccggtca

SEQ ID NO: 103125 - DNA, 1933 bp, Homo sapiens
  Payload ID: 115
  Gene Symbol: AKAP8L
  Gene Name: A kinase (PRKA) anchor protein 8-like
  Uniprot ID: Q9ULX6
  ENST ID: ENST00000595465
  CDS Start-End: 104-1861
gggtgtgtgtggaggggaccctgtggttagcagcagctatcgcagcgtcggatgttcagagcagcagaagccggcgtcgtcggatgttgtgttgcccgccaccatgagctacacaggctttgtccagggatctgaaaccactttgcagtcgacatactcggataccagcgctcagcccacctgtgattatggatatggaacttggaactctgggacaaatagaggctacgagggctatggctatggctatggctatggccaggataacaccaccaactatgggtatgactcttatgagtcctgcgactcgagggccgtcctgagtgagcgcgacctgtaccggtcaggctatgactacagcgagcttgaccctgagatggaaatggcctatgagggccaatacgatgcctaccgcgaccagttccgcatgcgtggcaacgacaccttcggtcccagggcacagggctgggcccgggatgcccggagcggccggccaatggcctcaggctatgggcgcatgtgggaagaccccatgggggcccggggccagtgcatgtctggtgcctctcggctgccctccctcttctcccagaacatcatccccgagtacggcatgttccagggcatgcgaggtgggggcgccttcccgggcggctcccgctttggtttcgggtttggcaatggcatgaagcagatgaggcggacctggaagacctggaccacagccgacttccgaaccaagaagaagaagagaaagcagggcggcagtcctgatgagccagatagcaaagccacccgcacggactgctcggacaacagcgactcagacaatgatgagggcaccgagggggaagccacagagggccttgaaggcaccgaggctgtggagaagggctccagagtggacggagaggatgaggagggaaaagaggatgggagagaagaaggcaaagaggatccagagaagggggccctaaccacccaggatgaaaatggccagaccaagcgcaagttgcaggcaggcaagaagagtcaggacaagcagaaaaagcggcagcgagaccgcatggtggaaaggatccagtttgtgtgttctctgtgcaaataccggaccttctatgaggacgagatggccagccatcttgacagcaagttccacaaggaacactttaagtacgtaggcaccaagctccctaagcagacggctgactttctgcaggagtacgtcactaacaagaccaagaagacagaggagctccgaaaaaccgtggaggaccttgatggcctcatccagcaaatctacagagaccaggatctgacccaggaaattgccatggagcattttgtgaagaaggtggaggcagcccattgtgcagcctgcgacctcttcattcccatgcagtttgggatcatccagaagcatctgaagaccatggatcacaaccggaaccgcaggctcatgatggagcagtccaagaagtcctccctcatggtggcccgcagtattctcaacaacaagctcatcagcaagaagctggagcgctacctgaagggcgagaaccctttcaccgacagccccgaggaggagaaggagcaggaggaggctgagggcggtgccctggacgagggggcgcagggcgaagcggcagggatctcggagggcgcagagggcgtgccggcgcagcctcccgtgcccccagagccagcccccggggccgtgtcgccgccaccgccgccgcccccagaggaggaggaggagggcgccgtgcccttgctgggaggggcgctgcaacgccagatccgcggcatcccgggcctcgacgtggaggacgacgaggagggcggcgggggcgccccgtgacccgagctcggggcgggcggagcccgcgtggccgaagctggaaaccaaacctaataaagttttcccatccca

SEQ ID NO: 103126 - DNA, 608 bp, Homo sapiens
  Payload ID: 115
  Gene Symbol: AKAP8L
  Gene Name: A kinase (PRKA) anchor protein 8-like
  ENST ID: ENST00000599137
  CDS Start-End: 98-235
gtgtggaggggaccctgtggttagcagcagctatcgcagcgtcggatgttcagagcagcagaagccggcgtcgtcggatgttgtgttgcccgccaccatgagctacacaggctttgtccagggatctgaaaccactttgcagtcgacatactcggataccagcgctcagcccacctgtgattatggatatggaacttggaactctgggacaaatagagaattaaccagcgcttagatatggtgccgcatttggagacagacatgatgcaaggaggcgtgtacggctcaggtggagaaaggtatgactcttatgagtcctgcgactcgagggccgtcctgagtgagcgcgacctgtaccggtcaggctatgactacagcgagcttgaccctgagatggaaatggcctatgagggccaatacgatgcctaccgcgaccagttccgcatgcgtggcaacgacaccttcggtcccagggcacagggctgggcccgggatgcccggagcggccggccaatggcctcaggctatgggcgcatgtgggaagaccccatgggggcccggggccagtgcatgtctggtgcctctcggctgccctccctcttctccca

SEQ ID NO: 103127 - DNA, 583 bp, Homo sapiens
  Payload ID: 115
  Gene Symbol: AKAP8L
  Gene Name: A kinase (PRKA) anchor protein 8-like
  ENST ID: ENST00000600247
  CDS Start-End: 257-583
attgccagcagcttccagccactgatatgaggaggcatagagatagacagcggttccttccaatagacgtgaagccgaggccggctttgtccagggatctgaaaccactttgcagtcgacatactcggataccagcgctcagcccacctgtgattatggatatggaacttggaactctgggacaaatagaggctacgagggctatggctatggctatggctatggccaggataacaccaccaactatgggtatggtatggccacttcacactcttgggaaatgcctagctctgacacaaatgcaaacactagtgcctcgggtagcgccagtgccgattccgttttatccagaattaaccagcgcttagatatggtgccgcatttggagacagacatgatgcaaggaggcgtgtacggctcaggtggagaaaggtatgactcttatgagtcctgcgactcgagggccgtcctgagtgagcgcgacctgtaccggtcaggctatgactacagcgagcttgaccctgagatggaaatggcctatgagggccaatacgatgcctaccgcgaccagttccgcatgcgt

SEQ ID NO: 103128 - DNA, 2113 bp, Homo sapiens
  Payload ID: 115
  Gene Symbol: AKAP8L
  Gene Name: A kinase (PRKA) anchor protein 8-like
  ENST ID: ENST00000609519
  CDS Start-End: 66-1361
atcgcagcgtcggatgttcagagcagcagaagccggcgtcgtcggatgttgtgttgcccgccaccatgagctacacaggctttgtccagggatctgaaaccactttgcagtcgacatactcggataccagcgctcagcccacctgtgattatggatatggaacttggaactctgggacaaatagaggctacgagggctatggctatggctatggctatggccaggataacaccaccaactatggaattaaccagcgcttagatatggtgccgcatttggagacagacatgatgcaaggaggcgtgtacggctcaggtggagaaaggtatgactcttatgagtcctgcgactcgagggccgtcctgagtgagcgcgacctgtaccggtcaggctatgactacagcgagcttgaccctgagatggaaatggcctatgagggccaatacgatgcctaccgcgaccagttccgcatgcgtggcaacgacaccttcggtcccagggcacagggctgggcccgggatgcccggagcggccggccaatggcctcaggctatgggcgcatgtgggaagaccccatgggggcccggggccagtgcatgtctggtgcctctcggctgccctccctcttctcccagaacatcatccccgagtacggcatgttccagggcatgcgaggtgggggcgccttcccgggcggctcccgctttggtttcgggtttggcaatggcatgaagcagatgaggcggacctggaagacctggaccacagccgacttccgaaccaagaagaagaagagaaagcagggcggcagtcctgatgagccagatagcaaagccacccgcacggactgctcggacaacagcgactcagacaatgatgagggcaccgagggggaagccacagagggccttgaaggcaccgaggctgtggagaagggctccagagtggacggagaggatgaggagggaaaagaggatgggagagaagaaggcaaagaggatccagagaagggggccctaaccacccaggatgaaaatggccagaccaagcgcaagttgcaggcaggcaagaagagtcaggacaagcagaaaaagcggcagcgagaccgcatggtggaaagggctcccgcactggcgcttgcctcctccgcctcagactcttgctcttgctggaccttcctcagcctcgccggcgcccggcccctgggctctccagacaaagctgaccccgtggcccagataaggacgtccggcagaggatccagtttgtgtgttctctgtgcaaataccggaccttctatgaggacgagatggccagccatcttgacagcaagttccacaaggaacactttaagtacgtaggcaccaagctccctaagcagacggctgactttctgcaggagtacgtcactaacaagaccaagaagacagaggagctccgaaaaaccgtggaggaccttgatggcctcatccagcaaatctacagagaccaggatctgacccaggaaattgccatggagcattttgtgaagaaggtggaggcagcccattgtgcagcctgcgacctcttcattcccatgcagtttgggatcatccagaagcatctgaagaccatggatcacaaccggaaccgcaggctcatgatggagcagtccaagaagtcctccctcatggtggcccgcagtattctcaacaacaagctcatcagcaagaagctggagcgctacctgaagggcgagaaccctttcaccgacagccccgaggaggagaaggagcaggaggaggctgagggcggtgccctggacgagggggcgcagggcgaagcggcagggatctcggagggcgcagagggcgtgccggcgcagcctcccgtgcccccagagccagcccccggggccgtgtcgccgccaccgccgccgcccccagaggaggaggaggagggcgccgtgcccttgctgggaggggcgctgcaacgccagatccgcggcatcccgggcctcgacgtggaggacgacgaggagggcggcgggggcgccccgtgacccgagctcggggcgggcggagcccgcgtggccgaagctggaaaccaaacctaataaagttttcccatccca

SEQ ID NO: 103129 - DNA, 12471 bp, Homo sapiens
  Payload ID: 116
  Gene Symbol: AKAP9
  Gene Name: A kinase (PRKA) anchor protein 9
  Uniprot ID: Q99996
  ENST ID: ENST00000356239
  CDS Start-End: 234-11957
tacgtggagacgaagatggcggcggcggcggcggtgacggcgcttcccgtgcggctgaggacgatccgccagtgagcgcggagactgcttccacttcgggcgggggagcgccggaccgaatcggctctctaggccgtggagcttgccgtcccacctccgtccaaatcgacctttcctttctatccccaaccacccctcaacccctgttttcccctgccttccttgcagaggccatggaggacgaggagagacagaagaagctggaggccggcaaagccaagcttgcccagtttcgacaaagaaaagctcagtcggatgggcagagtccttccaagaagcagaaaaaaaagagaaaaacgtcaagcagtaaacatgatgtgtcagcacaccatgatttgaatattgatcaatcacagtgtaatgaaatgtacataaatagttctcagagagtagaatcaactgtgattcctgaatctacaataatgagaactctacatagtggagaaataaccagtcatgagcagggcttctctgtggaactggaaagtgaaatttcaaccacagcagatgactgcagttcagaggtaaatggttgcagttttgtgatgagaacaggaaagcctacaaatttattaagggaagaagaatttggtgttgatgattcttattctgaacaaggagcacaagacagtccgactcatctagagatgatggaaagtgagttggctgggaagcagcatgagattgaagagctaaacagagagctggaagaaatgagggttacctatgggactgaaggactgcagcagttacaagaatttgaagctgccattaaacaaagagatggcattataacccagctcactgctaatttacaacaagcaagaagagaaaaggatgagacaatgagagaatttttagagttgacagaacagagtcaaaaattacagattcaatttcagcaattacaggctagtgaaactctgagaaacagcactcatagtagcacagctgcagacttactacaagccaaacaacagatcctcactcatcaacagcagcttgaagaacaagaccacttattagaagattatcagaaaaagaaagaagacttcacaatgcaaattagtttcttgcaagagaaaattaaagtatatgaaatggaacaagataaaaaagtagaaaactcaaataaagaagaaatacaggaaaaggagacaatcattgaagaattaaacacaaaaataatagaagaagaaaagaaaactcttgagctaaaggataaattaacaactgctgataaattactaggagaattacaagaacagattgtgcaaaagaaccaagaaataaaaaacatgaaattagagctgactaattctaagcaaaaagaaagacagtcttctgaagaaataaaacagttaatggggacagtcgaagaacttcagaagagaaatcataaagacagccagttcgaaactgatatagtacaacgaatggaacaagaaacacaaagaaagttagaacaactccgggcagagctggatgagatgtatgggcagcagatagtgcaaatgaaacaagaattaataagacaacacatggcacagatggaggaaatgaaaacacggcataagggagaaatggagaatgctttaaggtcatattcaaatattacagttaatgaagatcagataaagttaatgaatgtggcaataaatgaactgaatataaaattgcaagatactaactctcaaaaggaaaaactcaaggaagaactaggactaattttagaagaaaagtgtgctctacagagacagcttgaagaccttgttgaagaattgagcttttcaagggaacagattcagagagctagacagacaatagctgaacaagaaagtaaacttaatgaagcacataagtcccttagtacagtggaagatttgaaagctgagattgtttctgcatctgaatccagaaaggaactagaattaaaacatgaagcagaagttacaaattacaagataaaacttgaaatgttagaaaaagaaaagaatgctgtgttagacagaatggctgaatcacaagaagctgaattagagaggctgagaacacagcttctatttagtcacgaagaagagctttccaaactgaaggaagatttagaaattgaacatcgaataaatattgaaaaacttaaagataatttaggcattcactataaacagcagatagatggtttacagaatgaaatgagtcaaaagatagaaaccatgcagtttgaaaaggacaatttgataactaagcagaatcaattaattttggaaatttcaaagctaaaagatttacagcagtctcttgtaaattcaaagtcagaagaaatgactcttcaaatcaatgaacttcaaaaagaaattgaaatactcagacaagaagaaaaagaaaagggtacacttgaacaagaagttcaagaattacaacttaaaacagaattgttagaaaaacagatgaaggaaaaagagaatgatcttcaagaaaaatttgcacaacttgaagcagagaatagcattcttaaagatgaaaagaaaacccttgaagacatgttgaaaatacatactcctgttagccaagaagaaagattgattttcttagactccattaagtccaaatccaaagactctgtgtgggaaaaagaaatagaaatacttatagaggaaaatgaggacctcaaacaacaatgtattcagctaaatgaagagattgaaaagcaaaggaacactttttcatttgctgaaaaaaactttgaagttaactatcaagagttacaagaggagtatgcttgccttctcaaagtaaaagatgatttagaagacagtaaaaataaacaggaattagagtataaaagtaaacttaaagcacttaatgaagagcttcatttgcaaagaataaatccaactacagtgaaaatgaaaagttctgtctttgatgaagacaaaacttttgtagcagaaacattggaaatgggtgaggttgttgaaaaggatacaacagaactcatggaaaaacttgaggtaaccaagcgagagaaattagagctgtcacagagactgtctgatctttctgaacaattgaaacagaaacatggtgagattagttttctaaatgaagaagttaaatctttaaagcaagagaaagaacaagtttcattgagatgtagagagctagaaatcattattaaccacaacagggcagaaaatgtacagtcatgtgatactcaagtaagctctttattagatggagttgtgaccatgacaagcaggggtgctgaaggatcagtttctaaagtaaataaaagttttggtgaagaatcaaaaataatggtggaagataaagtttcttttgaaaatatgactgttggagaagaaagtaagcaagaacagttgattttggatcacttaccatctgtaacaaaggaatcatcacttagagcaactcaaccaagtgaaaatgataaacttcagaaagaactcaatgtacttaaatcagaacagaatgatttaaggctacagatggaagcccaacgcatttgcctctctctggtttattcaactcatgtggatcaggttcgtgaatatatggaaaatgaaaaagataaagctctttgcagtcttaaagaagagcttatttttgctcaagaggaaaagatcaaggaacttcagaaaatacaccagttagaactacagactatgaaaacacaagaaacaggtgatgaaggaaagcctttacatctgctcattggaaaacttcaaaaggcagtgtctgaagaatgttcttattttttacagactttatgcagtgtccttggtgaatattatactcctgctttaaaatgtgaagtaaatgcagaagacaaagagaattctggtgattacatttctgaaaatgaagatccagaattacaagattatagatatgaagttcaagactttcaagaaaatatgcacactcttctcaacaaagtaacagaagaatacaacaaactcttggtacttcaaacacgactaagcaagatctggggacagcagacagatggtatgaaacttgaatttggagaagaaaaccttccaaaagaggaaacagagtttttatcaatccattctcagatgaccaatttggaagacattgatgtcaatcataaaagcaagttatcttctctgcaagatcttgaaaaaactaaacttgaagaacaagttcaagaattagaaagcctcatatcctctttgcagcaacagttgaaagaaactgaacaaaactatgaggcagagatccactgtttacagaagaggcttcaagctgttagtgagtccacggttccgccaagcttacctgttgattcggtggtaattacagaatctgatgcacagagaacaatgtaccctggaagttgtgtgaaaaagaatattgatggtacaatagagttttctggtgaatttggagtgaaagaggaaacaaatatcgttaagttgcttgaaaaacaataccaagaacaattagaagaagaagtagctaaggttattgtgtcaatgagtatagcatttgctcaacaaactgaactgtctagaatatctgggggaaaagaaaatactgcatcatcaaagcaagcacatgctgtgtgtcagcaagaacaacattattttaatgaaatgaaattatcacaggatcaaattggttttcagacttttgagacagtggatgtgaaatttaaagaagaatttaaaccacttagtaaagagttaggagaacatggaaaggaaattttattatcaaatagtgatccccatgatataccagaatcaaaggactgtgtgctgactatttcagaagaaatgttctccaaagataaaacatttatagttagacagtctattcatgatgagatttcagtgtcaagcatggatgcttctagacaactaatgttgaatgaagaacagttggaagatatgagacaggaacttgtacgacaataccaagaacatcaacaggcaacggaattgttaaggcaagcacatatgcggcaaatggagagacagcgagaagaccaggaacagctacaagaagagattaagagacttaatagacaattagcccagagatcctccatagataatgaaaacctggtttcagagagagagagggtgcttttagaggagctggaagcactaaagcagctgtctttagctggaagagagaagctgtgttgtgagctgcgcaacagcagtacgcaaacacagaatggaaatgaaaaccaaggagaagttgaagaacaaacatttaaagaaaaggaattagacagaaaacctgaagatgtgcctcctgagattttgtctaatgaaaggtatgcactccagaaagctaataatagacttttgaagatcctcttagaagttgtaaagacaacagcagctgttgaagaaacaattggtcgccatgtccttgggattctagatagatctagtaaaagccagtcatctgccagcctaatttggaggtcagaagcagaggcatctgtaaagtcatgtgtccatgaggaacatacaagagttacagatgaatccattccctcttattctggaagtgatatgccaagaaatgacattaacatgtggtcaaaagtaactgaggaaggaacagagctgtcacaacgacttgtgaggagtggttttgctggaactgaaatagaccctgaaaatgaagaacttatgctgaacattagctctcgactacaagcagcagttgaaaaactcctagaagccataagtgaaactagcagtcagcttgaacatgcgaaagtgacacagacagagttgatgcgtgagtcatttagacagaaacaagaagcaacagagtcccttaagtgccaagaggaacttcgagagcgccttcatgaggagtccagggccagagaacagctagctgtggagctcagtaaggctgagggcgtcattgatggctatgcagatgaaaaaactctttttgaaaggcaaattcaggaaaaaactgatataatagatcgtcttgagcaggagttgttatgtgcaagtaacaggttgcaagaattggaggcagagcaacagcagatccaagaagaaagagaattactgtccagacaaaaggaagctatgaaagcagaggcaggcccagttgaacaacaattactacaggagacagaaaaattaatgaaggaaaaactagaagtacaatgtcaagctgaaaaagtacgtgatgaccttcaaaaacaagtgaaagctctagaaatagatgtggaagaacaagtcagtaggtttatagagctggaacaagaaaaaaatactgaactaatggatttaagacagcaaaaccaagcattggaaaagcagttagaaaaaatgagaaaatttttagatgagcaagccattgacagagaacatgagagagatgtattccaacaggaaatacagaaactagaacagcaacttaaggttgttcctcgattccagcctatcagtgaacatcaaactagagaggttgaacagttagcaaatcatctgaaagaaaaaacagacaaatgcagtgagcttttgctctctaaagagcagcttcaaagggatatacaagaaaggaatgaagaaatagagaaactggagttcagagtaagagaactggagcaggcgcttcttgtgagtgcagatacttttcaaaaggtagaggaccgaaaacactttggagctgtagaagctaaaccagaattgtccctagaagtacaattgcaggctgaacgagatgccatagacagaaaggaaaaagagattacaaacttagaagagcaattagaacagtttagagaagaactggaaaataagaatgaagaagttcaacaattacatatgcaattagaaatacagaaaaaggaatctactacccgcctacaagaacttgaacaggaaaacaaattatttaaggatgacatggagaaactgggacttgccataaaggaatctgatgccatgtctactcaagaccaacatgtgctatttgggaaatttgctcaaataatacaggaaaaagaggtagaaattgaccaattaaatgaacaagttacgaaactccagcagcaacttaaaattacaacagataacaaggttattgaagaaaaaaatgaactgataagggatcttgaaacccaaatagaatgtttgatgagtgatcaagaatgtgtgaagagaaatagagaagaagaaatagagcagctcaatgaagtgattgaaaaacttcaacaggaattggcaaatattggacagaagacatcaatgaatgctcattccctctcagaagaagcagacagtttaaaacatcaattggatgtggttatagctgaaaagctggccttggaacagcaagtagaaaccgctaatgaagaaatgaccttcatgaaaaatgtacttaaagaaaccaattttaaaatgaatcagctaacacaggaattattcagcttaaagagagaacgtgaaagtgtggaaaagattcaaagcataccagagaatagtgttaacgtggctatagatcatctgagcaaagacaaacctgaactagaagtagtccttacagaggatgctcttaaatccctagaaaatcagacatacttcaaatcttttgaagaaaatggcaaaggttccataattaatttggaaacaaggttgctacaacttgagagcactgttagtgcaaaggacttagaacttacccagtgttataaacaaataaaagacatgcaagaacaaggccagtttgaaacagaaatgcttcaaaagaagattgtaaacctacagaaaatagttgaagaaaaagtggctgctgctcttgtcagtcaaatccaacttgaggcagttcaggaatatgcaaaattctgtcaagataatcaaacaatttcatcagaacctgaaagaacaaatattcagaatttaaatcaactaagagaagatgagttggggtcagatatatcagcattaaccttgagaatatcagaattagaaagccaggttgttgaaatgcatactagtttgattttagaaaaagaacaagtagaaattgcagaaaaaaatgttttagaaaaagaaaagaagctgctagaactacagaagctattggagggcaatgagaaaaaacagagagagaaagaaaagaaaagaagccctcaagatgttgaagttctcaagacaactactgagctatttcatagcaatgaagaaagtggattttttaatgaactcgaggctcttagagctgaatcagtggctaccaaagcagaacttgccagttataaagaaaaggctgaaaaacttcaagaagagcttttggtaaaagaaacaaatatgacatctcttcagaaagacttaagccaagttagggatcacctcgcagaggcaaaagagaaattgtccattttagaaaaagaagatgagactgaggtacaagaaagcaaaaaggcctgcatgtttgagccacttcctataaaactgagtaagagcattgcatcccagacagatgggactctgaagatcagtagcagcaatcagactccacaaattcttgttaaaaatgcaggaatacaaattaatttacagagtgaatgttcctcagaagaagttactgaaataatcagtcagtttactgaaaaaattgagaagatgcaagaactacatgctgctgaaattttggacatggaatccagacatatttcagaaactgaaaccttaaagagggaacactatgttgccgttcagttactgaaagaggaatgtggtaccttgaaggcagtgatacagtgtctgagaagtaaagagggatcctcaattcctgagctagcacattctgatgcttaccagactagagaaatatgctccagtgattctggatcagactggggtcagggaatttatcttacacacagtcagggatttgacatagcatcagaaggccgaggagaagaaagtgaaagtgcaacagattcctttccaaagaaaataaagggattactgagagctgtccataatgaaggcatgcaggtgctttctctcactgagtctccctatagtgatggagaggaccattctattcagcaggtttcagaaccttggctagaagagagaaaagcttacatcaatacaatctcatctctaaaggatttaattacaaagatgcaactgcaaagagaagccgaggtttatgatagttctcaatctcatgagagcttctcagactggcgaggtgaactactgcttgcccttcaacaagttttcttagaagagcgtagtgttttactagcagcatttcggacggagctgacagctctaggtactacagatgcagttggtttactaaactgtttggaacagagaatacaagaacagggtgttgaatatcaagcagctatggaatgcctccagaaagcagatagaaggagtttgttatctgaaattcaggcactgcatgcacaaatgaatggtaggaaaattactctgaaaagagaacaagagagtgagaaaccaagccaagaactcttggaatataatatacagcagaagcagtctcaaatgctggagatgcaagtggagctcagcagtatgaaagacagagcaacggaactgcaggagcagctgagttctgagaaaatggtggttgctgaactgaagagtgagcttgcacaaactaaattggaactagaaacaacactcaaggcacagcataaacacctaaaagaattggaggctttcaggttggaagttaaagataagacagatgaagtacatttgcttaatgacacattagcaagtgaacagaaaaaatcaagagagctccagtgggctttggagaaagagaaagccaagttgggacgcagtgaagaacgggataaagaagaacttgaggatctgaagttttcacttgagagtcagaaacaaaggaatcttcagctaaatctacttttggaacaacagaaacaactactgaacgaatcccagcaaaaaatagaatcacagagaatgctatatgatgcccagttgtcagaagaacaaggtcgaaacttagagcttcaggtacttcttgaatctgagaaagttcgaattcgggaaatgagtagtaccctagatagggagcgggaattgcacgcacagctgcagagcagtgatggtactggacagtctcggccacccttgccctcagaggacctactgaaagagctgcagaaacagctagaggaaaaacacagtcgcatagtagaattgttaaatgagactgaaaaatataaactggattctttgcaaacacgacagcaaatggaaaaagataggcaggttcacaggaaaacactgcagacagaacaggaggccaacactgagggacagaaaaaaatgcatgagctccagtccaaagtggaagatcttcagcgccagctggaagagaaaagacaacaagtttataagttagaccttgaaggacagcgactacaaggaatcatgcaggaattccagaagcaagaactagaacgagaagaaaaacgagaaagtagaagaattctgtatcagaaccttaatgagccaaccacgtggagcttaaccagtgatagaactagaaattgggttcttcaacagaaaatagaaggagaaacaaaagaatcaaactacgctaaattgattgaaatgaatggaggaggaaccggctgtaatcatgaattagaaatgatcagacaaaagcttcaatgtgtagcttcaaaactacaggttctaccccagaaagcctctgagagactacagtttgaaacagcagatgatgaagatttcatttgggttcaggaaaatattgatgaaattattttacaactacagaaattaactggccagcaaggtgaagagcccagcttggtgtccccaagtacttcttgtggctcattgactgaaagactactgagacaaaatgctgagctgacagggcatatcagtcaactgactgaagagaagaatgacttaaggaacatggttatgaagctggaagagcagatcaggtggtatcgacagacaggagctggtagagataattcttccaggttttcattgaatggtggtgccaacattgaagccatcattgcctctgaaaaagaagtatggaacagagaaaaattgactctccagaaatctttgaaaagggcagaggctgaagtatacaaactgaaagctgaactaagaaatgactctttacttcaaactctgagccctgattctgaacatgtcactttaaagagaatttatggtaaatacttgagggcagaaagttttcgaaaggctctcatttaccagaagaaatacctgctgctgttactgggtgggttccaggaatgtgaagatgccaccttggccctgcttgcccggatgggggggcagccagctttcacggatctagaggtgatcaccaatcgcccaaagggcttcaccaggtttcggtcggccgtcagagtatccattgcaatttccagaatgaaatttttggttcgacggtggcatcgagtcacaggttctgtttccatcaatattaacagagatggctttggactgaatcaaggtgcagaaaagactgactcattttatcattcttctggtgggctggagttatatggagaaccaagacatactacgtatcgctcaagatcagatctggactatattaggtcccctttaccatttcagaataggtacccaggcactccagctgatttcaatcctggttctttagcatgttctcagcttcagaattacgatcctgacagagccctaacagattatatcactcggctagaggcactgcaaagacgacttggaactatacagtcaggttcaactactcaatttcatgctggcatgagaagataatcctttgaaacatcattaattgaagtgattttaaatagatttccttttgtaaatcaatggttcttttgtgcttttgtattgtgaatattcaatgggaccaatatgaacacagcttatgattgtatacaaatcccttgccagcacatgaaaacaaactggaatttgtatatataagcattgtgtatgtattcatgcacaataattattgaattacctgtatatttgtggaatgctaatttaaaacattaaattataaaccttgtgtatttatcaaatgggtgaaaagattaaacttttacgcattacaatactgctgaatgtgtagctcgaggtgtcctgcacttttcttataaggctactgaagttacatgttttgcctaatatattctactggtgatgaagacagataatatcacttgtagagacctatttttgtataatggtagaagttttgaattttatggggtattttgtcaagtactgaaataaaaatgacttcaccattttcaccaca

SEQ ID NO: 103130 - DNA, 10309 bp, Homo sapiens
  Payload ID: 116
  Gene Symbol: AKAP9
  Gene Name: A kinase (PRKA) anchor protein 9
  ENST ID: ENST00000358100
  CDS Start-End: 1-9381
atggaggacgaggagagacagaagaagctggaggccggcaaagccaagcttgcccagtttcgacaaagaaaagctcagtcggatgggcagagtccttccaagaagcagaaaaaaaagagaaaaacgtcaagcagtaaacatgatgtgtcagcacaccatgatttgaatattgatcaatcacagtgtaatgaaatgtacataaatagttctcagagagtagaatcaactgtgattcctgaatctacaataatgagaactctacatagtggagaaataaccagtcatgagcagggcttctctgtggaactggaaagtgaaatttcaaccacagcagatgactgcagttcagaggtaaatggttgcagttttgtgatgagaacaggaaagcctacaaatttattaagggaagaagaatttggtgttgatgattcttattctgaacaaggagcacaagacagtccgactcatctagagatgatggaaagtgagttggctgggaagcagcatgagattgaagagctaaacagagagctggaagaaatgagggttacctatgggactgaaggactgcagcagttacaagaatttgaagctgccattaaacaaagagatggcattataacccagctcactgctaatttacaacaagcaagaagagaaaaggatgagacaatgagagaatttttagagttgacagaacagagtcaaaaattacagattcaatttcagcaattacaggctagtgaaactctgagaaacagcactcatagtagcacagctgcagacttactacaagccaaacaacagatcctcactcatcaacagcagcttgaagaacaagaccacttattagaagattatcagaaaaagaaagaagacttcacaatgcaaattagtttcttgcaagagaaaattaaagtatatgaaatggaacaagataaaaaagtagaaaactcaaataaagaagaaatacaggaaaaggagacaatcattgaagaattaaacacaaaaataatagaagaagaaaagaaaactcttgagctaaaggataaattaacaactgctgataaattactaggagaattacaagaacagattgtgcaaaagaaccaagaaataaaaaacatgaaattagagctgactaattctaagcaaaaagaaagacagtcttctgaagaaataaaacagttaatggggacagtcgaagaacttcagaagagaaatcataaagacagccagttcgaaactgatatagtacaacgaatggaacaagaaacacaaagaaagttagaacaactccgggcagagctggatgagatgtatgggcagcagatagtgcaaatgaaacaagaattaataagacaacacatggcacagatggaggaaatgaaaacacggcataagggagaaatggagaatgctttaaggtcatattcaaatattacagttaatgaagatcagataaagttaatgaatgtggcaataaatgaactgaatataaaattgcaagatactaactctcaaaaggaaaaactcaaggaagaactaggactaattttagaagaaaagtgtgctctacagagacagcttgaagaccttgttgaagaattgagcttttcaagggaacagattcagagagctagacagacaatagctgaacaagaaagtaaacttaatgaagcacataagtcccttagtacagtggaagatttgaaagctgagattgtttctgcatctgaatccagaaaggaactagaattaaaacatgaagcagaagttacaaattacaagataaaacttgaaatgttagaaaaagaaaagaatgctgtgttagacagaatggctgaatcacaagaagctgaattagagaggctgagaacacagcttctatttagtcacgaagaagagctttccaaactgaaggaagatttagaaattgaacatcgaataaatattgaaaaacttaaagataatttaggcattcactataaacagcagatagatggtttacagaatgaaatgagtcaaaagatagaaaccatgcagtttgaaaaggacaatttgataactaagcagaatcaattaattttggaaatttcaaagctaaaagatttacagcagtctcttgtaaattcaaagtcagaagaaatgactcttcaaatcaatgaacttcaaaaagaaattgaaatactcagacaagaagaaaaagaaaagggtacacttgaacaagaagttcaagaattacaacttaaaacagaattgttagaaaaacagatgaaggaaaaagagaatgatcttcaagaaaaatttgcacaacttgaagcagagaatagcattcttaaagatgaaaagaaaacccttgaagacatgttgaaaatacatactcctgttagccaagaagaaagattgattttcttagactccattaagtccaaatccaaagactctgtgtgggaaaaagaaatagaaatacttatagaggaaaatgaggacctcaaacaacaatgtattcagctaaatgaagagattgaaaagcaaaggaacactttttcatttgctgaaaaaaactttgaagttaactatcaagagttacaagaggagtatgcttgccttctcaaagtaaaagatgatttagaagacagtaaaaataaacaggaattagagtataaaagtaaacttaaagcacttaatgaagagcttcatttgcaaagaataaatccaactacagtgaaaatgaaaagttctgtctttgatgaagacaaaacttttgtagcagaaacattggaaatgggtgaggttgttgaaaaggatacaacagaactcatggaaaaacttgaggtaaccaagcgagagaaattagagctgtcacagagactgtctgatctttctgaacaattgaaacagaaacatggtgagattagttttctaaatgaagaagttaaatctttaaagcaagagaaagaacaagtttcattgagatgtagagagctagaaatcattattaaccacaacagggcagaaaatgtacagtcatgtgatactcaagtaagctctttattagatggagttgtgaccatgacaagcaggggtgctgaaggatcagtttctaaagtaaataaaagttttggtgaagaatcaaaaataatggtggaagataaagtttcttttgaaaatatgactgttggagaagaaagtaagcaagaacagttgattttggatcacttaccatctgtaacaaaggaatcatcacttagagcaactcaaccaagtgaaaatgataaacttcagaaagaactcaatgtacttaaatcagaacagaatgatttaaggctacagatggaagcccaacgcatttgcctctctctggtttattcaactcatgtggatcaggttcgtgaatatatggaaaatgaaaaagataaagctctttgcagtcttaaagaagagcttatttttgctcaagaggaaaagatcaaggaacttcagaaaatacaccagttagaactacagactatgaaaacacaagaaacaggtgatgaaggaaagcctttacatctgctcattggaaaacttcaaaaggcagtgtctgaagaatgttcttattttttacagactttatgcagtgtccttggtgaatattatactcctgctttaaaatgtgaagtaaatgcagaagacaaagagaattctggtgattacatttctgaaaatgaagatccagaattacaagattatagatatgaagttcaagactttcaagaaaatatgcacactcttctcaacaaagtaacagaagaatacaacaaactcttggtacttcaaacacgactaagcaagatctggggacagcagacagatggtatgaaacttgaatttggagaagaaaaccttccaaaagaggaaacagagtttttatcaatccattctcagatgaccaatttggaagacattgatgtcaatcataaaagcaagttatcttctctgcaagatcttgaaaaaactaaacttgaagaacaagttcaagaattagaaagcctcatatcctctttgcagcaacagttgaaagaaactgaacaaaactatgaggcagagatccactgtttacagaagaggcttcaagctgttagtgagtccacggttccgccaagcttacctgttgattcggtggtaattacagaatctgatgcacagagaacaatgtaccctggaagttgtgtgaaaaagaatattgatggtacaatagagttttctggtgaatttggagtgaaagaggaaacaaatatcgttaagttgcttgaaaaacaataccaagaacaattagaagaagaagtagctaaggttattgtgtcaatgagtatagcatttgctcaacaaactgaactgtctagaatatctgggggaaaagaaaatactgcatcatcaaagcaagcacatgctgtgtgtcagcaagaacaacattattttaatgaaatgaaattatcacaggatcaaattggttttcagacttttgagacagtggatgtgaaatttaaagaagaatttaaaccacttagtaaagagttaggagaacatggaaaggaaattttattatcaaatagtgatccccatgatataccagaatcaaaggactgtgtgctgactatttcagaagaaatgttctccaaagataaaacatttatagttagacagtctattcatgatgagatttcagtgtcaagcatggatgcttctagacaactaatgttgaatgaagaacagttggaagatatgagacaggaacttgtacgacaataccaagaacatcaacaggcaacggaattgttaaggcaagcacatatgcggcaaatggagagacagcgagaagaccaggaacagctacaagaagagattaagagacttaatagacaattagcccagaatggaaatgaaaaccaaggagaagttgaagaacaaacatttaaagaaaaggaattagacagaaaacctgaagatgtgcctcctgagattttgtctaatgaaaggtatgcactccagaaagctaataatagacttttgaagatcctcttagaagttgtaaagacaacagcagctgttgaagaaacaattggtcgccatgtccttgggattctagatagatctagtaaaagccagtcatctgccagcctaatttggaggtcagaagcagaggcatctgtaaagtcatgtgtccatgaggaacatacaagagttacagatgaatccattccctcttattctggaagtgatatgccaagaaatgacattaacatgtggtcaaaagtaactgaggaaggaacagagctgtcacaacgacttgtgaggagtggttttgctggaactgaaatagaccctgaaaatgaagaacttatgctgaacattagctctcgactacaagcagcagttgaaaaactcctagaagccataagtgaaactagcagtcagcttgaacatgcgaaagtgacacagacagagttgatgcgtgagtcatttagacagaaacaagaagcaacagagtcccttaagtgccaagaggaacttcgagagcgccttcatgaggagtccagggccagagaacagctagctgtggagctcagtaaggctgagggcgtcattgatggctatgcagatgaaaaaactctttttgaaaggcaaattcaggaaaaaactgatataatagatcgtcttgagcaggagttgttatgtgcaagtaacaggttgcaagaattggaggcagagcaacagcagatccaagaagaaagagaattactgtccagacaaaaggaagctatgaaagcagaggcaggcccagttgaacaacaattactacaggagacagaaaaattaatgaaggaaaaactagaagtacaatgtcaagctgaaaaagtacgtgatgaccttcaaaaacaagtgaaagctctagaaatagatgtggaagaacaagtcagtaggtttatagagctggaacaagaaaaaaatactgaactaatggatttaagacagcaaaaccaagcattggaaaagcagttagaaaaaatgagaaaatttttagatgagcaagccattgacagagaacatgagagagatgtattccaacaggaaatacagaaactagaacagcaacttaaggttgttcctcgattccagcctatcagtgaacatcaaactagagaggttgaacagttagcaaatcatctgaaagaaaaaacagacaaatgcagtgagcttttgctctctaaagagcagcttcaaagggatatacaagaaaggaatgaagaaatagagaaactggagttcagagtaagagaactggagcaggcgcttcttgtgagtgcagatacttttcaaaaggtagaggaccgaaaacactttggagctgtagaagctaaaccagaattgtccctagaagtacaattgcaggctgaacgagatgccatagacagaaaggaaaaagagattacaaacttagaagagcaattagaacagtttagagaagaactggaaaataagaatgaagaagttcaacaattacatatgcaattagaaatacagaaaaaggaatctactacccgcctacaagaacttgaacaggaaaacaaattatttaaggatgacatggagaaactgggacttgccataaaggaatctgatgccatgtctactcaagaccaacatgtgctatttgggaaatttgctcaaataatacaggaaaaagaggtagaaattgaccaattaaatgaacaagttacgaaactccagcagcaacttaaaattacaacagataacaaggttattgaagaaaaaaatgaactgataagggatcttgaaacccaaatagaatgtttgatgagtgatcaagaatgtgtgaagagaaatagagaagaagaaatagagcagctcaatgaagtgattgaaaaacttcaacaggaattggcaaatattggacagaagacatcaatgaatgctcattccctctcagaagaagcagacagtttaaaacatcaattggatgtggttatagctgaaaagctggccttggaacagcaagtagaaaccgctaatgaagaaatgaccttcatgaaaaatgtacttaaagaaaccaattttaaaatgaatcagctaacacaggaattattcagcttaaagagagaacgtgaaagtgtggaaaagattcaaagcataccagagaatagtgttaacgtggctatagatcatctgagcaaagacaaacctgaactagaagtagtccttacagaggatgctcttaaatccctagaaaatcagacatacttcaaatcttttgaagaaaatggcaaaggttccataattaatttggaaacaaggttgctacaacttgagagcactgttagtgcaaaggacttagaacttacccagtgttataaacaaataaaagacatgcaagaacaaggccagtttgaaacagaaatgcttcaaaagaagattgtaaacctacagaaaatagttgaagaaaaagtggctgctgctcttgtcagtcaaatccaacttgaggcagttcaggaatatgcaaaattctgtcaagataatcaaacaatttcatcagaacctgaaagaacaaatattcagaatttaaatcaactaagagaagatgagttggggtcagatatatcagcattaaccttgagaatatcagaattagaaagccaggttgttgaaatgcatactagtttgattttagaaaaagaacaagtagaaattgcagaaaaaaatgttttagaaaaagaaaagaagctgctagaactacagaagctattggagggcaatgagaaaaaacagagagagaaagaaaagaaaagaagccctcaagatgttgaagttctcaagacaactactgagctatttcatagcaatgaagaaagtggattttttaatgaactcgaggctcttagagctgaatcagtggctaccaaagcagaacttgccagttataaagaaaaggctgaaaaacttcaagaagagcttttggtaaaagaaacaaatatgacatctcttcagaaagacttaagccaagttagggatcacctcgcagaggcaaaagagaaattgtccattttagaaaaagaagatgagactgaggtacaagaaagcaaaaaggcctgcatgtttgagccacttcctataaaactgagtaagagcattgcatcccagacagatgggactctgaagatcagtagcagcaatcagactccacaaattcttgttaaaaatgcaggaatacaaattaatttacagagtgaatgttcctcagaagaagttactgaaataatcagtcagtttactgaaaaaattgagaagatgcaagaactacatgctgctgaaattttggacatggaatccagacatatttcagaaactgaaaccttaaagagggaacactatgttgccgttcagttactgaaagaggaatgtggtaccttgaaggcagtgatacagtgtctgagaagtaaagagggatcctcaattcctgagctagcacattctgatgcttaccagactagagaaatatgctccagtgattctggatcagactggggtcagggaatttatcttacacacagtcagggatttgacatagcatcagaaggccgaggagaagaaagtgaaagtgcaacagattcctttccaaagaaaataaagggattactgagagctgtccataatgaaggcatgcaggtgctttctctcactgagtctccctatagtgatggagaggaccattctattcagcaggtttcagaaccttggctagaagagagaaaagcttacatcaatacaatctcatctctaaaggatttaattacaaagatgcaactgcaaagagaagccgaggtttatgatagttctcaatctcatgagagcttctcagactggcgaggtgaactactgcttgcccttcaacaagttttcttagaagagcgtagtgttttactagcagcatttcggacggagctgacagctctaggtactacagatgcagttggtttactaaactgtttggaacagagaatacaagaacagggtgttgaatatcaagcagctatggaatgcctccagaaagcagatagaaggagtttgttatctgaaattcaggcactgcatgcacaaatgaatggtaggaaaattactctgaaaagagaacaagagagtgagaaaccaagccaaggtatgttgtatgacaagctcatatggttacacaaacaggtgaaaagatttcactttgttttctttcttattattattaagttaaaacatattttcttggtcacattttcttctcattctcataatgttaaggatacaatctatattaattactctaggggttagaggattgtctaattggtttaaacagctacgttgactttaaaataaactgccattcccctgataaggttaagcccattggattcattctttttctttattttagagctgtatgttaagaaaacagtctttccaatcataaaacagaaaatactctttagaggaaaatccacaatgcatgtaactaattattttttaatccttttttaaaaaaattgtgagccataacatacagaaaattacaaattgcaaatatgcagtatgacgcatttttaaatgagtatctatggaaacatcacccatgtgaatatagccagtatcccaacagccccttctcccaagcacatgctcctctgagtaacttagaggtaatcattgttctgatttttctttagttttactatctatttatatattcctaaaacatttaagtttcaagtttttttctgtttttgaactttatcaatctgtatgtattttttatcttgtttctttcacctctctgtaacattcttccaacattcttccaagttactgcatttttcaagttactgcattcttccaaattagtagtagaacattcttccaagttactgcatttatctctagttcattcattcttgttactctataactctatgaccctgtgtagggccaggcacggtggcttacacctgtaatcccagcactttgggaggctgacgtgggtggatcacgaggtcagaagttcaagatgagcctagccaaaatggtgaaacccagtctctactaaaaatacaaaaattagccaggcgtggtggcgggtgcctgtaaggccagccactcaggagactgaagcagagaattacttgaacccagaaggtggaggttgcagtgagctgaaatcacaccactgcactctagcctgagcgacagagcaagactccatctc

SEQ ID NO: 103131 - DNA, 12247 bp, Homo sapiens
  Payload ID: 116
  Gene Symbol: AKAP9
  Gene Name: A kinase (PRKA) anchor protein 9
  ENST ID: ENST00000359028
  CDS Start-End: 1-11733
atggaggacgaggagagacagaagaagctggaggccggcaaagccaaggtaggagagcccgagggttattttcttttttctcttgcccagtttcgacaaagaaaagctcagtcggatgggcagagtccttccaagaagcagaaaaaaaagagaaaaacgtcaagcagtaaacatgatgtgtcagcacaccatgatttgaatattgatcaatcacagtgtaatgaaatgtacataaatagttctcagagagtagaatcaactgtgattcctgaatctacaataatgagaactctacatagtggagaaataaccagtcatgagcagggcttctctgtggaactggaaagtgaaatttcaaccacagcagatgactgcagttcagaggtaaatggttgcagttttgtgatgagaacaggaaagcctacaaatttattaagggaagaagaatttggtgttgatgattcttattctgaacaaggagcacaagacagtccgactcatctagagatgatggaaagtgagttggctgggaagcagcatgagattgaagagctaaacagagagctggaagaaatgagggttacctatgggactgaaggactgcagcagttacaagaatttgaagctgccattaaacaaagagatggcattataacccagctcactgctaatttacaacaagcaagaagagaaaaggatgagacaatgagagaatttttagagttgacagaacagagtcaaaaattacagattcaatttcagcaattacaggctagtgaaactctgagaaacagcactcatagtagcacagctgcagacttactacaagccaaacaacagatcctcactcatcaacagcagcttgaagaacaagaccacttattagaagattatcagaaaaagaaagaagacttcacaatgcaaattagtttcttgcaagagaaaattaaagtatatgaaatggaacaagataaaaaagtagaaaactcaaataaagaagaaatacaggaaaaggagacaatcattgaagaattaaacacaaaaataatagaagaagaaaagaaaactcttgagctaaaggataaattaacaactgctgataaattactaggagaattacaagaacagattgtgcaaaagaaccaagaaataaaaaacatgaaattagagctgactaattctaagcaaaaagaaagacagtcttctgaagaaataaaacagttaatggggacagtcgaagaacttcagaagagaaatcataaagacagccagttcgaaactgatatagtacaacgaatggaacaagaaacacaaagaaagttagaacaactccgggcagagctggatgagatgtatgggcagcagatagtgcaaatgaaacaagaattaataagacaacacatggcacagatggaggaaatgaaaacacggcataagggagaaatggagaatgctttaaggtcatattcaaatattacagttaatgaagatcagataaagttaatgaatgtggcaataaatgaactgaatataaaattgcaagatactaactctcaaaaggaaaaactcaaggaagaactaggactaattttagaagaaaagtgtgctctacagagacagcttgaagaccttgttgaagaattgagcttttcaagggaacagattcagagagctagacagacaatagctgaacaagaaagtaaacttaatgaagcacataagtcccttagtacagtggaagatttgaaagctgagattgtttctgcatctgaatccagaaaggaactagaattaaaacatgaagcagaagttacaaattacaagataaaacttgaaatgttagaaaaagaaaagaatgctgtgttagacagaatggctgaatcacaagaagctgaattagagaggctgagaacacagcttctatttagtcacgaagaagagctttccaaactgaaggaagatttagaaattgaacatcgaataaatattgaaaaacttaaagataatttaggcattcactataaacagcagatagatggtttacagaatgaaatgagtcaaaagatagaaaccatgcagtttgaaaaggacaatttgataactaagcagaatcaattaattttggaaatttcaaagctaaaagatttacagcagtctcttgtaaattcaaagtcagaagaaatgactcttcaaatcaatgaacttcaaaaagaaattgaaatactcagacaagaagaaaaagaaaagggtacacttgaacaagaagttcaagaattacaacttaaaacagaattgttagaaaaacagatgaaggaaaaagagaatgatcttcaagaaaaatttgcacaacttgaagcagagaatagcattcttaaagatgaaaagaaaacccttgaagacatgttgaaaatacatactcctgttagccaagaagaaagattgattttcttagactccattaagtccaaatccaaagactctgtgtgggaaaaagaaatagaaatacttatagaggaaaatgaggacctcaaacaacaatgtattcagctaaatgaagagattgaaaagcaaaggaacactttttcatttgctgaaaaaaactttgaagttaactatcaagagttacaagaggagtatgcttgccttctcaaagtaaaagatgatttagaagacagtaaaaataaacaggaattagagtataaaagtaaacttaaagcacttaatgaagagcttcatttgcaaagaataaatccaactacagtgaaaatgaaaagttctgtctttgatgaagacaaaacttttgtagcagaaacattggaaatgggtgaggttgttgaaaaggatacaacagaactcatggaaaaacttgaggtaaccaagcgagagaaattagagctgtcacagagactgtctgatctttctgaacaattgaaacagaaacatggtgagattagttttctaaatgaagaagttaaatctttaaagcaagagaaagaacaagtttcattgagatgtagagagctagaaatcattattaaccacaacagggcagaaaatgtacagtcatgtgatactcaagtaagctctttattagatggagttgtgaccatgacaagcaggggtgctgaaggatcagtttctaaagtaaataaaagttttggtgaagaatcaaaaataatggtggaagataaagtttcttttgaaaatatgactgttggagaagaaagtaagcaagaacagttgattttggatcacttaccatctgtaacaaaggaatcatcacttagagcaactcaaccaagtgaaaatgataaacttcagaaagaactcaatgtacttaaatcagaacagaatgatttaaggctacagatggaagcccaacgcatttgcctctctctggtttattcaactcatgtggatcaggttcgtgaatatatggaaaatgaaaaagataaagctctttgcagtcttaaagaagagcttatttttgctcaagaggaaaagatcaaggaacttcagaaaatacaccagttagaactacagactatgaaaacacaagaaacaggtgatgaaggaaagcctttacatctgctcattggaaaacttcaaaaggcagtgtctgaagaatgttcttattttttacagactttatgcagtgtccttggtgaatattatactcctgctttaaaatgtgaagtaaatgcagaagacaaagagaattctggtgattacatttctgaaaatgaagatccagaattacaagattatagatatgaagttcaagactttcaagaaaatatgcacactcttctcaacaaagtaacagaagaatacaacaaactcttggtacttcaaacacgactaagcaagatctggggacagcagacagatggtatgaaacttgaatttggagaagaaaaccttccaaaagaggaaacagagtttttatcaatccattctcagatgaccaatttggaagacattgatgtcaatcataaaagcaagttatcttctctgcaagatcttgaaaaaactaaacttgaagaacaagttcaagaattagaaagcctcatatcctctttgcagcaacagttgaaagaaactgaacaaaactatgaggcagagatccactgtttacagaagaggcttcaagctgttagtgagtccacggttccgccaagcttacctgttgattcggtggtaattacagaatctgatgcacagagaacaatgtaccctggaagttgtgtgaaaaagaatattgatggtacaatagagttttctggtgaatttggagtgaaagaggaaacaaatatcgttaagttgcttgaaaaacaataccaagaacaattagaagaagaagtagctaaggttattgtgtcaatgagtatagcatttgctcaacaaactgaactgtctagaatatctgggggaaaagaaaatactgcatcatcaaagcaagcacatgctgtgtgtcagcaagaacaacattattttaatgaaatgaaattatcacaggatcaaattggttttcagacttttgagacagtggatgtgaaatttaaagaagaatttaaaccacttagtaaagagttaggagaacatggaaaggaaattttattatcaaatagtgatccccatgatataccagaatcaaaggactgtgtgctgactatttcagaagaaatgttctccaaagataaaacatttatagttagacagtctattcatgatgagatttcagtgtcaagcatggatgcttctagacaactaatgttgaatgaagaacagttggaagatatgagacaggaacttgtacgacaataccaagaacatcaacaggcaacggaattgttaaggcaagcacatatgcggcaaatggagagacagcgagaagaccaggaacagctacaagaagagattaagagacttaatagacaattagcccagagatcctccatagataatgaaaacctggtttcagagagagagagggtgcttttagaggagctggaagcactaaagcagctgtctttagctggaagagagaagctgtgttgtgagctgcgcaacagcagtacgcaaacacagaatggaaatgaaaaccaaggagaagttgaagaacaaacatttaaagaaaaggaattagacagaaaacctgaagatgtgcctcctgagattttgtctaatgaaaggtatgcactccagaaagctaataatagacttttgaagatcctcttagaagttgtaaagacaacagcagctgttgaagaaacaattggtcgccatgtccttgggattctagatagatctagtaaaagccagtcatctgccagcctaatttggaggtcagaagcagaggcatctgtaaagtcatgtgtccatgaggaacatacaagagttacagatgaatccattccctcttattctggaagtgatatgccaagaaatgacattaacatgtggtcaaaagtaactgaggaaggaacagagctgtcacaacgacttgtgaggagtggttttgctggaactgaaatagaccctgaaaatgaagaacttatgctgaacattagctctcgactacaagcagcagttgaaaaactcctagaagccataagtgaaactagcagtcagcttgaacatgcgaaagtgacacagacagagttgatgcgtgagtcatttagacagaaacaagaagcaacagagtcccttaagtgccaagaggaacttcgagagcgccttcatgaggagtccagggccagagaacagctagctgtggagctcagtaaggctgagggcgtcattgatggctatgcagatgaaaaaactctttttgaaaggcaaattcaggaaaaaactgatataatagatcgtcttgagcaggagttgttatgtgcaagtaacaggttgcaagaattggaggcagagcaacagcagatccaagaagaaagagaattactgtccagacaaaaggaagctatgaaagcagaggcaggcccagttgaacaacaattactacaggagacagaaaaattaatgaaggaaaaactagaagtacaatgtcaagctgaaaaagtacgtgatgaccttcaaaaacaagtgaaagctctagaaatagatgtggaagaacaagtcagtaggtttatagagctggaacaagaaaaaaatactgaactaatggatttaagacagcaaaaccaagcattggaaaagcagttagaaaaaatgagaaaatttttagatgagcaagccattgacagagaacatgagagagatgtattccaacaggaaatacagaaactagaacagcaacttaaggttgttcctcgattccagcctatcagtgaacatcaaactagagaggttgaacagttagcaaatcatctgaaagaaaaaacagacaaatgcagtgagcttttgctctctaaagagcagcttcaaagggatatacaagaaaggaatgaagaaatagagaaactggagttcagagtaagagaactggagcaggcgcttcttgtgagtgcagatacttttcaaaaggtagaggaccgaaaacactttggagctgtagaagctaaaccagaattgtccctagaagtacaattgcaggctgaacgagatgccatagacagaaaggaaaaagagattacaaacttagaagagcaattagaacagtttagagaagaactggaaaataagaatgaagaagttcaacaattacatatgcaattagaaatacagaaaaaggaatctactacccgcctacaagaacttgaacaggaaaacaaattatttaaggatgacatggagaaactgggacttgccataaaggaatctgatgccatgtctactcaagaccaacatgtgctatttgggaaatttgctcaaataatacaggaaaaagaggtagaaattgaccaattaaatgaacaagttacgaaactccagcagcaacttaaaattacaacagataacaaggttattgaagaaaaaaatgaactgataagggatcttgaaacccaaatagaatgtttgatgagtgatcaagaatgtgtgaagagaaatagagaagaagaaatagagcagctcaatgaagtgattgaaaaacttcaacaggaattggcaaatattggacagaagacatcaatgaatgctcattccctctcagaagaagcagacagtttaaaacatcaattggatgtggttatagctgaaaagctggccttggaacagcaagtagaaaccgctaatgaagaaatgaccttcatgaaaaatgtacttaaagaaaccaattttaaaatgaatcagctaacacaggaattattcagcttaaagagagaacgtgaaagtgtggaaaagattcaaagcataccagagaatagtgttaacgtggctatagatcatctgagcaaagacaaacctgaactagaagtagtccttacagaggatgctcttaaatccctagaaaatcagacatacttcaaatcttttgaagaaaatggcaaaggttccataattaatttggaaacaaggttgctacaacttgagagcactgttagtgcaaaggacttagaacttacccagtgttataaacaaataaaagacatgcaagaacaaggccagtttgaaacagaaatgcttcaaaagaagattgtaaacctacagaaaatagttgaagaaaaagtggctgctgctcttgtcagtcaaatccaacttgaggcagttcaggaatatgcaaaattctgtcaagataatcaaacaatttcatcagaacctgaaagaacaaatattcagaatttaaatcaactaagagaagatgagttggggtcagatatatcagcattaaccttgagaatatcagaattagaaagccaggttgttgaaatgcatactagtttgattttagaaaaagaacaagtagaaattgcagaaaaaaatgttttagaaaaagaaaagaagctgctagaactacagaagctattggagggcaatgagaaaaaacagagagagaaagaaaagaaaagaagccctcaagatgttgaagttctcaagacaactactgagctatttcatagcaatgaagaaagtggattttttaatgaactcgaggctcttagagctgaatcagtggctaccaaagcagaacttgccagttataaagaaaaggctgaaaaacttcaagaagagcttttggtaaaagaaacaaatatgacatctcttcagaaagacttaagccaagttagggatcacctcgcagaggcaaaagagaaattgtccattttagaaaaagaagatgagactgaggtacaagaaagcaaaaaggcctgcatgtttgagccacttcctataaaactgagtaagagcattgcatcccagacagatgggactctgaagatcagtagcagcaatcagactccacaaattcttgttaaaaatgcaggaatacaaattaatttacagagtgaatgttcctcagaagaagttactgaaataatcagtcagtttactgaaaaaattgagaagatgcaagaactacatgctgctgaaattttggacatggaatccagacatatttcagaaactgaaaccttaaagagggaacactatgttgccgttcagttactgaaagaggaatgtggtaccttgaaggcagtgatacagtgtctgagaagtaaagaggtatttggtttttataatatgtgtttttcaacattgtgtgattctggatcagactggggtcagggaatttatcttacacacagtcagggatttgacatagcatcagaaggccgaggagaagaaagtgaaagtgcaacagattcctttccaaagaaaataaagggattactgagagctgtccataatgaaggcatgcaggtgctttctctcactgagtctccctatagtgatggagaggaccattctattcagcaggtttcagaaccttggctagaagagagaaaagcttacatcaatacaatctcatctctaaaggatttaattacaaagatgcaactgcaaagagaagccgaggtttatgatagttctcaatctcatgagagcttctcagactggcgaggtgaactactgcttgcccttcaacaagttttcttagaagagcgtagtgttttactagcagcatttcggacggagctgacagctctaggtactacagatgcagttggtttactaaactgtttggaacagagaatacaagaacagggtgttgaatatcaagcagctatggaatgcctccagaaagcagatagaaggagtttgttatctgaaattcaggcactgcatgcacaaatgaatggtaggaaaattactctgaaaagagaacaagagagtgagaaaccaagccaagaactcttggaatataatatacagcagaagcagtctcaaatgctggagatgcaagtggagctcagcagtatgaaagacagagcaacggaactgcaggagcagctgagttctgagaaaatggtggttgctgaactgaagagtgagcttgcacaaactaaattggaactagaaacaacactcaaggcacagcataaacacctaaaagaattggaggctttcaggttggaagttaaagataagacagatgaagtacatttgcttaatgacacattagcaagtgaacagaaaaaatcaagagagctccagtgggctttggagaaagagaaagccaagttgggacgcagtgaagaacgggataaagaagaacttgaggatctgaagttttcacttgagagtcagaaacaaaggaatcttcagctaaatctacttttggaacaacagaaacaactactgaacgaatcccagcaaaaaatagaatcacagagaatgctatatgatgcccagttgtcagaagaacaaggtcgaaacttagagcttcaggtacttcttgaatctgagaaagttcgaattcgggaaatgagtagtaccctagatagggagcgggaattgcacgcacagctgcagagcagtgatggtactggacagtctcggccacccttgccctcagaggacctactgaaagagctgcagaaacagctagaggaaaaacacagtcgcatagtagaattgttaaatgagactgaaaaatataaactggattctttgcaaacacgacagcaaatggaaaaagataggcaggttcacaggaaaacactgcagacagaacaggaggccaacactgagggacagaaaaaaatgcatgagctccagtccaaagtggaagatcttcagcgccagctggaagagaaaagacaacaagtttataagttagaccttgaaggacagcgactacaaggaatcatgcaggaattccagaagcaagaactagaacgagaagaaaaacgagaaagtagaagaattctgtatcagaaccttaatgagccaaccacgtggagcttaaccagtgatagaactagaaattgggttcttcaacagaaaatagaaggagaaacaaaagaatcaaactacgctaaattgattgaaatgaatggaggaggaaccggctgtaatcatgaattagaaatgatcagacaaaagcttcaatgtgtagcttcaaaactacaggttctaccccagaaagcctctgagagactacagtttgaaacagcagatgatgaagatttcatttgggttcaggaaaatattgatgaaattattttacaactacagaaattaactggccagcaaggtgaagagcccagcttggtgtccccaagtacttcttgtggctcattgactgaaagactactgagacaaaatgctgagctgacagggcatatcagtcaactgactgaagagaagaatgacttaaggaacatggttatgaagctggaagagcagatcaggtggtatcgacagacaggagctggtagagataattcttccaggttttcattgaatggtggtgccaacattgaagccatcattgcctctgaaaaagaagtatggaacagagaaaaattgactctccagaaatctttgaaaagggcagaggctgaagtatacaaactgaaagctgaactaagaaatgactctttacttcaaactctgagccctgattctgaacatgtcactttaaagagaatttatggtaaatacttgagggcagaaagttttcgaaaggctctcatttaccagaagaaatacctgctgctgttactgggtgggttccaggaatgtgaagatgccaccttggccctgcttgcccggatgggggggcagccagctttcacggatctagaggtgatcaccaatcgcccaaagggcttcaccaggtttcggtcggccgtcagagtatccattgcaatttccagaatgaaatttttggttcgacggtggcatcgagtcacaggttctgtttccatcaatattaacagagatggctttggactgaatcaaggtgcagaaaagactgactcattttatcattcttctggtgggctggagttatatggagaaccaagacatactacgtatcgctcaagatcagatctggactatattaggtcccctttaccatttcagaataggtacccaggcactccagctgatttcaatcctggttctttagcatgttctcagcttcagaattacgatcctgacagagccctaacagattatatcactcggctagaggcactgcaaagacgacttggaactatacagtcaggttcaactactcaatttcatgctggcatgagaagataatcctttgaaacatcattaattgaagtgattttaaatagatttccttttgtaaatcaatggttcttttgtgcttttgtattgtgaatattcaatgggaccaatatgaacacagcttatgattgtatacaaatcccttgccagcacatgaaaacaaactggaatttgtatatataagcattgtgtatgtattcatgcacaataattattgaattacctgtatatttgtggaatgctaatttaaaacattaaattataaaccttgtgtatttatcaaatgggtgaaaagattaaacttttacgcattacaatactgctgaatgtgtagctcgaggtgtcctgcacttttcttataaggctactgaagttacatgttttgcctaatatattctactggtgatgaagacagataatatcacttgtagagacctatttttgtataatggtagaagttttgaattttatggggtattttgtcaagtactgaaataaaaatgacttcaccattttcaccaca

SEQ ID NO: 103132 - DNA, 5652 bp, Homo sapiens
  Payload ID: 116
  Gene Symbol: AKAP9
  Gene Name: A kinase (PRKA) anchor protein 9
  ENST ID: ENST00000394534
  CDS Start-End: 1-5310
gagaaactggagttcagagtaagagaactggagcaggcgcttcttgtagaggaccgaaaacactttggagctgtagaagctaaaccagaattgtccctagaagtacaattgcaggctgaacgagatgccatagacagaaaggaaaaagagattacaaacttagaagagcaattagaacagtttagagaagaactggaaaataagaatgaagaagttcaacaattacatatgcaattagaaatacagaaaaaggaatctactacccgcctacaagaacttgaacaggaaaacaaattatttaaggatgacatggagaaactgggacttgccataaaggaatctgatgccatgtctactcaagaccaacatgtgctatttgggaaatttgctcaaataatacaggaaaaagaggtagaaattgaccaattaaatgaacaagttacgaaactccagcagcaacttaaaattacaacagataacaaggttattgaagaaaaaaatgaactgataagggatcttgaaacccaaatagaatgtttgatgagtgatcaagaatgtgtgaagagaaatagagaagaagaaatagagcagctcaatgaagtgattgaaaaacttcaacaggaattggcaaatattggacagaagacatcaatgaatgctcattccctctcagaagaagcagacagtttaaaacatcaattggatgtggttatagctgaaaagctggccttggaacagcaagtagaaaccgctaatgaagaaatgaccttcatgaaaaatgtacttaaagaaaccaattttaaaatgaatcagctaacacaggaattattcagcttaaagagagaacgtgaaagtgtggaaaagattcaaagcataccagagaatagtgttaacgtggctatagatcatctgagcaaagacaaacctgaactagaagtagtccttacagaggatgctcttaaatccctagaaaatcagacatacttcaaatcttttgaagaaaatggcaaaggttccataattaatttggaaacaaggttgctacaacttgagagcactgttagtgcaaaggacttagaacttacccagtgttataaacaaataaaagacatgcaagaacaaggccagtttgaaacagaaatgcttcaaaagaagattgtaaacctacagaaaatagttgaagaaaaagtggctgctgctcttgtcagtcaaatccaacttgaggcagttcaggaatatgcaaaattctgtcaagataatcaaacaatttcatcagaacctgaaagaacaaatattcagaatttaaatcaactaagagaagatgagttggggtcagatatatcagcattaaccttgagaatatcagaattagaaagccaggttgttgaaatgcatactagtttgattttagaaaaagaacaagtagaaattgcagaaaaaaatgttttagaaaaagaaaagaagctgctagaactacagaagctattggagggcaatgagaaaaaacagagagagaaagaaaagaaaagaagccctcaagatgttgaagttctcaagacaactactgagctatttcatagcaatgaagaaagtggattttttaatgaactcgaggctcttagagctgaatcagtggctaccaaagcagaacttgccagttataaagaaaaggctgaaaaacttcaagaagagcttttggtaaaagaaacaaatatgacatctcttcagaaagacttaagccaagttagggatcacctcgcagaggcaaaagagaaattgtccattttagaaaaagaagatgagactgaggtacaagaaagcaaaaaggcctgcatgtttgagccacttcctataaaactgagtaagagcattgcatcccagacagatgggactctgaagatcagtagcagcaatcagactccacaaattcttgttaaaaatgcaggaatacaaattaatttacagagtgaatgttcctcagaagaagttactgaaataatcagtcagtttactgaaaaaattgagaagatgcaagaactacatgctgctgaaattttggacatggaatccagacatatttcagaaactgaaaccttaaagagggaacactatgttgccgttcagttactgaaagaggaatgtggtaccttgaaggcagtgatacagtgtctgagaagtaaagagggatcctcaattcctgagctagcacattctgatgcttaccagactagagaaatatgctccagtgattctggatcagactggggtcagggaatttatcttacacacagtcagggatttgacatagcatcagaaggccgaggagaagaaagtgaaagtgcaacagattcctttccaaagaaaataaagggattactgagagctgtccataatgaaggcatgcaggtgctttctctcactgagtctccctatagtgatggagaggaccattctattcagcaggtttcagaaccttggctagaagagagaaaagcttacatcaatacaatctcatctctaaaggatttaattacaaagatgcaactgcaaagagaagccgaggtttatgatagttctcaatctcatgagagcttctcagactggcgaggtgaactactgcttgcccttcaacaagttttcttagaagagcgtagtgttttactagcagcatttcggacggagctgacagctctaggtactacagatgcagttggtttactaaactgtttggaacagagaatacaagaacagggtgttgaatatcaagcagctatggaatgcctccagaaagcagatagaaggagtttgttatctgaaattcaggcactgcatgcacaaatgaatggtaggaaaattactctgaaaagagaacaagagagtgagaaaccaagccaagaactcttggaatataatatacagcagaagcagtctcaaatgctggagatgcaagtggagctcagcagtatgaaagacagagcaacggaactgcaggagcagctgagttctgagaaaatggtggttgctgaactgaagagtgagcttgcacaaactaaattggaactagaaacaacactcaaggcacagcataaacacctaaaagaattggaggctttcaggttggaagttaaagataagacagatgaagtacatttgcttaatgacacattagcaagtgaacagaaaaaatcaagagagctccagtgggctttggagaaagagaaagccaagttgggacgcagtgaagaacgggataaagaagaacttgaggatctgaagttttcacttgagagtcagaaacaaaggaatcttcagctaaatctacttttggaacaacagaaacaactactgaacgaatcccagcaaaaaatagaatcacagagaatgctatatgatgcccagttgtcagaagaacaaggtcgaaacttagagcttcaggtacttcttgaatctgagaaagttcgaattcgggaaatgagtagtaccctagatagggagcgggaattgcacgcacagctgcagagcagtgatggtactggacagtctcggccacccttgccctcagaggacctactgaaagagctgcagaaacagctagaggaaaaacacagtcgcatagtagaattgttaaatgagactgaaaaatataaactggattctttgcaaacacgacagcaaatggaaaaagataggcaggttcacaggaaaacactgcagacagaacaggaggccaacactgagggacagaaaaaaatgcatgagctccagtccaaagtggaagatcttcagcgccagctggaagagaaaagacaacaagtttataagttagaccttgaaggacagcgactacaaggaatcatgcaggaattccagaagcaagaactagaacgagaagaaaaacgagaaagtagaagaattctgtatcagaaccttaatgagccaaccacgtggagcttaaccagtgatagaactagaaattgggttcttcaacagaaaatagaaggagaaacaaaagaatcaaactacgctaaattgattgaaatgaatggaggaggaaccggctgtaatcatgaattagaaatgatcagacaaaagcttcaatgtgtagcttcaaaactacaggttctaccccagaaagcctctgagagactacagtttgaaacagcagatgatgaagatttcatttgggttcaggaaaatattgatgaaattattttacaactacagaaattaactggccagcaaggtgaagagcccagcttggtgtccccaagtacttcttgtggctcattgactgaaagactactgagacaaaatgctgagctgacagggcatatcagtcaactgactgaagagaagaatgacttaaggaacatggttatgaagctggaagagcagatcaggtggtatcgacagacaggagctggtagagataattcttccaggttttcattgaatggtggtgccaacattgaagccatcattgcctctgaaaaagaagtatggaacagagaaaaattgactctccagaaatctttgaaaagggcagaggctgaagtatacaaactgaaagctgaactaagaaatgactctttacttcaaactctgagccctgattctgaacatgtcactttaaagagaatttatggtaaatacttgagggcagaaagttttcgaaaggctctcatttaccagaagaaatacctgctgctgttactgggtgggttccaggaatgtgaagatgccaccttggccctgcttgcccggatgggggggcagccagctttcacggatctagaggtgatcaccaatcgcccaaagggcttcaccaggtttcggtcggccgtcagagtatccattgcaatttccagaatgaaatttttggttcgacggtggcatcgagtcacaggttctgtttccatcaatattaacagagatggctttggactgaatcaaggtgcagaaaagactgactcattttatcattcttctggtgggctggagttatatggagaaccaagacatactacgtatcgctcaagatcagatctggactatattaggtcccctttaccatttcagaataggtacccaggcactccagctgatttcaatcctggttctttagcatgttctcagcttcagaattacgatcctgacagagccctaacagattatatcactcggctagaggcactgcaaagacgacttggaactatacagtcaggtgctctgagtttaaccacatcttggcagcaccacagtgcgagacccacagctcccctttctttgaaattctttcacactcattaggataatcaaagcttccagtttagtgcatgagctaattattaagttagccaaagcttaaactcttgtaaccagcagagaaactgactttaaataatttaagtgaaaatatgatttatcaccccagatcccactcctcccaaaaatgatttcctactatgttcattcagcggactgatgacacaaaatgcacaatgagcaccagtgtgcaaggtactctgagtctacagagcctaactggagaacgtattcctaagtagcgcatggcagaaagtggtaaggccgtgccgcagcactccagcctgggcagcagagcgagaccctgtctcaaagaaaaaaaaaaaa

SEQ ID NO: 103133 - DNA, 1356 bp, Homo sapiens
  Payload ID: 116
  Gene Symbol: AKAP9
  Gene Name: A kinase (PRKA) anchor protein 9
  ENST ID: ENST00000394564
  CDS Start-End: 175-1119
gacgatccgccagtgagcgcggagactgcttccacttcgggcgggggagcgccggaccgaatcggctctctaggccgtggagcttgccgtcccacctccgtccaaatcgacctttcctttctatccccaaccacccctcaacccctgttttcccctgccttccttgcagaggccatggaggacgaggagagacagaagaagctggaggccggcaaagccaagcttgcccagtttcgacaaagaaaagctcagtcggatgggcagagtccttccaagaagcagaaaaaaaagagaaaaacgtcaagcagtaaacatgatgtgtcagcacaccatgatttgaatattgatcaatcacagtgtaatgaaatgtacataaatagttctcagagagtagaatcaactgtgattcctgaatctacaataatgagaactctacatagtggagaaataaccagtcatgagcagggcttctctgtggaactggaaagtgaaatttcaaccacagcagatgactgcagttcagaggtaaatggttgcagttttgtgatgagaacaggaaagcctacaaatttattaagggaagaagaatttggtgttgatgattcttattctgaacaaggagcacaagacagtccgactcatctagagatgatggaaagtgagttggctgggaagcagcatgagattgaagagctaaacagagagctggaagaaatgagggttacctatgggactgaaggactgcagcagttacaagaatttgaagctgccattaaacaaagagatggcattataacccagctcactgctaatttacaacaagcaagaagagaaaaggatgagacaatgagagaatttttagagttgacagaacagagtcaaaaattacagattcaatttcagcaattacaggctagtgaaactctgagaaacagcactcatagtagcacagctgcagacttactacaagccaaacaacagatcctcactcatcaacagcagcttgaagaacaagaccacttattagaagattatcagaaaaagaaagaagacttcacaatgcaaattagtttcttgcaagagaaaattaaagtatatgaaatggtatgtttattttaaggaagtcagctaacttgtagaagctttagagtttcaagttttttatgcaagtggtttttttttgttaggcacatgaatcacaaaatttcataattaagctctttgtgtaatttatttcaaaagcaaatgggaatctcagtaatgtagtttttaagataatagtcattactgagttccctaaaagtgatcagcctatgttaaactgaattagcaggaaaatacaaatttatagctata

SEQ ID NO: 103134 - DNA, 696 bp, Homo sapiens
  Payload ID: 116
  Gene Symbol: AKAP9
  Gene Name: A kinase (PRKA) anchor protein 9
  ENST ID: ENST00000438114
  CDS Start-End: 1-696
ccttccaagaagcagaaaaaaaagagaaaaacgtcaagcagtaaacatgatgtgtcagcacaccatgatttgaatattgatcaatcacagtgtaatgaaatgtacataaatagttctcagagagtagaatcaactgtgattcctgaatctacaataatgagaactctacatagtggagaaataaccagtcatgagcagggcttctctgtggaactggaaagtgaaatttcaaccacagcagatgactgcagttcagaggaagaagaatttggtgttgatgattcttattctgaacaaggagcacaagacagtccgactcatctagagatgatggaaagtgagttggctgggaagcagcatgagattgaagagctaaacagagagctggaagaaatgagggttacctatgggactgaaggactgcagcagttacaagaatttgaagctgccattaaacaaagagatggcattataacccagctcactgctaatttacaacaagcaagaagagaaaaggatgagacaatgagagaatttttagagttgacagaacagagtcaaaaattacagattcaatttcagcaattacaggctagtgaaactctgagaaacagcactcatagtagcacagctgcagacttactacaagccaaacaacagatcctcactcatcaacagcagcttgaagaacaagac

SEQ ID NO: 103135 - DNA, 1904 bp, Homo sapiens
  Payload ID: 116
  Gene Symbol: AKAP9
  Gene Name: A kinase (PRKA) anchor protein 9
  ENST ID: ENST00000435423
  CDS Start-End: 1-956
aacactatgttgccgttcagttactgaaagaggaatgtggtaccttgaaggcagtgatacagtgtctgagaagtaaagagggatcctcaattcctgagctagcacattctgatgcttaccagactagagaaatatgctccagtgattctggatcagactggggtcagggaatttatcttacacacagtcagggatttgacatagcatcagaaggccgaggagaagaaagtgaaagtgcaacagattcctttccaaagaaaataaagggattactgagagctgtccataatgaaggcatgcaggtgctttctctcactgagtctccctatagtgatggagaggaccattctattcagcaggtttcagaaccttggctagaagagagaaaagcttacatcaatacaatctcatctctaaaggatttaattacaaagatgcaactgcaaagagaagccgaggtttatgatagttctcaatctcatgagagcttctcagactggcgaggtgaactactgcttgcccttcaacaagttttcttagaagagcgtagtgttttactagcagcatttcggacggagctgacagctctaggtactacagatgcagttggtttactaaactgtttggaacagagaatacaagaacagggtgttgaatatcaagcagctatggaatgcctccagaaagcagatagaaggagtttgttatctgaaattcaggcactgcatgcacaaatgaatggtaggaaaattactctgaaaagagaacaagagagtgagaaaccaagccaaggtatgttgtatgacaagctcatatggttacacaaacaggtgaaaagatttcactttgttttctttcttattattattaagttaaaacatattttcttggtcacattttcttctcattctcataatgttaaggatacaatctatattaattactctaggggttagaggattgtctaattggtttaaacagctacgttgactttaaaataaactgccattcccctgataaggttaagcccattggattcattctttttctttattttagagctgtatgttaagaaaacagtctttccaatcataaaacagaaaatactctttagaggaaaatccacaatgcatgtaactaattattttttaatccttttttaaaaaaattgtgagccataacatacagaaaattacaaattgcaaatatgcagtatgacgcatttttaaatgagtatctatggaaacatcacccatgtgaatatagccagtatcccaacagccccttctcccaagcacatgctcctctgagtaacttagaggtaatcattgttctgatttttctttagttttactatctatttatatattcctaaaacatttaagtttcaagtttttttctgtttttgaactttatcaatctgtatgtattttttatcttgtttctttcacctctctgtaacattcttccaacattcttccaagttactgcatttttcaagttactgcattcttccaaattagtagtagaacattcttccaagttactgcatttatctctagttcattcattcttgttactctataactctatgaccctgtgtagggccaggcacggtggcttacacctgtaatcccagcactttgggaggctgacgtgggtggatcacgaggtcagaagttcaagatgagcctagccaaaatggtgaaacccagtctctactaaaaatacaaaaattagccaggcgtggtggcgggtgcctgtaaggccagccactcaggagactgaagcagagaattacttgaacccagaaggtggaggttgcagtgagctgaaatcacaccactgcactctagcctgagcgacagagcaagactccatctcaaaaaaaaaaaaaaaaaaaa

SEQ ID NO: 103136 - DNA, 6006 bp, Homo sapiens
  Payload ID: 116
  Gene Symbol: AKAP9
  Gene Name: A kinase (PRKA) anchor protein 9
  ENST ID: ENST00000619023
  CDS Start-End: 185-5098
tgcggctgaggacgatccgccagtgagcgcggagactgcttccacttcgggcgggggagcgccggaccgaatcggctctctaggccgtggagcttgccgtcccacctccgtccaaatcgacctttcctttctatccccaaccacccctcaacccctgttttcccctgccttccttgcagaggccatggaggacgaggagagacagaagaagctggaggccggcaaagccaaggtaggagagcttattttcttttttcttgcccagtttcgacaaagaaaagctcagtcggatgggcagagtccttccaagaagcagaaaaaaaagagaaaaacgtcaagcagtaaacatgatgtgtcagcacaccatgatttgaatattgatcaatcacagtgtaatgaaatgtacataaatagttctcagagagtagaatcaactgtgattcctgaatctacaataatgagaactctacatagtggagaaataaccagtcatgagcagggcttctctgtggaactggaaagtgaaatttcaaccacagcagatgactgcagttcagaggtaaatggttgcagttttgtgatgagaacaggaaagcctacaaatttattaagggaagaagaatttggtgttgatgattcttattctgaacaaggagcacaagacagtccgactcatctagagatgatggaaagtgagttggctgggaagcagcatgagattgaagagctaaacagagagctggaagaaatgagggttacctatgggactgaaggactgcagcagttacaagaatttgaagctgccattaaacaaagagatggcattataacccagctcactgctaatttacaacaagcaagaagagaaaaggatgagacaatgagagaatttttagagttgacagaacagagtcaaaaattacagattcaatttcagcaattacaggctagtgaaactctgagaaacagcactcatagtagcacagctgcagacttactacaagccaaacaacagatcctcactcatcaacagcagcttgaagaacaagaccacttattagaagattatcagaaaaagaaagaagacttcacaatgcaaattagtttcttgcaagagaaaattaaagtatatgaaatggaacaagataaaaaagtagaaaactcaaataaagaagaaatacaggaaaaggagacaatcattgaagaattaaacacaaaaataatagaagaagaaaagaaaactcttgagctaaaggataaattaacaactgctgataaattactaggagaattacaagaacagattgtgcaaaagaaccaagaaataaaaaacatgaaattagagctgactaattctaagcaaaaagaaagacagtcttctgaagaaataaaacagttaatggggacagtcgaagaacttcagaagagaaatcataaagacagccagttcgaaactgatatagtacaacgaatggaacaagaaacacaaagaaagttagaacaactccgggcagagctggatgagatgtatgggcagcagatagtgcaaatgaaacaagaattaataagacaacacatggcacagatggaggaaatgaaaacacggcataagggagaaatggagaatgctttaaggtcatattcaaatattacagttaatgaagatcagataaagttaatgaatgtggcaataaatgaactgaatataaaattgcaagatactaactctcaaaaggaaaaactcaaggaagaactaggactaattttagaagaaaagtgtgctctacagagacagcttgaagaccttgttgaagaattgagcttttcaagggaacagattcagagagctagacagacaatagctgaacaagaaagtaaacttaatgaagcacataagtcccttagtacagtggaagatttgaaagctgagattgtttctgcatctgaatccagaaaggaactagaattaaaacatgaagcagaagttacaaattacaagataaaacttgaaatgttagaaaaagaaaagaatgctgtgttagacagaatggctgaatcacaagaagctgaattagagaggctgagaacacagcttctatttagtcacgaagaagagctttccaaactgaaggaagatttagaaattgaacatcgaataaatattgaaaaacttaaagataatttaggcattcactataaacagcagatagatggtttacagaatgaaatgagtcaaaagatagaaaccatgcagtttgaaaaggacaatttgataactaagcagaatcaattaattttggaaatttcaaagctaaaagatttacagcagtctcttgtaaattcaaagtcagaagaaatgactcttcaaatcaatgaacttcaaaaagaaattgaaatactcagacaagaagaaaaagaaaagggtacacttgaacaagaagttcaagaattacaacttaaaacagaattgttagaaaaacagatgaaggaaaaagagaatgatcttcaagaaaaatttgcacaacttgaagcagagaatagcattcttaaagatgaaaagaaaacccttgaagacatgttgaaaatacatactcctgttagccaagaagaaagattgattttcttagactccattaagtccaaatccaaagactctgtgtgggaaaaagaaatagaaatacttatagaggaaaatgaggacctcaaacaacaatgtattcagctaaatgaagagattgaaaagcaaaggaacactttttcatttgctgaaaaaaactttgaagttaactatcaagagttacaagaggagtatgcttgccttctcaaagtaaaagatgatttagaagacagtaaaaataaacaggaattagagtataaaagtaaacttaaagcacttaatgaagagcttcatttgcaaagaataaatccaactacagtgaaaatgaaaagttctgtctttgatgaagacaaaacttttgtagcagaaacattggaaatgggtgaggttgttgaaaaggatacaacagaactcatggaaaaacttgaggtaaccaagcgagagaaattagagctgtcacagagactgtctgatctttctgaacaattgaaacagaaacatggtgagattagttttctaaatgaagaagttaaatctttaaagcaagagaaagaacaagtttcattgagatgtagagagctagaaatcattattaaccacaacagggcagaaaatgtacagtcatgtgatactcaagtaagctctttattagatggagttgtgaccatgacaagcaggggtgctgaaggatcagtttctaaagtaaataaaagttttggtgaagaatcaaaaataatggtggaagataaagtttcttttgaaaatatgactgttggagaagaaagtaagcaagaacagttgattttggatcacttaccatctgtaacaaaggaatcatcacttagagcaactcaaccaagtgaaaatgataaacttcagaaagaactcaatgtacttaaatcagaacagaatgatttaaggctacagatggaagcccaacgcatttgcctctctctggtttattcaactcatgtggatcaggttcgtgaatatatggaaaatgaaaaagataaagctctttgcagtcttaaagaagagcttatttttgctcaagaggaaaagatcaaggaacttcagaaaatacaccagttagaactacagactatgaaaacacaagaaacaggtgatgaaggaaagcctttacatctgctcattggaaaacttcaaaaggcagtgtctgaagaatgttcttattttttacagactttatgcagtgtccttggtgaatattatactcctgctttaaaatgtgaagtaaatgcagaagacaaagagaattctggtgattacatttctgaaaatgaagatccagaattacaagattatagatatgaagttcaagactttcaagaaaatatgcacactcttctcaacaaagtaacagaagaatacaacaaactcttggtacttcaaacacgactaagcaagatctggggacagcagacagatggtatgaaacttgaatttggagaagaaaaccttccaaaagaggaaacagagtttttatcaatccattctcagatgaccaatttggaagacattgatgtcaatcataaaagcaagttatcttctctgcaagatcttgaaaaaactaaacttgaagaacaagttcaagaattagaaagcctcatatcctctttgcagcaacagttgaaagaaactgaacaaaactatgaggcagagatccactgtttacagaagaggcttcaagctgttagtgagtccacggttccgccaagcttacctgttgattcggtggtaattacagaatctgatgcacagagaacaatgtaccctggaagttgtgtgaaaaagaatattgatggtacaatagagttttctggtgaatttggagtgaaagaggaaacaaatatcgttaagttgcttgaaaaacaataccaagaacaattagaagaagaagtagctaaggttattgtgtcaatgagtatagcatttgctcaacaaactgaactgtctagaatatctgggggaaaagaaaatactgcatcatcaaagcaagcacatgctgtgtgtcagcaagaacaacattattttaatgaaatgaaattatcacaggatcaaattggttttcagacttttgagacagtggatgtgaaatttaaagaagaatttaaaccacttagtaaagagttaggagaacatggaaaggaaattttattatcaaatagtgatccccatgatataccagaatcaaaggactgtgtgctgactatttcagaagaaatgttctccaaagataaaacatttatagttagacagtctattcatgatgagatttcagtgtcaagcatggatgcttctagacaactaatgttgaatgaagaacagttggaagatatgagacaggaacttgtacgacaataccaagaacatcaacaggcaacggaattgttaaggcaagcacatatgcggcaaatggagagacagcgagaagaccaggaacagacaagaagagattaagagacttaatagacaattagcccaggtaagggtcttgtagtcccctttctctccccagttatttttttttccaaacaccaacttgaaccagatccccaattaaaacaacagtattttttatgtagccataatttttttttttttttgccgaaatctgaataaactacatatatttagcatcaggaacacactctatactaagacagcagctttagatcttgttagggacacctatctcaaccttggagtgggcattgtctttctgtcattttatttaactcctttttcaagcactggaaaagtggctacacggttttgtttttttcttttaaatcattccattagccatatatagcaaactcactttgacattttggaaataacattgtgctgaggtgctccattatgcagttactatcattcagttttactatcttcatttatagttttgtgagtccaccaattagcatctcgaaggtttacctttatctgtctttaatccatctttttaatcatgaatggaaatcggaagtagtatgcttctgaaactctttccagggaaacatctcttcttgatttgagaaatgcaaatttatttaacattcttatccctttcttgactaaatttaaatacttcttggtatttgggagctggattcttgtcaactgctgtataaaatatactcacaaaaccattgcagaaaagcaagaaatatttatgtagaagttcttatgaaaacttattgaatttaattttgaaaactgaagctaagagagataataaatatctagagataactattaacagtattctttcaaacataaaataataagataattgggagctgagcataaaacattatttggaaaaattaactttgcttttcttcattgcattttgtgaattc

SEQ ID NO: 103137 - DNA, 1247 bp, Homo sapiens
  Payload ID: 117
  Gene Symbol: AKIP1
  Gene Name: A kinase (PRKA) interacting protein 1
  Uniprot ID: Q9NQ31
  ENST ID: ENST00000299576
  CDS Start-End: 92-643
gctgcgccggcgccgccgggagcgctaggcctggtccctcttcctagaatagcgttgcgcgcatgcgccttgacgagtgagccggggagccatggacaactgtttggcggccgcagcgctgaatggggtggaccgacgttccctgcagcgttcagcaaggctggctctagaagtgctggagagggccaagaggagggcggtggactggcatgccctggagcgtcccaaaggctgcatgggggtccttgcccgggaggcgccccacctagagaaacagccggcagccggcccgcagcgcgttctcccgggagagaaatattattcatctgtgccagaggaaggaggggcaacccatgtctatcgttatcacagaggcgagtcgaagctgcacatgtgcttggacatagggaatggtcagagaaaagacagaaaaaagacatcccttggtcctggaggcagctatcaaatatcagagcatgctccagaggcatcccagcctgctgagaacatctctaaggacctctacatagaagtatatccagggacctattctgtcactgtgggctcaaatgacttaaccaagaagactcatgtggtagcagttgattctggacaaagcgtggacctggtcttccctgtgtgatgttgaccatcactgccatcacatcacctttttttaagtagtaagaataaagccactgtatgattctcttaatagctatacattaatcctgtttttagtgctgactgggtcagccttccgggaactggagtctgtctctttcagtgcttttttgtttgtttggttggtttttttttgagacagtctcactctgttgcccaggctggagtgcagtggcgtgatctcggctcactgcaagttccgcctcccgggttcacaccattctcctgcctcagcctcccgagtagctggcactacaggcacccgccaccatgcccggctattttttttgtatttttagtagagacggggtttcaccatgttggccaggatggtctcgatctcttgacctcgtgatccacccaccttggcctcccaaagtgttgggattacaggcgtgagccaccgcgcccggcctcagtgccttttttaacttgagggtgtagaggtcctccacgcttgtttgcctgaaagtaatataatgatgctgtctgaacaggttttactgcttgctttccaagtaaaggttaattatgataataaagagatttggaaatgaagagaa

SEQ ID NO: 103138 - DNA, 1327 bp, Homo sapiens
  Payload ID: 117
  Gene Symbol: AKIP1
  Gene Name: A kinase (PRKA) interacting protein 1
  Uniprot ID: Q9NQ31
  ENST ID: ENST00000309377
  CDS Start-End: 91-723
ctgcgccggcgccgccgggagcgctaggcctggtccctcttcctagaatagcgttgcgcgcatgcgccttgacgagtgagccggggagccatggacaactgtttggcggccgcagcgctgaatggggtggaccgacgttccctgcagcgttcagcaaggctggctctagaagtgctggagagggccaagaggagggcggtggactggcatgccctggagcgtcccaaaggctgcatgggggtccttgcccgggaggcgccccacctagagaaacagccggcagccggcccgcagcgcgttctcccgggagagagagaagagagacccccaacccttagtgcttccttcagaacaatggctgaattcatggactatacttcaagtcagtgtgggaaatattattcatctgtgccagaggaaggaggggcaacccatgtctatcgttatcacagaggcgagtcgaagctgcacatgtgcttggacatagggaatggtcagagaaaagacagaaaaaagacatcccttggtcctggaggcagctatcaaatatcagagcatgctccagaggcatcccagcctgctgagaacatctctaaggacctctacatagaagtatatccagggacctattctgtcactgtgggctcaaatgacttaaccaagaagactcatgtggtagcagttgattctggacaaagcgtggacctggtcttccctgtgtgatgttgaccatcactgccatcacatcacctttttttaagtagtaagaataaagccactgtatgattctcttaatagctatacattaatcctgtttttagtgctgactgggtcagccttccgggaactggagtctgtctctttcagtgcttttttgtttgtttggttggtttttttttgagacagtctcactctgttgcccaggctggagtgcagtggcgtgatctcggctcactgcaagttccgcctcccgggttcacaccattctcctgcctcagcctcccgagtagctggcactacaggcacccgccaccatgcccggctattttttttgtatttttagtagagacggggtttcaccatgttggccaggatggtctcgatctcttgacctcgtgatccacccaccttggcctcccaaagtgttgggattacaggcgtgagccaccgcgcccggcctcagtgccttttttaacttgagggtgtagaggtcctccacgcttgtttgcctgaaagtaatataatgatgctgtctgaacaggttttactgcttgctttccaagtaaaggttaattatgataataaagagatttggaaatgaagagaa

SEQ ID NO: 103139 - DNA, 1232 bp, Homo sapiens
  Payload ID: 117
  Gene Symbol: AKIP1
  Gene Name: A kinase (PRKA) interacting protein 1
  Uniprot ID: Q9NQ31
  ENST ID: ENST00000309357
  CDS Start-End: 77-628
ccgggagcgctaggcctggtccctcttcctagaatagcgttgcgcgcatgcgccttgacgagtgagccggggagccatggacaactgtttggcggccgcagcgctgaatggggtggaccgacgttccctgcagcgttcagcaaggctggctctagaagtgctggagagggccaagaggagggcggtggactggcatgccctggagcgtcccaaaggctgcatgggggtccttgcccgggaggcgccccacctagagaaacagccggcagccggcccgcagcgcgttctcccgggagagagagaagagagacccccaacccttagtgcttccttcagaacaatggctgaattcatggactatacttcaagtcagtgtgggaaatattattcatctgtgccagaggaaggaggggcaacccatgtctatcgttatcacagaggcgagtcgaagctgcacatgtgcttggacatagggaatggtcaggctgagaacatctctaaggacctctacatagaagtatatccagggacctattctgtcactgtgggctcaaatgacttaaccaagaagactcatgtggtagcagttgattctggacaaagcgtggacctggtcttccctgtgtgatgttgaccatcactgccatcacatcacctttttttaagtagtaagaataaagccactgtatgattctcttaatagctatacattaatcctgtttttagtgctgactgggtcagccttccgggaactggagtctgtctctttcagtgcttttttgtttgtttggttggtttttttttgagacagtctcactctgttgcccaggctggagtgcagtggcgtgatctcggctcactgcaagttccgcctcccgggttcacaccattctcctgcctcagcctcccgagtagctggcactacaggcacccgccaccatgcccggctattttttttgtatttttagtagagacggggtttcaccatgttggccaggatggtctcgatctcttgacctcgtgatccacccaccttggcctcccaaagtgttgggattacaggcgtgagccaccgcgcccggcctcagtgccttttttaacttgagggtgtagaggtcctccacgcttgtttgcctgaaagtaatataatgatgctgtctgaacaggttttactgcttgctttccaagtaaaggttaattatgataataaagagatttggaaatgaagagaa

SEQ ID NO: 103140 - DNA, 1084 bp, Homo sapiens
  Payload ID: 117
  Gene Symbol: AKIP1
  Gene Name: A kinase (PRKA) interacting protein 1
  Uniprot ID: Q9NQ31
  ENST ID: ENST00000396648
  CDS Start-End: 113-664
cggtggtctccagggaggtcgaggctggggctcccacccggatttggagcagggtcgccgcggcccagctgacccgccggcgtttgtacgttgtgtgcccactcagggagccatggacaactgtttggcggccgcagcgctgaatggggtggaccgacgttccctgcagcgttcagcaaggctggctctagaagtgctggagagggccaagaggagggcggtggactggcatgccctggagcgtcccaaaggctgcatgggggtccttgcccgggaggcgccccacctagagaaacagccggcagccggcccgcagcgcgttctcccgggagagaaatattattcatctgtgccagaggaaggaggggcaacccatgtctatcgttatcacagaggcgagtcgaagctgcacatgtgcttggacatagggaatggtcagagaaaagacagaaaaaagacatcccttggtcctggaggcagctatcaaatatcagagcatgctccagaggcatcccagcctgctgagaacatctctaaggacctctacatagaagtatatccagggacctattctgtcactgtgggctcaaatgacttaaccaagaagactcatgtggtagcagttgattctggacaaagcgtggacctggtcttccctgtgtgatgttgaccatcactgccatcacatcacctttttttaagtagtaagaataaagccactgtatgattctcttaatagctatacattaatcctgtttttagtgctgactgggtcagccttccgggaactggagtctgtctctttcagtgcttttttgtttgtttggttggtttttttttgagacagtctcactctgttgcccaggctggagtgcagtggcgtgatctcggctcactgcaagttccgcctcccgggttcacaccattctcctgcctcagcctcccgagtagctggcactacaggcacccgccaccatgcccggctattttttttgtatttttagtagagacggggtttcaccatgttggccaggatggtctcgatctcttgacctcgtgatccacccaccttggcctcccaaag

SEQ ID NO: 103141 - DNA, 1022 bp, Homo sapiens
  Payload ID: 117
  Gene Symbol: AKIP1
  Gene Name: A kinase (PRKA) interacting protein 1
  Uniprot ID: Q9NQ31
  ENST ID: ENST00000534147
  CDS Start-End: 8-640
gggagccatggacaactgtttggcggccgcagcgctgaatggggtggaccgacgttccctgcagcgttcagcaaggctggctctagaagtgctggagagggccaagaggagggcggtggactggcatgccctggagcgtcccaaaggctgcatgggggtccttgcccgggaggcgccccacctagagaaacagccggcagccggcccgcagcgcgttctcccgggagagagagaagagagacccccaacccttagtgcttccttcagaacaatggctgaattcatggactatacttcaagtcagtgtgggaaatattattcatctgtgccagaggaaggaggggcaacccatgtctatcgttatcacagaggcgagtcgaagctgcacatgtgcttggacatagggaatggtcagagaaaagacagaaaaaagacatcccttggtcctggaggcagctatcaaatatcagagcatgctccagaggcatcccagcctgctgagaacatctctaaggacctctacatagaagtatatccagggacctattctgtcactgtgggctcaaatgacttaaccaagaagactcatgtggtagcagttgattctggacaaagcgtggacctggtcttccctgtgtgatgttgaccatcactgccatcacatcacctttttttaagtagtaagaataaagccactgtatgattctcttaatagctatacattaatcctgtttttagtgctgactgggtcagccttccgggaactggagtctgtctctttcagtgcttttttgtttgtttggttggtttttttttgagacagtctcactctgttgcccaggctggagtgcagtggcgtgatctcggctcactgcaagttccgcctcccgggttcacaccattctcctgcctcagcctcccgagtagctggcactacaggcacccgccaccatgcccggctattttttttgtatttttagtagagacggggtttcaccatgttggccaggatggtctcgatc

SEQ ID NO: 103142 - DNA, 513 bp, Homo sapiens
  Payload ID: 117
  Gene Symbol: AKIP1
  Gene Name: A kinase (PRKA) interacting protein 1
  ENST ID: ENST00000529942
  CDS Start-End: 1-456
gcggccgcagcgctgaatggggtggaccgacgttccctgcagcgttcagcaaggctggctctagaagtgctggagagggccaagaggagggcggtggactggcatgccctggagcgtcccaaaggctgcatgggggtccttgcccgggaggcgccccacctagagaaacagccggcagccggcccgcagcgcgttctcccgggagagaaatattattcatctgtgccagaggaaggaggggcaacccatgtctatcgttatcacagaggcgagtcgaagctgcacatgtgcttggacatagggaatggtcaggctgagaacatctctaaggacctctacatagaagtatatccagggacctattctgtcactgtgggctcaaatgacttaaccaagaagactcatgtggtagcagttgattctggacaaagcgtggacctggtcttccctgtgtgatgttgaccatcactgccatcacatcacctttttttaagtagtaagaataaagccact

SEQ ID NO: 103143 - DNA, 1128 bp, Homo sapiens
  Payload ID: 117
  Gene Symbol: AKIP1
  Gene Name: A kinase (PRKA) interacting protein 1
  ENST ID: ENST00000525005
  CDS Start-End: 259-846
gttgcgcgcatgcgccttgacgagtgagccgggtgagggggctccctaagtagcggaaggggtagatgaaaatggaaggggcgggcgcgctaggcctagtcctggctgggctcccgctggagtgtgcgttgggggcggaccaggagcggtggtctccagggaggtcgaggctggggctcccacccggatttggagcagggtcgccgcggcccagctgacccgccggcgtttgtacgttgtgtgcccactcagggagccatggacaactgtttggcggccgcagcgctgaatggggtggaccgacgttccctgcagcgttcagcaaggctggctctagaagtgctggagagggccaagaggagggcggtggactggcatgccctggagcgtcccaaaggctgcatgggggtccttgcccgggaggcgccccacctagagaaacagccggcagccggcccgcagcgcgttctcccgggagagagagaagagagacccccaacccttagtgcttccttcagaacaatggctgaattcatggactatacttcaagtcagtgtgggaaatattattcatctgtgccagaggaaggaggggcaacccatgtctatcgttatcacagaggcgagtcgaagctgcacatgtgcttggacatagggaatggtcagagaaaagacagaaaaaagacatcccttggtcctggaggcagctatcaaatatcagagcatgctccagaggcatcccagcctgtgagtacggaactgcttacgcactgggtttcaccaccgttgcaactccatgaaccagttgacatggttcttagagggctatttgaattgagtctatagtatttttaagttgagatgttcttacacttaagaagggcacacaagattttggttcagtgtaaaattaggttttcttggtattcttccttcactctaagcttcagggatactctttgtgcctgaactcatagttgtggttggaaagaatgtgaagtattcacctctcagttcctacagctcagctgggctggcactgggtcctgctggaattccaccatctgttcaagcagcaggaggggcacgatcctcctgctaacaaagtgaaaaccattgctgaaattc

SEQ ID NO: 103144 - DNA, 1421 bp, Homo sapiens
  Payload ID: 117
  Gene Symbol: AKIP1
  Gene Name: A kinase (PRKA) interacting protein 1
  ENST ID: ENST00000529876
  CDS Start-End: 262-768
agcgttgcgcgcatgcgccttgacgagtgagccgggtgagggggctccctaagtagcggaaggggtagatgaaaatggaaggggcgggcgcgctaggcctagtcctggctgggctcccgctggagtgtgcgttgggggcggaccaggagcggtggtctccagggaggtcgaggctggggctcccacccggatttggagcagggtcgccgcggcccagctgacccgccggcgtttgtacgttgtgtgcccactcagggagccatggacaactgtttggcggccgcagcgctgaatggggtggaccgacgttccctgcagcgttcagcaaggctggctctagaagtgctggagagggccaagaggagggcggtggactggcatgccctggagcgtcccaaaggctgcatgggggtccttgcccgggaggcgccccacctagagaaacagccggcagccggcccgcagcgcgttctcccgggagagaaatattattcatctgtgccagaggaaggaggggcaacccatgtctatcgttatcacagaggcgagtcgaagctgcacatgtgcttggacatagggaatggtcagagaaaagacagaaaaaagacatcccttggtcctggaggcagctatcaaatatcagagcatgctccagaggcatcccagcctgtgagtacggaactgcttacgcactgggtttcaccaccgttgcaactccatgaaccagttgacatggttcttagagggctatttgaattgagtctatagtatttttaagttgagatgttcttacacttaagaagggcacacaagattttggttcagtgtaaaattaggttttcttggtattcttccttcactctaagcttcagggatactctttgtgcctgaactcatagttgtggttggaaagaatgtgaagtattcacctctcagttcctacagctcagctgggctggcactgggtcctgctggaattccaccatctgttcaagcagcaggaggggcacgatcctcctgctaacaaagtgaaaaccattgctgaaattccgaaacatacacatttggtgagatcaggttccaaaacatttgaaggcatttgttcttattttccacaaatgtttctctgtaaaaacatataatgagtttttcatttttaggataaagtactcattaggtcatgaagccaggggatcctttttggaacttggaagggctagaattctgaggaaaggaacttcattcagcatggtgccgcaatacatttactttttgtttgtatacggtttgctacgagtcaggatttggagtatactagagttagtgacaattaagaatattctgcttctagtacaaatataagttgttaaggcttagacgcctctcaacacttgctgacttttggtaatgctgatgttcca

SEQ ID NO: 103145 - DNA, 569 bp, Homo sapiens
  Payload ID: 117
  Gene Symbol: AKIP1
  Gene Name: A kinase (PRKA) interacting protein 1
  ENST ID: ENST00000524577
  CDS Start-End: 32-569
gcatgcgccttgacgagtgagccggggagccatggacaactgtttggcggccgcagcgctgaatggggtggaccgacgttccctgcagcgttcagcaaggctggctctagaagtgctggagagggccaagaggagggcggtggactggcatgccctggagcgtcccaaaggctgcatgggggtccttgcccgggaggcgccccacctagagaaacagccggcagccggcccgcagcgcgttctcccgggagagagagaagagagacccccaacccttagtgcttccttcagaacaatggctgaattcatggactatacttcaagtcagtgtgggaaatattattcatctgtgccagaggaaggaggggcaacccatgtctatcgttatcacagaggcgagtcgaagctgcacatgtgcttggacatagggaatggtcagagaaaagacagaaaaaagacatcccttggtcctggaggcagctatcaaatatcagagcatgctccagaggcatcccagcctgtgagtacggaactgcttacgcactgggtttcaccaccgttgcaactcc

SEQ ID NO: 103146 - DNA, 576 bp, Homo sapiens
  Payload ID: 117
  Gene Symbol: AKIP1
  Gene Name: A kinase (PRKA) interacting protein 1
  ENST ID: ENST00000534506
  CDS Start-End: 32-538
gcatgcgccttgacgagtgagccggggagccatggacaactgtttggcggccgcagcgctgaatggggtggaccgacgttccctgcagcgttcagcaaggctggctctagaagtgctggagagggccaagaggagggcggtggactggcatgccctggagcgtcccaaaggctgcatgggggtccttgcccgggaggcgccccacctagagaaacagccggcagccggcccgcagcgcgttctcccgggagagaaatattattcatctgtgccagaggaaggaggggcaacccatgtctatcgttatcacagaggcgagtcgaagctgcacatgtgcttggacatagggaatggtcagagaaaagacagaaaaaagacatcccttggtcctggaggcagctatcaaatatcagagcatgctccagaggcatcccagcctgtgagtacggaactgcttacgcactgggtttcaccaccgttgcaactccatgaaccagttgacatggttcttagagggctatttgaattgagtctatagtatttttaagttgagatgttcttacacttaagaagggc

SEQ ID NO: 103147 - DNA, 469 bp, Homo sapiens
  Payload ID: 117
  Gene Symbol: AKIP1
  Gene Name: A kinase (PRKA) interacting protein 1
  ENST ID: ENST00000530281
  CDS Start-End: 167-469
tagtcctggctgggctcccgctggagtgtgcgttgggggcggaccaggagcggtggtctccagggaggcgccccacctagagaaacagccggcagccggcccgcagcgcgttctcccgggagagagagaagagagacccccaacccttagtgcttccttcagaacaatggctgaattcatggactatacttcaagtcagtgtgggaaatattattcatctgtgccagaggaaggaggggcaacccatgtctatcgttatcacagaggcgagtcgaagctgcacatgtgcttggacatagggaatggtcagagaaaagacagaaaaaagacatcccttggtcctggaggcagctatcaaatatcagagcatgctccagaggcatcccagcctgctgagaacatctctaaggacctctacatagaagtatatccagggacctattctgtcactgtgggctcaaatgactta

SEQ ID NO: 103148 - DNA, 2430 bp, Homo sapiens
  Payload ID: 118
  Gene Symbol: AAR2
  Gene Name: AAR2 splicing factor homolog
  Uniprot ID: Q9Y312
  ENST ID: ENST00000320849
  CDS Start-End: 88-1242
ccggtgcgtttccgctgtaccggaacgtggggcgaggcgctgttcatcaaagaaaaagggttcttttggtcacccaccactggccccatggctgccgtgcagatggatcctgagctagccaagcgcctcttctttgaaggggccactgtggtcatcctgaacatgcccaagggaacagagtttgggattgactataactcctgggaggtcgggcccaagttccggggcgtgaagatgatccctccaggcatccacttcctccactacagctctgtggacaaggctaatccgaaggaagtaggccctcgtatgggtttcttccttagcctgcaccagcgggggctgacagtgctgcgctggagcacactcagggaagaggtagacctgtccccagccccagagtctgaggtggaggccatgagggccaacctccaggagctggaccagttcctggggccttacccatatgccaccctgaagaagtggatctcactcaccaacttcatcagcgaagccacagtggagaagctacagcccgagaatcgacagatctgtgccttttccgatgtgctacctgtgctctccatgaagcacaccaaggaccgcgtggggcagaatctaccccgctgtggcattgagtgcaaaagctaccaagagggcctggcccggctaccagagatgaagcccagagccgggacagagatccgcttctcagagctgcccacgcagatgttcccagagggtgccacgccagctgagataaccaagcacagcatggacctgagctatgccctggagactgtgctcaacaagcagttccccagcagcccccaggatgtgcttggtgaactccagtttgcttttgtgtgcttcctgctggggaatgtgtacgaggcatttgagcattggaagcggctcctgaacctcctgtgccggtcagaagcagccatgatgaagcaccacaccctctacatcaacctcatctccatcctgtaccaccagcttggtgagatccccgctgacttcttcgtagacattgtctcccaagacaacttcctcaccagcaccttacaggttttcttttcctctgcctgcagcattgccgtggatgccaccctgagaaagaaagctgaaaagttccaagctcacctgaccaagaagttccggtgggactttgctgcggaacctgaggactgtgccccggtggtggtggagctccctgagggcatcgagatgggctaactcggggagcgctctcagctgcgaggggccccttcccacagggctgcagtcctggcctctccatttacttcttcccatcctgggacctgccagggcagcaatctctccaggtcctgcaaagatggagccagaattccctttttcactgataaatatatttcttcattgccaaagaggctgtacccatcctgaaggcacatttgtgggttccccatcagccaggccttggtgctaacctggctgaatttcacacaggctcttacacacacacgctcctaggagacatctgcctacacggcaaccatatttcctctgaatgagaaggaattgaaccaaaagtccaagaaagaactgattgcttgttccataggagcttaggaaacaagaaaccctggattgcccagggggtctgagaagttggttggtgactttttttgcggttaaatgaagggtgatggggagatcagcccgaattgccgcctgcctcttgctaaataggagcagaggacttggcctgcagctccttgggagcccttgattgggaagagagtttcaagggaggcagctggattcaatctagcaggtggtcagcttcagctttctccatcgaaatcccattctcctgtccagaggcccagtgggtcatctcccaaggtgggtgtggaccctggcctcagaggccttgctggtgctgtcacctcccacctgttccattccgaggcctcacccagaagtgggaccctccccttcctcaccagagccaccgtgactgtttctgatgacctggagagtcaacaacaaccagaaaggtttctgcccagagcaggcttcttaaggcctttacgaagttttgtgccttccaagtgctgaagaagacctggtcagcctaaatcttcccagtcccgctgtggagctgtcagtcaccggagtaatgagctcctggttcctcgggagtccttcgtgctgtgtggcagggttcctctctagacaagtacacaggccctgccaccctgacatcaaactgttgtactatgatcacagtccctgtgccatccttttccaagactggggctcacaccatgtttttgaatgagaatccctgctggttgagacttttgcttccacttgtttccttggagatgtttttccaagagcataatgtacattaaagtcttcgagttgagacaa
